United States Patent 7,314,974 (EXPRESSION OF MICROBIAL PROTEINS IN PLANTS FOR PRODUCTION OF PLANTS WITH IMPROVED PROPERTIES) - sequence listing, part 15

SEQ ID NO: 42972 - DNA, 2071 bp, Myxococcus xanthus
accacgctcaagagcgaaagcctcgaaccccaccggatgcatgcggtggggaaggtcctcaccacggaccagggcattcccatctcggacacggacaactcgctgaaggccggcatccgcggccccacgctcctggaggacttccacttccgggagaagatgatgcgcttcgaccacgagcgcatcccggagcgcgccgtccacgcgcggggcgcgggcgcccacggttacttccaggtctacaagtcgctggagaagtacacccaggcccgcttcctcaccgacccatccctgcgcacgccggtgttcgtgcgcttctccaccgtgggcggctcacgtggctcggcggacaccgtgcgtgacgtgcgcggcttcgccaccaagttctatacggaggaaggcaacttcgacctggtgggcaacaacatgcccgtcttcttcatccaggacggcatcaagttcccggacttcgtccacgcggtcaaacccgagccgcacaacgaaatcccccaggcatcctcggcgcatgactcgctctgggacttcgtctcgctcgtccccgagacgacgcacatgatcatgtggctgatgtccgaccgcgccattccgcgcagcttccggatgatggagggcttcggcgtccacaccttccggctggtcaacgcggccggcaaggcgaacctggtcaagttccactggaagccgctactgggcaaccactcgctcgtgtgggacgaggcccagaagctgtccggcaaggacccggacttccaccgccgcgacctctgggagtccatcgagcgcggtgacttccccgagtacgagctggggctgcaaatcatccccgaaggcgacgagctcaagtacggcttcgacctgctggacgccaccaagctgctccccgaggagctggcgccggtgcagcgcgtgggcaagctgacgctcaaccgcaacccggacaacttcttcgcggagacggagcaggtggccttctgcgtggccaacgtcgtccccggcatcgacttcaccaatgacccgctgatgcaggcgcggctcttctcgtacctggacacgcagctcacgcggctgggcgggcccaacttcgcggagctgcccatcaacaagccggtgtgccccgtcaccaaccaccagcaggacggcttcgggcggcagaccattcccacgtcgcgcgccaactaccaccccaactccctgggcggcggctgcccggtgctggcgaaccccgcgagcgcctttcgccacacccaggagcgcgtggagggccacaagattcgcgcgcgcagcggcagcttcagcgaccacttcagccaggccaccctcttctacaagagcctgtcgaggccggagcaggagcacctcgtggccgcgctcgagttcgaggttggcaaggtggagcgcgtggagattcgcgagcgcgtggtgaaccagattctggtgaacgttgacccggagctggccgtgcgcgtggcgcgcgccgtgggcgtcacgccgccgaaagcgaccaggccccccaagccgtccaaggccgcgggcaagaaggcggcaccctcggtggaagtgtccccggcgctgagcatggagaactcgccgcatgactccatccggacgcggaagatcgcggccctggtatcggacgggttcgccggcaaggagctggacggcgtgcgcaaggtgctggaggagcgcggcgcgacgctggagctggtgggccccacgctgagcccggtgacgagccaggaaggccgggaggagcggcccctgcggaccttctccacggcgtcttccgtcatgtacgacgccgtctacgtgcccggtggagagaagagcgtcgcggccctgctgcgcgtgccgctggcggtggacttcgtgcgcgaggcctacgtgcactgcaaggcgctggcgctctccgcggacgccaacaccctgctggacgccgcgggcgtgcgcgacctggaggcgccgccgagcaagggcctggacgccacgcgcggcgtcgtccgcagcgcgaaggtggagacgaagggcttcggccagctcttcaccgagtcca

SEQ ID NO: 42973 - DNA, 951 bp, Myxococcus xanthus
cgggcattcgtcaccggtggttcaggcttcgtgggcaggcacctcctcaccgcactgaaggtgcgcgggacgcccgctcgggccctggcgcgctccgccgcggcacgggcctcggtgacggaggccggcggggagcccttcgagggcgacctgtcggacgtggagaagctgaaggcgggcatggagggctgtgacaccgtcttccattgcgccgcggtggtgaagggctggggcgcgcgcagcgagttctacgagacgaacgtgcgcggcacggagcgggtgctggaggcggcgcgcgccgcgggcgtcaagcggctggtccacgtcagcacggaggcggtgctggcggatggctcgcccctggagcgggtggatgagacgatgcccctgcccgagcgccccatcggcgactatccctccaccaagggcgaggcggagcgccgggtgctcagcgtgaatgcgccggacttcgtcaccgtggtggtgcgtccccgcttcatctggggcgccggtgacacgtcactgctgccgcagttccaggaggcggtgcggaccgggcgcttccggtggttcggcggtggccgttacctgacgtccacctgccacgtggccaactgcgtggagggcatgctgctggcggcggagaagggccgtggcggcgaggcctatttcctcaccgacggggaacccgtggagttccggggcttcatcaccgccatgctcgcgacgcagggcgtggacgcgggcgagcgcaccctgccatacggcgtggccgcgacggtggcctcggtgggggacttgctgtggggcaccttcggcctgggcggcaggcctccgctcacccgcaccgaggtgctgctcatggggcgggaggtgacggtgcgggacgacaaggcccgccgggagctggggtatgagggccgccgctcccgtgaagaagggctccgcgag

SEQ ID NO: 42974 - DNA, 1008 bp, Myxococcus xanthus
ttgacgattggcgtggtgggcgcgacgggcgtggtgggccgcgaggtgctcgccgcgctgtacgcgcaggacgtgcccgctgaacaggtgcgcgtcttcggctccgagcgctccaagggcatggaggtggagtacggcgaggactcgctcgaggtggagcaggcgacgccggacgccttccggggtgtgaagctggtgctgctcgccacgcccgccgaggcctctcgcacgctggctccggccgcgcaggccgcgggcgcgtgggtggtggacgccagcagtgccttccgaggtgacggcaacgtccccatggtgctgccgggcttcaacacggatgtgctgggcgcgggcttcaccttcaagggccgcatcgtgtgcctgccgggggcggtgacgaccgccgcggtgcacgtggtggagccgctgcggaaggccttcggcgtggcgcgcgcgcaggtgacggcgctgatggcggcgtccagcgcgggtgtgcgcggtgtggcggagctggagaagcagacggcggacctgctgtcgggccgcgagccggagccgcacgcctttccccaccgcgtggggttcaacctggtgccccaggtgggcggcttcatggtgaattcgccctggacggaggaggagggcggctggacgctggaggcggcccggctcttctcgtccaagggggatgtgcccgtcatcgccgggacggcggtgcaggtgcctaccttctacggccatggcctcaccctcaacgtgcagctcaagaaggcgggcccggtggagcaggtgcgcgcggccctcaagacgtccggggccttgaaggtgctggatgtgcccggtgagcgtgtgtaccccatgcccatgctcgtcacgtccgacccggcggtccatgtgggccgggtgcgcgcattcccccaggcgccggagtgggtgacgctcttcgcctcggtggacaacgccagccggggcgccgccctcaacctggtggaagccggactccgcctggcc

SEQ ID NO: 42975 - DNA, 954 bp, Myxococcus xanthus
gttcgcggccttcgcaagcactacaaagtccataagcgcccgccgggcttgaaggcggccctccgctcgctcatccaccgtagctacaccacggtgaaggccgtggatgggatttccttcgacatccgccccggagagcgggtgggcttcctgggccccaatggcgccgggaagacgacgacgctcaaggtcctctccggcctgctctatccctccgacggcgaggtgacggtggacggccatgtcccgcagaagcgggaggaggccttcctcaagaaaatcatgctcgtcatggggcagaaacagcagctcctgtgggacctgcctccggcggagacgttcgaactcaaccgcgccatctacgacgtgccccaggcccagtacaagaagacgatttcggacctgattgagctcctggaaatcggggacctcatcggcaagcccacccgtcaactgtcgttgggggagcggatgaagtgcgagctggccgcggcgctcatccaccagccccgggtgctcttcctggacgagccgaccatcggcctggacgtggccatgcaggccaccatgcggacgttcatcaaggagtacaacgagaagtacggcgccacgctcatcctcaccagccactacatggatgacgtggcggcgctgtgcccccgcgtcatcgtcatcgacaagggcctcctgtcgtacgacggcggcctggacgcgctggtgcagcgggtgcggccggagaagcgcgtggtgctgcgcctgtcggaggaagtggacgccgggcgcctgtcgccgctgggtcgggtggtgacgcacgagcccggcaccgcggtgctccaggtccagcaggaggcggtcaacgccaccatcacccgcgcgctgtccacgttgccggtgatggacctcacggtggagaacgcgccgctggaagaggtgatgagcgaactgttcgcggag

SEQ ID NO: 42976 - DNA, 1278 bp, Myxococcus xanthus
cccgcgcccgacaccgtgccgccctccgccgccagcgccctgcgcgccactggcgtgagcaacagcagcgtgtcgctgtcctggggcgcgtccactgacaacgtgggcgtcaccggctacgaaatcttcgtcaacgggagcgcgtccgcgtccgcgaccacctcgggcgccaccagcgccacggtgacgggcctcgccgcgaacacgacctacgccttcaccgtgaaggcgcgggatgccgcgggcaaccgctcggcggcgagcaatagcgtctccgcgacgacgacggggacgcagcccgtggggaacaaaatcatcgtgggctactggcacaacttcgacaacggctcgacgaacatccggctgcgggacgtctccgcgaagttcaacgtcatccaggtcgccttcgccgagcccgtgggtggcccgggctccggacgcatggccttcacgccgtacaacgccagcgtcgcggacttcaaggcggacatcgccctgctcaagagccagggccgcaaggtgctcatctccattggcggcgcgaatggcaccgtccacctggatgacgccaccgcgcggcaggacttcgccaccaccatgcaggccctcatcgacacctacggcttcgacgggttggatttggacctggagggcagctcgctgtcactcaacggcggcgacaccgacttccgcaaccccaccacgccgcgaatcgtcaacatcatccaggccacgcgccagctcctcaaccagaacggcccgggcttcatcctcaccatggcgcccgagacggcctacgtccaaggcggcatggccgcgtacggcggtccctggggcgcgtacctgcccgtcatccacgcgctgcgagacagactggcgtacctgcacgtacagcattacaacaccggcaccgtcatggcgctcgacggcagggcctacgcgcagagcacgccggacttccacgtgtccatggcggagatgatgcttcaggggttccccgtcggcggcaacaccggcgtgatgttcccgtggctgcgcccggcacaggtactcatcggcctgccgtcgtcaccgcaggcggcgggcggcgggtacacgacgccggccaacgtgcacaaggcgctcgactacctgctcaagggacagtccttcggcggaacctacgtgctgcgcaaccccgccggctaccccggcttcaagggcctgatgacctggtccatcaactgggacgcgttcacgaacttcgagttctccaacagccatcgcgcgtacctggac

SEQ ID NO: 42977 - DNA, 285 bp, Myxococcus xanthus
aagcggctgctggacgcccgggcctccgtgcggctgctggatgtccgggaggcggacgaatacgccgggggccggctgccaggggccctccacattccaaggggttacctggagctgcgcatcgaaagccaggtccagcgtgacgaggagctggtcgtctactgcgccgggggcacccgctccgccctggccgccaagacactgaaggagctggggtacgagcgggtggcctccctggccggcggctacaaccggtggagtgacgccgccctgccagtggagaag

SEQ ID NO: 42978 - DNA, 834 bp, Myxococcus xanthus
acactcaaagggcatgatggtccggtcaatggctgcacggtgacacccagtgggtgggtggtgtcggcctcggacgacaagacgcttcgggtgtgggagttggaaacggggaaggaactggcacgaatggaaggccatgaaggttgggtgcgaagctgcgcagtaataccggatgggcgggtggtgtcggcttcggatgacaagacgcttcgggtgtgggagttggaaacggggaaggaactggcacggatggaaggccataagggcccagtctggggatgctcggtgactccggatggacggttggtgtcggcttcattcgacgagatgctcagggtgtgggaactaaagacgggaatcaaactggcgcagctggtgggccataaaggggcagtcaatggctgcgcggtgactgtggatgggcgggtggtgtcagcttcgtccgacgggacgcttcgggtgtgggagttggaaacagggaaggaactggcgcggatggagggccatgaagggccggtcaatggctgcgcggtgactgtggatgggcgggtcgtgtcagcttcgtccgacgggacgcttcgggtgtgggagttggaaacggcgaaagaactggcgcggatggagggtcatgaacagccggttaatggctgcgcggcggcagcacatggctgtgtcttgtccgcctgcaacgataagactcttagggtatgggagctggatacagggagagaggtagcacagctggaaggccatgagggcccagtcaagagctgtgctgtaacggaagatggatgggtggtatcggcatcggacgataaaacactaagagtatgg

SEQ ID NO: 42979 - DNA, 1419 bp, Myxococcus xanthus
ggcgactaccagtggggcgaggtggagcagcagtggcgcgccaaccgccaggacgagaactggcaggggcacggctggcaggacctcatcgtctacgaggttcacgccaagggcttcacggcggaccccgcaagcggtgtgcgcttcccgggtacctaccgcggcttcggtgagaaggcggcctacctggccgagctgggcatcaccgcggtggagctgctgcccatccacgagaagccgctggacggtggctactggggctaccagaccatcaacttcttcgcgcccgagctgtcctatgcggccttcaaggagccgcaccaggtcatcaacgagttcaagtggatggtggagcaactccacaagcacggcatcgaggtgattatcgacgtcgtctacaaccacaccggcgagggtggcctctggcgcgagaagctggagacggatgacgtcatgcccggcgagccgctggagtccctggaccccgcggagacggctggcctctattcgttccgcggcatcgacaaccaagcgtactacgcgctcaacccggacctccgcacgtattggaacaacactggcgtcggtaaccagacgcgccccaaccaccggcccacgcgcaagctcatcatcgacagcctgcgcttctacgtggaagagctccacgtggatggtttccgcttcgacctggcgcccatcctgggtgagcgggacggcgactacaaccgctgggatgacccgcgcaacaccgtgctccaggacgtcatcgacgacccggtgctccagaagtacaacacccgcatcatggccgagccgtggagcgcgggcggctggtactgcatgccgctgggcgagttccccaacgccaagacgcagccgggcaatggctggtacgagtggaacggccgcttccgcgactggtggcgcgcgttcatgaaccaggatggttggaagctcaactccaacgagggttcgctgtgcggccggcctggcaccgtggacggcggcttcctgatgtacggcagccaggagtggttcgagcgcaatggccgccgcccgtatcactccatgaacttcatcaccgtgcacgacggcttcaccatgtacgacctgttcgcgtacgacgagaagcagaaccgctgcggtccgctgaacccggtgtgctgtgacacaccgaacagtcccttctgcgacaaggtcagcggcgaggagcacaaccgttcccgcaactgggggccgattggcgacgagcgcgcggagagcatgcggcggcagatgattcgcaatgccttcatgtcgatgatgatcagccacggcacgccgatgatcctgggcggcgacgagtggatgcgcacgcagttggggaacaacaacgcctactccacgctgtccgacaaccccttcaactggtaccagtgg

SEQ ID NO: 42980 - DNA, 1228 bp, Myxococcus xanthus
gcggtctacttcgtgatggtggaccgcttctccaatggagacccgaagaacgacggtgcagtggacctggaggacgcgcaggcctttcacggcggagacctgcaaggcgtcattgaccgactggacgggctgcagcagctcggtgtccgcacggtgtggctttcacccgtcttccagatgcgcaccgacaagttccatgggtacggcgccttccacggtaactgggtggagggtttcggccgggtatagccgcgcttcgtacagtaggccctgttgaagactctgccgtggcagttgtgctgctgggacatgcgggtggttctgtacgtggtgctcaactcacgtggggccatggacgagcctgtcgcgtgagctgcctgattggttctacgccgtgggtcccatcaaggactggggcgattcacgccagttggtcatgggatatgtgcacggccttccggacctctctagtggagaaggaagatgtgtacgcgcacctgctggcgcattcgcgccggtgggtggacgtgctccagcccgcgggcttccggctggacgcggtgaagcacatgcccacctccttctgggctcgctacaacgcgacttgcgccagcacgcggggccggacttcctgctgttgggggagatgctggacggcgacccggtgctgctgtcgaacacgatgaaggaaggccgcttcgggacgatgttcgacttcccgctggccttcgcgctggtggacgtcttttgcagggaccgctccccgtcgcacctgggcgccatcctcttcaacgaccggctatacccggcgccgggctcgctcgtgacgatggtggacaaccacgacctgccccgggtgatgagcgagtgcggtggtgacgtggagcgggtgaagcgggcgctggcggtgcagctcaccgcgcgcggcgtgccggcgctcacctacggcaccgaggagggcctgacgggcgcgaaggagccggagaaccggggggatatgcgcttcacgaaccacccgctgcggtcgtggattggcgggttgctggcgttgcgtcgaggcagtgcggccctccagcgtggcgagacgatgattctcgccgcccgggaggacctctttgcctacgcccgcgtcaccgccgacgaggttgtcgtcatcgccgtgaatacccgtgacagcgccgtggacgtgccgctgcccgacgggctggccggcgcgaagctggagccg

SEQ ID NO: 42981 - DNA, 1029 bp, Myxococcus xanthus
gcggggcccactccgaggttcgaagtgaacgaccgactcctccgcgcggcgcgccgccagcccacagacacgacgccggtatggctgatgcgccaggcgggccgctacctgcccgagtaccgggccatccgcggcaacatcgccttcctggacttgtgcaagcacccggacctggcggcggaagtcaccgtccagccggtgacgcgcctgggtgtggacgcggccatcatcttctcggacatcctcatccccgtggaggccatgggcatcaccctggagctgggggacaaggggccgcacttccccgaccccgtgcgctccgcggcggacatcgacaagctgggcgtgccggacccggtggagggcaccggcttcgtggccgaggccatccgccgcacgcgcaaggcactcaatgactccgtgcccgtcatcggcttcgcgggcgcgcccttcaccctggccgcgtacatggtggaggggggcggctccaagagctacatcctcatcaagcggctgatgttcgagcagcccgagttggcgcaccgcctcttcggcaagctcaccgacacgctcatcccctacctgaagatgcaggtggaggcgggcgcgagcatcgtccagattttcgactcgtggggcggcgcgctgtcgccatgggactacgagcgcttctgcattccctacctcaagcgcatggtgtccgagctgaaggccaccggcgtgcccgtcatcgtgttcggcgtgggcatgtcctcgcacctgtcgctgctcaagagcaccggcgcggacgtggtgggcctggactggacgctgcccatggacgagggccggaaggtgctggggccggacgtggcggtgcagggcaacctggacccgctgcacctgttcctcccccgcgaggagctggacggccgcgtgaaggacatcctccgccgcgcgggccccgaagggcacatcttcaacctgggccacggcatcctcccgcccacggaccccgacgccgcgaagttcctggtggaggccgtccac

SEQ ID NO: 42982 - DNA, 1263 bp, Myxococcus xanthus
agggtggccatcgtccgcggcctgcggaccccgttcgtcaaggcgggctccgtcttctcagggctgacggcgctggatttgggccgcctggtggtccaggagttggtccagaagacggacctggacccgaacgtcatcgaccaggtggtgttcggccaggtcatccccacgttgacggccccgtccattgcccgcgaggtcgtcatcgcggcggggctgccgaagaagattgatgccttcacggtgtcgcgcgcgtgcgccacgtccatccaggcgctgacgacggcggccaacgcgattgccacgggcgaggcggacgtcatcatcgccggtggcaccgagtccatgtcggacgcgcccatcttcaccagccggccgctggcccacgcgctggtggcggcgtccaaggggcgctcgctgccggacaagctcaagcccttccagcgcctcaaggccaaggatttgctgccggtgcccccggccatcgccgagtactccaccggcatgacgatgggggagagcgcggagaagatggccaaggagaacggcatctcccgcgaggagcaggaccgcatcgccttcaactcgcaccgcaacgcggccaaggcgtggaaggacggtctgttcgacaacgaggtcatgcacgtcgtcgtgccgccgaagttcgacaagacggcggagcgcgacaacatcgtccgtgaagactccagcatggaggcgctggggcagctcaagccggcgttcgaccgcaagtacggcacgattacggcgggcaacgcgtcgccgctgacggacggcgccgcggcgctgctgctgatgagcgaggagaaggcgcgcgcgctgggctacgagccgttgggcttcctccgcagccacgcctacgcggccacggacccgggcgaccagttgctccagggcccagcctacgcggtgcccacggcgctcaagcgcgcgggcatgacgctggcggacatcgacctggtggagatgcacgaggccttcgccgcacaggtggccagcaacatccaggcgctggcgtcccaggccttcgcgaagaaggcgggctggagcgcgccggtgggcgaaatcgaccgggagcggctgaacgtgacgggtggctccatcgccatcggtcatccctttggggccacgggggcgcgcatcgtcacccaggccatcaatgagctgaagcgtcggaacaagaacacggcgatgtgcaccgtctgcgcggcgggcggcctgggcgcagtcgtcatcctggag

SEQ ID NO: 42983 - DNA, 1476 bp, Myxococcus xanthus
ctgggggagcgcgtgctggccgcgctgcgagaagcgcgcgtcacggtgtggatgaccgcgcagtccgccaatggccagtcactggccgtcgtcgtgcctcgccccgacgcggagcacgcgcggtccgtgctcgtcaccgagctggcgcaggagctgtcacgccgcgaagtggaaccgctggaggtccgccagccggtgacgctgctgacgctggtggcggagaccatgggccacggcgtcaacgtggccgggcgcttcttcagcgcgctgggcgcggtgggcgtcaacgtgcgcgccagcgcccagggtgccagctcccgctccctttcgtgtgtcgtcgacgcggcggacaccgccgtcgccgcgcgcaccacgcacgcggccttcaacctggcccatcagcaggtgagcctcttcgtcctcggccgaggcacggtgggcggacaactgctggcccagctgcgcgcccagcaagcgctgctccgggacaggcacggcatcgcgctgcgcgtcgtggggctggcggacagcaagcgcgcgctcttcgacgcggcggggctcacgctcgatggcgtggaggcgcggctcgaaggcgtgacgcccgaggcgccccaggcgcgcaccctggtccccttgttggacgcgctccggcggctgcccgtccccatcctggtcgactgcaccgccgcgggcgggttggaggcgctctacacggaggccttccagcgcggcatccacgtggtggcggccaacaagaagccgctggcgctgccgtgggaggcccgcgaagcgctggtggacacggcgcgccgcaaccacgtcgcgtaccactacgagacgacggtggcgtccagcctgcccgtcatcgacacgctggcgaacctggtgcgcaccggtgacaccgttcgcctcatcaccgcgtccctgtccggcagcctgggcttcatctgcaacgaactgacggccggcgtgcccctgtcccgggccgtccgcaccgcccgggagcgcggcttcacggagccggaccctcgcgaggacctgagcggcacggacgtcgcgcgcaaggcgctcatcctcgctcgggagctgggcctgccgctctccctgtcggacgtggcgctggagcccttcgtcgccacggacgaatgcgccagcgtggactcgttcttccaggtgctcgccacgcaggatgcggcctacgcggagcgcgtggcccgctgccgccacgccggcaccgtgctgcgctacctggcacgcatcgacccatcgaaggcgggcacaggcagtcccgtcatccgtgtgggccccgtaggcgttgaagcgggccaccccgcggcggacctccgcggctccgagtccttcgtctccttcaccaccacccgccacagcgacttcccgctcaccgttcgaggcgcgggcgcgggcggcgccgtcaccgcgtccggcgtgctggcggacatcctccgcatctcccag

SEQ ID NO: 42984 - DNA, 1071 bp, Myxococcus xanthus
atgaaactcgccaccgctctcgtccacgccggcgtgcgccgcgaccccaccaccggcgcggtcgccgtccccatctaccaatccgccaccttccagcaccccgcgctcgggcaatccaccggctacgactactcgcgcacgcgaaaccccacccgctccgcgctggaggatgcgctggcgcaactggagggtggcagccggggcctggccttcagctccggcatggcggcgctgcactgtgccctccagctcttcggcccggaggaccacatcctcctcaccgaggacctctacggcggcacctaccggctggtggaccgcatcctccacgtcccctgcaccttcgtggacacctcacaccccagcgccgtgcgggacgcgctgcgccccaacacccgcgccatcgtcgtggagacgcccaccaacccgatgatgcgcaccgccgacctctccgaactggcggccattgcccgcaaggccggggtgctgctcatcgtcgacaacaccttcctcacgccgtggttgcaacgcccgctggagctgggcgcggacatcgtcgtgcacagcgcgacgaagtacctggccggacacaacgacgtcgtcgcgggcgcgctggtggtcaaggacgccgcgctgggcgagcggctggcgtacctccagaacggcatcggcgcgattctcggtccgcaggacgcgtacctggtgattcgcggcctgaagacgctggccctgcgcatggagcggcaccaggccaacgcgcgggaagtggccgcgtggctgcgcgcccacccgggcgtggagcgcgtcttctatcccggcgtgggcggaatgctgtccttcaccgtcgcccacgcggccctggtgccccaggtgctcgcgtccgtgcagttgtgtctcttcgccgagtcgctcggcggcgttgaaacgctcatcacctaccccaccacgcagacccacgctgacatccccgccgagcgccgggaggcgctgggcatctccgaccggctgctccggctctccgtaggaatcgaggactcccatgacatcatcgccgacctggcccaggcgctt

SEQ ID NO: 42985 - DNA, 1074 bp, Myxococcus xanthus
acccgtctgctgcacacggggcatgagcaggaccccaccacgggcgccgccgctgtccccatctaccaggtgtccatgttcgaccagccgggcctggagacgcccggcgagttcgactacgcgcgctccggcaatcccacgcgcaaggccctggagggcgtgctcgcggcactggacgaaggccacgcggcctttgccttcggctctggcatggccgccgtgtccagcgtgctgatgctcttcagcgcgggggaccacgtcgtcgtgacggacgactgttacggcggcacctaccgggtgctcacacgcgtcttcagccgcttcggcctgcaggccaccttcgtggacaccagcgacccggacgccgtgcgcgcagccctccgccccaacacacgagcgctgctggtggagagcgtgagcaatcccttcctcaagcgcaccgacatccccgcgatggcgcgggtggcccaggcgcatggggcgctgctcatcgtggacaacacgttcctgtccccggccctctcgcgtccgctgaccgagggcgcggacatcgtcatccactccgccaccaagtacctcggcggccacagtgacgtcgtcgccggtgcggtggtggtgaagacgcccgcgctcgcgcaggagctcggcttcctccagaacgcggtgggcgcagtgctgggaccccaggactgcttcctcctccagcggggcatcaagacgctgcaggtccgcctggagcgacaggtgcgcacggcgggagccctggcgaagtggctcaccgagcggccggaggtgcggcgggtcttctatccgggcacgggcgcggtggtgtcgttccggctggcccaggacacgctggcggcgcccttcgtggaatcgctccagctccccctgctgggtgtgtcgctgggcgcggtggagagcatcgtcaccgtccctgcgcggcactcccacgcctccgtgcccgtcgccgagcgggagcgccgaggcatcaccgacggactcatccgcttctcggtgggactggaggacctggaggacctgcaagaggacttcgtgcgggcattcacgcag

SEQ ID NO: 42986 - DNA, 1854 bp, Myxococcus xanthus
tgtcaacagtcgcgggttcttctacggtccgcggccatgaaccggaaacgtcccctgaattccctcctgcgtgcggccgcggtcatggtgctgcccgccttcctggggtgtgcccaggattcgcaagtgacacgcgaggcgcccacgcccgccgagtctcccgccgccgcgtcgcagccctcgccggcagaggcgaaggccttcgcggagaaggtgaacgcggacctcaagagcctgtggacgaagcaagccaccgcggagtggatcaagtccacgtacatcaccgatgacaccgagcagaacgccgccttcgtcaacgaagaggtgctggcctacgtcaacggcgccatcaaggaggcgcggcgcttcgagggcctgacgttggacgcggacaccgcgcgcatgctgcacctgctcaaggtgtcccaggcgctgccggcgccgtcggacgcggagcggcggtccgagctggccgccacggcggcgaagctggagggcctctacggcaagggcaagtactgcgggccggacgggaaggggaagtgccgcgacctggaggtgctgtccgacgtcatcgcggagagccgcaactttgacgaactgctggacgcgtggcagggctggcactccgtggcccgtcccatgcggccgctgtacgagcgcctggtgtccatctccaacgagggcgcgaaggacatcggcttcaacgacctgggcacgctctggcgctccgcgtatgacatgtcgccgggcgagttcgaggtcgaggcccagcgcctgtggggccaggtgaagccgctctatgacgacctgcactgctacgtgcgcggccgtctggcgaagcagtacggcgccgacaaggtacccgacggcaagccgattcccgcgcacctgctgggcaacatgtgggcgcaggagtggaacaacatctacccgctggtggagcccttccccggacaggccagcctggacgtggacgcggcgctgaagcagcagaagtatgacgcgatgcgcatggtgaagctgggtgagaagttcttcacctcgctgggtctcaaggagctgccgccgagcttcttcgagcgctcgcagttcaccaagccggaaggccgcgacgtcgtctgccacgccagcgcctgggacgtgaacttcagcaacgacctgcgcatcaagatgtgcatcaagcccacggaggaggacctcgtcaccatccaccacgagctgggccacaactactactacacgtactactaccagctcccggtgctctatcaggccggcgcgaacgacggcttccacgaggccattggtgacgcgctcacgctgtccatcaccccgggctacctgcagcaggcggggttgctgaaggccgttccgaagaacgagaagaacctcatcaaccttcagatgaaggacgcgctggagaagattgccttcctgccgttcggtctgctcgtggaccagtggcgctgggaggtgttctccggccgcgtgcagccggcggactacaacaagtcctggtggacgctgcgggagaagtaccagggcgtcgccgcgccggtggcccgttcggagcaggacttcgacccgggggccaagtaccacgtgcctgcaaacgttccgtatacgcggtatttcctggcgcgcatcctccagttccagttccacaaggcgctctgcgaggcgtctggctacaagggcgccctccacgagtgctccatctatgggaacaaggatgccggcaagcggctccaggccatgttggagctgggtgcgagcaagccgtggcccgacgcgctccaggccatgacgggaacccggcagatggatgccacgccgctgctcgactacttc

SEQ ID NO: 42987 - DNA, 840 bp, Myxococcus xanthus
gtgaacgcccagttgattgatggcaaggcagttgcggcgcgcgtgcgagcggaggtcaaggcggaggtcgaccggctcaagctcgagcatggcctgacgccggggctggccgtggtgcgcgtgggggaggaccccgcctccaaggtctacgtcaatgggaagaagaaggccgcggaggaggtgggcttccgctcctgggagctccacccggacgagggcatcacccaggcggcgctgctggaggtcatccaccagctcaacgcggacccggcggtgcacggcatcctggttcagttgccgttgcccaggcacatcgacccggacgtcatcatctccgccgtgaagccggagaaggacgtggacggcttccacccgctcaacgccggcaacctgctgctgggccggtccaccacccgggcgtgtacgccctacggggtgatgcggctgctggaggagattggctgcgaccccgcgggcaagcgggcggtggtggtggggcgcagcaacatcgtgggcaagcccatggcgctgatgctgctccagaagaacgccacggtgaccatctgccacagcaagagcgacctgcgccgggaagtggagggcgcggacatcctggtggtggcggtgggggcggccgagctggtgaagggcgcgtggataaagcccggcgcggtggtgattgacgtggggatgaatcgcaagccggacggcaagctcgtgggcgacgtggaattcgccgctgccgccgagcgcgcgtcattcatcacccccgtgcccggtggcgtggggcccatgaccatcgccatgctgatgcgcaacacgctcgacgcggccgtccgc

SEQ ID NO: 42988 - DNA, 1065 bp, Myxococcus xanthus
atgtacggactcacccgctcgctcctcttccagctctccgcggagcgcgcgcaccggctcggcatggcggggcttcactacctgggccgctcacgggacttgtgcgagtccctgcgcgagaaggccctggagggcgccccgcccggcctggccgtcgaagtggccgggctgcgctttgcccaccccgtggcgcttgccccccgcctggacaaggacgcggaggcggtggacggcctcttcgcctgcggcttctccgcagtggagattggcaccctcacgcccaggccccagcccggcaaccccagccctcgcctgttccgcctgccggagcaccgcgcgctcatcaaccgcatgggcttcaacaaccacggcgccacccaggccgccgcgcggctgcggatgcagacgtggcgtccgggcccgctgggggtgaacatcggcaagaacaaggacacgccgctggagcaggcggtggatgactacgtggcctgcgtggacgcgctggcgcccctgggcgactacgtggtggtcaacgcctcgtcccccaacacgccgggcctgcgcaagctccaggagcccgagcagttggggcagctcctgggcgcggtgcaggagcgcctggccaccgtggccccgggtaagccgctgttcctcaagattgccccggatctgtcccccgaggcagtggacgaggtggtggatgtcgcgcgggcccagaagctcgccggcctcatcgccaccaacaccaccgtggcccggcccttcgagcatcccctggcgaaggaagccggcggcctgtccggcgcgcccgtccgcgagcccgccaacgccgtcatccgccgcgcctggctgcgcagcgggggcgcgctgcccatcatcggcgtggggggtgtcttcaccgcccaggacgtctacgaaaagctgcgcgcgggcgcgtcggtggtgcaggtgtacacgggcttcatctacgagggcccgggcatggtgggaaacatcctccccaccctggccaccctgctcgcccgcgacggctacaagcaggtccgcgacgtcatcggcgccgag

SEQ ID NO: 42989 - DNA, 1539 bp, Myxococcus xanthus
ccgccgggttcagctagcgtggataccatgcccatcgtccatgactggctggcccggcgtgccgcgctggcccctgagcgtaccgccctcatcgacgccgaccatggcgagcgacgcatctcctttcgtgaatggaacgattcggcttcgcgtaccgccgctttcctccaccatgcgctgggtgtggggcgaggggaccgtgtcgcggtgctcgcctacaactgcgtcgagttcctcgacctcttcttcgcgtgcgcgaagctgggcgccgtccttcagcctctcaactggcggctgagtgccacggagctgggggggctgctcgcggatgccgagccatccgtgttcgtcttcgggccggagttccgaacccaggtggaggccgtgcggtctggcgcgtccttcgtgcgccactggctcagtctcgcggctccagggccgagcgagcgggccttctccgagcgcgacacgcagacggacgtggcccttcctccgctggagctagaggaggatgctccatgggtgctctgctacacgggcggaagcaccggtctgccgaaggccgcggtgctcacgcaccgctccatcaccgccaacgcggtgaacacggtgatgggctggggcctgaccgccgatgacgtggcgatcctcaacgcgccgttgttccatgccggaggactcagcgtcttcaccgcgccgctggcctacgccggcggcgcatcggtggtgtgccggagcttccatgtggagggcgtgttcgacctcgtgcggcggggcgtggtaagtctcttcttcggtgtgcccaccatgttcatcgagatgcagcgccacccgcgtttcgatgccgtggacctgtcacgcctcaagctggtcatcagcggcggcgcgccctgcccggcccccgttttcgagcgcttcttcgctcggggcgtggacttcaagacggggtatggcctcaccgaagcgggccccaacaacttctggcttccaccggaagacgtgcgccgcaagccaggggcggtgggcgtgcccctgttccacgtcgaggctcgcatcgacggtgagacgcagccgggcgacgtgggcgagctgctcttgcgaggccctcacctgtgtgcgggctactggcgccgtccgggggacactgcccgcaccttcgcggacggctggctgcacaccggtgacctggccacgcgggacgcggagggatgcttccgcatcgtgggccgcagcaaggacctcatcatctccggcggtgagaacatctacccgtcggaagtggagagcgtcctcgcggggcatcccgatgtggccgaggtcgccgtcatcggcgtggcggaccccaagtggggggagacgccgcgcgcgctcgtcgtcgcacggccgggcacctcgccttcggctgaggccctgctgcgcttctgcgacggacggctcgctcgatacaagacgccgaagtcgattcgtttcgtggacgccctgccgaggacctccgccggcaaggttgaccggcgcacgctcggtgccgcgcacggcgcg

SEQ ID NO: 42990 - DNA, 363 bp, Myxococcus xanthus
atgaaaggcctcgtgggcaagcagggcacggcgacgcgcgggggcatcgggcaacggagcttggagctggacccaggtggttcccgcccaagtcagcgccgtgttggcgatggtgagttccgaggggaacactcccacccagggccctgttcccgaaccgctcggccaggtgctcgcgacgaagacgcgcgtgacgggatggacgacgaggagaggggcacacagcgactgtccccacagtcgccgtcccgcggcgtcacacgttcgttggaattccgcgaaggtcgaggtgagtgcccctacctccagaacgtcgggcactgtcttcacctcggggtcggccacggccgacccgaagcttga

SEQ ID NO: 42991 - DNA, 951 bp, Myxococcus xanthus
gtgatgaagttcggtggcacgtccgtgggctcacccacgcggctccgccaggtagtggagctgattggcaagcacgcgcggcaaggcccgctggcagtggtcgtctccgcgatgggcgacaccacggactggctgctggacgcggcccacctcgccaccgagggtgacctggaaggcgcgctcgcggtggccacgcgcatcgccgacctcgcgaaggccaacgccgcggcgctggcgcccggacaagccaccgcgctggccgagcgtgtcgacgggctcctcgcgccgctgcgtcagttgctccatggcgtctcactcacgcgagagtgctccgcccccacgagagaccgggtgctgtcgttcggtgagttggtgtccgccacgctgctggcggagctgctcacggcccatcgcacgcccgccaccttccgtgacgcgcggcagctcctggtgacggatgaccgctttggcgcggcgcgggtggacctggttcggacgcgggagcgactccaagccgcccgggagacgtggggcgtcgaggtgcccgtgctccccggcttcatcgccgcgacgccggatggacgcaccaccacgctgggccgcaacggctccgactacaccgcggcgctggtggcccagggcctgggcgcgtcggaagtcacggtgtggacggacgtgctcggcctgcacaccgccgacccggagctggtcacggacgcctaccccgtggcgcacctcacccatggcgagggcctggagctggcggcggtgggtgcccgcatgctgcacccgcgcacgatgattccgctcatcgagtccggaatctccctgcgcatccgcaacaccatggagccggagcacccgggcacgctcatcgacgccatcggttcgcgcgacggccagcgtcccgcctgcatcgcgacgcgcgaggacctggcgctgctcggcatc

SEQ ID NO: 42992 - DNA, 1337 bp, Myxococcus xanthus
accttcgattccctgggcttgaagcccgcgctcgtcgaggcgctcagcgcgctcggctacgaggagcccacccccatccaggccgccgccctcccgccactgctcgcggggaaggacctgctcggcatcgccgccaccggcaccggcaagacggccgccttcgccctgcccctgctcaaccacgtggagcccggcgcgtgccggcccaacaccacgtccgcgctggtgctggtccccacgcgcgagctggccatgcaggtctccgaggccatccaccgctacggccagaagctcggcatctccgtgctgcccctgtacggcggccaggtcattggccagcagctccgcgtcctcaagcgcggcgtggacgtcgtcgtcgccacgccgggccgcgcgctggaccacctgcgccgtggcacgttgcagctcgatgacgtgcgcgtcgtcgtgctcgacgaggccgacgagatgctcgacatgggcttcgccgaggacctggaggccatcctctccggcacgcccgaggaccggcagacggccctcttctccgccacgctcccgccgcgcatcgccagcatcgccgagcgtcacctgcacgagcccgtgcgcgtgaagatcgcccgcgagaaggtggaacagggggagattccccgcgtccggcagacggcctacgtcgtgccgcgcgccttcaagatcgccaccctgggccgcctgctcgacgtggagtcgcccaccgcggccatcatcttctgccgcacgcgcacggaggtggacgacctcaccgtctccctcaacggccgtggctggcgcgcccacgccctgcatggcggcatgacgcaggagcagcgagaccgcgtcatcaagcagctcaagtcccagggcaccgacctgctcgtggccaccgacgtcgcggcgcgcggcctggacatcccccgcctgtcccacgtggtgaacttcgacgtccccaacgcgcccgaggcctacgtgcaccgcatcggccgcacgggccgcgccggccgcgagggcgtggccatcaccctggtggagccccgcgagcaccggttgctgcgcaacatcgagcgcgtcaccggccagcgcatcgaagtggccaccgtgcccaccgtcgcggacatgcgcgagaagcggcaggagatgctgcgcgcatccctgcgcgagacgctggtgaccggtgagtacgactccctccgcaacgtggtggagagcctggccagcgagttcgacgccatggacatcgccgccgccgccgtgaagctcctccatgaggcccaggacgagggccgcgacacggaggagacggagatccccgtcgtcgcgcc

SEQ ID NO: 42993 - DNA, 630 bp, Myxococcus xanthus
aagcgcgcgcgccccatgctggcgcggctgttcggcggcgcggtgggcgttccggcggagcggctggtggacgtggccgtggccgcggagctcatccattccgccagcctgctgcacgacgacgtggtggacgcgggcatgttccgccggggccggcccacggtgaacgcgcgctggggcaacatcgtcgcggtgatgagcggcgacctcatcctgtccacgggcctgttccagctgtcccaactggacgcgcggctgacgcgcagcgcgctgtcggtcgtctccgagatgacccgcgccgccatcgccgaggtggaggctcgcggcgacctggacctgccgctcaatcggctgcgcttcatcgccgagggtaagacgggctcgctgttcggctggtgtggcaacgcggcggcgacgctggcggagcaccccgaggcggtggagcgtttcgacggcttcgggcgtcacctgggcgtggcgttccagattgccgacgacattcgcgacatcctgggcacggacgtaggcaagccgcgttacgcggacgtgcactcgcgcacgccgtccatgcccatcctcctggcggtggccaaggatgagtcgctgcggcgcaagctgaaggacgcgtgg

SEQ ID NO: 42994 - DNA, 2205 bp, Myxococcus xanthus
ccaagtgaggaagcccagcccgacaaggcccaggtcgacgcggagcttcaacgcgtcgtggaactgaggcacccggagccgcacgctgtcctgggtatccacccggatggggatggcgtggtgattcgcgccttccgcccggacgccgtggccatccacgtgctgccggaatccggcggtcgcgtcgcgatgacgcaccggccgggcggcgtctacgaggcccgcatcaacggcaaggaccagacgttcaactatttgctggaagtggagtaccccggcaagcgcgtcttcacgcttcgcgacccgtacagcttcctccccaccctgggggagatggacctgtactacgccggtgaaggccgccacgagcgcctctgggagcgcatgggcgcgcacctgctgcaccaccacggcgtgcgcggcacctcgttcgcggtgtgggcccccacggcggcgggcgtgtccgtggtcggtgacttcaacggctgggacggccggctgcactccatgcgccgcatgggctcctccggcatctgggagctcttcgtccccgaggtgggcgaaggcacccggtacaagttcgagattcgccccggccagggcgggcccaacgtcctcaaggcggacccgttcgccttccgtaccgaggtcccccccgccacggcctccgtggtgcacgacctggcgcgctacacctggggcgacgcggcgtggctggagcaacgcgcccagcggcgggacgtccatcaccaaccgtggagcgtgtacgaggtccacctgggcagttggcgccgggtggtggaagacggcgaccggcccatgacgtaccgggagctggccccggcgctggccgagtacatcaagttcaccggcttcacccacatcgagctgctccccgtggccgagcacccctacggtggctcctggggctaccaggttggcggctactacgctcccacggcgcgcttcggccacccggatgacctgcgcttcttcatcgaccacatgcaccaggaaggcatcggggtgctcgtggactgggtgcccggacacttcccgcgcgacctgcacgccctgggacagttcgacggcacggccctgtatgagcatgccgacccgcgcaagggcgcgcagccggactggggcacgctggtcttcaacttcggccgcaatgaggtgcgcaacttcctcatcgccaacgcgttgttctggatcgaggagtaccacatcgacggactgcgcgtggacgcggtggcgtcgatgctctacctcgactacagccgcaagcagggcgagtggattcccaaccgctggggcggccgggagaacgaagaggccatccatttcctgcgcgagctgaacgaaacggtccaccgcaagcacccgggcgtcgtcgtcatcgccgaggagtccacggcctggcccaaggtgtccgcgccggtgtccgaaggcggcctggggttcgactacaagtggaacatggggtggatgcacgacacgctgtcgtacttctccaaggaccccatctaccggcagtaccaccacaaccagctcaccttcggcctgctgtacgcgttcagcgagcagttcatgctgccgctgagccatgacgaggtggtgcacggcaagggcagcctgtacgggcgcatgccgggcgacccgtggcagaagcgcgccaacctgcgcgccctgttcgcgtggatgtgggcgcacccgggcaagaagctcgtcttcatgggcggcgagttcggccagcccgccgagtggaaccacgacaagagcctggactggcacctgacgcacgacccggggcaccacggcatccttcaactggtctcggacctgaaccgcatctaccgggacatgcccgcgcttcacgacgcggatggcgagcccatgggcttccagtggctccagccggactcggccgcgtacaacgtgttcgcgttcgtgcggcgcgcgcgtcagccaggacggcatgtggtgtgtatcgccaacctgtcgccaacggtgcgtgagaactaccgcgtgggcttcccgttccagggccgctacgtggagttgctcaacacggacgccgagcagtacggcggctccaacctgggcaacatgggccagattcacaccgagcccacgggctgggatggccagccggcttcggccaccctcaccctgcccccgttgtccgtgttgtggttcacgccg

SEQ ID NO: 42995 - DNA, 3330 bp, Myxococcus xanthus
gaggacaagggccccgtcgagctgcgcgtcctcaagccggagaacctggacgccttcatccgcgcccagggtgatttgcgtcgcgcgtaccagacgccgcccacgctgaagaacccgggccgcgcgctcagccgtggcttcaacgcggtccgcacgccgggcatgttcctgctcgacacgctcagcccggccttccgcgacgaggtgggagaggtgctgccccgtgcgccgcaagcgtcgggctcgggcgagccgctggcgaaggtagccgaggggccggagcgcctggtgggcgtgccgcccggcttcacggtgacgcgcagccagtggctgaacctggacctgggcggcgccgagcgggacttcaacgtccccggcttcaacgccagtggctccagcggcttccaggagcgccgcgtcacgctggcgccgctgcccgcgggcacctacgtgctccagttggtgcagggccgcgtggagggacaggtggtgctggtcgtcagtgacttgacggtgcagctcaagcagacggatggccaggtgctgctgcgcgtggcgggccgggaccagaagccgcgcgagggcgccgaggtgcaggtgtacctgcccaagggcaagggccccgccggcaagacgaacgcgaagggcgaggtgacgctggaggtgtcggagccgcgcgtcatcgccacggcgacggcaggtggggacacggccatcgtcgacacggacttctactccgcgctggcggtggcgccggacgtgttcatctacagcgaccggcccatctacaagccgggccacgaggtgaagttccgcggtgtggtgcgccagccggacaccttcctggcgcgcctcttcacgccgaagaagcgccaggtgcaggtgaagctcgtctcgcaggagggccgcgcgctcaccacgcgcgccgcggtggacgagttcggcgccttccacggcacgctgaaggtgccggacgacctgggcaccggcgtgctgcgcgtggaggcggaggtggacgggcacccacaccagggcgaggcccgcgtgcaggactacgtgaagccgacgttctacctggagatggagcccgcgtcggagacggtggtgcctggccagacgctgcgcgcgaaggtgcgcgcccgccgctatgccggtggcacgcccgacgccacgaagtacgaggtgttcctctaccgcagcctgctggacgcgcccgcctgggtggatgacgcgggcaagggcggccagggcagcgacgtgacgtacggcagcgcctccaccacggagggcaagctgagtgtgccggagcggctgtactcctccgtggaggcgcgcggcgcgtatgaggacccgtggtccagcgccagcgccttcgacgccaacggcgaggctgaaatcgaggtggccgtgccggcgctggccgcgggcgaggagcggctgccgtaccggtactcgctcaccgtgcgcgcgcgcgatgaccaggagaccttcgccaacgccacgtccgccttcttcctgtcgaaggtggaggtgctgggcctggcgcgctactccgacgcggtggtggccaagagcggcgacgcgacgctggcgattcgcgccaccacgctgtcgggcaagccctacggcgtgacgcagggcgaggtggagttcgtgctgcgcaaggcggatggctcggagaagagcctgggcaagcgctccttctccacggcggcggatggcacgcaccgcgagaaggtccccacctcggacgtgggcagcgtgctggcgcgcgtggtggtgaaggacaagaacggtgagacgtggcagggcgaggagtcgctgctcgtcatcggcggcgcggacgagccggtggcgcgcgtgcccaacctgacgctggcctcgctgtccgggacgctggcgccgggcgacaccgcgaagctggtggcgctgatgccggatagctggggttcgggtggccgtgatgcgggcccggtgtgggtgacgctgtcgggcgcgtcgctctacgacacgcaggtggtggagctgacgggccgcacgctggtgcacagcttcaacgtggagaagcgcttcggcagcgcggtgtacgcgtccgtcgcgtaccccacggccacgggccgctgggaggagcgcacggtggccttccgggtgattccgcgcgagcgcaccctcacggtggagctgcagccccgccgcgcggaggccacgccgctcaccgagcagagcatcgacgtgcgcgtggtggaccacgagggccgcggcgtggtggcgcagctctccgtgggcgtggtggacaaggccgtctacgccatccagagcgagttccggcccagggtgctggacttcttctacccgccggcgcgcaacaacgtgtccaacttcttctcgtcggagttccagggctacggctacggcgaggcgctggcgcggaagatggcggggctgccggaccacgccttcgcctccatcaagccgcccagccgccagacgaaggacctggagcgcgacaccgcgcactgggacccggcggtggtgacggaccgggatggccgcgccacggtgcgcttcacgctgccctccaaccagacgctgtgggtggtgacggcggtggcggcggacacctccggccgctttggcgagggcacctccgagttcgccacgcgcggcggcctcaacctctacgccgcgctgccgcagttcctccgtgaaggcgacgaggcggtcgcttcggtgcgcctgtcggcgggggagaagtcgccggccagccagctactggacgtgaagctggcgtcgctgggcgcgctgaaagcggaccagttcgagcacaaggtggagctggcgaaaggcggtgagcaggtggtgccgctgacgctgaaggcctcgtccacgggcgccgcgcagctcaccgtgaatgtggcgggcggcaaggactcgctgagggacctcaagcgcttcgatgtgggcccagcggcggtggaggacgtggtgaaggtgagcgcctggggcggcggcgcgctggaggtgcccgcgcctcaggaagcgacgctggcgcgcgtggagctggtgctccagccgtccatcgtcgacgcggcgctgtccaacgtgcgcgagctgctcacgtacccctacggctgcctggagcagttggtgtccaccaccgtgcccaacgtggcggtgtaccaggtgctccagaaggcgggcgcgctggcgaagctggacacggacacgcaggcgctgctggcggaggcgcgcagccgctccgtgcagggcaccgcgcgcatcctcgacatgtcggtgaagggtggcggcttcacctggttcggtggctat

SEQ ID NO: 42996 - DNA, 2235 bp, Myxococcus xanthus
ctgctctggttcagcgagctgtcccgcgaggacgtcgcgctggcggggggcaagggcgcgaacctgggcgagatgacgcgggcggggctgcctgttccgccgggcttcgtcatcaccgccaccgccttccaggaggccatggcgccggtgcgtgcccggcttcaagcgctctgggcgcaggtggacccggatgacccttcgtcactgacccaggtcacgcagcagctccgtgagcacgtgcggagcgcgcccgtcccggagcggctgcgcgccgccatcctggaggcgtatcagcagttgggcgcggaccgggccgtggcggtgcgttcctcggcgacctcggaggactcggcggccacgtccttcgcgggcatgcacgagtccttcacccacgtgttgggcgaggacgctttgatggacgcgctccgggcgtgttgggcttcggcctacggtgagcgtgtggtggcctaccgcaaagcggaagggctcaccgaggaacccgccatcgccgtggtggttcaggccatggtggatgcggctcgcgcgggcgtcatgttcaccgcggacccgtcttcgggagacaccggccgcatcgtcatcgaggcggcctgggggctgggagaagtcgtggtgggcgggcaggtggagccggatacgtacagtgtctccaagaaggagccttgcgtgcgcgaggtccgggtgggcgacaagagtgtccgcctggtgcgcaatgccgaaggacacacgcagcgcgagacactgagtccggaacaggcccacgagcgcgtgctgagcgacgtggcggtgctggagttggcgcggttgggattgcgggtggagcagcactacggtgcgccgcaggacatcgagtgggcggaggagcgcggacgtttgttcctggtgcagacgcgcccgattaccacgttgggaaagtccgccgtgccaccgccagaggaaggccacgcgggcaaggcgctggtgcagggactgggtgcgtcgcccggtgtggcggccggccgcgtgcgggtgctggcgtcaccggccgagggacggcaactccagccgggcgaggtgctggtggctgagatgacgtcgccggactgggtccccaccatgcggcgggccgccgccattgtcacggaccggggcggcatgacgtgccacgccgccatcgtcagccgggagctgcgaaaaccctgcgtggtgggcacacgcaccgccacacgcacgctgcgagacagcgaggcggtgacggtggatggctcgatgggagaagtccgggagggacaggaggcgccacgtccacgggcggtggaggtgcctgccaccgcatccacggtgggaacggccccggtgctggccacgcgcctctacgtcaacctggccctgcccgcgcaggctcgcgaggccgcggcgcttccggtggagggtgtgggtctgctgcgcgccgagttcatgctcacggaggccctggggggtgtgcatccacgcaagctgattgcggagggtcggaggggtgagttcgtggagcgcatggcgggggccctgctccagacgacgcgagccttccatccgcgccccgtggtctaccggacgacggacttccggacgaacgagtttcgcggactggaaggcggcgctgagttcgagcccgaggagtccaacccgatgattggcttccggggcgcctaccggtacttgcgcgagcccgacgtgttcaacctggagctggaggtgctcgcgcgggtccgggagcagacgcccaatctccaggtgatgctgcccttcgtgcgcacgctctgggagctggaggcgtgtctggagctcatcgcccgcagtccgctggggcggcagcggggtttgaagacgtgggtgatggcggaggtgccttccatcgtctatcgcctccacgattatgcgaagtgtgggattgatggcgtgtccatcggctcgaatgatttgacgcagctcatgctgggcgtggaccgggactccgagtcgtgcgccgagctgttcgacgaagcggacgccgcggtgctggccgccattggcgacatcattcgtgggtgcgaggaagcgggcctgacgtcctcgctgtgtggacaggcgccgtcgaaccggccggacttcgcggagcacctggtgcgcgcggggattacgtccatctccgtggacccggcggcggtgctcgcgacgcagcgggtgattgcggcggcggagcagcggctgctgctg

SEQ ID NO: 42997 - DNA, 1053 bp, Myxococcus xanthus
atgcgagccaatgtctttcaggctgtgaaccgcttcggcatcgaagaggtggagcgtccacgcgcgggagccggcgaggcggtcatccggatgacgatgaccactgtctgcggcacggacctgcacatcgtccgtggcgagtacccggttcgcccggggctcgtcatcggtcacgagcccgtgggtgtcatcgaggagcttggtcccggcgtgacggactaccgcccggggcagcgtgtcctcgtgggcgcaatcaccccgtgtggacaatgcagggcctgcctgtccagtcacctctcgcagtgcggccacggcgcgggctatgaggccctgggaggctggcgcatgggcaacacccaggatggcgcccaggccgagtacatccgcattcccgccgcgcaggccaacctcgcgcccattccagatgggctcaccgacgagcaggtcatcctcctgtcggacatcgcctccacgggcttcagcggcgcagaggcaggcagcgtgcgcatcggcgatgccgtggtcgtcttcgcgcaggggcccatcggcctgtgcgcctccattggcgcgcggttgatgggcgcctcgctcgtggtcggcgtggacggcgatgaggcgcggatgaagatggcgcagaggatgggcgtggacgtggtgctcgaccaccgtcagcaggacgtcgtagccgaggtgaaacggctcacgggcggcggcgccgacgtggccatcgaggcgctgggcacccagcagactttcgagagcgcgctgcgctgcctgcggcccgcgggcacgctgtccagcctgggtgtgtactcgggcaagctccagttgccctacgacgcgttctccgccggcctgggggactaccgcatcgtcaccaccctgtgcccaggaggcaaggagcgcatgcgccgcctcatggacctggtgcaccacaagcgcgtcgacctgtcgccgctcatcacccatcgcttcaagctcgcggacatccaggaggcctacgccctcttcggcgagcgccgtgacggcgtcttcaaggtggccatccaaccg

SEQ ID NO: 42998 - DNA, 1311 bp, Myxococcus xanthus
ctccaggagtacggccgcgattggacgcgcgtctatgcgcccgcccccgccgccgtggcgcttccccggacgacggacgaggtcgcccggctgctggccctgtgtcaccagcatcacatcgccgtggtgccctccggcggtcgcaccgggctggccggcggcgcggtggcggcccggggcgagctggtcctgtccctccagcgcatgacgcgcatggggccggtggacctgctcggcaacacggtgcgcgtgcaggcgggcgcggtgacggaggccgtccaccaccactgcgcggagcacggcctcacctggccggtggacttcgcctccaagggctccagcacggtgggcggcaacatcgccaccaacgcgggcggggtgaaggtcatccgctacggcctcacgcgccagtgggtgctggggctccaggtcgtcaccgcccagggggaagtgctggagctcaatggcgcgctggagaagaacaacaccggcacggacctgcgccagctcttcatcggcagcgagggcaccctgggcgtcatcaccgaggccaccctcaagctcacccagctccccggcaagcaggacgtgttcctcttcgcggtgccggacgtggcggccgtgctgcggctgttccgcgacgcgcgccggcagaacgccttcagcatctccgcctacgagttcttcaccgacaggtgcatggcccgcctgggccgccaccgcaagctgcgcccgcccttcgagacccccagcgagtgctacgtgctgctggaggcggaggcgaaggacgccgccgcggtggagggctggctgggctcgctgttcgagcgcgagctggtgacggacggcgtccaggcgcagggcgcggcgcaggcggccgagctgtgggcgctgcgcgagggcatcagcgagagcctctccgccaccggcctgccgcacaagaacgacatctccctgccggtggcggggctggaggccttctgcgcggagctggaggccctcttcagcgcgcgctacccgggctgggaaatctgcctcttcggccacatcggcgacggcaacctgcacgtcaacgtgatgaagccggacgccatggacaaggcggagttcctggcccacacgaagcaggcggaccccaccatgttcgcgctggtgcagaagcacggcgggagcatctccgccgagcacggcgtcggcctgctgaagaaggactacctgggctactcacgcgcgccggcggagctggccctgctgcgcaccctcaagcgggcgctggaccctcgaggcatcctcaacccgggcaaggtcgtg

SEQ ID NO: 42999 - DNA, 738 bp, Myxococcus xanthus
tccaagacggtggtggtaacgggcgcgagccgaggcattggccgcgcggtggcgctgggtttcgcgaaggcgggccatgacgtgtgggccctggcgcgttcgacggaagcgctggagtcgctccggcaggaaggcggcgagcgcatccggccgctcgcggtggacgtggccgacgaagcggcgctgattgccgcgagccagcgaatcctcgccgagggtcctccgcgcgtactcgtgaacaacgcgggcatcaccgtctccgcgcccctggcgaagacgcgcaccgaagacctggcccgcgtcatggccgtcaacgtgacggcgcctttcctcctctgccgcgagctgatgccggccatggcccaggcgggcggcggacgcgtcatcaacatcggctccatggccgcggtgcggggcgtgaagtacacgtccgcgtattgcgcgtcgaagcatgcgctgctgggcctgacgcgcgcgctcgcggtggagtacgcgaagaagcaagtcacggtgaacatcgtgaatccgggctgggtggagacggacatgttcgccggtgcgacctcggccatcagcgcctccacgggccgcagcgaggagcaggcgcgcgaggccctcgcgtccatgaacgccatgggccgcatcatcacgccggaggaagtcgccgcgctgtgcctgttcctcgcgtcggacgcggcgggcggcatcaccggctcggcgtacgccatcgacggtggc

SEQ ID NO: 43000 - DNA, 873 bp, Myxococcus xanthus
cccaagcaggtcgacgtctacgaagtcggtccccgggacggcttgcagaacgagctgcgcacgctgcccacgcgggacaaggcgcgcctcatcaacgcactggtggccgcgggggagaagcgcatcgaggtgacgtcgttcgtgtcacccaagtggattccccagctcgcggacgccgaggagctgctgcggctggtgggccgtcgcgacggcgtcgtgttctccgcgctggtgcccaacctcaagggcctgcagcgcgcgaagaagcggggcctggaggagaccgccgtcttcatctccgcctccgaggcgcactcgaagaagaacatcaacaagagcatcgccgaggccgtggtgggcgcgcgcgaggtgacggcctccgcgctccaggcgggcatgcgcgtgcgcggctacctgtccaccgtgtggggctgcccctacgagggtgacgttccggtggagcgcgtggtggacatctgccggcagctcgtggacgcgggcatctaccagctcagcctgggagacacgattggcatcggcacgccgcgccagaccgaggtcatcctcgaggcgctgctgaagcacatccccgtggagaagctggcgctgcacctgcacgacacacgcggcaccgcgctggcgaacgcgctcgtgggcctgtccgcgggggtgacgaccttcgacgccagcattggcggcctgggtgggtgcccctacgccccgggagcggcggggaacctggccaccgaggacgccgtcttcatgctccacggcatgggcgtggacacaggcatcaacctggaccggctggtggaggccggggagattgcccaggagctgattggccggaagctggcgggcaagtacctccag

SEQ ID NO: 43001 - DNA, 1131 bp, Myxococcus xanthus
aaggctacgggtctctatccgtacttccgtgccatcgaagcgtcgcacggtgccaccgaggtggagatcgaaggcaagcgcgtcatcatggtcgggtccaacaactacctgggcctgtccgccgatccgcgcgtgaaggaagcggccatcaaggcgacggagaagttcggcaccaccagctccggctcgcgactgctcaacggcacactggcgctgcacgaggagctggaagcgcggttggcgaagttcctcaaccgcgagtccgccatcgtcatctccacgggcttccagacgaacctggcgctggcgtccatcctgggccggcacgacatcgtcttcagcgaccggcagaaccacgcgtcgctggtggacggaatccgcctgtccttcgccaccgagcgcaagttccgccacaacgacatggaccacctggagcagctgctgtcccaggcggatccggacgcgggcaagatcatcgtcaccgacggcgtcttctccatggagggcgacatctgcaacctgccccgcatcgtggagctggcgaagcactacaacgcgcgggtgatgacggatgacgcgcacgccatgggcgtgctgggcacgcggggccggggcacctccgagtacttcgacctggagaaggagacggacctcgtcatggggaccttctccaagagcttcgcgtcgctgggcggcgtgctggccggtcccttcgaggtcatcaactacatccgccacaaggcgcgctcggtcatcttctccgcgtccatgacgccgggctccatcgccgcggcgctcaaggcgctggagatcatcgaagcggagccggagcgccgcgcccgcctgctggacatcgcggagaagatgcacaacggcttccgcgccatgggcttcgacacgggtgtgtcggtgacgccggtggtgccggtgcacatcggcgaccaggtgaagtgcttccgattctggcgcgcgctgcatgaggccggcgtcttcgccaacccggtgattccgccggcggtggagccgggccacgcgctcatccgcacctcgtacatggccacgcacacggacgcgcaactggaccgcgtgctcgacaccttcgagaccattggccggaagctgggcgtgatt

SEQ ID NO: 43002 - DNA, 1746 bp, Myxococcus xanthus
ctggacctgaccatcctccacatcaacgaccaccactcgcacctcgcgggttccagtctggagctgaatgtgacgaacgccgcgggtgacaccgtggccgcggaggttgaatcctcgggtttcgcgcgcgtcacgtccgcgatgaaggagctggcggccggtaaggagaacgtgctcaagctccacgcgggtgacgccctcaccggcacgctgtacttcaaccgcgcgggccagattggcgaggccgacgccgcgatgatgaacacggtgtgcttcgacgccttcaccctgggcaaccacgagttcgacaagggcgacaccgagctgaagcgcttcatcgaccgcctgcatgccggccagtgtcagacgcccgtcatcagcgccaacgtccagttcggcgcgggctccgccctgcacacctccagggctgccggctacgtggagcccttcaccgtcgtcgaacgggggggccagaagattggcctcgtcggcctgacgattgcgggcaagacgaaggagtcctccagcccggatgcggacaccacgttcgaggccgaggtgcccgccgcccagcgcgccatcgatgcgctgcgggcccagggcatcaacaagatcatcgtgatgagccacatcgggtaccagctcgaccggaccatcatcccgcagttgagtggcgtggacgcggtcatcggcggtgactcccacacactgctggggcctgccgccatggagaccttcaacgtcggaacgcccgcggggccctacgcggagtcgctgcgcaaccgcgacggcgaaaccgtgtgcctggggcaggcctggcagtactcgcaggtcgtcggagagatgaccctccgcttcgacgccgagggcgtggtcacctcctgtggcggcacgccccacgtactcatcggcaatcagttctccattgacgggacgcccgtctccgaatccgacaacgccgcgatgctggccagcgtggccgtcagcggcttcctgcgggtgacgcagccggatgccgccgccgcgcaggtgctggcgccgttccagggccggatcgacgagtacagccggacggtggtggccacggcggacgacgagctttgcaatcgccgcgtgccgggaaacacggagccgggccgctccagcgtgagctgcaacgccctgggggaggtccacagccggggcggcgacatccagcaactggtggcgcaggcctacctggaggtggcgaacgcggattacggcggcgcggacatcacgttgcagagcgcgggcggcgtgcgccggccgctgcagggaccggtgacggcggcggacgtcatcgaggtgctgcccttcggcaacatgctgttccggctggacgtcactggcaccgaggtgaagtcgatgattgaggacgggctgcacgccacgttccgggagggaggcaccacggggccctatccgtacaccggcggcctgcgcttcgacgtcaacgccgctcacgctcgcggccagcgcgccagcaacctggaggtgctggaccagacgacgggccagtggaacgaacttcagccgaccgccacctatcgcctgttcgtgctgagcttcaatgccacgggtggtgatggctacgtgacgctggccaacgtgccggccgagcgccgctccgacatcggcgtgctcgatgccgacgtcctccagacgtacatcgaccgtcaggccgagcgcaagcccggcacgaacctgcccgtcctgcacaaggtg

SEQ ID NO: 43003 - DNA, 781 bp, Myxococcus xanthus
cgcacagattgcggtcatccactccgcagtcacgaggcgcatccatatgtctggaattgaagggaaggtcattgccatcaccggagcgagcagcggaatcggggaggcgacggctcgcctgctcgcgaagcgtggggcgcacgttgtcttgggcgcgcgccggacggaccggctcgaaaccctggtgtccgccatccgcgcggagggcggctccgcgcgctaccggaagctggacgtcacgaagcgggacgacgtcgagtccttcatgggcttcgtccgcgccgagcacggccgcatcgacgtcatcatcaacaacgcgggcgtgatgccgctgtcgaagttggaggcgctcaaggtcgaggagtgggaccggatgattgacgtcaacatccgcggcgtcctgcacggcatcgccgcggggctgcccatcatgcaggcgcagcgctccggccagttcatcaacctctcctccattggtggccaccaggtggtgcccacggccgccgtgtactgcgcgaccaagtacgccgtcatcgccatctccgagggcctgcggcaggaggttggcggcgacatcagggtcaccgtcatttcaccgggcgtgacgacctccgagctcgccgactccatctccgatccggtcgcgcgcgagggcatgcgcgaataccggcgggtggcgattccgccggaggccattgcgcggagcatcgccttcgccatcgagcaacccgacgacgtggacgtgaacgaaatcatcgtccgtcccaccgctcagtcctga

SEQ ID NO: 43004 - DNA, 606 bp, Myxococcus xanthus
atgaaactcttctactcccctggcgcctgttcgctgtcgccccacatcatcctgcgtgagggcggcttctccttcaccaccgagaaggtggacatccgcgccaagaagacggcggcgggcgaggacttccacgccatcaaccccaagggctatgtcccggcgctccagttggatgacggcagcctgctgaccgagggccccgccatcgtccagttcctcgccgaccaggtccccgacaagaagctggccccggccaacggcacgctggagcgctaccgcctccaggagatgctcaacttcatctccaccgagattcacaagggcttcagccccctgttcaacccggcgttcccggatgacgtcaagcggctgacgcgtgagcggctcgcgcagcgcctgggcgtgctggaggtggtggtggcgaagcaggcgttcctgctgggcgaccagttcaccgtggcggacgcgtacctcttcacgacgctcaactgggccgggcacaccaaggtggacctggagcccttccccgcgctgcgcgcctatcacgcccgcgtggcggaccggccctccgtgcaggaggccctgaaggcggaaggcctcgcgaag

SEQ ID NO: 43005 - DNA, 616 bp, Myxococcus xanthus
atggcctccaacactggtttcaccctctggctgaccggcatgtccggtaccgggaagagcaccaccgccgcctacatcgccgcgcgcttgcggcaggtgggtcgcaacgtcgagatcctcgacgagggtgaacttggcgaggcgctgtgggcggggctgggggatggcaaggaggaccgtatcaccgtcgtgaagcggctgggcttcgtggcgaacctgctgacgcgaaacggcgtggcggcgctggtaccctgcgtgagcccgtacaagccgggccgtgaggagaaccgccggtcgattggtcgctacgtggaagtctacgtcgactgcccgaccgagaagctcatcgagcgcgacagcacgggccgctacaagaaggcgctcaacggggagatccccaacttcatcggcatcaccgagccgtatgagccgcccaactcgccggaggtcaccatccactccaacgtggagtcggtggaggacggcgcggcgaagatcttccagtcgcttctggacctcggctacatgagcaccgaggagctgaaggtcatcaccggcaagaagatgaaggccaacccgctccccgcgaagggggagaaggctgagaaggccgaga

SEQ ID NO: 43006 - DNA, 579 bp, Myxococcus xanthus
cccgaggccctcttgcgggccgcagagaagggtgatgcggcgacggtctccgaactgctgcgccagggggtggccgtacacgcccgggactccgcgggcaacacgtcgctcttgctggcgactgacggcaaccacgtggctgccgcccgctccctcatcgaggcaggagcgaacgtgaacctccagaaccgccagctcgatagcgcctacctcctggctggagcgcgggggtacctggagatcctgcgcctgactttgaagaacggcgccgacctgaagagcaccaaccgctatggcggcactgcgctcattccggcctgtgaacgcggccatgtggaggtcgtgaaaacgttgctgcaagccggcgtcgatccgaaccacgtcaaccgcctgggctggactggactgctcgaggcgatcctgctcagcgacggcgggccacgtcaccaggcgatcgtacgtctcctgattgacggcggtgccgacgtcaacctggcggacggaaacggcgttacgccgctccagcacgcccgcgagcgcaagcaagacgcgattgccaagatgctcgtagccgccgga

SEQ ID NO: 43007 - DNA, 790 bp, Myxococcus xanthus
caggagattgtgggaggaatcgaggctcggcctcactccttcccgtggattgtcagcttgcagcagggcaccagccacttctgtggtggcgccctcgtgcgggtcggcgccaaggaagagagcgatatcgtcctcaccgctgcccattgtttctacgacggtacgtccaacgtcaccgcggtcgcaggggctcatgacctgtaccgccccaccgcgggacaagccacagcccgggtggtgagggcggtccttcacccgcaatacaatccggacacgacgatgaacgacatcgccgttctcaagctcgaccggcccatcaagttcgaccaggccgttgccggtgcctgcggtcagtcatccaccatgcgccccaatctggccgcgccagtacgcatctggaggcacccgcgcacctgtctgtctccctgccagcggggatcgggttgcagacaacacgatggcgaccgtcgcgggctggggcctgacacgggagggcgggtatgacacgtcctccctcttgctgcaggtgggggtccccaccctgaatcaccgggacgtggccaatagctatcgcccccatggaatcaccatcaacgagcaggcgatgttcggggctggttacaaggaaggaggcaaggacgcatgccaaggggacagcggaggacctctcatcgtaccggggccccaagggtacgtgctccagggaatcgtgagcttcggcgtgggctgcgcgagggcggggttgcccggcatctatacgcgggtctccaattacatcccgtggatcaac

SEQ ID NO: 43008 - DNA, 1098 bp, Myxococcus xanthus
agcggcaacaccagcctgggtgtggcgctctatcagcgcgccatccaggagaagcagaacctcttcttctcgccctacagcgtcacgcaggccctctccacggtctacgccggggcacgggggaacaccgaggcgcagatggcccaggcactgcgcttctccctgtcccagtcgaggcaccaccccacggcgaacgccttggagcgcgccctggcgaagcccgcgagccctcccccggcttcggggacaccgccgacctttcattccctgaactcggcatggggtcagcagggcatgaccttccatgacggattcctcgacaccctggcccggcattacggcgccggcatgcgtctgatggacttcgagaacgacgcggccggtgcgcgcgcggaaatcaaccgctgggtcgaggtgaacacgagagaccgcatccaggacctggtcaatgaagagtccctcccgaacgcgacgcgcttgatgctcatcaacgccgtctatttcaaaggcgcgtggtcgtggccgttccgcgagcaaggaacgcggaacgcggccttccgggccctggatggaacgagccaccaggtcccgacgatgagcggcggcagggggcagtacatggagggggatggcttcgaagccgtcaccctggactatgccggaggcaccttccgcatggtgctcgtcgtcccggagtgggagcgcttcgaggaggtggaatcccggctgtctcccgctttcttcaaagacgtccgcgcacggctcgagaaccatcagatcgacatccagctgccgcgcttccagatcgagtccgagctccccctcatccccgcattgcaggcgctgggcatggaggacgcgttcacggagggcgctgacttttcggccatctcccccacgaagctcaggattgcgaccgtgaatcacaaggcgttcgtggccgtgaacgagcttgggacggaggccgccgccgcgactgccgtgggaatggtccccgtgtcactgccaaagccgatccacgtcaatcggccgttcatcttcgtcatcgaacacgtggcgacgcagaacgtgctgttcctggggcggttcgtgaagcct

SEQ ID NO: 43009 - DNA, 1062 bp, Myxococcus xanthus
ttcgacagcagcgatgacctggacagcgccctggacgggaaggactacgcctacgcccgaatcagcgcgcccaacaccacgttgctggaggaggcggtggccgcgctggaaggcgccgaggactgtgtggcctatgccagcggcatggccgcgctgcgctccgtcttcgaggcccagggcttccgggccggtgacaagctggtgatgccggcggatggctacggcgtcacgcgcgcgctgtacaagagtctgtgcgccacgctgggcgtggagctgcatgcgttcctgatgacggaccccgaggtgcccgagcgcatccgagcgctgaagccgcgcatggtgctggcggagagtatctccaatccgctgctgcgcgtgcccgacctgcgcgtgctggcgcgggcctgccaggacgtgggcgcgacgttcgtggtggatggcaccttcccgtcgcccgtgggacagcgcgcgttggcgctgggcgcggactacgcggtgcagtccaccagcaagtggctcaacgggcacagcgacgcgctgggcggcacggtgagcgcctcgcgtgagcggatggcgccactgcgcgccgcgcgggtgctggcgggggacgtgctggggcccttcgaggcgtggctcaccctgcgcggcctgcgcacgctgccggtgcgcatgaaggcgcatgtcgagcacgcggcgcatgtggcgcggcgcctcatggagtcgcccctgttggagcgggtcatctacccggggctgacttcgcacccggaccacgccaccgcgcaggagctactgctgggcggcggccccatggtggcctttgaaatcaagggcgcggggcggccggagagcatgcgcttcctggaggcgttgaaggtggggcggcccggtccttcactgggggatgtgtgcacgttggtgatgcacgcggccagcgccagcgcgcgccggttcacaccggaggagcgggaggccgcgggcatccgggagaatctcatccgcgtctccgtggggttggaggacccagacgacatcgtggatgacctgctcgccgcggtggcc

SEQ ID NO: 43010 - DNA, 1311 bp, Myxococcus xanthus
  unsure (1)..(1311): unsure at all n locations
gtcgacacgcgggacatgtccaaggcgaacaacccctggccgcgcgcggagttcgtgaagcgcgcgcccggtctcgcctggaaggagttctttgacgccgcgggcctgggcacgcaggagcaggtcatcgtctggcagccgagcgcgctgacggtcctgtcgaagctcgcccagagcgagcccctgcaggcgtggaaggattacctggccttccacgcggtggctcgcgcggacccgtacctgcccaaggccttcgtcgacgagagcttcgccttcaacggcaagacgctgagcggaacgcccgcccagaaggagcgctggaagcgtggcgtggacgccaccaacctctccatgggcgaggcggtgggcaagctctacgtcgcgaagtacttcccgccggaggtgaaggcggaagcggaggccatggtccgcaacatcatcaccgcgttcgagaagcgcatcgacgcgctgacgtggatgtcgcccgagacgcggacccgcgccaaggagaaggtgggcacgctccaggcaagcatcggccacccggagaagtggcgtgactactcggggctcgacatcgtggccggtgacgcctacggcaacgccgagcgcgccgtccgcttcgagtaccagcgcaacgtcgccaagctgggtcagcccgtggaccggaaggagtggtacatggtcccgcagttggtgaacgcgctgaactcaccgcagcagaactccatcatcttcccggccgccatcctgcagccgcccttcttcgacgcgaacgcggacccggccgtcaactacggcggcatcggcgcggtcatcggtcacgaaatcgtccacagcttcgacgacgtgggcgccaagttcgacgcgcgcggcaagctggagaactggtggacgaaggaggacgaagcgaagttccaggccgcggggaaggccctggcggnccagtacaacgactaccgcccgctgccggacctgtctgtgaatggcgagctgacgctgggtgagaacatcgcggacatggcgggggtggcggtggcctatgacgcctaccagctctccctgggcggcaagcccgcgcctgtcatcgacagctacaccggtgaccagcgcttcttcctcggcttcggccaggtatggcgcgccaagtaccgcgagccgtacctgcgccgcatcatcatgacggacggccacgcgccgggcccgtaccggaccgccaccgttcgcaacctctatgcctggtatggcgcgttcgatgtcaagcccgggcagacgctgttcctgactcccgagcagcgcgtccgcatctgg

SEQ ID NO: 43011 - DNA, 1044 bp, Myxococcus xanthus
ctcatcggtgccactggactcgccggacagcaattcatcgccgccctgaagaatcacccctccatcgaactgacggggctcgcggcctcgcctcgctcggcgggcaagacgtatgcggaggcgctgaaaacggcgagtggcatgacggcctggttcgtcccggagccgctgcccgccgagctcgccggcatgaaggtggtggccggtgacgcgctcgaggccaaggattacgacctggtcttctccgccgtggaggcggacgtggcacgcgagctggagcctcggctggcgaaggacatccccgtcttttccgccgccagcgcgttccgatacgaagacgacgtcccgttgctgattccccccgtcaacgccgcgcacgcgcccctcatccgggagcagcagcgccggcgtggctggaagggcttcatcgtccccatccccaactgcacgaccaccggcctggcggtgacgctggcgccgctggtggagcgcttcggggtgaaggcggtgctgatgaccagcctccaggccatgtccggcgccggccgctcgccgggcgtcatcggcatggacatcctcgacaacgtcatcccctatattcccaaggaggagcacaaggtcgaggtggagacgaagaagattctcggcgcgctgcgtccagcgggtgacggcctcacgccgcatgacgttcgggtgtcctgcacctgcacccgcgtggcggtgatggagggccacaccgagtccgtcttcgtctcattggacaagaaggcgactgtggccgaagtgacccagaccctgcgggagtggaagggtgccgagctggctcggaacctgccgtccgccgcaccgcgttggattgaagtgctggacgatcctttccgaccccagccccgtttggaccgggacacgcatggcggtatggccaccaccgtcggacgcatccgcgaggatggcgtcctggagaacggcttcaagtacgtgctggtgtcgcacaacaccaagatgggagccgcgcgaggcgccatcctcgtggccgagctgctg

SEQ ID NO: 43012 - DNA, 1131 bp, Myxococcus xanthus
ctgtacctggaagagcatgacgcgtttcgtcgcaccgtacgtgcggtggtggagaaggagattctccccttcgtgaaggagtgggaggcccgggaggcgttcccccgggagctcttcacccgctttggcgagctgggcttcctcggcctgaagtatccggtggagtacgggggctcggcggcgggggagctgtatgaggcggtgttgctggaggagctggggcgctgtggctcgggcggtgtgtccgcggggctgggggcccagttcaccatctccacggggcccatccatcagttcggcacggacgcgcagaagctccgctggctggcccccgccatccggggcgagaagattggcgcgctgggcatcaccgaaccggacgcgggctcggacgtggcggggctgcgcaccaccgctcggcgcgagggcgacagctacgtcctcaacggctccaagacgtacatcaccaacggtgtgcgcgcggacttcgtggtgctggcggtgaagacggatccgtccgcgggtcacaagggcctgtccatggtggtggtggagaagggcacgccaggcttctccgtgggacgcaagctggacaagctcggctggcgcgcctcagacaccgcggagctgttcttcgaggactgccgcgtgcccgcggagaacctgctcggcgtggaagggcagggcttcgcgcagatcatgggcaacttccagtgggagcgcctgtcgctcgcgctgggggcggtgggggccatggagcacatgctggagacggtgctggcgcaggtgaagtcacggcgtgccttcggccagtcgctccaccagttccaggtggtgcgccacaagctggcggagctcttcaccgcgcgcgagtcggcgcgccagctcacctaccacgcgctgcgcctgcacgtggccggtgagtgggcggtggcgcagacgtccatggcgaagaaggtggccaccgagacgtgctgccgcgtggcggatgagtgtctccaactccatggcggcgcgggctacatgatggagtacgacatccagcgccactggcgtgacgcacggctggggcccatcggcggtggcaccagcgaggtgatgaacgaaatcatcgccaagcagctcggactg

SEQ ID NO: 43013 - DNA, 789 bp, Myxococcus xanthus
ctgcgggtgcttcgcgtggagcggcccgaaggcactcgcgtgcgagtgggccccgtggaagtcggaggccccgggttcgtcgtaatggctggcccctgcgcggtggaaggcgcggagcaggtgcagcacgccgcctcggtggtggccgccgcgggtgcccatgtcctgcgcggtggcgtattcaagcctcgcaccagtccctacgcattccagggcatgggtgagccgggcctgcacgtcctggcggaggccgggcgccgccacggcatgcccatcatcagtgaggtgatggagtcggcgcagattcccctcatggaggagtccacggacatcctccaggtgggtgcgcgcaacatgcagaactactcgctgcttcgggcgctggggaaggtgcgcaagcccgtgctgctcaaacgaggcctgtcggccacgttgcaggagtggctgctggccgccgagtacatcctcgacggcggcaacgaacaggtgatgctgtgcgagcgcggcatccgcaccttcgagacggagctgcgcaacacgctggacctggcggcggtggcctgggcgaagcagcgctcccacctgcccgtcatcgtcgacccgtcccatgcgacgggcgacccggcgctcatcctccccatgtcgctggcggccgcggccgcgggggcggacggattgttgattgaagtccacccgaagcccgagcaggccatgtgcgatgggcaccaggccctgacgcctgaacgcttcgagacgttgatgcggcggctgccagccgtgctagacgcg

SEQ ID NO: 43014 - DNA, 1002 bp, Myxococcus xanthus
aataccttcggcgaactgtttcgcctgacgacgtttggagagagccacgggcccgctctcggcgccatcctggatggctgccccgccggcgtgcccctgacgcgcgagcagattcaagtcgcgctggaccgtcggcgccccggccagtccaccatcaccaccgcgcgcagcgaaccggaccaggtggagctcctgtccggcgtcttcgaggacaagacgctggggacgcccatcgccgccatcgtgcgcaacaccaaccagcgctcgggggactacgagaagctgaaggccgaggaccggcccggccacgcggacgccgtgtggcgcgagcgcttcaagcaccgtgaccaccgcggcggcgggcgcaccagcgggcgcgagacgctctgccgcgtcatcggcggcgccatcgccgaggcgtacctcgcccgtgacgtgccttccatccgcaccgtcgcctacgtgtcccaggtgggcaacctggtggccgccgtgcccgcgccgggactcacccgcgagcaggtggacgcccacgccacgcgctgcccggacgtcgccatccgcgacgagatgtcccggcgcatcctcaccgcgaaggaggcgggcgacagcctgggcggcgccattgacgtgcgcgtggagggcctgcccgtgggtctgggcgagcccatcttcggcaagctcaaggcgcgcatcgcgcaggccctgggcagcatcggcgccgtcacgggcgtcgtctggggtccgccggacctgctcgagcgcattggccagcccggcatccagttccacgccgtgaaggacgcatacggcggcatccagggcgggctcgccaacggtgagccgatgcagattcgcaccttcttcaagccgcccgcgacgctgcaggagcatgcgaagggcggccgtcacgacccgtgcatcatgccccgggcagtcccggtgctggaggccatggtgtcgctcgtcatcgccgacctcgtcctccacttcaacgcgagg

SEQ ID NO: 43015 - DNA, 909 bp, Myxococcus xanthus
ctgatgattcaggtcgaagggctgaccaaatactacggtgagcatgcggcgatccgggagctggccttcaccatcagccagggagaagtcattggctttctgggcctcaatggcgctggaaaatcgacgacgctgaaggtcctggggtgcgtgctgatgccgacctcggggcgtgtcgtcatcgacggccatgacgtggtgagcaatgcccacgaggtccgccagcgcatcggctacctgccggacgtgcctccgctctatgacgagatgacggtgggcgaatacctgacctacgtcgcacagcttcgcggcgtcacgtcccgggacaccgccagccgcgtgggcgaggccgaggagaagacgggcctgcgtgacgtccacggcgagctcatctccacgctcagtcacggctaccgccagcgcgtaggcgtggcgcaggcgctggtgcacaagcccgccctgctcatcctcgacgagcccaccagcgggctcgacccccggcagattgtcgagatgcgcgacgtcatccgcgggttgaagggcgcgcacacggtgctcgtctccagccacatcctcccggaaatctcccagacgtgtgaccggctgctcatcatccacaaggggatgttggtggcgcagggcacggaggaggagctggcggcgaagatgggcggccggggcaccatcgaactggaggtgcgcggcgacaaggcgcgcgcggtggaggtgctccagcgctttggctcggtggaggtggaccgcgcgtcggacggcttggtggcgctgacggtgcgggcctcgcccgaccagcggccccaggtggcgcaggcggtggtgggcgcgggtctggagttgttgcggctggaccagggagccggtcagctcgaatccatcttcttgcggctgaca

SEQ ID NO: 43016 - DNA, 1119 bp, Myxococcus xanthus
gagcaggccagcgcgcccaagtcccagttcctggccaacatgtcccatgagttccgcacgccgctcaacgccatcctcggctacacgaacatgctgctgcagggcgtgtccggcgaactgaacccggcgcagaagcggaacctcacgcgcatcgactccaacggcagacacctgctggaggtcatcaacgagattctggacatcacccgcatcgaagcgggccgcatgcccttgaacctgtcggacttcggcatcccggagctgctccaagaggtgatggcggagatggaccccatcatcgcgcgcagcaagctgacggtgagcgcccacctcggtccgcgcgtgccggcggtgtacagtgaccggcagaaggtgaaacaaatcgtcctcaatctcctgtcgaatgcgttgaagttcacgcacgaaggctcagtgcaggtgcaggcggagtacgtggctgctacgtccacgctcaccatctcggtgacggacacgggcattggcatcgacccagcgaaccaggaaaaaatcttcgaggacttccagcaggtggacagctctccgacccgggcctatggaggcacgggtctggggctctccatctgccgtcgcctggccaccatgctgggggggcgcgtcaccctccagagcacccagggcgagggttcgacattcaccctgcactttcccagacgcgcgaggcgcgcatgatgaacccatctgagaccccgaagcccctcgtgctggtcgttgacgactatcaagatgcccgggagatgtacgccgagtacctggagttctcgggcttccgcgtcgccgaggccaagaacggccaggaggcgctggacaaggccttcgagctgcggcccgacatcatcctcatggacctgtcgctgcccatcatggacggctgggaggcgacacggcgactgaagggcgacgaccgcacgcgggccatccccgtggtggcgctcacgggccatgcgatgacggggcagtccgacgaagccaagggcgcgggctgcgactccttcgtcaccaagccctgcctgccggacgcgctggtggatgaagtccgccgcgtgctcgccacccacggaggcgcatcggcgaggtgaa

SEQ ID NO: 43017 - DNA, 1425 bp, Myxococcus xanthus
atgcgaagagcgaagattgtctgcaccctcggtcccgccagccagagccaggagatgctcgaagcgctcctggagaacggcatggacgtggctcgcctgaacttctcccacggcagccacgagcagcacgcggagaacatcgcgaagctgcgcgccgcgtcgctgaaggttcgcaaggcggtgggcatcctcggcgacctgcaaggcccgaagattcgcactggccgtttcgtgaagggcagcaccgagctgaaggaaggcggcaccttccacatcaccacggatgaaacggtcccgggcacggacgaaatcgtgtccacgacgtacccgttcctggccgcggacgtgaatccgggggaccgcatcctcctggatgacggcctgctggagctgaaggtcctggagacggacaagcagaagctcatccgcacgcaggtcatccacggcggcacgctgaagaacaacaagggcatcaacctgcccggcgtggcggtgcgcgcggaggcgctgacgccgaaggaccgtgaggacctggtgttcgggatcaaggccggcgtggattacatcgcgctgtccttcgtgcgccagccgtccgacctggacaccgcgcgccaggccatggccgaggtgggccgcacggtgcccatcatcgccaagctggagaagccggaggccattgcccggctggacgccatcctggacaagacggacggcgtgatggtggcgcgcggcgacctgggcgtggagattccccccgaggaagtgccggccgtccagaaggacatcatccggcgctccaacctgcgcggcctgcccgtcatcgtggccacgcagatgctgaactccatgattgataacccgcgccccacgcgcgccgaggccagcgacgtggccaacgccgtgttcgacggcgcggacgcggtgatgctgtcgggcgagacggccagcggcaagttccccatcgagtccgtgcagatgatggagcgcatcatcctggcggccgagtcctccgcgcgcacgacgcagtcgctgatgcgcgtgctggagacgccggtggggctgcccaaccacttcccggacgtcatcgcgcgcgtggcctgcgaggcggccaaggcgagcaacgcctcgctcatcgcggccttcacgctgtcgggtgtgacggcgcgcctgctgtcgcactaccggcccccggtgccgattgtcgccttcagccccaaccaggaagtgcgccgccggctgtcgctgttgtggggcgtggtgccgcgcgtgctggagcccacccaggacaccgaggccatggtgaagcgcgtggaggaagagctcctggcgcgaggcctgggccgcaagggcgaccgcatcgtcatcgtgttcggcgcgcccgtggggcagccgggcaagatcaacagcctgcgcctgcacaccatc

SEQ ID NO: 43018 - DNA, 1251 bp, Myxococcus xanthus
ttccccgcggacttcaccttcggcgtcgcgaccgccgcgtaccaggtggagggcggcatcgagaacgactgggccgagtgggaacgcgccgggaagctgaaggagccggacgctcgctgcggccccgcggtggaccactggaaccgctacgaggaggactacgccctggcccgggcggtgggcgccaccgcgttccgcatctccctggagtgggcgcgcatcgagccggaacgcgggcgcttcgacgaggcggcgctggagtcctaccgggagcggctcctgaagatgaaggcccatggcctgcggccggtggtgacgctccaccacttcacgcaccccacctggttccaccgggagacaccgtggcaccagccggccagcgtggacgtcttccggcggtacgcgaagcggtgcgcggcgctgctggaggggctggacgcgctggtcatctccttcaacgagcccatggtgctgctgttgggggggtatctgcagggcgccattcctccgggcctcgcggatggccccaccaccatgcgggccatggagaacctggtgcgctcgcacgtggccgcccgggaggaactgttgtcccggctgggccgcgtggagctgggcatctcccagaacatgctcgccttcgcgccggaccggtggtggcaccccttggaccgtgcgctggtgaggctcggggcccaggcctacaaccatgcgttccacgaggcgctggccaccggcaagctgcgcgtcaccatgccgggcgtggcctccacccgcgtggacatccctggcgcgcgggactccgtggagttcatcggggtgaactactacacccgcgcgcacctgcgcttcgtgccgcgcccgcccttcatcgagttcaagtaccgggacatccacggccggggcctcaccgacatcgggtgggaggactggccggagggcttcctccagacgctgcgcgacgtgaagcgctacgggaagccggtgtggattacggagaacggcatcgatgaccgcgtcggcgtccgccggccccactacctccattcccacctggcccaggtgctggccgcgcgcgcgcagggcgtggacgtgcgcggctacctctattggagcctgctcgacaacttcgagtggctggagggctggggcccgcgcttcggcctctaccacgtcaacttcgacacgctccgccgcagccccacgcccgcgtgtgactacttccgcgccgtggccaccggacggaagctg

SEQ ID NO: 43019 - DNA, 768 bp, Myxococcus xanthus
cgcctcaactggctctcctccatccccttcttcgcagtccacctgatgtgcctgttcgtcttcgccgtcggcgcgaagccggtggacgtggccgtgtgcgtcggcctctacgtcgtgcgcatgtggggcatcaccgcgggcttccaccggtacttctcccaccgggccttcaagacgggacgcgtcttccagttcatcctcgccttcgtgggcagcatgtccgcgcagaagggcgtgctgtggtgggcggagcaccaccgccaccaccaccgctattcggaccaggcggaggacatccactcgcccctgcagaagggcttctggtggagccacgcggggtggattctctccgacaagtacaacgacacccgcatggagggcatcaaggacttcgcccgcttcccggagctggtgtggctcaaccgcttccacctggtgccgtccgtcctgctggccgtggcgctctacttcatcggaggcttctccatgctggtgtggggcttcttcgtcagcaccaccctgctgtggcacggcaccttcaccatcaactcgctcagccacatcttcggcaagcgccgctacaagacgacggacaccagccggaacaactggctgctggcgctcctcaccctgggcgaggggtggcacaacaaccaccacttccatcagaacaccgccaaccagggctggttctggtgggaggtggacctcagctactactcgctgaaggtgctctcctggttcaaggtggtggaggggctgcggctt

SEQ ID NO: 43020 - DNA, 1327 bp, Myxococcus xanthus
gtcgagaaacagcgagcccgtttcgagacccgtgccacgctgccgctggcgtggcgacgggagcagttgcaggtactcgaacgggcggcacgcaagtacgaggcggagattctcgccgccctgcagtcggacctctccaagagccccgaggaggcctacctcacggaggtgggcagcatctacggggagctgaaggacgcgctgaagaacgtgaaggcgtggatggcgccgcgcaagggggcggcgccgctcgccatccaacccgcgcgcgtctggcagtactcggacccgctgggcgtgacgctcatcatctccccgtggaactacccctatcagttggcgattgctccgctcatcggggcgctcgccgcgggctgtaccgccgtgctgaagcccagcgagttgtccccggcgacgtccgccgtgctcgcgcggatgctgaaagaagccttccccgaggatgtcgtcgccgtcgtggaaggcggcgcggaggagagccgcgccctgctcgacgagcgctgggacctcatcttcttcaccggcggtccccaggtgggccgggtggtggcggaagccgcggcgaagcacctgacgcccaccgtgctggagttgggcggcaagagcccctgcatcatcgacaagagcgcggacctggaagtcaccgcgcgccgcattgcctggggcaagtacctcaacgccgggcagacctgcatcgccccggactacgtgctcattccgcccgagctcaagggccgcttcacggagctggtccagaaggctgtcaccgacttctacggggcgaacacgcgtgagagccgcgactatggccgcatcatcagttcgcggcacttcgagcgcgtctcgaagctggcgcaggacgggaccgtagcctttggcggtgagcgggacgcggacagtcgcttcttcgcgcccaccgtcatcatcgatgcgccgctgtccagcccgctcatgcaggaggagattttcgggcccctgctgccggtggtggactgtccgagcatcgacgaggccatccgcttcgtccgcgcgaggccgaagccgctggcgctctacaccttctccaaggacgcggcggtcaacgagcgcgtcctcacggagacgtcgagcggcggcgcggtggccaacgatgtatgcgtccacttcgccgcgaaggacctgtctttcggaggcagtgccgcagtccggcagcggcggttatcacggccagcccagcttcgacgccttcagccaccgcaagggggtggtgaagcggcccttcctgctcgacctgaagctgcgctacccgccctacacggggaagctgggc

SEQ ID NO: 43021 - DNA, 1209 bp, Myxococcus xanthus
gtgagccaggaagcattcatcttcgacgccgtccggacccctcgcggcaagggcaggaaaggcgcgctgcacggcaccaagcccatcacgctgctcaccgggctggtggacgcgctcaagaagcgtcacccgaacctggacccccagcgcatcgacgacgtggtgctcggtgtcgtgtcgccggtgggtgagcagggcgccgacatcgcccgtaccctggtgctggcggcggggctgccagagactgtgggtggcgtgcagctcaaccgcttctgcgcgtccggcctcacggcggtgaacatggccgcccagcaggtgcgctcgggctgggagcacctggtcatcgcgggcggcgtggagagcatgtcgcgcgtgcccatgggctcggacggcggcgcctgggccatggacccggccacgaacttcgacacctacttcgtcccgcagggcatctccgcggacctcatcgccaccatcgagggcttcacgcgcgaggacgtggaccgctacgcggcccgttcgcagcaactggcggcccaggcgtgggccggcgggtacttcaagaactcggtcgtcccggtggtggaccagaacggcctcaccgtgctggaccatgacgaactcatgcgcccggactccaccgtggcgtcgctcggcaagctcaacccgtccttctccgtcatgggcgaggcgggcggcttcgacgcggtggccctgcagaagtaccacttcgtggagcgcatcgagcacgtccacacgccgggcaactcgtcgggcatcgtggacggcgcggcgctggtgctcatcggctccgagcaggtgggcaagtcgctgggcctcacgccgcgcgcgcgcatcgccgcggtggccacgtccggctcggaccccaccatcatgctcaccggcccgattccggccacccagaagctgctggagattgcgggcctgtcggtgaaggacatcgacctgttcgaactcaacgaggccttcgcctcggtggtgctcaagtaccagaaggacctcggcattccggacgagaagctgaacgtgaacggcggcgccatcgccatggggcacccgctgggcgccacgggcgcgatgattctggggacgatggtggacgagctggagcgacgcaaggcgcgccgcgcggtcatcaccttgtgcgtcggtggtggcatgggcgtggccaccctcatcgagcgcgtc

SEQ ID NO: 43022 - DNA, 1674 bp, Myxococcus xanthus
cgcgacctcaccgcgctggcgcgggagggaaagctaccggccgcacacggcgtggatgccgccgtgacggaggtgctgggcctgctcacgcggggcggcaagcatcccctgctggcgggtgagcccggcgtggggaagagcgccctggtacaggaggtggcccggcgcatcgccgaaggccgcgtggacgccgagctggcgaacgcacgggtggtggaggtgtccgtcgccaacatcctggcgcgcagcacccagcgccaggcggcggagagcttcgaggagctgctggcctacctctcccggcacccccgccccatcgtctacatccgggacctgcccgcggccctcggtggcccgctcgcgcccgtcgccgtgcgcggactgcgcaccggaggcctgcgcttcatcttcgagacagagcccaagcgcgtgcaggagctgcttcgctccgacgaggcgctggccgagcggctccacctgctgcccctgcacgagcctccgacggagaaggcccgctgggtgctgggccgcgtagcggaggaactggagcgcgagctgcggctgcccatcgacccggcggcgtgcgacctggcgttgcgcctgtcgtccaagttcctgctcgcgcagcgcatgccgcgcaaggccatcgagctgctgaaggagacagccgcggaggcggcgagcgcggccaaggaccatgtgggtcccgaggacgtactcacccgcttctgcgcggccacgcggctgcctcgcttcgtcgtcgacgacgcgatgccgttggacctcgatgagacagagcgcttcttcggcgagcggctgctgggacagacggacgcagtgggcgcggtattgcgctcggtggcgctgctcaaggccggcctcaacgatccgcgccgccccctgggcgtgttcctcttcgcgggtcccacgggcgtgggaaagacgcagttggccaagctgctggcggagtacctgttcggctcggcggacagactggtgcgcctcaacatggcggactaccccaacgacggtgacgagagcgtccccttcggtgccacctgggccccggcactggagacacggcggggagagctgagcgcgctgctggacggcaaggtgttcaccgtgctgctgctcgacgagttcgagaaggcggcgcgcagcgtccacgaccgcttcctccagctcttcgacgagggcacgttcgtcaacggggccggcgagacggtgtcgtgcaacaacacgctcatcgtcgccacgtccaacgtgggcgcggaggtgtatcgcgagtccggcatgggcttcacgggcgcgcgccgcgcggaggagatggtccccgaggtcgaccggcgaatcggagaggcgttccgcccggagttcctcaaccgcttcgacgccatctgccacttccggcccctgtccaaggtggacatccggaagattgcgcagcgcgaggttggccgcgtgctggagcgcgagggcatccgcgcgcgcgccctggacgtggaggtgacgcccgccgtggtggacctgctcgtggagcggggttactcgccccagttcggcgcgcgctacctgcagcgtgaaatcgagaagacgctcaccgcggcgctggccgtggagattgcgcgcaggccgctgcctccgggcacgcccgtccgcgtcgaggcccgc

SEQ ID NO: 43023 - DNA, 705 bp, Myxococcus xanthus
gccctcgaactccagggactctccaagcgttacggagagttcacggcacttcacaccgtggacctcgccatccgtcccggtgaaatcttcgccctgctgggccccaacggcgcgggcaagacgacgatgattggcagcgtctgcggcctggtgaagaagtcctccggcagcatccgcgtcttcggcaaggacctggaccaggacccggtgggtccgcgctacgacatcgggctggtgccgcaggaaatcaacttcgaccccttcttcaccgtggccgaatcgctgcgcatccagttgggcttctacggccgccccgcggatgaggcgcgcatcgacgaggtgctcaccgccctcaacctgcacgcgaagaaggacgcgtacacgcgcgcgctgtccggcggcatgaagcgccggctgctcatcgccaaggcgctggtgcacaagccccgcctcgtcttcctcgacgagcccaccgccggcgtggacgtggagctgcgccgtgacttgtggacctacgtgcgcaagctcgcctcagagggcaccaccatcgtcctcaccacgcactacctggaagaggccgaggagctggccgaccgcgtgggcatcatcaacgaaggccgcctcctcatggtggaggacaaggccaccctgctgcgccgcttcggcgagcgccgcgtcatcatcaccttcgagcagccgcagccc

SEQ ID NO: 43024 - DNA, 1377 bp, Myxococcus xanthus
ttttccgcgcttgcgctatctccccccctgctccaggtcctggaggagctggacttcaagacggccacgcccatccaggcgcagagcatcccggtgctgctccagggcagggacctggtcggccaggcgcagacgggcagcggcaagacggcggccttcgcgctgccgctgctccagaaggtccagttgcagcaccgcaaggtgcaggcgctggtgctgtgtccgacgcgagagctgtgcgcgcaggtggcgggcgagattcgcaggttggggcggcggctgcccgggctccaggtgctggtgctcgcgggaggccagcccatccgcccgcaactggaagcactggagaagggcgcgcacctggcggtgggaacgccgggccgggtgatggatgtgctggaccgcgaggcgctggagacgcggcagttatccacggtggtgctggacgaggcggaccggatgctggacatgggcttccgcgaggacatggagcgcatcctcggagccatgccgccgcggcggcagacggtgctcttctccgccaccttcccgccggacatcgaggcgttgagccgcgatttccagcgtcagcccgtccgcgtcacggtggaggccgccaccgcggggcccgacatccagcaggtgcgctacgactgcgagccgggagacaagcaggccctgctgctgcgcatcctccggcactaccagccggcgtccgccatcgtcttctgcaacctcaaggcaaccgtggtggagttgaagaagtcgctctccgcgtcgggcgtcagcgtggacgggctccagggggatttggagcagttcgagcgcgaccgggtgatggcgaagttccgcaaccagagcacgcgggtgctcatcgccacggacgtggcggggcgcggcatcgacgtggaggcgctggatgccgtcatcaacttcgacctgcccatgcaggccgagccctacgtgcaccgcatcggccgcacgggccgggcggggcgcgcgggcctggccgtctccatcgtcacgcctcgggatggccgcaaggtggacgacatccaactggccaccggcgtgaagctggagcgtggggacgtggagtcactgccctcggcggatcctcgcaacgcggtgtccctggagtccacgtgggacacgctctacatctccgccggacgcaaggacaagatgcggcccggggacatcctgggcgcgctcacgggcgaggcgggcgggctcgaagcgaccgacgtgggcaagattgaaatccaggaccacgtggcctacgtcgccgtcgcccggcgcgtgtcgcgggtggccttccagcggctgagtgaaggccgcatcaagggccgccggtacaaaatcgagcgcgtgaag

SEQ ID NO: 43025 - DNA, 606 bp, Myxococcus xanthus
atgaaggtgtacggcctcccgatgagcactgccacgcgttcggtcctcaccaccctggcggagaagggccaggaggcggaactcgtcgtcgtcgacctcacgaagggggagcagaagagccccgcgtacatggagcaccaccccttcggcgtcatccccgccttcgaggacgatgacggcttcaagctctacgagtcgcgcgccatcatccgctatctggaccgcaagctgccggggccctcgctgacgccgtccgacgtgcatgcgtacgcgcgcatggagcagttcatcagcgtggagcagtgttacttctcgccctccgcgatgaaggtcatctgggagcgcctcttcaagaaggtgatgggcggcggcacgccggacgaggcgcgcatcagcgagggcctgcagggcgtcgagcgcgtcttcggcatcatcgagccggtgctgggcaagcagcagtacctggcgggagacggcttctcgctcgccgaggtgacgtggatgccctacatggatttcttcgtcgccgcgggcggcgcggagctcgtcggtaagtacccgaacgtggcggcctggtgggagcgcgtccggagccgtccttcgtgg

SEQ ID NO: 43026 - DNA, 864 bp, Myxococcus xanthus
atccgcaagtgtgtcatcccggcagccggcctgggcacgcgcttcctgccggcgaccaaggcggttcccaaggagatgctgcctatcgtcgatactccgacgctccagtacatcgtggaagaggcggtatccgccggcatcgaggatgtcgtcctcatcaatggccgcggcaagggcgccatcgaggaccacttcgacatcggcttcgaactggagacgacgctgcgtgcgcgcggcaaggattccgaggccgacaagctgcgcgccatcgcggacctcgtgcgcgtcgtcagcatccgtcagaaggagcccaagggactgggccacgcggtgctgtgcgccaagagcgtcatcggcgacgagcccttcggcgtgctgctgggcgacgacatgattgatgccgaggagccgggaatccgccagctcgctcgcgtgtaccgccagtacaaccaggcggtcatcgcgctcatggaagtgccggagagtgagacgcacatgtacggcatcgccgcgggcacggacctgggtgatggcgtcatgcgcatcgaccgcatcgtggagaagccgaagaagggcactgcgccctccaacctcgccgtcatcggccgctacgtgctgccgcccgacatcttccccatcctggagaaccagacgccgggtgtgggcggcgaaatccagctcaccgacggcctggccacgctccagcagtcgaaggggctgctcggctaccgcttcaagggtcagcgctatgacgcgggcgacaaggtggggtacctgaaggccaacatcgcctacgcgctcaagcgtccggacctgcgtgccgggctgctcgagtacatgcgtgaagtcgtgaagacggagaag

SEQ ID NO: 43027 - DNA, 1743 bp, Myxococcus xanthus
ctccgagagttgctgaaggcctcgcggccctatcaccgcatgttgttgctcgccatggccgccacggtggtcagcagggcgatgcaggtgggctacgtggcactggtaggggtgctcacggattcgttgctctctccgcaccgggtgatgttgttcgggcggcgattgcccatcgggcggctcggactggggaaggtcgcggcggggttggtggcgctgatcgccggctgctcgttcttcgagtacgtctcccgaatcctctggatgcgcgccgcgcaccgcatcacccatgacctgcggctgcgtctgtacgagcatgtccagagccttgaattgaaggcgttcgccgacaccagccgcgggaactacctgaccctgctcaacgaggatctcaaccgaatcgagttgctcttctcctcgacgtggggcgtctggaacgaggtcgcctatgccacgtgcagcacggtgggcttcttcctggtcagccccgggttcgcgggcctggccgcagtgccgatgcccgccctgctgctcctggcgcagtcgctggagaagcgcatccgcccccggtacgccgcgctgcggcagcaggccggcgtgcttcagggcgtgctcaacaacaacatcgatgggattcccaccatccgcgccttcggcgccgagcggatggcggcccgatgggtggatgaggcgagcgtgggcttccggggggagcaggacgcggcgacccaaattcattcctcatacaacccggtggtgctcgccgcggcgaacacgctccgcatggtgaccgcgctggcggcggggttccatgcgtccagggggcatctcacgccgggcacctatgtctcgctggtcatcctgagcacctccttgtccctgccgatgctcagcgtggcccgcgactttccgcacatcttgtcgacgctggcctcgctcagccgtgtgttcaaggcctttgagctgccccgcgagcgccgggacgagggtgccgcgctggacgcgggcgccgttcgtggcgccatccgcgtggaggacgttcgcttcgggtatcacccgggcctgccggtgctcgacgggttctcggtggatatcccggcggggaagatgaccgccttcgtcggggagacgggttcgggcaagagcacgctcgccaagctcctgctgcgcttccatgatgcggacgcgggccacatcctgctggatgagcaggacatcgcggggctgcggcgaggcgacgtccggcgggccatcgcctatgtcgggcaggacatcttcctcttcaatggcagcatccgggacaacatcgccttcggcatgccggacgtggggctcgaggccatccaggaggccgctcagagggcgggggcgcatgaattcatcatgcagctaccccagggctatgcgtcgcacaccggcgagctgggtcagaagctctcgggtgggcagcgccagcgcatcggcattgcccgcgccctgctgctgcgcaggcccatcctcatccttgacgaggtgacctcctcgctggacgccgtgacggaggcccaactgttgcgcgcctggtccgaggtcctggcgggtcgcaccgtcatcgtcgtcgcccaccgcctgtcggcggtccgggacgcgcaccgaatccacgtgctcgaacgcggacggattgccgagtcgggctcgcacgaggagctccttggacgaggaggccgttacgcgcggtactgggacctccaggtcaaccagaag

SEQ ID NO: 43028 - DNA, 1425 bp, Myxococcus xanthus
gccaacacgcagcccaccgcggacaccgagcgcatccgcgcggtgttcgaagcccagcgcgcgcaccgctggacgatgtcccgcaccacggccgccgaacgcatcgcccggctgaagcggctgcgtgaagccatcatcgcccgccgcgcggagctggcggacgccatccacgcggacttccgcaagcccgcgatggaggtggacctgacggagctgcaccccacgctggaggagctgaaccacacggtgcggcacctcaagtcgtggatgaagcccatgcgggtgggcacgccgatgctgcttgcgggctcgtccagccacgtgcgctacgaggcgcgcggcacggtgttgctgctgtcgccgtggaactaccccttcaacctgctggtgtcgccgctggtggccgccatcgcagcgggcaacaccgtcatctgcaagcccagcgagaagacgccgcacacctcgcgcttcctggcgcagttggtgaaggacgtgtttcccgagaacgaagtggcgctgttcgaaggcggcgcggagacggcggaggcgctgctggagctgcccttcgaccacatcttcttcaccggcaacacgcgcatcggccgcaaggtgatggaggccgcggcgaagcacctggccagcgtgacgctggagctgggtggcaagtcgcccgtcatcgtcgatgagacggcggacgtcgccgccgctgccgagcgcctgtgctggggcaagttcgtcaacggcggccagacgtgcgtggcgccggactacgtgttcgtgcacgcgtcgaaggagcgggcgttcctggacgcgctcaaggcgtccatcacgcgcttctacggcggcaccgagcaggagcggcaggcgagccctgacctgacgcgactggtggacccggtggcgtggcggcgggtgaaggacctgctcaagcgctcggtggccgcgggagcgaaggtggaagtgggcggggagacggacgagccctcgcgctacatcgcgcccaccgtgctgtccggcgtgacggcggagaacccggtgatggagggcgagattttcgggccggtgctgccggtgctcaccttccagtcccgtgaagaggtctacgcgcacatccgcgcgggcgggaagcctttggccctctacgtgttcagccaggacaagcgggcggtggaagacatcttccagaacaccacgtcgggtggcgcggtggtgaacaacgtgctcgtccacctcgcgaaccccaacctcccgttcggcggggttggtaccagtggcctggggaactaccacggtcatttcggcttcaagacgttcagccatgagcgggcagtgatggttcagtggatgaagtcgctggcttcggtgttcttcccgccgtatcgcgggaaggcgcaggaattggcctcccgcgcgacccggctgatg

SEQ ID NO: 43029 - DNA, 1341 bp, Myxococcus xanthus
gcgcgccgcggcatgaaggaacggctggcccggctggagcagttcaagacgctgctcgtcgcccggcgcgaggccctggccgaggcgctccacgccgacttccgcaagccgcgcgcggaggtggaggccaccgaggtcctccccgtcctgatggagttggcctccatccagaagcacctcaagacgtggatgaagccccggaaggtctccacgcccctgctgctcaccggcacgtccagcctggtgcagtacgagccccggggcgtggtgctggtgatggccccgtggaactaccccttccacctgctggtgtcgccgctggtcgccgcggtggccgcgggcaacgccgtcctgtgcaagcccagcgagaagacgcccaacacggcgcgcttcatcgcggagctggtgaaggatgtctttcccccagaagaggtcgcggtggtggagggaggcccggaggtgggcgaggcgctgctgcggcttcccttcgaccacatcttcttcaccggtggggcccgcgtgggccggcgggtgatggaggccgcggcgaagcacctggccagcgtgacgttggagctgggtggcaagtcacccgtcatcgtcgatgagacggcggatgtcgccgccgctgccgagcgcgtggtgtggggcaagttcctcaacggcggacagacgtgcatcgcccccgaccacgtctgggtccacgcgtcgaaggaagaggccctgctggaggcgatgaaggaggccctggagcgcttctacggccgcaccgaggaggcgcgtcgcgcgagcctggacctgtgccgcatggtggatgacagcgccttcacgcgggtgcgccagttgatggaccgcaccgtgcaggccggcgcgcgcgtggtggtgggtggtggcgtgggcgcggagtcgcgttacatcgcgcccacggtgctcgcggacgtgacgccagacacgcccatcatggccgaggagattttcggaccggtgctgccggtgctgcgcttcgagtccctggacgaagtcgtgtcgcacgtgcgcgaggacggcaagcccctggcgctctacgtgttcagcaacgacgaggccacggtggagcggctgctgcgggagactcgcgcgggcggcacgtgcatcaacacggtggtgctgcacaatgtgaatccgaacctgcccttcggcggcgtgggcgccagcggtgtgggcgcgtatcacggcgagacgggcttccggaccttcagccacgagcgcgcggtgctgcgccaggggcgcacgtccctggtccacctgttcttcccgcccttcacgggcaaggcgcagaagctggcgcggctggcggggcgg

SEQ ID NO: 43030 - DNA, 1684 bp, Myxococcus xanthus
atgattcgtctcgacaacatcagcaagcagaacggccagcagattctcttcatcgaggcctccgcggcgctccacaagggggagaaggtgggcctcgtcggacccaacggggccggcaagacgacgctgttccggatgattaccagccaggagcaccccgacgagggccaggtcgccgtcgaccggggcgtcaccattggctacttcagccaggacgtgggtgagatggagggccgcagcgccgccgccgaggtgatggacggcgcgggcccggtcagcacggtggccgccgagctgaaggagctggaggccgccatggccgacccggaccaggcggacaacatggacaagctcgtggagcgctacggcctggtccaggggcgcttcgaggagctgggtggctacgcgctggaaggccgcgcgcgggagattctcgcgggcctgggcttcacccaggagatgatggacggcgacgtgggcgcgctgtcgggtggttggaagatgcgcgtggcgctggcccgcatcctcctgatgcgtccggacgcgatgctgctcgacgagccgagcaaccatctcgacatcgagagcctcatctggctggaggagttcctcaagaactacgacggcgcgctgctgatgacgtcgcacgaccgcgagttcatgaaccgcatcgtgaacaaggtggtggagatcgacggcggctcgctgtcgacgtacaccggcaactacgagttctacgagcagcagcgggcgatgaacgagaagcagcagcaggcgcagttcgagcgccagcaggccatgctcgccaaggagctgaagttcatcgagcgcttcaaggcgcgcgcctcgcacgccgcgcaggtgcagagccgggtgaagaagctggagaagattgagcgcgtggagccgcccaagcggcgtcagacggtgctcttcgagttccagccggcgccgcgctcgggcgacgacgtggtgagcctgaagggcgttcacaaggcctacggctcgcggaccatctacgaggggctggacttcctggtgcgccgcacggagcgctgggccgtcatgggcgtcaacggcgcgggcaagtccacgctgctgaagctggtgacgggctccacgcagccggacacgggcaacgtggcgctgggtggcagcgtgaagatgggttacttcgcgcagcacgccatggacctgctggacggcgagcggaccgtgttccaggcgctggaggacgccttcccccgcgcgggtcagggctcgctgcgggcgctggccggctgcttcggcttctccggcgacgaggtggagaagaagtgccgcgtgctgtccggtggtgagaaggcccggctcgtcatggcgaagatgctcttcgacccgccgaacttcctggtgctggacgagcccaccaaccacctggacatggccacgaaggagatgctgattacggcgctctcccgctacgaggggacgatgctgttcgtctcccacgaccgtcacttcctggccgcgctgtccaaccgcgtgctggagctgacgcccgagggcatccaccagtacggcggcggctacacggagtacgtcgcgcgcaccggccaggaagcgcccggtctgcggagctgaagcaccgcaaggggcccggcgtccgccgggcacgtcgcgcttcacggcggctcagcgctcc

SEQ ID NO: 43031 - DNA, 1677 bp, Myxococcus xanthus
  unsure (1)..(1677): unsure at all n locations
aagaagctggtcaacgcccctcgcgcggtggtgcgggagatgctggaggggttggtctcgctcgcccccgggcaggtgctgctggacggggagtcggtggtgctccgcgccgacacgccttccgacgtccgcgcgcgcaaggtggctgtcatctccggtggcggcagcggccatgagccggcgcacgcgggctacgtgggcgcgggcatgctggacgcggcggtggccggtgacgtcttcacctcgcccagcaccgatgccgtgctggccgccatccgcgccgtcgcggggcccgcgggcgcgctgctcgtcgtgaagaactacaccggggaccggctcaacttcgggctcgccgccgagctggcgcgcgccgagggcatccccgtggagacggtggtggtggcggacgacgtgtccctgcacgacacggtggagcccgcgcggcgccggggcatcgctggcacggtgctggtccacaaggtcgcgggcgcggcggccgaggcgggcgcggcgctccaggacgtcctccgcgaggccaccgcggcggcggaggtgctgggcaccatgggcgtggccctggggccctgcaccgtgcccgcggcgggcaagccgggcttcacgctggaggaggacgaaatcgagctgggcctgggcatccacggcgagcagggcgtgcggcgcgtgccgatgcagacggcggacagcctggtggacacgctgctcaccaccatcgtcgaggaccggcgcatcacctcgggagacagggtggtgctggtggtcaacggattgggcggcacgccgcccatggagctggccatcgtcgcccggcgcgcactggccgctctgcgtcagggcggcatccgcgtggagcgcgcgtggagcgggacgttcctctccgcgctggagatgcccggctgctcgttgacgctgctgaaggtggacgacgcgcggctggcccgcctggatgcggcggtggatgcgcccgcgtggcccggcgcgggacggctgccgaaggagccgggggtgtaccggccttcgtccacggcgtctccagcatcgcttccggcggaggcgccgcaaccggggatggaccgcttccggaaggccgccttgcgggtggcggacgcattcgagcagtcggagccccggctgaccgcgctcgatagcgccgcgggcgacggtgacctgggcctcagtctggtgcgtggcgccgaggcgattcgcgctcttccggaggacgcgtggacgagccccgcgcgtgcgctgacggccattggcaatgccttgcggcgcagcattggcggcagctcggggcccttctacgcgacggcgctgctgcgcgccgcgcgcaggctggcggaagggcccgtggatgccgccgcatgggccgaggccttcgacctcgccgtcaccgccgtatcggagctgggcggcgcgcggcctggggaccgcaccatgctcgatgcactccggcccgccgccgacgccttcgcgaaggcggtgcgttgcgggcagggggctcgagaggcttgggcatcggcggtgcacgcgnccgaggcggaagaggaggcgacgtcccggatgcagccgcgcctgggacgcgccagctacctgggtgcgcgcgccgtcggtgtgccggacgcgggcgccgcggccgtggtggtgtggatgaaggcg

SEQ ID NO: 43032 - DNA, 816 bp, Myxococcus xanthus
cgcatcttcaagtatcagggcctgggcaatgacttcgtcgtgctggaccggcgcggctccggcgaggacatcgacgccgccacgtcgcggtggatgtgcgaccggcgcctgggcattggcggggacggggtgctggcgctgctgccctccgagcgtggcattgcccgcatggtcgtgcacaacgccgacggcagcatcgcggagatgtgtggcaacggactgcgctgcgcggtgaagttcctggtggatgattcgggccagacgccaggccacatcaacgtggagaccggggcgggcgtgctcacctgctacccctcgtatggcgagggcggcgtggtggccgtggacatctccatggggcccgcccggctggtggcccccaacctgccttcgggcgccacggggcagccctttctggatgccttggtgccgggccatccgcccctgcgcgcctacgcggtgagcatgggcaatccccacatggtcctcctggaccagccgctggaggatgcctcgcgcctggggcccctgctggagcaccacccgtcctttccggaccgcaccaacgtggagttcgtccgtgtggactcggacggcctcaccgtggtggtctgggagcgaggctgcggcctcacccaggcctgtgggacgggcgcctgcgcgtccgccgtggccgccgtgctggccaaacggctcccggccgatgcctggctgcgcgtcaccctgccagggggagacctgagcatccgcgtccccgccgacctgtccgacatccgcctccgtggaccggtggccttcgtcttcgagggcgttgtc

SEQ ID NO: 43033 - DNA, 771 bp, Myxococcus xanthus
gtctccatgctgctccaaggcaagaagctgctcatcaccggggtgctcacgcctcagtccctggcctacggcatcgccgagcacgcgctggctcagggggccgaggtcctcctcaccggcttcggtcgggccaagtccctcaccgagcggagcgccaagcgcctcaagccgggaatggaggtgctggaattggacgtcaccaactccgcccacttccccgcactcacggacgccctgcgccaacggtgggaccgggtggacggcgtgttgcattccattgcctttgcgcccgaagatgctttgggtggcaactttctcaacaccccgtgggagagcgttcagacggcgttccgcatctccacgttctcgctgaaggagctgtcggtggcgtgcctgccgctgatgacgcaggggggctccatcgtcacgctggacttcgacaaccgcgtcgcctggcccatctacgactggatgggggtgtgcaaggcggccctggagtccacggtgcgctacctggcgcgcgacctgggccccaagggcatccgcgtcaacgccctggccgccggtcccctgtccaccatcgccgcgaagggcattccaggcttcaaggccctggagcgtggctgggggcagcaggcccccctgggctggagcgcgaaggacagccacgacatggtggcccgcaccgcgtgtgccctgctgtcggattggctgccctccaccaccggcgaaatgatccacgtggacggtggctaccacgccattggcgcg

SEQ ID NO: 43034 - DNA, 2842 bp, Myxococcus xanthus
ctttccggcgccaacatcgatttcatcgagggcctctacgcccgttatctggaggaccccgccagcgtggatgcaagctggcgggaggtcttcgaccgcagcaacggcgccggacgacccatcttcagcacccggctgctggagccagtagcggctccagcggcggccaagggaggcggcaagggcgccgcgcccaaggcccaggtcgcgccggcgccgcagcccgccccggtggccgctcccggccagtccgtccaggacatctcgctgcaggcgcgcgtggaccacgtcatcttcgcgttccgcctgcgcggccacctgcgcgcgaagctggatccgctcggccgtccgcgcccggcgctggcgcacgtggcggatgtggccctggtggatgacagccacttcaccgacgccgaggcccagcagctcgtggagaccaatggcgtgttcggcgagcagcgcgtgcgcctgacggagctgctggcgcgcctgcgccgcacgtacacggacaccatcggcgtcgagtacatgcacatgctcgacagcgagcgccgccgctggctgatgcaccggatggagtccaacgagaaccgcaccgacttctccccggacgagtgccggcacatcctcaccaagctgtcgtacgcggagggcttcgagcacttcctccacaccaagtacgtgggcgccaagcgcttcagcctggacggcggcgaggcgctcatccccatgctggacgcgctgggcgaagtggccaccggcatgggcctgagggagatcgtcatcggcatggcccaccgcggccgcctcaacgtgctgacgaacatcctgggcaagcagccggatcagatcttcagcgagttcgacggtccccggaacccgcaggactacctgggccgcggcgacgtgaagtaccacatgggcttctcgtcggaccacaccacgcgccagggccgcaagctgcacctgtcgctggccttcaaccccagccacctggaagcggtggacccggtggtggagggccgcgtgcgcgccaagcaggaccgcggcggcgacaccgagcgcaccagcgtgatgccgctgctcatccacggcgacgcggccttcatcggccagggcgtggtggcggagacgctcaacctgtccggcctcaagggctacaccacgggcggcacggtccacgtcgtcatcaacaaccaggtcggcttcaccaccgacccgcacgactcgcgctcgtcgctctactccaccgccatcgcgcagatgctggacatccccgtcttccatgtgaacggggatgatccggaggcctgcgtccacatcgcgaagctggtggccgagtaccgccagacgttcaagtcggacgtcgtcatcgacctggtctgctaccgccgctacggccacaacgaaggtgacgagccctcgttcacgcagccggcgatgtacgacatcatccgcaagcacccgacggtgcgcacgctctacgcggcgaagctggcggagcagaacaagattccggctgaggagtcggaggccatcaagcagcgctgccagcaggagttcgacgcggcgctcacccgcgcgcgccaggagagccagttcaaggaacccagcgcgctggaaggcctgtggaagccctaccagggcggcgcgctgaagagcgcgccggacgtatccaccgcggtggacaagcaggtgctgtgtgatgcgctgcgcaagctgtccacgctgccggagggattcaacgtccaccgcgacgtggagcgcaccgtcatcaagaagcgcctgggcatgctggacagcggcgagctgcagtggagcgagggcgagtcgctggcctacgccacgctgctctccgagggctacaacatccgcatcaccggccaggactgcgagcgcggcaccttcagccaccgccacgcggtggtgcacgacgtgaagacgggcgagaagttcgtcccgctgcgccagttcatcagcggcacgggcaggaacggcttccacatctacaacagcccgctgtcggagatgggcgtgctcggcttcgagtacggctacagcctggacgtgccggacggtctgacggcctgcgcaagcgcagttcggcgacttccgcaacggcgcgcagatcatcatcgaccagttcatcgccgccggtgagagcaagtggcgccgtctcagcggcctcaccctgctgttgccgcacggctacgaaggccagggcccggagcactccagcgcgcgtctggagcgcttcctggacctgtgcgccgaggacaacatccaggtctgctaccccacgacgcccgcgcagatcttccacctgctgcgccgccaggtgctgcgcccggtgcgcaagccgctggtcatcatgtcgcccaagagcctgctgcgccggccggaggccaccagcaaggtggaggagctggccacgggcaccttccaggaagtcatcctggaccgggtggacccggcgggcgtgacgcggctgctgctgtgcagcggcaaggtgtactacgacctggtgaaggcgcgggacgagcgcaaggacgagagcatcgccatcgtccggctggagcagctctacccgttcgcctccgacgtgctggcggggctcatcgcgaagatgccgaagctcgccgagctcctgtgggtgcaggaagagccgcgcaacgctggcgcgtggcacttcatgttcccccgcctgcacgacctggcctccacgcagtcgaagcagcaggtgaagatcggctacatcggtcgcgccgaagccgccagccccgccacgggcttccccaagacgcacgaatacgagcagcagctcatcatcgaggaagccatc

SEQ ID NO: 43035 - DNA, 1194 bp, Myxococcus xanthus
atggccgttgaaatcaaagtgccccccctgggcgaatccatcaccgaagccgtcgtcggcaagtggaacaagaagccgggtgacgccgtcaccgccgacgagccgctcgtcgtcctggagaccgacaaggtcaccatcgacgtgccggccccgtccgctggctcgctgtccagcatcgccttcaaggagggcgacaaggtccgcgtgggcgaggtgctcggcctcctcgaggcaggcgccggcgctcccgccgccaggcccgccgccgctccggctccggccgccgcgcccgctcccgccgccgaggtgcccgcggcgtccgacgcgcgctccacgcccaccgcgcgcaaggtggccgaggagaaccggctggacatctcccaggtgaagggcagcggcgccggtggccgcgtgcacaaggacgacgtgctgggtcagctcaaccgcccggccacgcccgccgccccggcgcagcccgccggcccccgcccgaacgccgcccgcgaggagcgcgtgcggatgacgccgctgcgcaagcgcgtggccgagcgcctcatccaggcccagtccaccgccgccatgctcaccaccttcaacgaggtggacatgggcgaggtgatggccctgcgcaagaagtacaacgacaagttccagcagaagcacggcgtgaagctcggcttcatgagcttcttcatccgtgcctccgtcgaggccctcaaggccttcccgcaaatcaacgcggagattgacggtgaggacgtcatcttcaagcactactacgacatcggcgtggccgtcagcggcagccgcggtctggtggtgccggtggtgcgcaacgcggacaagcagggcctggcggagctggagaagtccgtgggcgagctgggcaccaaggcgcgcaatgacaagctggccctggccgacctccagggtggcaccttcaccatcaccaacggcggcatcttcggctccatgctgtccacgcccatcctcaacccgccgcagacgggcatcctgggcatgcacaacatcgtcgaacgccccgtggcccgcgacggccaggtcgtgattcggcccatcatgtacatcgcgctcacctacgaccaccggctggtcgacggccgcgaggccgttcagttcctggtgcgcgtgaaggagtgcatcgaggacccggagcggctgctcctggacgtc

SEQ ID NO: 43036 - DNA, 1971 bp, Myxococcus xanthus
cgcatctcccccgacgagaagagcatcctcttcctgcgcacccagcccacgtccaacgtgcagacgctctacgcgttcgacgtggagagcgggcagacgcaggagctactcacccccgaggccatcctcaagggcgccgaggagacgctcacccccgaggagaaggaccgtcgtgagcgcatgcgcgtcagcgcccggggcttcaccagctatcaggtgtccgaggacggcaatcggctgctggtgcccctgtccggccgcctctacgtggtggaccgcgccagcggcaaggtgacggagctgaagacgggcccgggcacgttggatccgcgcttctccccggacggcaagcaggtgtcctacgtgcgggaacacgacgtgtaccgcatcgacgtggccgccaaccgcgagcagcgcgtcaccaagggcggcaccgaggcgaagtcgcacggcgtggccgagttcgtcgcccaggaggagatggggcgcttcaccggctactggtggagcccggacgcgaagtccatcgcgtacacggaggcggacacgacggaggtggagaagctcaccatcgtcgacgtgatgcaccccgagcgcggcggcgaggacttcgcgtacccgcgccccggcaaggccaacgccaaggtgcgcctgggcatcacccccgtcaccggtgggaaaaccgtgtgggcgcagtgggatgcggcgaagtacccgtacctggccaccgtgacgtggcccaagggcggtccgctcaccgcgctggtgcagaaccgggagcagaccgagcagaagctgctcgcggtggacccgcgcacgggcaagtcgcgggagctgctgacggagcaggacgccgcctggctcaacctggagcaggtcttcccgctgtggctggaggatggcagcggcttcctctggtacacggagcgcaacggcggcccggaggtggagctgcgcaaggcggacggcgcgctggtgcgcaccctggtgaagccggacgcgggcttccgctcgctggcgcgctacatccagaaggatgacacgctctacttcaacggcggccccaaccccacgcagagccacctgtggcgcgtgaaggccggtggcgcgccggagaaggtgacgacggggctcgacatcgagtcgggctcggtgtccaagagcggcgggctgatggtgatgaatggccagggcctcaagtccatgcccaaggtgcaggtggtgcgcggcgacggaaccaccgtgggcgagctgccctcggtggcgaaggagccgccctacacgcccaacgtggagcagcggcaggtgggccccgagcgcttctggacgtccctggtgcgcccgcgcgacttcaagcccggcaagaagctgcccgtcatcgtcgaggtgtacggcggccccaccaccaccgtggtccacaagagcatggccgcgcacctgatgtcgcagtgggtggcggaccagggcttcctcgtggtgaagattgacggccgcggcaccccgctgcgcggcgcgaagtgggagcgcgaggtgaagggcgacttctccggcgtcacgctggaggaccaggtcgccgcgctccaggcgctggccaaggaagtcccggagctggatttgtcccgcgtgggcatctccggctggagcttcggcgggtacatgtccgcgctggccgtgctcaagcgcccggacgtcttcaaggccggcgtggccggcgccccggtggtggactggctggactacgacacccactacaccgagcgctacctgggcgtgccgcagcagagcccggaggcctacgagaagagctcgctgctcacgtacgcgaagcaggacaagcccatgggcaagctgctgctcatccacggcaccgcggacgacaacgtctacttcttccacacgctgaagttgagcgacgcgctcttccgcgccgggaagccgcatgacctgctgccgctgagcggcctgacgcac

SEQ ID NO: 43037 - DNA, 882 bp, Myxococcus xanthus
gtccgaggccgcttcgcccccagccccaccgggcgcatgcacctgggaaacatccgcagcgcgctgctcggctggctccaggcgagggcggcccacggccgcttcctgctgcgcatcgaggacctggaccgcgcgcgctgcaagccgcagtacgtggacgacctgctgcgcgacatggaatggctggggctggactgggacgagcagcccgtcttccagagccagcgggacggcctctaccgcgacgcccaggcccggttggaacaagcagggcgcgtgtatccctgcttctgcacacgcgcggagattgcacgggccgccagcgcgcctcacggactctccgacgaaggcccccgctacccgggcacctgcgcgcacctcacccgcgaacagatttccgagcgcgcccgcacgcgcccccccgcgtaccgcttccgcgcggtccccggcgaggtccgcttcgtggacggcttgcagggctcgtactcgcaagacgtggacgcggtggtgggcgacttcgtcgtgcggcgcaacgacggcgtggccagctaccagctcgcggtggtggtggacgatgcggccacggacatcacccacgtgctgcgcggggatgacctgctctcctccacgccccggcagctccagctctacgccgcgctcagcctgcgcgcgcccgacttcctccacgtcccgctggtgctgggcgaagacggcaagcgtctcgccaagcgcgagggtgccttcgcgctcgcggagttgcgtgagcgtggcgtggctcccgagcgggtgctgggcctgctcgcctcatggagtggatggggagacggtggccccctgacgctcgccgaactggtgcacagcttccgtcccgaaagactgccg

SEQ ID NO: 43038 - DNA, 1494 bp, Myxococcus xanthus
atgccgaaggcgaagtacgtcctggccctggaccagggcaccactggaacgcacgtctccatcctcgacacgaagctgcaggtggtcggccgctcctacaaggagttcacccagcacttccccaagccgtcctgggtggagcacgacctggatgaaatctgggccagcagtgaatggtgtatcgcccgggcgctgaagagcgcgggccttcgcggcaaggacatcgccgccatcggcatcaccaaccagcgcgagacgacgggcctgtggatgcgcggcagcggacagccgttgtcccacgccatcgtctggcaggaccgccgcaccgccgagcagtgccgccggctcaaggagcagggcgtggagccgcgcgtgcgcgaggtgacggggctggtggtggacccgtacttctccggcaccaagctcacgtggatgttcgaccacctgaagggcgcgcgcgcgaaggcggagaagggcgacgtgtgcttcggcaccatcgacacctggctcgtctacaagctcaccggcggcgcggcgcacgtcaccgacgtgtccaacgccagccgcacgttgctcatggatttgacgacgctccagtggagcgacgagatgcgcgccatgctgtccgtcccggccgcgtgcctgccgcagattcgcggctccgcggaggtgtacggcaccacgcgtggcatgcgcagcctgccggacggcatccccgtggcgggcatggcgggagaccagcaggccgcgctcttcggccaggcgtgcttcgagcccggcgaatccaagtgcacctatggcaccggcgccttcctgctgatgaacaccggctcggagccggtgcgctcgtcggcgggcctgctcactaccgtagcgtggcggctgggcgggacgggcaccaccacgtacgcgctggagggcagcagcttcatcgccggcgcggcggtgcagtggatgcgcgacgggctcaaggtcatcaagcgcgcgccggacatcgaagcgctggccgccagcgtgaaggactccggggacgtggtcttcgtgcccgcgctggccggcctgggcgcgccacactggcggcccgaggcgcgcggcctcttcgctggcatcgaccgctccaccaccgtggcccacatggcgcgcgcggtgctggagggcatcgcgctgcagattcatgacctggcggaggccatgcgccgcgacagcgggcgggacatccccgtgttcaaggcggacggcggcgcggcggccaacaacctcctcatgcagttccaggcggatgtgctgggcgtgccgctggtgcgcccgcgcaacctggagacgacgagcctgggcgcggcgttcctcggcggcctgggcgcgggcatctgggacagcccggaggccatccgccgcgcatggaaggcggagaagacgttcaagccgaagatgaagccggatgcccgcgagcgacacctggccaagtggaagcgggccgtggagcgcgcgtgagac

SEQ ID NO: 43039 - DNA, 741 bp, Myxococcus xanthus
gctctcatcacggggggaagccgtggactggggcggaacatggcgctcaagctggcggcccggggcaccggcatcatcctgacgtaccgcaccggcgcggacgaagcggcggcggtcgtgaagcagattgaagcagcaggcggcaaggcggtggcgctcccgctcgacgtgggggacacgcggggcttcggcgccttcgtggaagcggtgcggacggagctgggccgtcacttcgggcgcgagcggctggacttcctggtgaacaacgcgggcatgggcatccaagtcagcttcgcggagacgaccgaggcccagttcgacgcgctgatgaacgtccacctcaaggggacgttcttcctcacgcagcggctgttgccggtgctggcggatggggggcgcatcctgaacatctcctccgggctcgcgcgcttcaccttccctggccacgccgcctacgcgaccatgaaggcgggcgtggaggcgctcacccggtacctcgcgaaggagctgggggcccggaggatttccgtcaacgtgctcgcgccgggcgcgaccgcgacggacttcgggggcggcgtcgtccgtgacaacccggagctgaacaagacgctggccgcccaggttgcgctcggccgtgtgggtcagcccgacgacatcggggatgcggtcgccatgctgctgtcgccggagagcgcgtgggtgacgggccagcgcatcgaggcctcgggcgggatgatgctc

SEQ ID NO: 43040 - DNA, 735 bp, Myxococcus xanthus
gtcgaggagcaggcggagtcggtggcgccggcgaccatcgagcaggacatcgtcggtggcaccaccacgaccatcaatgagaatccgtggcaggtgtccctgcggtacggcggccactggtgcggtggctccatcctcaacaaggattggattctgaccgcggcgcactgtgtggatggctacgccgtcaccagcatcgtggcgggctccacctcgagcacgagcacgagcacgggccagacgcgcaacgtggcgcagaccatcattcatgaagattacggcgcttccggcaacgacgttgccctgctccgtctggccacgtcgctggacctcaatggcaccaccgtcgcggccattccccgcatctcggcggcggatgccgcgagcggcgccaccgacccggccgtggtcgcgcgcgtgacgggctggggtgcgacctcctccggtggttcggggtccgccaccctgcgcacggtggacgtcaacgtgatttcgaacacggaggcgcagcaaagctaccccaatgagtacattggcccggatcagattggcgccaaggcgccgggcaaggactcgtgccagggcgacagcggtggtccgctcaccgtcaatcacaatggcacccgcaagctcgcgggcgtcgtgagctggggctacggctgcgccgacgcgcgctacccgggtatgtacgcgcgcgtgtcgtacttcgagagctggatcgactccaagctcagt

SEQ ID NO: 43041 - DNA, 495 bp, Myxococcus xanthus
ctgcgtttgctcatggaccgcgcccccacgcccatcggctcgatgctggtcgtctgtgacgaagcgggcagcctgcgcgcgctcgactgggaggagtacgagccccggatgctccggctgctgcggctccactacggcgtgaacggctacgtgctcgagcccgcgagcgaccccttcggcaggacgaccgcgatgcagacctatctgcgcggagacgtcagcgtcatcgactcgttgcccgtggccaccgcgggtacgccattccagcgagaagtctggcgcgcgctgcgtgacatccccgcgggcgccaccacgagctacggccaactggcccagcgaatcggccgccccaaggccgtgcgcgccgtggggatggccaacggcgccaacccgattggcgtggtggtcccctgccaccgggtggtgggggccaacgcctcgctgacgggctacggcggtggactggagcgcaagcagtggctgctcgaccacgag

SEQ ID NO: 43042 - DNA, 1326 bp, Myxococcus xanthus
ttcaagaaggtgctgatcgccaaccgcggggagattgccctgcgggtcatccgcgcctgccgggagttgggcatcgccacggtcgcggtgcactccacggcggacgccaacgcgctccatgtccgcttcgcagacgaggcggtgtgcatcggcccgccggcgtccaaggagagctacctcaacgtcccgcagctgctgtccgcctccgaaatcacccgcgcggacgccatccacccgggctacggcttcctgtcggagaacgccgagttcgcggaggtctgcgagaactgcaagattcgcttcattggcccccggccggagatgctccggctgatgggcaacaaggtgcgcgcccgccaggccgcgcgcgaggcgggactgccgctgcttccgggcagccccggcaccgtgaaggacccgcgtgaggcggaggccttcgcccgcgagattggcttccccgtcatcctcaaggcggccgctggtggcggcggcaaggggatgaagatcgtccgcgagccgggcgcgctggcgcaggccttctccaccgcccaggcggaggccgtggcgtcgttctccaatggcgacctctacatcgagcgctatgtggagaagccgcgccacatcgaaatccagatcgtcgcggacgagcacggcaacatcgtccacctcaacgagcgtgagtgctcggtgcagcgccgacaccagaagctcattgaagagagtccgtcgccggcgctgacgccggagctgcgcaagcgcatgggcgaggtgtccgtgaacgccatgcgcaggctcgcgtacaacaacgtgggcaccatcgagtacctgctcgacgagcgcggcgagttctacttcatggagatgaacacgcgcatccaggtggagcacccggtgacggagctcgtcacgggcgtggacctggtgagcgagcagatccgcctggcctatggggagcccctgcgcttcacgcaggaggacgtccagattcgtggccacgccatcgagtgccgggtgaacgccgaggacccgattaccttcgccccctggcccgggaagattaccggctacagcgtgccgggcggctacggggtgcgcgtggactcgggcgcctacgagaactacacggtgctgccgtactacgacagcctcctgtcgaagctcatcgtccacgcggaggaccgggctacggccatccgccgcatgcagcgcgccctgggcgaatacgtcgtggaaggcatccgcaccaacatcccgttccaccgggccgcgctcgcggaagagtccttccaggagggcaattacgacacccgtttcgtggagcgcttg

SEQ ID NO: 43043 - DNA, 495 bp, Myxococcus xanthus
gtcctgatttccgaggacaagttgcaggcgcgcgtgcgcgagctcgcggcggagattacgcgcgactacgcgggcaaggacctgacgctcatctgcgtgttgaagggctcggcgtttttcgccatcgacctggcgaagtacatcgacctgccggtgaagttggagttcctgggcgtctccagctaccagggcggcacggagtccacgggcgaggtgcgcatcaccaccgacgtcagcaagccgatggctggcaagcacctgctcatcatcgaggacatcatcgacaccgggctcaccatgcagttcctgctggagaacctgcgcgctcggcaccccgcgtcgctgaaggtgtgcacgctgctggagaagccctcgcgcgcccggacgaaggtggacatcgactacaagggcttcgtcatcgatgacctcttcgtcgtgggctacgggctcgactttggcgaggtgtaccggaacatccccttcatcggggtgatg

SEQ ID NO: 43044 - DNA, 933 bp, Myxococcus xanthus
gacttcaaggtgttcgccgggaactcgaatcccggcctggcgcatcgcatctgcgagtacctcaagcgccctctgggcaaggcggaggtcggtcggttctcggacggggagattcacgtcgagatcggcgagaacgtccgcggccacgacgtcttcatcctccagtcgacctgcccgcctgcgaacgatcacctgatggagttgctcatcatgtgtgacgcgctcaagcgggcgagcgccggctccatcaccgccgtcattccgtactacgggtacgcccgtcaggaccggaaggtggcgccgcgtacgcccatcaccgcgaagctcatcgcggacctgctggagtccgcgggcgccgggcgcgtggtgtccatggacatgcacgcggggcagatccagggcttcttcaacatcccctcggaccacctctacggctcgccggtgttcctggaagacctgcgcaagcgcttcccggagtcgcaggagctggtcatcgtctcgccggacgccggcggtgtggagcgcgcccgcgcgtactccaagcggctgaacacgggcctggccatcatcgacaagcgccgtccccgccccaacgcgtcggaggtgatgaacctcatcggcgacgtgagcggcaaggacgcggtgctggtggacgacatggtggacaccgccggcacgctcgcccaggcggccgcggcgctgaaggccaagggcgcacggcgcgtggtggcatacgcggtccaccccatcctctccggcccggccatccagcgcatccaggactcggtgctggaagaggtcgtcttcacggacaccgtgccgctgtccccggcggcgcaggcctgctcgaagatccgcctgctcaccaccgagcgcctcttcggcgaggccattgcccgcatccaccgcgcagactcgctcagctcgctgttc

SEQ ID NO: 43045 - DNA, 1644 bp, Myxococcus xanthus
tgccggaggtctccgccgatgctgctcgcgagcgcgagggaagaagccccctggagtcccaccctcttgcattgcctgcgtcaccgcgcgagcactcagcccgacgccatcgcctatacgttcgtgggcgacgacgcatcggacgagacgcgcatctcgtaccgggagttggaccgtcgcgcgcgcgccatcgcggcctcccttcagcggatggatgcggcgggcgagcgggccatcctcctctaccctccggggctggactacgtggccgccttcctgggctgcctctacgccaacgtcatcgccgttccggcctacccgcccgacatcagccgcctcaaccgctcactgccgcggctccaggcgatcctcaccgatgcccgggcatccatcgtgctcaccaccgagatgattctctcgctggtcgactcgctggaagagcaggcgtcgcagctgagggaccgccgctggctggccaccgacctcctggaggcgggctgcgaggacggctggcgagaacccgaagtcacggggcagacgctggccttcctccagtacacctccgggtccaccggcacgcccaagggggtcatgctcacgcacggcaacctggtgcacaactcgcacctgattggcctgggcatggagctccgcgaggggtccgtagcggtgaactggctgccgccctatcacgacatggggctcatcggcggcatcctccagccgctctacaacggctttcacggcgtgctgctgtcccccatcaccttcctgcaacgaccgctgagttggctccaagccatcgagcggcaccgcggcacctgcgcgggcggtcccaacttcgccttcgacctctgcgtgcggaagacccgcccggaggagcgcgagcagttggacctgcgcacgtggcaggtggcgttctgtggcgccgaacccatccggcccgagacgctggcccgcttcgcccgcgccttcgaacccgcgggcttccggcccgagttcttctatccgtgttacgggctggccgaggccacgttgatcgccgcgggcggcgtcaaggcggaaccggtgcggacgggccacttcgacgcgcgggcgctccagcacggccagggcgccccccgggacgagggcaccgggcaggacacggtgacgctcgtcagcagcggcacccagcttcccacccagtcgctcgtggtggtggatccccaggcgcgcacgctccaggccgacggagaggtgggggagatttggatgtccgggcccagcgtggcccagggctattggggacgccccgaggagacggagcgggtgttccaggcccgcctggcgcgaggcgaagggcccttcctgcgcaccggggacctgggcttcctccgtgacggccagctcttcgtcacgggccgggccaaggacctcatcatcatccgtggccggaaccactatccccaggacctcgaacagaccaccgagcagagccaccccgcgatccgccccggatgcagtgccgcgttctccgtggatgtggacggagaagagcacctggccgtggcgttcgaggtctccgcccgccaggaggtttcgcccgacgacgtggccacgagcgtccagcaggccatcgccgaacaccaccagctcggtgtc

SEQ ID NO: 43046 - DNA, 1873 bp, Myxococcus xanthus
gccatgccgagtcccagccgttccgtacagaccctgaccgacctgctgcgctggcgcgcctcgaaccagaccgaggcccgcgcatatacgttcctccaggatggcgaaggccaggagaccacctggacctatggcgatttggatcgccaggcccgcgccattgccgcggcgctccaggagcacaagggcgctggcgagcgagcgctgctgctgtatccaccggggctcgagtacatcgcggcgttcttcggcagcctgtacgcgggcgtggccgcggtgccagcctatcctcccgcgcagctacaggccgtcacgcgcatcctctccatcctccaggatgcgaagccacgcttcgcgctcaccacgcacgaaatcctggagagcgtgaacgcactggcggaggcctaccccgtcctgaaggacatccgctggattgcgacggacgcgctggaggatgggctggaggatggctggaagcgccccgccatcaccggcgacacgctggccttcctccagtacacgtcaggctccacgtcgacgcccaagggcgtgatggtgctgcaccggaacctgatgtccaacgaggagatgatccggcagggcttcagccacgacgacccgccgacgatatgcggctggctgccgctgtaccacgacatgggactcatcggcacggtgctccagccgatgtacctgggatcgcactccatcgtgatgtccccgtggtccttcctgcagcgccccatccgctggctgaacaccatcacgaagtaccgtgcgacgacgagcggcgggcccaacttcgcctacgcgctctgcacgcgaaaggtgaagccggagaagctcgcttcgctagacctgagttcgtggcgcgtcgccttcaatggcgcggagcccgtgcgggcggagacgctggtggagttcgcggacaccttcgcgcccgccggcttccgccgggaggccttctatccctgctatggcctcgcggaggcgacgctcttcgtgtcgggaggcatcacctccgagttgccacgccacctcaccgtggattcggcggcgctcgagcagaaccgcgccgtggccgcccagccgggcccgtccgcgcgaacgctcgtcagctccgggcggagctggggtgacagcctcatccgcatcgtgaatccagagacgctggtggcgtgcgcaccgggcgaggtgggcgaaatctggacggccggtccccacgtcactcacggctactggggacgcgaggagacgaacgcagagaccttccaggcgcgcatccagggcagcgaggaaggtcccttcctgcgtaccggcgatttgggcttcatgattgacggcgatctgtatgtcaccggccgcatcaaggacctcatcatcgtcgacggtcggaaccactacccgcaggacctcgagctgacggccgagagccagcacccggcgctgcgccctggctgctcggtggcgttctccgtcgaccacccggagggcgagcggctggtggtgctggtggaggtcagcgcccgcttcgctccatccgaacagggtgatggcgcccagtccctgaacgggagcgcgctccagaagaccatccggcaggccgtggccgccgcgcactccgtggacgtccatgaggtcgtcctgctccagcagggcgaggtcctcaagacgtccagcggcaaggtccagcggcgcgcctgccgggcgaagtacgtggagggcagcctccagcgctgggccgcgtagtccgtcccgcgcggcatgttgaagcaggccctcgctacctgcgaggtccgagcacgatgatcgccatccccaggatggcgacgagcgcgcccacgaggtcccacgtcgtgggtcgctccccttc

SEQ ID NO: 43047 - DNA, 945 bp, Myxococcus xanthus
atggacgccgacatcacgcatgtcctgctggtcggaggtacggggcgttttggcggcaggttggcgtcggcgctgctggcgcgtcccggcatccacttgcatgtgttggtacgtccgggcacgcgcagcgacgcgctggtgcgtctggcggagcatggggtgacgttggtgagcgggacgctggatgacatgcgctcgctcgattcggccttggagggcgtggatgcggtggtctccgccgtgagcggaccacccgaggtgcaagtggcagggcaactccggttgctggactccgcgcggcggcatggcgtcatccgcttcatcccttcggactactcgctggactacaccgacgcggacgcgggtgacgccttcatggatgcgcaccgccgtgtcgcggacgccgtggtgaagagcggcgtgccgcactccttcgtcctctgcggcgcgttcatggagacggcgctgtcgccgcaggcgcaggtgttcgactttgagcgcggcgttgtctcgtactggggcacgggggacgagcccttcgacgtcaccgcgatggcggatgcggcgcgttgggtggcggaggtggtggtggatcctcacgccgcgggccggcggctggagttcgtgggggacgtggcgacggtgaatgacgtggccgccctgtacgaagcgctgaccggtcagcgcctgcgccgcctgtgcagggggagtgtggaggaccttcgccggcagctcgtgcgcgcacggcccgaaggcgtgtccgttcaggtgtcttcagcggagctgagtctgctctcgcagcttgcggggaaggggagactgcgcgaaccggcaaatgccgagtacccgcggctccggcccatgacgctgcgcgacttccttgaagcacggtggatggtgtcgacatccgcgcgggcgacgttgccactcgcttcacagccgtag

SEQ ID NO: 43048 - DNA, 1176 bp, Myxococcus xanthus
cgcatcgtcggctacttcaccgcgtggggcatctacgcgcgcaactaccacgtgtccaacgtgcagccgtccaagctcacgcacatcaactacgcgttctccaacatctccggggatggacgctgcatcctcggcgacccgttcgcggacatcgacaagagcggcggctggcagggtgagtgggaccccggtcagttgcgcggcaacttccgcgcgttcaaggagatgaagcggcagaacccgcacctgaagctgctcatctccgtgggcggctggtcctggtccacgcacttctccaccgtggcgtcctcgcctgcttcgcgcgcggccttcgtgaagtcctgcgtggacctctacatccgtggccagtaccccggtgtggaccccgtcaacggcgagggcgtgttcgacggcatcgacatcgactgggagtacccggtcggcggcggcctgccaggcaacagcaacagcccggctgacaagcagaactacacgctgctgatgcaggagttccgcagtcagctcaacgccgtcaccacgcagacgggcaagccgtacctgctcaccatcgccacgggcgcgtcgccggacctgctggagaacaagcaggagacgaagaagctgtccgacgtgctcgattggatcaacgtgatgtcctacgactaccacggggccttcgagagcacggtgaacttccactcggcgctccatcgcgtcacgggtgacccgggcgcggccacgggcttctacacggatggctcggtgtcgaagatgctggcgctgggcgtgccgcccgcgaagattgtcgtcggcgtgcccttctacggccggggttggggcagcgtgcccaacgtgaacaacggcctgttccagagtggtgtgcccacgcgcggcacctgggatgacggctcgtcgggtctgacgggtgtgttcgacttcaaggacatcaaggccaactacgagcgccccggttccggttacacgaagttcttccacccggaggcgaaggaggcctacgtctacaaccctgccacgggcatctggattgggtatgacgacgtgcagagcatcaacgccaaggcggactacatcctgaacaagaacctgggcggcgcgatgttctgggagttgagcggtgatgacggctcgctgctcgatgcgctggcacggaagctg

SEQ ID NO: 43049 - DNA, 768 bp, Myxococcus xanthus
gtgcgagtcgtttcgtggaacgtgaacggacttcgctcggtgcaccgcaagggcttcctgccctggctcgcggggtgccgggcgcaagtcgttggtctgcaggaggtccgcgcgcgcgccgaccagcttcccgacgatgtgcgctcaccgtcccggtggaagacgcacttcgtggcggcggagcggccgggctacagcggcgtcggactgtacagccgcctggagcccgatgaagtcgtgacggtgctcggcgtgggggagctggacgtcgaagggcgcctgcagattgcccgcttcggcaagctcaccgtggtgaacggctactttcccaacggcaacgggaaggaccgggacctgagccgcatcccctacaagctgaccttctaccggcgcctcttcgagcggctggagaagcccctgcgcgatggtggccgggtgctggtgatgggggacttcaacacagcgcatcaagaaatcgacctggcgcggcccaaggagaaccgggagacgagcggcttccggcccgaggagcgcgaggagttcgaccggtggattcgtgccggctgggtggacaccttccgccacttcaacaagggtggggggaactattcgtggtggagtcagcgggccggcgttcgggagaagaatatcggctggagaatcgactatgtcctggcctcgccagcggccatggcctacgtgcgcaaggctggcatccacccggacgtgctcggctcggaccactgtccggtgagcgtggacctggac

SEQ ID NO: 43050 - DNA, 921 bp, Myxococcus xanthus
ccgatggcgtatccgcagttcttcgagatgtaccggaacgccatcaagaacacctggaccgtggaggaggtggacttctccacggacctggtggacctgcgctcgaagatgacggacgcggagcgccacctcatccaccggctggtggcgttcttcgcgacgggtgacagcatcgtcggcaacaacctggtgctgaacctctacaagcacctgaacgcccctgaggcgcggatgtacctgtcgcgccagctctacgaggaggcgctgcacgtccagttctacctgacgctgctggacacctacgtgccggacccggcggagcgggcgatggccttcgcggccgtcgacaacatcccctccatccagcgcaaggcgcagttctgcatgaagtggatggacagcatccaggggctggacacgctgcagacgaaggcgcaccggcggcagttcctgctgaacctcatctgcttcgcgggctgcattgagggcctcttcttcttcgcagccttcgcctacgtgtacttcctgcgcagcaagggcctgttgaacggcctggcggcgggtaccaactgggtgttccgggacgagagcgcccacatggcgttcgcgttcgaatccatccaggtggcacgcaaggaagagccggacctcttcgacgcacagatggagcgcgacgtggtggccatgctccgcgaggccgtggagtgcgagacgcagttcgcccaggacctgctgagcggcggtgtcatgggcctgtccgtacaggacatgcgcggctacctggagtacgtggcggaccagcggctccagatgctgggcatgacgccggtgttcggcacgaagaacccgctgcacttcatggacctgcaggacgtgcaggagctcacgaacttcttcgagcgccgcgtgtcgtcgtaccag

SEQ ID NO: 43051 - DNA, 2352 bp, Myxococcus xanthus
atgcgggtgcgtaagcgcaacggcggcacggagacggtggacctcaacaagattgtgcgcgccgtgggccgctcctgcgtgggcctgccccgcgtggacgcgatgcgcgtggccaccaagacgatctccggcctgtatgacggcgcgacgacgcgcgagctggacagcctctccatccagacggccgccgccctcatcgtcgaagagcccgagtacggccgcctctccgcgcgcctgctggccaccttcatccagaaggaagtcagcaaccaggacatccactccttcagccagtcggtggccgcgggccacaagcacgggctcatcgcggaccggctgctccagttcgtccaggccaacgcgcgcaagctcaacgcggccatcgacccgtcgcgcaacgacctcttcgagtacttcggcctgcgcaccgtctacgaccggtacctgctgaagaacccgcagacgcgtgaggtgctggagacgccgcaggagttcttcctccgcgtggccagcgcgctcagcggcgacaatgtgaatgaggccatcgagctgtaccggctgttcagctcgctggagtacctgcccagctcccccaccctgttcaactcgggcacgcgccacgagcagctttcgagctgcttcctgctggactcgcccgcggacgagctggacgccatctacaagaagtattcggacatcgcgatgctgtcgaagttctccggcggcatcggcgtggcgtaccaccgggtgcgcgcacgcggctcgctcatcaagtccaccaacgggcactccaacggcatcgtcccctggctgaagacgctggacgcctccgtggcggcggtgaaccagggcggcaagcgcaagggcgcgtgctgcgtgtacctggagacgtggcacgcggacatcgaggacttcctcgagctgcgtgagaacaccggcgacgacgcgcgccgcacgcacaacctgaacctggccaactgggtgccggacctcttcatgaagcgcgtggaggcggacggcgactggagcctgttcgacccgaagtccgtcccccacttcacggacctgtacggcgacgccttcgagcaggcctacgcgaaggccgaggccgacggcctggccatgcgcaaggtgaaggcgcgtgacctctacgcccggatgatgaagagcctggcgcagacgggtaacggctggatgaccttcaaggacatcagcaaccgcaagagcaaccagacgggcaaggcgggcaacgtcatccacctgtccaacctgtgcaccgaaatcctggaggtgacgagccagggtgagacggcggtgtgcaatctgggctcgctgaacctgagccggatgctggtggacgggaagttcgacttcgagcggctgcgcgccaacgcccagctcgcgatgcggcagctcgaccgcgtcatcgacctgaactactaccccatccccacggcggcttcgtccaacaagcgctggcgcccggtgggcctgggcctgatggggctccaggacgtcttcttccagctcaagctggccttcgactcggcggaggcgcgtgcgctctccaagaagatttcggaggagatctacttcgcggcgctgaccacgtcctgcgagctggccgagcagtacggcgcccacgagtccttcgcggagacgcgggcggccaagggcgagctccagttcgaccactggggcgtggtgcccgaggacacggcgcgctgggacgcgctgcgccagcgcatcatgaagcacggcctgcgcaactcgctgatgattgccattgcccccacggcgacgattgcgtccatcgtgggctgctacgagtgcatcgagccgcaggtgtccaacctgttcaagcgcgagacgctgtcgggtgacttcctccaggtgaaccgctacctggtgcgcgacctccaggcgctcgggctgtggaacgagaacatccgcaaccgcatcaagatggcggaaggcagcgttcaggacattacggagctgccggagaacctgcgcgcggtgtaccgcacggcgtgggagctgccgatgcgctcgctgctggacatgggcgcggaccgcggggcgttcatcgaccagagccagtcgctcaacctcttcgtcgagacgccgaacatcgggaagctgtcctcgatgtacttctacgcgtggcagaagggcctgaagaccacgtactacctgcgctcgcgtccggcgacgcggattgccaaggccacggtgggcgcgggtggtggcgccagcgtggcgcaggcggcccctgctccggtggcgaaggcgaccgaggccgaggcggtggcctgctcgctggagaacccggaggcgtgcgaggcctgc

SEQ ID NO: 43052 - DNA, 1293 bp, Myxococcus xanthus
atgcgtattgccatcatcggaaccggctacgtcggactggtcgcgggcacctgtttcgcggactcgggtaacgacgtcacgtgcgtggacatcgacgagcggaagatccgcatgctccaggcgggcgaggtgcccatctacgagcccggcctggaggagctcatcaagaagaacgtgcgcgagaagcgcctgttcttcacccgggacctgacggaggccgtcaccaacgcccaggtcgtcttcatcgccgtgggcacgccggaaggtgagagcggcgacaccgacctccagtacgtgctggccgccgccgagcagattggcaaggcgatgaagcagtacacggtggtggtggacaagagcaccgtgccggtgggcaccgcggacaaggtgcgcgaggccatccgcaaggtgacggacatcgagttcgacgtcgtctccaacccggagttcctcaaggaaggcgccgcgctggacgacttcctcaagcccgaccgcgtcgtcattggcgtggactccgagcgcgcccgcaaggtgatggcggacctgtactcgccctttgtgcgcaccgagaacccggtgttgttcatggacacgcgctcggcggagctgacgaagtacgcggccaacgcgatgctggccacgcgcatctccttcatgaacgacatcgccgcgctctgcgagaaggtgggtgcggacgtggacttcgtgcgcaagggcctggggtcggacaagcgcatcggctatccgttcctcttcccgggcgtgggctacggcggctcctgcttccccaaggacgtgaaggcgctggtggccaccgcgcgtgactacggcctggagctggacctgctgcgcgcggtggagcgcaccaacgagcgccagaagaagctgctggtgaccaaggcggccaagcactacggctcgctggagggccgcaagttcggcgtgtggggtctggccttcaagccgaagacggacgacatgcgcgaggcgccgtccatcgaggtcatcgagggcctcatcggcaagggcgcccaggtgattgcgcacgacccggtgtctccgcacacggccaagcgcgtcttcggtgatcgcatccgctacgcctccgtgccctacgaggcgctggagggcgtggacggcctcttcgtggtgacggagtggaacgagttccgccacccggacttcgagcgcatgaagacgctgatgaagtcgcccgtcgtgttcgacggccgcaacgtgtacgacccggcgcgcatgcgtgagctgggcttcacgtactacggcatcggccgg

SEQ ID NO: 43053 - DNA, 654 bp, Myxococcus xanthus
ggcatgttcttcaatccgaccaagaagctgaggattccgaccccggaggaagcactgccgggccgctcggatgtgatgcccgtcccggagaagcacgaggtgctgggcacgcccatcaagggccccgtgccggaaggcctggaggaggtctacttcggcctgggatgcttctggggcgcggagcggaagttctaccagacgcctggcgtgtacagcacggcggtgggatacgccggaggcccgacgcccaaccccacctaccgcgaggtgtgcagcggtctcaccgggcacaacgaggtcgtccgcgtcgtcttcgacccgaagaaggtgtccttcgagcagctcctgcgcgtcttctgggagagccatgacccgacgcagggcatgcgccagggcaacgacgtgggcacgcagtaccgctccggcatctacttcaccagcgaggcccagcagcgcgccgccgtggcgagccgtgacgcgtaccagaaggcgctggcggcccggggcttcgacgccatcaccaccgagctgctccctgctccgcccttctatttcgccgaggactaccaccagcagtacctggagaagaacccgggtggttactgcggactgggcggcaccggcgtgagctgcccggtgggtgtgggcgtcaac

SEQ ID NO: 43054 - DNA, 732 bp, Myxococcus xanthus
gtgttcgctggcctgtgtgccgtggacaacccggagaacgtggacacgatgatggcggcgcttgctcgcttgggcatccgcaccacgcgcatgggcgcctacaagccccgcaccaacccctacgagttccagggcctgggcgccgcctgcctgccctgggtgttcgaatccgcgggcaagcacggcatcaaggtcatcgcgatggaggtgacgcacccgcgtcacatcgacgagattcgcgacgcgctcgagcgctccggcaacgccacgggcgtcatgctccaggtgggcacgcgcaacgcgcagaacttcgagctgctcaagagcattggccagcagcgtgtcttcccggtgctcttcaagcgcggcatgggcatcaccctggaggagtcgctcaacgcgtgtgagtacgtggcgagcgagggcaatccgaaaatcatcttctgcctccgcggcgtgaagacgcacctgggtgacccgcaccgcaacatggtggacttcgcccacgtgcccgtggtgcgccggctgacgcgcctgccggtgtgcgtggacccgtcgcacgccattggccaggccgcgccgccgccggacggactgccggacatcttccacgccattggccaggggctcatcgcgggcgcgtccatggtgctggtggacttccacccgcacccggaggccgccctgtgtgacggcccccaggccctgcgcatggagcagctccccgcactg

SEQ ID NO: 43055 - DNA, 1002 bp, Myxococcus xanthus
cgggagttccgtgggcggccagcatggaggcattccgcagtggccagcccgtactcaaaagaactgctgttggacatgtaccggaagatgtacctcatccgtcgcttcgaggagcgcgcgggtcagcagtacacgctggggaagattgccggtttctgccacctctacatcggccaggaggccgtggcggtgggaccggtggaggccctgcgaccggatgactacatgctcagtgcgtatcgtgaccacggccagccgctggcccgtggcagcgacgcgggcatggtcatggccgagctgatgggccgggacaccggctacagcaagggcaagggcggctcgatgcacatcttcgacatcgagcatcacttctacggcggctacggcatcgtcggcggccagattcccctggcggcgggcatggccttcgcgagccgttatcgcaacgaggaccgcgtcaccgtctgctacttcggcgacgcggcggccagccagggcgccctccacgagacgttcaacatggcgtccaagtggaagctccctgtcatctacatctgcgagaacaaccgttacgggatgggcacggccatttcccgcatcgcggcggtgccggagatctacaagcgcgccagcgcctacgacatgcgcggcgagccggtggatggcatggacgtgctggccatgtacgaggccgtcaaggacgccgccgagtactgccgcgccggcaagggccccgtgctgctggaggccaacacgtaccgcttccgcggccactcgatggccgaccccgccacctatcgcaccaagcaggaggtggaggatgagcgcaagggcgacccgattccgaagctgcgcgcctacatcctgaagcaggggctggcccaggacgacgtcttcgagtccatcgaagcggaggtcaatgcgcaggtggaccaggcagtgaagttcgccgacgagtcgcccgagcccagcctggacgaactgtggcgcgacaccatcgtg

SEQ ID NO: 43056 - DNA, 970 bp, Myxococcus xanthus
gagttgatgtaccgcgaggcgctgaaccaagcgctcgccgaggaaatggaacgcgacgccaacgtctatctgattggcgaggaagtgggccgttacaacggcgccttcaaggtgtcgcagggactgctggacaagttcgggagcgcgcgcatcatcgacgcgcccatcgccgagctgggcttcaccggcctgagcgtgggcgcggccatggtgggcttgcgccccgtggtggagatgatgacctggaacttcgcgattctcgcgatggaccagatcgtcaacaacgcggccaagctgcggcacatgtccggtggccagctgcgctgccccatcgtgttccgcggtccgggcggcgctggcggccggttgtccagccagcacagccaggcgctggaggccaactacgcgcacttcccgggcttgaaggtgattgcgcccgccacgcccgcggatgccaagggcatgctcaaggctgccatccgggacgagaacccggtgctcatgttcgagggcgagcggctctacgccatcaagggtgaggtgccggagggcgagcacgtcgtgccgctcggcaaggcggacgtgaagcgcgagggctccgacgtcaccatcatcacctggagccgcatgtattacttctgcatgcaggcggctgaggagttggcgaaggaggggcatcagcgtggaggtcctggacctgcgcacgctgcggcccctggatgaggaggccatcctggcgagcgtgcgcaagacgaaccgcgccgtcatcgtggaggagggctgggcgctcgccggcgtgggcgcgtccgtggtggatatcatccagtccaaggcgttcgacgacctggacgcgccggtggagcgcgtcacgggcctggacgtcaacatgtcctatgcagcgaacctggagaacgcgacccagccggacgcaccgaagatcatcgccgcggtgaagaaggtgctgtaccgc

SEQ ID NO: 43057 - DNA, 1569 bp, Myxococcus xanthus
atccagatgccgagcctgtccccgacgatgacggaggggaagatcgtcaagtggctcaagaagcaaggggacaaggtgtcctccggcgatgccgtggccgaggtggagacggacaagtccaacctcgaaatcgaggcctacgacgacgggtacctgctgcaggtgctcgtcggcgagggcgagatggccaaggtgggcgcgcccatcgcctatatcggtgcgaagggtgagaaggtgggggccggcaagcaggtcgcgcccgccgccgcgcctcctgagcagaagccccagccggcacccgcggcccccgcgccgcaggccgccgcgaagcccgcatcgtcgggcggcggcgacaaccgcatcgccatccagatgccgagcctgtccccgacgatgacggaggggaagatcgtcaagtggctcaagaagcagggggacaaggtgtcctccggcgatgccgtggccgaggtggagacagacaagtccaacctcgaaatcgaggcctacgacaacggcaccctggcggagatcgtcgtcggagagaaccagatggcgaaggtaggggcacccatcgcgtacctcaccgcgaagggcgccaaggcggccccggccgctccggcggcgcagcccaagccgcctgctccggctcccgagaagccggcggcagcgaagcccgcggcggctccggcccaggcgggtggccggcgtctccgcgccagccccgtggcgaagagaatcgcgcgcgagaagggtctggacctcacccaggtgagtggctccggtccgtctggccgcgtggtgaagcgcgacatcgaggaggcgctcgcgcgtggaccggcggcggttcctgccgcgaagaaggccccggccgcgcagcccgctccgggcgtgcgtcccgagccgaccgtgctccccctctcgtccatgcgcaaggtcatcgcgcagcggatgacggaggtgaagcccggcgtgcctcacttctacctcaccatcgaggtggacatggaggcggcgtcgaaggtgcgcgaagaggcgaaggcgatggacctcaaggtctccgtcaacgacctcatcgtgaaggccgtggccatggcggtgcgccgttacccgaagatcaacgtctcgctgcagggcgacaaggtcgtccagttccacagtgtggatgtgggcatcgcggtggcgctggaggaaggcctcatcacgcccatcctccgggatgcggaccagaagggcctgcaggccatcgcgtcgggcgtgcgtgagctggcggagcgcgctcgcaagcgtgccctcaagccggaggagtacaccggcggctccatcaccgtcagcaacctgggcatgtacggcatcgaccagttcgtcgccgtcatcaacccgccgcaggcctccatcctcgcggtgggtgccgtctccgagaaggcggtggtgcgcgatggtcagctggcggtccggaagatgatgacggcgacgctgtcgtgcgatcaccgcgtcatcgacggtgccattggcgccgagttcctgcgcgagctgcgcgggctgcttgagcaccccacgcggctgctgttc

SEQ ID NO: 43058 - DNA, 1416 bp, Myxococcus xanthus
cttcgcgtccgcttcgctccctcgcctaccggctaccttcacattggcggtgcccgtacggcgctgatgaactttctccaggcgcggcgccagggcggcaccttcgtccttcgcatggaggacacggaccagggccgctccaccccggagtcggtgcaggccatcctggacgggctgaactggctgggcatcgactgggatgagggccccggtaaggaaggcccctacgccccctacttccagatgcagcggctggacacctatcgcaagcacgccgaccagctcatcgccgagggcaaggcctaccggtgctactgcacgaaggaggacctcgacgcgcagcggcaggtggcggagaaggcgggcggcgcgttcaagtacccgggcacctgccgcgagcggaccgagccccccgccggccgcaacgccgcggacgccgtcatccgcttcaagatgcccgcgggtgacggttccgtgtccttcaccgacaaggcgctgggcaccatcaccaagacgcacagcgacctggatgactgggtcatgatgcgggcggacggcatccccgtgtacaacttcgggtgtgtcattgatgaccacctgatggacatcaccctggtcgcgcgcggccaggagcacgtcaactccaccttcccgcagctcatgctgtaccaggcgctggggtggacgcctcccgacttcgcccacctgccgctcatcctgggcccggaccgcgagaagctgtccaagcgcaagcacccggaagcggacgtgatggtgcacaagcgcaacggcgtcatgccggaggcgctgctcaacttcgtcatccgcctgggctggagccacggcaacgacgaggtcatcagccgcgaacagatgctcgagtggttcgacttcagcgacgtgggcaccacctccggcgtgtggaacccggagaagctgctgtggctcaaccagcagtggatgaagcagttgccggtggagaccgtggtggagcggctgctccccttcctggaggcgaagggcatccaggcgaagggcgacccgcggctggagacgctggtgcgcacgctgcgcgagcgctccaacaccctggaagacatcgccaccaccgcggccaacgtctacttccgctccggcatcaccctggacgagaaggccgccaccaagcacctctccggagagtccctcaacctgctgcgcaaggtgcgcgagacgctcaccgcgctgccggagtggtcggtggaggcgctggacggcgtggtgaagcaggtgagcgaggcctccagcgtcggcatgggcaaggtggcgcagcccatccgcgtggcactcactggcaacaccaccagcccgggcatcggcgagacgctggtgctggtaggccgcgacgaatccctgctgcgcatcgacgcggcgctg

SEQ ID NO: 43059 - DNA, 2382 bp, Myxococcus xanthus
gtgggcagcttcctgctggccgcgggcatcaagcacggcgaccgcgtgctgctggtgtcggagaaccggcccgagtggggcatcagctacttcggcatcctgcgcgcgggcgccaccgtcgttccggtggacccgggcttgagcgaggcggagctcgtcaacatcgcccgccgggcggacgcgcgcgcgtgcctcgtctccgaggacgcggcccgggacttccccggcctcttcgccgcgctgggtgacggcgtcaccgtggccagcctcgcggaggcgatgacaggcgacccggcgcacccggaccgcatcgggccagtgcgcaggtccgccgcggcggatgacctggccagcatcatcttcacctccggcaccacgggcacgcccaagggcgtcatgctcacccaccggaacttcgccgcgctggtggcgaagctggcggggaccttcgacatcggcgtgggcgacggcgtgctgtccgtcctgccgctgcaccacaccttcgagttcgccgccggcttcctcaccccgttctggcgcggggcggaaatcacctacatcgacgagctgacgtcggaccggctgggcgaggtgttcgagacgggccgcatcaccgccatggtgggcgtgccggcgctgtggcagctcttgcatcgcaagattacgcaggagttcgccagccgccctcagttcatcgaacaggcgctcaaggcgctgatggccacccacggcgagctgcgcaaccgcaacaacatcaacctgggcaagctgctgttctggccggtgcaccgcaagttcggcgggcgtatcaaggtcatcgtgtcgggcggctcggcgctgccggacgacgtgcacaaggccttccacgagctgggcttcaacatcacggagggctacggcctgacggaggccgcgccggtgctggcggtgacgaagcccggcaacaagcgccagcccggtacggtgggccgcgcgctgcccggcatcgagctgcgcatcctcaatccggacaacgacgggttgggtgaagtgctggccaagggccccaacgtcatgcccggctacttcggcgaccgcgaggccaccgaggcggtgctcaaggacggctggctccacacgggcgacctgggacgtctggacgcggagggccacctgtacctggtgggccgcgcgaaggacgtcatcatcgaccacaacgggaagaacatctacccggacgagttggaggagctgtaccaggaccacacgcacatcaaggagctgtccatcgtcggcctgcccgacgacgcgggcggtgagaaggtggcgtgcctgtgcgtgcccgactacgcggaccgcccacgcgaggaagtgcgccgcgagttggaggagcacttccgcaaggtgagcgcgggcatgcccttctaccggcgcgtgaaggtgctgcgcctgtgggacggcgagctgccccgcaccgccaagcgcagcgtgaagcgcaagcaggtggtggaggagctcaagcgccaggagcgcatggcggccagcgccagcaaggcgcgcgagaaggcggccaaccccaccacgggtggcatcgcggactggctcttcccgctcatcgcggacgtcagccaccggccggtgtccgacgtgcgtccggacgcgctgctcagcggggacctcggcttcgactcgctgatgctcaccgagctgtcctccgcgctggaggccgccggcgtgccgctgcccgcagtggaggacctgacgcaggtgcagacagtggaggacctgcgcaaggtggtggcgtcctccggcaagcgccccacggtggagacgcgcgcgaaggagatctccaaggagaacgagcgcgcggaaaaggtggagattccggggcccgacgtggtggcggacgtgggccgtcagctcttgtccttcgggcagaaggtgctctacggcggcgtgttcgacgtgaaggtgacgggcaagtccttcatcccgcagaaccgcaacttcctcgtcatcgccaaccactccagccacctggacgcgggcctggtccgcgtggcgctgggtgaccagggcgagcgactggtgtccctggcggcgcgcgactacttcttcaacacgccgctcaagcgcgcctggttcgagaacttcaccaacctgatccccattgaacggcagggctcgctgcgcgagtcgctgcggatggcgggcgaggcgctgcgtcagggcttcaacgtcctcatcttcccggagggcacgcgctccaccaccggtgagctgatggagttcaagtccacgctgggctacctggcgctcaccttcaacatggacgtgctgccgctgtacatcggcggcgccttcgacgcgctgcccaagggcagcgtgctgcccaagacgaag

SEQ ID NO: 43060 - DNA, 609 bp, Myxococcus xanthus
gtcctggcgatgattctggctggaggcgctggcacgcgcctggagcccctgacgcgcgagcgcgcgaagcccgctgtccccttcggcgggcgctaccgcatcatcgatttcgttctctcgaacttcgccaactccggtgtgtaccggatgaaggtcttgacgcagtacaagagcgactcgctcaacaaccacctgtcccgcgcgtggcggatgacggcgttcctgggccactacgtggaagccgtccccgcgcagatgcggacggggctggactggtacaagggcagcgcggacgccatctaccagaacctcaacatcatcaccgacgaggagccggactacatcttcgtcttcggcgcggaccacgtgtaccggatggacacgcgccagatgctggacttccactgcacgaagaaggcggcgtgcacggtggccgcgattcccgtccccatcgagcagggccgcgagttcggcatcatcgacgtggggccggacgggcggatgcggcagttcctggagaagcccaaggacccgccgcccatgccgggcaacccgaagatgtgcctggcctccatgggcaactacctcttctccaccgacgtgctggtg

SEQ ID NO: 43061 - DNA, 1941 bp, Myxococcus xanthus
ggcgtggagctgaagcacctggaccgcgatgtccggccgcaggacgacttctacgccttcgtcaacggcaactggctgaagacgacgtccatccccgcggaccgcgcgcgctacggcaccttcatcgagctggcggacaaggccgagctggccatgcgcgccatcatcgaggagtccgccgcggcgaaggagcgccaccccggctccaccgcgcagaaggtgggtgacctctacaacagcttcatggacacccagcacatcgagtcgctgggcctgaagccggtgagcgacgaactggagcgcgtgaaggccgtgaagcgctcggacgcgctgccggagctgttcgcgacgctgctgcgcgaaggcgtgccggtgccgttcggcatcttcgtgggccaggaccagaagcaggccacgcggtacaccgtctacgccacgcagttgggcctgggccttccggaccgggactactacaccaagcaggagccgcgcttcgtcgaggtccgcgccgcgtacgtggcctacatcgagaagctgctcacgctggccggtgagaagaacgcgaagaaggccgcccaggacgtgatggcgttcgagacggcgctggccgcgaagcagtgggaccgggcacgcaaccgcgaccgcgagaagacgtacaaccccaagacggtcgcggagctggacgcgctgaccccgggcttctcctggggccgcttcctcaaggcgtccggtgcggaggccacgccctccgtcatcgtccgtcagccggactacctggagtccctgggcgggttgctgaagtccacgccgctgccggtcatcaagcagtacctggcgctgaaggtgctggacacccgcgcgccgctgctcagcagcgccttcgagcaggcgcacttcgagttccgcggcaagacgctccagggcttggaggagaaccgcccgcgttggaagcgcggcgtggcccaggtgaacgaggtcgtcggcgaggccgtgggccagctctacgtggagcgccacttcagccccgactccaagaagcgcatgcaggagctggtggccaacctgcgtgaggccttccgcaagggcatcgacggactggactggatgagccccgccaccaaggcgcaggcccaggccaagctggagaagttcggcgtgaagattggctacccggacaagtggcgggattactcgtcgttggacatcgtcgccggtgatctggtgggcaacgtccgccggggcgagctgttcgatcaccagcgcgcggtgggcaagctgggcaagcccatcgaccgcgaggagtggggcatgacgccgcagacggtgaatgcctactacagctccacgatgaacgagattgtcttcccggccgccatcctccagccgccgttcttcaatccggaggcggacgacgcgacgaactacggcgccatcggcggcgtcatcggccacgagttcagccacggcttcgacgaccagggcagccgctccgacggcgacggcaacctgcgtgactggtggacgcccgaggacaagtcgggcttcgagcagcgcaccaacatgctggtgaatcagtacaacggcttcagcccgctggatgccatgaacgtcaacggcaagctcacgctgggcgagaacatcggcgacctgagcggcctcaccgtggcgtaccaggcctacaagctgtccacccagggcaagatgccgcccgtcatcgacggcttctccggcgaccagcgcttcttcctgggctgggggcagatctggcgtggcgtgtaccgggacgatgccatgcggcagatgctgctgaccgacccccactcgccgccgcagtaccgcgtcaacggcgtggtgcggaacatgccggagttctacgaggccttcggcgtgaagcagggggacgccaactggctgccgcccgagcagcgcgtcaagatctgg

SEQ ID NO: 43062 - DNA, 2544 bp, Myxococcus xanthus
atccctatggcgcatccgaccgaagacaagaacttccgcctgccgacctccatccgtccccgccgctacgcggccacgctgaccctggacctggacgcgaagtccttctccggccagcagaccatcgacctggacgtggcggcgccgtcgaacgaaatcatcctgcacggcatcgccctggcgctgagcgacgtgacgttccgcgccggtggccagcagcgcaagccggcctccatccagcccgcgcaggcgagcgagacggtggtgctccgcttcgatgaagcgctgcccacgggcgccgcgtcgctggacgtcgcgtggacggggcgcttcacggaagggctgcgcggcctgtaccaggcgggcaaggtggcggccacccagttcgaggccgccgacgcgcgccgactcttcccctgcttcgacgagcccgccttcaaggcgcgctgggccctcaccgtccgcgtcccgacggggctcaccgtgctgggcaacggcccggtggtgaaggacacgcaggagggcaacctgcgcgcggtgacgttccaggagacggaggtgctcagcagctacctcatcgccctggtggtgggcccgctggtgggcacggacgcgcaggacgtgcagggcgtgccggtgcggacctgggcgctgccggagaaggcgcacctgacgcgcttcggccaggacgtggcgctggcggtgctgcccaggctccaggactacttcgggctgccgtatgccttcaccaagctggaccaggtgggcatccccgacttcgaggccggcgccatggagaacgccggcctgattacctaccgcgaggtggcgctgctgctggacccggccaccgcgccgctgtcggtgaagaagcgcgtggcggaggtggtgacgcacgaactggcgcaccagtggttcggcaactgggtcaccatggtgtggtgggacgacctgtggctcaacgaggcgttcgccacgtggatggccttcaagattgtggaccagtggcgccccgagtggcgcatgtggctggacttcgacgcgcaccgcgccagcgcgctgcatctggacgcgctcaagtccacgcaccccatccacggcgaggtgcgcaacgcgggcgaggccggtgagagcttcgacgcgattacgtacgagaagggcggcgcggtgctgcggatgattgagggcttcctcggggaaggccccttccgcgagggcatccgccagtacatgcgcaagcacgcgcgcgccaacgcagtgaaggaagacttgtggaacgcgctgggcgacgccgcgaagcagccggtggaggagctggccaccgcgtgggtgggccagagcggcttcccgttggtgacggcgacgctggacgggcgcgggctgtcgctgtcgcagcggcgctactacagcgagcccggtgtgcagagcgctgaggtgtggccggtgccggtggtgctgcgctacgaggacagcaccggcgtgcgcgagcagcgcgtgctgctgcgggacgcccaggccacggtgaagctggagggcgaaggcgcggtgaagtggctgacggccaacgcgggctccaccggcttctaccgggtcgcctacgacaagccgggcctggagaagctggcgacgaacctgaagtcgctggccccctccgagcgcaccgccctgctggcggaccagtgggcgctggtgcgcgcgggccaggcgtcggtggcggacctgctggaccttgcgggccgcttcggtgacgaggaggacgactccgtcctggacgagctggtgggccggctggcctacatcgaaggccggctggcggacggcgaggaccaggtccgcttccgcgcgtgggtggagaagctgctggggccagggctgaagaagctgggctggcagtccgcgccgaacgaggcggaccgggtgaagctgcggcgcgcgtcgctggtgcgcgcggtgggtggcctggcgcgcagccaggacgcgctcgccgaggcccggccccgcgtggagcgcatgctccagggacagcgagacgcgctggagcccaacctgctggacgccgcggtgggcatggtggcgcgcgcgggcgacgcggcgctcttcgacaccttcctccagaagattccgtccgagcccgaccctgccacgcagcgccgctacctcatggcgctcaccgccttcgaggcccccgaactcaccgcgcgcgcgcgcgggctgctctacacggacacggtgaagacgcaggacgtggccagcttcgtggcggggctgctgggcaaccgcgtcggccgcgacgcgtggtgggcgcagatgcgcacgcaatggaaggacgtggtggcccgcaccggcggcgcccccatgctgctgcgccgcatcgtcgaggccatgggcatgctgcgcacgcgcgagcacctggagcagatgcaggccctgctcaaggcccagcccatccccgaggcgcagcaggccacggcgcagacactggagcggctgtcccaggatgtggcgctgcgtgagcgctgcatgcccgaggtctccgcgtggctg

SEQ ID NO: 43063 - DNA, 951 bp, Myxococcus xanthus
gtcgtgtgctttggcgagacgttggtggacttcctcccggcggctccagggcaccgcgtgcgcgacgtgcccgcgtggcatccgtgccctggtggctcgccggcgaatgtcgcggtggggctggcccggttggggctgcgtccagccatgctgggcgtggtgggcgcggatgagttcgggcacttccttcgcgagcgattggcggcggaaggcgtggacgtgagtcacctgcgccagacggcggaggctcgcaccgggctggtgttcatctccctggatgggaagggcgagcgcagcttcaccttcttccggacacgctccgctgagttcctgctgggacaggcggatgtcgacgcggcgttcctgtcgggggcgaaggcagtgcactgtggttccaactcgctccagtggccggaggcgcaggaggccgcggtgcggatgctggggctggcgcgcgacgcgggcctcatcgtgagttgtgaccccaacttgcggctgcacgcgtgggaggacacgtctctcctgaagggcctgctggcgcggatgctgccgctgtgcaccgtggtgaagctctccgaggaggagattggcttcgtcacggggacggaggtgccccacgaagcgctgacgcgactggccgcgatgggcgtgccgctgcccgtggtgacgctgggcgagcgtggcgcgctgctgcagtggaagggggagtgcatccacgtcgcggcgccgcaggcgcgcgtcgtcgacaccaccggtgctggcgatggtttcgtcgcgggcctgcttcaggggctggtgcgctggtacggcggcgctggggggctgcgtgatgcaaccggtgaggagttggtgacgctggccacgttcgcgtgtgaggtcggggcccgtgtcgtggagaagctcggtgcggtggatgggcttccccgggcggaagtgctggctcacgtcatg

SEQ ID NO: 43064 - DNA, 702 bp, Myxococcus xanthus
cgcgccattcgactcctcttctccatcgtcttctgggcgttcctgatgctctccagcgccgtgctcttcgtgggcgccgtgctggtctggctcgtcacgttgccgttcgaccgcgacgggcgcgtcctgcacctgtattcgtgcttctgggcgcagctctacttctacgtcaacccgctctggcacctggaggtcgacggccgcgaacacctgccctggcggggcccggccgtgctcgtgtccaaccacgagtcgctcggcgacatcctggtcctcttcggcctctaccgccccttcaagtgggtctccaaggcgtcgaacttcaagctgccgctcatcggctggaacatgcggctcaaccgctatgtccccctggtgcgcggtgacagggcgagcatcacgaagatgctggccgactgcgaatactggctgtctcgcggcgtgcccatcctcatgttccccgaaggcacgcgctcctccgacggcgtcgtgaagcccttcaaggacggcgccttcgcgttggccttgaagcagcgctgccccgtcatccccgtggtcctcaccggcaccgcgcgcaccctgcccaagcacggcctggtgctggagaccaccgcccgctgccacgtccaggtcatgccccccgtcgaccccagcgccttcaccgacgtggcctccctgcgtgagcacgtccggaatctcatc

SEQ ID NO: 43065 - DNA, 1765 bp, Myxococcus xanthus
accgtctccgattacctgctccaccgcctgtcccagtggggcgtccgccgcatctatggctatcccggtgacggcatcaacggcatcctcggcgcgctcgggcgcacgttggagttccgcttcgagcacacgcgccatgaatatatgtccgcgttcatggcctgtgcgcacgcaaagttcaccggcgaaccgggcgtgtgtctggccatcgtcggggcccggggccatccatctgctcaatggcctctatgacgccaagctggaccaccagccggtggtggccatcgtcggacagcagacgcgctcagcgctgggcggccacttccagcaggaggtggatctgatgtccctcttcaaggacgtgcccagcgaatacctcacgatggtgaccagcccctccgccatccgccacgcggtggaccgggcgatgcgcgtcgccatctacgagcgcaccgtgacgtgcgtcatcatccccaacgacgtccaggaagaggcctaccacaagcctccgcacgcgcacggcacggtccattcaagcgtgggctacagcgtgccgcgagtgctgcctcgcgagcgggacttgcggcgggcggcggacgtgctcaacgccgggaagaaggtggccatgctggtgggcgccggagcgcaggccgcggcggacgaggtgatgcacgtggcggagttgctaggcgcgggtgtggcgaaggccctgctgggcaaggccgtgctgccggatgacgttccctatgtcaccggctccatcgggctgctgggcaccaaggcgagctgggacctgatgtcggactgcgacacgttgctgatggtgggcaccagctttccgtactcggagttcctcccgaaggagggacaggcccggggcgttcaaatcgacctcgatggccggatgctggccatccgctaccccatggaggtggcgctggtgggggacagtcaggagacattgaaggcgctgattcccatgctcgagcacaagaaggaccggagctggcgcgacagcgtggtgaagaacgtgcggcagtgggagaagacggcggaggcgctcgcgatggaccgcgcgaatcccgtcaacccccggcgcgtgttcttcgaactgtcgtcacggctgccggatggcgtcatcctgacggcggattcggggtcgggcacgagctggtacgcgcagcacctgaagatgcgcaaggggatgatggcctcgctgtccgggaacctggccagcatgggctgcggcgtgccctatgccatcggcgccaagttcgccttcccgcaccggcccgtcatcgcgctggtgggcgacggtgccatgcagatgaatggcaacgcggagctcatcaccgtggccaagtactggaaggagtggaaggacccgcgcttcatcgtcatggtcctcaacaaccgggacctcaacatggtgacgtgggagcagcgcgtgctggccggcgacccgaagctgcccgcgtcccaggacctgccggacttcccgtacgcggcctatgcggagtccctgggcttcctgggcattcgcgtggaccggccggagtcgctgggtcgcgcgtgggatgaggcactgagcgcaacccggcccgtcgtcttcaaggcctacgtggacccggacgtcccgctgctaccgccccacatcaccttcgagcaggcgaagcactatgcccaggcgctggcgaagggcgacgtggacacgggcggcatcctgaagcagtcgctcaaaggcatggtggagacactgctgccc

SEQ ID NO: 43066 - DNA, 933 bp, Myxococcus xanthus
attggcctgggcggcgtggccattggcaatggcttcgcgtccaccagcgacgcgcaggcgcaggccaccctggaggccgcctgggccgccggcgtgcgctacttcgacacgtcgccctggtacggcctgggcctgagtgaacgccgcttcggccgcttcctgcacacccgcgacgcgaacgagtacgtgctgtccacgaaggtgggccgcatcctcaccgccgcggacgcgccgccgccgaagctgctgtggagcgacgcctcccccttcaactaccaatacgactattcggccgccggggtgcgccgctccgtcgaggacagcctgcagcggctcggcgtgtcgcgcatcgacatcgtgttcatccacgacctgtcgccggacaaccaggacatgggcgacaagtggacggagtacttcgaccaggccatcaagggcgccatccccgagctgacgaagatgcgcgaggaaggcctcatcaaggcctggggcttcggcgtcaaccgagcggagcccgcgctgcgcgccctcgaggtcagcgacccggacatcttcctgctggccacgcagtactcgctgacgaaccacgaggaggccctgagcaagacgttccccgcgctggagaagcgcggcatctccgtggtggtgggctcgccgctcgacgccggctacctcgccggacgcaaccgctacctctacgacggcaccattccgcccggcgtgcaggagaagcgcgcccgcatgagcgcgattgccgcgaagcacggcatcgacctgcgcacggccgcgctccagttcgccgccgcgccttccgtcgtctcctccgtcattcctggagcgcgcacgcccgaacaggtgaaggcgaacgtgcagtccatgacggtcgcgattccagacgccttctgggaggcactgaagaaggaagggttgatt

SEQ ID NO: 43067 - DNA, 1653 bp, Myxococcus xanthus
gaaacgcagggcctgaacttcctccaggaaatcatcgaggaagaccagcggacgggaaagtacgcgggccgcgtgcacacccgcttcccgcccgagcccaacggctacctccacatcggccacgccaagtccatctgcctcaacttcgggctggcgcagcaatacggaggcaagtgcaacctgcgcttcgacgacaccaaccccgtcaccgaggacaccgactacgtcgaggccatccagcgtgacgtgaagtggctgggcttcgagtgggaggaccggaagttcttcgcgtccgactacttcccgaagctctacgacttcgccgtgcagctcatcaagcagggcaaggcgtacgtgtgcagcctgtcccctgaggagattcgcgagtaccgcggcgacttcaccacgccggggcgcaacagtccgtaccgcgagcgctccgtggaggagaacctggacctgttccaccgcatgcgcgcgggcgagttctccgacggccagcacaccctgcgggcgaagatcgacatggcgtcgcccaaccccgtgctgcgcgacccgcccatctaccgcatccgtcacgcgcaccatcaccgcaccggcgacgcgtggcccatctacccgctctacgacttcgcgcactgcctgtcggacgcgattgagggcatcacccactccatctgcacgctggagttcgagaaccggcgcgtgctgtacgactggattgtcgacaacctcgtcagcggggaccggccgtaccagtacgagttcaaccggctaaacctcaactacacggtgatgagcaagcgcaagctgctcaagctggtgacggagggcttcgtggccgggtgggatgacccccggatgatgacgattaccggcctgcgccgccgtggcttcacgccggcgtccatccgggacttcgccacgcgcgtgggcgtgggcaaggcgcagcagctcatcgacatgagcctgttggagctgtgcatccgcgaggacctcaacgagacggctccgcgcgccatggcggtgatgcgcccgttgaaggtggtcctggagaactacccggaggggcagacggagctgctggaggtgcagaaccatccgcagaagccggagatggggacgcgccaggtgcctttcatgcgcgagctgtacatcgaggcggacgacttcatggaggacccgccgaaggggttcttccggttggcgcccggcaaggaggtgcggctgcgctcggcgtacttcatcaagtgcgagcaggtcatcaaggacgccgcgggtaacgtggtggagttgcgttgctcgtatgacccggccacgcgcggcggcaacgcgccggatggccgcaaggtgaagggcacgctgcactgggtacccggcaacgcgcccgtcgcggaggtccgcctctatgaccggctcttctccgtggaggcgccggacgcggacgactccaaggacttcaccacgttcctcaacccgaccagcctccagacgctgcgcgacgcccgcgtcgagccgatgctggtggatgccgccgtggagtcgcgctaccagttcgagcgcaccgggtacttctacgtggacccgaaggactcgaagccgggcaagcccgtcttcaaccgtacggtgacgctgaaggactcatggacgaag

SEQ ID NO: 43068 - DNA, 1257 bp, Myxococcus xanthus
ctgagcctggagggtgtcccgctggcgcagttggtggagcgctggggctcgccgctgcacgtggtgcacatggcggcactgcggcgcaacgcggagcgcttcctcgcggtgcctccggggcgcacgggcggctgtgaagtctattactcgtacaaaacgaacccggtgcccggcgtgctgtccttcctgcacggcctgggcgtgggcgcggaggtcatctccgcctacgagatgtggctggcgctgaagctgggcgtgcccccggagcgcatcgtctacaacggcccggtgaagtcggaggcctccgtgcgcgaggccatctcccggggcatccagttgctggccgccaaccacgcggaggagatagccgtcttcgcccggctggccgcggagctggaccgccgcccgcgcgtcgccgtgcgggtgacgacgaacagcggctggtccgcgcagttcggcacgcccatcgcgggaggcgccgcgctgcgggcctaccagcaggcgcgcggctcgaagcacctggacgtggtgggcctgcacgcgcaccgtggagaaaccatccgcacggagggcgacttcacggccttcgtggagtcggtgctcgacttcacggacacgctgcaccaggagctgggactggacttggaggtgctcgatttgggcggcagcctcaacacgcccaccgtcgagcacatcgccgagcgcgactggcgcctcaacctcaccttcttccgcgacgtgcccgcgcccgacccggcggcgtcgctgtccatcgaccgctacgtggcgctggcggtggagatggtggagacgcactacgcgcggcgcggccggcagcgtccccgcatcttcctggagccgggccgcgccatgacgggcgacacgcagctcttgctgggccgcgtgcacgcgctcaaggcgggggaagacaggacgtgggcggtgctggacgccggcatcaaccatgccgagtgcgtgcgcaacgaataccaccagctcttccacgtgaaccggccggacgcgccggccgacaaggtttacacggtggtgggccccatctgcacgccgggcgacacgctctaccacgcgaagcggctacccgacctgcgcgtgggggacacgctggccatcatggatgcgggcgcctacttcgtgcccttcgccacgtccttctcctatccccagccggccatcgtcgcgctggaggacgggaaggagcggctgctgcggcgcgcggagacgttcgatgacctggtg

SEQ ID NO: 43069 - DNA, 2463 bp, Myxococcus xanthus
cgtcccttctcccttcctggcgccaccgagcactacgccgccgagcggccggtccgcgccgagcacgtccgcatcgaggtcgacctcgatttcgacacccaccgcatcaccggcctgtgcaccacgcgcgtctccgccgtccgtccagtccacaccctcaccttcgacgcggtggacctcgacgtgtccgacgtccaggtagacggccgcgccgcgcgcttctccaactccggcgcccacgtccgcgtggagctgtccgcgccgctcgccgccgggcaggcctgtgaggtggccatccgctacacggcccggcctcgccgcggcctctacttctgggcgcccgacgccgcctatccgcaccgtccccaccaggcctggacacaaggccaggacatcgacgcgcgtgcctggttcccctgcctggacacgcccgcccagaaggccacgtccgaggtcatcgccaccttccccgaggcgatgacgtccctgtccaacggcacactggaaagcgaccgcgtccacgatggccgccgcacccagcactaccggatggcgcagccgcacgccccgtacctcgtcacgctcgtggtgggtgaattcgaggaggccaccgacacggctggcacggtgcccctgcgctacctcttccccaagggccgcaaagaggacgcgctgcgctgcgtgcgccgcacgccggagatggtgcgcgtcttccaggaagtcaccggcgagccctacccctggagcagctacgcccaggtcttcgtcaccgagttcatcctgggcggcatggagaacacctccgccaccagcctcacggacaccgtcctccacgacgcgcgcgcccaaccggactacaacgccgagccgctcatctcgcacgagctggcccaccagtggttcggggacttgctcacctgccgtgactggccccatggctggctcaacgagggcttcgccacctggctcgagatgctctggaaggagcgcgccgacgggcaagacgaggccgaccagcaccggctcgtggacctggaggcctacctgggcgaggcgcgtgagcgctatgcccgccccattgtcgcgcggcgcttccacgcgcccatggatgtcttcgaccggcacctctacgagaagggcggcctggtcctccacgagctgcgccgccggctgggcgatgacctgttcttcaagggcctgcgccactacgtcgcgcgacaccgccacggctccgtggagacggtggacctggcccgcgcgttcgaggacgccacgggccacaacctggacgccttcttcgaccagtacatcttcgcgcccggccaccccgagctgaaggtcgacgtccgctacgacgccgaggaagcgcggctgcgcctccaggtgcgccagacgcagtccacggcggacggcgtgcccctcttccggctgccgctggatgtggcgctcaccgtggacggccgcgacaccgtccaccggctggaggtgacggacgcggagcacgcgttccacctgccctgccccagcgcgccctcgcaggtgcgggtggaccctcggcgcggagtgctcggcacgctgacggtggacaagtccgcgggcctttggatggacgagctgcgtgccgcgccggagatgcgcgcgcgcaccgaagccgccgtggccctgggacgcgacggcagcccccgcgccgtggacgcgctgggcacggcgctggcggacgcgcgtttgttctggggcactcgcgccgcgtgcgcgaagtccctgggccgcatccgcacccccgattcccgcgcgcgccttctggacgcgctgtccaccgagcatccccgcgtgcgccgcgccgtggtggcttcgctgggcgagttccgccgcgatgcggaggtgacagcccgcctgcgcgccctggtgaacggcggtgacaccagctacttcgtggaggcggaggccgcccgcagctatggccgcgtgcgcgcgccggacgcgttgggcgtcctggaggccgcgagcacccggccctcgtaccaggacgtcatcgccgtgggcgcggtggatgggctcgccgagtctcaggaccccgccgccttctcggtggtgctggcgcgcaccgcctatggccacgcggctccgctgcgccgcgccgccacgctcgcggtggcgaagctggcggaggtcgcgggtcgcaagcgcgaggccgtggacctgctggcggagctgctccgcgacccgctcttccgcgtgcgcatgggcgtcttcgaggcggcgcgcacgctgggggattcacgcctggtgcccgcgctggagcagacgccactgttggatgccgtcgcccggcgcgcggcgcgcgagacggtgcgcttcctgcgcgaaggtgaaccgcaagtccgcgaggtggcatcgctgcgcgaagaggtggaccgcctcaaggaggagacacgggccttgcgcgagcggttggaagggctc

SEQ ID NO: 43070 - DNA, 1620 bp, Myxococcus xanthus
ccgctcgctggcaagccccctccggaagacttcctcatcgaccccgagaaactgcgcgccgcgtacttctccggccggcccgacgtggacgtgccggagcaacgcgtggccttcggcacctccgggcaccgcggttcctccgcgcgcaacagcttcaacgaaggccacatcctcgcggtgacgcaggccatctgcgagtaccgccagcagcagggcatcgacgggccgctcttcctgggcatggacacccacgccctctcctcccccgcgcagcagacggcgctggaggtgctggcggcgaacggcgtgcaggtgcgcttcaccgacggcgccacgcccacgcccgtcatctcccacgccatcctcacgtacaaccgcggccgcacggcggggttcgcggacggcatcgtcatcaccccgtcccacaacccgccggaagacggtggcatcaagtacaacccgcccaacggcggccccgcggacacgaacgtcacctccgtcatcgagaagcgcgccaacgcgctgctgggtgcgggcaacgagggcgtccagcgcatcccccacgagcgcgcgcgcaccgcgcccacggtgaagccgtacgacttcatcaccccgtacgtggaggacctgggcaccgtcatcgacatggaggccctgcgcggtgcgaagctgcgcatcggcgcggacccgctcggcggctccaacgtcgcgtactgggagcccatcgccacgcgctacgggctgaacctgcacgtggtgaaccccacggtggacccgacgttccggttcatgccgctggaccacgacgggaagattcgcatggactgctcgtccccgcatgccatggcgaacctggtgcgcctgaaggacgcgtatgacatcgcgtttggcaacgacgcggactcggaccggcacggcatcgtcacccgcagcctggggctgatgaacccgaaccactacctggcggtcgccatcgactacctctatcgcaaccggcccggctggaagcccggcaccgcggtgggcaagacactggtgagcagcagcctcatcgaccgcgtggcgaaggacctgggccgccgagtcgtcgaggtgccggtgggcttcaagtggttcgtggacgggctgctggacggctcgctcggcttcggcggcgaggaaagcgccggcgcgtcgttcctccgccgagacggcacggtgtggaccaccgacaaggacggcatcatcctggacctgctgtcggtggagatcctcgcgcgcaccggaaaggaccccggtgagcactaccagtccctggcggcgaagttcggcgcgccgcactacacgcgcatcgaccagccggccaccgccgcgcagaaggccgcgctgaagaagctgtccccggaggcggtgaaggccaccacgctggccggtgagcccatcctccagcgcctcacccgcgcgcccggcaacaacgcggacatcggcgggctcaaggtggtggcggagaacggctggttcgccgcgcgtccctccggcaccgaggacgtctacaaaatctacgcggagagcttccgcgacgaagcccacctccaagacatcctccaggaggcgcgcgccatcgtcggcgaggcgttcgcg

SEQ ID NO: 43071 - DNA, 297 bp, Myxococcus xanthus
atgaagattcgtcccctgcaggatcggctcatcgtcaagcgcgtcgccgaggagaacaagaccaagggcggcctcttcatccccgacacggcgaaggagaagcccctcgagggcaaggtcatcgccgtgggcaacggcaaggtgcaggaggacggcaaggtccgtccgctggacatcaaggccggcgacaccatcctgttcagcaagtacgcgggcaccgagatcaagctcgacggcgaggagcacctcatcctccgtgaagaggatgtgctcggcgtgatcgagaagtaatccggc

SEQ ID NO: 43072 - DNA, 3564 bp, Myxococcus xanthus
atgcgaatcaagcggttggacatcaccggcttcaagtccttcatggaacggagcgtcttcacgttcgacgaaggcgtgacgggcatcgtcgggcccaacggctgcggcaagtccaacgtcgtggacgccatccgctgggtgatgggtgagcagagcgcgaagaacctccgtggccgcggcatggaggacgtcatcttcaacggctcggagaacaagccgccgctgtccatggcggaggtgtcgctcacgttcatcgtggatgacacggaccagctcgcgccccagtaccagggcttctccgaagtgacggtgacgcggcgcctgttccgcaacggcgactccgagtacctcatcaacaagacgctgtgccgcctgctggacatcaccgagttgttcctcggcaccggcgtgggcacgaaggcgtactccatcatcgagcagggccgcgtgggcctcatcgtgtccagcaagccggaggaccggcgccacctgctggaggaggccgcgggcgtcaccaagtacaaggcccgccgcaaggccgccgagcgcaagatggaggcgaccgacgccaacctgctgcgcgtcactgacatcaccaacgagttggagaagcggctcgacgcgctgtcgcgccaggcgaagaaggcggagaagtacaagaagctcaaggcgcgcatgcgggacatcgacctgcacgcggccacgcaccgccagttggagctgatggcggagaagaagatgctccagtcgcggctggagaacctgggctccgaggagcgggagagcctggaccgggtgaaggagctggaggagaccatcacccggcgccgcacggagttggaggcggaaaccgccgcgctccaggcgctggccgcggaggtgcacacgctggagagctccctgcagcgcgacacgcaggagatgacctacggcaagcgcgacctggaggagacgcgggcccgcgtggccgccgcccaggtggagctggacgggctcctggcgcgcaaggcggagatgtccgaggccatggccgcccgcgaggcggagctgtcgggcatcgccggctcgtggaaggaggacgaggtcgcgatgcaggtggcgcaggaggaactgcgccgcgtgtcccagctccagacggaggtggcgctgcgcctggagcaggagcgcgccggcctggtggccgtggccacgcgcctggccaaccacgagagcaacctggtcaacctcgctcgccagcggggggatttgggtgcccgccgcgcgaagctccagggcgagctggaaaccctgcgcgcccaggagcagacgctggagaacgtccggggcgacgtggcgaagcgggtggaggacacccggcacctcgccgcggagctggccgagcgcaagggccaggaggaggacgcgctcacccgcacccgcgcggccttcacggagaacgaaatcgaggtcatcgcgctgcgggaggagctgagcgacaagcgcagccgcctctccacgctggaagacatccagaagaactacgacggcttcgaccgcggcgtgcgcgccgtgatgacgcgcgccggtgtgcaggcccgtgagcagggcatcttcggcctggtggcggacgtcatcaacgtcaccccgcgctacgagcgcgcggtggaggccgccctgggagagcggctccagcacgtcatcgtcgagagccgcgacaagggcgtggagctggtggactacctcaagggccacgccgagggccggggcagcttcctcccggtgcccgcgctggacacgctgccggccccgctggagccggacttcagccagcccggcgtgctcgcgcatgccctgcgtgaggtgacgtgtgaggaggcgctgacgccgctcgtccaactgctgctgggggatgtcgtcatcgtccaggacgtagccacggcgcgcgcgtggaccgagtcgggcggcccggcgtgcacgctggtgacggtggagggcgaggtgttccgcccggacggcaccatcgtcggcggtgagagcgagggcgcggcggtgggcgcgctccagaagaagcgcgaaatcgccgagctggccaccgaggtggcccgcgtggaggagcgctacaacgagattctcacccggcactacacgctccagaagcagatggggcacgcggagggcgtcctcaaggggctggcgaagaatcagcacgccgaggagctgaacctcgccagccaggagaaggacctgcacaaggcgggcgaggacctggcccgcgtgcgcgagcgggtgcgggccctggaagtggaggaggggcagctcacccagagccaccaggccctggagcacgaggaggaggcgagccgcggcgaggtggcgcacggccaggcggaccgcgagggccgcgaggagcgggtgaagcagctcgtgtccgaacaggagtcgctgcgcctgcgcgcagagacggccaacggcgagctgacgggcctgcgcatcaaggtggccgctggcagcgagcgtggcgagtcggcccgcaaggagctggacagcctcgtctcccagcgtcaggacatggagacgcgcatcacccggctccaggccacggtggtggagggtggggcgcgcgtcgaggagctggcgcggcgcacgacggacaccgagggcggcctgtcccagcgcgccgaggagcaccggctcgccgcggaagggctggaggcgcaccgcgcggcgcacaccacggcctccgcggaggtgcgtgagcaggacgcgacgttccgcgagctgcgcggccgcgtggacaagctgatgcagggcctgtcgcaaatctcgctgcgggagcgcgaaatccccctggagctggagcacctggcggggggcatccatgagcggcaccaggtggagctggctaacgaactgcacaagtaccacatgctggccgcgctggccccggagacggaggccgatctgaaggacctgcgcgcgcaggtggagaagatgggggagatcaacctcaccgccatcgacgagcacgcggagctgtccaagcgctacgatttcctcaccgcgcagaagaaggacctgcagtcctccatcgagcagttgaaggaggccatccagcgcatcgacgccaccagccgcgagcgcttcaagcagaccttcgacgtggtgaacgagaagttccaggccatcttcccccgcctgttcggcggtggccgggccagcctcatcctcaccaacgaggggccgggcggggagccgggcgtggaaatcgtcgcccagccgcccggcaagaagctgcagagcgtcaacctcctgtcgggtggcgagaaggccctcaccgccgtgggcctcatcttcggcatcttcctcatcaagccgacgcccttctgcctcctcgacgaggtcgacgcgccgttggatgagggcaacgtgggccgctacaacgacatggtgaaggagatgagcaagcagtcgcagttcatcctcatcacccacaacaagcggaccatggaggtttccaacaccctctatggcgtcaccatggaggagccgggcatctccaagctcgtcagcgtgcgcatgcgcgag

SEQ ID NO: 43073 - DNA, 2214 bp, Myxococcus xanthus
gagcggatggacctcgccgtgtcgggtatgacgtgcgccgcatgcgcgcgccgcgtggaacgcactctgagcgaggtggagggggtccaggagtgcagcgtcaacttcgccacccgccgtgccagcgtactcttcgatgctcgggctacgtccgtcagtgcactggccgatgcggtggccgacgccggctatcgcgctgaggtgccgcaggcttccaccgccgaagagacggacgccgcggaggagcgagggctccggcgccggctcgccgtggccgtgctcttcggcttgccggtggtcgtgctggccatgtcccacggagcgctcgacttcaccggttccatctgggtgcagctcggcctgacggtgccagtcatggcgtacagcggtggtcccatcttccgggcggcgtgggccgcgttgcggcacaggtcggccgacatgaacgtcctggtggcgctcgggaccggcgcggctttcattttctcggtggtggccaccgtgtggccgacattcatggtcaccggggaccacggaggtcatggtgggcacggagccgcaccccccatctacttcgaggcggcggccgcggtgattgccttcgtactgctcggccgcttcctggagtcgcgagcacgcacccgggcaggggatgccatccggcggcttcaggcgttggccccttccatcgccaccgtgctggagaatggcgtcgagcgagaggttcctctcgccgaggtgcgggtgggggaccgtgtggtggtgcgtccggggcagtccatccccgtcgatggctccgtcgtggacggggcctcctcggtggacgaatccatgctcacgggggaaagcctgccggtggagaaggccgcgggcgcggaggtcttcgccgggacgatgaacggcacgggccgcctggtcttccgcgcggccaaggtggggagtgacaccgcgctccagcagattgtccaggtggtggagcgggcccagggcaccaaggcgcccatcgcgcgcctcgcggacgtggtgagcggcgtcttcactccggtggtgctgctcatcgccatcgccacgttcgcggcctggttcgtcttggcccccgaggagacgcgcctgacgatggccctgctcaacgcggtggccgtgctggtcatcgcttgcccgtgcgccctgggcctggccacgcctgcggcgctcatggtggggatggggcggggtgcgcagctcggagtgctggtgaagagcgccgcttcgttggaaggcgcgagccgtatcgacaccgtggtgctcgacaagacgggcacgctgacccaggggcgcccggcggtggtccgcgtcctcaccgcgagcggcatgacggaggaggaagtgctgaccctcgccgccgccgccgaatcggcgagcgagcacccgctggcccgtgccgtcgtgtccgaggcctccaaccggggcctgaaggtcggaacgcccgagtcgttcaccgccactccgggacatggcgtggaagccgaggttggcgggcgcaaggtgctcgtgggcagtcgtcggatgctggacggacggggcgtgtccgggagcgaggacgccgagcgtgtgctcacgacggacgggcagacgcccgtgctcatcgcggtggacgggcgctgggtaggcgccatcggcatcgcggatccagagcgggaggaggccgccacggtggtccaatccctgcggagcatggggctgcacgtggtgatgctcacgggcgaccatgatggaccggccgcacgggtggcgcgcgcgctcggcatcgaccgggtcttcgccggtgtactgccgtccggcaaggcgcacgtggtgcgtacgctccagacggagggacggcgcgtggccatggtgggggatggcatcaacgacgcaccggccctggcggaggcggacctcgcagttgccatgggcacggggacggacgtggcccgggatgccgcgggcgtcgcgctgcttcgctccgatttgcgaggactgccggccgcactcggggtggctcgccccacgattcgggtcatccgacagaacctgttgtgggccttcctctacaacgtgcttggcatcccggtaacggcggggttgctatacggcctgacaggctggctgttgtcaccaatgctggcgagcgtgcccatgtccctgtcgagtgtgtcggtcctgctcaacagcgtgtgtctacggcgcctgcgc

SEQ ID NO: 43074 - DNA, 1270 bp, Myxococcus xanthus
caggagcagcaagcaggagtcgaagtcgtgaagcgtggtgagtccgcgccgtcgccgtcgttgcgcgtgctggatgtgatggccctgacagtgggcatcgtcctgggagcaggcatcttcaaggcgccctcgctggtggccgcgcagtccggcagcggtgaggccatgctgctcacgtggctgctgggcggtgtcgcgtcgctggtgggcgcgctgtgttacgcggagctggccagcgcctggccacacccgggcggggactaccactacctgtaccgcgcgctgggcaaggggcccgctttccttttcgcgtgggcgcggctgaccgtcatccccaccggctccatcgcactgctggccttcgtcttcggggactacgccacgcagctcttccccctgggcctgtattcgtcgcccgtctatgcggccatgctggtggtggggctgacggcggtgaacatcgccggacttcggcaggggacccgtacgcagaacctgctcacggccctggaggttctgggcgtgggggctgtcgtcatcgtggggttgcttttcacgcccgcgctggtgcccgcggcggcgccgccggcaccggccgcgtcgtcagggaccgcctggggcctggccatggtgttcgtgctgctgacgtacggcggctggaatgaggtggcgtacctgtcctcggaggtgcggggttcgcggcgcaccatcgcctggtcgctgttggcgagcatcgggctggtgacggcgctgtacctgctggtcaacgtggcctacctgcgcggcctggggctcgaaggcatggcgcgttcggaggcggtggccgcggacctgatgcagcgcgcggtgggcagcgggggcgcgctggtgttgagcgtcatcatcgccatctccgcgctgacgtccgccaacgccacggtgctgacgggggctcggacccactatgccttcgggcgggacagcgtgctgttcaatgggctggggcagtggcatgcgaagtccaatggcccgtcccgcgcgctgctggtgcagggggccatctccctggcgctggtggggctggggacgctgacgcgtcagggcttcgagacgatggtggagtacaccgcgcccgtcttctggctcttcttcctgctgacgggcgtgtcgctgatggtgctgcgcgtgcgtgagccggatgcgccgcggccgttccgcgtgccgctgtatccgctcacgccgctgctcttcatcggcatctgcgcctacgtcctctattccagcctggcct

SEQ ID NO: 43075 - DNA, 566 bp, Myxococcus xanthus
caaggagccgtaatgctgaccgttggcgacaagatcccgaacttcaaggtgaaggccaccgtgtccctggagaagggcaaggagttccaggacatcacgaacgagaccttcaagggcaagtggctggtcctgttcgcgtggccgaaggacttcaccttcatctgccccacggagatcgcggagttcggcaagaagaacaaggacttcactgaccgtgacgcgcaggtcctcggcctgagcaccgacagcgagttcgtgcaccacgcgtggcgcacgcaccacccggacctgaagaacctgcccttcccgatgctggcggacatcaagcacgagctgtgcaacgcgctgggcatcctccacaaggaagagggcgtggccctccgcgcgacgttcatcgcggaccccgagggcatcatccgccacgtgacggtcaacgacctgtccgtgggccgcaacgtctccgagacgattcgcacgctggacgcgctccagacggacgagctgtgcccctgcaactggaccaagggtgaggagaccctgacccagaagctgtcgaaggcggggta

SEQ ID NO: 43076 - DNA, 699 bp, Myxococcus xanthus
aacaccccggacgggtcgacgccggatgctggcgacgactgtggtgacggccagcgccagtccggcgaggcctgtgacgacggcaacagggtggacggtgacggctgtaacgcgacgtgcaccacggtggagggcgggttcatctgcgaggtgccaggagcgccgtgcgtccacctggtgaactgcggaaacggccgcgtcgaggacggcgaggagtgcgacgaccggaacctggtcagcggtgatggttgcaacgggagctgccgggtcgaacgtggctgggcgtgcccggcccagggtggccgctgccgcgccaaggagtgcggtgacaacatcatcgccggtgatgaggagtgcgaggatggcaacaccactccgggcgacggctgcagcgacgtctgccggctcgaggaaggctggaagtgcccgccgggtcagccgtgcagccgcaccacctgtggtgacggcatcaccgagggcaccgagcagtgcgacgacggcaacaccgtgatgggtgacggctgctcgccgctgtgcaccaaggagccccgctgctcggatggaaactgcgaggagacgtgcggcgacgggctcatcctccccaacagcgccgttgaggagtgcgacgacggcaacacgcgcgccaatgacggctgctcgccggactgcaagttggaggatggcttcgcgtgcgtgctc

SEQ ID NO: 43077 - DNA, 1131 bp, Myxococcus xanthus
ctgttcacgtctgaatccgtcactgaaggccacccggacaagatcgccgaccagatctccgacggtgtgctggatgccatcatcgccaaggaccctcaggcgcgcgtcgccgtggagacgctcgtcaagacgggcctcgccatcgtcgcgggtgaggtgacgacgaactgttacgtggacatcccgaagctcgtccgcagcaccatctgccgcatcgggtacaccgacagctccatgggctacgacggcaacacctgcggcgtcatggtggccatcgaaggccagagccaggacatcgcccggggtgtcgacaacaagaaggaccagggcgccggcgaccagggcatgatgttcggcttcgcctgcgacgagacgccggagctgatgccggctcccatccactacgcgcacgccatcacccgccgcctggcggatgtgcgtcgcaagcagcacccgtggatccgcccggacggcaagagccaggtgacggtggagtaccgcgacggccgccccgcccgcatcgacgcggtggtggtgtccacgcagcactccgatgaggtctccaacaagaagatccaggaggccatccgcgaggacgtcatcgcgaacgcgctgcccaagaagctcatcgacaacaagacgaagttcttcatcaaccccaccggtcgcttggtggcgggtggccccatgggtgactccggcctgacgggccggaagatcatcgtggacacctacggcggcatgggccgtcacggtggcggcgcgttcagtggcaaggacccgtccaaggtggaccgctcggccgcgtacatgggccgtcacatcgccaagacggtggtggccgcgggcctggcccggcgctgcgaggtgcaggtgtcctacgccatcggcgtggccgagcccgtcagcgtcatggtggagaccttcggcaccgccacggttccggaagagcgcatcgccctggccgtccgcaagacgttcggcctgcgtccgcgcgaaatcaccgagtacctgaacctgctgcggcccatctaccagaagaccgccgcctacggtcacttcggccgcacggagaaggagttcacctgggagcgcgtcgaggagaagaaggacgcgctgcgggatgccgcc

SEQ ID NO: 43078 - DNA, 1398 bp, Myxococcus xanthus
gattacgccatcgccgacctgtcgctcgccgactggggccgcaaggaaatccgcatcgccgagagcgaaatgcccgcgctcatggccatccgcgaggagtacgccaagacgcagccgctcaagggcgcgcgcgtgacgggctcgctgcacatgaccatccagacggccgtgctggtggagacgctccaggcgctgggcgccgaggtccgctgggcgtcgtgcaacatcttctccacgcaggaccacgccgccgccgcgctggtgcaggccggcacgccggtgttcgcgcacaagggcgagtccctcaaggagtactgggacttcacccaccgcatcttcgacttcggccccgcgggcagcgaccacgagggtccgaacatgattctggacgacggtggtgacgccacgctgctcatgcacctgggcaagcgcgcggagaaggacgccagcgtcctcgccaacccccagagcgaggaagagcgcgagctgtacgccgccatcaaggcgaagctggccgaggacgcgacctggtacacacgcaagagcgcgaagattctcggcgtcaccgaggagaccaccacgggcgtgcaccgcctccaggaaatgtccgccaagggcacgctcctgttccgcgccatcaacgtcaacgacagcgtgacgaagagcaagttcgacaacctgtacggttgccgtgagtcgctggtggacggcatcaagcgcgccacggacgtgatggtcgccggcaagattgccgtcgtcgcgggctacggcgacgtgggcaagggctccgcgcaggcgctgcgcgcgctgtccgcccaggtgtgggtgacggagatcgaccccatctgcgcgctccaggcggccatggagggctaccgcgtcgtcaccatggactacgccgcggacaaggcggacatcttcgtcaccgccaccggcaacaagggcgtcatcacccatgaccacatggccaagatgaaggaccaggccatcgtctgcaacatcggccacttcgacaacgaaatcgaggtcgcctccctggagaagtacaagtgggaggagatcaagccgcaggtcgaccacatcatcttcccggacaacaagcgcatcatcctgctggccaagggccggctggtgaacctgggctgcggcaccggccaccccagctacgtgatgtccagctcgttcgcgaaccagaccatcgctcagattgagctgtactcgcacagcgccaactacgaggtcggcaaggtgtacgtgctgcccaagcacctggacgagaaggtcgctcgcctccagctcaagaagctcaacgcccagctcaccgagctgagccaggagcaggcggactacatcggcgtgaagacctccggcccgtacaagccggacacctaccgctac

SEQ ID NO: 43079 - DNA, 789 bp, Myxococcus xanthus
gtgttgcccaagtccgcgctctccaccgtggtggggatggccacgcgactgcccgtgcccgcgccggtgcatcaggccgccatgcgcgccttcgccaaggcctacaacgtggacatggaggaggccgagcactccttcgagcactacccgaccttcgcccagttcttcacccggggcctgaagcccggcctgcgtccggtggacgcgggggagaaggtggtggtgtccccggtggatggccgcgtgtcccaggtgggctattcggattacgggcgctgcctgcaggccaagggcatcgagtacacggtggacgagttgctgggggattccgaggccgccaagcccttctacggcggtgcctggacgaccatctacctgtcgccgcgcgactaccaccgcatccacgcgccgctgggcggcaccatcaccgggtacgcgtacatccccggtgagttctggccggtgaaccccgcgtcggtgaagaacaagcagtccctgttctgcgtgaacgagcggctggtgacgtacctggacaccgtggcgggcaagtgcgcggtggtgaaggtgggtgccacctgcgtgtcgcgcatcaaggcggcctacgacgaggtgacgacgcacaccgggcagcccggcaaggtgcaccgctacggctcggccatgccggtggagaagggtggggagctgggccgcttcgagatgggctccaccgtcatcctcctgttcgagcccaagcgcgtcacctgggacgacagcctccaggaggaagcggtggttcggctgggcaag

SEQ ID NO: 43080 - DNA, 747 bp, Myxococcus xanthus
catgtggcggtggtgcacgggtatggagaccacttcgggcgctatggcttcgtgacggacgcactgctggcggacggcttcgcggtccacggcttcgactaccggggccacggtaaggccgacgggcgccgggcctactgtgagaagtggccggactacctggaggacctggaggtcttctgggagcgggtgcgcgcggtgtcggagggcaagaaggccttcgtgctggcgcacagccacggcggcctgatgtcggcgacgtgggcttccagccggcgggtggaggggttgacggggctggtgctgtcggcgccgtacctcaagctggccatcacccctccggcctcgaagctgatggccgcgcgcgcggtgggcaagctggtgccatggctgagcatctcctccggactgaaggtggaggacctcacccatgacaccgacgtgcagcgggccacccgggaggacccgctccatcaggccatcgccacgccacggtggttcgtcgaatccacccgggcgcagggtgaggccgtgctgctggcgccgaagattcaagtgccgctgttcgtcctgtgtggcgcggaggatggggtggccgctccggcggcggcgcgggagtacttcgagcgggcggggtcgccggacaagaagttcaaggagtaccccggaatgcggcatgagccgctcaacgaggtgggccgtgcggaggtattccgggatatctccggctggatctccgcgcatctc

SEQ ID NO: 43081 - DNA, 1581 bp, Myxococcus xanthus
ctcaccatgccccatcggttcgatttcctcgtcctgggaggcggcgtggcgggtctttcgttcgccctccaggcggcccgccatggcacggtggccatcctcaccaagcgcgaccgtttcgaaagcaacacggcctatgcccagggcggcatcgccagcgtgctcgcgccccctgacaccttcgagtcccacatcgaggacacgctggtggcgggtgcggggctgtgccaccgcgacgcggtggaagtcacggtgaaggaaggccccagccgcgtgcaggagctggcggacctgggcgcggagttcaaccgccgcatcaccggcgaattcgacctcacccgcgagggtggccactccgcgcgccgcatcatccattcgggcgacatcaccggccgcgaggtgcagcgcgcgctgctcgccgcgtgtgacgaagcccccaacatcaccttcttcccgcagacggccgccatcgacctcatccaggaccggcgcgtcccctcccctggggtcagccgctgtctgggggtctacgccctgctggaagacggcgtcatcgagcgcttcctggccaaggtgacggtgctggccaccggcggcgctggcaaggtgtacctctacacatccaacccggacgtggcgacgggtgacggcgtggccatggcgtaccgggcgggcgcgaaggtggcgaacatggagttctaccagttccaccccacgtgcctttaccacccggaggccaagagcttcctcatcagtgaggcgctgcgcggcgagggcggcaagctgaagctcaagagcggcgcgtccttcatggagcgctaccaccccatgggcgcgctcgcgccgcgtgacgtggtggcgcgtgccatcgacgcggagatgaagcgcacgggcgacgactgcgtctacctggacatgacgcacctgggacgcgccttcctcgccgagcgcttccccaacatctacgccacctgcaaggcgttcaacatcgacatggcggtgcagcccatccccgtcgtcccggcggcccactacatgtgcggcggcgtggtgacggacctggagggacgcaccaacgtgcccagcctgtacgccatcggagaagtcacctgtacgggcctgcacggcgccaaccggctcgcgtccaactcgctgctggaagggctcgtcttcggccaccgcgccgtgcaggtggccgccgaagaagtgcgcgcccagccctctccctccgaggacccgccgccctgggattcgggcagcgcggtggagtcggatgagagcgtcgtcgtcacccacaactgggacgagattcgcaggctcatgtggaactacgtcggcattgtccgcacggacaagcggctgatgcgcgcgcggcgccggctggaactgctgcgcgaggagattcgcgactactactggcgcttcaaggtgactcgcgacgtcatcgagctgcggaacatcgccgacgtcgcctacctcatcgtcgactgcgccagccgccgcaaggagagccgcggcctccactacacgctggactacccgcacccggacgaccaccgctggttgcgggacaccgtcgtg

SEQ ID NO: 43082 - DNA, 606 bp, Myxococcus xanthus
gcgctgcgcggcatcaatctcaccatccccaagggtaagacggtgggcatcatcgggcggaacggctcggggaagagcacgctgctcaagctcatcaccggcatctacacgcccacctccggcgacttgcagatcaacggtcgcatctccgccttgctggacctgggcgctggcttccatccggacttctccggacgggagaacatcctcatcaacggcatcatcctgggcatgacgcgcgccgaggtccgggcccggatggatgaaatcatcgccttcagtgagctgggcgagttcatcgacgagccggtgcgcacctactccagtggcatgtacatgcgcctggcgttcgcggtggccacgcacgtggacccggacatcctcatcatcgacgaaatcctcgccgtcggggacgagcacttcagcaagaagagcctcgccaagatgatggacttcaagcgtcaggggaagaccatcgtcctggtgacgcacgagctgggcaccgtggagcgctggtgcgacctggctgcgtggattgatggtggctacgtccgccgcgtgggcaagccctcggaggtcaccgccgagtaccgtgaggccatttcc

SEQ ID NO: 43083 - DNA, 1422 bp, Myxococcus xanthus
gtctcgtgccgtaacctcgttggaggaagctggcaggtgccgcccggtgcggcgcaccttgatgtccggagcccctacacgggcaccgtcattggcagggttcccctgacgcccgcatccggagtcgcccaggcggtggaggccgcgaaggcggcggcggctgcctggaagaacacctcgctgcgggagcgcacgcagtacctgtaccgcttccgccagttcctcgagcgtgacctggacgccctggcccagctggccgccagcgaggcggggaagacggtggcggaggcccgcgcgggcctgctcaagggcatggaggtctgcgacttcgcgctgtccctccagaacctcgacacgggcgcgcacctggaggtcagccgcggcatctcctgtgagtaccgccgcgagccgctgggcgtcgtcgccggaatcactccgttcaacttcccggccatggtgccgatgtggatgttccccatcgccgtcacgctgggcaacgccttcatcctcaagccgtcggagaaggtgccgctgaccgcgtgcgcgctgggcgagctcatgtgtgaggctggctaccccgcgggcgtcttctccgtcgtgcacggcggcaaggaggcggtggacgcgctggtggcgcacccggacgtgcaggcggtgggtttcgtcggctcgtccgcggtggcgcgccacctgtacgcggagggctgcaagcgcggcaagcgcgtgctggcgctgggcagcgcgaagaaccacctcatcgtcgtgccggacgcggacccggagttgacgccgcaggcggtggtggactcgttcaccggctgcgcgggccagcgctgcatggcggccagcgtgctgctcgcggtgggcaacgtggagtcccttctccaggaagtcgtccgccgcgcggcgaagctggaattgggccccggcatgggcgcgctcatcgaccggggctcgttggaccgcttggagacggccattgcccgcgcggaggccgagggcgcgcgggtgctgctggacggccgtggccacaagccgcagggcgagccgtggtccggcggcaactggctgggccccacgctgctggacggcgtgcgtccggagatggaggccgcgcggcgcgagctgttcggcccggtgctctccatcgtccgggtgcccacgctgtccgcggcgctggcggtggagaacgcgtcgccctacggcaacgcggcgtccatcttcaccacgaacggtggggtggcgcagacggtggtggagggcgtgcgcgccggcatggtgggcgtcaacgtgggcgtccctgtcccgcgtgagccgttctccttcggtggcacgggcgattcgcgcttcgggcacggggacatcaccgggccgtccagcctcgacttctggacgcaggtgaagaaggtcacccgcaagtgg

SEQ ID NO: 43084 - DNA, 960 bp, Myxococcus xanthus
atgcacttccgcaagctcggccgcagcggcctcgtcgtcagtgagatttcctacggcaactggatcacccacggctcccaggtggaggaggaggccgcgctcgcctgcgtgcgcgcggcgctggacgtgggcatcaccaccttcgacaccgcggacgtgtacgcggcaacccgcgccgaggaagtgctcggccgtgccctgaagggcgagcggcgcgccggctatgagctcttcaccaaggtgtactggcccaccggccccggaaagaatgaccgcggcctgtcgcgcaagcacatcctggagagcatcgacggctcgctgcgccggctgcagacggactacgtggacctgtatcaggcccaccgcttcgacgtggagacgccgctggaggagacgatgctcgcgttcgccgacatcgtccgccagggcaaggcgctgtacatcggcgtctccgaatggacggccgaccagattcgccagggcgccgcgctggcccgcgagctgcgcgtgcccttcatctccaaccagccgcagtactccatgctctaccgcgtcatcgagccgcaggtcatcccggcctccgacgaagcaggcctggggcagattgtctggtcccccatcgcccagggcgtcctcaccggcaagtacctgcccggccaggcccccccggcgggcagccgcgccacggaggccaacgccgtgcgctacggcatcacccgcttcatgacggatgacgtgctcacccgcgtgcagcagctcgtcccattggcgaaggatgtcggactctccatggcccagctcgccgtggcctgggtgctccagaatcccagcgtctcctccgccatcgtcggcgcctcccggccggagcaggtgcacgacaacgtgaaggccgcgggcgtgaagctggagccggagctgctgcgccggattgacgcggtgctgggccccgccatcgagcga

SEQ ID NO: 43085 - DNA, 1449 bp, Myxococcus xanthus
gcgtctcaacgcgaccgtgggcatggcccgccgccgcgctacgcagcgggcacgaggtgaaggcacatggcggaagcgttcgacgtggtggtgataggggcaggccccgcgggtgaggtcgccggtgcgcgcgccgcggaggccgggctgtcagtggcgttggtggagcatgagctgctcggcggcgagtgctcatactgggcctgcatccccagcaaggccttgctgcgcccgagcgaagcgcggtggctggcggagcatgccgccggcgtgcgcgagaagctccaggagggcatcgacgcgcgtgcggtgctggcccaccgggattcgatggtcaacaactaccaggacgactcccaggtgaagtgggccgagaatgcgaagctgaaggtggtgcggggcaccggcaagctcactggccctcgcaaggtgcgtgtggaggacaaggacggcgccgtgcgggagctggaggcccgaaaagccgtggtgctggccaccggcagccatccgcgcatcccggacatcccggggctgaaggacgcccagccctgggacaaccgccagggcactgcggcgaggcaggtgcccaagcggctggtggtgctgggcggcggcgcggtcggggtggagctggcccaggcgtggcgctcgctgggctccgaggtgacgctggtgcagcgcggaaagagattgctgtcccgcgcggagcccttcgccggagagcaggtggcccaggcgctgcgagatgccggcgcgcgcgtgctgcttggaatgaacgcgacgcgcgtccagcggcccggcggcaagggcgaggtgacggtgacgctgtccaatggcgagcaggtcgtcgcggacgaaatcctggtggccatgggccgcgtgccccgcacggaaggaatcgggctggagacggtggggctcgtgggcggcaagcccgtggaggtggatgaccagctccgcgcgaagggcgtggacggcggctggctctacgcgtgcggcgacaccaatggccgcaacctcctcacccatatgggcaagtaccaggcccgcatggtgggcgacgtcatcgcgggcaagcaggcaagggcctgggcggacgcgaaggccaccccgcaagtcgtcttcacccacccacaggtggccagcgtgggcctcaccgaggccaaggcacgcgaggccgggctgccggtacgcacggtggagcagcaactccaggacgtgtccggcacctcgctggtgggcaagggcctcactggcaccgtgaagtgggtggtggacgagaagcgccgggtgctcgtgggcgccacgttcaccgggccggaggtgggagagatgctccatgcggccaccatcgccgtggcgggggaggtgccgctcgacacgttgtggcacgcggtgccgtcgttccccaccatgagcgaggtgtggttgaagctgctggaggcgtac

SEQ ID NO: 43086 - DNA, 2643 bp, Myxococcus xanthus
  unsure (1)..(2643): unsure at all n locations
agcgcacatgcagcgattttcgagcactcgcgggatggggtgctcgtgctggatgctgggcagcgcatcgtggaggtcaaccgcgccgcggaacgcatcttcgggccgcgtaccagactcgtggggcagccggtggggctgctcctgcccggctggcgtcctcccgagccccgcgctcccgccgatgccgccctgcgcgagacggagctggccgggcatcgcccaggcggctctggccccgcgcactacctgcgggtggtgacgctgcccctgcccggagaaggggacgggggctgggtcttgcagctccatgacatgacggcccgcctggaggtggaggcctcgctccggcagcagaaggagttcttcgaggcggtggtcatcaacagcccggtggccatcatcaccatcacccgccagttccgcgtgctgtcgtggaaccccgaggccacgcgcctgttcgggtattcgccggcagaagcgctcggcaagcacatcttcgaactggtcgccaccgagcccaccgtcctcccggaagcggagcaggcgtcgcgcgaggtcgtgcagcgcgggcggctgcgctccgtcacccggcgggtccgcaaggatggcagcgtggtggacgtggagctgcgggcgctgccggtgtcggtgggcgggcggcagcttggcttcatcgccatctaccacgacatcaccgacctcgaacgggcacgcaaggcggcggaggcggccaatcaggccaagagcctgttcctggccaccatgagccacgaaatccgcacgccgatgaacgccatcatcggcatgacgggcctgctcctggaccgggcgctgacggaagagcagcgcgacttcgtcgccaccatccggcagagcagcgaggcgctgctgacgttgctcaacgacgtgctggacttctccaagatcgaggccggtcgcttcgaggcggagctgcggcccttcgacctgcgccagtgcgtggagtccgtcctggacctgatggccgtgcgcgccagcgagaaggggctggacctggggtgtgacctcgcgccgccgctgccgcagatgttggtgggcgatgcgtcgcgcctccgccaggtgctgctcaacctggtgggcaacgcgctcaagttcaccgaacacngcggcgcggtggtgagcgtgcagggattggccctgggcggcacggagggcgcggcggactgggagctgaccttcagcgtgcaggacaccggcctggggattcccgacgaccggcgcaccgggctgttccagccgttcaaccaactggatgcctccgtgtcgcggcgctttggtggcacggggctggggttggccatctccaagcggctggtggaggccatggccggcaccatctgggtggagagtgagggcgtgcccggacaaggcaccaccttccgcttcaccctgcgcgcccaggctgcgccacaagcctacgcggtgcagccgcgccaggagcaggggctgctccagggccggcgcgtgctcgtcgtggatgacaacgctctgtttcgaaggttgctgggccggcagctccaggcgtggggcctggtgcccgtggagtccgcgtcggggatggacgcgctcgcccaactcgaggcgggggcttcgttcgacgcggtgctcattgaccatcacatgccggggctggatggcaccgcgctggccgagcgcatccggcagcgcgaggagacgcgggcccttcccctggtgctggtgtcgacgccgggccggcggggcaatccccccgagggcctgttcgcgggcgtgttgtcgcgtccgctgaaggactcgcagctctacgacgcgctggtgtcgtgcttctcgcagcaccttccccagctcccggagccccggcagacgcggccctcgcgagcggggccctttccgggggagcggccgggggacaccgtgccgctggacatcctcctggtggaggacaacgccaccaatcagaagctggcgctgctggtgctggagcggctcggctaccgcgctgacgtggcgctgaacggacgccaggcgctgcaggcgttgtcccagaagcgctacgacgcggtcctcatggacctgcagatgccggagatggacggcctggaggccacgcgccgcatccgccaggaactgccgcccaaggcgcagccctgggtcatcgcgatgacggccaacgccatggactccgaccggactcagtgcttctcggcgggcatggatgacttcctgggcaagcccatccgcgtggaggcgctgatggcggcgctcatgcgctgccagccccggcgttcgtaggtggcaccggagcggcgggtctccagcggcgcggtcgagctcacgccgcagcactcggtcatgagagtcgtgctggacgtggcgcgcatcccgggcctggagtctgccgcgctcgcccggctgtgggcggagctgggggcgcaggcggcgcagattctccccgaactcatcgacaccgcgctgcacagcatgccggcgctcctggaggacgcgtactcggccctggggcgtgggcacgcggacgacctgggccgggcggcgcatacgctcaagtcgaacgcggcctggttcggcgccagcgcgctggagtcccaggcccgcgacatcgag

SEQ ID NO: 43087 - DNA, 978 bp, Myxococcus xanthus
gggttggacaagctggtgcaggtcgagcggccggacccgactccaggccccatgcaggtgcgggtgcgcgtgaaggccacgagcctcaactcccgtgacttgatgatggtggagggtcgttacaacccccggcagaagctgccactcattcccaactcggacgcggcgggcgtcgtggatgcggtaggcccgggtgtgacgcgggtgaagcctggtgaccgggtgatgagcctcttttcccaggcctggagcgccggagagcccacgcgggcggcgcaggtgagcacgctgggaggaccgttggacggtgccctcgcggacacggtgctgttgcacgaggacggcgcggtgcctacgcccgcctatctctccgatgaagaggctgcgacgctgccgtgcgcggccgtgacggcgtggagcgcgctggtcacccatggggcactcaaggcgggggacaccgtcttgcttcagggcaccggtggcgtgtccatcttcgcgttgcagattgccaggctgctgggcgcgcgaatcatcatcacctccagcagtgacgccaagctggcgcgagcccggacgctcggcgcgcatgaaggcatcaactacgggacgacgccggactgggacaaggcggcgcgcgcgctgacgggaggcgtgggcgtggaccacgtggtggaagtgggtggggcggggaccttcgagaagtcgctgcgcgcggtccggcccggcggcacggtgtctgtgattggcgtgctcagcggtggtgcggggacggtgccgctgacgcccatcctcatgcagaacctgcgggtgcagggcatcttcgtgggccaccggcagagcttcgacgcgctcaaccgggccttcgcgttgcacaccgttcgcccggtggtggaccgcgtcttcgagttctccgaggcacgcgctgctttcgagcacctcaagagaggggcgcacttcgggaaggtggtcgtccgggtg

SEQ ID NO: 43088 - DNA, 1350 bp, Myxococcus xanthus
caggcttcgcagaagctgttcggcacggatggtgttcgcgggaaggcgaacgtctatcccatgactgccgaggtcgcgatgcagctcgggcgggcgctcgcgttcctcatccgcaacggcccgcaccgccaccgcgtcatcgttggcaaggacacgcggctgtccggctacatgttggagcaggcgctggcctccggcctcacctccatgggcgtggacgtggagctcgtcgggccgctgccgaccccgggcatctccaacatcaccacctccatgcgggcggacgcgggcgccgtcatctccgcgtcccacaacccctacgaggacaacggcatcaagttcttctggcgcgacggtttcaagctgccggacgagacggaaggcaagattgaggagctggtgtccagcggctccatcgactccatccggcccacggccacgaagattggccgggccttccgcatggaggacgcgcggggccgctacatcgtcttcctgaaggccaccttcccgcgcgagctgacgctggaggggatgaccatcgtcgtcgactgcgccaacggcgcggcctacaagacggcgcccgccgtgctggaggagctgggcgccaaggtgattgcgctcggcgtttcgccggacggcaagaacatcaaccacaagtgtggcgccctctatccggagaacctggccaagacggtggtgaagcacggcgcgcacctgggcatcgccctggacggtgacgccgaccgcctcatcgtcgtggacgagaagggcaaggtcgtcgacggcgacgccatcatggccatctgcacgggcgagctggtggcccgcaagcaactgaagaagaagatgttggtctccacggtgatgagcaacatcggcctggagcgcgcggtggcgcgctggggcgtgaaggtggctcgcacgcgcgtgggtgaccgctacgtcgtcgatgagatgcgccgcaatggctacaacctgggcggcgagcagagcggccacctcatcttcctggatcacaccaccacgggtgacggaaccctggcggcgctccagttgctggcggtgatgtgccgggcgggcaagcccctgagcgagctggcctccatcttcgagcccgtgccccagacgctggtcaacgtcgtcgtgaagcagaagaaggagctgggcgagctcccgacggtgatgaaggtcatcaagagcgtggagcagcggctgggcaacaccggccgggtgctggtgcgcttctctggcaccgagcccaaggcccgcgtcctcatcgagggcgaggacgccgcccgcaaccaggcctacgcgaaggaaatcgcggacgcgctgtccaaggccctc

SEQ ID NO: 43089 - DNA, 1878 bp, Myxococcus xanthus
aagaccatcgggctctgggtcatcctgatcgtcctcttcgtcgccttctacaatttcttctcccagggcaacgaccaggtccaggaaccgtccttcacccagttgctgacgaaggtggaggagaagaaggtccaggaggttgccgtcaagggcaacacctattccggcaagttcaccgacacgtcggagaagttccgcacgacggggccggcgccggatgcggccatgctgaaccagctccgcagcaacggcgtggacgtgaagtacgagcgggaggagcagaacagcctctggctgaccatcctcggtcagtggatgccggtcgtcttcctgttcctgttcttcatcttcttcatgcgccagctccagggtggcagcggcaaggccatgaccttcgggaagtcgaaggccaagctcctcagcgagagccacaacaaggtcaccttcgcggacgtggccggcgcggacgagtgcaaggaagagctcgaggagattgtcgccttcctcaaggacccgaagaagttcaccaagctgggcggccgcattcccaagggcgtgctgatgatgggctcgccgggaacgggcaagacgctgctcgcccgcgcggtggccggcgaggccggcgtgccgttcttctccatctccggctcggacttcgtggagatgttcgtgggcgtcggcgccagccgcgtccgtgacctcttcgagcagggcaagaagaacgccccctgtatcatcttcatcgacgaaatcgacgccgtgggccgtcaccgtggcgcgggcctgggcggcggacacgacgagcgcgagcagacgctcaaccagctcctcgtggagatggacggcttcgagtccaacgacggcgtcatcctgattgccgccaccaaccgtccggacgtgttggatccggcgctccagcgtcccggccgcttcgaccggcgcatcgtggtgccgcgtcccgacgtgaagggccgcctgggcgtgctgaaggtgcacacccgccgcgtgccgctggcgccggaagtggacctggaggtcatcgctcgcggtacgccgggcatgacgggcgcggacctggagaacctcgtcaacgagtcggcgctgatggccgcgcggcagaacaaggagcgcgtggacctgagcgacttcgaggccgccaaggacaaggtcttcatgggccccgagcggcgctccatgatcatgaccgagaaggagaagaagaacaccgccgtccacgaggcgggccacgcgctgctggccaagctcctcccgggctgcgaccctctccacaaggtcaccatcatcccgcgcggccaggccctgggcgtcacctggagcctgcccaccgaggacaaggtcaacggctacaagaagcagatgctggaccagatctccatggccatgggcgggcgcatcgccgaagagctcatgttcaacgagatgagcagcggcgccgccaacgacatcgagcgtgccaccgagacggcccgcgccatggtgtgccgctggggcatgagcgagaagatgggccccctggcgttcggcaagagcgacggtgaggtgttcctgggccgcgacttcaactcgtccaaggactactccgaggactccgcccggcagattgacgccgaggtccgcaacatcgtcgtgggctgctacgagcgcggcaagaacctgctgacggagaacatcgaggctctgcgccgcgtgtccgacgcgctggtggagtacgagacgctggacgccgaggacgtcaacatcctcctccagggtgggcagctgacccgtgagcgtccgcccccgcgcgtgaatgcgcccccgaaggcgacggagaagaaggacaagcggaagattctcgacgcgctcgagggcctgccg

SEQ ID NO: 43090 - DNA, 2436 bp, Myxococcus xanthus
ctgctccggaagatcggggcagacgtgaagctgttccccgcgcggctcggcgaggcgctccagaagctgccccgcatgcaggggggcgagagcgcgatgctgggccagcggctgctcaagactttcgacaaggccgaggacgaggccaagtccctcaaggacgagttcatctcctcggagcacctgctgctcgcgctcacgcacgacaagggcgcggtgggcgaggtgatgaagtcctcgggcgtcacgagggagcgcgtgctgtccggactcaaggaggtccggggctccgggcgcgtgacgagccaggacgccgaggcgacctaccaggcgctggagaagtacggccgcgacctcacagaggcggcgcgctccggcaagctcgaccccgtcatcggccgtgacgaggagatccgccggtgcgtccaggtgctgagccggcgcaccaagaacaacccggtgctcatcggcgagcccggcgtgggcaagacggccatcgcggaaggactggcgcggcgcatcgtcgatggcgacgtgccggagggcctgaagaacaagcgcctggtgtccctggatttgggcgccatggtggccggcgcgaagtaccgcggcgagttcgaggagcgcctcaaggccgtcctcaaggagattgccgacgccgcgggcgaggtcatcctcttcatcgacgagctccacacgctggtgggcgcgggcaaggccgaaggggccatggacgcgggcaacatgctcaagccggcgctggcgcgcggcgagctgcactgcatcggcgccaccacgctggacgagtaccgcaagcacatcgagaaggacgccgcgctggagcggcgcttccagcccgtcctggtgggcgagccgagcgtgcacgacaccatcagcatcctccgcggcctgaaggagcgctacgaggtgcaccacggcgtgcgcatccaggacaacgccctggtggccgccgccacgctgagccaccgctacatcgcggaccggttcctgccggacaaggccatcgacctggtcgacgaggcctccagccgcctgcgcatcgaaatcgactccatgcccacggagctggacgacgtgcgccggaagatgacgcagctccagattgagcgggagggcttgcgcaaggagacggacccgcactcgcaggagcgcctgggccagattgagaaggagctggccaacctgagcgagaagttcaacgcgctcaaggtgcactgggacgcggagaagacggccattggcgccatccgcagcctgaaggagaagcaggagaaggcgaagaacgaccaggctgcggccgagcgtcagggcgacctgaaccgcgcggcggagctgaagttcggcgtcatcccctcgctcgacaaggagctgaaggcgcagaacgagaagctggccgagctgcagaagaaccagaagttcctcaaggaggaggtcgacgcggaggacatcgcccaggtggtggccaagtggacgggcatccccgtctcgcggctgatggagggcgaggtccagaagctggtccacatggaggaccggttggcgaaccgggtgattggccagcgcagcgccatcgaggcggtgtccaacgccgtgcgccgcgcgcgcagcggactgcaggaccccaaccgccccatcggttcgttcatcttcctgggccccacgggcgtgggcaagacggagacggccaaggcgctggcggagttcctcttcgatgatgactcggccatggtccgcatcgacatgtccgagtacatggagaagcactccgtggcccggctggtcggcgcgcctccggggtacgtcggctacgaggagggcggccagctcaccgaggcggtgcgccggcggccgtacacggtggtcctcttcgacgaaatcgagaaggcgcaccacgacgtcttcaatgtgctgctccagattctcgacgagggccggctgacggacagccagggccgcacggtggacttcaagaacacggtgctcatcctgacgtccaacatcggctcgcaggacatccaggccggcatggcgggcaaggaggagctggacgagcgcacgcgcaacgaggtgatggacgcgctgcgcgcgcacttccggccggagttcctcaaccgcgtggacgagatcgtcatcttcgagccgctgcggaagaaggacatctaccgcatcgtggacctgcagttggcgcggctgtccaagctgctggccgacaagcggctgacgctggagctgacggagaaggcgcgcgagctgctcgccgagcgcggctacgacccgacgtacggcgcgcggcccctgaagcgcgcggtacagaagaacctgttggacccgctggccctcaaggtcctgggcggcgagttcgtcccgggcgaccacatccaggcggatgcgggcccggacgggctcaccttcgcc

SEQ ID NO: 43091 - DNA, 984 bp, Myxococcus xanthus
aagcacgtcacgcacatcaaggatctggggcccgagggcgtggaggcggtgctcgcgcaggcagccgcgtggaagcagaagggaccggagcacgcgctcttcgccaacacgctgctggggatggtgttcttcaacccgtcgctgcgcacacgcacctcgttcgaggccgtcatgctgcgcggcggtggcaacgccatcatcctggacgtgggctccggcgtctggaagctggagcaccgcgagggcgcggtgatgaacgcggaccgggctgagcacctcaaggaggccgcgcctgtcctgtcgcgcttcgtggacatgctcggcgtgcgcaccttctcgcaaggcggcggtgacgaggaggacgaactcgaccccgtcatcaacgcgttccgcaagtggtccaccgtgccggtggtgagcatggagtccgcgcgcgagcacccctgccagggtctggcggacatgctgacgctgcgcgagacgttcggcaacacgaagaagctgccggtgacgctgacgtgggcgccgcacatcaagccgctgcccaaggccgtgcccaactccttcctgctgagcgcggcggcggcgggctgcgagattcgcgtagcccaccctcccgggttcgacctgcacccggccgtccgcgccgaggcggaggcgtacgccaaggccacgggcggcagcgtcacctatacgcacgaccaggacgaggccctggccggcagccgcgccgtctacgccaagtcgtggggccccacggccgctgcggcgttttcgcccaatgacgtctccgcgctgctcgcgtcctactccggttggatgcccacccgcctgacgatgtcgcgcgcgcaaaaggacgcagccttcctccactgcctgcccgtgcgccgcaacgtcgaagtggccgatgaggttctggaccacccgagcagccgcgtcgtagacgaggccggcaatcgctaccacgtccagcgggcgctgctg

SEQ ID NO: 43092 - DNA, 855 bp, Myxococcus xanthus
cttcgccacgcggcgaagtacgtgcagcagttccgccgcaagacgttcgtggtgaagctcggcggcgccatgctcagcgacccgcgtctgcgccgcgccgcctgcgagcagattgcccttctgtggaccttctccatccgccccgtcgtggtacacggcggcggtccggagctggacacgctgtgtgacgccctccaccttccggtggagaaggtggccggccgccgcgtcacctccgcgcccgtgctggacgcggcgaagatggtgctcgcgggcaagctgcacacggacctgctggcggacctccaggcggcgggcgtgcccgcggtgggcctgagcggcgtggacgccggcctcatcaaggcacgcaagcgcccgcccgtcatggtgacggaagccggtgccaccgagggcaagctggtggactacggcctggtgggtgacatcgagcaggtggacacccgcgtggtggagcacctgcgctcggccgactacgtgcccgtcatcgcccccctgtcgggtggcacggacggcgccgtgtacaacaccaacgcggacaccgtggccgcggcgctggcggtggcgctgtccgccgagaagctcttcttcctggtccaggttccgggcctgctgaagaacgtgagcgacccgtcgtcgctcgtcacgctggccaacctcacggacctggccaccatggagagcaccggcgccatcgcgggcggcatgaagcccaaggcgcacgccatccgccacgcgctcgtgggcggcgtgggcagcgtgcacctggtcagcggcgtgcagcccaacgcgctcctggaggaggtcttcaccaacgagggcagcggcaccatggtc

SEQ ID NO: 43093 - DNA, 1050 bp, Myxococcus xanthus
gcgcacgcgcggatgctggcgcgcgtgggcctgctgaaggacgcggaggccaagtccctggtgacggcgctcaaggcgctgcacgacgaggcccgcgcgggcacgttcgtcatccgtcccgagcaggaggacggccacaccgccctggaggcggcgctggtggagcgcgtgggcgacccgggcaagcgcatccacctggggcgttctcgcaacgaccaggtgcagttggccctgcgcctgctgctgcgtgaagaagtgctcacgctgggcgcgcgggcggcggagctggcgggggccttcctggacttcgcgcaggcgcacaaggacgtggcgctgccgggctacacgcacctgcgccgggccatgccttccaccttcggtctgtggggcatggcgttcgcggaagggctgctggaggaactcgaggcgctgcgcggcgtgtgggctcggctggaccgctgcccgctgggcgcggcggcgggcttcggcgtgccgctgcccatcgaccgggagtacgtggcggcgctgctgggtttctcgcgcgtgcagcgcagccccatcgacgtgcagaacggacgcggccgtcacgagtccgcggtgctgggctgggcctgctcggtggcgggcacgctggagaagtggctgtgggacgtgcagctctacagcatggacgagttcggcttcctcggactgccggacgcgtacaccacgggctcgtccatcatgccgcagaagaagaacccggacgtcgtggagctggcccggggccgctgccgcgagctgcgcggactggcgcatcaggtggaggccgtcgcgggcggactgccctccagctaccaccgcgacttccaactgctgaagtcccccaccctgacggcgctgggctccacgcgggagctgctggacgtgctcacccggttggtgcccgcgctccaggtgaaggcggacgcggcggcgcgtgccagcgacgacacgctgtacgcggcgcaccatgcctatgcgctggtggcccagggacaggccttccgtgacgcctacaagcaggtgggc

SEQ ID NO: 43094 - DNA, 729 bp, Myxococcus xanthus
aagaagaacgtggtgctggccttctccggcggactcgataccgctttctgtgccgtctacctgcgagagcagggctacgacgtcaccaccgtcacggtggacaccggcggcttcccgcccgagcagttggagcgcatcgccgcgctgtccaagcagttgggcgcggtggagcacgtgacggtggacgcgcgcgagacgctcttccagggctacctgcgctacctcatcgcgggcaacgtgctgcgcggccaggtctaccccctgagcgtgtccgcggagcgcgcgtgccaggcggcggaggtcgtccgcgtggcgcgcgagaagggcacccaggcgctggcgcacggcagcacgggcgcgggaaatgaccaggtgcgcttcgacgtggccttccgctcgctggcgccggagctggagctgctcacgcccatccgcacgctgtccctgagccggcagcaggagctgacctacctggccgagcgcggcgtccacatgccgccgaagctgggctcctactccgtcaacgagggcatgtggggcacctccgtgggcggcgccgagacgctggactcctggaaggcgctgcccgaggcggccttccccggcggcgagctgtcgcaggacctcaagccccgtcccctcacggtgtccttcgagaagggcgtcccggtggcgctggacggcgagaagctgggccccgtgaagctggtggaagcgctcaacgcgctg

SEQ ID NO: 43095 - DNA, 969 bp, Myxococcus xanthus
gcggccggcatcggcgcggcgctgggactgcgccgcatcctccgctcccgattccaattcaaggacagcaccgtcctcatcactggcggctctcgcggcctgggcctggtgctggcgcgacagctcctgaaggaagaggcccgggtggccatctgcggccgggacgagcagacgctggagcgggcccgcgaggagctggagcgcactggcggcgaggtctacgccatcccctgcgacgtgcgagatccggtgcaggtggaggccatggtctccgccatccacgagcgctggggcacggtggacgtgctcatcaacaacgccggcgtcatccaggtggggccactggagtccatgacgctggaggacttccaggaagccatcgacacacacctgtgggcgccgctgtacaccacgctggccgtgctgccggagatgaagcggcgcggaaaggggcgcatcgtcaacatcgcctccgtgggcggaaaggtgagcatcccccacctggtaccgtattcggccagcaagttcgcgctggtgggcctgtcggacggccttcgcgcggagttgcgccaggacggcatcgtcgtcaccacggtgtgcccggggctgatgcgcacgggcagcccacgcaacgcgtacttcaagggcaaccacgaggcggagtacgcgtggttcgccaccggggactccctgcccctcacctcactgagcgccgaacaggccgcgcgcaagattctggacgcgtgccggcggggtgacgccgaggcgctgctgggcgcaccggcgaagctggccgccgtgggccgcacgctggcccccaacctgacggccaccctcacctcctgggccaaccgattcatgccccaggacagcagccaggaccgctacagcggcagccagagcgaaacgccgctgacccagtcctggctcaccgagctgacgcggcgcgcggccgagcgcaacaacgag

SEQ ID NO: 43096 - DNA, 1137 bp, Myxococcus xanthus
atggacttcagttggactcacgagcaggtggagctctatgaccgtgccctcgccttcgcgcgagcgcagttgcccgaggccgcaaagcccagcaaggaagccctgccacgcgatttgtggcaacgctgtggtgagttcggcttcttggggctgcccgtgcccgcggcgcatggcggactggggctggacacactgaccactgcacgggtgatggaggcgctggggcgtggctgcgtggacaccggactggtgttctccgtgggagctcacctcttcgcctgcgtgatgcccatcctggagagcggggatgacgcgcagaagtcccggtacctgccccgcctgtgctcgggggaatgggtgggcgccaacgccatctccgaacccgaagcgggctcggatgtgtttgccctgaagacgcgcgcggtgcgggacggcgacagctacgtgctcgatggtggcaagagctacgtcaccaatggcccctccgcggacgtcttcctcgtctacgccgccacgcagccggcccatgggtacatgggcctgagcgccttcctcgtcgagaaggacacgccgggactgtccgtcgggcgcgccttcgagaagatggggctgtccacgtcgcccatcgcccccatctacctggaggggtgccgtgtcccggagtccgcgcggctgggtgcggagggccagggcgcggcgatgttcaagcgctccatgcagtgggagcgcgcgtgcctcttcgccgcctacgtgggcgtgatggagcgggtgctcgaacagacggcggacttcgcccggacccgcaagcagttcaagaaggccctggggaagaaccaggccatctcccacaagctggcggacatgaagcagcggctggaggcatcccggctgctgctgtaccaggcctgctggaagatggaccgaggccaggacgccgtcatggaagtgtccctggccaagctggccatcagcgaggccgccatccagagcggcctggacgccatccagattcacggcggcatgggctacgtggccgaaacgggcatcgagcgcgtgctgcgtgacgccattcccagcgccatcttctccggcacctccgaaatccaacgcgacatcatcgccaaccagctcggccta

SEQ ID NO: 43097 - DNA, 1584 bp, Myxococcus xanthus
ccttccctcatcgattcaggaccgcgcagcatgcccgcgggagcgccgcggacgctcgtcgaactgctccagcaggccgtggcgcacgctcccggtcatgtcatcaccttcatcgacgtacaggggcagcgggagacgctgacgttcgccgcgctctgggacgaggcgctccggctgtggggaggtctgcgggcgcggggcgcgaagacgggtgacagggtgatgctcgcgatggagcgcccgggcgacttcgtgcgtggcttctgggcctgcacgctcggcggcgtggtgccggtgccgctggcgctgccggcgtcgctggagcgctcgcagcctggcgtcgcgcggctcatctcggtgtcggagcggttgggaacaccgtggctgctcacggaggcgagggccacggcgccgctgtcggaggcggggctgcgcgccctgtcgctgcaatccctgtcgggcgcggagccggggcccctcgcggccgtggacccggaggcgcccgccatcctctccttcacgtctgggagcaccgggcgtcccaagggcgtggtgttgaagcacgccaacctgatggcgatgggcgaggggatggtggccggcggttggtacctgcctggggacgtgggcgtgagctggatgcccttggaccacgtggcggggacgagctacccccacctgctcgcgctgcgcacccgcacgccccatgtgctggtggcgcgcgactacgtcctggcggacgtgctgcgctggctggatttgctctcggagttcggcgggacgatgagctgggcccccaacttcgcctacggcctggtggcggatcggctggagcgcgaggagcgccgcgcgtggcggctggagcaggtgcgggtgctggcctctggtggcgagtccgtgctgcccgcgacgctccggcgcttctccgagcccctgcgcgacagcggactgcgcgaggacgcggtgtgcccggcctggggcatggcggagacgtcgtccttcttctcgatgacgcggggcgtgcggacccatcccgtggaagcggcgacggagctgggaccgcctccggtgggcgcggccctgcgtgtggtggacgacaccgacgcggtggttcccgaaggtcaggtcggccacctgcaggcccggggtgagcaggtgctgtccggctacctggatgacgcggaactcaacgcgcgctccttcacggctgatggctggtttcgcaccggggacatggccgtgattcaggacgggcagatgtccatcgcggggcgccagaaggaggtcctcatcctccacggcaacaacgtctacccgcaggacatcgaggaggtggtggagtcggtgcctggcgtgctgccgtcgtacaccgtggcctgcccgacgcggagcggtgcggcacagacggatgaactggctgtctgcttcgtgcccacgccggatgcgccgccgctggcggagttgctgcggagcatccgggagaaggtgggccgggtgctcggcttccatgtcgcgcacctgttgcccctggcgcgcgagcaggtgccgcgcacggagctggggaagcggggtcgcaccgaattg

SEQ ID NO: 43098 - DNA, 900 bp, Myxococcus xanthus
gagctcgccatcgaggtgaagggattggtcaaacgtttcggcgacgtcaccgccgtggacggaatcgacctggacatccgccgtggcgagtgcgtgggcctcctgggccccaacggcgcgggcaagacgacgaccgtggaaatcctcgagggcctccagacggccacctcgggggaggtgcggctcctggggttgcgctgggagacggacgcgccggtgctgcgggagcgcattgggatgacgctccaggagacgcggctggtggaccagctcacggtggaggagatggtgcgtttgttcacctccttctacccacgccccctggaggtcgaggcgctcatcgggctggtgcaactgggcgagaagcgccatgcccgggtgggcaagctgtccggcggccagaagcagcggctggccttggcgctgggcttggcgggcgacccggacgtgctcttcctggacgagcccaccaccggattggacccccagtcgcgccgcgccttgtgggacgtggtggcgcagctcaaggcgcgcgggcgcaccgtggtgttgaccacgcattacatggatgaggccgaagtgctgtgcgaccggctggtcatcatcgaccggggccgggtgattgcgcgcgggacgccgcgggacatcatcacctcgctgggcgcggagcaggtcatcgagttggaggcggagccctcgccggacctggagcggttgcgcccgctgccgtcggtggtggccgcccagcggcacgctggccgcatcaccctgcgggtgcgggagctgcacctggcgctgccggaggtgctgcgcgaggtggcggcggggggcggccagttgctgcacctgtccacccggcgccccacgctggatgatgtcttcatcgacatgacgggccgc

SEQ ID NO: 43099 - DNA, 584 bp, Myxococcus xanthus
atgttcgtgctgccgaatctcttcaccgtcacgtccattttctgcggcttctacgccatcaccttgtgcacgggggacgccgaaccggtgcagctgtaccaggcggccctggccatcttcttcgccatgttcttcgacggcttcgatggccgggtggcccggttgacgaagactcagagcgacttcggcgtgcagctcgacagtctggcggatgtcatctccttcggagcggcgccctctctcctggtgtacaagtgggcgctcgagcccctggggttcatggggctgttcatcgcgttctccttcgcggcctgtggtgcattgcgtctggcgcgcttcaacgtgctggcggcgcgcaacccgcacggaggcggtggcagtttcttcgtgggcctgcccatccccgtggcggccggaatgctggtctccgtcatcatctcccaccatgcggcgacgcaggggcagcccctggccgagagcgccgtggtgcccatggcggtggcggtggccggcctggcgctgctgatggtgtcgacggtgcgctatcgcaccttcaaggacacgcggcccaaccggaagagcgc

SEQ ID NO: 43100 - DNA, 1308 bp, Myxococcus xanthus
atctcgtatgagaaatacgcgctgcccaacggcctggaggtcatcctctccgtggaccggaagctgccagtggtggccgtcaacgtctggtaccacgtcggcgcatatcacgagcaacccggccgcaccggcttcgcgcacctgttcgagcacatgatgttccagggctcgcgcaacgtggccgacgacgtccacatctcccggctggagcagttgggcgccaccgacctcaacggcaccaccagcttcgaccgcaccaactacttcgagaccgtccccagcaaccacctggagacggcgctgtggctggagagcgaccgcatgggcttcctgctcgacgccatcacaccggagaagctggagacccagcgcgaggtggtgaagaacgagcggcgcgaatccattgaaaccgcgccgtacggcgccgcccgcgagaaggcgtggcacgcgctcttcccgctgccgcacccgtaccacggggatgtcatcggctcgatgaaggacctgaacgcggccaacgtggacgacgtgaaggacttcttccgcaagtggtacgcgccgtccaacgccacgctggccatcgtcggtgacttcgacgtggcgaagacgaaggcgctggtggagaagtacttcggcacgctgcccagccacgcccggccgcagcggccggaggtcgcgccggtgaacctcaccgcgcccgtggtgctgcgcgaggaggagcgcgtggcccggctgccgctcttgtccatccagtggctcacgcccgcgtacctggaagaaggggacgccaccgcggacgtgctggccaccgcgctgtccaccggcaaggccagccgcctctaccgccggctggtgctggacaaggagctggcccagagcgtcagcgccacccagcagagccagggcgcgcagtccgtcttctcggtggacgtggtggcgcggcccggcgtgtccacggacacgctgctccatgaggtggacgcggtgctggacgaggtccgccagcagggcatcaccccggcggagattgcccgcgcccgcacgcgctacgacacgcgcacgctggccggcctccagtccgtcggcggcttcggcggcaaggcggacgtcctccagagctacaaccacttcgtcggcgagcccaactacgtggcccaggacctggctcgctacgagtcggtgacgcccgaagccgtgaagcagttcgcccaggacacgctgcgccccggcgcgcgcgtcatcctccacgcggtgccgcccgcacgccggcaggcgcccctcgactcgaaggagcgccactgatgcgcc

SEQ ID NO: 43101 - DNA, 1487 bp, Myxococcus xanthus
ccccatataaaggaggggccggggccgcgaaagccctggagtgaacggccggacgctcggaccacgagcggcacggtctccccgcgcccggctgctatcagagggccccaaggaggcacttccatggccatttccaccatcgacccggcgaccggcaagacgctgcgcaccttcacgcccctctccgccgaggaactggaggcgaagctccagaccgccgccgacacgttccgcacctaccgcgagacgaccttcgcagaccgcgtcacctggctgcggcgcgcggccgacctgctggaggccgaggccgaccgctacggccgcatcatgacgcaggagatgggcaagcccatcgacgccgccaaggccgaggcgaagaagtgcgccacggcctgccgctactacgtggacaagggcgagtccctcctgcgcgacaggctcgtcgacatgggcaccggccgcgccttcgtgcgctaccagcccctggggcccgtgctggccatcatgccgtggaacttccccttctggcaggtggtccgcttcgccgcgcccgcgctgatggcggggaacgtgggcctgctcaagcacgcccacaacgtgccccagtgcgcactggccctggaggaactcttccttcaggcgggcttcccacgcggcgccttccagacgctgctcatcgagacagccgacgtccatcgcgtcatcgaggaccgccgcgtgcgcgcggtgacgctcaccggcagcgagggcgcgggccgagccgtgggcgccgccgcgggcaaggccatcaagaaggtggtgctggagctgggcggcagtgacccgttcatcgtcatgcccagcgcggacatggagaaggcggtggagacggcggtgtccgcgcgcctcatcaacaacggccagtcctgcatcgccgccaagcgcttcatcgtcgccgacgccatctaccccgagttcgagcgccgcttcgtggagcggatgaagcgcgtcacggtgggcgaccccatggatgcgaagacggacctgggtcccctggcgacgcgcggcatcctcgacgggctccatgcccaggtggaggcgagcgtgaaggccggcgcgaggctgctcctgggcggcaagccctggagggtccggggaacttctacccggccaccgtcctggccgagcccccgccccaggcccccgccttccacgacgagctcttcggccccgtggccacgctgctgcgcgcgcgtgacgtggaccacgccctggagctggccaacgcgacgccgttcggcctgggcgccagcgtgtggacacaagacgaagccgagcagcggcgtttcatcgacggcatcgacgcgggcatggtgttcgtcaacgcgcttgtggcatcggacgccaggcttccgtttggcggcgtgaagcactccggccacgggcgcgagttggcggacgtgggcatccacgagttcgtcaacatcaagtccgtccgcatcgccgcg

SEQ ID NO: 43102 - DNA, 1012 bp, Myxococcus xanthus
cgaggcctggtgcccggccagacggtggcccagcgataccgcgtggagcgctggctgggcgccgggggcagctctaccgtgtacgaggccaccgacctccaccaggacatgcgcgtggccctcaaggtcctcgcggtgccccatgcggatgccgcgatggtggcgcgcttccgccaggaggtggagcacgcccgggcgctggagcacgtcaacatcctgcgtgtcttcgatgcgggcgtggacggcgagcggcacttcctcaccgtggagttgctggatggcgtggatttgcgtcagcggctgctggagcggcgcgccacgttggcggaggcgctgcgctggctcacccacgcgacggtggcgctggaacacgcgcacggccggggcgtgctccaccgcgacgtgaagcccgccaacctcttcatcacccgcaccggcgtgctcaagctgatggacttcgggctcgccaagagcacgcacgtcatggggacgacggcccagggcgcggtgctcggcacgccggagtacatggctcccgagcaggtgacgggcaaccccgcggtgtcacccgccacggacctgtacgcgctcggcgtggtggcctacgagctgttcaccggacagcttccgttccgccacccggagcccgtgccgctgatgttcctgcacgtccaggagcgccccgtcccgccgcgcacattgcgaccggcgctgccggagcccttcgagcgcgtcgtgctgcggctgctggagaaacgccccgacgaccgctaccggtccgctgccgagctccgcaccgcgctggcgaagctgtggccccacgcactgaatggtgatgcgtcggtggcggcacgagcaccggcgccgcccctcgcgcgcgcccgagcaccgggcccgggaggcggcacgggctgagagaaacgtgcccgctgtcacgcccccgatgccgctggctccgtcctgcccggagccaacagcgccaacccgagcgccgcgacggccgtgagtccag

SEQ ID NO: 43103 - DNA, 1569 bp, Myxococcus xanthus
ctgctgggggagacgattggccagaacctgcgccgcaccgtcgagcgccacggcgaccgggaggccctggtggtggcgtcccaggggtttcgggccacgtatcaacagctctgggcgctcacctcgcaggtggcccgggggctgatggccctgggcgttcagaagggggaccgggtggggctctggtcacccaaccgcttcgaatgggtggccgtccagtacgccacggcccgtatcggcgccatcctggtcaacatcaacccggcctaccgctcctcggaggtggagtacgccctcaaccagtccggcaccaaggtgctgctccacgcacggggcttccggcagacggactaccggggcatggtgaaagaggtccggccgcgctgtgccggcctggcggcggcgctcgtcctggaggacgactggcagcggctgctcgatggcgcggaggatgtttcggaggacgcgttggccgcccgcgaggcgtcgctccagttcgatgacgccatcaacatccaatacacgtcgggaacgacaggcttcccgaagggcgccacgctgtcgcaccacaatgtcttgaacaacggcttcttcatcggggaggcccttcgctacggccccgaggaccgggtgtgcatcccggtgccgttctaccactgcttcggcatggtgattggcaacctggcctgtaccagccacggcgccaccatggtgattcccgccgaggcgttcgacccgctgacggtgctccagacggtgcaggccgagcgctgcacgtcgctgtacggcgtgcccacgatgttcatcgcggagctggaccatccgcgcttcggtgagttcgatttgtcgacgctgcgcaccggtgtcatggcgggctcgccgtgcccggtggaggtgatgaagcaggtgcagtcgcgcatgcacatgcgcgaggtgaccatctgctacggcatgacggagacgtcgccggtgtccacgcagagcgcgctggacgagccgctggacaagcgcgtgtccaccgtggggcgcgtgcatccgcacctggaggtcaaggtcatcgacgcgggctcgggtgaggtggttcctcgcggctcgccgggcgagctgtgcacgcgtgggtacagcgtcatgctggggtactgggccaaccccgaggccaccgccgcggccgtggacgccgccgggtggatgcacacgggcgacctcgcggtgatggacgacgagggctacgtgaaggtggtgggccgcatcaaggacaccatcatccggggcggtgagaacatctccccgcgcgaggtcgaggagttcctccacgcgcacccgggcgtcagcgagacgcaagtcattggcgtgccgagcaagaggtacggcgaggaggtcatggcctgggtgcgggtgaagcccggcgcgacgctcaccgccgaggagctgacccggttctgcgcgggccgcatcgcgtccttcaagattccccgctacttcaagttcgtggacgcgttcccgatgacggtgacgggcaaggtgcagaagttcaagatgcgcgaggcgtccgtcgtggagctggggctg

SEQ ID NO: 43104 - DNA, 1041 bp, Myxococcus xanthus
atgcatgcggtggcagtgtttccagggacgcgcgaggttcgcctcgtcgacccgccggagcctcggcccgtgacgggctctcaggtgctcctgaaggtcctcgaagtgggcatctgcggcacggaccgggagatcggtgcctttgaatacgggacgcctcctccggactccgaccacctcattctcgggcacgaggcgctcgcggaggtggtggagacgggcccggacgtcaccctggtccgcgagggagacctcgtggtccccaccgttcgccggccctgtccccatgcgcgctgccgtccctgtcgcgcggagcgtcaggacttctgtgtcacgggggatttccgggagcggggcatcaaggcggcgcacggcttcctccaggagtgggtggtggaagaggaggggcacctggtcgtggtgccccgcaagctctccgacgtggcggtgctggtcgagccgctctccgtggccgccaaggccgcggagcaagtacaggccatccagcggaggctgccctgggagcgcgcgcgcgtgcgagccctggcactcggcgccggaccggtggggctcctgggcgccatgagcatggtggtgaaccactttgacaccttcgtctactccctggagcccgcggccagcgagcgcgcgaacctcatccgctccttcggtgccacctacgtctccggacaggacgtgctccttggggagctcggaaagaaggtcgggacgttcgacatcatctacgaggctgtgggcatgtcgaaggtcgcgttcgcggccctcgatgcgctggggcccaatgggctcttcatcttcacaggcattcccgcgcacggcggcccgaaccccgtggatacggacaccctgatgcgcaacatcgtgctgaggaaccaactgctcctcgggaccgtgaatgcgagccggagcgcttacgagctggcgctccgcgagctggagcaagcgatgttcttgttcccgcagagcgtgcgcgccctcatcacccatcgggttcccatccaggaggcgcccgcgctcctc

SEQ ID NO: 43105 - DNA, 756 bp, Myxococcus xanthus
cgattcgccaatcagaagctcatcgttgtgggcggtaccagcggaatgggaaaggccgtagctcgtatcctccttgaggagggcggtcgagccgtcgtcatcgggcatcgagacgacaagctccaggccgccgtcgcggaattggctgcgtccggccctgtggagggcctgcgcgcggacatcgcatccggcacggagagacaggccctggtggcccagttgcagaaggaccacgccgacgcgacgctgctggtcaacgcagcgggtgtcttcctgccgaaggcattcttggagcacgaggagcgcgattacgacttgtacctcgacatcaacaaggcgctcttcttcatcacgcaggccgtcgcccgctccatggtcgcgctgcgcaaggggggagcgattgtcaacattggctcgatgtgggccaagcaggccatccaggccactccatcctcggcctattcgatggccaaggcaggactccactcgctgacgcagcacctggcgatggagctggccggacatggcatccgcgtcaatgctgtttcgcccgcggtcgtcgagacccccatctacgaaggcttcatcccaaaggagcaggttcacggtgcgctccaggggttcaacgggttccatccactcggccgcgtgggccgcgcagaggatgttgcgcagaccatcgtccatctgttgtcggacgagacttcttgggtcaccggcgcaatctgggatgtcgacggcggcgtcatggctgga

SEQ ID NO: 43106 - DNA, 1398 bp, Myxococcus xanthus
gtgagcacgaagaacgtccgtaccgagaaagacaccttcggtcccatcgacgtccccgccgaccggctgtggggcgcgcagacgcagcgcagcctccagaacttcgccatctccaccgagcgcatgccgctggccctcatccgcgccctggtgctggtgaagaaggccgccgcgcgggtgaacgtggagaacggctcgctggcgaaggagaagggcgaggccatcatccgggccgcggacgaggtgctggccggccagcacgacgcggagttccccttgagcgtctggcagacgggcagcgggacgcagacgaacatgaacacgaacgaggtgctcgccaaccgcgcctcggagctgctgggcggcgagcgcggcgagcgccgcaaggtccaccccaacgacgacgtcaacaaggggcagagctccaacgacgtcttccccaccgcgatgagcgtggccgccgtggccgccatcaccgagcacgtgctgccggagctgaaggcgctgcgcgacgtgctcgcgcagaaggcccgcgccttccatgacgtggtgaaggtgggccgcacccacctgcaggacgccacgcccctgacgctggggcaggaggtcggcggcttcgtggcgcagttggaccacgcgaagggccacctggagcgcaccctgccgcatcttctggagctggccctgggcggcacggcggtgggcaccggcctcaacgcccccaagggctatgccgagcgggtggcgcaggagctggcccagctcaccggccaccccttcgtcaccgcgcccaacaagttcgaggcgctggccgccaacgacgcgctggtgcaggcgcacggggcgctgaaggggctggcggcggtgctcttcaaggtggccaacgacgtgcgctggctgtcctcggggccgcgctcggggctggcggaaatcaccatcccggagaacgagccgggcagctccatcatgccgggcaaggtgaaccccacccagagcgaggcgctcaccatgctgtgcgcccaggtgatggggaacgacgtcgccgtcaccgtgggtggggcgtccggcaacttccagctcaacgtcttcaagccgctcatcgcccacaacctgctccagagctgccggttgctggcggatggcatgcgcagcttccgcctgcactgcgcggtgggcatcgagcccaaccggccccgcatccaggagaacctggagcgcagcctgatgctcgtcacggcgctcaacccccacatcggctacgacaacgcggcgaaaatcgccaagacggcccacagggacggcacgacgctcaaggagacggccgtggcgctggggctcgtcacccccgagcagttcgaccagtgggtccgcccggaggacatgacgggccacaagggg

SEQ ID NO: 43107 - DNA, 2094 bp, Myxococcus xanthus
cgcaccgccctgctccgtccgtctgggaaagagacgcgcgaggaccccttccccgccctggtggccatggcccgccagtccgacaagcccgtgtacctggtgccggagttgttcgtctgggagaagcgccccgcgcgcctgaagcccaactgggtggacgtggtgttcggcagccccgaggcaccgggattcctgcactcgatgctggccttcttccgcaactacaagcgcgcgcagttccgcgtgggcgagcccatcgacctgcagcgcttcgtcgcggagaaccctcgcgactcggacgaactgctcgctcgcaaggcgcgtagcagtctccacgtccacctcgcgcgcgaaacgcgggccgtgttcggtccgccggtgaagcccgcctcgcgcgtcatcgaggagacgctgcgcgacaggtccctgcgcaaggtggtggaggagtgcgcggcggaatccgggcgcaagccggagagcgtcctgcgcgaggctcgccgcaacctggaggccattgccgccaaacccagccccaccgcgctggcgttcacctcccccgtgctggagtgggtgttcaaccgcatctacgacggcatgcacgtggacgaggccggcctccaccgcgcgctcaaggccgcgagccacgcgcccatcgtcctgtgccccagccacaagagccacgtcgactacctggtaatgagctgggtgctatggaaccggggctacgcggtgcccctggtggccgcgggcgccaacctctccttctggcccctgggcacgttcttccgccgctgtggcgcgttcttcctccggcgctccttcaagggcgacaaggtctacgccgcgtccttcaaggcctacgtgcgcaagctggtgcacgacggcatccaccaggagttcttcccggaaggcggccgttcgcgcacgggcaagctgttgttgcccaagctgggcatgttcacctggcaggtggagtccgtgctggagggcgcgcgcgatgacctcatcttcgtgccggtggccatcgactacgagaaggtcgtcgagtccagcagctactcgaaggagctggctggcggagagaagaagcccgaggacctcaaggcgctcttgagcacgcccaaggtgctggcggcgcggtacggccgcatccacctgggcttcgatgagcccatctccctgcgcgcgttcatgcaggcacgtggcatcaacccggacgaaccggtgtcggacgaacagaagaaggggctcgtccgcgcgctgggcaaccgggtgatgtacggcatcagcaaggtgtccacggtgacgccgcacgcgctggtcagcaccgccctgctctcgcaccggcgccgcggcttgacgcagcgggagatggcagaccgcatcaacatcctgcgccgcatcgccgtggaggagggctcgcctcagtcggtggagatgcgcaacgcccccagcaacccggagacgatgggccccatccaggacgccatgcgcacgttcatctccgacgagatggtgcgcacccaggaagcgcgtggcgaggtcatctaccaggtcgaggaggcacgccgcccggagctgtccttctacaagaacacgctgatgaacctggtggcctcccggagcctcgtggccaacgccatgcttgccagcggcagcccggcgccctacgacaccgtgaaggagcgcgcgctgttcctgtcccgcctcttcaaggtggaattcatctaccgggtgggcaccacgttcgactctatcttcgcggagacggtggagcggctggagcgcatgggcctggtgcttgaggagaacgagacgctccgcgtggcccccgaggcccacgcgcgtccggacctggagttcctggccgacatgctgcgcgactacctggaggcctacctgctggcggccctgacgctccaggatgtggccaccggcgccgcggaggaccggaagtccttcgtgaagatggccctggaaacgggccgcgcggagtaccacgccggccgcatcaccgcctccgagtccctggccaaggtgacgctggagaacgcggtggcgttcctcctggaccagaagctgctcatcgaggcc

SEQ ID NO: 43108 - DNA, 1104 bp, Myxococcus xanthus
gactactatcagaccctcggcgtcgatcggtcggcttcagcggaggacgtcaagaaggcgtaccgcaagctggcgcgcaagtaccacccggacgtcaacccgggcaacaaggccgccgaggagaagttcaagcaggtgagcgcggcgttcgaggtgctgtcagacacccggaagcgcaagctctacgacgagttcggcccggacgccgagaagattggcttcgacgaaaagaaggcggaggcctatcgggcctacaaagcctcggccgggagcgccggtgccgggggcattccctatggcgccgagggcttcgacctgggtgacctcttcggcgacctgttcggaggccgtggcggtggcgcggcgggcggcgccccggggggcttcgacattggcgagatgtttgggcgtcggggtcgcaacgccgggcctgagcgtggagaggacctgacggtccgcgtccagctcaccctggctgaagccgtctccggaaccgagcgccccctggccttcaaccgtccgggccggtgctccacgtgcagtggccgaggcacatcaggaccggtgtccacctgcaacgtttgcaacggtacgggccgagcccggcgttccgggagcctgttcggtggcgcgggcgcgtgccccaactgccacggcacgggcaaggccgcgccaccctgcccccagtgcgggggcgcgggtgtgaaggaggagctggcccggctgacggtgaagattcccgcgggcgtgcacaccggctcaaaggtgcggctctccggccagggcgcggcggggacacgcggcggccccccaggagacctctatatcgagaccgaggtggccgaacatcccctcgtgcgtcgcgaaggcgacgacctgcacctcgatctgcccgtgacggtctccgaggccctgctgggcgccgacgtgcgcgtccccacgttccagggggaagtcaccgtgaaggtgctcccccactcccaatccggccgccgcatgcggctgaaggggcgcggcgttccctcgctcaagggcggagcacagggcgacctgtacctccacctccaggtgaaggtccccgaggaaacaaccgccgaggctcgg

SEQ ID NO: 43109 - DNA, 414 bp, Myxococcus xanthus
atggacatcggagagattctcaatctgctgccgcatcggtacccgttcctgctggtggaccgggtggtggagatcatcccgggccagaagctgacggcctacaagaacgtcaccatcaacgagcccttcttcaacgggcacttccccggtcacccggtgatgccgggtgtgctcatcctggaggcgctggcgcaggcgacggccatcctcgcctacaagagcgagaacatggatccgtcgcgcaagctcacgtacctgatgggcgtggacggcgcgcgcttccgcaagccggtgttgccgggggatcgcctccagttggagatcgaggtggtgcgtcacaagggcgctgtctggaagacgaagggcctggcgacggtcgacggcgcgcgtgtcgccgaaggcgagttcctggca

SEQ ID NO: 43110 - DNA, 1050 bp, Myxococcus xanthus
gtcctccacttcggctcctacaactactccgggctgaacgggcacccgcgcgtggtggccgcggcggaggcggcgctgcgccgctacgggacgacggtcagcggcgtgcgtctgctcaacgggacgtgtgagctgcacctggagctggagcgcgcgttggcggagttcctgggcttcgaggactgcgtcacctacagcagcggctacgcggcgaacctgtccgtgttgtccgcactgtgtgctgagggcgacgtggtgctgtcggacatgctcaaccaccagtccatcatcgacgggctgaagctgtccggcgcggacatccgcacctaccggcacaagagcctgcgcagcatcgagtccacgctgaagaagctgccatacgagcagcgcaagttcatcatcaccgacggcgtgttcagcatggacggcgacgtggcggacctgccgggcatcgtggcgctggcggagagctacaacgccttcatcctcgtggatgacgcgcacgccaccgccgccatggggcccaacggccgcggcaccccggcctatttcgggctccagtcgcaggtggacgtgctcaccggcagcctcagcaagggcctgccgggcatcggtgggttcgccgccggctccaaggccaccatcgacctgctgcgcttcggctccaacggctacatcttctccgcctcgctgccgccgcccatcgccgcgggcctgctggagggcatccgcatcctccaggagcagcccgagctccaggagcgcctgcaccacaacgagaactacctgcgcgccggcatccgctccatgggcctggactgcatgaacagcgagtcccccatcatccccatcctgatgcccgcctacgagaagacgttcgagctgacgcggctgctccacctggagggcatctacgtcaacccggtgggctaccccgccgtgagcaagaaccgcacgcgcctgcgcatcaacgtcagcgccaacctcacccaggcggacctggaccgattcctggacgcgctggaccgctgcagccgcaaactcaacctc

SEQ ID NO: 43111 - DNA, 1743 bp, Myxococcus xanthus
  unsure (1)..(1743): unsure at all n locations
gggggcgcgttcctcttcgaggaggtgggctcggcccgcatcctcaccccggagaccttcacggaggagcagcgcctcttcttcaagacggcgctccagttctcccgtgagcaggtcctccccctgtccgagcgaatcgaggccaaggacaacgcgctcctgcgccagttgctgcgacaggccggcgagctgggcctgctgagcgtggatatccccgaggcctacggcggcaccggcctggacaagacgacgtcgctgctgctggcggaggccatgagcctcaacggctcctggtcggtgacgttcggcgcgcacaccggcatcggtacgttgcccatcgtctggttcggcaacgccgagcagaaggcgaagtacctgccgaagctggccacgggggaatgggtggcggcctatgcgctcacggagcagggcagcggcagtgacgcgctgggcgcgaagacgaaggcagtcctgtcccccgacggcaagcactggattctcaacggctccaagctctacatcaccaacgcggccttcgcggacgtgtttgtcgtcttcgccaaggtggacggggacaagttcaccggcttcatcgtggagaaggacacgcccggcctcaccgtggggccggaggagcacaagatgggcatccggggctcttccacgtgcccgctctacttcgaggacgcgcgcgtcccggtggagaaccagctgggcgaggtgggcaagggccacaagattgccttcaacatcctcaactacggccgtctcaagctgggcgcgggcgtgctggggggcatgaagctccagctccagaacgcgctgcgcttcacgcaggagcgcaagcagttcaacgcgcccatcgtccagttcccgctgtcacgcgagaagctggcccgcatggccgcgctcgtctacgcggtggagagcatgacgtaccgcaccgccgggctcgtggatgcgcgcctggggcagggggacaaggacgccccggactacgaggcgcgcctcctggaggcggtggaggagtacgccatcgagtcttccatcatgaaggtgcacggctcggagtccttcggccacctcgtggatgacgccgtccagctccacggcggcgcgggctacatcgaggagtacccggtggagcgctcgtaccgcgacgcgcgcatcaaccgcatcttcgagggcaccaacgaaatcaaccgcatgctcatcaccggcatgctcctcaagcgcgcggtgaggggggacctgccgctgttcgccatggccggcaacgtggcggaggagctgtcccggggcgagcggccccgcgcgcgcgtgcaggacgccctggccccgcaggaggtcgccgccgaggccgccaagcacctggcgctccacggcctgcgcgtggcggcggagacgttcggcccggaactggagcagcaccaggaggtgctcgcggccctgtcggacgtggtgatggacgccttcgccctggactccatggtgacgcgcacgcgccaggccgccacgtccggcgcgttggacccggtgcgggtggcgatgacgcagctctacgcactggacgccatcccccgcgcctacgacaggacgcgccgcgcgctgtgcgccacgttgaaggggggcgcgctcgaccaggagctcgagcgcctgggcacgctggacgtcttcacgccatatgacccngcggcgctgcgggagacggtggtggcggcccttgagtccgcgggcggctac

SEQ ID NO: 43112 - DNA, 843 bp, Myxococcus xanthus
aagggcatcatcctcgccggtggctcggggacgcggctgtacccactgacgcgcgtggtcagcaagcagttgctgcccgtgcatgacaagccgatgatctactaccccctgagcacactgatgctcgcgggtatccgggacgtgctggtcatctccacgccgcaggacctgccgcgcttccaagaactgctgggcagcggcgaccagtggggcatgcgtttcagctatgcggagcagcccaagccggacggcctggcccaggccttcgtcatcggccgggacttcgtgggcgctgacagcgtgtcgctggtgctgggcgacaacatcttctacggccacggcctgagcgagctggtgaagcgcgcggcgtcgcgtacctcgggagcgacggtgttcgggtactacgtgaaggacccggagcgttacggcgtggtggagctggacgcgaagaaccgagcggtgagcctggaggagaagccgctgaagccgaagtccaactacgccgtcaccgggctgtacttctacgacaaccaggtgctggacatcgccgcgggcctcaagccgagcaagcggggtgagttggagattaccgacgtcaacgcggagtacctgcgacgcggccagctcgacgtggagctcatggggcgtggctacgcgtggctggacaccggcacgcacgagtcgctgatgcaggcgtcgaacttcatcgaaatcatcgagcgccgccagggcctcaaggtgtcgtgcccggaggagattgcgttccgcatgggatacatcggcgcgcagcaactgctgacgctggccgagcccatgctcaagaacgactacggccagtacctg

SEQ ID NO: 43113 - DNA, 1287 bp, Myxococcus xanthus
atggagctcatttgcattggcctgtcccaccggacggcgcccctcaccgtccgcgagcgactggccttgccggagtcgcgtcaggtggacgtgctccagcggctggcccaggcgcccgtggaggccctctgggtgtccacctgcaaccgcgtggaggtgtacctgttcgcgccggacgcggcgatggcgcggcagcgcgccttgatggagctgcaggtgctgggcggggtggaagccctggagcacctctacgagcaccagggcgaggcggcgctggtgcacctgttccgcgtggcgtgcagcctggactccatggtgctgggcgaggctcagattctgggccaggtgaaggaagccttcgagcggggccagggcgcgggcgcggtgcgtggtgagttgatgcgcgcgtgcgcggcggccttcagctgcgccaagcgcgtgcgcacggagacggccattggccgcgcggccacgtccatggcggcggcggcggtgcaactggccagcaaggtgttcgatgggctcgcgggcaagacggtgctggtggtgggcgcgggggagatgggcgagctggcggcgcgccacttgaagcaggctggtgcgtcgaagctctacgtcaccaaccgcaccctgtcgcgagcggaggcgctggcggcggaggtgggcggacaggcgaggcccttcgaggagctgctcggtctggtggccgcggcggacgtggtggtgtgcagcacggcgtcgcaggcgccgctcttcacgcgggacaacgtgggcgccctggggcgcggacgccgggggcggccgctgttcatggtggacctggcggtgcctcgcgacatcgatccggcggtgggcacgctggactgggtacatgcatacgacgtggacgacatccagaagttcgtcgcggacaacgccgcggcgcgcgcggaagaggcgcagaaggcgggcgtgctcgtcgcgcaggaagtagcgcgtttcgtcaaggagcgtgcgctgcgtgagggcacgccggtgctggcgcgactgcgtcagcgcgcggaagccattgcccgctccgaggtggagcgcacgctgggcgccctgggcgacggactcaacgaaaagcaacgcaagagcatcgaggccatgggccgagccatcgtcaacaagctgctgcatgagcccaccgcgcggctgcgcgccgtggggccggaaggggagggcaaccgcctggcgggtgccgccgccgagctgttcggtctcctggaggaggaggtcggcaccgccgccgccgcgccctccgtc

SEQ ID NO: 43114 - DNA, 894 bp, Myxococcus xanthus
gtgcgtatcgccacccggcagagtcccctggcgctctggcaggcgcgtcacgtgggcgcgctgctgacctcgcggcatcccggtttggaagtgaccctggtggagatgaccaccgagggagaccgcttcctgtccgcgccgttgtccgcggtgggcggcaagggcttgttcgtgaaggaaatcgaacaggcgctgctcgacggccgtgcggacatcgccgtgcatagcctcaaggacatgacgtccgtgttcccggaagggctgatactcgcggcggtgccggagcgggaggatccgcgcgacgtcttctgtggcctgggcgggctgacgttggacacgcttccgcagggcgcgcgcgtgggcacgtcgtcgctgcgccggagctgcatcttgcgctcgcgccggccggacgtggacatcgtcagcgtgcgcggcaacgtgcagacgcgcctggcgaggacgcgggagcaggggctcgcgggtgcgctgctggcctacgccggactcaagcgcctgggcctggaggacgtcatcacccaggtgctgccgcccgaggtgagcctgcccgcggtggggcagggcgtgttggccatccagtgccgcacggacgatgcgcgcgtgcgcgcgctgctggtgccgctggagcacgccaccactcgcatcgccgtcaccgccgagcgcgcgctgctggcgaagctggaggggggctgcaccgtgcccctggccgggtatgccaccgtgtcgggcgacaccgtcttcctgcgcggactcgtgggccgtccggatggcacacacgtggtgcggggcgaggtgcgcggccccgtgtcgcaggcccatgcactgggtgaatccctggcggatgacctgctttcgcgtggggcggcggacatcttg

SEQ ID NO: 43115 - DNA, 747 bp, Myxococcus xanthus
cttgaaggcaagagagtcttggtgacgcgcccgcgtgagcgggccgaggagttgtgcttcctcctggaggatgagggcgccgaagtgctgagcgtgccccttctggaactgcatcctccggaggacccacgtccgctggcgtctgcggccgagcacatccagcgctacacctgggtggtgttcgcgagcccgaccggcgtggatgcgctgatggaggccctgcgcgaggcgggcacccaggaccggatacagcgggtgaaggtggccaccgtggggccgcgcacgacgcgcgccgcggagggctacggcctggtcgtggtggccgaaccttccgagggcacgggcgcggccctgctcaacctcatcaaggatgcgctgcaaccgggtgacgaagtcctgcttcccgccgccgaggaaggccggcgtgagctggaagacgggctgagagagtacggcctcctggtgacgcgggtgacggcgtatcgcgccacgcccgcgcccctgccaccggagtcgctggccttactggatgcctcaccgccggacgtcgtgctcttcgcttcgccgcgcacggccgaggccttcgtggaagaggccggacgcgagcgcctggccaccgctcgggtggtggcaatcggtccgacgacggcgtccgccctggagcggctgggcgtgcccgcggcggccgtcgcggagcggccgacgccagagtccctggtggatgccgccgtgctcgcggtgacgagc

SEQ ID NO: 43116 - DNA, 1389 bp, Myxococcus xanthus
atggcggacttcgacctggtggtgattggctccggcccggcgggtgagtggggcgcggtacaagcggcgctggcgggcaagcgcgtagcggtggtggagcgggagcccgtgctgggtggtaccgcggcgaacacaggcacccttccctccaagacgctgcgcgagacggcgctgcacctgtccggcttccgggcgcgcgggctgtacagcgtggagacgacgctgcggcacgaggccacggtgtccgacttcctcttccgcgaacggcgggtgaaggacatcgagcgcgagcgaatcgcccgcaacctccagcgccacaaggtggaaatcatccagggcaccggcgcgctcgtggacgcgaacaccgtcgtcgtgcggcgccaggacgccccggagcggcgcctcaccggcggcaccatcctggtggccaccggctcgtcgccgtaccggccgccgctgtaccccttcgaggacccgcgcatccacgactcggacgaggtgctggagctcgaaaggctgccgcgctcgctggtggtggtgggcgccggcgtcatcggctgtgagtacgcctgcatgttcgccgccatggacatcccggtgacgctggtggaggcgcgcgcggagctgctgcccttcctggacgacgagttctccgcgctgctgggccagcgcatggaggcgctcggcatccaactgcgcttcgggcaggtggtggagcaggtagacgtgccgcgggacgcggacactcccatccggatgatgctctcctccggcgccgtgcttgagacggaccaggtcctggtcgcctccggccgcaccgccaacacggcgggcttggggctggaggctctgggcgtgcaggtgggcccgcgcggccaggtggaggtgggccccacctaccagacggccctgccccacatctatgccgtgggggacgtcatcggcttcccggcgctggcctccacgtccatggaccaggcgcgcatcgccgtggagcacgcgttcgacctgggcggcgtgcgcaccatggcgccggtgctgccctacggcatctacaccatccccgaagtgtcgatggccggcgagacagaggaggccctgcgcacgctgaacgtgccctacgtggccggccgcgccgccttcgccaccaacccgcgcggtcagattctgggagacacgcacggcctgctgaagctgctcttccaccgggagagcctcaagctgctgggcgtgcacgtcatggggccccaggcctccgagctggtgcacgtgggcctcaccgccctgctcaccggctccacggcccggctcttcgtggagacgtgcttcaactacccgacgctgtcggaggcctacaaggcggccaccttcgacgcgttggatcagctc

SEQ ID NO: 43117 - DNA, 2058 bp, Myxococcus xanthus
gcgcccgaggcgccccccgccgctcccgtggccactgcccctgaatggcccgaaccccagccccccgcgctgcggctgcccgactcggtccgccccacgcgttacgcgctcgacctgaagctgctgcccgccgagcccaccttctccggcagcgtcagcatcgacgtggatgtgagcgagccggtgcgccaggtctggctgcacgggcaggacatggaagtctcgcaggcccgcatcgaagcgggaggccgcaccctggaggcccgtcctgtcaccgccagcgaagggcggctcgggctgctgctccccgaaacgctcgcgccgggcaaggcccgcatccacatcgccttcaccggcaaggtcgaccgcgagcgcagccagggcctctacgccgtggaggaaggcggcgagccctacctctacaccttcttcgagcccgtcgacgcgcgccgcgccttcccctgcttcgacgagccgggcttcaaggtgccctggacgctgcgcatcaccgccaaggaggaccacgtcgcgctcgccaaccaccccatcgtctcgcgcgagaagctgccggacgggctggcgcgcgtcacgttcgccgagagcaagccgatgcccagctacctcgtggcgttcgtggtgggccccttcgacgtggtggacgcgggcaccgcgggccgcaacgccgcgccgctgcgcttcatcgtgccgcgcggccggggcgcggagacggcctacgcggccagcgtcacgccgcgcatcgtcacgctgattgaagactacttcgacatgccgtacccgtacgagaagctcgatgtcgcggtggtgccgcgctactggggcaccatggagcacccgggcctcgtcgcgctcgggcagccgctgacgctcatccgtcccggcgaggagacgctcgcgcgccgcaagtggtacgtgaacatcgccaaccacgaactggggcactactggttcggcaacatcgtcacctgccagtggtgggacgacatctggctcaacgagtcgctcacctcgtggctggaccgcaagacggtggaccccttcgacacgagctggggcttcggactggagcagagcacccagtccacgctcttcgcgttggacacggacgcgctcgccgccaccccgccggtgcgcaagcccgccaacacgcatgacgaggtgctcggctcgttcgacaacggcaccacgtacgccaagggctcggccatcatcgacatgttcgaggcatggctcggtgaggagcgcatgcgcgacctgctgcgcggccacatcaagaagcatgaatggggcgtggccacgtcggaggacttcgccgccacgctgtcggccgccgcagggccggacgtcgcgcgtgccttccgcagcttcatcgaccagccaggcgcgccgcgcatcgccgccgaactgcaatgccagccgggagcccccgcgaagctgacgttcacgcaggagcgctacgtccccgcgggctccaccgccagcaaggaccagacgtggtccgtgccggtgtgtgtgcgcgcgggttccggcaagacgtccgagcgcacgtgcaccatgctcaccggggccacgggcgagttggcgttgcccggcaagagctgcccttcctggttcgtgctcaacgcgggcggcaccggctactaccgctccggctacacgcgcgagcagctcacccgcgtgctggccgcgcccacggaagcgttgacggtgcgcgagcggctgaccctgttggccgacatggaggccggggtgcgccggggagacctgcccctgagcgacgtcctgcgctacgtgcccaccacggccaagggcgaccaccgcctcatcatgcagcgcggcgcccggctgctgaccttcgtgcacgtggaccgactgtccaacgacgagagcgcgcgctaccggaactgggtggccgcgatgtacggccctcgggcccgcgcgctgggctgggagcccaagcccggtgacgacgacgcggtgaagtcgctgcgacccaacctcctggggctggcggcgctgcgcggcgaggatccggccttg

SEQ ID NO: 43118 - DNA, 705 bp, Myxococcus xanthus
atcggtgtcggggcggagcagtccctcacgaggctgcaccgggcccacttggaggccgtgcccttcgagaacctggacatccacctgaagcggcccattcggctcgacatgaacgccctcttcgagaaggtcgtcgtccagcggcgcggcggcttctgctacgagctcaacggcctcttcgcccggctgctgacggcgctgggtcaccgggtgacgctgctgtccgcgggcgtggccacggccccggatggcagcgcctacggccccgagttcgaccacctggccctccaggtggaggatgaacagggacgctggttggcggatgtcggcttcggtgagtgcttcaccgagcccctgcgcctggacacccacgacgtccaggtgcgctccggccgcgcgtaccgcctctcaccggagggtaacaacctcatcctctggagtgagaagccctccggatgggaggcggagtaccgcctctccctcgtgccccgccaactcgcggacttcgagggcatgtgccgctaccaccagacctccccggactccatcttcacccagcggcggctgtgcacccgggcgacgcctgagggacgcatcaccgccaaggagggcacactcgtcctgacccggagtggggtccggacagaacaacctctccccgttgaagacgccctgcggcgcgcgctcgtcgaacacttcggcgtc

SEQ ID NO: 43119 - DNA, 2481 bp, Myxococcus xanthus
atgtccgatgagaagaagaagggctccgctgcgagcgctatgcccaccgcgatggcccctccggggctcatcaacaaggaagacatcccgcaggtgcttcccatcctccccctgcgcaacagtgtcttcttcccgggcggggtgcttccgctggccgtcggccgccagaagaccatcgccctgatcaaggacgccgtgcgtgacgaccaggtcatcggtgtcgtcacccagcgccgcgccgaagaagaagatccgggtgccgccgacctctacaccatggggacggtcgcccgcatcgtgaagctcctgaagatgggcgaggacaactactcgctcgtggtgcaggggctcgcccgcttccgcgtggtggagctggtccaggaagcgccctacctcaaggcccgcgtggacgccgtggaggacaagacctcttcggagaacgtggaagtcgaggcgctgggcatcaacctcaagaagctggcgcgcgaggtcatcgagctgatgcccgagctgcccgccgccgccaccgagctggtggagagcatcacccaccccggccacctggcggacctgatcgccgccaacgtggacgtgcccatcgaggagaagcaggccgtcctggagacggtggacctcaaggcccggatgaagctcgtgctggagctgctcaaccggaagcgggagatcctcaagctctccaacaagatcgactccgccgtgaagggcgagatgtcgaagacccagcgcgagtactacctgcgccagcagctcaaggccatcaaggaagagctgggggagatgggcgaggaggaagaggagctcgacgagctgcaggagcgcctgaagaaggccggcctgccgcccgacgtggagaaggtcgccaacaaggagctcaaccgcctgaagaccattccggcggcctccagcgagtacaccgtcgcgcgcacctacctggattggatcgccgacctgccgtgggcgaagatctccgaggacaacctcgacatcgagaacgcgcgccagcagctggacaaggatcacttcggcatcaagaaggtgaagaagcgcatcctggagtacctggccgtccgcaagctgaagaacgacatgcgtggccccatcctgtgcctcgtcggtccgccgggcgtcggcaagacgtcgctgggccagagcgtggccaaggccacgggccgcaagttcgtgcgcctgtcgctgggcggcgtgcgtgacgaggcggagatccgcggccaccgccggacctatgtcggcgccctccccggccgcttcatccagagcatgaagaaggccggcacgaagaacccggtcatgatgctggacgaaattgacaagctcggcgccgacttccgtggcgacccgagcgcggcgctcctcgaggtgctggatccggagcagaacaacacgttcagcgaccactacctcgacgtgcccttcgatttgtccaaggtgatgttcgtcgccacggcgaaccagctcgaccccatccccggtccgctgcgtgaccgcatggagatcatcgagctgacgggctacaccttcgaggagaagcagagcatcgcccgcatccacctggtgcccaagcagctcaaggagcacgggctgagcccggaccacatcgacatcaccgacgaggcgctgctcacgctgaccaccgcgtacacgcgcgaggccggtgtgcgcaacctggagcgccgcatcgcggacatctgccgcgcggtggcggtggaggtggccggcgggaagacggagaagcagaccatcaacgccgaccgggtgaaggagatcctcgggcccgagatgttctactccgaggtcgccgagcgcaccgaggttccgggtgtggccacgggcctggcctggacggcggcgggtggcgacctgctcttcatcgaggcgacgaagatggcgggcaagggcggcatgacgctcaccggccagttgggcgacgtgatgaaggagagcgccacggcggcgctgagctacctgcgcagcaaggccgagcagctcggcatcagcccgaacttcctggagaagacggacctgcacctgcacttcccggcgggctccattccgaaggacgggccttccgcgggcgtcaccatcctgacggcgctcaccagcctcctgacgggcatccgcgtgcgtcacgacacggcgatgacgggcgaggccacgctgcgtggcctggtgctgccggtgggtggcatcaaggagaaggtgctggcggcgcaccgagcgggcatcaagcgggtcatcctgcccgagcggtgccgcaaggacctgatcgacgtgccggaccaggcgcgcaacgagctggagttcatcttcgtcacccacatggacgacgtcctgaaggcggcgctggagacgcctcccgtcggcgtggcgggaaccccgggcggtgagccgggcaaggaggctccgctgccgaagccggccgagtccgcccctgaggtccgcgcc

SEQ ID NO: 43120 - DNA, 1134 bp, Myxococcus xanthus
ggtgagtcgcagcgcttcaaggcctaccgcgtgcagcacaaccaggcgcgcggcccctacaagggcggcctgcgctaccaccgcgaggtgtccctggacctcttcaaggccctggccgcggagatgacctggaagacggccatcgccgaggttccgttcggcggcggcaagggcggcatccagatcgacccgcgcgagtacggccgcgaggagatcgaggccatcaccctgcgcttcatgtaccggctcaagagcatgattggcccggacatcgacatcccggcgccggacgtgggcaccaaccccggcatcatggccctgctctaccgccagtactcggacggtgagcgcgagcgccacaacctgcgcggcatcgtcaccggcaaggacgtgcgcatcggcggctccgagggccgccacaaggccaccggccagggcgtcgccttctgcatcgaggactactacgccgaccgcggcgagtccgtgaagggcaagacgttcatcatccagggcttcggcaacgtgggcagccacgccgccaacatcctgtcgcagatgggcgcccgcctgcttgcggtgaacgacgccgacggcaccatcttcaatggtgacggcatcgacgtgaccgcgctctccgcctacgtgcaggaccccaagaacctcaagcgcagcgtgctcggcttcccgggcgcccagcgcatcgagaagaaggacctctgggacgtccaggcggacatcctggtccccgcggccctgggcggcgaaatcaccgccgacgtggccgagcgcctgcgcgtcaagctggtggccgagggcgccaacggccccaccaccccggaggccgaccgcatcctggagaagcgcggcatcgagctcatcccggacatcatcgccaacgccggtggtgtgacggtgagctactacgagtggatccagaacaagcgcatggagcgctggagcgaggccgaggtcgaccagcggctcgagcgcgccatgaagcgcaactaccgcatcatccgcgacatctcgcgcaaccagccgcgcaagacggagatgcacgacagccgccagtactgcatcggtgagacggtggacacccgctgcgccgccatgattctggcgctcaagcgcatc

SEQ ID NO: 43121 - DNA, 1815 bp, Myxococcus xanthus
tacatcctgttactcgtcctgggcttcctgctgttccgcaacgtcttccaggacgcgggcgtgcggcgcgtgagctacagccagttccgtgacggggtggaagctgggaacttcagccgggtccagatttcgaacgagtgggtgaagggcttcctcaaggacacggcgcagccgcctcctcctccagcggacggggagcgcacgctgcgcggcgagccgagcgccctgccgtggatggcctaccgcgtcgccggtgacgaggggctggtgccgttgctggagcagaagggcatccagttcgaggccgtgccgcagtcagggctgggcgaggcgctgtggatatggctgttgcccctgggcctcttcttcctcttctggagcttcatgatgcgccgggtggccggcggcatgggccagggcccgcagagcgtcatgagcttcgggaagacgcgcgccaaggtgcaggccgaggccgataccggcgtgggcttcaaggacgtggctggcgtggacgaggcggtcgacgagctgcgtgaaatcgtcgagttcctcaagacgcccgagaagttccgccgcctgggcgggcgcatccccaagggggtgctgctggtgggccctccgggtacgggcaagacgctgctggcgcgagccgtggcgggtgaagcgggcgtccccttcttcagtctgtcgggctccgagttcgtggagatgttcgtcggcgtgggcgccgcgcgagtccgcgacttgttcgcccaggccacgtcgaaggcgccgtgcatcatcttcatcgacgagctggatgccattggcaagagccgcaactcgggcgtggccggtgggcatgacgagcgtgagcagacgctcaaccaactgctcgcggagatggacggcttcgacagccgcgcgggtctcatcatcctggcggccaccaaccgtccggagatcctggacagcgcgctgatgcgtccgggccgcttcgaccggcaggtgctggtggaccggccggacaagcggggccgcgagcgggtgctggagattcacgccaagggcgtgaagttgggaccggacgtggacctcaaggccattgcctcgcgcaccccgggcttcgcgggcgcggacctggccaacgtggtgaacgaggccgcgctcctggccgcgcggcgcaaccgcgacgcggtgatgcgggcggacttcgaggaagccatcgagcgtgtcgtcgccggtctggagaagaagaaccgccggatgaacgagcgtgagaaggagattgtcgcgcaccacgaggcgggccacgcggtggtggggtggatgctgcctcacgcggagcgggtgacgaaggtgtccatcatcccgcgcggcctggcggcgctgggctacaccatgtcgctgccgctggaggaccgctatctcatgtcgctggacgagctgcgcgacaagatggcggggatgatgggcggccgggccgcggaggagatcttcatcggggaaatctccaccggcgcgtccaacgacatccgccaggccacggaaatggcccggatgatggtgcgggactacggcatgagcacgctggggccggtggccctgagcgcggaccatggcccgggcttcctccgctcggcgggcgtgccggagacgcgcagctactccgagcagacggcgcggatgattgacgaggaggtgcgcaagctcgtcagtgaagcgctcgacagggcccgtcaggtgctgaccacccacaaggacagggcccaggcgttggcggcccggcttctggccgtggaggtggtggaggaggacaccatggtgacgattctg

SEQ ID NO: 43122 - DNA, 1596 bp, Myxococcus xanthus
atgcgctggtgcgtgacctgtgtggcgtggtgcccgtcgggaggcaggatggccatggactgcgactggctcatcatcggctcggggttcgggggcagcgtcagcgcgctccggctgaccgagaagggctaccgcgtcatggtgctggagaaggggcggcgctttcgcgccccggacttcccgaagacgaactgggcgctgaagcgctggctctggatgcccacgctggggtggcggggcctgttcgagatgtcgttcttccgccacgtcaccgttctgtcgggcgtgggcgtgggcggtggctcgctcgtatacgccaacacgctccccatcccccgggacgacttcttccaggcctccacgtggggccacctcgccgcgtggaaggaggagctggcgccgcactacaccaccgcgcggaggatgctgggcgccacgccgaatccactgcgcaccgtgccagaccaggtgctccaggacgtgggcacggacctgggccgcaccgacttccagcccaccacggtggccgtgtacttcggcgagccgggcgtcaccgtgaaggacccatacttcaatggtgagggaccggaccggacgggctgtaccgcgtgtggcgggtgcatgctggggtgtcgcttcgatgccaagaacacgctcgacaagaactacctccacctggcggagcggcgcggcctcgcgctgcacgcggacaccgaagtcacctgggtgcgaccgctgccagacgggggctacgaagtcgaagcgcttcaaggggcgcggcgcttcttccggaagaaggtgcggttcaccgcgaagcacgtcgtcttcgcggggggcgtgctgggcaccctggacctgctgctcaagttgaaggcgagcccggacggactgccgcgcctgtcggaccggctgggagacggcgtgcgcaccaactccgaggcgctcgtgggggtggtgaacggccgcaaggggcaggatttgtcacggggcatcgccatcggttccatcttgcataccgatgcccagtcccacctggagccggtgcgctactcggcgggctcgggcttcttccggttgttgatggcgccgcaggtgtccggggccacgatgctccagcgcttcgtgcggctggtgggcctgctggtccggcatccgctgcgcttcctcaaggcgtggttcgtcccggacttcgctcggcggacgatgattctgctctacatgcgcaccctggaagggcacctgcgcatgacgcgctcgcggaggctggggctgagcacggcgctccaggagggcccggcgccgagcgccaacatgccggaggcgttcgacctggcccggcgcgtggcggacaagctggatggctatccgatgaccatcgtcagcgagaccctgctgggcattccgacgacggcgcacatcctgggcggctgctgcatgggggactcggcggagacgggcgtcatcgactcgcggcaccgcgtgtttggccatgaggggttgtatgtggtggacggctccgccatctccgccaatccgggcgtcaatccgtcgctcacgattacggcgctggccgagcgcgcgatgaccttcattccc

SEQ ID NO: 43123 - DNA, 1773 bp, Myxococcus xanthus
atctggactagcctgcgtgcaatgggcttgattcagaatccgccgctgagccacgcatcccttcgtcgcgtcctggcactggctcgtcccgagtggaggctgctcttgctcggcacgtgcttcctcttcatcgggagcgcgggaggcctgctcttcccacaggccatccgggtcatcctcgacgaagccctgactaccgccacgctcgacatggtgaacgacaccaccctgtggatgctgggggtgtgtttcatccagtcggtggccatcgggctgcgcttcgccttcttcaacatcgcgggtgagcgcattgtcagcgacctgcgggagcggctgtatcgcagcttgctggagcaggagatcgcgttcttcgaccagcaccgcactggcggcctcaccagccggctgtccactgacaccgccctcatccagggcgccgtcagtacgcacatcgccatcatgctccgcaacgcaaccacgttgattggagggctggcgctgctgctctacacctcgccccggttgacgctcgtcatgctggcggtcgtcccccccgtgacgctgggggcgctgttctatggccgcaaggcacggcagctcgcgcgagacgcccaggccgcggtggccgaagccaatgaagtcgccgccgagtccctctatggcattcagaccgtccaggccttcgtcgccgaagacgcggagcgccggagctatggccgtgccattggcaaggccctggcgctggcgcgcacgcgaatcgtctcctcgggcttcttcatgggaggaacgggcttcaccggcctggcgtcgaccctgctcgtcttctggtacggcacgcacatggtcgtttcgggcgacatcacggtgggtggactgacctccttcctgatgtacacgctgatggtcgtcatggccgtcggtgccctgagcgagctgtgggcggagttcatgaaggccggaggcgccaccgagcgcgtcttcgagctcatcgaccgtacgcccgccatctccgtcagcggcggcgagcggcccgcgaacatggaaggcaacctgcgcttccgcgacgtcaacttcagctaccccacgcgccgggacgtgcccgtcctccaaggcctggacatggacgtcgcgcccggtgaagtcgtggcgctggtgggacactcgggcgcgggcaagtcgactgtcgcctcgatgttgatgcgcttctacgatccggaccgaggggccatcctcgtcgatgagacagacctgcgaacgctcgacgtccgctggctccgtcagaacatcggcatcgtgtcgcaggagcccacgctcttctcgggcagcatcgccgacaacatccgctacggacgcaccgacgccaccgatgcggaagtggaagccgcggcccgcgtcgccaatgcccacgacttcgtgagccggtttccagaaggctaccgcacgcgcgtcggcgagcggggcatccagctctcgggcgggcagaagcagcgcgtcgccattgcccgcgcggtcctcaaggatccgcggctgctcatcctggacgaggccaccagcgcgctggactccgaaagcgagcacctggtcaaggaggcgctggaccggctcatggtgggacgcaccaccctcatcatcgcccaccgcctgtccaccgtggcgggcgtcgaccgcatcttcgtgctggaccagggccgcgtcgtccagcacggaaaccacgaggcgctcatcacccaggacggcctctacaagcgcctcgtggaacggcagttcatcgcc

SEQ ID NO: 43124 - DNA, 765 bp, Myxococcus xanthus
atgaagatcgccacctggaacgtgaactcggtgcgggcccgtcaggaacggctgctcgcctggttgaagaaggcccagccggatgtcctctgcctgcaggagctcaagtgcgtggacgacgacttccccatggaggccgtgcgggagttgggctaccacgccgccgtccacgggcagaagacgtacaacggcgtcgccatcctcgcgaaggaggagccgaaggacgtcgtgaagggcctgtccgacggcgtggatgattcgcatgcgcgcctcatcgcggcgaccgtgggcggcatccgcgtggtgagcgcgtacgcgcccaatggccagtcggtggactcgccgcagtaccagtacaagctggagtggtacggccggctgcggcgctacctggacacacgggacaagcccgacgagcccctggtgctgggcggggactggaacgtggcgcccgaggacatcgacacctatgacccgaagttgtgggaaggccagacgctcttcacgctgaaggagcgggatgccctccagcgcctgggcgccttcgggctttcggatgccttccgcaggctgcaccctggcgttcagaagttcacctggtgggattaccgcatgctcggcttcccgaagaacctgggcctgcgcatcgaccacctctacgtgacggcgcccgtggccgaacgactgacggtcgtggacgtggaccgcgaggagcgcaagggcaagcagccctcggaccacgctcccgtgtggctcgaactgcgc

SEQ ID NO: 43125 - DNA, 1013 bp, Myxococcus xanthus
gagcggaacctcatcgcccgcacgcggcccttcgctgcgcaggacacgcggcggagctggtgggaagtaggcaccaccttcgcggccctgctgggcgccatcgcgctcgccgcccttccctcctggtggcccctgcgcatcgtgggcagcgtggtgcaagcgctggcgctgatccgctccttcatcctggtccacgactacttgcacggttcactgctgtcgggctcgcggatcgccaaagccctgttccacacccacgcggtgctgctgctcacgccgccgcgcgtctggaccgagtcgcacaaccaccaccatgcgaacacggcgcggctggctgcctccgcgtcagggacgttcaccacgtggacggcgcagcagtggcgagaggccacggcgctggagcggctggcctacgtggtggagcggcatccgcttgtgatgatcttcgcgtacccgctcgcgttcctgggtgggctgtgcatcgtgcctttcgtgaagcacccgctgcgctactggagcgcgggcttcgccgtgctcctccacgtgaccatcagcgcggcggtgttccacttcgggggcctgggcgtgtacctcacggcgatggtgctgccgctgtccctcggctacgcgctgggggcgtacctcttcttctcccagcacaacttcccggacgtcgcgctgcgcgaggacccggactggacgcacgcgagcgcggccctggaggcgtcgagctacctggcctgcggccccgtcatggcgtggttcaccggcaacatcggctaccaccacgtccaccacctcaacccgcgcatccccttctaccggctgccggaggccatggccgccatccccgaactgcagaacccgcgcaccaccaccctgcaccccagggacgtgctggcctgtctgcgactcaacgtctgggacggaaagcggggtcgcatggtccggttccgggacgttcccgcgtcacgctgagggcgcccggcagggcccctagggagcggaaggct

SEQ ID NO: 43126 - DNA, 877 bp, Myxococcus xanthus
agacacctgcttggaatcgaaggctggcgccgggacgagctggagtcactgctcgaccgggcgaaggcacacctccccggcggtcccgacaccacccacctgcttcgcggcaaggtggtggcgaatctcttcttcgaggactccacccggacccgaacgtcgttccacatggcagcgaagggtctgggggccagtgtgctcaactggactcacaccggctcctcggtgtccaagggtgagacgctgctggacaccgcccgcaacatcgaagcgacggggccggtggccatcgtcatgcgtcatcgctcgtctggagcgccgcacctggtggcgaagcacgtgaagtgcgccgtcatcaacgcgggtgatggcacgcacgagcacccctcccaggcgctgctggacgccttcacgctgcgccagcgctggggctcgctggacgggcgcacggtgctcatcgtgggcgacgtgctgcacagccgcgtggcccgctccaacctgcactgcctcaaggcgctgggcgcccaggtggtgatgtgtggcccgcccacgctgcttccgccggggctggagtcgctgggcgcggaggtgacgcacaacctggatgctgcgctccctcgcgcggacgcggtgatgtgcctgcgcgtccaactggagcggcaggagcaggcgttcctgccgtccacgcgtgaatatgcacggctgttcggcctcaacgcggcccgcgaagagcggatgaaggcgggcgcggtgagtgatgcatccgggccccatcaaccggggcgtggagctggcgccggcggtggcggatggcgcccgcagcgtcatcctcgagcaggtgtccaacggcgtcgccgtgcggcgggccatcctggag

SEQ ID NO: 43127 - DNA, 1116 bp, Myxococcus xanthus
atgacgaagcgggcagtgctcgccctggcggatggcaccacgttcgaaggccgtgcgtttggcgcggtgggcgaaacggtgggtgaagtggtgttcaacacgaccatgtacggttaccaggaggtcctcacggacccctcgtacgtgggccagattgtcaccatgtcgtacccggagattggcaacgtcggcgccaacccggaggacgaggagggctcccgggtgcacgcggtgggcatggtggtgcgcgccctcagcgagcagccgtccaactggcgcgcgaaggagtcgctggacgcgtacctgaagcgcaacggcgtcgccggcatcgagggcatcgacacccgccgcctggtgcgccacctgcgcacgcatggcgcgcagatgggcgtcatctccagcgagggcctgtcccccctggccctggtggagcgtgcccgctccgcgcgcggcatggagggcctggacctggccacgggcgtgtccacgaaggaggcctacaccttcacccagccctcgccggacgtcttcaccggcttgggagaggtgcgggtgccggccgagccccgcttcgacgtggtggcctatgactacggtctgaagaagtcgatgctgcacttcctggtggatgtgggctgccgcgtgacggtggtgccggccaacacctcggcggaagaggtgctggcgcgcaagccgaacggcgtcttcctggccaacggccctggagatccggcggcggtgaagggcgcggaccgcaccgtggcggcgctgctgggcaaggtgccggtgttcggcatctgcctggggcatcaaatcatggcgctggccctgggcggccggacgtacaagatgaagtttggccaccggggcggaaaccagccggtgaaggacctcacgacgggcaaggtggaaatcaccgcgcagaaccacggcttcgccgtggatgacgccagcctcaagggcctggccgtcgtaacgcacatcaacctcaacgacggcacggtggagggcctggccgtcccggacgcgcgggccttcagcgtgcagtaccaccccgaggcctcgcccggcccccatgacgcgcgctatctcttcgacaggttcgcgaagctgatg

SEQ ID NO: 43128 - DNA, 1395 bp, Myxococcus xanthus
cgcaaggcgaaaatcatctgcaccctgggccccgcttcggacacgcccgaggtcatcgaagggctcatccgcgcgggcatgaacatggcgcggttgaacttctcgcacggcacgcacgaggagcaccgccgccgagtggaaaccatccgcaaggtcgcgaagcgcctgggcacgccggtggccatcctccaggacatccaggggccgaagatccgcctgggccgcttcgacggggggcaactgctggtgaagcagggccagtccgtcacggtgacgacgcgcaacgtcctgggccaggacggcgtcatccccacccccatcaagtcgctggtgaaggacgtggccaagggccacgaaatcctcctggacgacgggcgcgtgcggctgcgggtgctgcgcgtccacgggcaggacgtgcagtgccgcgtggaggtgggcggcgtgctcaagaatcacaagggcctcaacctgcccggctcgcccatgtcggtgcccacgattacgcgcaaggacgcggtggacctggcctttgggcaggaggtgggcgtggactacgtggcgctgtccttcgtccgcacgcccgaggacatcaagaaggcgcgcgcgcacgtggcgaagctgaagacgcccctcatcgcgaagattgaaaagccccaggcggtggagcgcgtggaagagattgccgccgtggcggacggcatcatggtggcgcgtggcgacctgggcgtggagatgcccctggagcgcctgccggccatccagaagcacatggtgagcgcggtgaaccgcatgggcgggctcgtcatcgtcgccacggagatgctggagagcatggtggccaatgcgcgccccacccgcgccgaggtgtccgacgtggccaacgccatcctcgacggcgcggacgccgtcatgctgtcgggcgagacggccgcgggcaagtaccccgtcgaagcggcgtccaccatggcgtgcatcgtggaggagacggagcgcggcgtggtgaagcaccagcaccactcccccttcgagcgctccgaggacctgggcaccggcgtggccgcggcggccgtggcggcggcgacgcaactgggcattggcaccatcgtcgcctacacggagagcggccacaccgcgcgcctcatctccgagttccggccccacgcgcgcatcatcgccctcacgccgagcgagacggccgtgaatcgcatggcgctctactggggcgtgacgggcatgcaggtggcgcgcgtgtccaccacggacgccatgctcacccaggtgcgtcagctgtgccggaaggagaagctctgcgcgcccggcacgcccgtcgtggtggtggccggtgtcccgctcaacgtcccgggcaacaccaacctgatgagcatccaccgcatc

SEQ ID NO: 43129 - DNA, 1860 bp, Myxococcus xanthus
cgactgcgagtgaccatggctaaacaatcaggtttgctgcgccgtcttgggaatgtggcgctgaatgaggtgagcgagcgcttcggcagcacgtcacccacgccttcctccggagacacgcgcttcacgccgccgacgcctgccgcgtcgaaggacgaagaatcactcgaaggctggggcttcgccgacacgcgtttcgtggtgaagcccgacgggagcaccgttctcacgggcacccgctacaacatcagcaatgtcgcgctgccagacttgatgcagtggttcgccggcaagctggcctcgccgctggggtacgacaatcgcaacgagccgcactacccgcccgagattcccgcggcgaagaagaacgacaagcttgtagcggcgctgcgcgagttcctgaaggaagagcagctcaccgacgaccccaagcagcgcctgcgccgtggccatggccacaccggcggtgaaatctgggccatccgctacggaaagctggaccgggtgcccgacctcgtcgtcttcccgcgcggccacgatgaggtggtgcgactggtggaggtcgccacccagcacggcgcctgtgtcatccccttcggcggcggcaccaatgtgacggaggcgctgcgcatcccgctctccgaggagcgcctggtcatcgccgtcgacatgcggcagatgaaccggattctgtgggtggaccccgtcaaccgcatggcctgcatcgaggcgggtgccacgggccgtcacctgatggaggagctcgcgaagttcggcttcaccatgggccatgagccggacagcctcgagttctccacgctcggcgggtggattgccacgaacgccagcggcatgaagaagaaccgctacggcaacatcgaggacctggtgctcgacatgcaggtcgtcacgccccagggcatcgtggagcgcccgcgccaggccccccgggagagtgtgggcgtcaacccgcgccagtacatgttcggcagcgagggcaacttcggcatcgtcaccacggcggtggtgaagctgttcccccttcccgaagtgcagcgctacggctcggtcatcttccccgacctcgaaacgggcctctcgttcctctacgcgctccagcagtcgggagcggtgccggccagcgtgcgggtgatggacaacacccagttccacttcggccaggcgctcaagccagccaagcacgggctggccgcgaaggtgaagagcgaggtcgagaaggccgtggtgacgaagctcaagggcttcgacccgtacaagctcgccgtggccaccctcgtgttcgagggctcgcgcgaggaggtcgccttccaggagaagacggtgtaccgcatcgcctcggagcacggcggcatgaagggcggtggcgccaacggtgaacgcggctaccagttgaccttcggcatcgcgtacatccgggacctcaccttcgagcactgggccatcgccgagagcttcgagacgagcgtgccgtggagccgtgccatggacctctacgagcgcgtgcagcgccgcgtggagaaggagcacgccgcgctgggccttccgggcaaggtcttcttcaccggccgcttcacgcaagtctaccagacgggcgtggccatctatttctatctgggcttctacgcgcgcggcgtcagcgacccggtgggcgcctacgcggcgctcgagcatgcggcgcgcgaggagatcctggccgctggcggctcgctgtcgcatcaccacggcgtcgggaagattcgccgcgacttcctgcccgaggtgtactcggaggccgcactggccctcaaccgcaaggtcaaggccgccatcgaccccgacaacgtcttcggcgcgtcgaac

SEQ ID NO: 43130 - DNA, 2196 bp, Myxococcus xanthus
atgcgattccccttcgttcccctcggcctgatgctcacggcgctgacgggagcccccggcctggcgctggatgacgctcccccccccctcgccccctccggaaccacgccggatgcgcaggtccaggcgaagctggacctggcggaccggttcgtccgccgggcggaactcctgcgggacagcctggttccccccaggtggctgcgtgagggcgaccggttggtcttctggtcccgtgagggcaaggacggcgggacgtgggtgctggcgcacgcgaagaccggggagctgaagccactcctttccggtgagcaactgaggcagcagctctcgacgctgctgggcaagcccatcaccgcgccccgcttcttcgacgtcgcgctcgctccggatgagcggggcatcgtgttccgcctggaggggaagacctttggcctgggcctgtcaggtggccatgtcaccttgctgtcgccggaggaccgggccgcgctgacgctgtcgccccagcacttcctcgcgccgaaaggcggcgcgctcgccgtgcaacgccagggcggcttcgcggtgctgaacgcggaaggcgccaccgtggtcgagcgcacgggggaagcgaacctcgactggcggattccggagcgtccctggtcaccggatggccgcttcctggtggtgtggcgggacgacctccgcgccgttcaccaggtgcccgtcgtggactactcctccgcgctggagaaggtgacgacggtgccgtacacgaagtccgggacgccactgccgcgcgcggagctccatgtcgtggaagtggcgacgggccgcgtgacgcgcgttccgcccgtcgagggcgagacatatgactggttcgccggctggaatcccgagggcaccgaggcgctgtgtctccacctctcgcgtgacgccaagcggctggacctgagcgtcgtggaacccgcgtcgggccagcgtcggcacgtcctgcgcgaggagcgcccggagaccttcgtcaccggcctggacttcgcggtgggcggctgggcgaagcaggtgacggcgctgccaggagggcgcggctacctctggatgtccgagcgtgatggctggcgccacgtgtatgcgtatgaccgctcggggaagcgcgtgaggcagctcacgcgaggcgcctttcccgtgcacgaagtggtgggagtcgcccccacgggagatgccctctacgtgctggcctccgccgacagcggcgcgccatacgagcacctcttctaccggggaagcctgaagggaggcgcgttgaagcggctgtcctctgcctcggggatgcaccgcatcacgccgtccccctccggccagtactacgtggacacatggtcctcgcggacacagccccggttgagggagctggtgtccgtggagggtggcaagcgcgtgcggctcaccacgtcggacgcgagtgagttcgagtcgctcggcgacacgcggccggaggcgctgctcgtcaaggcggccgatggcgtcacgcccctgcacggcgtgctctacaagccacgcgacttcgacgcctcgaagcgctaccccgtgctcgcctccatctacgcgggtccgttcaccaccgttgtcccctggagcttcctggggacttcggattcgctgaccgccagcggcctggcgcaactgggcttcatcgtggtgttgctggacccccggggtggccccggacggagcaagtccttccaggacgcgaactacggccgcgtgggccagacggagattcccgactacgtcgcggggctgaagcaggccgcgtccacgcgcccctggatggacctggagcgggtcggcatccacggcggttcgtggggcggctatttcacgctgcgcggcatgctgacggcgccggacttcttcaaggcgggctacgccggagcccccggagcgctggaggaagaggccatcatcaacgagccctatctcaacctcccaagcgtcaatccccaggggtacgcggcgggcgacaacctcgcgattgcagacaggctgaggggccacctgaagctgatgcacggcacgagcgacgtgaatgccacgctctccgtgacgatgcggatggcggacgcgctcatccgcgcgggcaagcgcttcgaattgctcatcatgcccggccagccgcactcccctcggggtgccgccagccgctactaccgg

SEQ ID NO: 43131 - DNA, 1194 bp, Myxococcus xanthus
cgagtggtcatcaccggcatgggcgcggtgtccccctacggggcgggcgtcccgcccttgctggacgcgctcgccgagggacgcagcgccatccgccccatcgacgacttcgatgtgtccggatgcggttgcaaacacggggcgcgcgttcctcgagggagcctgtccgcgctgacgggctccaacaacctgcggcgtgcgcctcgagggacgcagtacacgatgctcgccacggaggaggcgctccagatggcggggcatgggccctccacctggaacccggagcgggtgggcgtgttcctgggcacctaccgggccatggcggaggtcagccaggacatctggcatcgcatcatcaccagcgagccgcgcttcgtccaaccgctgctgttccaggagaccgtgacgaacgcggtggccagcgcgctgagcatccgctggggctggcgcggcaccaattacgccatcagcgcggggaacgcctgcggcttccaggtgctcgcgctggctgcgcaggcgctgcgcagtgggcgggcggacgctctcatcgcggggacgttcgacctgttcaccacggccacgcacttcgacatggatgacattggcgtgctaagtgatgccaacgtgagccgtcccttcgacacccggcgagatggctacatcatgggagagggggcggcggtggtggtgttggagacgctcgcctccgcgcgggcaagaggcgccaccccgctggcggaaatcgcgggcctgggcgtggcgcacgacgggcacgccttcggcatccaccacccagagggccggggactggcctccgcgatgagtcaggcgcttcgcgacgcggaagcctcgcccgaggccgtggactacatcgccgcggccagcaactccacgcaatcgttggaccgggcggaagtggccgcgctgaagacggtgatgggcgccgcggcgagcaccgttcccctcagcagcgtgaaggggctcatgggcgaggccgagtccgccagcgacatgttcaacctgctcgcctgtgtcggcgcggttcggggaggcgggttgcctgtccaggccggcatcgagcagccggagttcgagctcaatctggtacgccagccgcggccacaccggcccgtccggacggccctggcgcactcctattcgttcgggggcaacgccggcgcggcgttggtccgg

SEQ ID NO: 43132 - DNA, 1215 bp, Myxococcus xanthus
aaagtcgtcgttaccggcattggcgttctcacgcccattggcaacaacctggcggagttctccgaagggcttcgctcggggagagatggcatcgcgcccgtcacccatttcgacgccagcaagcaccgctgtcagtccgctggcgagctgaagaacatcgacttctccgcgcacttcagccccgatgagctgccctacctcagtcgcggcgcccagatgattcgcgtggcggcggcgcagggactggcggcgtccgggatggacctggatgtcgaggaccgctcgcgcattggcgtggtgctcggaaccaacctgggaggaatgcccgccaggaaggaaggctacgccgcgctgcactacccctaccggcgcgggcgcgcaggcccgaaggagccctggcgagccctggtgctcgacagcttcatctgcgccatgagtgaccacgtcgccagccagtaccagttggggggactcagcctggtcatgtccaccgcgtgcagcgcgggccttcatgccctgggcgtggcgatggatgtgattcgctccgggcggtcggaggtgatgttcgcgggcggagtcgatcccctcagtgagatgccccaggccggcttcggcgtcctgcgctccctggcgagcgacaagctgcggcccttcagcaaggaccgcgatgggacgctactgggcgagtccgcctcgctgtgggtgctggagagcgaggcgcacgcgaagcgccgcggagcgaacatcctggcggagctcgcgggctacggaggctccacggacgcctaccacatgacccggcccgacgagacgggacgcggccccgcgcgggccatgcaggcggcgctggcgagcgcgggcatgaaacccgagcagattggctacatcaaagcgcacggcacgggcacgccggccaatgacgtcatcgagacacgcgccatcaagcatgtctttggcgagcagacccgagtccccgtcagctccatcaaggcgatggtcggccacagcctcgggtccagcggcgccatggaggcggctgcggcggtggtggcgctgaacgacggcttcctgccgcccacgctgcacctggatacgccagaccccgagtgcgacctggactacgtgccccatcacagccgacccacgaagctggaagcggtgctctccaacgcgtttggctttggcggcaacaacgccgcgatggtcttccgccgc

SEQ ID NO: 43133 - DNA, 741 bp, Myxococcus xanthus
ttccaacagcagacggtcatcatcacgggcggctcgcgtggcattggtaaggccatagccctcgcgttcgccgctgagggcgcggacatcgtcctcaactacgggagcaacgcggaggccgcgcgtcaggccgccgccgaggtcgaggcacaggggcgccgctgcgtgctggtccccggctcggtcgccagccccgacgtaccaggacagctccgagaggcggcgctctcccacttcggccgcatcgatgtgctggtgaacaacgccggcatcagccgggatgggcacttgatgatgctccaggccgcagcgtggcgggagacggtggacgtcaatctctacggtgcgctcgcctgctgtcaggcggtcatcccgaccatgatgcagcaaggccgtggcgccatcatcaacatgtcctcctccgccggaatccggggacgcgcgggacaggtgccctacgccgccaccaaaggggccttgattgggctgacgcaggcgctggcgggagagctggggccacatggcatccgggtgaactgcgtggcgcctggcttcgtggagacggagatggtcgcggggctgatgaaccgtcccggggtgcgcgagggcttcatccaggccacccccatccgccggctgggaaccgtggaggacgtcgccaacgccacgctcttcctggcgtctcctgagagcgcctacgtggtcggcgacgtgctgcgcgtgaatggcgggctggtgctg

SEQ ID NO: 43134 - DNA, 696 bp, Myxococcus xanthus
caggtggtgctagtcaccggagcgggacagcccatcgccaatgccattgcacggcgccatgggaaagcgggcgcgcgtctggccctcgtgttcctgccggagcacgaggcagaggcaacggcactcgccagggagctgagcgcggagctggccctggcctgcgagtcttctgacgcacaggcggtgggcgcggtggtccgccgcgtcgccacggaattgggccgcatcgacctgctcatcaacgcgtcattgagccgcgcgacaggtcgactcagcgacctgtccgccgaacagtggaaggccgtgctcgaccgccagttgagtgggacggcgtggttctgcaaggaggtcatccgcccgatgatgcgcaagcgctcggggcgcatcgtcaacctgctggatgccgcttccggaggtgcgagccgcgtggccgccgaaggcatcaccgcgatgacacgcgcgctggcgaacgaggtggcccggcaaggcatctccgtgaacacgctggcggtccaactccttgaggaggagaccgcacacctcaccccagcgcagcgcgagcggctcgatggcgagttgggtcccctggggcggctcgggagcgcggaggaggttgccgaggccgtgctcttcctcggttcgagcgcggcgaacctcacgacgggtcagcgcctgtccgccaccggaggtctgtgg

SEQ ID NO: 43135 - DNA, 954 bp, Myxococcus xanthus
ggcacgatgagccggcgcatcgtcatcagcgggctcggcgcggtgtgtccccaggccacgggacctacggccctttgggagcgcttctcccaaggcgatgcgggcccaccgtcctccctggcggagcgcattcccgacgcggcgttcgcgaagcagtccgcccagttgcggcacatggaccggctcgggcgcatcgcgctcaccgcgaccacgctggccatcgaggatgccgggcccggcaatcccctccagacaggcatcgcgttcggctccagctacggctgcctgcccacgaacgcggagtacctggaagccatcctggagcggggcggccgctacggaaacccggtggtgttccagaacaccgtcaccaacgcggcgacgggctacatctccatggtgcacgaccttcgcggtcccaccgcgaccctgtgctcgggccacgccgcgggactggaggcgcttcgcttcggctgccagcaaatcgaggaagggcaggcggagcggatggtggtggtgggcgcggacaccctgagccccatgctcctggctggcatcgccctgcctgagggaatgcgggtgagtgaagcggcgtgcgccctggtcctggaggagcacacgcacgccctgacgcgcggcgcacaccgccacgcggaagtcctgggcaccgggcaccggggaggctcgctcacgaaccaggcgcacacgctggcccgcgcggtgcgggacgcgatgcacctggcccgaatcgagcccgagcaactgagcgccgtcttctcctgtgcgagcggccgaggagacttcgacgggtgggagcagcgtgggctgcacgaagccctcggggcgcacgcggcgaaggtgcccgtgagctgtcccaaggacgtgcttggagagacgttcagcacggcgggcatgctggccgtcgtgctggccacgcgggccctcgacaaggga

SEQ ID NO: 43136 - DNA, 1191 bp, Myxococcus xanthus
atgagcccccatcgcgtcgtcatcacgggccttggcgtgacggccgccaatgcgctgtccgccgacaagctcgcccaggccctgttgaaccgccgcagcggcatccggcgggctgccccgttcgacatcgaaggccggacgtactccgcgggcgtggtggacctgccgggcgagacgcccgacaacggtttggaccgcgtgtcaaagctggcacttcacgccgcggagcaggccctccgcgacagtgggctcgaagcccaggggaactggcgggaggtggcgggggtcatgctgggcacgagccgtgggcccgccttgtccctcgaacaggtcattcgctccggaggtgatgaggacgctcgccggagacacttcggggaggttcccttctcctccatcgcgcggaacgtcgcggaccggttcggcctgggcggcatcctgtccaccgtcaccatggcctgcgtgtccagcagcctcgccatgggccgagcactggacgaaatccgtcagggacgggcctccgtgatgctggcgggaggagcggatgcactgaccctgctcagcttcagtggcttctccgtcctgcgcgccatgacgcccacggtgtgccgccccttcgaccatcggcgcaatgggatggtactcggcgagggcgcgggcatcctcgtgctcgaggagctgaaccacgcccgccagcggggcgctcgaatccatgcggagctgtgcggctggggaacggcgggcgatgcccatcaccccaccagcccgcaccccgagggccgggggctccaacaggcgatgacgctcgccttgcgacaggcgggactgacgacggagcagatcgacttcgtcaacctccacggaaccgggacgccggccaatgaccccgcggagtgccaggccctgcgaggtgttttcggtgcgcgagccgcggcgctgccggtcaactccctcaagccctacttcggccacacgctgggggcctccggcgcgctggagctcatcggctccgtgctgggcatggctcgtgacttcctcccgccgaccctcaactgcgaggaactggacccgaagtgcgacgtcgacgtggtgcgtggcgagggccgcgcccaacgcatcgacacgctgatgagcaccaagtccgcgttcggcggggcgaacgtcgctctcgttacccggcgctttcctgag

SEQ ID NO: 43137 - DNA, 462 bp, Myxococcus xanthus
caggcagcaacgcccgcggggctcggcatccaggagctcctccgactcctgccgcatcgctatccgatgctcatggttgaccggattgacagcttggaacccggcgtgttcgccgaaggaatcaagtgcgtcacggcgaacgagcccttcttccaggggcactttcccgagcaccccatcatgcccggcgtgctgatcgtcgaatccatggcccaggtggcgggcgtcatgctccgcacgaggagccgcccggacctcgcgcccgtggagccggcgacacagaagccagcgcggccgggcgtgatggccaacatccaccggatgcgcttccgccgccctgtcgttccgggagaccagctccgtgtccgggccactcacctcaagagccttggcaccatccaccatgtgaaggtcgaagcacgggtgggtgaagagctggtcgccgacggcgaattgatgctg

SEQ ID NO: 43138 - DNA, 1347 bp, Myxococcus xanthus
cagttccccaatgacttcctgtggggtgtggccacctccgccttccagattgagggcgccaccagcgccgatgggcgcggtgagtccatctgggaccgcttcgccgccacccctggcaaaatcagcgacgggtcggacggcaaggtcgcgtgcgaccactaccaccgctggcgcgaagacgtggcgctgatgcgctggctgggcgtgaagtcctaccgcttctccgtggcctggccccgcgtgctccccaccgggcgcggcgccgtgaatgccgcgggcctcgacttctactcgcggctggtggacgggctgctggacgcgggcatcgagcccttcgtcacgctctaccattgggatttgccccaggcgctccaggacctgggcggctggccttcccgcgacaccgcgagcgccttcgtcgagtacgccgacgtgatgagccgcaagctgggcgaccgcgtgaagcggtggattacccacaacgagccctggtgcatcagcgtgctcggctacggcaacggcgaacacgcccccggtcacaagaactggggcgaggtgctggccaccgcgcaccacacgctgctgtcccacggccaggcggtgcccgtcatccgcgccaacgtgaagaacgcggaggtgggcatcaccctcaacctgtcgcccgcggagcccgcgtctcccagccccgaggacgcggaggcatgccgccgccatgacggcagcttcaaccgctggttcctggacccactctacggccgcggctacccgaaggacgtggtggaggactacgtgaaggacgggcgcctcgcctcgtccgcgctgcccttcgtgcgcgacggggacatggccgccatcgccgtccccaccgacttcctgggcatcaactactactcgcgcgccatcatgcgcagcgaccgcatccccgaatcccagaacgcgccgcgcaccgtgcaccccgagcccgagcgcacggacatggactgggaggtgtacgcccccgccctcacccggatgctcgtgcacctgcacaccgactaccagcccggccccctctacatcacggagaacggctgcgcctacgccaccggccccagcgaggacggcaaggtgcatgacgacaagcgcgtggcgtacctgcgctcgcacctggaggcgtcactggaggccatccgccagggcgtgccgctcgcgggctacttcgcctggtcgctgatggacaacttcgagtgggccttcggctaccagaagcgcttcggcatggtctacgtggactacgactcgcagcgccgcatcccgaaggacagcgctcatctctacaaggccctggtggagaagaacgggctggat

SEQ ID NO: 43139 - DNA, 2038 bp, Myxococcus xanthus
aacccgctgatcgcgaagtggacgggcgcccatggcggcgttccgccgttcgaccaggtgaaggtggagctcttcaagccagcgctcgaggccgcgatggagcggacgcgcggcgaactggcggccatcgcgaacgacacctcggcgcccacgttcgagaacaccatcgtcgcgctggagtccgccggcaagacgcagggcgaagtggagacgctctacggcatctggagctcgtccatgagcgggccggagttccaggcgctggagcgggagatggcgccgaagctggccgccttcgacgacgaaatcttccagaacgaggcgctcttccgccgcatcgaggcggtgtaccagtcgcccgacaaggcgaagctgacgcccgagcagcagcggctcacctggctgcactacacgcgcttcgtccgctccggcgcgaagctggacgcggcggccaagcagaagctggcggccatcaaccagcggctggcgtcgctctacacgtccttcagccagaacgtgctcgcggacgaagagggctacaccgtcgtcctggagtccgaggcggacctggcgggcctgccggactccgtgcgcgcgggcgccgccgccgcggccgagtcgcgcggtcagaagggcaagtggctcatcaccaacacgcgctcctccatggagccgttcctgacgtactcgtcgcggcgcgacctgcgcgagaaggtctggcgcaactacgtcaaccgaggtgacaacggcgacgcgcgcgacaacaacgtcatcatcgccgaagtcctgaagctgcgcgccgagcgcgccacgctgctgggctacaagacgcacgcgcactggcggctggagaacgccatggcccgcacgcccgagcgcgccatggagctgatggaggccgtctggaagcccgcggtggcccgcgttcacgaagaggtcgcggacatgcagcgcgtggccaacaaggagggcgcgaagctcaagattgaaccctgggactaccgctactacgcggagaaggtccgcaaggcgaagtacgacctggaccagaacgaggtgaagccctacctccagttggagaagctgcgcgagggcatgttctgggtggccggcgagctgttcggcttctccttcacgcaggtgaacgacgtgcccgtgttccaccccgacgtgcgcgtctgggaggtgaaggaccaggccagcgggcgtcacgtgggcttgtggtacttcgacccgtacgcgcgcaagggcaagcgctccggcgcgtggatgaacgcgtaccgcagccaggagcggttccggggtgaagtcaccaccatcgtctccaacaactccaacttcgtgaagggccagccccggtgagcccgtcctcatcagctgggaggatgcctccacgctgttccacgagttcggccacgcgctgcacggcctcagctccaacgtgacgtacccgtcgctggccggcaccgcggtggcgcgcgactacgtggagttcccctcgcaattgctggagcactggctgtccacgcccgaggtgctgaacacctacgcgctgcactaccagacggggaagcccattccccaggcgctggtggaccgcatcgagaaggccgccaccttcaaccagggcttcgggacggtggagtacctgtccagcgcgctggtggacatgaagctgcacctggcgggggctacgcccattgacgcggacgccttcgagcgcgacacgctcaacgcgctgggcatgccgaaggaaatcgtcatgcggcaccgcacgccgcagttcggccacgtcttcgcgggtgacggatactcggcgggctactacagctacctgtggtcggacacgctgacggcggacgcctacgagcgcttcaccgaaggcaagggcgcctacgacaaggacgtggccgcgctcctgcgcaagcacgtcttctccgtgggcaacacgctggacccggccgacgcgtaccgcgccttccggggccgtgaggcgggcatccaggccctgatgcgcaagcgcggcttccccgtgcct

SEQ ID NO: 43140 - DNA, 2460 bp, Myxococcus xanthus
atgagggtgatgaaattcggggggacgagcgtgggcaacgccgagcggatgcgcggcgtggcggacctggccgcggcggcgcgcaagcagacgcgggtgatgatggtcgcctcggccgtgtccggcatcaccaacctcctgttggaagcggcccgcgcggcccaggaaggtcagccggtggagtcgctccacggccgcttcgaggacgtccaccgcggcatcatccgcgagctggcgccggagctgggggaggcgcggcagcgctcgctggaagagggactttccacgctggcctcggagctgcgcgggctgctgcagggcgtggggctgctgcgggaatgttcgccctccgtgctcgcgcacctgtccggactgggcgagcgcgccgcgtgcctgattctgggcgcgctgatgcacgcacgcggactggagccgcacgcagtggagccacgggacgtcatcctctgcgcgggggacccgctccaggccacgccgctccaggaggagacccgggcgcgcttcacgccgctgcgcgaggccggcggtcccgggttgatgctgatgccgggcttcttcggcggtgacacccggggcaagacgatgtgcctgggccggggtggctcggattattcggcggcgctggcggcggcggcgctggacgcggagctgctggagatctggacggacgtggacggcatcttcagcgccgacccgcggctggtgccagaagccttcccgctgcccgaggtgagcttcgaggaagccatggagctggcctacttcggcgccaaggtgctccaccccaagacgattgcgcccgcgcgcgagcgcggcatccccgtgcgcgtctgcaacagcttccgccccgaccacccgggcacccgcgtgaccgacgacgccgcgccgcccgagcacccggtgcgcggcctctccttccttcccggcatcgccctggtgaacctgggcggcgcggggctcaagggcgttccgggcaccgccgcccgcgtcttcgagtccatggccctcgccaacatctccgtggtgctcatcacccagggctccagcgaatgctccatcagcttctgcgtccagcaggcggacgcggagcgcgccgtgcaggccctggaagtcgcgttcgagatggagcgcgcggcgggcaaggtggacaccatcgagcagcagcgcgggctcgccgtgctcagcatcgtcggtgatggcatgcgccaccgcgtgggcgtggcgggcaccttcttcagcgcgctggcggacgtgggttgcagcatcgccgccatcgcgcagggctccagcgagcgcagcatctccgcggtcatcgcggagacggacggtccccgcgccctggcccatgtccacggtcggtgcttcggcaccacggaagtcgtggagctgctgctggccggcgtgggcagcgtgggcggcgagctgctcaagcaggtccaccagcaggcgcccaagctgcgcgcccacggcgtggacctgcgcgtctgcgtcatcgccaacagcaagcgcgtcgcgacggcgagcgagggaattcccctggaggactggaagcagcggctggcggccagcagcgacggcgcgcccctggacgccttccgcgactgggcccgcgcgaagcggccgggccggcccgtcttcgtggactgcaccagcagcgaggacatcgcgctcgcctacccgtcgctgatggaggcggggctccacgtcgtcaccgccaacaagaaggccaacgccggccagtggagccactaccgcaagctgcgcgagacggcctcccgtcaccaacgccgcttcctctacgagacgaacgtgggcgcggcgctgcccgtcatcgacacgctgaagaacatgcttcgcacgggagaccgggtgctgcgcgtggaaggcattctctccggctcgctgtcattcatcctgggcctgacggaggaaggcgtccccttgtcgcaggcggtgggcaccgccatggagaagcgcttcaccgaacccgacccgcgcgacgacctccacggcaccgacgtggcgcgcaaggtgctcatcctcgcccgcgagctgggccgccaggtggagttggagcaggtgacgctggactccctgctgccgtcggacttcgacgccaccgggccgctggatgacttcctcgcccggctcccccaggtggacgccgccttccagcgccgcgtggagacactccgcgcggagggcaaggtgctacgctacgtgggcagcgtcacggaggacggttgctttgtcgggctcgtgccggtgcccctgacgcacccgctggcggcggtgaagggcggagagaacgcgctcagcttcacctcggagcgctacagccccacaccgctggtgattcgcggctatggcgcgggcgccgcggtgacagcggctggcgtgctggcggacgtgctccgcctggtcgacgggccactcccctga

SEQ ID NO: 43141 - DNA, 875 bp, Myxococcus xanthus
atcggcaccgggccgctgggcaccgtcttcaaggggcgcgtcaccgcgctgggcctggacatctgcctcaaggagctgaaggacatctttggctacttctccttcctgcagcgcggcgaggtgctcaagcgcctgaagaaggagctgtgcgcccaggcgcaggtgcgccacccgggtgtggtccaggtggtggaccagaacgtggacgccgcccggccgtacttcgtgctggagctgatgcagggcagcctgcgtgagcggctggacgcgggcggtggcaacggcgtaccggtgcccttcgcgctgcgcgccttcctgcagatggcctatggtctgcgggccgcacacgccgggggcctcacgcaccacaacatcaagcctgagaacgtgctcttcgacgtgtacggcaacgctaagctggccgacttccgcctgggccgggtggtggaggtggacgccaccaagggcatgccccaggtcttcgtgggcacgggcggcatggcctacatggcgccggagctgatgaaccggggcggcaaggagccgggcgcctccgcggacgtgtacgcgctgggcatcctgctctacgagatgctcaccgggcagattccgggccgccgctcgccgctgccctccgaggtcaacccggaggcccccagcggcctcgatcagctattcgacaaggccacccaggacaagcgcgagcagcgctacccggacgtggacgccatgttggaggacttctacaaggcgttcccggacaaggagttcctcgccaagggcgacctcgtcatctcctcggacacgccgaaggagtgacggacgagcggccgggccccggcgcactcggggctcgccgcgcacgttgggggctg

SEQ ID NO: 43142 - DNA, 1773 bp, Myxococcus xanthus
tcaacgcacacgcaggcgtccggtgcgcaggttggaagctcgcgttagtctccgccggtgtcttcccccgcgaacgattcgaaaagcagtgcctcccctggcgtcaccgtccggcgactgctgaagctggcgcgccccgaactgctgcccctggccgcgggcaccctcttcctcctcatcagcagcggagccacgctggcctatccccgcgccattggcgacctggtggaccaggccctcaccgcgcgcgaccggtatgtggtggaccggctcgcgatgctgatgctcgccgtgttcacggtgcagggcatcgccatggcgctgcgcatctacctcttcaccaacgccggcgaacgcgtggtgtcgcggctgcgcaaggacctcttccgcgccctgctgtcccaggaggtgggcttcttcgattcgcgccgcacgggcgagctcaccagccggctctcctcggacaccaccgtcctgcagaccaccgtcacggccaacgtgtccatgatgctgcgctacgtcgtcacggccctgggcggcgtgggcctgctgctctacacgtccgtccagctcacgctggtgatgctggccgtcatcccgcccgtggccattggcggcgtgttctacgggcgccgggtccgggtgatttcccgtcaggcccaggacgcgctcgccgccagcggcgaggtggccgaggaagacctgtccggcatccgcaccgtgcgctccttcgccgcggagcggcacgaggtggagcgctacagcgtcgccgtggagcgctccttcacgctggcgaagaagcgcgcgctccagacctccgtcttcatgggcgtggcctccatcgcggggtatggctccatcgccgcggtgctctggtacggaggccggctggtggtggaaggcggcctctccgtgggcgagctcacctcgttcctcatctacaccatgctggtggccttctcgttcagcggcatcgcggagctgtgggcggacttcatgcgcgccagtggcgccgccgagcgcgtcttcgaactgctggaccgcaagcccgccatcggcgctggcggcgagcagctgaccgacctgcgcgggcacgtgcagttccgcggcgtgcacttcgcctaccccagccgtcccgacgtgccggtgctccagggcctggacctggagctgcggccgggcgaggtggtggcggtggtgggcccctccggcgcgggcaagtccacgctggcctccctgctgtcgcgcttctacgacccgcagaacggcgaggtgctgctggacggccatccgctcaccgccctggagccggagtggctgcgccgcaacatcggcatggtggcgcaggagccccagctcttctcctgctccatcgcggacaacatccgctacggccggcccggcgccaccgacgcccaggtggaggaggccgcccgcgccgccaacgcccacgcgtacatcgagcgcttcccggaaggctacggcacccaggtgggcgagcgcggcgtgcagctctccggtggccagaagcagcgcgtggccatcgcccgggcggtgctgaaggaccctcgcctgctcatcctggacgaggccaccagcgccctggacgcggagagcgagcacctggtgaaggacgcgctggagcgcctgatgaagggccgcaccacgctcatcatcgcccaccgcctgtccaccgtggccaacgcggaccgggtgctggtgctcgacggcggcgtcgtcatccagagcggcacccacgcctccctcatgagc

SEQ ID NO: 43143 - DNA, 825 bp, Myxococcus xanthus
agcacacgggtgtccgtgcccgtcctgggccaggggacctggcagatggaggaggatgaccgggcaggcgccatccgcgcccttcgcgccgggttggacctgggaatgacgcacgtggacaccgctgaactgtacggctacggcaaggtggaggagtccatcgtctccgaggccatcgcgggccggcgcggcgacgtcttcctggtgtcgaaggtgatgccgtccaacgcttcctacgcgggcacgctcgccgcctgtgagcggagcctgaagcggctgcgcacggaccacctcgactgctacctgctgcactggccgggttcgcacccgctggaggagacggtgcgcgccttcgagaagctggtggtggatggaaagattcgcgcctggggcgtgagcaacttcggggtggaggacctggaggaggcgctcgcgctcgcggggcccgggcgcatcgcctgcaaccaggtgctctaccacctggaggagcgcgccattgagcacgccgtcctgccctggtgcgaagcccacggggtggcggtggtgggctacagccccttcggcaacggccgttttccccggcccgacagccggggtgggaaggtgctgggcggcatcgcccgcgcgcacggcgtcacgccgtaccaggtggcgctccggttcctggtgcgcgggccgtcgctgttcgccatccccaaggcgagccgggaagcccacgcacgcgacaacgccgccgccgcgtcgctgacgctgaccgccgacgagctggcccacctcgacgcggccttcccgctggggcccgagccggcgtcgctgcccgtcatc

SEQ ID NO: 43144 - DNA, 1893 bp, Myxococcus xanthus
ctcaacgaggagcagttgcgcgcggtggaggcgggggaggggcccgtgctggtgattgccggcgcgggctccggcaagacacgcacgctgaccttccgggtggcgcgcatgctggagcgaggtgttccgcccgcgggcatcctcctgctcaccttcaccaacaaggcggcccgggagatgacgcgccgagtggaggagctggccggcgccttcgtggacgtgcggcgcatcctcggcggcaccttccaccatgccgcgcacgtgctgctgcgccagtacgcgggcgtgctgggcttctccacgaacttcaccgtgctggaccgcgaggacgcgcgggacctgatggtgacgtgcatcgccgagcgccggctcaagagcgacaagcgcttcccccggccagacctggtgttggacctggtttccctggcggccaacctccagcaacccgtgtcacacgtgctgatggaccgccggccgcagatgttgccgctggcgcccgaggtgctcgccgccgccgcgcgcttccagcagcgcaaggcgcagatgcacctgatggacttcgatgacctgctggtgcacctcaagcgcctgctgacgcatcacccggacgtgaaggcgcagctcaccgagcgcttccgctgcgtgctcgtggacgagtaccaggacaccaaccggctccagggcgacctggtggatttgttcgccggagagcgcaaggacctcacggtggtgggggacgactgccagtccatctacagcttccggggcgcggacttcaccaacatcatcggcttccccgaacgctacccgggctgctccgtccatgcgctgacgcgcaactaccgctccacgccggaaatcctgcggctggccaacacctccatcgcgctcaacacgaaccagttccccaaggtgttgacggcggcacggtccccgggcgtcaagccgctcatcgttcccgcccgggacgccggggagcaggccgcctacgtggcccagcgcatcggtgagctccgcgaccagggcctgtccctggaggccatggccgtgctgtatcgggcccacaatcactcgctggagctccaactggagttgacccggcgcggcatccctttccgggtgcgctccggcgtccgcttcttcgagcagtcccacatcaaggacgtgctggcccacctccggttggtgaacaacccgggggatgagctggccttcaagcgcgtcatccggcgcgtcccaggcgtgggaccggcgacggccgagcacctctggaccgctctgcgcgcatcgccggaggggacacccctggcggaggggctggcccatgcggacgtccgcgcgcacctgccacgcaaggcgcagaagggattccaggccttcagtgacctgatggggcggctgacccagccggaggcgtccccctcaccagggcgcctcatcgaggacgtcctcgccgggggctacgcggacttcctccgggcggagttctccgaggaggagcaccgggaggacgacgtccgccaactggcggagttcgccggccgcttcgaggacgtggcgcgcttcctgtcggagatcgccctggtgtcggagttcccggcggggcaggcattgaggcagcaggggccggaggcgtgcctgacgctgtccaccgtccatcaggccaaggggcttgagtggcgggccgtcttcgtcctgtggctggccgacgggcggtttccgctgtcattggccacgcgcctgcccgagtaggaggaagaggagcggcggctgttctacgtggccctgacccgggcgcgggacaccctggcgctggtgtacccccagtcggtgctgccccgggacggggagcggatcctcctgcgaccgtcccggttcctccaggaactgccc

SEQ ID NO: 43145 - DNA, 1766 bp, Myxococcus xanthus
cgcatcatcgggattgacctcggtaccaccaacacgctggtggcgtccgtccgcaaccgtatcccgaagatcgtccccaccgatcgcggcaatctcacgctgccctccgtcgtggcgctgtcggcgcgcggcgacctgttggtgggtggggtggccaaggaccagatggtcaccaacccgaagaacacgctctggggaaccaagcggctcatcgggcggaagtacaactccaagacggtggaggatctccggggctacttcccctacgacatcgtcgagggcgccaacggggacgccgcggtgatgatgggcggcaagctgtactcgctgccccacgtgtccagcttcgtgctgggccaggtgaagaccatcgcggagcagttcctgggcggccccatcgagggggcggtcatctccgtcccggcctactacaacgacaaccagcgcaacgcggtgaaggaggccggccggctggcgggcttcgacgtgaagcgcatcgtcaacgagcccaccgccgcggcgctggcctacggcttcaaccggggcctggatcagaaggtcctcgtctacgatctgggcggcggcaccttcgacgtgtccgtgctgcacctggccggcaatgtcttcgaagtcctggccaccggcggcgacaccttcctgggtggggcggacttcgacaaccgcatcatggagtacgcgctggagcgcttccgggaggagaccaaggtcgacctcaacacggagaaccccatcgcgctccagcgcatcaagaacgcggcggaggcggcgaagatcgacctcacgctgatccccaacgtcgtcatcgacctgccctacatcgacgagcgcaagggcaagccgatggacatgcgcatccccctgacgcgcgagttcctcaacagcctcaccggcgacctggtggaccgcaccttcgagatctgcgaccgggtgctggcggagaagggcatctcccgcgcggagatcgacgagatcatcttggtgggcggccagagccgcatgccgctggtgcagcagaagatccaggcgcacttcggcaaggcgccgcgcaagggcgtccacccggacgagtgcgtggccctgggcgcggcgctgctgggcgactcgctgggcagcatcgacgcggtgacgctgctggacgcgctgtccatgcccatcggctacgcgatgcccaacgggcgcgtgaagcgcatcatcgagaagaactcgctgattcccatggtgaagagcttccgtctgcctcctcccaaggagccgggctcgcccttcatcgagctggacatctaccagggggacagtgacctgctggtggacaacgaatatctgggcacggttcgcgtgccctcggccgccgccggccggaagatcgacttccgcctcaccgaggagtgtctgctccaggtgacggtggaggaagcgagcggcatgcgcaaggtggacctcgccacccgcgacacgccggagcagctcaagcgggcgctccaggaggtcgcgtcgcgtcactcacagcaggtgcccagctccagcaacagcgggagcgacgaccgggggctcttctccagtatcaagagcatcttccggaggggctaggagtccagatggcgaagttcccgtcgaaggagtgggtggacgaagcggtccgcctcaccaatgaggatcccgagtgcgccatggccggcaagggctggaagggcgacttcggggcggtggtggaagccgagcccggcaagctggcgaaggctttcgtg

SEQ ID NO: 43146 - DNA, 507 bp, Myxococcus xanthus
gcgggcttcatactctggctgacaggtctgtcaggtgcgggcaagagcaccttgtcccgtgcactgcgtgcgcacctggcctcgtcgatgcccgtggaggtgctggacggggatgaggtgcgcacctggctgtcccgcgggctgggcttcacccgcgaggaccgcgaggagaacgtgcgccgcatcggtcatgtggcccggctgctggcgaagcacggggtgggcgtcatcgccgcggccatttcgccctatgcgagctcgcgcgccgaggtgcgccggctggccgaggaagcgggcatccccttcgtggaaatctatgtccaggcgcctctggacgtgctcatcgcccgggacgtgaaggggctctacaagaaggcgctggccggcgagctggcgcacttcaccggcgtgtcggacccctatgaggcgcctgacgcgcccgacgtcaccgtccactcggatgtggacaccgtggaggcgggcctgtggcgcgtcttggagacgctg

SEQ ID NO: 43147 - DNA, 1515 bp, Myxococcus xanthus
gtgctgggcatcgacctgggcacctcacatgcgcgcgtcgccgtcgtccaggacgggacacccaagctcattcccctccccggcaccaccaccacggaccttcccgcgctcatcgcggtgaacggaaccggcgacctcgtcgtcggcgccacggctcagacggaaggccaacgtgccccccgccgtgccatctccggtctcaagcggctgctgggtctgaagccgcgttctccgcaacttcgctggctcgccccgttgctccccttccccgtcaccacggacacgaatggggactccgccgtggaggtccgaggccgcgtcatctcacccattctcttcacggccatgctgcttcgcgagctgaagcatgccgccgcgacgcacctgggccgcaaggcaacccgcgccgtcatctgtgcccccacgcacttcaccgaccgccagtgcgcggcccttcgcgaagccgccacgctcgcggggctcgatgcccagcgcatcctcatcgcccccgcggcggcagcgctcgcgtatgcacatggccgagggctcgcgcgaaagcgggtgctcgtcgtggacctgggcggtggcggtctccaggtctgcgtggtgcaagtcacaggcgatgacctcgaggtcattaccaccggaggcgacgccaccctcggcggtatggacttcgatgcgcgcatcgccgaggccatcgccagcgacctctcggaacagggcgtgcccaagccggaccatcccttcgactgggcccccctgcgcaccgccgccgagtccacgaaggtggccctctccagccaggagcaggtggacgtcaccctcccctcgggaaccgtgccccccatcaaccgggagcgagtcgaagccctcaccgccgacctcgcccagcgcgtcaccaccgtggtccgcgacgtgctcgaatccaatgcgctctccccccaggggctggacgcggtgctgctcgtcggcgggcagagcgccgcgccgctggtccgccgccggctcgaagagagcctgggcgtgagcgtgcgcgacgacgtggacactcgaggcagcgtggccctgggcgccgcgctgctcggacaggggcttctgctggccgcggccggcaagcccgcggccactgtctccgaggtgctgtcctcgccgctcgccgtcgccgagcgcggtggcaccttgcgccgcgtcctcgaacggaacacccgcctgcccgccaccaagacgctggtgcttcccgccgtgccgggtccactcgagctggccctcttccagggggcagtcacgcaggcgtccgacgccgagtacctcggccggctcaccctcaacgtggagcgcgcgggtgaggtggaacttcacctcgccctctcagtcgatggagccctgtcgctcgaaaccaccctgcctggcatgaagcggcacgcggtgtctctggccacggagcacttggacgacgcgaccttcgacgcgctcatcgcccgctcgccgctggccgctgagccggagcgacgc

SEQ ID NO: 43148 - DNA, 639 bp, Myxococcus xanthus
ctgcttcgtgccgtcatcttcgacctcgatggaaccctggtggactcgctgggggacatcgccgatgcgacgaaccatgcgctggcccaccacggtctgcccacccatccggagtccgcgtacctgcgcttcgtgggcagcggtgtccgggagttgattcgccgggcggtgccttcagggcaggacgcgctcatcgagccggtgctggcctcctacaaggcctactacgacgaccacctcttcgaccgcaccgcgcactacccgggcatcccggagatgctgaccgcgctggccgcgcagggcacgaagctggcggtgctcagcaacaagtcagacgacttcgtgaagcgcctggtcgcgcgcctgctgccacaagcctccttcgccgccgtgtacggcgagcggccggagctgccgcgcaagccggacccgacggcggcgctggcgttggcctcggagctgggcgtaccacccgcggcctgcggcttcgtgggggacacgtccatcgacatggacacggcgcgcgcggcggggatgtacggcgtgggcgtggcctggggcttccgcgaggtggacgagctgaaggcccacggcgcgcgcgcggtggccgccaccgcggcggagttgctggcggcgctg

SEQ ID NO: 43149 - DNA, 738 bp, Myxococcus xanthus
cgggcgctctggcagattgagcagatggcgtccttctgtgcgcgctccggggatgccgcccgcatcaccacgaccggcgccatgctggaggacaacctcgcgcaggggcggctgtccgcggtgctgggcgtggaaggggggcacgccatcgaaggccaggtggcgcgcctgtcggagcttcaccagcgcggggtgcgcttcatgggcctcacccacctgtccaacaacgacctgggtggttcttcctttccgatgatgggcaaccggggcctcacaccgctgggccgggatgtcatggaggaaatggcccggctgggcatgagcgtggatgtggcgcatgcctcggagtccaccctcaaggacctcttcacccacccctcggtccggttcttctgctcgcacacgggcgtccgcgcggcgggcggcggctggcgcaacctctccgacgaatccctgcgcttcatcgcagaccggggcggggtggtgggcatcatcttcgcccccgtctatctgggcggtgacaccgtggatgacgtggtccggcacatcgagcatgccgtggacgtcatgggggagggcggggtggggctgggctccgactacgacggaatggtgccgcttccccgtggcatgaaggatgtcaccgggttgcctttgctcacagaggcgctgttgcgccgccatccaccgtcctgggtggaacgcgtcatgggtggaaacttccgtcgtttcttccag

SEQ ID NO: 43150 - DNA, 576 bp, Myxococcus xanthus
gtgagcagcgtcaatctgatggcccgtgaagtggccgcgaaaatcgttttctacggaccgggcctttccgggaagacgacctcgctgaggaagatctacgagactgtccgccccgcacaccgcggcgagatgatgtccatcgccacggagggggaccggacgctcttcttcgacttccttcccgtgaaggtggagcgcgtgggcgactgctccgtgcgactggcgctctacaccgtgccgggccaggtcttctacaacgccacccgcaagctggtgctccagggcgccgacggcgtggtcttcgtggcggactcgcagccggaggccatggacgccaaccgcgaatcactggccaacttggaggagaacctcttcgagcacggcatccgcctggaccgcttcccactggtgatgcagtggaacaagcgggacctggacggcgtgctgccggtggaggtgctccgcaaggagctcaacccccgaggcgtcccggagctggagacgtccgccgccaatggccgcggggtgctcgacacgctcaaggccatcacccggctggtcatcaaggacctgcgc

SEQ ID NO: 43151 - DNA, 537 bp, Myxococcus xanthus
gtcgtcttcgacatggacggcaccctcgtcgacaacatgcagttccacaacgaggcctgggtctcgttcgcccagaagctgggcttgccgctgaccgcgaacgacttccagagccgcttcgccggcaggaagaacgaggagatcatccccgagctgctcggccgcccggtggcccctgatgaagtggagcgcatcgccgaggagaaggagaaccactaccggaccctgtaccggccgcacctgaagctgcaccggggcgcggaggccttcatccagcgattgaaggaggcccacgtcccggcggccatcgccaccgcggcgccccagggcaaccgcgagctggtgctggacgggctcggcatccgtcccctcttcgcgagcatcgtcggtgccgaacaggtgacgcgcggcaagcccgccccggacatcttcctggccgccgccaaggcgctgggcgtggcccccaccgagtgcctcgccttcgaggacgccgtcctgggcatcatatccgcccgagaagccggcatgacggtggtg

SEQ ID NO: 43152 - DNA, 1635 bp, Myxococcus xanthus
ggaacgacctacaagcagtccggagtagacatcgaggccggcgacgcgttcgtcgagcgcatcaagccccatgccgcgcgcaccatgcgccctgaagtcatgggcggagtgggtggattcggcggcctgttcgccctgccaccaggcaagtaccagcagccagtgctggtggccggcacggacggcgtgggcaccaagctgaaggtggccttcgccgctggacgccatgggacggtgggcatcgacctggtggccatgtcggtgaacgacatcctcacctgcggcgccgagcccctcttcttcctcgactacttcgccaccgggcgcctggaggtcgacgacgccgccgaggtggtgaagggcatcgccctgggctgcgagcaggccgggtgcgccctgctgggcggcgagacggcggagatgccaggcttctacgcgcgcggcgaatacgacctcgcgggcttctgcgtgggcgtggtggagcgcgcggccatcatcgacggcaagagcgtgaagccgggtgacgcgctcatcgggctcccctcctctggcctgcacagcaacggctattcgctggcgcgcaaggtgctgctggacgacggaaagctggccctggacgcgacgcccgagggcctggaccggccgctcgtggacgcgctactggagcccacgcgcatctacgtgaaggacgtgctggcgctgctccaggcggtgaaggtgaagggcctggcgcacatcaccggcagcggcattccaggcaacctgccccgctgcctgccggacggcacgcgcgcggtgctgagtgagcagacttggcccaagccgcccatcttcgacctcatcgcgaagctggggagcgtggcccgcgacgagatgttcaacacgttcaacatgggcctggggctcatcctcgtcgtggcgaaggaagacgtcgcccaggcgctgagcgtgctgagcggccggggcgtgcaggccttcgaggtcggccgcgtggaagcgggccagggcgaggccacggcggtcatcgacccatgagcggccagcgagtccgcctgggcgtgctcgtgtccggcagcgggagcaacctccaggcgctgctggacgcctgtgcgcgggaggactttcccgccgaggtggcctgcgtggtgtccaacgtctccaccgcgttcgcgctggagcgggcgcgcaaggcggggcgtgacggccaaggtggtggaccacaaggcccacgcgacgaaggagggcttcgagaaggccctgctggacacgctgcgcgcggcgaacgtggagtgggtgtgccttgcggggttcatgcgcttgttgagcgcggacttcctgggccactacgcggggcgggtgctgaacatccacccgtcgctgctgcccgccttcccgggcctgcatgcgcagcgacaggcgctggagcgaggcgtgaaagtggccgggtgcacggtgcacttcgtggacgcgggcaccgacacggggcccatcatcgcgcaggtggccgtgccggtgctgccggatgacgacgagaaggccctgagttcgcgaatcctcgcggaggagcaccggctctacccgctggccgtgcggctcgccgtgacgggcaaggtgacgctggacgcggcccgcacg

SEQ ID NO: 43153 - DNA, 1212 bp, Myxococcus xanthus
ggcatcaagctggggttggagcgcgtgcaggaggccctggcagcgctgggccacccggagcggcggtatccggcgctccatgtcgccgggacgaacgggaagggcagcacctgtgccatgacggcggcgtcgctccatgccgccgggcaccgcgtggggctctacacgtctccgcatctggtgcgcgtcaacgagcgcatccgcgtggacagcgaggacatctccgacgcggacttcggcctgcgcatcctggaggtgttggagcgctaccccagcgccgtgtcctctcccatgacgtacttcgagttcggcaccgtcgtcgccctgtggcacttcgcccaggtgcgcgtggatgtggccgtgctggagacgggcctgggcggccggctggacgccaccaccgccgccagcccggtggtgacggcgattacccccgtgtccttcgaccacatggagtacctgggcgacacgctggcggccatcgcgggcgagaaggcgggcatcctcaagccgggcgtgccgtgtgtcgtcgcgcggcaggccccggaggccttggaagccatcctccgcaaggccgagcaagtcggggccccggtgcggctggagggacgtgacttcacgggcgagcgtcagcccgatggtggcctgtcgtaccgcggggcgacctggtccctggatgggctgtccgtcgcgctgcgggggccccatcagcggcagaacgcggcggtggcgctcgcctgcctggaggccttgcaggagcgcggcgtcaccgcgccgcccgaggccgcgcgtgcgggcctggcgtcggcgtgctggccggggcgtctggaggaggtggggcagcagcccatcctcttgctggacggcgcacacaacccggcgggcgtggaggtgctgctcgcgtcgctgaaggacctctacccggggcgtcgcctccacctcgtcttcggcgtggtgggggacaaggaccggggaccgatgatgcgagcgctgttgcccgagtgtgcctcggtgcagctcacgcctttggagacgcctcgctcactggctcccgaggcctacctggcagaggcgcgcgcgctgtgcgcggacgtgactgcctggccggatgcggacgcggcccttgccgcggcgcgcaagcgggcagccgcgaacgacctcgtcctttgtacaggttcactgttccttgtcgggatgatgaaggctcgcatg

SEQ ID NO: 43154 - DNA, 2036 bp, Myxococcus xanthus
cggacgctgcgcgccgccgagtccctcggcaaagacctgggccgtggcctcgcccgcatggaccccgccgacatgaagcggctgggggcgcatgtcggcgacatcgtcacgctgtccggcaagcgccgcagcgcggccaaggtgatgccctcctacccggacgcccgggggcgcggaatcctccagattgacggtgtgacccgggccaacaccggggtgcagttggacgaaccggtgaagctgaccctggcccccgcccgacacgccgagaaggtcgtgctggcgcccctggagttcacccccgcgcagcgtgacctggcctacatcggcacgctgctggacggactgccggtggtgaagggagaccgggtccgcgcgctgctgttcggcagccgcacggccgacttccgcgtcgtcgagaccactcctgtgggggcggtggtgattcaccccaacaccctgctggaggtcgccaaggcgccggagaaggagaaggtgacgcacgagcgggcgcgcgccgtcagctacgaggacgtgggtgggctgaagcgggagctgggccgcatccgcgagatcgtggagctgccgctgcggtatccggaggtgttcgagcggctcgggatcgacgcccccaagggggtgctgctgtatggcccgccgggctgcggcaagacgctgatcgcccgggcggtggcccacgagacggcggcggcgttcttcaccatcaccggcccggagatcatgcacaagttctacggagagagtgaggcccacctccggcagatcttcgacgaggcccagcgcagggccccggccatcatcttcgtggacgagatagacgccatcgctccccggcgcgagaacgtgcagggcgaggtggagaagcgggtggtggcgcagttgctgtcgctgatggacggcctggcccaacgccggcacgtcatcgtgctggctgccaccaacatccccaacgtgctggacccggcgctgcgtcgcccggggcggttcgaccgcgagatcgccatctccatcccccgaccgcacggcgcgcaaaggagatccttcgccatccaccagccgggggcatgccgctggcagaggacgtggacctggaccatctggcggccgtgacgcatggcttcgtaggcgcagacctccaggccctgtgccgcgaggcggcgatgctctgcctgcgccggctgattccccacatcgacttcgcctcggccgagattccctacgacgagctgatacaggtccaggtgacgatggccgacttccaggcggcgctgcacgaggtggggccatcggcgatccgcgaggtgttcgtggagaccccggacgtgggctggaaggacgtgggcggactggggcagctcaagcagcggctcatcgaggcggtggagtggccactccggtaccccgaggagttcgcgcgggccaaggtccgcccccccaagggcgtgctgctgagcggccctcctggctgcggcaagacgctgatggccaaggccgccgcccacgagagccaggtcaacttcatctcggtcaagggcccggcgctgctcagcaagttcgtgggggagtccgagaggggggtgcgcgagacctttcagaaggcccgtcaagcggccccctgcatcatcttcttcgatgagatcgactcgctcgtgccgacgcgctccgccgggggaatggacgagcgcgtcacagagagggtcgtcagccagttcctggccgagatggatggcatcgaggagctgaccggcgtgctggtgctcgcggccaccaaccgcgcggacctgctcgaccctgcgctgctgcgcccgggacgcttcgacctgctcgtcgatgtgccgctgccggaccgcgaagcgcggcgcgacatcttccaggtccacctgcgcgacaagccggtggagaaggacctcgacctgggcggactcgctgcacgcagcgagtccttctccggcgccgacatccaggccgtgtgcaatcaggccgcctgggaagccgtgcgtcacgtcatcagcggc

SEQ ID NO: 43155 - DNA, 1677 bp, Myxococcus xanthus
cagcgcttcctgctggccatggtgaagacgcacttcgacgcccaggggcagcctgaccgcgtcgtcggcgccctgcaggacgtgacggagcagcggagcgctgaacgggaacgcgagcggctggccaccattgtcgaacaatcccccgacttcatcggcgtgggagacccatccggccgggcggtgtgggtgaacgatgcggggcggcgtctgctgggcctgggactggatgaggacatcacccggtaccacctgcgggacttcttcctggccgaagaccagacctacgtcgacgaacacatcgccgccgccatcctccagggcggccggcgggagggagcgttccgcttccggcacttcccgacgggcgagcccatcgcggcgcagtaccacaccttcgccctggtagagcacgacacccagcggcagatgggcatcgccaccgtcggccgcgacatccgcgcccagaagcggctggaagcggagcgggagcggttgctcgcccgggagcgcgtggcgcgcgaggaggcggaggaggccaaccggctcaaggacgagttcctcgccaccgtctcccatgagctgcgcacgccgctcacggcggtgcttggctgggtgcagatgctgcggaccggcacgctgccgccagagaagcgggagcgggcgctggccaccgtggagcgcaatgcccgcgcccaggggcagctcgtcgaggacctgctcgacgtgagccgcatcatgacgggcaagctgaagctggacgtgtcgtccgtcgacgtgagccaggtcgtggaggccgtgctcgagtcactgcggccggccgccgaggcgaagggcatccgcatccaggccgcgctcgattcgggcggcaccatcatgggcgacgtgagccgcctgcagcaggtggtgtggaacctgctgtccaacgccgtgaaattcacccccaagggaggccgcgtccaggtgctggtggagcggcggaactcctcggtggaaatcacggtggccgacacgggccagggcatctccccgcagttcctgccgcacgtgttcgagcgcttccgacaggccgacggcagcaccacgcgcaaggccggtgggctcgggctgggactggccatcgtccggcacctggtggagttgcacggcggcaccgtgatggccaccagcgagggcgagggccggggggccaccttcatcgtcagcctgccgcaggccgtggcgctgaggcgggaggtgctggtgccccccaccctccgcggcccgttgcaggagcaggacatcccctgcccgccccagctcgcgagcctgcgggtgctcgtggtggacgacgaggaggacacgcgtgagctgcttcgcagcatcatcgaggcgtgtggcggcatcgtcaccacggccagttcttcggaggacgcgctggccgagctccgcgaggcctcgttcgatgtgctcgtctccgacgtcggcatgcccgaggaggacgggtaccgcttcattgcccgcgtccgggccctgcccgaggaacagggtggcggcatccccgcggtggccctcacggcctacacccgcatggaggaccggacgcgcgcgctgctcgcgggcttcaccacccacgtgcccaaacccatcgaaccggtggagctgatggccgtcatcgcctccatgtccaaccggggc

SEQ ID NO: 43156 - DNA, 1038 bp, Myxococcus xanthus
aaccctcttgggctgaatggcttcgagttcgtggagttcaccagcccccagcccgaggtgatggagcacctcttcgagcggctggggttcaccgcgtactccaagcacccgtccaaggagctggtccgctacaagcagggcggcatcaacctgctcatcaaccgcgaggcttccgggcaggccgctgagttccgcgcggagcacggcccgtccgccagcggcatggccttccgcgtggcgaacgcgcgcaccgcctacgagatggccctggagcgtggcgccaaggcggcggacccggagcggggctcgctgggcgagggctcctatgtcctggagggaatcggtggcagcctgctgtatctggtggaccgccacggggagaaggggacgctctatgactcctggcaggagattcctggcgccgaggcggccgaggcgaagaacagcgtgggcctggagacgctggaccacctgacccacaacgtgcgccgcgggcagatgcgcacctggtcgtccttctacaaccgcatcttcggcttcaccgagcagaagtacttcgacatcaagggccaggccacgggcctgttcagccaggcgatgatcgccccggacaaggccatccggattccgctcaacgagagccaggacgacaagtcgcagattgaagagttcatccgccagtacaagggcgagggcatccagcacctggcgctcaccacgccggacatctacgacaccgtggagcggctgcgcgcgcgcggcgtggtgctgcaggacacgctggaaacctactacgacctggtcgacaagcgcgtccccaagcacggcgaggacctggcgcggatgcgcaagaaccgcatcctcatcgacggcagcgaggaagagggcctgctgctccagatctttaccgagaatctcttcgggcccatcttcttcgaaatcatccagcgcaagggcaacgagggtttcgggaacggcaacttccaggcgctcttcgagtccatcgaactggaccagattcgccgcggcgtcatcaag

SEQ ID NO: 43157 - DNA, 1306 bp, Myxococcus xanthus
gggagcgtcctcaagacggctcccggcgcctatctgtctggctttggcaacgagttcgccaccgaggcggtgcccggcgcactgcccgagggacagaactcaccccagcgggcgccgttcggcctctatgccgagcagttgtcgggctcggccttcacggccccgcgccgggagaaccggcgctcgtggctgtaccgcctgcggcccagcgccaaccaccctgcgttccagccgctggcgcagggactcttgcgcagcgggcccttcgacgaggtgcccgcctcgcccaaccggctgcggtggagtccccagcccccgccggcccagcccactgatttcgtggacgggctcgtcacctacgcgggcaacggggacgcggcgtcaggggcgggcatcagcatccacctgtacgcggccaaccgctccatggtggaccgggtgttcttcgacgcggacggtgagctgctcatcgtcccgcaggcggggcggctgcggctggtgacggagctgggcgtgctggacgtggcgccgggcgaaatcgcggtggtgccgcgcggggttcgcttccgcgcggagctgccggagggccaggccgccggctacgtctgtgagaaccacggtgcgttcttccggctgccggacctggggcccattggggccaatggactggccaacccgcgcgacttcctgacgccggtggcggccttcgaggacgtggaccggcccacggaggtggtgcagaagttcctgggcaatgctgtggtcggcgcggtattcgtactcaccgctggacgtggtggcgtggcacgggaacctggtgccgtacaagtacgacctggcccgcttcaacaccatcaacacggtgagcttcgaccatccggacccgtccatcttcacggtcctcacgtcgcccagcgaggtgccgggcacggccaactgcgacttcgtcatcttcccgccgcggtggatggtggccgagcacaccttccggccgccctggttccaccgcaacgtgatgagcgagttcatggggctggtgcacggcgtctacgacgcgaaggcgggcggcttcgccccgggcggcggctcgctgcacaactgcatgagcggccatggcccggaccggaccagctacgagcaggccatccaggcggacctgaagcctcacaaaatcaaggacacgctggccttcatgttcgagtcgcgctgggtcatccgtcccacgcgcttcgccatggagacgcccgcgctccagcaggactacgacgcgtgctgggcgggcttccagaaggcgaagttgccttga

SEQ ID NO: 43158 - DNA, 1327 bp, Myxococcus xanthus
  unsure (1)..(1327): unsure at all n locations
atgacattcgcttcgctcggcctgtcggacgcgctcacccgcgccgtggccggactcggatacgacgaacccacgccggtgcagcgcgcgaccatccccgtggtcctgcgaggtggcgacgtctgggcttcggcgaagacgggctcagggaagaccgccgcgttcctgctgcccatcctggaagccctgcgggcacgtcccggagggtcggtccgaccggtgcgggccttcatcctggtgcccacgcgggaactcgccgcgcagatcgtcgattcaatccagcggtacggccaacacctgaagaagccgctgaagacctgcctcgcgagtcggtggcgtctccgccaacccgcagatgctggcgctgcggggcggcgcggacatcgtcgtgnccacgcccgcccgcgcgctggacctggtgcatcaaaacgcgctccggctggaccaggtggagacgctggtgctcgacgaggccgaccgtctgttctcgttgggcttcgccgatgagctcaacagcctgctggcgctgctgcccacgcgccgccagaacctgttgttttccgccaccttcccgcccgcggtgcggaagttcgcggagcagttgctgcacgagcccacgcgcatcgacgtcgatgacggggagctgccctcgacggagttcatcctccagcgagccctccaggtggatgtgccccggcgcacgatgctgctgcggcacctgttggaaacacatgcgtggagccatgtgctcacgttcgtggccagtcgctacacggcggaccatgtcgccctgaagctgaaccgcgccggcatcgtcgcgacgtcattgcatggggaactcagccagggcgcgcgcacgcgggcgctcgcggacttcaaggcgaagcgcgtgcgcgtgctcgtggccacggacgtcgccgctcgcggcctggacatcgcgcagctgccggcggtcgtgaactacgacctgccccgttcgaccgcggactacgtgcatcgcatcggccgcacggggcgcgcgggcgacaagggcgtggcgatcagcttcgtcagcgcgggcaccgaagcccacttccgactcatcgagaaacgccaccagctcgacctcccgcgcgagcaggtgccgggcttcgagccgacggaagaggtctcgacgaccacgccgccccgggatccaaacggcggagtgaagggtcggcgcaagagcaagaaggacaagctgcgcgaagccgccgctgccgccgccactcgccctccgaagcaagggccgtagcggctcctgctcccgcgtgtccagcaaggccacgtgcgatttcgcggccgtcaa

SEQ ID NO: 43159 - DNA, 1812 bp, Myxococcus xanthus
aagtacacactgctcgtggttggctccgggctggcgggggcttcggccgcggcgacgctcgccgagcttggctaccgtgtgcactgcttctcctttcacgactcgccgaggcgcgcgcacagcatcgccgcgcagggcggcatcaatgccgcgaagaactaccgcaacgacggcgacagcgtgtggaggctgttctacgacacgctgaaaggcggcgacttccgctcccgcgaggcgaatgtctacaggcttgcccaggtgagcaaccgcatcatcgaccaatgcgtggcccagggagtccctttcgcccgcgaatatggagggctcctcgccacacgctctttcgggggcgcgctcgtctcgcgcaccttctatgcgcgtggacagactgggcagcaacttctcctcggcgcctaccaggcgctcgagcggcaaatcagcgcgggccaggttcgcatgcatccgaggaccgaaatgctcgatctcgtcatggtcgacggacgggcgcggggaatcatcgcgcgcgacctccggacgggcgagctgagggcgttcgccggcgatgctgtgatcctcgcgacaggaggctacggcaacatctaccatctctcgaccaacgcgcgaggctcgaacgcgaccgcgatctggcgcgcgtaccgaaggggcgccggcttcgccaacccttgcttcacgcagatccatccgacctgcatccccgtcagcgggcctcatcagtcgaagctcaccctgatgagcgagtccttgcgcaatgacgggcgtgtctgggtgccgaagctcaagggggaccagcggacaccgcgcgatatcccggagagcgaacgggactacttcctcgagcggcggtacccaacctacggcaacctcgcgccgcgtgacatcgcctcgcgctcggccaaggaaatctgtgaccagggcaggggcgttggccccggcgggcgcggcgtgtatctggacctcggtgatgccattgagcgtctcggggccggtaccattcgcgaacgttacgggaacgtcctcgagatgtacgagcgcatcacgggcgagcacccgtaccgggcgccgatgcggatctaccccgccgtccactacaccatgggcgggctctgggtggactacgacctgcgcagcaccctgccgggcctctacgtgctcggcgaggcgaacttctccgaccacggcgcgaaccgcctcggcgcgagcgccctcatgcaggggctcgccgatggctacttcatcgtcccgaacaccatcgcggccgagctggcgcgtttcgggccagggtcggtcgaccttgaccatcccgcgtttcgagacgccgagcgcatcgtgcaggcaaagctcgagcgcctgctcgcctcgcgaggcacgcgaaccgtcgaggaccacttccgcgcgctgggtagcctcctctgggaacaatgcggcatggcgcgcagcgagcgcgggctgtcctccgcgctcgagagcatccaggcgcttcagggcgacttcgagcgagatctccggctgccggacaccggcatcgagctgaacgactcgctcgagcgagcagggcggctcgccgattactacgagctcgcggagctgatgtgccgcgacgcgctcgagcggcgcgaatcgtgcggagcgcacttccgcgaggagtttcaaacggcggaaggtgaggcgcgccgagatgacgagcacttctgccatgtgtcggtatgggaataccgcggccaggatcgacctcccgcgctccacaaggagccactctccttcgagtcggtcgcggcggagaccaggagctac

SEQ ID NO: 43160 - DNA, 1823 bp, Myxococcus xanthus
gggcccgtcatcggcattgacctgggcaccacgaactcgtgcgtggcgttgctttccaacggccggccgctcgtgctgcgctcgcgcgagggctacaacacgattccctccgtcatctcgctcaacgcgcagaacaagctgctggtcagccaccgcgcgaagaaccagttggtgctgcgtccccagcacaccatctacggcgcgaagcggctcgttggccgtccctacgacagcgccgtggtgaaccaggtccgcgagcgcttccactacgacatcgtccctgactccgctggccgcgccgccgtgcgtctggcggacacggccctgtcgctggaagaggtgcaggccctcatcctccgcgagtgcaaggagatggcggaggcccacctcaaccagaaggtggagcgcgcggtggtgacggtgcccgcgtactactccgagccacagcgtgaggctgtgcgcaagtccggcatcctcgcgggcctcaaggtggagcgcatcctcaacgagcccacatccgcggcgctcgcctacggtctcaaccgcgagctcaacaagaaggtcctcgtctacgacctgggcggcggtaccttcgacgccacgattctgaaaatcgagaagaacgtcttcgaggtgctcggcaccggaggcgacgtcttcctgggggggatcgacttcgacaacctcatcgtcgactacctgctggcgcgcttccaggagaaggagggcatcgccttcacgggggacggcatcgccttgtcgcgcgtgagtgacgcggccgagcgcgcgaagatggggctgtccgagcgcagcaccttcgaggtccacatccccatgctgatgatggacgactcgggcaggccgcgtgacttgcgcgtggtcctcagccggcaggagctggagaagatctgcgagccgctcctcagccgcaccatcgacgtggtgcgcgacgtgctcctggacgcgaagctgaaggccgccgaggtggacgacatcatcctcgtgggcggcatgagccgcatgccgctggtgcgcgacaagctcaaggggctcttcggcaagggcgcgcaggccagcgtcaacgcggacgaagccgtggccctgggcgcggcgctctactcgggctccgtggacaaggtgagcagcgtggtgctcatcgacgtgctgccgatgacggtgggcgtggccatgcccggtggcgccttcaagcgcgtcatcgagcgcaacagcccgctgcccgcgcagcgctccttcgccatcaacacgacgaaggacaacgaggtcttcctggagctgtccatcttccagggcgaggacagccacatctccgccaacgagtacctgggcaccgtgcgcatcgaaggactgcccaaggggccgaagggctcggtgcgcgtggcggtgacgctcaagctggactccgaatgcgtgctgcacgtggaggcgcgtgagtactccacgcgcaaggaagtgaaggccacgctggccacgcgctactcgccggaggagctccagaagcagctccaggtcagcaaggagtccgtgaaggccgccgaggagcgccgcggcgccgacctcaaggagcgcgcgggcggcttctggagcttcgtgaagaaggcgctgggcaggaagtagcgtgtcgccatgacggccaccgcaccccggtacatgacgcgcttcaggtgcctcgcggatgcctgcgaggacacctgctgcgcggggctcgtcgtcctcgtcagcgagccgcgcttgcagcgcctgaagcaagcggtggcgggcacgccggacgcggagcgggtggagaccttcatccggctggagcc

SEQ ID NO: 43161 - DNA, 960 bp, Myxococcus xanthus
tatcccatccaccgaccccgccgcctgcgccgcaacgccgtcctgcgtgacatggtgcgcgagacgcgcctcgacccgggcgacttcatctaccccctcttcgtcgtggaaggccgggacgtgcgccgtcccatcgtctccatgccggggatcttcaacctgtcgctggagcacgtcgtcgccgaggccaggcacgcccggaagctgggcgtgcccgccgtcctcctgttcggcatccccaaccacaaggacgcccgcggcacccaggcctacgccgacgacggcatcgtccagcgcgccattcaggagatcaaggcggccgagccggacctccaggtcatcgtcgacgtctgcctgtgcgagttcaccgaccacggccactgcggcgtgttggaaggcggccacgtcgtcaatgacgccacgctggcgctgctggcgaagatgtccgtgagctgcgccaaggcgggcgcggacatcatcgctccgtcggacatgatggatggccgcgtggccgccatccgcgccgccctggacgagacgggcttcggcgagctgcccatcatggcgtactcggccaagttcgcgtccggctactacgggccgttccgcgaggccgcccagaacacgcccacctccggtgaccgccggggctaccagatggaccccggcaacgtccgcgaggccctcaaggaagtggccctggacgtggaggagggcgcggacatgatcatggtcaagcccgcgctggcctacctggacgtcatccgcgccgtgcgcgagcgctgggagctgcccgtcgtctcctacaacgtgtccggcgagtactcgatgctcaaggccgccgggcagaacgggtggattgactacgagcgggtgatgctggagacgctcacgtccatgaagcgcgccggctccgacctcatcatcacctaccacgccctggaggcggcgaagctcctg

SEQ ID NO: 43162 - DNA, 1983 bp, Myxococcus xanthus
atgggcacgagcttcaccccggacgagcagacgctcttcttcctgcgcaatccggagggctcacgcgccctcgcgctccacgcgttcgacgtggccacgggacagacgcgcgagcacctcaccgcggagcgccttctgcagcgtgcccgggagaacctcgccgtcgagccgaaggcgcgccaggagcccgcgcgtgtgtcctcgcggggcctgagctcctatgccctgtccgaggacggcgagaagttgctcgtgggcttgtccggcaagcagtacatcgtcacgcgcgcgtccgggaaggtgacggagctgaagacgggccccggcgccatggacgtgcgcttctctcccgatgccacccaggtggcctatgtgcgggggcatgacgtgtatcgcctggacctggccacgaacatcgagcaccaggtgacgaagggcggcacggaggagaagagccacgggctggcggagttcatcgccacgagcgagatgatgcgcttctccggctactggtggagcccggacggaaaggccctggcctacacggagtccgacacgagcggcgtggagaagctcgccatcgcggacgcgctccacccggagaacgatgcgcggcggctcgccttcccgcgcgccggcaaggccaacgcccgggtgcgcctgggtatcatccccatcacaggcggcaagacgacgtgggtgcgctgggacgtggagaagtatccctacctcgccacggtgcgctggccggcgaagggccctctgacggtgctggtgcagaaccggctccagacggaggagctcctgctcgcggtggacccgaggacggggagcacgcgcacgctgctcgtggagagggacgacgcttggctcacgctgcaccagacgttcccccactggctggaggatggaagcggcttcctctggtacacagagcgcaacggcgctggcgaagtggagctgcgcgacgcctcgggcaagttcgtgcgctcgctcgtgccgcccggcgcgggcttctatgacatggcgggctacgttgagaaggacggcaccgtctacttcaccggcggcccaacctccgacgagcgctacgtgtggcgcctgagcccgggcgggaggcccacccgcgtcacctcggagagcccggcgctggagctggcccggatgtccaagcggggcggcttgctggccatcacgtccgagggcccccggcgcatgcgtcacaccactgtgatgaaggcggacggcactcgcgtgggcgagctgccctcggtggcaatggagccgccgttccagccgcgagtggaggtgcggtacgtgggcaaggagcgctaccccacgtcgctggtgcgtcctcgcgacgcgaagcccggcgtgaagctgcccgtcatcgtggacatctacgcggggcccggcatccccatggtgtaccagagcatgcagcagcacctcaccaaccagtggctcgcggacgagggcttcatcgtggtgaaactggacgggcgaggagtttcgcccaccgccgacgcgaagctgcgcaagccgaagtacgactggccccggctgctgctggacgagcaggtggccgcgctgcgcgcgctcgcggccgaggtgccggaaatggacctgagccgcgtgggcatcactggcgcgagcaacggcggctacatgtccgcgctggccgtgctcacccgcccggacgtcttcaaggccgcggtggccgtgtcctcagtgacggactggcgcgactacgactcacacctgacggagcgcttcttcggcctacccgacgagcacccccaggcctacgagcaggcctcgctccttactcacgtgaaggccgaccagcccatgggaaagctcctgttcatccatggcactgcggacgacaacgtcctcttcttccacgccctcaagctttcggacgcgctgtttcgggcgggccagccccacgagttcctgcccctcagcggcatgccgcac

SEQ ID NO: 43163 - DNA, 2307 bp, Myxococcus xanthus
ctcctcgaagacctcaatgcgccgcagcgcgaggccgtgttgcatggtgacggccccctgctcgtcctgtcaggggcgggcagcggcaagacgcgcgtcatcacccggcgcgtggcgtatctggtgaaggtccacaacgtctacccgtggcgcatcctggccgtcaccttcaccaacaaggcggcgcgggagatgcgcgagcgcctggtgcagttgctgggggcccaggcgaacgagctggtggtgagcaccttccactcggcggcggcgcagattctccgccgagaggcggagcacgtggggctcacccgctccttcgtcatctacgacgactcggaccagctcaacgtggtgaagcgcgccatgcgcgaggcgggcatcgagtccatgcagccgcgcgaaatcctccaccgcatcgaccaggagaagaacgcggcccggctcccggagcacatgcaggtcgcgcccggcgacgagcggggccaactggtgcgcaaggtgtacgcggcctaccaggagcggctgcgcgcggccaacgcggtggacttcggagacctgctgctcctgctggtgacgctgttccgcacccggccggacgtgctggagaactatcggcgccgcttccaccacgtgctggtggatgagttccaggacaccaacccggtgcagtacgcgctgctgaagcaactggcgccgcccccttccgccaacctggtggtggtgggcgacgacgaccagtccatctaccggtggcgtggcgcggacgtggacaacatcctcggctttccgcggcagtaccccggcgcgaaggtggtcaagctggagcagaactaccgctccgaccagaacatcctggacgcggcgcatgaggtcatccggaagaacacgcggcgcatggagaagaagctctggtccgagcgccagcggggccagacgctcaacctgatgctcaaccgcgatgagcgggccgaggggcaggaggtggcgcggcagattctggcgctgcagcgggagggcttcatcaagctctccagcatggcggtgttctaccgggccaatgcgcagagccgcgtgttggaagaggcgctgcgtctggcgcgcgtcccgtacaccctggtgagcggacgcagcttctatgaccgggcggaagtgcgggatgcctccgcgtatctgcggctgatggtgaacccgcgctcggacgcggacctgctgcgcatcatcaacatcccggcgcgtggcattggcgacaccacggtggagcgggtgacggacttcgccaacgcgcgcggcgtgagcctctacgaggtcttgtcccagccggagcagattcccgcgctcaatggtgccgcggtgaagcggctcaagggcttccgcaacctgctggagtccctgacggccttcgcccagacgaacgaggaagccgcgggcgcggtggaccagatgcttcgcgagacgaagctggtggagacgcttcaggccgagggcagcgacgagtctcagacgcgcgcggagaacctccgcgagttcctgggcgcggcgcaggagttcgacctgaaccgggcggccgcggcggtggcggccgcggcgaatccccccagcgacgttcctcccgaagtggacgcggccccgctgacggcggacgtgccggcgctgcaggccttcctggagcagatttcgctggtgggcgaggcggacgcggaggtgggcgacggccgggtggcgctgatgacgctgcacgcggccaagggcctggagttcgacgccgtcttcctcaccggcatggaggagaacgtcttcccgcactcgcgcgcggtgaagtccgagtccacgttcctgaacgaggtcgcctcggcggatggggagccctcggaggagatggccgaggagcggcgcctctgctacgtgggtttcacgcgcgcgcgaaagcggctcttcgtgagtctggcccagtgtcgctcgctgttcggtgagctgcgctacaacgcgcccagccgcttcctgcgggatgtgccgccggcgctgttcggcatcagcgagcaggaagtccccgaagcgcctcggcccatggtgccctccacgcagcgcaggcggacctgggacgaggatgacgggccgcgcatcgaccgctcgtactcgcaggcgtcgtcggacatggacggcgtgggcggggacgtgcgcggcatgcgcgtgcgccacgagcagttcggcgtgggccgcgtggtgtccgcggacggcaacggccccaacgcgaaggtgacggtggagttcggtggaggcgtgggcctcaaacgcatcatcgcccgtttc

SEQ ID NO: 43164 - DNA, 762 bp, Myxococcus xanthus
gacctggaactgggtggcaaggtggtactggtgacgggtggctcggaggggctgggcgccgcggtggcccggcggctcgtccgggagggcgcgaaggtggcgctctgtgcccgtggggcggagcggctggaagccaccgccgcggccctgcgcgccgagggtggggacgtgctcaccgtccaggccgacgtgtcgcgtgcgtgggaggtggagcacttcgtggatgccgcccacgcgcgcttcgggcgcatcgacgggctggtgaacaacgcgggcaccgcggcgggccggcccttcgcctcggtgagtgacgcggagtgggaggccgacctccagctcaaggtcttcgcggcgattcgtgcctcgcggcaggcgctgcccttcctgaaggagtcggggagcggcgccatcgtcaacgtgctggccatcgcggcgaagacgcccggcgcaaactccacgccgtcgtcggtgtctcgcgcggcggggctcgccttgacgaaggcgctgtccaaggagttgggcccgcacgccatccgggtgaacgcggtgctggtgggcatcatcgaaagtggccagtgggcgcgccgtgccaaggaggtgggtaagcccatggagtccttcctgcaggagatggcgcgtcacgccgggattccgctgggccgggtggggaaggcggaggagttcgccgataccgtggccttcctgctgtcgccccgtggtggctacatcagcggcgcggccatcaatgtggatggcggcctg

SEQ ID NO: 43165 - DNA, 969 bp, Myxococcus xanthus
acgatcatcaatggcgatggcattggccccgaagtcatggcggccaccgttcgcgtcctcgaggcgctcaaggtcccccttgatttcgagtacaaggacgcaggcacggaggtggtggccaagtacggcaccaacctgcctcacgagacggtggaggcggtgctgcgcagcggcatcgcgctcaagggccccacgggcacggtggtgggcggtggcctcccgtcggccaacgtgggcctgcgcaagcggctggacctgtactcgtcgctgcggcccgtgaagagcgtaccgaacgtgaagacgcgctacgagggcgtggacctcgtcgtggtgcgtgagaacacggagagtctctacgccggcctggagcacatcatcgtcccgggcgtggtggagtcgctgaagatcatcaccgagaaggcctccacgcggattgcccgcttcgccttcgagtacgcccgcaagcacggccgcaagaaggtcaccgccgtgcacaaggcgaacatcatgaagctgtcggacggtctcttcctggactgctgccgcaaggtgggccgtgagttcccggacgtcacctacgaggaagtcatcatcgacaacctcgccatgcagctcgtgaaggacccgacgcgcttcgacgtgctggtggcggagaacttctacggcgacgtgctcagcgacctgtgcgcgggcctggtcggcggcctgggcgtggtgccgggcgccaacatcggcgagcgcaccgccgtcttcgaggccgtgcacggcaccgccccggacatcgcgggcaagggcatcgcgaaccccaccgccctgatgatgtccgcggtgatgatgctggaccacctggagctgggcgaggcggcgcgccgcatggagaacgccatctggaaggtgtacggctcgggcgaggtccgcaccggtgacctcggtggcaaggccaccacccgcgagttcaccgacgccatc

SEQ ID NO: 43166 - DNA, 573 bp, Myxococcus xanthus
atcgacaagagcatcctgattacgggcgcgagccggggactggggcttgcgctgatgaatggattggctcgccgaggcgcgcgggtggtgggcgtggcgcgtcatgccgcggagatgggggccgtcgcggaggcgctgcgctgggaggggttggaggcgcacgcgctggcctgcgacgtgggggacaaggaggccatctacccgatggtgggcgcggccaccgcgctggtgggcccgctggacgtgctggtccacaacgcgagcacgctggggcccacaccgctgccgctgctgctggacaccgcctgcgaggacctgcagcgcgtgctggaggtcaacgtggtgggccccttccgcctcaccaaggcggtggccgggaacatgtcggtgcgaggcaaggggctggtcatgcacatcacctcggatgcggcggtgtccgcctatccccgctggggcgcatacggcgtgtccaaggccgcgctggaacacctggggcgcgtctgggccgcggagctggagggcacgggcgtgcgcttcgtctcggtggaccccggggagatggacacgcggatg

SEQ ID NO: 43167 - DNA, 1069 bp, Myxococcus xanthus
ggtgcctaccgcgtactcggagagctgggacgtggtggcatggccctggtgtaccgaggcctgcacgagatgttgcagcgcgaagtcgccatcaaggaactgctcccggatggccagcgcgacagggagacgttgtcgcgtttccggcgcgaggcgctcgcgctcgcggccttccgtcaccagaacatcgtgacgctctacgacatggtggagaagggtgagagcctcttcatggtgatggagctggtggacggccccaccctccacacgctcatcaaggaaggcccgctgcccgcggatgtcaccggcgtcatcgccgcgcgcatcgccagcgcgctggaccacgcgcacttccgccacatcatccaccgcgacctcaagcccgccaacgtcatgctcaccaagtccggtgaggtgaagttgatggacttcggcatcgccaaggacgtgggcatggaggcgctcacccagcagggcatggcggtgggaacgccgtcgtacatgtccccggagcaggtgacgggcgtgccggtggatggccgcaccgacatcttctcgctcggcgtgctgctctacgaagccctctccggcgcgcggcccttccacggcaagacggcgggcgaggtcttcgcgaagattcgcgacggcaagtacacgccgctctccaaggtggcgcccaacgtccccgcgccgctggtgcgcatcatccagcgcgccatggaggtgaagccggaggaccgcttccccgacgccgccgccatgcgccgtgaactggacgtcttcctcgcgcaggaggtgcaggtgtcccacgcggcgctgctggtggccttcctgcgccaccgtcagaagctgacggagacggaggcccagcagctcatgcggccgcacgaactggacgccgcggtggaggtgttcgacacggggcgctcccgccagggcgggaagctgcggtgggccctggccgccgccatcgcgttgatgacggcggcgggcaccgggctctacttcacccaggcccagtgggcgccgctggtggagcagctcacccgctgaggccggcgggtggctc

SEQ ID NO: 43168 - DNA, 1182 bp, Myxococcus xanthus
tccaccgacgccctggtccagaaggcgaagcgccacctgctgcagaactacaagcagccgcccttcgtcctggctcggggccagggggctcgtgtctgggacatggatggccgcgagtacctggacctgattggcggcatcgccacgtgcgcgctgggacactgccacccggaagtcgtggctgccgcgaaggcgcaactggattcactgtggcacgtctccaacgtgttctattcgcagccccagattgacctggccgcgcagctcaccgagtggtccggcctgtcacgcgcgttcttctgcaactcgggcgcggaggcgaacgaggcgctgctcaagctgacgcgcaaggtgatgaaggaccgcggcacgccggagcgcttcgaggtcatctccttcgacagcagcttccacggccgcaccctggccaccgtcaccgccaccggccaggcgaagtaccagaagggcttcgagccgctgcccgccggcttcacccacgtgccctacggcgacctcgaagcggtgcgcaaggccgtgggcccggcgaccgccgccatcctcgtggagcccatccaaggggagggcggggtgcgcatggcgcccctgggtttcctcgtcggtctgcgcgcgctgtgtgacgagcacgggctgctgctgctggtggacgaagtccagacgggcatgggccgcactggcaagccgttcggcttcatgcacgagggcatcgtcccggacggcatcagtgtggcgaaggcgctgggcaacggcctgccgattggcgccatgctctgcaaggaagagctgggcgccagcctcacgccgggcacgcacggctccacctttggtggcaacccggtggctgcggccgccgccaatgccgtggtgcgcatcctccgccgtcccggtttcctggacgaggtccaggagaagggcgcctatctgctcgcccgggcgcgtgaactccagggccggctgcctgcgggtcgcatccaggccgtgcgcggccaggggctgctggtgggcgtgcagttggatcacaaggtggcgcccgtcatcgcccaagtgcacgaagagggtctgctggtgaatcccgcaggcgaccgcacaatgcttttcgctccgcccttcatagtcacggtgcgtgagttggattaaggtctgtccattcttgagcgcgtgctc

SEQ ID NO: 43169 - DNA, 1986 bp, Myxococcus xanthus
agttcccgcgcgattcctgtgatcgtccgttgttcacgggagtccaccccatctaccccagggagcctcgagacgccgatgcccgtaaacgcccctccccaccgctggaccctcgccgacgcgcatgagctgtacggaatccggaactggggcaacccctacttcggcatcaatgagaagggccatgtcatcgtccacccggacggtccccaggccccgaacatggacctgaaggagctggtcgacgaagtgcgccgccggggcatcggcctgccgctgctcatccgcttcacggacgtgctgcgccaccgcgtggtccacctgaacgaagccttccgtaaggccatgagcgatcaggggttcaagggcggctaccgcggcgtgtaccccatcaaggtgaaccagcaccgctacgtggtggagaccctcatcgaggcgggcaagggctacaactacgggctggaggccggcagcaagccggagctgctcgcggtgatggcgctgttggagaacgagaacgcgctcgtcatctgcaacggctacaaggacgaggagtacatcgagacggcgctcttctactcgcgcctgggccgcaacgtcatcctggtggtggagaagcccagcgagctgccgctcatcgcggaggtcgcccggcgcacgggcatcgccccccggctgggcattcgcgtgaagctgtccacgcgcggcgccggcaagtgggaggccagcggcggcgaccgctccaagttcggcctgacctcctccgagctgatgaactgcatcggcttcatgaaggacgcgggcctgctcaactccttcgagctgctgcacttccacctgggcagccagatttccaacatccgcaacgtgaagaacgcgctgcgtgaggtgggctgcttctacgtggaggtggcccgtcagggcgcgccgctgaagtacctggacgtgggcggcggcctgggcgtggactacgacggctcccagacgaacttcgcctcttccatgaactacaccacggaggagtacgccaacgacgtggtgttcggcgtcatggaggcctgcgaccgggccggcgtaccgcaccccacgctggtgtcggagtccggccgcgccgtggtggcgcaccacgcggtgctggtggtggacgtgctgggcaccagtgagttcggcccggcgccggtccccgacaaggtggacgagaaggccccctccgtggtgcgcaacctctggtccacctaccgcgaggtcaccaacaagaacctgctggaggcgtggcacgacgcgcaggacgccaaggaggagagcctcaccctcttctcgctgggccacctgtcgctggagcagcgcgtggcggcggagaacatctactgggccacctgccacaagatcatgcgcatcgcgcgtgagcagggcgagattcccgaggagctggactccctggagaaggcgctcaacgacacgtacttctgcaacttctccgtgttccagtcgctgccggactcgtgggccatcgaccagctcttcccgatgatgcccatccaccggctggcggagaagccgacccgccgcgcgacgctggcggacatcacctgcgactcggacgggaagatcgagcacttcatcgacaagcgcgaggtgaaggacgcccttgagctgcacgcgctcaacgatgacgactactacctgggcatcttcatggtgggcgcctaccaggagatcctcggcgacctccacaacctgttcggcgatacgcacgccgtgcaggtgtcgctggggcccaacgggggctacctcatcgacaatgtggtggccggcgacacggtaacggaggtgctcaactacgtcagctacaccaaggacgacctggtggcgaagctgcgcaagttcactgaggccgcgctgcgccagggccgcatcaccctggacgaatcgcgcaacctgctgcgcatgtacgaggatggcctgtccggctacacgtacctggag

SEQ ID NO: 43170 - DNA, 855 bp, Myxococcus xanthus
gcgcggaccctcgatggaaccgaaatcagccgggtgatgcgggcggagatggcccaggacgtcgcggcgctccaggccgccggcgtgacccccgggctctccgtggtgctggtgggcaacaatccggcgagccaggcgtacgtcgcgagcaagacacgagcgtgcgagtccctggggatgcgcggccagacgctgacgttgcccgaggacgtgtcgaaggaggcgctgttcgccgtcatcgaccggctgaacgccgacccgtccgtgcacggcatcctggtgcaactgccgctgccggcccacctgccctacaaggccgtcctggagcacatccacccggcgaaggacgtggatggctttcacccggtgaacgccgggctcgccttcgtcggagacccccgggccttcgtgccctgcacccccgccggcatcatggagatgctccggcgcgaggacatccccacccggggcaaacacgtggtcatcgtgggccgcagcctcatcgtcagcaagccgctggcgtcgctgctgatggcgccgggccccgacgccaccgtcaccatcacccaccgccacacgccggacctcgcgtcattcacgcggcaggcggacatcctcatcgtcgcggtgggcaagcagaacctcatcaccgcggacatggtgaagccgggcgtcgtcgtcatcgacgtggggcagaaccgcgtgtccgacgcgagctcaccgcgcggctaccgcatggtgggggacgtggatttcgatgccatccagcccattgccagcgccatcaccccggtgcccggcggcgtggggccgatgaccatcaccatgctgctggcgaacacgctccaggccgcg

SEQ ID NO: 43171 - DNA, 660 bp, Myxococcus xanthus
tggacgttcgaccgcatcgacgggggcggtggcaaccccggcacggggctggccgccatcctgagcgagtccacgttcaacgccatgttcccgaaccggaaccccttctacacgtacagcagcctcatcgccgccgcgagcaccttcccggccttcgccaacacgggctcgctggagacgcgcaagcgcgaggtggcggccttcttcgccaacacggcccatgagacgggcaactacgtgtacgtggaggagatcaatcgcggtgactactgcggctcatgggggccgccgggctgctactgcgtcgcgggcaagaagtactacggacgtgggcccatccagttgtcctggaacggaaactactgcgccgccggcgccgcgctggggctgccgcttcacaccaacccggacctgctggcccaggacgccaacgcctcgtggcgctccgcgttctggttctggaccacgcaggccggcgccggaaccatgtccgcgcaccgcgcgatggtcgacggccacggcttcggtgagaccatccgcaccatcaatggctcgctggagtgcaatggtcgcaacccgggccaggtgcagagccgcatcaacaactatcagcacttcaccaacatgctcggcgtgagccctggcggcaacctgggctgc

SEQ ID NO: 43172 - DNA, 4020 bp, Myxococcus xanthus
acctaccggcggctggattcacgggcgcggtcgctgggggctcggctgcgtgccctgggggcgcagggggagcgggcgctgctgctctatccgcccggcctggagttcgtcgcgggcttcatgggctgtctgtatggcggcgtcatcgccgtgccgtgttacccgccggaccccacgcggttggagcgcacgctgccgcgccttcgcgccatcgcccgggactgcggcgcgcgctacgtgctgacgacgagcaccatccaggagatggcggagttcctcacgccacaggctcccgagctgggtgaattgcagtggattgccagtgacgcggtgccggaagccgaggccgcggactggaagcgcccggacctgacgtccgagtcgctggccttcttgcaatacacgtcgggttccacgggcaacccgaagggggtcaaggtcagccacgccaacatcctccacaacgagtcgttgattacgcgtgacttcgggttgcaggcggagcgttcggtgggcgtgggctggttgcccatgttccatgacatggggctcatcggtaaggtgttgcagccgctctacctgggcttcccgtgcgtgctgatgtcgcccatcgcgttccttcagcggcccttgcgttggctggaggccgtctcccatttcaaggggacggtcagtggtggacccaacttcgcgtacgacctgtgcgcgcgaaaggcccgcgccgaagacgtggcccgtctggatttgagccactgggacctggccttcaacggcgcggagcccgtgcggcgcgagacgatggagcgcttcgcggagacgttcgcgcccgctggcttccggcgcgaggccttctatccctgctacggcctggcagaggcgacgctcatcgtcagcggcggcgtgaagggaacgccttgtgtgcaggagcgctacgacaccggctcgctggagctggggcgcgcgaagcccgcgtccgacgcggcggaggggcccacggcgcgcacgctggtgtcctccggtcagggcgcgccggaccagcggctgctcatcgtggacccggagacgcgggtgcctcgggcctcgaacgaggtgggtgaggtctgggtcgctggccccagcgtggcgggtgggtattgggatcgtccggaggagacggcgcatgccttcggcgcgcggctcgccaacggcgaggggcccttcctccgcaccggtgacctggctttcctgtcgccggagggcgagctcttcatcaccggccgtctcaaggatctgctcatcgtccggggtcggaacctgtatccgcaggacctggaaatgaccgcggagcgcgcgcaccgcgcggtgcgtcccggctgcagcgccgccttctccgtggacgtggagggggaggagcggctggtggtggtctccgaggtcgacgtgcgcgaaggcttcgacggcgcggcggtggtgggcgccctgcgccgcgcgctcgccgatgagcaccaggtgcatgcgcacacggtggtgctgctccaggcccggagcattccgaagacatcgagcgggaagattcagcgccgcgcctgtcgtgatggcttcctggcgggctcgctggaggtggtggaggtgtcgggcgaggaggccgctccggtgccggaggccgtgccttccacgccgtccgcgcccctgcgcgagcgcctggccctggcgtccgaggaggcccgtccggcgctgctggtggacttcctccgcgtggaggccgcgcgggtgctgcgcgctgcgcccgcgtccctggcgccggagacgtcgctggccagcctggggctcgactcgctgatggcgctggagctccacggccggctggaagaggaactcggtgtgtcgctgcccgtggccttcctctggcagcacccgacgctggggaccgccgccgcgcatctggtggacgcgtggaagggctccgccgcgcccgccgcgccgccgctgaaggccggctcgctggagggagagctgccgctgtctcccggtcagcagcgcctgtggttcctggaccggctggtgccggagagcgcgctgtacaacgtccacttccagctccggctctccggcgcgctggacgtgcccgcgctggagcgcgcgctgcaagggctcctgtcgcgtcacgcggtgctgcgcgcggccttccccgaagtggagggtcagccgcgccagctcctgccgcccctgcgtccgctggacgtggcccgcgaggacctgcgggcgctgtcgcccgccgagcgtgacgcgcggctgaatcagttggcccgcgcccagggcgaggcgcccttcaatctctcagagggcctgctggtgcgtgcggcgctggtggcgctggaggaccaggagcacgtgctcctgatgacccagcaccacatcgtcaccgatggctggtccattggcgtcctggcccgggagctggccgcgctgtaccgcgcggaggtggctggcgccgccgcgtcgctgggcgcgcccgccttgcagtacgtggactacgcacgttggcagcgcgggctgggcggcgcgctggacgggcagcgtgcctactgggcgcggaagctggagaacctgccgcgcctggagttgcccacggacttcccgcgtccccgggagccgggcttccgcggcgcgctccaccgtttcgcgctgccggccgagctggtggattcgctcaaggcggtgggccggagtgagggctgtaccttcttcgttacgctggcggcggcctgggcggcgctgctgcaccgctatagcggtcaggacgacttcggcctgggcaccatcttcgcgcagcgggaccgggccgagctgcgtgacgtggtggggttcttcgccagcacgctggtgctccgcgcggacgtgtccggcgcgccccgcttccgggagctgctgggccgcatgcgccacacgttccacgaggccctggcgcacgcggacctgcccttcgaggaagtggtgggcgcgtcgcgcgcggtccgtggcggcgacaacccgctgttccaggcgaacctggtgttggagagcctgccgccggtggacatggacgtgccgggcatgcagtggcgcccggtgctgcccgtgccggacggcgcggtggagggcacggcgaagttcgacctgcagctcgccgtcgtggagacgccgcgagggctggagggcgcgctggagtaccgctcggacctcttctcggcggagacgatggcgcggctcgcgggacacctggaggcgttgctgaggggcatcgtcgctgctccggacgcgcgtgtggaggacctgccgctgctcgacgaggcggagcgtcgttctctgctggagcgctggaacgacttcacggcgccgctctcccaggacgcttcgcactgcatccacgcgcagttccgtgagcaggccgcccgcacgcccgacgcggtggcggtggtcgccgaggacgggacgctcacctacgcggagctggcgcgccgtgcgtccgcgctggccttgcatctgaggggcctgggcgtgggccccgaggtgcgcgtgggcctgtgcgccgagcgctcggtggagatggtggcggggatgctcggcatcctcgaggcgggcggcgcctacgtgcccctggacccggactatccccgggagcggctcacgtacatgctggaggactcgggcgcgcgcgtgctcgtcacgcagtcccatctggcggggacgctgcccgtggccggcctgcacaccgtgctgctggatacggcggagccctacgcggcgatgccggcgtcaccgctggccctggggaccacgccggacaacgcggcgtatgtcatctacacgtcgggctccacgggacggcccaagggcgtggtggtaccgcatgggggcgtggccaacttcttcgccgccatggacgtgcgcgtgggccactcgcccgcgggcgcctggttggccgtcaccagcatctccttcgacatctccgtcctggagttgctgtggacgctcacccgcggcttcaaggtggtggtgctt

SEQ ID NO: 43173 - DNA, 1083 bp, Myxococcus xanthus
cgcgtcatcaacttcaacgccggcccggccggattgccactaccggccctcgagcgggctcgggacgaactgattgacttccagggctccggcatgtcggtgatggagcacagccaccggggacgggaatacgagggggtccacgacgaagccatctccctgttgacccggctgctggggattcccgacacccaccaggtcctgttcctcactggcggcgcctcccagcagttcgcccaggtgccgatgaacttcctgaggcccggggccagcgcggactacctcatgacgggcgtgtggagcgagaaggccttcgacgaggcgaagtactacggcacgccgcgcgtcgcggtgagcactgcgcggccggacaagcgttacacgcgggtgccccgccaggatgagctgcgcctcgagtcgagcgcggcgtatgtccacctgacgagcaacaacaccatcttcggcacccagtggcacaccttcccggacgtggggaacgtgccgttggtggcggacatgagctcggacttcctgtggaagggcttcgatgtcagccgcttcggcctcatctacgcgggcgcgcagaagaacctggggccctccggcgtgacgctggtggtggctgacaaggcgttcatcgcgcggggccggacggacattccgaagatcttccgctacaccacccacgcggagaacaactcgctctacaacacgccgcctaccctggccatctacctggtgcgcaacgtcctggcctggattcagtcggtgggggggctcgcgcagttggagcagtggaaccgggaaaaggcggcgttgctctacggggccgtggatcggcacccggaattctaccgcgcgccggtggagcgcgaatcccgttcagtgatgaacgttgtcttccagttgcccacggaagcattggatgcgtccttcgtcgctgacgcgaagcagcaaggaatggtgggcctcaaggggcaccggacggccggaggaatccgcgtttccatgtacaacgcggtgagcgtcgaaaatgtgcgcacgttggccgccttcatggaccacttcgtgaagacgcgcggg

SEQ ID NO: 43174 - DNA, 1788 bp, Myxococcus xanthus
ttcgacgcaatcatcgtgggctctggctttggcggctcggtgatggcgtaccgactggcagaggccggcttgcgcgtgtgcgttctggaacgaggaaaggcctatccacctggcacgttcccgcgcagtccctacgacatgcgcaacaacttctgggacccgagcaaggggttgcacggcatgttcaacctctggtccttccgggggctgggcggcgtcgtctcctccgggctgggcggaggctcgctcatctacgccaacgtcatgctgcgcaaggacgagaagaccttcgtccatgagcatccgcagaccggcggttatgagtattggcctgtcacccgtgacgacctcgaagaacactacgacgccgtcgagcggatgatgcacgtccagcgatttccgctggcgcaccctccctacgacgccacggcaaagacgctggccatgaagcttgccgccgaacgcctgggccgtgcagccgactggcagcttcctccgctggccatcaccttcgccaacgccggggcggcgcccgcgctcggcgagcccattcgcgaggcggcgccgaacctcttcggccgcatgcgaaccacctgccggctgtgtggcgagtgcgacatcgggtgcaactacggcagcaagaacacactcgacttcacgtacctgtccgctgcgcatcgcgcgggggctgacctgcgcacccgcgcggaggtgaaagagttctggcccgcggatggagggggctacgtggttcagtacgtggaccatgccgaggcccgcgaaggcgagcggcgcgaggtggcctcggaccaactccagcgggtgacgctcaccgcggaccggctcgtactgggggcgggcaccttcggcaccacgtacctgctgctgaagaaccgggcgcactttccacgcctgagcgcccggctcggcacacgcttctgcggcaatggagacctgctgggcttcctgctgcgcagcgtggacagcagctccgggacccgtctgcctcgggtgctggatggcggaagaggccccgtcatcaccagcgcgctccacttccgtggcaaggaggagggcggcaccgggcgcggctactacatcgaggacgcgggctacccggagttcatcaactggctctatgaaggctcgcagcaggccccccttctgaggcgaggcatgcgcctggcctggcgcctcgtcaagggctggatcggcctgacgcgcgacacggatgtcagcgaggagattgctgaagcgctgggggattgcctgggctcagccacgtcgctgccgctactcgccatgggccgggacatccccaacgggaacatgcggctgacacgagatgggaagctggacatcgactggcgcatgcatggttcgcgcgagtacttcggccgtgtgcggaaatccatggaggacatcgccgacgcgctggaggcgaagatggtgcacaaccccctcagttacttgagccgggtcatcaccgtgcatccgctgggtggttgccccatgggacagacgccagcagaaggggtggtgaacgcccatggcgaggcgttccactaccccggcctgtacgtggcggacggctcggtgatgcctggccccaccggccccaacccgagcctcaccatcgccgcgctcgcggaccggttctcagaccacttgattgcgcactggccacgaaccacggcgctccgcaaacaccccaccacggaggaacgcatatgacgatacgagctgccggcgggggaaccgccatcggcgccgggggacgccacgaac

SEQ ID NO: 43175 - DNA, 693 bp, Myxococcus xanthus
atggacacggagctgcagggcagaggcgtcctggtcacgggcggcgccggaggaatcggcaccgccctggtccataccttcgcggaagaaggcgcgaaggtggcagtgcaccaccactccagtaccgagaaggcccaggcgctggcacgcgacgtcggcggtgcagcgctgcgcgcggacctgacggtggaggccgacgtggacgcgctggttcccgcggcggtggccgcgctggggcggctggacgtgctggtctgcaacgcgggtgtctggcccgccccggatgaacccgtctgggagatgtccctggcgcgctggcgccgcacgctggcggagaacctggacagcgtcttcctgtgctgccgtgccttcctgcggcacgtggccaccacgaagacgggcaacatcgtcatcatcagctccacggcggggctgttcggtgaagcaggacacgctgactacgccgccgccaagggcgcgctggcgagtggcttcctcaagagcctcaagaacgaattgggccgcatcgcgcccctgggccgcgtcaacgtcgtgtgcccgggatggacggcggtggaccgcagccgcgacaagctggcccagccgggcttcgttgaacgcgtcacgcggactatgccgctgcgcaaggtggcgcagccggtggatgtggagcgggcggtggtgtcgctcgca

SEQ ID NO: 43176 - DNA, 1509 bp, Myxococcus xanthus
ctgcttctaaccgccattctctttggcggttcggccgccgtcgccgcgacgccccctcccctgacgacggacaccggatcccccgtggggaccaaccagaactccaagacggccggcccgcgtggcggcgtcctcctggaggacttccacctcatcgaaaagctggcgcgctttgaccgtgagcgaatccccgagcgcgtggtccacgcccgcggcaccggcgcctacggcaccttcgagagctacggcgacttctccaagctgacgcgcgcatccctcttctccgccaagggcaagaagacgccgatgttcgtgcgcttctccacggtcatccatccgacgggctcgccggagacgctgcgcgatcctcgcggcttcgcgctcaagttctacacggacgagggcaactgggacctggtgggcaacaacctgcccatcttcttcatccgcgacgccatcaaattcccggacatggtgcactcgctgaagccgtcgcccatcacgaacaagcaggacccgaaccgctccttcgacttcttctcgcacctgcccgagtcgacgcacatgctcacgcaggtgtactcggacatcggcatcccggcgaactaccgccagatgaacgggcacggcgtgcactccttcaagttcgtcaacgcgaagggcgaatacaagtacgtgaagttcaactggagctcgcagcagggcgtgaagagcctcaccgccgaggacgccgcccgcgtcatctccgaggaccaccagcacgccaccacggacctctacgccaccattggcgcgggcaagttcccctcgtgggagctgagcgtgcaggtgctggaccccaaggagctggacaagttcagcttcgacccgctcgacgcgacgaagatctggcccgaggcgcaggtgccgtccatcaagctgggcaagttcacgctcaacaagatgccggacaacttcttcgaggagaccgagcaggcggccttctcccctggcgtgcagccgccgggcatcgagccctccgaggaccgcctcctgcagggccgcctgttctcctacgccgacacccagcgctaccgcattggcgccaactatcagtcgctgcccatcaaccggtcccgcgcgacggtgagcaacaacaaccaggcgggcagcatgaacttcgccaacacgaagtcggacgtgaactacgagcccagcgtcagccgtgagacgcaggacgcgccgcagtacctcttctccaacgcgccgctcaggggcaccacgcagcagggcggcatcgagaagacggacaacttcgcgcaggccggcgccttctatctggcgctcgacgcgggcgggaaggaccgcctcatcaagaacctggccgcggacctgaatcaggtgcgtgatgccaaggtgaaggcccgcatggtgggtcacttcttcatggccaaccctgactacggcacccgccttgccaaggcggtcaacgtgaagctggacgacgccaaggccgccgtggccacgctc

SEQ ID NO: 43177 - DNA, 873 bp, Myxococcus xanthus
ctgcttcgcggtatcgtcgcgtatccaatcactcccttcacgtcgacgggacgtgtcgacgaggtgctcctcggcaagatcgttgacgacatggtgaaggcgggtgtccacgccatcgcgcctctcggcagcaccggcgtgctgccgtacctctccgatgacgaaagggagcaggttgcggaaatcgtcatcaagcgggtcgccgggcgcgtccccacgctcgtcggcgtttcgagcctcaccaccgagcgcaccgtccaccacgcgaagcacgccgagaagctcggtgccagcgcggtgatgatcatcccgatgagctactggaagctgagcgacgccgaaatcatcacccactacgagacggtggcgaagcgcatcgccatccccatcgcggtctacaacaaccccgcaacgggtggcctcgacctgagccccgacgtcatctcgcggctgctgaagatcccgaacgtcacgatggtcaaggggagcaccggcgacgtgaaccgcatgcaccgcctcgtccagctctgcggcgaggatgtggcgttctataatgggagcaacccgctcgccttggcagccttcgtggccggtgcgcgcggctggtgcaccgcggcgccccacatcatcccgaagctcaacatcgagctctacgacgccatccagcgaggtgacgtcgcggcagcgcgtcagagcttctatcggcagcttcctttcctgcaattcatcgtcgctcacggcctcccgcgtgcaatctcggcggcgctcgagctacaggggacgtctgtcgggccgctccgcgcgcccctgcaggcgctccctgcagagcgtgtcgaggagctccgtcgaatcctcgtcgggctcgaagtcatt

SEQ ID NO: 43178 - DNA, 1290 bp, Myxococcus xanthus
atgaccgagatttctcagattctggcgcgcgaagtgctcgactcccgtggcaacccgaccgtggaggcggaggtccagcttgccgggggcgctcgtggccgcgccgcggtgccgtccggtgcgtccaccggtgagcatgaggccatcgagctgcgcgacggcgacaagcatcgctacctgggcaagggcgtgcagaaggccgtgaagaacgtggtcgacgtgctcgcgcccgcgctggtgggcatggacgcggcggatcagttcgcggtggaccagcggatgctggagctggacggcaccgccaccaagggcaagctgggcgccaacgccatcctcgcggtgtccatggcggccgctcgcgccgcggcggacgcgcacgggctgccgctgtaccgctacgtgggcggcgtgcaggcgcgcaccctgccggtgccgctgatgaacatcctcaacggcggcgcgcacgcggacacccgcgtggacgtgcaggagttcatggtggtgcccgccggtgcgtcctccttcgcggagggcctgcgctggggcgccgaggtgttccacgcgctgaagaagattctcaagggccgcaagctggccacgggcgtgggcgacgagggcggctacgccccggacctgccggcgaacgaagaggcgctgaagctcatcatggaggccatcgaccaggcgggcttcaaggccggtgagcagctcttcctggccctggacgtggcggccagcgagttcttcgacaagggcagcaagaagtacaagctgaagggcgagggcaaggagtacgactcgaccggcctgctcgagtactaccggggcctctccgagcgctaccccatcatctccatcgaagacggcatggcggaggatgactgggagggctggaagaagctcaccgacgcgctgggttcgcgcatgcagttggtgggtgacgacctcttcgtcaccaacgtggagcgcctgggccgcggcatcgagacgggcacggccaactccatcctggtgaaggtgaaccagattggcaccctgacggagacgttcgacgccgtgcgcatggcgcaccgcgccggttacacgtccgtcatgagccaccgctccggcgagacggaggacaccaccatcgccgacctggccgtggcgctggactgcgggcagatcaagacgggttccgcgtcccgctccgaccgcgtggccaagtacaaccagttgctgcgcatcgaaggcgagctgggggccgcggcccgctacgctggcaagtcggtgttccgcgccttgaaccag

SEQ ID NO: 43179 - DNA, 792 bp, Myxococcus xanthus
ggccgcatgagcctggaggttcgtggcatcgaggtgtggcgtggccgtgggcggacgctgggacccatggatttgacgctggagcccggtgaggtgctggccgtcgtggggcccaacggcgcgggcaagtccacgctgctgtccgccatgtcgggcgagctgcggtgctcgacgggcgaggtgcttctggacggcactcccttgttgcagtggaagccgcgggagcgggccatgcggctgggcgtgcttccccaggagtcgtcgctgggcttcggcttcacggcgctggaggtggcgctgctgggacggagtccccattcgagccgcgctgagggcagcgcggacctggcggcggcggtggcggcgctcgatgccaccgacacgcggcacctggcttcacgttcgtatctcacgctgtcggggggcgagcggcagcgtgtgcagctgtcgcgggtgctggctcagctctccgaaccgttggcatccggacaccgttacctgctgctggacgagccgacggcgagtctggacctggcccaccagcacctcgtgctggaggcggcggcgcgcttcgcccaggcgggtggcgcggtgctggcggtgctgcatgacctcaatctggccgcgcgttacgcgcaccggatggccgtgctcgccgagggccgggtggttgaactgggcgcaccggcgcaggtgctttcccaggagttggtggcccgcgtcttcggtctgcgcgtgcaggtcgtcgaatggccgggctcgcccggtcccctggtcatcccggagggccgc

SEQ ID NO: 43180 - DNA, 1729 bp, Myxococcus xanthus
cgacctgcgcgaagtgaagcagcacgacacccaacggtaccagttgctctgcctgccttgaagggcgcggagcaggcacgctccgcaacgtcggaccggcgtcactgcccgcactctcccttgcccggtggttgctcggaaggcgtaaggtgcctgccggaccgaacccggagggaggcagcgaatggacgcgcatcagggcctgcacatcgagacccatccccgagaaggagacccgctggttcgcgcccggcggcccgacccgtgcgcgctggtgttgttcggcgccaccggagacctggcccagcgcaagctgttcccggccctcttcgagttggcgcgagcccacctgctgccgaagaacttcgccgtcgtcgccttcagccgctccgaaggagacagcgaggccttccgcgagcatgtgaaggcgtccctgctgaagttcgcccgcacccagcccctggacgaggccgtctggaacgacttcgccccgcgcctggagctcatctccggcggctatgacgacccgaagtccttcgtgcgcctgcgcgaggagctcgaccgggtcgcccagaagttcggcacccagggcaaccagttctattacctggccactccggcctccaccttcccccaaatcctccagggcctgtcggagtcggggctgctgaagcgccaggaacaggccgacccgcgcccgtggcagcggctcatcatcgagaagcccttcggccacgatttggagagcgcccgcgcgctcaaccgtgagctggcggcggtgctggacgagcggcagatattccgcatcgaccactacctgggcaaggagacggtccagaacatcctcgtcttccgcttcgccaatgccatcttcgagccgctgtggaaccggcagcacatcgaccacgtggaaatcaccgcggcggagacgctgggggtggaggggcgcggcggcttctacgacgagacgggcgtcatccgggacatggtgcagaaccacctgctccaggtgctcgcgctgtgtgcaatggaaccgcccgtgtccttcggcgccgaggacatccgcgacgaaaagaccaaggtcttccgcgcgctgcgcccgctggagggccgcgaggtgtcccgcgcggtggtggccggccagtacgagggttacctccaggagaagggcgtgaaggccggctcgcgcacgccgacctatgtcgccatgaagatgaacatcgacaactggcgctgggcgggcgtgcccttctatctgcgcgcgggcaagaagctgaagcggcgcgtgacggaggtgtccatccacttcaaatcggtgcccatcagcctcttctccggggaaggcgccacctgccagcggctgcagcccaacgtgctcacgctgcgcatccagccccaggaaggcatcgcgctctccttcgaatccaaggtgccgggcgaggatgtcaacatcgcgggcgtcaccatggacttcaactatcaggagaccttccagcggccggtccccgaggcctacgagcgcctgctgctggactgcatgcgcggcaacgccaccctctacgcgcggcaggacagcgtggagcaggcgtggaccttcgtgacgcccatcctccaagccctggagtccggcgagggcggaccggcgcacggctaccccggtggcagcgcgggcccggatgccgcggccgcgctgctggcccgcgatggccgccggtggaccggcctatga

SEQ ID NO: 43181 - DNA, 1404 bp, Myxococcus xanthus
gcgggcgcgcagttcggcgtggcgggaatgggcgtcatgggggcgagcctcgccctcaacatcgcggaccacggcttccgggtggccgtgtgggacaggcatgcggagcgcatcgatgagatgcaccgcaaacacggacaccccgaggtctggggcaccgagtcgctggaggccttcgttcagcgactggagcgcccgcgcaaggtgctgctgatggtgacggcgggcgcggcggtggactccatgctggagcgcctgctgccgctgatggcggaaggcgacgtcatcatggacgccggcaactcgtggttcctggacacgcgccgccgcgaggagcagtgcaaggccaagggcatccacttcctgggcgtcggcgtgtccggcggcgaggagggcgcgcgcaacggcccctccatcatgccgggcggtgctccctcggcgtacgagctggtgcgtccggtattcgaagccatcgccgcgaatacggacatggggccgtgtgtcacctacgtgggggcggacggtgccgggcacttcgtgaagatggtgcacaacggcatcgagtacgcggacatgcagttgctcgcggaaacgtacgacgtgctgcgccgcgggctcgggctggacgcggacgcgttggcggacctgctgtcccagtgggaccacggcatcgccggctcgttcctgctggagaccaccatcaaggtgctgcgccagaaggacccggagacgggcaagccgctggtggacctggtgttggacaaggcgggccagaagggcaccggcaagtggacggtgcaggtggcgctggatttgggcgtcccgattccctccatcgccgcgtcactggacgcacgcatcctgtcctccatgaaggacgaacgcgtggccgccgcgccgaagctgaacggcccggtggggcagctcagcaaggaggagcgagcgcaactggcggcgtggacgcacgacgcgctctacgcggcacgggtggtgacgtatgcgcagggcatgcggctcatccaggcggcgtcccaggagtatcagtggaacatcagcctggcggagctggcgcgcatctggcgggggggctgcatcatccgcgcgaagctgctcacgccgctgcgtgaggccttccagcagcagccgacgctgcccaacctgatggtgtccgacgccttcgcgccggtgctggagcgcatggcccccgcgtggcggcaggtggtgggcgtggccacgcgcgtgggcatccccgtgccggtgttcagctcctcgctggcgtacctggacagctaccgcaccgcggagctgccgcagaacctcacccaggcacagcgtgacgccttcggcgcgcacacgtatcagcgcaaggacagaccggaagcgggcttcgtccacacggagtgg

SEQ ID NO: 43182 - DNA, 1608 bp, Myxococcus xanthus
cctcggaacatgaaggactacgaggccacccgccgggactttcgctgggagcggcccgagcacttcaacttcgcggccgacgtcatcgaccggcacgccgccgagcgcccggaggcgctggccctgctgtggtccgacgaagccgggcaggcgcggcgcttcacgtgggaggacttgcggcggcgctcgctgcacgcggcccgcttcctgacggagcaggggcttcgccggggggaccgggtcttcattatgatgccgcgcgtgccggagtggtggttcctggtgctgggctgcattcgcgtgggcatcgtcttcatgccgggcacgcccatgctcacgccgaaggacatccgttaccggttggaggtggcggaggcccaggcggtgattgcggacgtgagctgcctggagcgcttcgacggcctggtggggacggccggcaaggtccgcacctgggtgtcggtgggcgagggcgcgccgtctccgtgggggcgctacgtgtccggcgtcgcggaggcgaacgcgggcgcggccttcgagcccacgcgcgcggatgcgccgctgctcatctacttcacgtccggcaccacgggcatgccgaagatggtgctgcacacgcaggccagctacgggcaggggcacgtgattaccggccgctactggctggacctgacgccggaggaccggcacctgacgctcagcgacaccggctgggccaagtgcgcgtggggcaagctcttcggcccgtggagtcagggcgcgtgcaacgtcgtctatgacttccgtggccgcttcgagcccgcgaagctgctgaaggtgctggagacgcagaaggtcaccaccttctgcgcgccgcccaccgcgtggcgggcgctggtgctccaggacttgaaggccttcgacctgtcctcgctgcggcacacggtgagcgcgggcgagccgctcaatccggaagtcatcgacacgtggaaggatgccaccgggctgcacatccatgagggctacgggcagacggagacggtgatgattgtgggcatgttcccctccatggcgccgcgcgtgggttccatgggcaagccgtccccgggcttcacggtgagcgtcatcgacgaccagggccaggaggtggcggacgggcaagagggggacatcgcggtgcgcgtggcgcccgagcggcccgtggggttgttccagggctatctcggggacgacgcggccaacgcggcgtgccggcgtggtgactggtacgtgacgggagaccgggccgtgcgcgacgcggacggctacttctggttcgtgggacgcgcggatgacgtcatcaagacgtcgggctaccgcgtggggcccttcgaggtggagtccgcgctgctggagcacgacgcagtggcggagtcggccgtcatcggtgtgccggacgagaagattggccagcgggtgaaggccttcgtggtgctggcgccggggcatacggcatccccggtgctcgcgcaggcgttgcaggagcacgtgaagcggacgacggcgccctacaagtacccgcgcgaaatcgagttcgtcaccgagctgcccaagacggtgagcgggaagattcgccgcgcggagctgcgc

SEQ ID NO: 43183 - DNA, 918 bp, Myxococcus xanthus
atgacacacaagcggctgaagaggattggcatggtgggcgggggcgccatggggtgcggtatcgcgctcgagctcgccatcgccggcaggcaggtggtgctctacaacacgcgcgccgacagcagcgagcgggcacgcgcgaagctggagcgagacgcatcgctgctggtggagacgggcctgctcgccccggagcaggctcccgccgcgatcggacgcatccgccgcaccacagtgctcgccgaggccgccgtggagcaggacctggtcatcgagtccatccccgaggacctcgccctcaagcagcagctcttccgcgagctggaccagctcgcggcccccgacacactgctcgccaccaacaccaccgcgctgagcgtgacggccatcgctcgggactgcacgcggccggagcgcgtcctctctgcccactactatctgcccgcgcacctcatcccgctggtggacatcattcccggcgagaagacgtcccccgacgcggtggagacggtgcggcggttcattgaggagcttggcaagtcgccggtggtgttctccagggacgtgccgggctcggtgggtccgcgcctgcagcaggccctcatcggcgaggccatccggctggtgcacgagggcgtggccacgccggagatggtggaccgcgtgctcacccagggcgtcggacggcgcctgggcgcttcgggtgtcttcgaccggctggacctggtggggttggacttcatgacggccctcctccgcggcaccggccgccccgtgccgcccgtgctcgcgcagaaggtggagcggggcgagctgggccagaagacgggccagggcttctactcctggacgcccgagtccaccgctgcctacgaggagcgcatggcccgccacctcgccacccagcttcgtgaggat

SEQ ID NO: 43184 - DNA, 987 bp, Myxococcus xanthus
aagtaccacctgctcggccagacgggccttcgggtgagcccgctggcattgggcaccatgaacttcggtaccgactggggctggggcatcaccagtgaggacgcacaccgcttgctgacacgctatctggaagcgggcggtaacttcattgatacagcggatgcgtacacctccggctccagcgagcggatcatcggcgactacttcgcgaagcatggcgggagggaacgggcggtcatcgccaccaagttctccgccaacctgtctccgggggatccgaatgcgggcggaaacagccgcaagcacatctacgccgccctcgaaggctcgctgcgccgcctcaagatgagctacgtggacgtgtactggctgcacgtatgggacggcctgacacccgtggaggaagtgatggggacgctgaccggcctcgtgcgcgagggcaaggtgcgctacatcggcttctccgacgtgcctgcctggtacttcgcgcgcgcacagacattggcggagcgcaaccactgggaaaaggtcgccgcgctgcaactggagtactcgctcgctgaacgcaatgtcgagcgcgagcacctccccgccgcgctggccatgggggccgccctcactccgtggagccccctggccgggggcctcctcaccgggaggtacacccgcgacggaaaccagccgaagggtgacgggcgcgcccatgcactgctcgccagcggaaaccccgtggcggacaagttcctgcaagagcgcccctgggccattgtcgaggagctcgtcgctgtggcgaaagaggtggagcgctcgcccgcccaggtggcgctcaactgggtggcgacgcgtccggccgtcgtgtccaccatcatcggcgcgagcaggctggagcagttggaggacaacctccatgcgctggacttcaagctaccgcacgaactctccgcgagactggacgccgcgagtcgccccgagctcttcaatccgtac

SEQ ID NO: 43185 - DNA, 1986 bp, Myxococcus xanthus
gcggacacaatggagcgcttcaagaaggtcctcatcgcgaaccgcggcgagattgccgtccgggtgattcgcacctgccatcggctgggttacagcaccggggcggggttctccgaggcggaccgcggcgcgccgcacgtgctggcggcggacgaggcggtggccattggtccgtctccggcgaaggagtcctacctcgtcatcgggaagattctggaagcggcgaagacgtccggcgcggaggccatccacccgggctacggtttcttgtcggagaacgcggacttcgcgcgcgcttgccgcgacgcgggcctggtgttcatcggcccggaggccgaggccatcaccctgatgggcaacaagcgtcaggcgaagctgcgcatgattgcggcgggcgtgccctgcattcctggctacgaggcgtccgacctggatgatgaggcgctggcggtggagggcgagcgcatcggcttcccgctgatggtcaaggcggcggcgggtggcggcgggcgcggcatgcggctggtgcacgaggcatcgcagcttcgcgcggccctgcgcgcggcgcgctcggaggcgacgaatgccttcgggagcggggagctcatcctggagaaggccgtcatcgacgcgcggcacgtggaggtccaggtcttcgcggacacgcacggcaacgtggtgcacctgggcgagcgggactgctcggtgcagcgccggcaccagaaaatcgtggaggagagtccgtcaccggcggtgagcccggcgctgcgcgcgcgcatgggtgaggtggcggtggcggcggctcgggcgattggctaccggggagcggggaccatcgagttcctcctcgctccgagcggtgacttctacttcatggagatgaacacacgtctccaggtggagcacccggtgacggagctgattaccgggttggatttggtggagtggcagctccgcgtggcggcgggggagacgctgccccggacgcaggaggcgatttccgcgtcggggcatgccatcgaggttcgcctctgcgcggaggacccggcgaagggctacgcgccccaggccgggcggctgctggcgtggaggctgccgctgcgtgagggcgtgcgcatcgaccacggcgtgcgggaggggcaggagattccgcccttctatgactccatgcaggcgaaggtgattgcgcacggcccggaccgggagacggcgcgccggcggctggtggaggcgctgcgcgagctgacggtgttcggcgtcaccaccaacaagaacctgttgttgtacgtgctggagcacgcggcgttccgttcaggggagtacgacacggcgttcatcgcgaggcacgcggcggcgtcggaggtggaagggctgtatcaggcagacgcgaaggcgcgggcgctggcggcggcgctgctcttccacgacgaaggcctgaagctggcggacacggcgggtctggatgtgtccctgctgaattggaacacgtcccaccgccaccccgtgcggatgaagctcgtgagccgtggcgcggaagcgtccgtcaccgtccagcccgtgtccggggaagggtacgaggtggacgtgggggattcgtcgttcgacgtgtccgtgttggggctgtccgcgggcgtgctcgacttctccagcgccgggacacggggccgcgcacgctacctgcgggacggggacacgctgtggctggacctgggctcgggcgcgcacgccgtgacggacgtaacgttccgtccgccgtcgaagtcggacggcgtgggcagcggacggctggcggcgcccatggatgggcgcatcctgcgcgtggacacgcaggtgggcgcggcggtgaagcccggggacgtcctggtggtgctggaggccatgaagatggagttccaggtggtggcggacgttaggggcaccgtcgcggagctcaacgtgtccgtgggcagccaggtgaaggcgaagcagctcctggtgtcgctggct

SEQ ID NO: 43186 - DNA, 792 bp, Myxococcus xanthus
cgctctctcttcgcaccgggctgtttcagcaaccgcaccatcgtcgtcaccggcggcggcagtggcattggccgctgcaccgcgcacgagctggccgcgctgggcgccaacgtcgtcctggtgggccgcaagcccgacaagctggaggccgtcgcgcgggaaatccaggaggacggcggcaaggtgtccttcgaggtgctcgacatccgcgacgaggagggcgtgaaggccaccgtggcgcgcatcatcgccgcgcacggccccatccacggcctggtcaacaacgcgggcgggcagttcccctcgccgctgtcggccatctccaagaagggctttgacgcggtggtgtccaccaacctcaccggcggcttcctgatggcgcgggaagtctatctccaatccatgagcagccacgggggctccatcgtcaacatgctcgcggactcgtggggcggcatgccgggcatggggcactccggcgcggcgcgcatgggcatgctcaacctgacgcagacggccgccgtggagtgggccgcgtctggcgtgcgcgtgaatgccgtggcgcccggctgggtggcctccagcggcatggacagctacaaggacgagggcgtgcgggcgatgattcccctcctcaagaaggaggtgccgctccagcggctcgccaccgaatccgaggtgagcgccgccatcgtcttcctgctcaccgacgctgcggccttcatcaccggcgacgtcatcaagattgatggtggcgcgtcgtgcaacaccaagattttcccgctggaggag

SEQ ID NO: 43187 - DNA, 3008 bp, Myxococcus xanthus
tggcgcatggcccttgccagcctcgtgatggcgccgctcgccgtcatggcgatggccgtcgccatgcgcgaggtcggcaaggcccatcaacagtggaacgcgctccagagccggatgaaccgctcgctgctcgaatacctgcggggcatccacgtcatcaagaccttcggcctgtccgcgcggcgcttcagcgacctctcaagctccatcgaggaagggctctcgtggatggagggtttcatgcgcaccaacggccgtggctacggtgcgttcggcgcgctcatcggctcgagcctcgtcgtcctcgtccccatggggggttggctctacacgcgcggcacgctttcgctcgagtcgctcgtgctcttcctcgtactcgggccacagctcctcatgtcgatgatgcggctgatgttcgcgtggggcaacgctgaccgcatccaagcgggcaacgcgcgcatccaggccatcctcgcggcgcccgacctcgagactcccacgagcgccgcgcggccctcgcacgatggcgtcgcgttccgtggcgtcagtttccgttacgaggacggcggtccggaggttctccgcgacgtctccttcgaagcgcccgcgggcaaggtcacggcactggtcggaccttcgggcgcaggcaagacgacgctcgtgaggctcgtgcctcggctctgggaggcgacgaacggcgcggtggaactcggtggcgtcgacgtgcgcgcgctcccgctcgaccagctgctctcccacctctcgatggtgttccaggacgtcttcctcttccacggcaccgttcgcgagaacctgcgtctcgctcggcccgatgccaccgatgcgcaagtcgatgccgcgtgtcgcgccgcgcgtgcgtacgacttcatccaggcgcttcccgggaagtacgacacgctgctcggtgagcgcggcgcccgcctctccgggggcgagaagcaacgcctgtccatcgcgcgggcgctcctcaaggacgccccggtgctgctgctcgacgaggcgacggctttcgccgaccccgagaacgaggcgcgcatccaagaagcgctgtccgcgctatgcgcggggcggacggtgctcgtcgtcgcgcaccggctttcgaccatcgccaccgcggaccacatcgtcgtcctcgacggcgggcgcgtgaatgaccaggggacgcacgacgaattgctcgcgcgctgcgcgttgtaccagcaactctggcgcagccacaccgaagcgctcgactggtcactgggcgatccgggcactcctgacgttcagaaggaggtggtgtgatgctcagggaactcttcatgctcggcgagcggctcgcgggccgaaaggacgcacgggtccggcgcggccttctcttcgcctttgccgaggcactcgcgggcgccgcgccctacacactggtcctcttcttcgttcgtgaagcgctcgagcaccggctctcgatgcacctgacgtggtggctcaccggcggcatcgcgctctcggtgctgctgcgcctggcgttctcgatcagagcgatgtccaacatcttcgtcgccgcgcacgcgctcatggggcaagcgcgcatccgcaccgccgaccacctgcggcgcctgcccatggggttcttcacgcagcgaaggagcggtgaactggcaggcgtgctcaccaccgatgtcgcgcttgtcgaagacgtgtggtcgcacaccatcggcatcttcacggcgagcttcgcactgccgatgctcgtcggtctcggcctctgtttcctcgattggcgcctggggctcgtcatcctcgccgccctaccggtggcgctcctcgtgctggccgcgaccacgcccctcttcgtgcgtgagttcgaagccgtgctcgaggcctcggcggatgtcaacgcccgcgtcgtcgaatacgtgcagggcatcgccgtgcttcgggcgttcggccggcacggcgaggtctaccagcgcttcgtgaaagcaatggagcgcctgcgcgacgccctcattcgcgccgatgtcttgccctccccgctgctcgccgtgttcggcttcgtcgtcgagatgagctttgtcgcggtggcgtacgcaggaagcaccctggcgttgcgcggttcgattcagcccggggtgctgctcgtcttcctcatcgtgacggttggggtcgttcgccaggtcgcggatctcggagtggctctgctcatgcttcgagcgtctcagcgcgcgctcggtcgcgttgatcggctactcgcggagaagccgctcccggaaccgtccgtaagagcggcgtcgatccagaagttcgacgtggaggtcgacacagtgtccttcgcgtacgaagacgcgaccgtgctcgacggcgtctcggtgacgttccccgagcgctcgctgaccgcgctcgtcggtgcctcgggctcaggcaagtcgacgctggtccacctcgtggcgcggctgtgggacattccgcgccagggtgccatccgcatcggcggtgtcgatatccgggacattccgttcgaggaactgcaccagcacctcgcgatggtgttccaggacgtcgtcctcttctccgggaccatcctcgacaacctgcgcgttggacggcccgacgcctcgctcgaggaagtccagcgggcagcgcgggcagcgcgcgcccacgacttcatcaccgccttgccgaacggctacgacaccctgcttggggaaggaggaggaaccctctcggggggtgagcgtcagcgcttgtccatcgcccgtgccatcctcaaggacgcccccattgtgcttctcgacgaggccactgcctccgtcgacgcgtcggcggaggctgaaatccagcgcgccatcgacgaactggtcaggaagaagaccgtcgtcgtgatcgcacatcggctgcgcaccgtgcggcgggcgcaccgcatcatcgtgctcgacaaggggcgcgtcgcggagtcaggcacgcacgtcgaattgctagcgaagcgcggcgtctacgcagcgctctgg

SEQ ID NO: 43188 - DNA, 741 bp, Myxococcus xanthus
cccttcgcggggaaggtcgcgttcgttacgggctctgggaaggggattggcaaggtcatcgcggctcgcctggccggctcgggggcgacggtggtggtgaactcgttccactcccgtgacgaaggagagcggacggttcaggagattgttgacgcaggagggaaggcgttccacgcctggggctcagtcgcgcaggaagagcacctggaccggatgttcgccagcatcgaggcgcagttcggcgggttggacttcctggtgtgcaacgcgtccaacggcctcatcggaccgttcgaccggattactccgcgcgactgggacaaggcgttccgcacctgcatcacggggacctatgagtgcgccatgcgcgcgcggcccctgatggcccggcgtggcggcggaagcatcgtgacgatgtccacctccatgtcccagcggtacatgcacgacctcggctgtcagggcgtggtgaaggccggggtggagtccttgacacgctacctggccgcggagctggcaccggatggcatccggaccaactgcgtgtccgcgggaccggtgcatggcgagctgctgcgcatgttccccgacgccgcgagccgggtcgcgcgctgggagtcggcgacgccgggcggggaaatctgcactgccgaggatgtcgccgacgtcaccgagctcctcctggggcccaagacgcgccgggtaaacggcgccatctgggtggtggatgcggggctctcc

SEQ ID NO: 43189 - DNA, 1563 bp, Myxococcus xanthus
gccatcctggccattgacctcgggacgtccgccgtcaaggtggcggccgtcacgctgaggggacggattctgggcggtgacgtggagccgctggagctggccctgctcccggatgggggcgccgagcagcagccggaggcgtggtggcgcgccatcgtcctggcgacgcggcgcctgctggcctctggggccgtgcgcgcggaggacgtcatcggcgtcaactgcagctcgcagtggtccggcaccgtcgcggtggacgcgtccggcacgcccgtgtgccccgcgctcatctggatggactcacgcggcgcgccggacgtgaagcgcgcggtgggcggcttcctctccgtggagggctacgacgtccgccgcctgatgacgtggattcgcctgtcgggcggagtgcccagcctgtcgggcaaggacccggtgggccacatcctctacctgcggcgcgagcgcccggacgtgtaccggcggacgtacaagttcctggagccgaaggactggctcaacctgaagctgagtggccgctgcgccgcctcgtatgactccatcaccctgcactgggtgacggacaaccgcgcgctgggccgcatcgcctatgacgaccggctgctgaagatggcggggctcgagcgggagaagctcccggacctggtccccgcctccacggtgctggggccgctccaggcgcaggccgcgagcgagctgggcctgcgcgaggacgttcaggtggtgacgggcgcgccggacatcctcgccgccgccgtggggtctggcgcggtgggagacttcgagccccacctgtgcgtagggacctcgtcgtggctgtgctgccacgtgccctacaagaagacggacctcttccaccagatggcgtccgtgccgtccgccctgcccgggcgctacctgctggccaacgaacaggagtccgccggcatctgcctcaccttcctcaaggacaacatcctgtatggccgggatgcgggggcgggcacggacggtgacgcgccggacctctaccgggtgatggaggcgcaggcgggcaacgtccccgcgggcagcgaccagctcatcttcctgccctggctcaacggcgagcgcagcccggtggacgacaagtcactgcgcggcggcttcttcaaccagtccctgaagacgacgcgggcgcatatggtccgggcggtgatggagggcgtggcctacaactcgcgctggctcttcacctatgtggagcagttcgtgggccggcggttggactcgctgcgaatcatcggcggcggggcacgctccgcgctgtggtgccagattcacgcggacgtgctgggccgcgcggtgcagcaggtggatgagccggtgctcgccaacgcacgaggcgccgcgttccaggccgcggtggcgctggggcggctgacggtggaggagattccctcgctcgtgccggtcgcccgcacctttcatccggattcgaagaacgcggcgctctacgacgagctgtttcgcgagttcgtcaacatctacaaacacaacaaggccatcttcgcgcggctcaatcgagcg

SEQ ID NO: 43190 - DNA, 1134 bp, Myxococcus xanthus
ttcgagttcgccaccgccacccgcgtcgtcttcggcccgggccgcctggccgaggcacccgaaatcattcgcggcctcgggggctcccgggtgctgctcgtcaccggcgcgaatccctcccgcgcacggcccctccacgacgcattggagcgcctgggcctgggggtgactgtcttctccgtggacggcgagcccaccgtggagcgtgctcgtgaaggcaccgcgcgcgtcgcggaagcgggctgtgatgtggtggtggccctgggcggaggcagcgcgttggacgcgggcaaggccattgcagcgctcgccgccaacgggggcgacccgctggactacctggaagtcattggccggggccagccgctcacccgcccgtccctgcccttcatggccatccccaccacggccggcacgggctccgaggtgacgcgcaacgcggtgctgggctcgaaggacgcgaaggcgaaggccagcctgcgcagtccacacatgctgccgcgcgtggcgctggtggacccggacctgctcacgggggcaccggccgccgtgcttgcatccagtggcatggacgcgctgtcgcagctcatcgagccctacctctccgcgcgcgccaacccgctgacggacgcgctggcacgcgagggcctgcgaaggtcggcccgctcgctgcggcgcgcggtgctggacggtccggatgcgcccgcccgcgaggacctggccctggccagtctcttcggcggtctgtgtctggccaatgcgggcctgggcgcggtgcacggcttcgccgcgcccctgggtggcatgttcgacgcgccccacggcgcggtgtgcgcggcattgctgccagcggtgttggacgtcaacctgcgcgcgctgcgggcccgtgcgccaacgcatccatcactgccccgggtgcaggagttggcggcgctgctgacggggcgggtggatgcaagggccgaggacgccgtcacgtgggtggacgaacttcgcgcggcgctgggcgtaccggggctgggacgctacgggctgacggaggcccaggtaccagcgctggtggcgaaggccaaggaggccagcagcatgaaggccaaccccctggtgctcaccgacgcagagctggcggaaatc

SEQ ID NO: 43191 - DNA, 1065 bp, Myxococcus xanthus
atgaaggccgtggccgtcttcccccagaagcgcgaggtgcgtgtcatcaccgacgcccccgagccccgcatccagtcccccacgcaggtgaaggtgcggacgcgggaaatcggggtgtgtggcacggacaaggaaatcatcgagttcgtctacggctccccgccgccgggctcggaccacctcatcctgggccacgagtgtctgggcgaggtggtggaggtgggcgaggccgtccggggtctgagccgcggggactgggtggtgccccgcgtgcgccggccgtgcccgcatgccacctgtccgccgtgccgcgggggccatccggacttctgcatcaccggcgattacaccgagcggggaatcaagggcgcccacggcttcggcgccgagtccttcgtggaggacgtggcctacctgcaccgggtgcccgcggagctgcgcgaggtggcggtgctcaccgagccgctcaccatcgcggagaaggccctccgccaactggagcgcttccaggaccggctgccctggagggcgggcccgggccgcgcggtggtgctgggtgcggggccggtggggttgctgggcgccatggcgctggcccgccggggttatgccaccacggtgtattcgcgcagccccaagcccaacgtgaaggccgaggcatcggaggcgatgggggtgccctacatctcctcgaaggaggtgcggccagaggagctggtccgcagggtcggcgccgcggacgtcatctacgaggccgcgggcgtggcgaaggcggcgctggagacgctgaaggcgctgggccccaacggcgtctgcatcctcacgggtgtgccgtcgaaggaggagcccttcgacgtgtcaccggtgctcaaggacgtggtgctgggcaaccaggtgctggtgggcacggtgaacgcggcggatgtcgacttcgacatggcgctggaggacttgcggcacttccaggcccgctggcccggggggctggagcggctcatctgcgccaggcactcgcccgaggacttctgcgacgtcgtcactggcaagaagtccggcggcatcaag

SEQ ID NO: 43192 - DNA, 1800 bp, Myxococcus xanthus
aaccactacgtccccaacctgcgcgatatcgaattcaacctcttcgagttcctcgatatcggccaagcctcgctgggccacgcaccctttggcgacctggacgagacggccgcacgccagatgctccagatgttcgcccagctcagcaccaacgagctggcccagagcttcgaagagccggagcacaacccgccgaagctcgagaatggcgaggtgacgctgccgcccggactgaagaaggcgatgaacgccttcttcgacgcgggcatgcacctgctggagcagccgccacacctgggcggcctgggcgcgccgccctccctgggctgggccgcgttcgagctgctggtgggcgccaatgcctcgctggccttctacacgctgggcaacctgctggcgcgcatcatcgaccggctgggcacggacgcgcagaagcagcgcttcctgccgcacatgctggaccgccgctggggtggctccatggtgctcaccgagcccgacgccggcagtgacgtgggcgccgcccgcaccaaggcccgccgcgtctccgacgacgtctgggaaatcgaaggggtgaagcgcttcatcaccaacggcgactcggacatgtccgagaacatcatccacatggtgctcgcgcgtccggagggcgcggcgcctggcaccaagggcctgtcgctgttcgtcgtgcccaagtactgggtgaatgaggacggcagcctgggtgaagccaacggcgtggtgtgcaccaagctggagaagaagatggggctcaagggctccgtcacctgtgagatgaccttcggcgacgggaagccctgtcgcggcctgctgctgggcgaggtccacgacggcatccggcagatgttctacatcatcgagcaggcccgcatggcggtgggcgtgaagtccatggccacgctgtccgccggctacggccgcgcgctggccttctccaaggaccgcctccagggcgcggacctgatgcaggcccgggacaagacggcgccccgcgtgcccatcttccgtcaccccgacgtgcgccgcatgctgatggcgcagaaggcccacgcggagggcatgcgcgcgctgtgcctctacaccgcgttcatccaggacggcgtggagcgcaagggcggccaccgcgccaccgaggcgggcgagctggacacgctcaacgacatgctgctgccgctggtgaagggctactgctcggagaaggcctacgagctgctggcgctgtcgctccaggtccacggcggctccggctacctgcaggactacccggtggagcagtacatccgggaccagaaaatcgacacgctctacgagggcaccacgcacatccaggcgctcgacttgctcatgcgcaaggtggcgcgtgacggcggcgcgacgctccagggcctgctgtcccagattcgcgagacggccgagcgcaccggagagggcaaggagttggaggccgagcgcgccgcgctgggccgcgcgctgggcgacttggagacgatgctcggcacgctgatgggcaagctgggcgagtccatctatcacgtgggcctgcagggcaaccgcgtgctggccgccgtcgcggaggtcgtcatcggctggctgctggtgcgccacgcggaggtcgcgctggagcgcatgaagagcaaccccggggaccgcgccttctacgtgggcaagctcgccagcgcccgctggttctgccacgaggtgctacccggcgtcgcccacgccgcccgcatggtggagcacggcaacctggacctgatggaggtgccggaagagtcgttc

SEQ ID NO: 43193 - DNA, 1191 bp, Myxococcus xanthus
ctgaagctcgaccgctccaaccagctcctcgccgaggcgcggcggctggtccccggcgtcacgcagtccatgatgaagcgcccggagatgttcgcgctcggcgccttccccgtgttcctggccaagggcaagggcgcgctggtggaggacgtggacggccaggagtacatcgacttcatcggcggcctgggcgccaacatgctgggccacaatgacccagccgtggtgaacgccatccgggagcacctggaggaaggggtcctccactcgctgcccacgcccgtggaggtctccgccgcccagacgctggtggacctcatccccggcgcggagatggcgcgcttcttcaagacgggcgcggatgccacgtccgccgccgtgcgcctggcgcgccacatcaccggcaagcagaagatcatcaccgtcggctacaacggctggcacgaccacttcatgttcgacacgccgggcgtcccggccgcgctggcggcgctgacccttcggatgccgctcttcacgcccccggacgaaccggccctgctggccagcatcgagaagaacgccagcgagctcgccctggtgctgttgtcggtgccctacaaccggcccctcaccccggccttcctgcaacaggtgcgcgccacgtgcaccgcgaacaacgtcctgttcgccctggacgaagtcgtcaccggcttccggctcgccgtgggcggcgcccaggagttcttcgacgtccgcgcggacttcgtcacgctgtccaagagcatcgctggcggcatgccgctgtcggccatcgccggtccggcgaagcacctgagccgcctgagcgagctccaggtgtccaccaccttcggcggtgagctgctgtcgctgtacgtgtgcgacgcggtgctgaagggctaccgggatggcgcctacatccagcacctggcccacctgggccgcaagctgcgcgagggcgtcaacgcccaggcggaggccgcgggctcatcgttgcgcgtgattggctacgacgcgattcccttcttcctgttcgccaaggacccgacggagcacgcgaagcagatgcagcccttccaggcgggcatggcccgccggggcatcctgctgcgccgcgacgtcaccttcctcagcacggcgcacacggaggagcagattgactacgccatcgagatgacgggcgaagtcctc

SEQ ID NO: 43194 - DNA, 1032 bp, Myxococcus xanthus
ggctatgccgcccaggacgccaagtcccccctcgccccgttccagttcgagcgccgcgagcccggccccagcgacgtgcagattgaaatcctctactgcggcgtctgccactccgacctgcaccaggtgcgcgacgaatggggcggctcccggttccccatggtcccaggccacgaaatcatcggccgcgtggtccgcgtgggggaccaggtgaagaaggtcaaggtcggggacatggccggcgtcggctgcatggtcgactcctgccgcacctgccccagttgccaggagggcctggagcagtactgcgagaagggcaacgtccagacgtacaacggcaaggagaaggacgggcagacagcgacccagggcggctacagcgaggccatcgtcgtggacgaggccttcacgctgaagattccggagaacctggacccggccgccgccgcgccgctgctgtgcgccggcatcaccacatactcgccgctgcggcactggaaggtgcagccgggtcagcgcgtgggcgtggtgggcctgggcggactgggccacatgggcgtgaagctggccaaggccatgggcgcccacgtcaccgtcttcagccacaccgacagcaagaagcaggacgccacgcgcctgggcgccgacgccgtcgtggtctcctcgaacaaggaggagatggccgcgcagacgggtgggttcgacttcatcctcgacaccgtctccgcgcagcacgacatcaacgcgtacctgcggctgctgcgacgggacgggcacctggtcctcgtcggcgccccggagaagcctctcgacgtccgccccttctccctcatccccacgcggcggagcttctcgggctcgatgattgggggtatccaggaaacgcaggaaatgctagacttctgcggcaagcacaacatcgtctccgacatcgagctgatttccatccagcaggtgaacgacgcctacgagcggctgctgaagggagacgtgaagtaccggttcgtcatcgacctcgcgagtctgcggaag

SEQ ID NO: 43195 - DNA, 564 bp, Myxococcus xanthus
ctcaaccatgcccagcgagagctgacgctcaagatcgtctactacgggcccggcctcagcgggaagacgaccaatctgcgtcatctccacgcgaaggcgtctccggaggtgcgggggcggttgctgaccgtggagacccacgacgaccgcacgctcttcttcgacctgctgcccgtcttcttctccacgtcctccggcttcaaggtgaaggtgaagctcttcaccgtgccgggccaggtcatccacaacgccacccggcgcatcgtcctgcagggcgcggacgcggtggtcttcatcgcggacagccgccgcagcgccacggcggacaacaacgcctattggcgcaacctccaggagaacatgaaggagaacaacctggaccccagccaggtcccggtggtcatccagttcaacaagaaggacctgccggacgcgcgcacggatgccgaaatcgaggagtcgcgccggcgaggcggcgaggcggtggtgggcgcggtggcgctgcggggcgaaggcgtactggagaccttccacgcggtggcgcaggcagcctaccggcggctc

SEQ ID NO: 43196 - DNA, 1305 bp, Myxococcus xanthus
tcacaggtgcgccttccgccggggccccagggccacttcattgctggcaacctggtggagttctccgaggacccgctggggttcctcacccgctgcgccagggagtacggcgacgtggtgcgcctggggaagcgcaacttcctcctcaatcacccggacctgattgaacgcgtcctggtcaacggcgacggcaactttgtgaagctcgccggagtgggccaaggcaagcgtcacaaaggcggctttcccgaagcgatgatgaacagcgagggcgaggactggctgcgcaagcggcgcctcgtccagcccgcgttccatcgcaagcacgtggccgcgtgtggtgacaccgtggtggccctcaccgaaacgatgctccagacgtggcgcccgggcgacgcgcgggacgtgcacgcggacgtgtccgcgctggcgctcgacatcgtcagccgattcctcttccacacgcccatcgacgacgaggcccgccacgtggccgacgccgtggacgctgtcatgcggcacaccgacagccccctgcggccgcccatctgggtgcccacgcccaccaacctccgcctgcgccgcgccctgggccggctcaacacgctgctcgcgacgctcgtgcgccgctatcgggagcaaccggagtcgcgcacggacctgctcgccctgctgctgtccgctccggtccccctctccgagaatcaactgcgcgatgagctggcgacgatgatcatgtccgggcacgagacgacggcggacgcgctcgtgtgggcctggtacctgctggcccagcacccggaggccgaggcccggctggtggcggagctggagacggtgctcgggggccggctccctggcgccgaggaccttcctcgcctgcgctacacggaggcggtggtgaaggaggccatgcgcctgtactcaccggcgtggatcaccagccgggaggcgctgcgcgactgtgagctcggcgggttccacgtcccagcgggaacgatgctggcggtgagccagtgggtcacccaccgcgacgcgcgctacttcgacgcccccgagtccttccgtccagaccgctggctgtccgaggacgcccaacgcatgcaccggtacgtctacttcccgttcggcggcggcccccggttctgcatcggctcggcgctggcgatgatggagacggtgctcatcaccgcgtgcgtggcacggcggttccggctggagctggcaccgggctgcgtggtgcggccccggccggcgctcgcgctccagccgctcggggtctggctgattccgcggcatcgctct

SEQ ID NO: 43197 - DNA, 825 bp, Myxococcus xanthus
attgtgggaggggtcgaggcacgtcctgggagtcatccgtggattgtcagcctgcagcaatacaacgatcacttctgcggtggttctctcatcagggttggcaacaaggaggagagcgatatcgtggtcacggctgcccattgcgtctacgacggaacatccggattgactgtcgtcgctggggctcatgatttcaatcgcccgtcgtcctcgcagcaggctgtcgtcgcgagaaagactgtctaccatccagagtacaacccggatacgacggcgaacgatgtcgcggttgtcgtgctcgacaagcccatcaagttcacctccacggtacagcctgtgtgtctcccggaggattcgttctcggtgagcggtgcttcgtgcggcaagagcagtgttgtcatgcgccccaacctggtcgcgaagtccccgttggctgaaacgtcgctcagccctgtggggctctcgtcggtgggtgcggatgtcccggatggtacgatgatggtgaccgcaggatggggtcttatcagggaggggggatacgatacatcctccatcttgatgcaggtgtgggttcccaccgtgaactctgagaccctgaagactgcgtacaagaaagaaggcatcaccatcgatcccaatgtaatgctcggggctgggtacatgtcaggggggaaggatagctgccagggggacagcggagggccgttggtcgctcaggtcggtggccgatacgtgctctacggaatcacgagcttcggcgtgggctgcgcgaggccgggcttccctggtgtctatgcccgggtctctgagttccgttcctggatc

SEQ ID NO: 43198 - DNA, 1500 bp, Myxococcus xanthus
cccctgctgacgttcgagcaggagcgcttcacctacggacagttcgccacgcacgtcacggccttcgcccggggcctcaagcagcgcgggctccagccgggggagcgggtggcgctcttcctggagaacagcgcccgcttcgccatcacctacctgggtgtgcaggccgcgggcggcgtggtggtgctggtcaacaccgcctaccggcaggtggagctggcccacatcctgtccgacgcggaagtctgcggctgcgtcaccggcgcggcgggcgccgcggagctggtgccgctgcgggcccaactgccctcgctccagtggttcatcaccggggagcgccccaccaccgcgctgcccgagtcgctcacggaggtccccttcgacacgctgctcgcggagggcacctccgccaccgcgccgctggtgatgccgcgtccggaggacctggcggtgctgggctacacctctggcaccaccggccgctccaagggcgccatgctgctgcaccgcaacctgctggccaacgtgcgggccgtcaccgaggcgtggcggtggacggagcaggaccggctgctgctcaccctgccgctgttccacacccacggcctgatggtgggcctgcacggcacgctgttcaccggcgccagcgcggacctgcgccgccgcttcaacgccgccgagtccctgaccgcgctgcgcgatgacgcctcgcttacgatgttcttcggcgtgcccaccatgtacagccgcctgctggaggaagcccgcgcgtcacgtgtgaagccgcgcgcgctgcgcctgtgggtgtccggctcggcgccgctcagtccccagctcttcgcggacatcgaagcggagctgggcgcccgcatcctggagcgctacgggatgacggagaccatcatgaacaccaccaacccctacgagggcgagcgccgctccggaacggtgggcttcccctaccccggccaggaggcccgcgtggtggacgtgcgcacgcgccaacctcaaccgtgcggtgagacgggggaaatcgaggtccggggccctcacgtcttcgccggatactggcgccgtcaggacgccaccgccgagtccttcgacgcggacgggtggttccgcacgggcgacctgggggatgtggacgcggacggctacctgcgcatcaccgggcgggcgcgcgagctcatcatcagcggcggcttcaacgtgtacccgcgcgaggtggaggaggtgctcgccatgcacccgggcgtcgcggaggtcgcggtgctgggcctgccggacgcggacctgggcgagcaggtggtggccgtggtggtgcctcaccccggggcgaccccgccggagtcccagtccctggtggactggtgcaaggaccggctcgccagcttcaagaagccgcgccaggtcgtcttcacggatgcgctgccgcgcaatgcgttgggcaaggtgcagaagcacctcctccgggcggcactggtgccacctggcacgcga

SEQ ID NO: 43199 - DNA, 1533 bp, Myxococcus xanthus
atggcgccgacgtacgacgcgctggtcattggcaccggctttgggggagcggtggcggcttgccggctggcacaggcgggcttgaccgtgcgcgtcctggagcggggcctgcgctaccagaaggggagctttccccgcgactggagcaacccgctcaacggctggctgtggcggtacgaccagggcctcttcgacgtgaagctgctgccggggatgagcattgtccaggccgcgggctacggcggcggctcgctcatctacgccaacgtccacctgcgcccgcccgcggagaccttcgacgccgactggccggagggctacagccgcgccgcgttggatccgtactacgacctggtcgcgtacatgctggacctccagcccatcaccgcgtccgcacgtggcctgcccaccaaggcgaagcggatgcgggaggtcgcgcgcaaactcggccgcgagcagcagttcttctacccggaccttgccgtgcgcttcgcccccgccggcgagccgatgcccaacaagttcggcgtcgcccaggagggctgcaactactgcggcgaatgcgacatcggatgcaacgtccgcgcgaagaacacgctggacctgaactacctggccgtcgctgaacagcagggcgcggagatgaccacccaggcggaggccacgcgcatcgagccgctgtctcccatgggctatcgcgtcacctataccgaccatgccgcgggcggcgccgagcgcaccgtggaggcccgccgcgtgttcctgtgcgccggcacggtgaacaccacggagctgctgctgcgctgccgcgaccagtggggaacgctcccgcgcatcagcgaccggctggggtgccgctattcggccaacggcgacttcctggccttcgccttcgagacgcgcgaggtgtgggacccgtccgagggccccaccatcaccaccagtctggtggtggaccaggggcagggcgcggacaagacgtggttcctcttccaggagggcgggcaccccgggaaggcggcggggctgcttcaggtgctggacatgggccgggacttccgtgtccccgcggacctgctccagaagcaactcgtccgcgccctgcgccggcgctcccagcctgaaaccgtcatgggcaaggagcgcgggcgtttccaggccgtgttcctggccatggggagggatcgcgccaacgggcggctcgcgctgcggcctttgactcgggacatggaggtgcgctgggacgtgccttccaacctgccgctgtaccggacgcaggagcagatctgccaggacatcgctcgggcgctcggggcgcgcgccgtcttcaaccccctgtgggatcggcttcacatccccgtgtcagtccacaacctgggcggctgcaccatggcggaggagccggcctacggtgtgctgaacccggacggtgaggtgcacggccaccctgggctgtacgtgctggatggcgccgcgctgcccgcgagcaccggggtgaacccttcatccaccatcgccgcggtggcggagcgc

SEQ ID NO: 43200 - DNA, 1518 bp, Myxococcus xanthus
tacgacgtggtcgtcgtgggctccggctttgggggctccatcagcgcgctgcgcctggcccaggcaggcaagtccgtgctggtcctggagcgcggcaaacgttaccggcccggtgactttccccgggacgtgacgcgaacggacgaggtgctctggcgccatgccacgcggcgcaaggcgcagggcctctatgacgtgcgcttcctgtccggcatcggcacggtgacggccagcggcgtcggcggcggctcgctcatctacgccaacgtccacgtgcggccggacgccgaggtgttcgaggacccgcgctggccccggacgtaccgccgggactcgctggagccttacttcgacaaggtggcgcgggagctgcggttgaatccggtgccgccctcgattccgctgcgcaagcgtgacctcttccagcgcgcggcccggggcatggggcgcgagacattcgacccgcccgtggccgtggccttctcggagccgccgggaccgggccggcgcgtgtgccagctctgcgccgagtgcgagttcggctgccagcacggcgcgaagaacaccatggacctgacgtacctggcgcgggcggaggcgctgggggcgctggtcctggcccgcacgctcgtctcccacgtggagccggtgcgggatgggtaccgcgtgcactgccaggacctggtgtcgggggcgcggcacaccgtggagagctcgcgggtggtgttggccgcggggacgctgggcacggtggagatattgctgcgcagccgggacgtcgcgcggacgctgcctcgggtgagccggcggctgggccatggctattcgggcaacggggacttcctggcgtcgatgcagggcgcgcgcgaggacatccagccctgggtgggccccgacgtgtccaccgtgatgcgcttcaccgaccggcagccgcgcttcacgctggtgacggccacgttcaaccagcccgccacggaggtcctcgcgggcctggggcagccgaacctcggacggctccagggcctgggggcgccgctgtggacctgcctgggcccagccgttcacgcggcgctcaagaaggggctgatgagccggcccctgcgtgccgacgtggatgcggcccgcacgtccaacctgtttggcatcggccaggacaacgccaacggccggatgcacctcgatgacgggcagctcgacgtgtcgtgggacttcgccggggagaacgcggagttggtgcggcggatgacggacgcgatgcgggacctggcggcccagtacggtgccagcttcgcgccgctgatcacctggcagctcttcaagcggcctttcacggtgcattcgcttggcggtgcccatctggcggaagctcccgagcgcggcgtggtgtccaccgagggagaggtcttccactatcccgggctgcacgtggcggacggctccgtcatcccgacagccatcggcttccaccccgtgatgaccatcagcgcggtggccgagcgcatcgccgaggccgtggtg

SEQ ID NO: 43201 - DNA, 951 bp, Myxococcus xanthus
cccctgcatgagacgcggctgcccattcctcgccccggcccggaggagctgttgcttcgcgtgcgcgcctgcgcggtctgccgcaccgacctgcacgtcgtggacggtgagctgccgaagcccaagctgccgctggtcccaggccatgaaatcgtggccacggtggaggcggcgggcgagcgggcgacggccattcccgtgggcacgcgagtgggcgtcccctggctcggctggagctgcggccactgccgcttctgtctggccggccaggagaacctctgcgagcaggcacgcttcacggggtaccaactggatggtggctacgcggagttcacggtggcccaccagcgcttctgcttccccctgccgcccgagtacaccgacgtccacgccgcgccgttgatgtgcgcgggcctcatcggctttcgcagcctccgcatggcggggagggagcgtcgtctgttgggtttctacggcttcggcgccgcggcccacctgctcatccaggtcgcgcgccaccaaggccggcgtgtcttcgccttcacccggccgggggacgtggagggccaacggttcgcgcgggagctgggcgcggagtgggccggggattcggacaccgtgcctccggagcggctggacgcggccatcctcttcgcgccggtgggcgcgctggtgcccgccgcgctccgggcggtggacaaggccggcgtggtggtgtgcggcggcatccacatgagcgacatccccgcgttcccctatgcgctgctgtgggaggagcgggtggtgcgctcggtggcgaacctcacccgggcggatgcgctggacttcctcgcgctcgcgcccaaggtgccggtgcgcaccctggtgcaaaccttcccactgtccgccgccaacgacgccctcaccgcgctgaggcgaggccaggtgcacggcgcggcggtgctggaggtg

SEQ ID NO: 43202 - DNA, 1347 bp, Myxococcus xanthus
cgctccgctctcacccgacggcgggagcagctggcgaaagccctggggagcgcggccgcgctgctggcgtcgagccgcccccgtgctcgcaactacgccgccgaccagttcccttttcgggcgtcgagccacttcctctacctcttcaggctcgcgacgccggacggcgtgggtctgtatgacggccagggctggacgctgtacctgcccgagcccggtcccgacgacgcgctgtgggacggcgcggtgcccggcttcgctgaaatcgcggagcggacgggctgcaccgtgcgttcgcgcgccgagctgcccgcggcgctgaagggccgcgacgtggcggcgctgcccacgccggacctggagacgtgcctggacgtggccgcgctgctgggccgcgaggtgcgtcccggccacctggcggcggtggacgtgccgctggcggacgcgatgattgcgctgcggcttcgccatgacgacgccgcgcaggcgcagcttcgtcaggccgcggaagtcacggtgctggcccacatggcgggcatgcgcgccacgcggccgggcatcctggaggccgcggtgcgcgccgcgatggaggcggagttcgtctcgcgcgacgtgcggccggcgtatcagcccatcgtcaccgtgcacggcgaggtgctgcacaacctgcgctatgaccacacgctgcgcgagggagacctgctgctggcggacgtgggtggtgaaagcccggccggcttcgcctgtgacgtgacgcgcacgtggccggtgacgggccgcttcagcacgacgcagcgcgagctgtacgacgtcgtgctgcgcatgcagaaagccagcatcgacgcggtccagccggggacgcgctaccgcgacgtgcacctggccgcgcaccgggagatggcgcgaggcctggtggcgttgggcatcctccgtggggacccggaggagttggtggtggacggcgtcaccgcgctcttcttcccgcacggcgtgggccacctgctggggctggacgtgcatgacatggaggacctgggggaccgggcgggctatgcgccgggccgcacgcgctcgccggagttcggtcaccgctcgctgcggttggaccgcgatttggagcccggcatggcggtgacgattgagccgggcatgtaccaggtgcccgccatcctgtcggacgcgcggctcatggcgcgcgcgaaggacaggctccagcgcgacgtgctggcgcgctacgcggacgtgcgcggcatccgcatcgaggacgacgtgctcgtcacttcggatggcaacgaggtgcttaccgccgccatccccaaggaggcctcaaacatcgaggccgtcatg

SEQ ID NO: 43203 - DNA, 1806 bp, Myxococcus xanthus
atgggcaaggtgattggaatcgaccttgggacgaccaactcgtgcgtcgccgtcatggagggcggcgagccggtggtcatccccaacagcgaaggcagccggaccacgccttccatggtgggcttcactgactccggcgagcgcctggtggggcagattgccaagcggcaggccatcaccaacccggagaacaccgtcttcgcggcgaagcggctcatcggccgcaagttcgactcgcccgaaggcaagaaggccattggcgtgtcgcccttcaaggtggcctccagccccaacggcgacgcgtgggtggagattcgcggcaagggctacagcccgccggaggtctccgccatcgtcctgatgaagatgaagcagacggcggaggactatctcggtgagcaggtctccgaggcggtcatcaccgtccccgcctacttcaacgacagccagcgtcaggccaccaaggacgccggccgcatcgccgggctcagtgtcctgcgcatcatcaacgagcccaccgccgcggccctggcctacggcctggacaaggtgcaggacggtggcaccgagcgcatcgccgtctacgacctgggcggcggcaccttcgatatctccatcctggagctgaacgccggcgtgttcgaagtgaagagcaccaacggcgacacgttcctgggcggcgaggacttcgaccagcgcctcatcgactacctggccaagcgcttcgcggaatccaacaacgggctggacctgcgcaaggaccgcatggcgctgcagcgcctgaaggaagccgccgagcgcgccaagcacgagctgtccagcgcgcccgagacggaggtgaacctgccgttcatcaccgccgatgcctccggtcccaagcacctcacggagaccgtggaccgcgccaccttcgaggcgctggtgacggacctcatcgaccgcaccatcgagccgtgccggattgccctgaaggacgcgggcattcccgcgcagcagatcaaccaggtgctgctggtgggcggcatgacgcgcatgccgcgcgtgcagcagaaggtgaaggagttcttcggcagggagcctcacaagggcatcaacccggacgaggtcgtcgccgtgggcgcggccatccagggcggtgtgctcaagggcgaggtgaaggacgtcctcctgctggacgtgacgccgctgtcgctcggtgtcgagacggccggcggtgtcttcacgaaaatcatcgacaagaacaccaccatcccctgcaagaagagccaggtgttctccaccgccgtggacaaccagccgctggtgagcgtgcacgtgctccagggcgagcgtgagatggcggcggacaacaagacgctggcgcgcttcgaactggtgggcattcccccggcgccgcgcggcgtgccgcaaatcgaggtgtcgttcgacatcgacgccaacggcatcgtccacgtcagcgccaaggacctgggcaccggcaaggttcagcaggtgcgcgtggtgagcaactccggcctgtccgaggcggaaatccaggcgatgatttccgacgcccagtcgcacgcctccgacgacaagaagaagaaggagctggcggagctgcgcaacaacgccgacggcctcatctacacgacggagaagagcctggaggagtacgcgagcctcctgtcggagaaggaccgcgaggaaatcaaggcggacctggagcgcctcaaggaggtgctcaacacctccgacgcggcggtgctcaaggaatccttccagcgcctggaaggcagcgcctaccgcatcgcggacgccatctac

SEQ ID NO: 43204 - DNA, 1518 bp, Myxococcus xanthus
gtcctgctctgcatcctggatggttggggtattcgccaggagcgtgacaacaacgccatcgtcctggccggcacgccgcacctcgacaagctggcgagcccctaccccttcaccgagctgcagacggcgggtctggccgtgggcctgcccgaggggcagatgggcaactccgaggtgggccacaccaacatcggcgccgggcgaatcgtctaccaggacctggtgcgcatcaatcgcgccgcggagtccggagagctggcgcagaaccccgtgcttcgcgcggccctcgacggagtgaaggcggacggcaaggccctgcacctgctggggctggtgtcgcccggcggcgtccattcctccatggaccacctgttcgcgctgctcaaggccgcgaaggaacgcaacgtggcccatgtctacgtgcacgccttcctggacgggcgtgacacgccgccgcagagcgcgctgggctacgtggaggagctggagcgcttcctccatgagacgcacaccggccgcatcgccaccgtgaccgggcgcttctacgccatggaccgcgacaagcgctgggaccgggtgcaccaggcctacgaggcgctggtgttcggccgcgggcccaaggcgccggacgcgctgagcgccatccgtgcgtcctacgcggagaaggtcaccgacgagttcgtgaagcccacggtgctggccgccggtgacggcacgccggtgggccgcatccaggatggcgatgcggtgatcttcttcaacttccgcgcagaccgggcgcgggagctgacgcaggccctggcgttcccggagttcaaggagttcgaccggggcgggctgcggctggggcgctacgtgtgcatgacccagtacgacgagaccttcaagctgccggcgctcttcgagccggaccagccgcaggacatcttcccggagctgctgtcacgccaggggctgcgccagttccgcacggcggagacggagaagtacgcgcacgtcacgttcttcttcaacggcggccgcgaggtcgtctacgcgggcgaggaccggcacctggtgcccagcccgcgcgacgtgaagacgtacgacttgaagccggagatgtccgcctacgaagtcacggccgagttggtgaagcggctcgactccgggaagtacgacttcgcgctggtgaacttcgccaacccggacatggtgggccacagcgggcggctggacgcggcgatgaaggcggtgaaggcggtggatgaatgcctgggcgcgctgggcaaggcgtgcgagcgcaacggctgggtgctggccatctccgccgaccacggcaactgcgagcagatggtggacctggagacgggcgagccccacaccgcgcacacgctcaacccggtgcccttccacctcatccacccggacttccgcgggcagaagctgcgcccgggcatcctcgcggacatcgcgcccaccctgtgcaaggtgatgggattgccgcagtccaaggagatgaaccgccagggcctgctg

SEQ ID NO: 43205 - DNA, 1455 bp, Myxococcus xanthus
atgaagcgcacccgcgtcgcggtggtaggcggcggcatcggtggactgacggccgccgggctgttggcgaaggacgggcatgaggtgacgctgttcgagcggggcgcctcgctgggcggcaaggcccaggccgtcatcgtgaatggcatcaccctggacacggggcccacgttgctgacgctgccgcacctggtgcgtggcaccttccagcaactgggcgccgaggacctgctgccgcgcttcacggagctggagccgcagtgtgcctaccgcttcgaggacgggtgtgacttcacggcctacaaggacgtggagcggatggcggagagcgcggcgggtgtccgcccgggtgagcgcgacggcatccgcggcttctacacggaggccgcggccatctggcgggccgcgggcgagccatacctggaggcccccttcgagggcatggcgggcttcatgacgcgcgtggcgaagcgtggcgtgggggccgtcatggcggggatgaagatgggcacgctgcacgagctggcggcccggcacttcaagacggaccacctgcggcagtacgtgggccgcttcgccacgtacacgggcgcgtccccctacgaggccagcgcggccttcgcgctgattccccacatcgagcatgcctatggcgtgcaccacgtccgcggcggcatcggtgcgctggtggacgcgctggggcaggccgtgcgccggctgggcatgcgcatccacctggacacgcgggttcgcttcgagcgcacgcgcgagggctaccaggtgggcccgcaggagggcacggagcgcttcgacagtgtggtggtgaacgcggacccgctggagcggctcgctcgcgcggaggagccgctggcgctgtctggcttcgtgttgctgttggaggtggagggccgcatggctctaccgcaccacacggtgctcttcggcggtgactaccggcgcgagttcgacgagctgttcggcgggcagctcgcgtccgacccgacggtgtacttctgcaacccctccgccaccgacgagagcatggtgcctccgggccgcaccgggttgttcgtcatggtgaacgcgcccgcgctgcccgtggatgcgcgcggcgcggagcaggccacccgcgactgggaagcaggcgccgagcgcgtgaaggcgcagatgctggagcgcctgtgccggcactacccggcgctcaaggggcgcgtgcgtgtcatcggccagcgctcgccggtggacctggccgcgcagggcgctccgggcggctccatctacggcttcctgccgcacgggaagttcggccccttccgccgaccgcgcatccgcggcaacacgccgggcctgttcttcgcgggcggtggcacgcatccaggcggcggcgtgccgctggtgatgttgtccggtcgcttcgccgcggagctggcttcgcagcacctccggagggatgca

SEQ ID NO: 43206 - DNA, 1551 bp, Myxococcus xanthus
atgagtgcatcgacacagggcaggcgcatcgtggtggtgggcgcgggcgtgggcgggctggccgccgctgcccggctggcgcaccagggcttcgacgtccaggtcttcgagaagacgcagggaccgggtgggcgctgcaaccgattgcaggtggatggcttcacgtgggacctgggccccaccatcgtgctgatgccggaggtgttcgaggagaccttccgcgcggtgggccgccgcatcgaggactacctgacgctgctcaggtgcgacccgaactatcgggtccacttccgggacggttcggatgtcaccttcacgtcagagttgtgcgccatgggccgagagttggagcgcgtggagcccggcagttacgcgcgctacctcgccttcctggcccagggccgcgtccagtatcgaacgagcctggaccacctggtggggcgcaactacgcgggcctgcgtgactacctctcgccgcgcgtgctcgcgcgcatcttccaggtccgcgctcaccgccgaatgtacgcggacgtcagccgcttcttccaggacgagcggctgcgcgcggcgatgaccttccagacgatgtacctgggcgtgtcaccctacgcgtcgcccgcggtgtacggcctgctgcccttcaccgagctgggtgtgggcatctggttcccgaagggcggcctgtatgccattccccaggccctggagcggctggcgcgcgaggagggtgtgcgcttccactacggcgcgcccgtggagcgcatcctcaccgatggcggccggactcgaggcgtgcggctggagggcggcgaggtggtggaggcggacgcggtgctgtgcaacgcggacctgccctacgcgtacgagaagctgctggacccgaaggcgacgacgctcaagcgcaaggagaagctgcgctacacgtccagcggctacatgctctatctgggcatgaagcggcgctacccggagctcttgcaccacaacgtggtgttcggccgggactacaagggctccttcgacgacatcttcgagcgcttccgcgtgccagaggaccccagcttctacgtcaacgcgcccacgcgcaccgacgcgtccctggcgcccgagggcaaggatgcgctctatgtgctggtgcccgtgccgcaccagcacccggacctggactggaaggtggaggggccgaaggtgcgcgcgaagttcttcgcgcgcatggcggagctgggcttcccgtcgctggagtcggacatcgaggtggagcgcgtcttcaccccggatgactgggccggcaccttcaacctggcgcgtggcagcgccttcggtctgtcccagaacttcacgcagattggccccttccgtccgtccaaccaggacgcgcgggtgaagaacctcttcttcgtcggtgcttccacgcagccgggaacggggctgcccacggtgctcatctccgcgcggctggtgacggagcggctgatgacgtgggcccacgcgcagggcgtttcgttgtcgcctcggacggccgccgccacgccactggaaggggtggccgcg

SEQ ID NO: 43207 - DNA, 1083 bp, Myxococcus xanthus
atggcactcacgcttcccgatgcgcagccgccgacgggcctgcttcctctggagcaggcctggctgcaactggtccagacggaggtggagacctcgctggcggagttgttcgagctccccgacgaggccggcctggacgttcgttggacacaggcactgacgcaggcccgggcgtataccttgcggcccgccaagcggctccgccccgcgctggtgatggccggacactgcctggcgcgtgggagcgcggtggtgccctccgggttgtggcgcttcgccgcggggctggagctgctgcacaccttcctcctcatccatgacgacgtggcggatcaggcggagctgcggcggggcgccgcgcccctccaccggatgctggcgccaggacgcgcgggcgaggacctggccgtggtggtgggggaccacctcttcgcgcgcgccctggaggtcatgctgggctcggggctgacgtgcgtcgcgggcgtggtgcagtactacctgggcgtgtgccgtcacacggcggccgggcagtacctggacctggacctgggccgcgcgccgctggcggaggtgacgctcttccagacgctgcgcgtggcgcatctcaagacggcgcgctacggcttctgcgccccgctggtgtgcggggccatgctcggcggtgccagcagcggcttggtggaggagttggagcgcgtgggccgtcacgtcggtcttgcctaccagcttcgggacgatttgctgggcctttttggtgattcgaacgtcgctggcaaggccgctgacggcgacttcctccaaggcaagcgaacctttccagtgctggccgccttcgcgcgcgccaccgaggccgagcgcacggagctggaggcgctgtgggcgctgccggtggagcagaaggacgccgccgcgctggcgcgggcccgcgcgctggtggagtcctgcggaggccgggccgcgtgtgagcgcatggtggtgcgtgcctccagggccgcccgccgctcgttgcagtcgctgcccaatcccaacggtgtgagagagctgctcgacgcgctcatcgcccggctggcccaccgcgccgcc

SEQ ID NO: 43208 - DNA, 1122 bp, Myxococcus xanthus
ttcgactacatgaacctgacaaagcccatccgcctcgccctggcggagcgcggttataccaaccccacccctgtccaggcccgcgccttccggcccgccatcgagggaaaagacctcatcgttcgcagcaagacgggcaccggcaagacggccgcgttcggcctgcccctgctcgaaaagattcccgccgacgagcgccgcgtccgagcgctcatcctctgccccacccgcgagctggcccttcaggtggcggacgagctgaagatgctcgccaagcacaagggcctgaaaatcgcggccatctacggcggcgcctccatgaagcagcaggaggacgcgctggaggaaggcacccccatcatcgtcggcacgccgggacgcgtgttcgaccacatcaaccgcggcaacctgaagctcgacgcgtgtgaccacgccgtcctggatgaagcggatgagatgctgaaccagggcttctacgaggaagtcacgcgcatcctcgaccgccttcccaagacgcgccaggtgctgctcttcagcgccaccgtccccacggacatccagaacctcatcgcgcgctacacgacgaacgcggagacgctgctgctgtcgggcgacgtcttcacggtggagcacatccaccacatccgctacgacgtgtcggacgccttccccaagccgcgcaacctcatctacgtgctggagaaggaggagccgcagaacgccatcatcttctgcaacacgcgggatgacacggccctggtgacggcggtgctcaaccgcaacggcttcgacgcggagctgctcaatggcgacctgccgcagaaggagcgcgagcgggtcatgggcaaggtgaagcgcggcgaggtggccttcatggtcgccacggacatcgcggcgcgcggcatcgacatctccggcctggagtacgtcatcaactactcgctgccggaggacccggcggtgtacctgcaccgcgtgggccgcaccggccgcatcggcaacaagggcaccgccatcaacctcttctccgggcgcgagctggccacgtacacctcgctggagaagaagtacggcatcaagttcgacaagcgtgagatgccggccccggaagaggccatgcgc

SEQ ID NO: 43209 - DNA, 1224 bp, Myxococcus xanthus
atgagcgccgtcgagggtaccaactactacttccgcaaagccgcgcggatcatggacgtaggcacccccatcgaaacgctgctcgccacgccccttcgcgaggtgaaggtccaggtctccatcgagatggactccggagagattcgcaccttcctcggctaccggattcagcacgacaacagccgtggccccatgaagggcggcctgcgctaccacccgatgctggaccaggacgagtgcgcgtcgctcgcctcgctgatgacgtggaagacggccgtcgtgaatgtcccctatggcggcgccaagggcggcatcgcctgcgacccgtcccagctgagcatcaaggagctggagcgcctcacccggaagtacgtggaccaggtgcaggacgtcatcggccccacgcgcgacatcccggcccccgacgtcaacaccaacccccaggtgatggcgtggatcatggaccagtattcgcgctaccacggccactctcccgcggtggtgacgggcaagccgctggagctctacggctccaagggccgcgaggccgccaccggccgcgggctgctctacgtggcgcgtgaaatcctgcgcgacctgggcctgccggtgaagggcacgcgcttcgcgctccaaggcttcggcaacgtgggcggccacaccgcgcagctcctctgggaggacggcggcgtggtggtggccgtggcggacgcgctgggcggcgttcgcaacccgcagggcctggacatcccctccctcttcgagcacgtgaagcgcaccggcacggtgacgggcttcagcgggggcgcttcgtgcagcaacgatgacgtgctgggcgcggactgtgaggtcctcatccccgcggcgctgggccacgtgctcacccgggagaatgcccacgcggtgcgcgccaagctcatcatcgaaggcgccaacggccccacccagccggaggccgacgaaatcttcgagaagcgcggcatcttcgtggtgccagacgtgctcgccagcgcaggcggcgtgacggtgagctacttcgagtgggtgcagaacctccagcacctgtcgtgggaggaggaccgcgtcaacgcggagctggagaagtccatgaaggaggcctacgagcgcgtggcgcaggtggcgcgctcccggaaggtctccatgcggacggccgcgtacatcctggcgattggccgggtgggcaaggccaccgtgctgcgcggc

SEQ ID NO: 43210 - DNA, 1164 bp, Myxococcus xanthus
atctacttcctgtccggcaagcgcaccccgttcggtacctacgggggaagcctgaaggacctcagtgccaccgacctcgccgtggagtcggcgaaggccgcgctggcccaggcgaaggtgtctccggaagacgtccagcacgtcgtctacggcaacgtggtgcagaccagcgcggacgccatctacctgccgcgccacgtgggcctgcgcaccggcgtgcccgtccccgtgcccgcgctgggcgtcaaccggctgtgcggctccggcttccaggccttcatcacggcggcggagctgatgctcaccgagcaggccgccgtcgtgctggccggtggcaccgagtccatgagccaggccccccacgtcatccgcggcgcccgctggggcctgccactgggcaagggcagcctggaggacatgctgtggacggccctcaccgacagctacaccggccagccgatggcgctcaccgccgagcagctcgcggtggactactcgctcacgcaggaccaggtggacgagtacgccgtcctcacccagaagcgcttcgccgccgcgcaggaggcgggccgcttccaggatgaaatcgcccccgtcacgctgaagacgaagaagggggagacggtggtgtcccgggacgagcacaaccgcccggagacgtcggtggagagcctgcgcaagctgcccaaggtcttcaagaaggacggcgtggtgcacgcgggcgcggccagcggcatctgcgacggcgccggctccatggtgatggccaccggcagcttcgtgaagaagcacggcctgcagcccattggccggctcgtcaactggggcgtctccggctgcgacccgaaaatcatgggtatcggccccgcgccggccatccgccagctgctggagcgcgcccagtgtcagctgtcggacatcgacctcttcgaggtcaacgaggccttcgcgccgcagtacctggcggtggagaaggagctggggctgccccgcgagcgcaccaacgtcaacggtggcgccatcgccgtggggcacccgctgggggcttccggcgcgcgcatcaccaccacgctggtgtacgagctgaagcgtcgcggcgcccgctatggtatcgggtccgcctgcatcggtggcggccagggcatcgcggtgctcgtcgaggcg

SEQ ID NO: 43211 - DNA, 1632 bp, Myxococcus xanthus
atcaacgcccatacccgcgtcccgccgccgaagaacgagcctgtcctctcctatgcgcccggcaccaccgagcgccgggaggtgcaagccgagctgaagcgcatggctggtgagcagatcgacatccccgtcatcatcggcggcaagcacatccgcaccggcaagacggacacggtgcgcatgccgcacaaccaccagcacgtgctggccacactgcacgaggcggacgccagccacgcggagcaggccatccaggccgccctggccgtcaaggacgactgggcgcgcatgcccttccagtcgcgcgccgccatcttcctgcgcgccgcggagctgctggcctcgcgctaccgccccatcctcaacgccgccaccatgctggggcagggaaagacggcccaccaggcggagattgacgccgcgtgcgaggccatcgacttcattcgcttcaacgtgcacttcgccgagcagattctcggctggcagccggaggccgcgtaccagacgtggaacatgacggactaccgcccgctggacggcttcgtcttcgcggtggcgccgttcaacttcacggccattgccctcaacctggccaccgcgccggccatcatgggcaacgtggtgctcttcaagccgtcatccaccgcggccctgagcgcctggtacatcatggagctgctgcgcgaggcgggcctgcccgacggcgtcatcaacatgctcccgggtgatggccccacggtgggcaaccccgtgctggccagcccgcacctgggcggcatccacttcaccggctccacgccgacgttcaacgccatgtggcgcacggtgggcgagaacatctcccgctacaagcagtacccccgcatcgtcggcgagacgggcggcaaggacttcatcgtcgcccacccgtccgcggcggacgacctggaggcgctcgcggtggccatcgtccgtggcggcttcgagtaccagggccagaagtgctccgccgccagccgcgtcttcatccccgaatccctgtggcccaagctgaagccgcgcctccaggcgctcatcagcgagattcgcatgggcgacgtgtcggacttccgcaacttcatgggcgccgtcatcgacgagaagtccttcaagaaggtctcctcgtacatcgacctggccaagagcgacagcggggccagcatcgtggccggcggcgacgtggaccgaaagcagggctggttcgtgaagcccacgctggtgcagctcgacagccccacccaccgcatcctccgcgaggaaatcttcgcgccgctggtgggcctgcacgtctacccggatgcgaagtacgaggagacgctgcgcgaggtcgaccaggccgcgtcctacgccctcactggcgccgtgttcgcgcgcgaccggaaggccatcgacacggcgctgcgcgagctgcgccacgcggcgggcaacttctacatcaacgacaagcccaccggcgcggtcgtgggccagcaacccttcggcggtggccgcgcgtccggcaccaacgacaaggcgggctcgggcctcaacctggtgcggtggaccagcccccgcaccatcaaggagaccttcgtcccgcccgtgaaggtgccctaccccttcatggacaacgac

SEQ ID NO: 43212 - DNA, 5577 bp, Myxococcus xanthus
atgtcctcggacaagcagccgtccacggtggatgaccagtctgcgtcgttcgcggacgtcaccgcggacatccagcagaatgcgcagcccgtattcgaggaggcgcagccggaagccctgagcgttgcggaggatgacttctccgaagtggggtcggacaccccagcggtggccgccagcgccgaacccgagacctcgctggaggcatcgttcgccgacctgtcgatggaggtcgagtcggcaccggatgcgccggtggcgcccacgggcgatgccctggcctcgacggaagtggaggtcccctcctccgaggtcgagttgctggacggcaccgccgacagcgaacctgtccttgcccacgagcagtctcccgccccaatcgatgatgcgtgggcctccgcgccgctcgccgtcgagacggagcacatggacgtcgccgatgcgggcgacatcatcgacgttgccgccatggcggagccggaggcggcctcgcaggctgcggattccgaaatcgcgctcgattcctccgaaatggtcgaagcgtcggctgcggactccgcggatacgacggatgcgtgggacgcgggtgcgacgaccgacgtgacggctgatgccatggcgacggccgaccacggcgcgacagatttcatcgcggccagcgcgggcgatacgtacgaggcacagcccgccgagattgcactcgacaccgcggatgaggcttcggccgaagccgagcccaccgagattgcgctcgatgcagcccacgtgagcgatgcggcggttgagcacgcctcggagatggcgttcgacgcatctgcggggtccgagccgggcgccaattactcgcccgctgaaatcgcgctcgacgcgtccgatgtcgccgtgccggaggcctatcccgagacggccctcacggcgtctgacgccagcgatgccgcgacggcggaagcctaccccgcggcagacttcgcgacggcggaggcctatcccacgacggagttcgcgacggcggaggcctaccctgaggcagacttcgcgacggccgatgtcagcgatgcctcgacggcggaggcttatcccgaggtggcgctgactgcctccgaggcaagtgatacgaccgcagccgctcccgagttggcgctctcggcttcggatgtcatcgaaacgtctgctcccgagccggagctggccgccgcggatgccagcagcgaagtcgtcgccgaggcttccccctacggcagcgcagcagcctcgttcgaagagcccttcgccgagactgccttcagcgaaggcgatgcaaccgccgctggtgaaacgtacgccgaagcggtgctcgacgccgcagaggtcagcgacacggctgtgagcgagcacgctttcgcgacgtccgaaacgagcgagtcggccactgccgaggcgtatccggaagtggcgctcgacaccgccgatgtcagtgatgcggccacgatggagttggactcggtggagaccgctgccgaagccacctccgacacggcgctcgcatccagcgcatggggcagcacggacgcggccgaggagtttgccaccacggagtatgcggcctccgacgtcagcgaattggctgccatcgagactgcgcccgagacggctcacagcacctacgaccactcgagtgaggccttcgatgggaaggaggtcgtcctcgacgcgaccgagatgagcgagcccgaaatcgctctcgatacgtccgacgtcgccgaatcgccttccgcccagtcgccctccgaaatcacgctcgacgccacagacgtcgccgagtccgccccgattgagccggccgcggagatttccctggaggcctccgacgtcgccgagccgcagtcggctgaaatcgccctcgatggctcggaggtgagcgaagagtctcccgcgcagcagggaagcgtccccacgctggagctcaacgcggccgaggtgtcgtccgacgagccctcgctcgatgtcatcgatgtcgagtccgcgcccggacacgccggggacgaggcatcgttccaggccgctgacggcgggagcgagcagcccacgctcgaggttatcgaagtcggtacggaggccaccgcttcggaagtggacttcccgccggaggctgcgcccttcgcgtcgtcggatgtcccgtcgctcgagatccggccggtccaggtgggtccggacctccacgcggaaacgatcgaggtggcgggagatccgccgcagtcgtccgcgcgcacgccttccgccgaggagatgttcgacctgagcgggaaccccgaagaggccgtgcctctcgccgcggcgaacgagttcctggcccacggacacttcgcgccgaccgatgagcgcagtgtggcgatggcggagggtgacgcgggcgccatcgagctgcagcctgaatgggcttccacttccgagcagcccgctgcggaagcggctcagacggaatgggccacttccggtgagcaggccgctgccagcgatgcgtatgcaggctgggaggatcctgtttcggaaaccgtcgaactccaggcggagtgggcggagcctgtcaccgcttccgagtggacgacctccgaacaaacggcggctgccacgggccacgcggagtgggcggcttccgatacaggcatcgcctccgaggctggccaggccgagtgggccgactccaccaccgagctccagcccgaatgggttgcggccgaaggcgcggcagcccctgaagcccaacccgagtgggccacctccgcggagcaggcgcacaccgaggcgcaggcgcagtggaccgagaccgccgcgcaagctgccctcggcagcgagcagacagaatgggctgcgaacacgcccgaggcagcccaggccgactgggcttcgtcctccaccgagaccgcgcccggcgaaatccaagcggagtgggctgagccgatcgccgaggacggccaggcccagtgggccacggctgaagcgcccccaagcgacggctggaacacggcgtcgactgaagcagcgcccgtggaagtccaggccgagtgggccgagtcttctgaggcctcgcccactgaggttcaggccgatgggtcgacccctacgctcgacgcagcgccggtggaagtgcaagccgagtgggacgaccccgcccagcaggatggagctaccctgacggctgaacctgcggcgacggaggcccaggccgaatgggctgcgccagaaatcgctgacgccactacggatgcccaggcaggttggacgacgccgggcgccgacaccgctcagtcggaatggactgcctcttctgaaaacgggtgggcgaccgccgaggaagttcagaccgaatggactgcgcctgcgaccgaaaccgccgcgcagcccgagtgggctacgacgcctgcggctgaagcagcacgaaccgactgggccgctcccggtaccgaaaacgccgggcagcccgagtgggccacgcctgcgaccgaagccgtgcccggcgaaggtgctcagcctgagtgggcttcgcctgcgaccgaggaagtccaggccgagtgggccacgcctgcggccgaagccgccgcatcgtcggagtgggcttcgcctgcggccgagggcgcccaagccgagtgggccacgcctgccaccgaaaccgccgcatcgtcggagtgggcttcgcctgcgaccgaggaagtccaggccgagtgggccacgcctgcggccgaaaccgccgcatcgtcggagtgggcttcgcctgcagttgaagaggttcagggcgagtgggccacgcctgccaccgaagccgccgcatcgtcgcagtgggcttcgcctgcggcagaaggcgcccagtccgagtgggctacgcccgcgaccgaggccgcgcaggccggctgggccgcagcgcccgtggaagccgcgcagccggagtgggcttcgcctgcggcagaagaggctcagggcgaatgggcttcgcctgcgacggaagaggcgcaaggcgagtgggcgaatcctgctgccgaggaagctcaggccgaatgggtaacgcccgcggaaggcgctgcgccagcaccggagtgggcttcgcctgcgaccgaggaagtccaggccgagtgggccacgcccgaggaaggcactgctccagcaccggagtgggcttcgcccgcgacggaggatgtccaggccgagtgggcgaccgatgccgctgcaccggcgtcggaatgggcttcgcctgcgaccgaggaagtccaggctgagtgggccacgcctgccacggaaaccgcagcccagcctgagtgggcctcgcctgcgaccgaagccgcccagcctgtctgggccgcccccacggaaggcgcgcaggcagagtgggccgcccccgaggcagaagaagtccaggaagagtgggccgccgctccggcggagggcgctcagcaggggtgggcaacgcccacggaagccccccacgcagagtggtccacgcccgccaccgaggaagtccaggccgagtgggccgaccccatcgaggaagccgctccggccgccgaatgggcctcaacgagcgcgcctgccgcctcgcagtgggacacgcccgcggacaacgcccccgcggccgcggaatggtccgcgaccagccacgacaccagcgcgacctgggacgcccccgccaccaccgagtggtcgtcggagcagacggcgaactggaacgaagcatccgctgaagaggtctccctcgcggacacggccacgcctgcctccgcggagtggaatgacgcctccgtggacgtggagcccgtcatggaggaggccgagcccatcgaagcggcgtccgcgtgggaggccgagcccatcctggacagcgcccccgtgacgtcgcagtgggccgccgccagcacggacagccccttcggcgctcaggcgcaggacttcaccgaggccatgcccatcgaggaagaagaagtctcgatggagctcgagcaggaggtggccgaaatcgacgtcgaggaagaagccgtggtgccgccgcccgcccccatggccgccatccccgtcgtcgcgtcggcgcccgtgcacttcgcccaggcggcctcactggccaccgccgcgcaggcgcagcacaccgccgtcgtcatgccggccgcgcccgccaaccacgtcgccgtggagcgtgagccgctcttcgatgacaccgccatcgtcggaggcacggccctcacctccttcgtggaaggcgagcaccgcgtcatcatccacaccgtcgaaggccaggtgaagcgcggcaccatccgcgacgcggacctgctcgatgaggtcatctccctcgagcagcagagcggcttcgccgccgagcagattccgggcaagcgcgtgaaggccatcttcttcatgctcgccgccggtgcgcgtcagccgcaggtggagggacagaagattcgggtcaccttcaacgacggacgtcaggtcgcgggcttctcccaggacttccagggcagcacgccgggcttcttcgtcatccccgccgaccagcgcaccaacaccgcgcgcatcttcatctaccgctccagcgtgcaggcggtggccgagggctga

SEQ ID NO: 43213 - DNA, 1272 bp, Myxococcus xanthus
gctcacagtcaggctctcttcgctcgcgcgcaggctcgcatccccggcggagtgaattccccggtgcgcgccttccgaggcgttggcggcgaccctgtcttcttccgtgaaggcgcaggtgcctggctcacggatgtggacggcaaccgctacgttgacctcgtggggagctggggtccgcttatcctgggccacgcgtatccgcccatcttggacgccatcatcgacgccgcgcgccggggttcgtcctatggcgcgccgcatgcggatgaggtggagttcgcggagctcatctgcgccaccatgcccgcggtggagatggtgcgcctggtctccagtggcaccgaggccacggtggcggccatccgcgtcgcgcgaggcttcaccggccgcgagcacatcctcaagttcgaaggctgcttccacggcgcgggagacccgttcctggtgaaggcgggcagtggcgtggagacgctgggcctgccggactctccgggcgtgccgtcggcgctggcgaagctcacgctcaccgcgcccttcaacgacctggccgccgtggagcgcatcttcgcggagaatggccaggacatcgcttgcgccatcatcgagccggtggtgggcaacatgggcgtgctggtgccgaagccgggctatctcgaagggctgcaggcgctctgccagaagcacggcgtgctgctggtgctggacgaggtcatgacgggcttccggctgtcgcgaggcggcgcgcaggagctgtacggcctcaagccggacctcaccaccatggcgaaggtgattggcgggggcatgccgatgggcgcgtatggtggcccccgcgacatcatggagaaggtggctcccgcgggcccggtgtgccagtccggcacgctgtcggggaacccggtggcggtggcggcgggccttgcgtgcctcaaggccctggcggcccccggcacctacgcgcggctggaggaggtcagccgcatgttggaggtcggcttgctcgccgaggcgaaggccgcggacgtgcccgtcaccgtcaaccgcgtgggcagcatgctcacggtgttcttcaccggtgagcccgtctacgactacaccagcgcgaagaaggcggacacggcgcgcttcgggaagttcttccacgccatgctgaacgaaagcgtctacctgccgcccagccagttcgaggcggcgttcgtgtcgctggccattggcgagccggaagtcgcgcacgtcctcgcggcggcgagaaaggccttccgttcgctt

SEQ ID NO: 43214 - DNA, 1017 bp, Myxococcus xanthus
gctgctatgcgtgccaccgttctccacaagcccggcgacgtccgcttcgaggagcgcgccgagccgaagattctcgcgccgacggatgccatcatccgtctctcggctacatgtgtctgcggctcggacctatggccctaccgaggcgtgcaggcggtgactgagccgacgccgatggggcacgagtactgcggcatcgtcgaagaggtcggaagcgctgtcgcttcggtcaagccagggcagttcgtcatcggttcgttcttcgcctccgacaacacgtgccctcactgcaaggcgggttaccaaacgtcgtgccagcaccgagagccggtgagtggggctcaggcgccaaggatgcgagtgccgctcgccgacggcacgctggtcgtgacggccgaggtgccgcccgatgcgcttgtgcccagcctgctggccgtgtcggacgtgtttggtaccggttggttcgcagccgacgccgccaacgtgaatcccggctcgacagtcgtggtcgtcggcgacggtgccgtcgggctcctggcggtactctccgcgaagcagatgggagccgagcgcatcatcgcgatgagccgccatgagacgcgccaggcgctcgctcgtgagtttggtgccacggacattgtgtccgtgcgaggcgacgagggcgttgctcgcatcaaagaactgacccgggggattggtgccgattcggtgctggagtgcgtgggcacacaggagtccatgctccaggctatcggcgccgcgaggcccggaggcttcgtcagctacgtgggcgtgcctcatggcgtgagcctggacggcgagaagctctttttctcgcacgttcatctccacggtggccctgcgccggtacgtcggttcatgcctcaactgattgacctggtctggagcaggaaggtcaatcccgggaaagtcttcgacctcaccctgccgctcgagaaggtcgccgagggctatcgcgcgatggacgaaaggcgcgcaatcaaggcgctgcttcgc

SEQ ID NO: 43215 - DNA, 747 bp, Myxococcus xanthus
gacttcaaaggacaggtagcgctcgtcaccggcgctagctctggcatgggcctcgccaccgcgaaggccttcgccgcagccggcgcctccgtggtacttgcagatgtcaatacggcagcgctcacgtcggctgtcgacgccctgacatcggccggacattccgcgctcggtgtcacctgcgacgtgtccgacgaagcccaggtcgccgcgctggtccggcgagcagttgaggcctatggccggttggacatggccttcaacaacgccggcattcaggcaccgcccaccgatgcggcggatgagccttctgacctgttcgacagggtcaacggaatcaaccttcggggggtctgggcttgcatgaagcatgaactcaagcagatgcgtcagcaaggcagcggcgccatcgtgaactgctcgtcgctcggtggtctcgtcggcctgcctggtcgagcggcctatcacgcgtcgaagcacggagtcatcggcctgacgagaagcgctgcgttggagtacgcacctcgtggcatccgcatcaatgccatctgtccaggaaccatttctacgcccatggtcacggacatgctcgccaagggggaacttgatctcgccggggcgattgcgaatcagcccatcgggcgcctgggagaggctgaggagattgctgcctcggtgctctggctttgcagcccaggcgcaagtttcgttactggcgtggcacttccggtcgacggtggatacacggcg

SEQ ID NO: 43216 - DNA, 2013 bp, Myxococcus xanthus
tacaaactcacgattcggacgggcacgaagctcggcgcggggacggatgccgacatttccatcgtcctcgtgggcacgcgaggagagagcgccccccgcgtgctggacaagcacttccacaacgacttcgaggcgggcgcggaggacgtctacgccctctcctccgaggacctcggtgacctggtcctgttgcgcttcagcaacgcgggcggcgtggcggccgactggctgctcgactgggcaatcgtcacggccggagagaagcagtggcacttccctttctaccggtgggtgctgagtggcgccacggtcgacgtgctcgaggggaccgcgaagctcgctcgccaggcaagcagcgagcgcgagtccacggcgcggcgcgagctgctcgaggcccgccagcggatgtacccgtggcgcgcgcctgagatgaccgaggggcttcccggcgcgctcgacctccgtgaggggaggccgctgccgaaggacgagctctaccggggcctgacggagggcagctacgaagtggtcatcgcgaagacgctggcggccatcaagctgaacctgcccatgctgacccgcgcctggaacgggctggtggacatcttcgacttcttcaaacacctggaggtgccccagctcgcccagcgctggaaggacgacctcgagttcgcgcggcaggccgtccagggcatcgcccccctccacatcacgctcgtccccagtctgccgcagggcatgccgctcaccgacgacgacgtccggggcctcttgtcgcccggcaccacgctggccagggcgctcgacgccaagcgcatcttcctgatcgacttcgaaatcctcgacgacatcaggatgtaccggaaggtcggcgaggacggagtcgaggagcggcgctgggctcccgcggcgcgctgcctgctgtacctggatgaccagcgtcaactgcgacccctggccatccagctcgggcgggacgcccagaaggaccctgtcttcacgccgaacgacgacgcgtacgactggctcgccgcgaaaatctacctccggtgcagcgagggcaactcgcaccagatggtgtcgcacgcgctgcgcacacacttcgtggcggagccgttcgtcatggcgacgatgcgcaacctgccggacccgcaccccgtctacaaactgctgcggcggcacttccgctacacgctcgccatcaacgagggcgcacgcaagggcctgctcgacgcaggcggggtgttcgacgacttcatcgcgacaggcggccccgacaagggccacctccagttgggcaagaagggcttccagcgctggacgctggcggacaacaagccccgtgctgacctggagcggcggggcgtgctggaccctgccgtgctccccaactacccgtaccgggacgacgccctgcccttgtgggacgcgttcgaggagtacgtcggcggcgtcctcaggcacttctaccggaccgatgccgacctcgaggccgacaccgagatgcagcaatggtggaaggacctcaccgagcacgggctgcccgtggacaagctgccctgccgggagctgcgccgcgtcgacgacctggtcgacatcctcaccaccgtcctcttcacggtcagcgtgcagcacgcggcggtgaactacctgcaatacgagcactacgccttcgtaccgaatgcgcccctgagcatgcgccgggagccaccccgccagaaggggacgctgcgtgcagaggacatccccgagatgattcccaccaagtcccagatgctctggcaggtcgccatcggccgggcgctctccagcttcggagacgacgaggagtacctgctgcacgagggcggctggcgcgaggagtacttccacgaaccggagctggtggccatccgccagcggttccaggagcgcctgcgcgcccagcgcgaggcggtggaggcgcgcaacgcgggcgccgaggtgccctacaccatcctgcgtcccgaccggattccctgcggcatcaccgtc

SEQ ID NO: 43217 - DNA, 1093 bp, Myxococcus xanthus
gtcgtcggagccggtgccttcgttccttcacgcgtggtgagcaacgagcggatcgccagggccatcccggggtggccggcggagcgcatcgaggagaaggtcggcatccgcgagcgccgcttcctctgggacatcgacgaggccacgggccgggcgattccgccgcccgagaatgacgggcacatctacccggccagcaacacgaacatgtgcgaggtggcgctccagaaggcgctcgcccaggtgggtgtggatgccaaggagttggacgcgctcttcgtggtgacgtgtacgccgaacgcgccgcacttcaaccacagacgccatggagctgcaccggcggctggagctgcgcgaggacgcgttcgggctcgtggtggacgacggctgcggtggcacgccgtacgtgttggacatggtgaagaagatgatggaaggagggcgcttccgcacggtggcggtggtggcctctgccttcacgtctccgctggtgaaccgtgaggtctacacggacgagctgccgcccgggccgggccgctcgaagacgctgcagggctacctctccatgtatgtcttcggcgacggcgcgggcgcggtggtgctccagtcgaagccaggagagtcgggggcggagggtatcctggcgtccttctccggcaacgcgtacggagacctggtcatccgcaagggtggcggcctgttgaagctgccgtatcagccggggcggatgcgcccggcggacatggccttcgtggtggatggcttccgcgtggcgcgcagctatccggagtacatgcagaagtgcctcgacgccgtcctcgggccgcgtccggagctgcgttcgaaggtggagcggtactacttccaccagccgaacaagcgggtgatggacgccttcgtggagcgggcgggactgccgcgtgaggcggtggcgtgcaacgtggaccgctacggcaacacgtcggcggcggggatgctcatccttctggccgaggacttggaagcaggacgcgtgcgtctgggaagtggtgacctggtggtggtggcagcggtaggcgcgaacgtccattacggcgcgcaactcgtgaggttg

SEQ ID NO: 43218 - DNA, 1176 bp, Myxococcus xanthus
acgcgcgacttcatcgacctggaggagcggtatggagcgcacaactaccatccgctggacctcgtcatcgaacggggcgagggctgctgggttcatgacgtggagggccgcaagtacctggactgcctgagcgcgtactcggcggtgaaccaggggcactgtcacccgcgcatcctggagacgctgcgcgagcaggccgcgaaggtgacgctgacgtcacgggccttccgcaatgaccagcttccccacctctacaaggcgctgcgcgagctgtctggattgagccgcgcgctgccgatgaactccggcgcggaggcgtgcgagacggccatcaagctggcgcgcaagtggggctacaccgtcaagggcatccccgaggacaaggcggaggtcatcgtcttcgcgaacaacttccacgggcgcaccatcagcctcatcagcttctccaccgtgcggagctaccggcagggcttcggccccttcacccccggcttcaccgtggtgccctacgacgacgtggaggcggtgcggcgcgccatcacccccaacacctgcgccatcctgatggagcccatccaggcggaggccggcgtgctgattccgcgcgacggctacctgaagcaggtggccgagctctgcaagcagcaccgcgtgctgttcatggtggatgaaatccagacgggcctggggcgcaccgggaagacgtttgccttccagcacgaggacgtgcggccggacgtcatcgtggtgggcaaggcgctgtcgggcggcttctacccggtgtccgccgtcatggcggatgacgaggtcatgggcgtgctccgtcccggcgagcacggcagcacctacggcggcaatccactgggctgcgccgtggcgcgcaccgccctggacgtgctgcgcgacgagcgcctggtggagcgctccgccgagatgggcacgtcgttcctggccatgctgaagacgctgaagaaccgccacatcgtggaggtgcgcggacgggggctgatgattggcgtggcgctggacatctccgcgcggcccgcctgcgaggcgttgatgaaggaaggcgtgctctgcaaggagacgcacgactccgtcatccgcctcacgccgccgctcatcgtcacccaggccgagctggactgggccttcgagcgaatcaagaaggtcatc

SEQ ID NO: 43219 - DNA, 1191 bp, Myxococcus xanthus
ttgaagaatctgtacgtccaggtgctgctggccatcgcggtgggcgtcatcctcggatggctgcggccggacctgggggagtccatgaagccgctgggcgacggcttcatcaaactggtgaagatgatcatcgcaccggtcatcttcctcaccatcgtcgcgggcatcgcgaagatgggcgacctcaagcacgtgggccgcatcggcctcaaggcgctcatctacttcgaagtcctgacgacgctggcgctcgtcgtgggcatggtggtggtgaacaccctgaagcccggcgcggggatgaacatcgacccggcgcagatcgacacctccggcatcacccagtaccgcgcgtccgcgtcgcagcagggcaccatccccttcctcctggacatcatcccgcatgacttcctgtcggccttcaccgaggggaagttgctccaggtgctgctcgtcgccgtgctgacgggcgtggcgctcacccgcctggggcccatgggacagcgcgtgctcgacttgtcggatgacctggcgcaggtcttcttcggcatcgtcgggatgatcatgaagctggcgccgctgggcgccttcggcgccatggccttcaccgtgggtaagttcggtgtcgaatcgctcagctccctgggccggctgctcatcgccgtctacgtcacctgcgccctcttcgtgttcctggtgctggggctggtggcgcggctgtccggcttctcgctgtggaagctgctgcgctatatgcgcagcgagctgttgctcgtgctggggacgtcgtcatcggagtccgcgctgccccggctgctcaagcggctggagacgctgggctgcgaccggggcgccgtcgggctggtgctgcccaccgggtactccttcaacctggacgggacgtgcatctacctgacgatggcggccatcttcatcgcccaggcggtgaacgtggacctttcgctgggcgaggagctcaccttgctgggcgtgctgctgctgacgtcgaagggcgcggcgggcgtgacgggttcgggcttcatcacgctgatggccacgctggcggcgctcaacggcaaggtgcccgtggaaggcgtggccctgctgctgggcgtggaccgcttcatgtccgaggcccgggccatcaccaacgtcatcggcaacacggtggcgacgctggtggtgtccaagtgg

SEQ ID NO: 43220 - DNA, 1113 bp, Myxococcus xanthus
ttcaccgaggaacacgaggccttccgcaacacggtgcgcagcttcgtggagaaggagatgaccccacacggcctcgagtgggaccgggcgggcatcttccccaaggagctgttccgcaaggcgggggacctgggcttcctgggcatcaaccacgacccgaagtacggcggtagcgggttggactactggtacgtgacggtgttcgcggaggagctgagccgcagcctcaacgcgggcgtgaacatggcgctgctggtgcagagccagatggccacgcccatcatcaacgagattggaacggacgagcagaagcgcgagttcctggagccggcgctcaagggcgagaagatcgccgcgctgggcgtgagcgagccggggtgcggctcggacgtggccagcatcaagacgacggcgcgccgggacggggatgactacgtcatcaacggctcgaagatgtggatcaccaacggcacgcgggcggacttcatcaccctggcggtgcgcacgggcgaggccggctacggcggcatctccctggtgacgttccccacggacgtgaagggcttcggcgtctccaagaagctggacaaggtgggcaacctgtcctcggacaccgccgtcctctacttcgaggactgccggattccggcccgctacgtcctgggcgaggagaacgaaggcttctaccacatcatgaccaacttccagggtgagcgcctggtgggcgccatcaccacggtcgcgggcatggagcggatggtggaggactccatccgctacggcaacgagcgcgaggccttcggccggccgctgatgaagttccaggtgtggcgccacaagttcgtggagcacctgacggccatcgaagcggccaagcgcctgacgtaccacgcggtggacctcttcgaccggaaggagaacccggtgaaggaggtctccatggcgaagctgttcgcgggggacctggcccagcgcgtggcctacgactgccagcagttctacggcggcatgggctacgtggaggagacctccatcgcccgcatgtggcgcgacgtgcgcctcatcaccatcggcggcggcacctccgaggtgatgaaggagatcatctcgaag

SEQ ID NO: 43221 - DNA, 1815 bp, Myxococcus xanthus
tttccgctaccgcgggggggtgatgcgacgctggtccaactgctcattcagcgcgcgaagaacgcgtcgacggtgggcgtaagccacaagaaagacggccgctggcaggacgtcaccttcgcccagttcctggacgaggtgaaagcgctctccgcgggcctggttgcccagggggtgaagcccggggaccgggtggcgattttcgcgaacaccagtctgcagtggctcatctgcgatgtggccatcagcgccgcgcaggccatcaccgtccccatctatgcgtccaacacgccggatgagtgccggtacatcctcaaccactccgagacgacgctcgtcttcgtggacaacgacgagaaggacgcccggcaggcgggccggctcacgcgcctgcgccagaagctggcggagtgtccggcgctccgccgcatcgtcgccttcgagggccccgttgccggtggcaccgagctgtcactcgccgacgtcatcgcccagggccgcaccgagcatgccgcccgtccggacgacttcgaggcgcgggtggcgggcgtgtccatggaggacaccgcctccatcatctacacgtccggcacgacgggggaccccaagggcgtcatcctcacgcaccgcaactgggccttcgaggcgaaggccgcccagtcggtggggatgatggtgccctctgactcggtgatgctgttccttccgctggcgcacgtcttcgcgcaggtggtgaaggccgcctggctgagcatgggttaccggctcgtcgtcgcggagtcggtggacaagctgctcgccaacctggtggagacgcgtccctcggtgctgccgtcggtgccgcgcgtcttcgagaaggtctacaacaacgtggtggccaacggctcggcggccccggggctcaagggccggctcttccgctgggccttcaagctgttcgacgagtacgtcgaggcacgcagccaggggcgcgagtacgccaccctgggcttcgcgttggcgaagaagctggtgttctccaaggtgcacgcggccatcagcgagaagctgggcggcaacatgcgcgtgttcatctccggcggcgcgcccctgtctccgaagatcggctacttcttcgacctgctgggcctcaaggtgctggagggctacggcctgacggagacgtgcgccggcaccaccgtcaatcgcgagcacaagatcaagattggcagcgtgggcgcgcccgtgccgggcatggaggtgatgattgcctccgacggcgaaatcctcatccgcggcccggccgtcatgaaggggtactacaagaaccccgaggccacggcggaggccatcgacgcggagaactggttccacaccggtgacatcggcgagctggacgcggacaactacctgcgcatcaccgaccgcaagaaggacctcatcgtcaccgcgggcgggaagaacgtggcgccgcagaatctcgagaacgccctcaagacgcacgccatcatcagtcaggccatggtgtacggcgacaagcggccgtacctggtggtgctcatcaccgtgtcggaggagggcgcgcgcagactcctcctggaccagggcgcccctgtgggcacctacgcggacaatgcccgtcgtccggaggtccaggcggcggtgaaggccgcggtggatcaggtcaacacgcagcagccgccctacgccacgctcaagcgcttcaccgtgctggagaacgacttcagccaggagacggaggagctgacgcccaagctcagtgtgaagcggaaggtctgcacccagaagtacagggcgcagctcgaccggatgtac

SEQ ID NO: 43222 - DNA, 2517 bp, Myxococcus xanthus
tccgccacgccgccgtcaccgaagctgcgcctgcccacggaggtgcgccccaccggctacaaggtggcgctcacgctggacccgaaggtgtcctcgttcaagggcgcgatggacatcacgctcgacgtgacgaagcccacgtccgtggtgtggctgcacgccaagagcctcaacgtgacgggggccgtgttcatccagaacggttcggccttcatcgggacgcccgtgaagggcgaggaggacttcctcggcttctctgtggcgaagccgctggccgccggccgggcgaggctggtcatcaactatgaaggcgtcgcgtcggagaaggagacggacggcgccttccgcgtcaatgaaggcggggactggtacatctacacccagttcgagccggtggacgcgcgccgtgtgttcccctccttcgatgaacccggcttcaaggtgccgtggcagctcaccttccacgtgcccgcgggcgtcgtggccgtcaccaacacgccgcaggagtcggaggaggtgcgcccggacggtggccgcacctaccgcttcgcgcgcacgcagccgctgcccagctatctcatcgccttcggcgtggggcccttcgacttcctccccgccgcggacgcgggccagaagaaggtgaagacgcgcatcatcaccccgcgcggccgcacggcggagggcgcctacgccgcgcaggtgacgccggaaatcctcgccgcgctggaggactacttcggcatcccgtacccgtacgagaagctggacgtgctggcggtgccgctgctgcgcggcgccatggagcacccgggcctggtgacgttcaactcgcgcctcatcctcgcgaagccggaggaagactcgctgggccgccagcgtgccttctccgacacgcaggtgcacgagctggcgcaccagtggttcggcaacctggtcaccatgcagtggtgggatgacctgtggctcaacgaggccttcgcctcgtggatgaccccgcgcatcgtcgaatcgtggcgtcccgcctgggacgcgcccgtcgagcgcgtgcacgaccgcgcccgggccctggacgcggacagtctcctgtcggcgcgccgcatccgccagcccatcgagagcgccaacgacatccacaacgcctttgacggcatcacctatggcaagggctccgcggtgctcagcatgacggaggagtggctgggccgggatgtcttccagcgcggcatccagcgctacttccgcaagcacgcgggcggcaacgccaccgcgaacgacttcctggacgccgtgtccgctgagtccggcaaggacgtgacgggcatgttggggagcttcctggaccagagcggggcgccgctcgtcaccgcgtcgctggcatgcggcgcggacggcgcgaaggtggtgctcacgcagcagcgttacctgcggctgggggccgcgtcgccgggtccgcagacgtggaaggtgccggtgtgcgtggagtacgcggcgggcggcaaggaggcccggacctgcacgctgctggagggcgagcgcgccgaggtggccctgagcgaggcgaagacgtgcccggactgggtgttccccaacgcggagggcgcgggctacttccgggtccagctcgatggggacgcagcggcgaagctggcgaagtccgggatgaagcggctgtcgcgcaccgagcgggtgacgttcctgacggacgtgcgcgcgctggccctggctgggacgattcccgccgccgaggccctggccctgacgagccgcctggcgaatgagccggaccgcgtcgtcaccctggcctcgctggacctgctggagctggtcagctcgcggctgcttccggacgagaagctgaaggaccgggctcgcttcctgcgtgagacctatggcccccgggcgcggcagctcggcttcgccccgcgcaagggcgagagcgaggacacgcgcctgctccggccccggctggtgcggctggcgggacgggacggcagggatccgaagctgctcgcggaagcgcgtgccctcgcgaacaagtggctgaaggacaatcgcgcggtggcgccggagatggtggacgtggtgctcgccctcgccgccaccgagaacgacgcggccttccgggagcagctcgtcgtggcggtgcgctcggagaaggagcggcgcacgcgccagcacctcatcggcgcgctgagcagcttcacggacccggtgctggtgaagcagaacctggccctggtgttcgagaagggcttggacccgcgtgagacgatgtggatggcgttcgcggcctcgcagggactgcgcacccaggacgtggccttcgacttcgtgaaggagaactacgaccgcctggtgggggactcgcccgaggcgctgctgtcactcgatgccgcggggcgcatggcctacatcggcagcaacttctgcgatgcgggcaagcgtcagcaggtggaggagttcttctccgagcgcaccgcgaaggcgccgggggggccccgggtactggcgcaggtg

SEQ ID NO: 43223 - DNA, 876 bp, Myxococcus xanthus
ctccttgttggcacggcgagcccccacctgggacgcgcgctcgggcaagccctgggcgtagcgcccgctgactgccacttcgagcgtttccccgatggggaaatgcacgtcgaggtgcccgagcaggtgcgaggccgcaccgtcatcctggtgcagtccacgacgccccccgcgggtgagcacctgctggagttgctgctgatggcggacgcgtgctggcgcatgggggccgcccgcctggaagccgtggtgccctacctgggctacgcgcggcaggaccggcgcgccaggccaggggagcccctgggcggccggctggtggcagacctgctgtcacagggccgcttcgcgcgcgtgctggtggtggacctgcacagccccgcgctggaaggctgcttcggcgcgccgctggagcacctcacctcgctgccgttgctggcggaagcgctccgcgagcacgtcaccgacacctccgtggtggtggcgccggacctgggcgcggtgaagcgcgcggaggccctggcgcggctgctgaaccggccgtgggcggtgattcacaaggtgcggctgagcggagacgaggtccacgccagcgggctgatgggcgaggtgcggggacgccgcccgattctggtggatgacatggtgtccaccggtggcaccctggccgccgccgcgggcaccctgcgcgacgcgggctgcacggaggacttcacggtggcgacgacccacgccctgctggtgggccccgccgtggagcgcctgcgcaccttgccgctcacccggctggtgagcaccgacagcgtggagcctgtcctggggctgccgttccagcaccaggtggtgacgctcgcgcccctggtggcccgggccctg

SEQ ID NO: 43224 - DNA, 1818 bp, Myxococcus xanthus
atcgcccagctcaaggccctccgccccccctacgtcacgcgcgaggtgctggagatctacgacgaggccacggcagcgctcgacgatgcgggagcccgcgccagcgtcgcccgccatgcgcacccggacgccgccatgcgcgaggccgccgaggccgccgagcaggccctggagacgctcagcaacgacatccgcatggaccggggcgtctatgacgtgctggccgcgctggacttgtccggcgaggacgccgccacgaggaagtggatggagaaggtgcggcgggagttccgccgcgcgggcgtggaccgggatgacgccacccgcgctcgggtgaaggcgctccaggaggagctggtccgcatcggtcaggagttcagtcgcaacatccgccaggacacgcgcacggaggcgctgtctccgtccgcgctggagggcctgcccgacgactacgtgcgcgcccatccgcccgggccggacggcaaggtgcgcatcaccacggactacccggacatcgtccccttcatgacgtactcgcgggatgcccaggcccgcgagcagatgtggcgcgtgttccgccagcgcggccaccccgccaacgcggacgtcctgcagcgcatggtgtcccgccggaacgagctggccacgctgctgggctaccggaactgggcggcctacgcgaccgaggacaagatgacgcgcacgcagcaggtggccgcggacttcatcgaccggctgggcatggccaccgaggcccgcgcgaagcaggagtacgcgcagctcctggcccgcaagcagaaggacgtcaagggagccaaggtgctggagccctgggaccaggacttctacgaggaccggctgcgcgcggagcgcttcagcttcgactcgcaggcggtccggccctacttcgagtacggccgggtgaaggcgggggtgatggacatcacctcgcgcatctggggcatcacctacaagccggtgaaggacgcccgggtgtggcagcaggaggtggagacctacgacgtgttcgacggcgacacgctgctgggccgcatctacctggacatgcatccacgtgacgacaagtacaagcacgcggcgcagttcgatctcgtcgcgggccaggccggcaagcgctacccggaggcctcgctggtgtgcaacttcgcgcgccccggcgagctgatgacgcacgacgaggtggagaccttcttccacgagttcggccacctgctgcacgccatcttcggcgggcacctgaagtgggcgggcatcgcgggcacccgcgtggagtgggacttcgtggagacgccgtccatgctgctccagcagtgggcgggcaacccggaggtgctgaaggagttcgcgaagcaccacgagacgaaccagcccatccccgcggagatggtggagaagctccgcgcgtcgaaggagttcggccagggcctgtgggcgcggcggcagttgttcctgtccgcggtgagcctggactactactcgcgagcgccgggcttcgacacgaccgaggccctggttgccctgcagacccggctcagccccttcaagcatgagcaccgcgacggcacgcacttcgaggtggccttcgggcacctggatggctactcggcggcgtactacacgtatctctggtcctccgtcatcgcgaaggacctggagaccgagttccagaagaagggcttcctcgaccgggagacggcgatgaagtaccgccgcaccgtgctggagcccggcggctccaagcccgccgcggagctggtgaaggacttcctcgggcgcgagtacggcttcgacgcgtac

SEQ ID NO: 43225 - DNA, 759 bp, Myxococcus xanthus
ttccgggacgggctgctcgcgggcaaggtggcgttcatttctggcggcagcagtggcatcaacctaggcatcgccgagtccttcgtgaaggcgggcgccaaggtggccatcaacggccgcaacgtggagaagctcgaggccgcggtgaaggggcttcaggcgcacggcaccgccatgggcgtggccgccgacgtccgggactatgccgcggtggagaaggccctccagacggtgcgcgaggcctacggtgagctggacgtcgtcgtgtgtggcgccgccggcaacttccccgcgcccgcgctgggcatgtcctccaacggcttcaagaccgtcatggacatcgacgtgctgggcaccttcaacatcagccgcgccgccttcgagcacctgcgcaagccgggcgcgtccctcatcaacatctccgcgccccaggcgtatctccccatggccatgcaggcccacgtctgtgccgccaaggccggcgtggacatgctcacccgcgtgctggccattgaatggggtggctccggtgtgcgcgtcaacgcgattacccccggccccatcgacgacacggaaggcatgcgccggctcgcccccagcgacgagggccgcgacaagctcgcccaggccctgccgctccagcgtttcgggaagaagcaggacatcgcccagctcgcgctcttcctggcgtcggaaggctcgtcctacatcaccggctccatcatggtctgcgacggtggccagtccctgctgggcggc

SEQ ID NO: 43226 - DNA, 1237 bp, Myxococcus xanthus
atgtccacctcacctgtgcaggagctggttgtctcggggttcggggtcacctccgccattggccagggggccgcgtccttcacctcggcgctgctggagggcgcggcacggttccgggtgatggagcggccgggccgtcagcatcaggccaacgggcagacgacggcccacctgggggcggaaatcgcctcgctggccgtgcccgaaggcgtcaccccacaactgtggcgctcggccacgttttcggggcaggccgcactggtgaccgtccacgaggcctggaacgcggtgcgcctccaggccgtccccggacaccggattggattggtggtggggggcaccaacgtgcagcagcgcgacctggtgctgatgcaagacgcctatcgcgagcgggtgccctttctgcgggcggcctacgggtcgaccttcatggacaccgacctcgtgggcctctggcacgcagcactttgacatccacgggatgtccttcacggtgggaggcgcatcggccagtggcctgctggcggtcatccaggccgcggaggcggtgctctcaagaagggtggacgtttgcatcgccgtgggggcgctgatggacgtctcctactgggaatgccagggcctgcgggccatgggcgcgatgggcaccgaccggttcgcgcgggagccggagcgtgcctgccggcccttcgaccgggagagtgatggcttcatctttggagaggcgtgcggcgccgtggtggttgagtctgcggagcacgctcggcgacgcggggtgactcctcgcggcatcctgtcgggctgggccatgcagttggacgcgagccgcggcccgttgtcgtccatcgaaggggagtcgcaggtgattggggctgcgctgcggcacgcggacctcgcgccggagcgggtggactacgtgaatcctcacggcagcggttcgcgtcagggggatgccatcgagctgggggccttgaaggcgtgcggcctgacgcacgcccgggtcaacaccacgaagtccatcaccgggcatggcctgtcctcggcgggtgccgtggggctcatcgccacgctggtccagttggagcagggccggctgcacccgtccttgaacctggtggacccgattgattcatcgttccgctgggtgggggccaccgcggaggcccagtccctccagaacgcgctggtgctcgcctacggcttcggcggcatcaacaccgctgtcgccgtgcgccgg

SEQ ID NO: 43227 - DNA, 837 bp, Myxococcus xanthus
ctcttcccggggcagggctcgcaggagcgcggcatgggggccgcgctcttcgacgagttcccggacctgacggacatcgccgacgccatcctggggtattccatcaagcgtctctgtttggaggacccaggcaaggagctggcgcagacgcagttcacccagccggcgttgtacgtggtgaacgcgctcagctacctgaagcggctgcgtgaaggagcggagcagccggccttcgtcgcgggccacagcctgggcgagtacaacgcgctgctggtcgcgggggccttcgacttcgagacgggactgcggctggtgaagcggcggggcgaactcatgagcggcgcgtccggagggaccatggccgcggtggtgggctgtgatgccgtggccgtggaacaggtccttcgagaccgtcagctgaccagtctggatatcgccaacatcaactcgcccgaccagattgtggtctccggaccggcgcaggacatcgagcgggcacggcagtgtttcgtggaccgtggcgcgcggtacgttccgctcaacgtgcgagcgccgtttcactcgcgctacatgcagccggccgccagcgagttcgagcgcttcctgtctcagttccagtacgcgccgctccggtgcgtggtcatctccaacgtcacgggccgaccttacgctcatgacaacgtggtgcaggggctggctctgcaactgcgcagcccggtgcagtggacggccaccgtccgctacctcctggaacagggcgtggaggacttcgaggagctgggccccggccgcgtgctgacccgcctcatcaccgcgaacaagcggggcgcccccgca

SEQ ID NO: 43228 - DNA, 1122 bp, Myxococcus xanthus
atgatgcaggagcgcggcgtcgcgctgccgttcgaggaccccgtcaccaacgcggtcaatgcggcgcggcccatcctggacgcgatgtcgcccgaggcccgggagcgcatcgagctcctggtcacctcgagcgagtccggcgtggacttcagcaagtccatctcctcgtatgcgcacgagcacctggggctgagccgccactgccggttcctggaggtgaagcaggcgtgttacgccgccaccggagcgctccagctagcgctgggctacatcgcgtcgggcgtgtcaccgggggccaaggccctggtgattgccacggacgtgacgctggtggacgagagcggtctgtactccgagccggcgatgggcaccggcggcgtcgccgtgctgctgggcgacgagccgcgcgtgatgaagatggacctgggagcgttcggcaactacagctacgacgtcttcgacaccgcgcggccctcgccggagattgatatcggcgacgtggaccggtcgctcttcacgtacctggactgcctcaagcacagcttcgccgcgtatggccgccgggtggacggtgtcgacttcgtgtcgacgttcgactacctggcgatgcacacgccgttcgccggactggtgaaggccgggcaccgcaagatgatgcgcgagctcaccccgtgcgacgtggacgaaatcgaagcggacttcggccggcgcgtgaagccgtcactgcagtacccgagtctggtcgggaacctgtgctccggctccgtgtacctgagcctgtgcagcatcatcgacaccatcaagcccgagcggtccgctcgggtgggaatgttctcctatgggtcgggttgctcgtcggagttcttcagcggcgtcatcggcccggagtccgtgtccgcgctagctgggttggacatcggtggccacctccgggggcgccgccagctcacgttcgaccaatatgtcgaattgctgaaagagaaccttcgctgtctggttccaacgaagaaccgggacgtggacgtggagcgctacctcccgctggtgacgcggacggcgagccgcccgcgcatgctcgccttgcgaagggtcgtggactatcatcgtcagtacgagtgggtg

SEQ ID NO: 43229 - DNA, 1260 bp, Myxococcus xanthus
atggggccggtcgggattgaagccatgaatgcctactgtggcatcgccaggttggatgtgttgcagctggcgacccaccgtggcctggacacctcccgcttcgcgaacctgctcatggaggagaagaccgtcccgctcccctatgaggaccctgtcacctacggcgtgaatgccgcccggcccatcctggaccagttgaccgcggcggaacgggacagcatcgagctgctggtggcttgcacggagtcctcgttcgacttcggcaaggccatgagcacctacctgcaccagcacctggggctgagccgcaactgccggctcatcgagctcaagagcgcctgctactccggggtcgccgggctgcagatggccgtcaacttcatcctgtccggcgtgtcgccgggggccaaggccctggtggtggcctccgacctgtcgcgcttctccatcgccgaagggggagatgcctccacggaggactggtccttcgcggagccgagctcgggtgcgggcgcggtggccatgctggtgagcgacacgccccgggtgttccgcgtcgacgtgggggcgaacggctactacggctacgaggtgatggatacctgccgcccggtggcggacagcgaagcgggagacgcggacctgtcgctcctctcgtacctggactgctgtgagaacgccttccgggagtacacccgccgcgtccccgcggcgaactacgcggagagcttcggctacctcgccttccacacgccgtttggcggcatggtgaagggcgcccaccgcacgatgatgcgcaagttctccggcaagaaccgcggggacatcgaagcggacttccagcggcgagtggcccccgggctgacctactgccagcgcgtggggaacatcatgggcgcgacgatggcgctctcgctcctcgggaccatcgaccacggcgacttcgccaccgcgaagcggattggctgcttctcgtatggctcggggtgcagctcggagttcttcagcggcgtggtgacggaggaagggcagcagcggcagcgcgccctggggctgggagaagcgctggggcgccggcagcagctctccatgccggattacgacgcgctgctgaaggggaacggcctggtgcgcttcgggacccggaacgccgagctggatttcggtgtcgtcggcagcatccggccgggcgggtggggcaggcccttgctcttcttgtcggcgattcgtgacttccatcgcgactaccaatggatttcc

SEQ ID NO: 43230 - DNA, 1257 bp, Myxococcus xanthus
ctgcgtgaggaccgcttcctcgacgtactccggcggctcatcgccctgactccgaagctgcagaacaaccctggcgcggggctggtgcccgaggaacggctggccgcgcaggtagtgctggacaccctggcgccgcacatcgagagcggcttcatccaggcggagtccgtggcggggccgggccaggcgtcgcgcccctgtctggtgctgaccgtgccgggggagggagaaggcgccatcggcttcgtcggcgcgcacttcgacgtggtccccgcggaccagaagacggagggctgggagcgcagccccttcgagctgtgggagggccccggcggcgtgctctacgggcgcggcgtcaccgactgtctggggcacgtcgccgtgctcaccgacctgctggcccagctggccgagcgcaaggtgcgccccagccgcacgctgaaggtggtgctcatctccaacgaggagtcctcggagctgccgggcctgggcctcaactacgtggccgagcagggcatgctcaagccgctcgatggccagccggtgtactggctggacagtgccaacttcggccccacgctgggcacggcgggcgtgtcgctgtgggagctgaaggtgacgggcgtggggggccactccggcatgccgcagaactgcgtcaacgcgctggagttgggcatggccgcgtcgttggagctggcgcgcttcttccacgagcgcttcccgcccacggaggacgagaagcgctggggcttcctctcgtcctccagtctcaaggccaccgtggtggaggcgcccaacaccaaggagacgaaggtgcccgccgacgtcgtcctgcgcggcgacatccgcctcacgcccttctacgacctggcggaggtgcagaagactgtgacggacttcatggcggagctcgacgcccgactggagcgcgacgatgcccccgcgcacttcccgcgcacgcgcacggcgggcggcaagcgcggtgagctggcgttccgcttccagggggaggggaccgagggcatcgcctgccggctggactcggagggcctgcgcgcactgaaggaggccatgcaggtggtgcgcggtgtgtcggccacgcccttctcgctcaccggctcgctgccgctcgtgagggacctgcaacgacagggctgcgacgtgcagattacgggcttcggggacatgcagtactaccacgcccccaatgagcaggcccggctggaggacttccggcagggcttcgcgattctc

SEQ ID NO: 43231 - DNA, 1881 bp, Myxococcus xanthus
gccccccagcgggagacccacgcattccaggcggaaatcaatcagctcctcagcctggtcatcaattcgctctacagccacaaggagatttttctccgcgagctggtgtccaacgcgtccgacgcgctcgacaagctccggttccgcgcgattacggagccggagttgctggcggacgagccggccctggagctgcgcctcatcccggacgaggcgaagggcaccctcaccatcgaggacaccggcatcggcatgtcgcatgacgagctggtgaagaacctgggcaccatcgcccactccggctcgcgcgagttcatcgaggcgctggcgcagaagggccagcagaaggacatgcagctcatcggccagttcggcgtgggcttctacagcgcctatctggtcgcggaccgcgtggaggtggtcagccgcgccgccggccagggccagtccgcctggcggtggacgtcggaagccaagggctccttcacggtggagcccgccgagcgcgccgcgcgcggcacctccatcaccctgcacctgaaggaggaccagaaggagttcctgggcgagtggcggctgcggtcgctcatcacgcagtactccgactacgtgggccaccccatcaagctccaggtgagcaagacgacggggaccggcgacgaggcgaagacggagacgtcgttggaggtcgtcaacaaggccagcgccctgtggcagcgctccaagtccgaaatcacggacgagcagtaccaggagttctacaagcacctgacgcacgactgggaagcgccgctggcgtggacgcacttcaaggcggacggcaacacccagttcaccggcctgctcttcgtgcccaagcagcctccgttcgatttggacgcgcagcagcagcgcggggtgcggctgttcgtcaagcgcgtgttcatcatggaccgctgcgaggagctggtgccgcagtggctgcgcttcgtgcgcggcgtcatcgattcggatgacctgccgctgaacgtgtcgcgcgagctgctccaggactcgcaggtggtgcgcgccatccgcaagcacgtggtgaagaagtccgtggacctgctggagaagctggccaaggacaagccggacgactacctcaccttctggaaggccttcggcacggtgctgaaggaaggcctggccacggaggccgagcagaaggacaagctgggcggtctgctgcgctacgagagctcgcgcgaggagggcctgacgtccctggcggactacgtgggccgcatgaaggaaggccaggaggccatctattacgtctacggcgagtcccggaaggcggtggcggacagcccccacctggaggcgctgaagcagcgcggcttcgaggtcctctacatgacggacccggtggacgagtgggccgcgcagggcctgcgcgagttccagggcaagccgctggtgtccgcgctccaggcggacctgaagctccagtccacggacgagcagaagaaggagcaggagcagcacgccgaaggcctgaagacgctcacctcgaagatgaaggacgtgctccaggagtcggtgcgcgaggtgcgcgtgtcggaccgcctgacggactcgcccgtgtgcctcgtcgtgccagagggcggctcgccggcctacctggagcgcctgctccagcagcgcggccggggcgcgggcatgccgcgcgtgaagcgcatcctggaagtgaatccgaagcaccccgtcatcgagcacctgaaggccgtgcatgaccgcgacccggccgcggcccaggtggcggagtggattgagctgctccacgaccaggcgctgctcaccgagggcagcaccatcgccgaccccaaccgcttcgcccgccgcatgacggggctgttg

SEQ ID NO: 43232 - DNA, 1011 bp, Myxococcus xanthus
atgttgatcgtgatgcgacccgacgcgacggcccaggacatcgagcgtgtgaacgacgagatccgccgccgtggttggcaaccgcacgcgattccagggggcactcgcacggccgttggcatcaccggaaacccgggcgcggtggaaccggagcccttccgcgtgctccctggcgtcgctgacgccgtggccatctcccagccgttcaagctcgtcagccgcgaggtgaagccggacgacacgcagctgcgcatcggcgacctgacgattggcggctccgccttccacgtcatcgccggcccgtgctcggtggagtcgcgcgagcagattctctccaccgcccacgcggtgaagaaggcgggtgccaccatgctgcgtggcggtgcgttcaagccgcgcaccagcccctatgagttccagggcctcaagggtgacggcctggcgctgctggccgaggcgcgccaggagacgggcctgctcgtcaccaccgaggtgaaggacaccgcgacgctccaggccgtcgccgacaccacggacatccttcagattggcgcgcgcaacatgcagaacttcagcctgctggaggccgtgggggacctgcgcaagccggtgatgctcaagcgcggcatgagcgccaccatcaaggaactgctgatggcggccgagtacatcgtcgcccgcggcaacacgcaggtcatcctctgcgagcgcggcatccgcaccttcgaaacgatgacgcgcaacacgctggacctcaacgcggtgcccatgctgaaggcgctctcgcacctgcccgtcttcgtggacccgtcgcacggcatcggcgtgcgcaaggcggtgccggcgatgatgcgcgcggcgacggcggtgggggcggacggcatcatcgtcgaggtgcaccccgacccgccgcgcgcgaagtcggacggcgcccagtcgctggacttctccgagttcgagaagtccatgaacgaggtccgcgccatcgcccaggcgatgggccgcgaagtg

SEQ ID NO: 43233 - DNA, 546 bp, Myxococcus xanthus
ctcgtccggcacggagagacggagtggagccgcgccggtcggcacacagggcggacggacattccgctcctggactccggaagggagatgggccgccttctcggcgcgccgctgaaggcctggcgcttcgacaccgtctacaccagcccgctgagccgcgcggcggacacctgcgccctggccggctacggggactacgcccaactgcgtgaggacctcatggagtgggactacggcgactacgaggggcgcaccggcgcggagattcgcgccgagcggcccgactggaccatctggaagaacggcgtccccaacggagagaccgcggcgcaggtcgccactcgcgtggacagcgtcatctccgacgcgctccggacggacggggacgtgctcatcttcgcccacgggcacctgcttcgcgtgctcgcggcgcggtggctgggcctgcccccgtgggaaggccgcctcttcctgctgagcaccgcgtccatcagcgtgctcggccatgacggcgacaggcgccgcccggccatcgtgtcgtggaac

SEQ ID NO: 43234 - DNA, 1212 bp, Myxococcus xanthus
aaagcagcgtccgcgctgcgccaatggatggaggatgggcgggagaagtacggcatcgcctaccagaagttcatctgcacctccgcggacaacctgggctactacgcgccgtggcggctggcgcccacgctgcgcttcaagccctggcagacgctgtaccggcaactggacggcttcttccacgatgaccgggtgacgtacgccctggcgtacccgtccaagtacctgggcctgcaccccacgacgtgctcgtcggtgttcagcgtgattcccttcctggagctggccttcggcgtctggcacgtggagggcggcttccgtgagctgtcgcgcggcatgatgcgctgcgcgcgggatttgggcgccaccttccgcatgggcacgccggtggagaaggtgcgcgtggacgcgggccgcgcggtgggcgtgaagctcgtgggcggcgaggtgctggacgcggacgcggtggtggtgaacgcggacctggcctacgcggcgcggtcgctgattccggcggaggcgcgggaaggctcgcgactgacggacgcggcgctggagcgcgcgaagtattcgtgcagcacgttcatggcgtactacggcctggacacggtgtacgccgacctgccgcaccatctcatctacctgtcggaatccgcgcggcgcacggaccgtgacgcgctggaggaccggcacgttgacctggaggacccgcccttctacgtgtgcaatccgggcgtgacggacccgtccggcgcgccggcgggccattcgacgttgtacgtgctggtgcccacgccgaacacgggacgtccggtggactgggtgaagacggagcaggcgctgcgcgagcgcatccccgccatgctggagaaggtggggctgaagggcgtgcgcgagcacatccgcgaggagcgctacttcacggcggagacgtggcgggacgacttcaacgtgttccggggcgcggtgttcaacctgtcgcacacgtggctgcagttggggccgctgcggccgaaggtgaagaaccgggacatcgaagggctgtacttcgtgggcggcggcacgcatccgggaagtggcctgctgaccatcatggagagcgcgaacatcgcggcggactacctgacgcgcgaggcgggcaagggaccgctgccgggctggccgtatgtgccgccgctggagccggagtcgcccgttcaagctcgcgcgggg

SEQ ID NO: 43235 - DNA, 573 bp, Myxococcus xanthus
gtgctggccctggtggcgttgggcgcggacctgaaggcgagggattccagcaagcacagcgtgctccacctcgccgcgatggtggatgacgcggcgctggtgaaggagttgctccgcctgggcgtcgccgccgacgtcgtcgattcgaataagtccacgccactgcatgtcgcggccgagcacggcagcgtgtcctgcatcgccgcgctggcgaaaggcggcgtgcctgtggatgcgctcgatacctcagggcggacggcgctcttcgaggcgcgtcaggccgacgtggcccaggcgctcatcgacgcgggcgcgaatcccaatgcgggcaagggctggacgccgctgcaccagcacgcacggttcaaggagcgaggccccgtcatcgaggtcctgctcaaggcgggggcggatgtctcgctgaagaatggcagcggccagacgcccgcgcaggaggcgctggagcacaagaacgcgtccctcgcccagctcatgggggccaaggcttcctcgggcaaggccggcgcgttggacgtgcagccgctgctggatgcactggcgcgtcagcgcaag

SEQ ID NO: 43236 - DNA, 882 bp, Myxococcus xanthus
atggcgtcccttcgcgacattcgcaagcgcatccgctcggtgaagaacacgcgtcagatcaccaaggcgatgaagatggtttccgccgcgaagctccgcaaggcgcaggacggcatcctggcggcgcgtccctacgcgacgatgctggatcaaatcatcgcggacctgtccgcccgcgccggggatgagagcctcagccacccgctgctcacggcccgtccggtgaagcgcgtggagctggtgctcctcacgtcggaccgtggcctcgccggcggcttcaactccaacgtcatccgccgcgccaaccggttcctctacgagaacacgaacctggagagcatccgcctctccaccgtgggccggaagggcaacgacttcttccgcaatcgcggccagaacatccgcaaggacttcggcggcctgtaccagcgcctgaactaccgcgccgccgcggacgtggccgaggagctggtggccagctacctcaatggcgaggtggacgcggtccacatcgtctacaacgagttcgtcaccgccatctcccagacggtgaaggtcgctcagttgctgccgctgcagacgctggggacgccggaccaggcctcgacggcgggctccacctcgctggtggacttcaagtacgagccggaccgtcagtccgtgctggaccgcctggtgccccaggccgtcaacatcaagctctaccgcgccctgctggagagcgtggccagtgagcacggcgcccgcatgagcgccatggagaacgccacctccaacgcgaccgacatgatcggcaacctgacgctcacctacaaccgcacgcgtcaggcggtcatcaccaaggagctgatggagatcgtctccggcgccgaggccctgaag

SEQ ID NO: 43237 - DNA, 1467 bp, Myxococcus xanthus
gcagacgattccatgagcgctcaagttccgacggcaggcagaatcatccaggtcctcggccccgtggtcgacgtcgagttcccgcccggcggtctccccgaggtctacacggccctcaaggtcaccaacgcgaacctgagcgccgccgctgacaacctcaccctcgaggtggcgcagcacctgggcgagaacaccgtccgcaccatcgccatggactccacggagggcctgggccgcggcatggccgtcacgaacacgggcgcccccatccaggtgccggtgggcaaggccaccctgggccgcatcctgaacgtcaccggtgagccggtggacgagatgggccccgtgaaggcgcaggagtactggtccatccaccgcgcgccgccgcccttcacggagcaggacgtgcgcgtgcagatgttcgagacgggcatcaaggtcatcgacctgctcgccccgtacacccgcggtggcaagattggcctcttcggcggcgccggcgtgggcaagacggtgctcctgcaggagctcatccgcaacgtggccgtggagcgcggtggcttctcggtgttcgccggcgttggtgagcgcacccgcgagggcaacgacctctaccacgagatgcaggacacgaaggtcatccagacggacaacctggaggccagccaggccgtgctggtgtacggccagatgaacgagccgcccggcgcccgcgcccgcgtggccctgtccgcgctgaccatggccgagtacttccgcgacgtggaaggccgcgacgtgctcctcttcgtggacaacatcttccgcttcacccaggccggctccgaagtgtccgccctcctgggccgcatccccagcgccgtgggttaccagcccacgctggccacggagatgggcggtctgcaggagcgcatcacctccaccacgaagggttccatcacctccgtgcaggccatctacgtccccgccgacgacctcacggacccggcgcccgcgacggccttcgcccacctcgacgcgacgacggtgctcaaccgctccatcgccgagctcgccatcttccccgccgtggacccgctggactccaccagccgcatcctggacccggccgtcatcggcgcggagcactacggcgtggcccgcaaggtccagggcatcctccagcggtacaaggagctgcaggacatcatcgccatcctcggcatggacgagctctccgaggatgacaagctggtggtggcccgcgcccgcaagattcagcgcttcctgtcgcagcccttcttcgtggccaaggtcttcacgggcaaggacggccgctacgtgaagctccaggacaccatccagggcttcaaggagatcgccgagggcaagcacgacgacatccccgagggcgccttctacatgacgggcagcatcgacgaggtggtcgagaacgcgcggaagctcgcggcgagctaagctgggcgc

SEQ ID NO: 43238 - DNA, 747 bp, Myxococcus xanthus
ctggagctcagaggaaagacggccctcatcaccggcagcagccggggcattggccgggccatcgcgtcggtgctggcccgcgagggcgtgcgggtgtgcctcagcgcacgcggcgcggaggccctggaggccaccgcggcgcagcttcgcgccgggggcgcggatgtggccaccgtggtgacggacgtggccacccaggccggcgccgtggaagcagtggaggcggcggtgcgcgccttcggccggttggacatcctggtcaacaacgtgggcggcagcggcggcgcgggcgccttccattccgccaccgccgagcagtggacatccgtcctggaccgcaacctcctgtccgccgtgtggtgcagccagcgcgccgtggaggccatgcgccagcagggtggcggctgcatcgtccacatcaactccatctttggccgcgagtacgccaccagcgccccctacactaccgccaaggccggcatcaccgcgctcaccaaggagatggcggtggacctggcgcagtaccgcatccgcgtcaacggcgtggcccccggctccatcctcttccccggcggaagctgggacaaacgccagaaggcggatccagagaaggtggccagactggtgcgtgacgagctgccctggggccgcttcggcgcccccgaggaagtggccgacgtggtggccttcctctgctcggaacgcgcacgctgggtcacaggggccaccctgcccgtggatgggggc

SEQ ID NO: 43239 - DNA, 1542 bp, Myxococcus xanthus
atgaccgagcgagaactgtgggagcggtaccagcgttatctgtgcgtcgtcccggccttggacttcacgctcgacgtctcgcggatgcgcttcccggcggactacctggagcggatgcgcccccgcctggaggaagccttcggcgcgatggaggccctggagaagggcgccgtcgccaacccggacgagaagcgcaaggtgggccactactggctgcgcgcgccggagttggcgcccgagcccgcgctccagaaggaaatcaccgacacggtggccgccatccacgccttcgcgaagaacgtgcatgagggccgggtgaagccgcagaaggcgcagcgcttcacgcacatgctgattgtcggcattggtggctcggcgctggggccgcagttggtggcggacgcgctgggcacggcgaaggacccgatgcaggtgtccttcttcgacaacacggacccggacggcttcgaccgcgtgctggcgcaactgggcgagcggctgtcggagacgctcaccctggtcatcagcaagtcgggtggcaccaaggagacgcgcaacggcatgctggaggccgagcgcggctactcggcgcgcggcctggacttcagcaagcacgccgtggccgtcaccggcgccggcagcgagctggacaaccacgcgaagaagcagggctggctgcgcgccttccccatgtgggactgggttggcggccgcacgtcggtgacgtccgcggtgggcctgctgcccgcgcgcctgcaggggctggacatcgacgcgctgttgaagggcgcgcgcgacatggacgcggcgacgcgggagcgtgatgcgctgaagaacccggccgcgctgctggcgctcatgtggcactacgccggtgatggccggggccacaaggacatggtcatcctgccgtacaaggaccggctgctgctgatgtcgcgctacctccagcagctcgtcatggagtcgctgggcaaggagaccgacctggatggccaggtggtgaaccagggcatcgccgtctacggcaacaagggctccacggaccagcacgcctacgtgcagcaactgcgcgagggtgtgctcaacttcttcgccaccttcatcgaggtgctgaaggaccgtgacggcggctcgcaggaagtggagcccggcgtcaccagcggtgactacctgctgggcttcctgctgggcacgcggcgcgcgctctacgagaaggaccgcgagtcactcaccctcaccgtgccggacgtgagcgcgcgtacgctgggcgcgttgattgcgctgtatgagcgcgcagtgggcttctacgccacgctggtgcacatcaacgcgtaccaccagccgggcgtggaggcgggcaagaaggccgcgggcgtggtgctggagctccagcgcaagctgacgacgcgcctgcgcgaggcgcgcgcggaggcccgcaccgccgagcagctcgcggcggacatcggcatgccggacgaggtggagacggtgttcaaggtgctccagcacctggccgccaacccggaccgcggcgtcacg

SEQ ID NO: 43240 - DNA, 603 bp, Myxococcus xanthus
tgctcgccctgcgccaccaatgattcgtgcgccggcaactcctgcaactgctgccccaacggcacccagtgcctggcgctgacgcccggtgccacgccgacctgtgtggagtgcaccaccagcagccagtgcgccgcgggccagcagtgcgacaccgccaacggccgctgcgtggacagcgtgccttcgtgcaacacggccgacagttgcggccctggctgcgtgaagtgccccggcgagcgcccctactgcctcgacggcgaagtctgcgtccaatgtcgcaacgacttggagtgcggcgacggccagttctgcctcagtggtgaatgcgcgtcctgcaccacggacaagcactgcggcccccgctgtggcgcctgcgatggcgacacccccttctgcctctccaatggcaccgcgcagggcagcacctgcgtgggctgcacggatgacggggactgcgggagcggcgtgtgcaaccccaccacgcgcacgtgtgagaactcgggcgcgtgcgcggtgacgtgcgagccgggaacggtctgcgacggcacctcctgcgtcgagtgcttcgcagatgcccactgcccctgcggcggcacctgc

SEQ ID NO: 43241 - DNA, 699 bp, Myxococcus xanthus
gcattcatcaccggggctggcatccgcatcggcagcgcggtggctcgggcgctcgggcgctcgggttatgacctggcgctccatgcgaaccgctcccttgagccgctggaagcgctggcggacgaactccgaggcctcggccgtcgcgtcaccctgcacgccgccgacctgagccgcccggaggcagtggactccctggccgcgcaagtacgtgaggcgtggcccgcgctggacgtggtggtccacaacgcgggcctcttcgagcgcaccgacttcgccgccatctcccgcgaccagtaccgcaccatgatggcggtgaacctggacgcgcccttcttcctcacccaggccctgctccccgcgttgcgcgccggcaaggacccgttggtggtgcacctcaccgacgtcggtggggagcggccggtgagtcactacgcgcactattcggtaagcaaggcgggcctcatcatgctcacccgcgcgctggcggtggagctggccccgcacatccgggtcaacgccgtgtcgcccggcacggtggccttccccgaggacttcgacgccgaggcccgcgacgcggtgctgcgccgcatccccatggggcgcgagggcaacgtcgaggacattgcccgcaccgtcgtcttcctcgcccgcgaggcgccgtacatcaccgggcaggtcatcgccgtcgatggcggc

SEQ ID NO: 43242 - DNA, 762 bp, Myxococcus xanthus
atgagtgaggtgggcacgcgcaaggtgctcgtcactggcggtgggacgggcattggtcgcgcggtggcggaggccctgctgcgcgcgggggggcaggtggtggtgtcgggccggcgcgtggaggtgctggagtcgctgacgacagcatggccgggacaggccttcgcgctgccgtgtgacctggcctcgctggaagcccgcgaggggctgcttcgccgtgccgccgggttgctgggagggctggacggtttcgtccacagcgcggggcaggtggtgcaccagccgccgggccacatcggcgaggacgcgcttcgcgcgcagctcgaggtcaacctcatcgcgccgctgcggctgggcgagcaggcactggaggtgctggagccgggtggggcgcaggtgttcatcgcgtccacgctggccacgaggcccgtcgtcaccagcgcggtgtacagcgcggcgaaggcagggctccttcaggtgatgaaggtgctggcgttggtgggtgcggcgcgaggcgtgcgtgccagcgcggtgctgccgggcgtggtggagacggacatggtgcgcgaggtgcgcctggctcccggcgcggggccgctgtccgagcccgagtacgcgcggcggcaggaggcccagcttgcgggcttgcgggcgctgcatccgctcggacggttggggcgccccgaggacgtcgcagaggcggtgcgctacctgctgggcgcgtcgtggatttccggttccgagctggtgctggatggaggg

SEQ ID NO: 43243 - DNA, 744 bp, Myxococcus xanthus
atgaacgttctgattaccggggccaccgcgggattcggcctggccattgcccgccgcttcatccaggacggcgcgcgcgtcatcgcctccgggcggcgcaccgagcggttggaggccttgcgcgcggagttgggcgagcgggtgctccccctgacgctcgacatcacggaccgtgaggccgtggagcgggccatccgctcgctgccggcggagttcgccgaggtggacgtgctggtcaacaacgcgggcctggcgctggggttggacctggcgcagtcggcccgcgtggaggactgggacacgatggtggacaccaacgtgaagggcctcctgtactgcacgcacgcggtgctgcccggcatggtggcgcgcaaccggggccacgtcgtcaacatgggctcggtggcggcggagtggccctacccgggcggcaacgtgtacggcgccaccaaggccttcgtgcaccagttcagcctcaacctccgcgcggacctgcacggcaccgccgtgcgcgtgacggacatcgagcccgggctggtgggcggcacggagttctccaacgtccgcttcaagggcgacgacacacgcgccgcgtccgtctacgccaacacccaggcgctgacgcccgaggacatcgcggacgcggtgcactgggtggccacgcgacccgcgcacgtgaacatcaacgtcatgtcgctgatgccggtgtcacagtccttcgggcccctcccggtgaagcgacag

SEQ ID NO: 43244 - DNA, 348 bp, Myxococcus xanthus
atcttcaaggaattcacctttgaggccgcgcaccggcttcccaacgtgccgcccgggcacaagtgcagccggcttcacggccacagctaccgggtggaaatccacgtgcgtggcccggtgggctcgcagtccgggtgggtgatggacttctccgacatcaaggaggccttcgagcccctgcggctgaagttggaccactactacctcaatgaggtggaaggcctggagaaccccaccagcgagaacctgtcgcggtggatctggaagcgcctgcgtccgggcctgcccctgctcagccgggtggtggtccgcgagacgtgcaccagtggctgcatctatcaaggcgaa

SEQ ID NO: 43245 - DNA, 420 bp, Myxococcus xanthus
gcttctattggattatcggctacagccattgcacccgggaagtttgctacagcggagcatatgaactttactactgttttatttgaaacgattggtacggttacaactgtagaggaagagcagcttcacgctgtaacaggactatctggaagcggcccagcgtatgtctattatttagtagaagcaatggaaaaagcagctgaaaaacaaggcttggatacgtcagtgtcaaatgaactaattcttcaaacgcttatcggtgctgcagaaatgctgaaacagtcacctaaaacaccggccgtacttcgaaaagaagttatgagtcctggcggtacaacagaagcaggaatcgaacagcttatttctcataacttccaagaagcgatgatgcagtgtattgaacaagctaccattcgctct

SEQ ID NO: 43246 - DNA, 108 bp, Myxococcus xanthus
atgagtaatccaaaagttgttttagcatattccggaggtttagatacatcagttgcaattaaatggttacaagaaaaagggtacgatgtggtagcttgctgtttagac

SEQ ID NO: 43247 - DNA, 843 bp, Myxococcus xanthus
atggaatcctctttgaaggaagtacgttttgattccattacagctgaacacttcaagcaagtgaaggagcatggttttacagatgcgtatctagcaagcgtatggaacgtgccagagcttgacgtaagagcgaaacgtaaagcactacatattacgccaagctacaaaatggtagatacatgtgcagcggagttcgaatcctctacggcttatttctactctagttattatggcgagagtgagattgaaccatcaacgaataaaaaagttgcgattatcggttctggaccgattcgtatcggccaaggagtagaattcgactacagttctgtacacggtgtgttagctcttgaaaaagaaggatacgaaacaattttaattaacaacaatccagaaacggtaagtacggattttgaagtagcagaccgcttatattttgaacctgtaacagtagaagatgtgctaaacgttcttgatgctgaaaatgtgacggatgtaattgttcaatacggaggtcaaacggctatttcgcttgttaaagggctagaagaagctggcgtcaatttactagggattacaaatgatgttattgatgcacttgaagatcgcgacctgttttataagctcttagacgactgtgatattccgcatatcccaggtgaaatggcgaaagatgagcaagaacttgtacaaaaagcaaaagctatgggattcccattacttattcgtccttcttacgtcattggcggaaaaggaatgctgacaattcaaaatgaaacggagctgcaggcttgtttaccagctattaaagcgtctcatttcccaatgcttattgatgcttac

SEQ ID NO: 43248 - DNA, 309 bp, Myxococcus xanthus
gtaggatatgcgttaggtatcggctttgcacctgttcgtaaagaaggaaaattaccgcgtgaagtaattgaagtacattacggtttaaaatacggtaaagacgtattaacgattcacaaagatgcaattaagccaggtcagcgcgtgttgattacagatgatttattaggaacaggcggcacaattgaagcgacaattaagcttgttgaagaattatgctgaattgttgttggagctgcgttcttaattgaactttcttaccttgacggccgtgacaaactacacggctacgatgtattcacattaatg

SEQ ID NO: 43249 - DNA, 687 bp, Myxococcus xanthus
ttagtcgtgagtgaccctggtgtggttcgtgcgggattagtttcacccattgtaactgccttggaggcttctggttaccgagtgctggtatttgattcaattgaacaaaaccctcgagatacgaactgcttggaaggtgctaagttatttcgtgactttagtgcggaggcagttgtggccattggtggcgggagtgcgatggacacgggaaaagctattgcgctgtgcggcccaaacggcggagaaccatctgactatgcagacggccgactcctgtattcaaacatcgcaccagttatttgtattccaactacttcaggtacgggctcagaggttactcgttctgccgttattaccgaggcatctacacatcggaaaatgacgctcaaacatagtacattaagacctgtcttggcgattcttgatgctgaactaacattaagtcttccgccttctgttacggctgcgactggcattgatgccctcgttcatgcgattgaaggttatacgtgtaaagtaacaaatcctatttcacaagcgcttggggctcaagcaatgagaacgattgtttcggcattgcctatcgttttccgcgatggtaaaaatgaagcggctcgtcaagatatgctggaaggaagtctcttagctggcttgtgttttggatctgcagatgttggttcggcacaa

SEQ ID NO: 43250 - DNA, 216 bp, Nitrosomonas europaea
ctggcaatcggttatacgctcaatgaactgggcaacgatattgcgggtggtatcatcccggcttcgtttgagccgactatcgactacgtcgtaaccaaagtacctcgcttcgcattcgagaaattccctcaggcaaacgatcgtttgactacacagatgaaatcagtaggcgaggtcatggcgattggacgcaccttccaggaatcgctgcaaaag

SEQ ID NO: 43251 - DNA, 267 bp, Nitrosomonas europaea
ctcgatctcgctgataaggcacatacgaatgtacgtgcgctgtcaggcggtatgaaacgacgtttgctgatcgcgcaggctctggtgcataaaccgccggtgatcattcttgacgaacctacggcgggggtggatgtggatttgcgccagagtttgtggcagttcatccggcagctcaatctcgaaggtcatacggtcgtgctgaccacgcattatctggaagaagccgaagctttgtgtaaccgtgtggcagtgctcaagcagggg

SEQ ID NO: 43252 - DNA, 804 bp, Nitrosomonas europaea
ttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtct

SEQ ID NO: 43253 - DNA, 768 bp, Nitrosomonas europaea
atgggatttcttgccggccggcaaattctgattacgggcctgctcagtaaccgctctatcgcttacggtattgccaaagcaatgcagcgtgaaggggccaaactggcattcacttaccagtcggatgatttacgcgagcgcatcagtaaattagctgcagaattcaacagtgacctgctgttccgctgtgatgtcagtcaggatgaagaaatcagccgttgcttcagcgagctggcagatcactgggatggattggacggaatcgtacactccattgcctttgcaccgcgcacagccttggccggcgattatctggaaagtgtcgatcgacaggcttttcatattgcacacgacatcagctcatatagctttgccgcgctggcaaaagccggactgccactgatgcagggaaggccggctgctctgctgacactcagctatctcggtgcggtacgtgtgatgcccagctacaatgtgatgggattggccaaagccagcctggaggccaatgttcgttttatggcatcgagccttggtaaacaggggatcagggtcaatgcaatttcagctggaccaatcaaaacgctcgccgcagcaggaatcggcaattttggcaaactgctgggatattctgaaaaagtttcgcctctgaaacgaaacgtgaccactgaagaagtcggtaatgtagcggcctttctttgcagtgatctggccagtggtatcactggtgaaatcacttatgtggatgcgggattcaataccgttgca

SEQ ID NO: 43254 - DNA, 981 bp, Nitrosomonas europaea
acccttacccagttcatcattgaagagcagcgtcacatcgcgggagcgagcggtgatttcaccgcattgctgaacgatatcgtgactgctatcaagaccatttccaatgcggtgaacaagggggcgctgattggtgtgatgggggcgctggatacagaaaacgttcagggtgaaacccaaaaaaagctggatgtgattaccaatgaaatcatgatccgcaacaatgaatgggctggtcatctttctggcatggcatcggaggaaatggatgatgtctactcgattccgtctccttatccactcggcaaatatctgctggtatttgacccgctggatggttccagtaacgtggatctcaatatttccgtcgggacgattttttcgattttgcgctcgccagtgccaagccgggctgccagtatggaagatttcctgcaacccggcgtcaaacaggtttgtgcaggttatgcattgtatggttcatccaccatgttggtgctgaccacaggccatggtgtcaatggttttacgctggatcgtgatatcggtgaattcgtgctgacacatccaaacatgaggattcccgccgataccagggaatttgccatcaatgcctccaaccagcgtttctgggaagcaccggtacagcgttatgtggcggagtgtctggcaggaagtaccgggccgcgcggtcgcgatttcaatatgcgttgggtggcttcgatggtggcagaggtgcatcgtatcctcactcgcggtggtattttcatgtatccgcgcgataccaaagatccctccaaacccggcagactgcgtctgatgtacgaagccaatccgatgagttttatcgtcgaacaggcaggcgggttatccaccaccggctacgagcgcattctggatgtcgtgccgcaggatctgcatcagcgtgtaccggtgattctgggctcgaagaacgaggtcgaggtggttctggagtatcac

SEQ ID NO: 43255 - DNA, 1260 bp, Nitrosomonas europaea
gccaattcacatgaatatctgctcgacaacggtctcaaactggtcgtcaaagaagatcaccgttcccccgtcgttattcaacaggtctggtataaagccggcagtatggacgaagtcaatggcacaaccggtgttgcacacgcgctggaacacatgatgttcaagggaacggacagtgtgcttgctggcgaattttccagaaagattgctgccatcggtggcaaggagaatgcattcaccagccgtgactacactgcttattatcagcagctgcaccagcgccacttaccgatggcgatggagctcgaatccgatcgcatgcacaacttgcaattgacggaggaagcattcgccaaggaaatacaagttgtcatggaagaaagaagattgcgtaccgatgaccaggcacattcactattgtatgaaaagatgatggcaacggcttttcagacacacccttaccggcgtccggtcatcggctggatgaacgatctggagaatatgcaggtaaatgacgccagggactggtaccagcgctggtatgctcccaataatgcggtgctggtggtggtgggtgacgttgatccggaaaatgtgttcgtactggcaaagaaatattacggcagattcagtgccgccagggtccctgctctgtctgaacgcaagccgcaaatcgaaccacctcaaacaggaatcaagcgcctggtggtgaaagcctctgcacaacttccctatctgatcatgggatacaaagtccccgttctgaaagatccgaaaaatgaatgggagccctatgcactgaccattctggcagaggtgctggatggcaatgcctctgcaagactcaacaaaacgctggtacgcgaaacacgtgtcgcgatctcggccgacgccagctataatgccattgaacgcggcccgggtacttttttcatcgatggagcgcccagcgaggacaagacggtggatgatctggagcagtcgatccgtactgaaatcggcaaaatcatccagtccggagtcacacaggaagagcttgcgcgtgtcaaggcacaggtagtggcaaaccatatttatcagctcgattccacatttgctcaggcaatgcagattggcagactggaaagcgtcgggctgtcccaccgcgatgcagatatcattctggaggggttgcaggcggttaccgcggaacagatcaggaaagtagccgagaaatatctgatcgatgattcactgacgattgccgtgctggatccgcaa

SEQ ID NO: 43256 - DNA, 1350 bp, Nitrosomonas europaea
ttcatccagaaccgcagcaaagaaaattttgccctgcatgacaagtatctgaacagccagatggtcaaagtcctcaaaaccatcgattttgatcgtcattatgtccgggcagaaggcgcatatctgttcgacgagcaggataaccgctatctggatttgctgagtggcttcggtgtctttgcactggggcgcaatcacgcggaaatcgtcgaagcactcaaaagcactctggaggcagatttacccaatctcgtccagctcgacgtatcattactcgcaggactgctggcggagaggctagttaaactgaccccggacggattaaaacgtgtcttttttgccaactcgggtactgaaacagtcgaggcggcgatcaaattcagccgttacgcaaccggaaaatccaaaatcattttctgccacggctgttatcacggactgagccttggctctctctctgccacgggagatgatcattacaagaagggattcggcccgatggtgccggattttatcgaaatcccgttcaatgatctcgaagcactggaacaggtgcttgcgcagggagatgtcgccgccttcattactgagccaattcaaggacacggtgtctggataccggacgataactatctgccggaagcagccagactcacccgcaaatacggcgcactgttcatcacggatgaaatacaaaccggactggggcggaccggcaagtggtgggcggtcgaacactggtccgtcgaacccgatatcctgtgcatgtccaagacgctttccggcggattcatccctgtgggtgcgctggtctgcaaggaatggatcttcgatcgtgttttcaaccgcatggatcgcgctgtcgttcacggcagtacatttggtaaaaacaacctggcaatggccgccggtctggctacactggaagtactggaatcaggaaatctcatcgagcattccgcccgtaccggagcagccattatggatgcgctgacgccactgacggaaaaatacgaatgcttcaaggaagtacgaggcaaaggcatgatgattgcgctggaatttaccgaaccgaaaagccctatgctgaagctgtcgtggaaaatgctcgaatctgccaacaagggactgttctcacagttgataaccgtcccgttattcaggcagcaccgggttctgtctcaggtagccggccacggcatgaatatcgtcaaattcattccaccactcatcctgacagaatccgatgttcaatggatcgttactgcggtcagtgatgtcgtggccaatgcacaccgcggaccttcagcagtatgggattttggcaaaacgctggcattcagcgcactg

SEQ ID NO: 43257 - DNA, 759 bp, Nitrosomonas europaea
atcaacgtttttcctgtccgggcgtttagggacaattatatctggatcgttcacaatcaacagttcgctctcatcatagacccgggcgatgcgacaccggttctcacctggctgagacaacaaaaattacaacccattgcaatcctctgcacccatcaccatcatgatcacacgggtggtatttccctgctggtacaaaaattcgaaatacccgtttatggccctgccagtgagaagataccggggatgacccacccgcttgcggaaggggacaccctcgtgttcccggagctatcgctggaacttagcattctggacgtccccggacataccgcaggccacattgcctgtcatggccagaaccggctgttctgcggggatacgctgtttgcctgcggttgcggaagaatctttgaaggcaatgcacaacagatgtttgattctttacagaaactgaccgacctgcctgacgaaactcaagtttattgcgcccatgaatacacgctggacaatatccgcttcgccagggcgatcgaccctgataatcccgagctgattgaactggaaagtaacgtggaagaaaagcgggagcagaatatgcccacactcccctccagtctggctgcagaaaaagccaccaacccgtttctgcgttgcaatcagccggccatcatccagagtgccagccggtatgccgggcggcagctcactgatccggtcagtgtatttgccgcgatccgtgactggaaaaacaatttc

SEQ ID NO: 43258 - DNA, 2367 bp, Nitrosomonas europaea
tcatcaccaacaacaattgaattacccatcgagggaatgacatgcgctgcatgcgctgcccggatcgagaaaaatctcaacaaactgccgggcgtgcatgcagctgtcaattttgccaatgagaaagccctcataaagttcgatcacgattccacccaccctgaagagctggttcaatccatcgaaaaggcaggattccaggtcccggaacagaccgtacagctgcaaatcagcggcatgacttgtgccgcatgcgcaaatcgtatcgaaactgtcctgaatgagatacccggagtcagagccatattgaatccggctgcagaaattgcttatatcagcttcaatcccgccattacttcggtcgagcaactggtttctgctgtagaaaaggcaggttatggcgctaatcagatcagtgatgacaattacgttaaagaacaatcccgcaatcaagctgcctaccggaaagaactccgtatattctggatctctgccgccctgactgtacccttcatgctggaaatgatcatgatgctgacgggtaatcacaacaacctgctcccttactggctgcaatggctgcttgcaacgctgatccagttttggcccggcaggcgtttctatatcagcgcctggcgcacactgcgtggcggaggagccaatatggatgtactcatcgcactgggtaccagcatggcctatctcttcagcaccgccgtcatcattttgcaactggaccagcatgtttactttgaggccagcgcgatgatcatcacgctcgtgcttctgggcaagctgatggaaaccagagcaaaaagaaaaacttcagcagccattgaaacactcatcaaacttcagcccaaaacggccagagtcgaacgtgatggggaaattatcgagatcgatatcaatagccttaagaatgaggatatttttcttgtccgctcgggcgaaagcctgcccgccgatggcatcgtcattgaaggatcttccagcataaacgaagccatgttgacaggtgaaagccagccggttaccaagcaggtgggcgcaaaggtttatgccgctacccagaatcagcatggtttactcaaatgccgtgtaacgggtgtcggtaaaaatacccagcttgcagccatcattcgtctggttgagattgcacagggctctaaagcacctatccagcgtatggcagatactgtctctggtatttttgtaccaattgtaattggtatcagcattctgacattgggactaacctggtggcttacaggccatttcgtcatagcactcatcaatgcagtagcagtactggttattgcttgcccttgcgcactgggtctggccactcctactgcaatcatggttggcacaggaagaggagcacaagaaggaattctggtaaaaaacgcgaccgcactggaactcgcagaaaaaatccagatgcttgttgtagataaaacagggacgctgaccgaaggccatccatcagtcacagatattatcgtggccgatgaggtgaatgagcacgatttattacagattgcagcttcactggaacaaggctctgaacaccccctggcaaaggcggtatcgcaatatgcttcttcatcaaaaatcagattattggcgataaccaattttgcctctgtgaccggcagcggaatcaaagcggatatcgacaatgcatcttacattcttggttcacccaaatttttggcagaaaaaggtgctgtgctcgatcagcagcgtatcactgcactccagacagaaggtaaaaccgtcgtgggtgtcgctatccaaattaatgaatcagtccgggtaatcggctatcttgccattgcggattcactacgcgaaacttccatcaaagcaattcaacgcatccagaatctgggcatagatgtcatgatgctgacaggtgacaacccgactacggctgccgccatcgcaaaacaggcgggaataaaaatttttcatgcagaagtttcgcctcagaataaagcagccgaaatcgaaaaaatcaaggcaaatggccagtttgtcgggatggtaggagatggaatcaatgatgcacctgcactggcagccgcgaatgtgagttttgcgattggtgctggatcagatatagcaattgaagccgctgacattacattgatgcgcaatgatctgatgagtgttgcggatgccatctcactatcgcgcagcacactgcacaaaatccggcagaatctgttttttgcattcttttataatattttaggtattccactggcagcagcaggtatgctaagccccgtaattgcaggtgcagcaatggcaatgagttcggtatcagtcattaccaattcattactgttgaaacgc

SEQ ID NO: 43259 - DNA, 657 bp, Nitrosomonas europaea
ctttctgcagttctttttgatgtagacggtacgctcgcggataccgaacgagatggacaccgaattgctttcaatcaggctttcaatgaatttcaactggattgggagtgggacgtagacctgtatggcgttttacttcaaattacgggtggcaaggaacgcatccgtttctatatagaaaattatgcaccttctttacttagtaaaaataatcttgatgaatggattgcacagattcataaaaccaaaaccaactattttctgaatctgctgaaagaagggaagataccactacggccaggcatcaaacggttgttggacgagttacgaaaaaacaatataaaaattgcaatcgccactacaacaacctatgaaaatgtaagcactttacttcagtgcacactgggagacagcgctctcgagtggtttgatgtaatcggcgcaggagatatcgtttcaaaaaagaagcccgcaccagatatttatgaatgggtacttaaccaacttaatcttcctgctgaagcttgtatcgctattgaagattcagaaaacggactgaaatcagctacggcagccggcataaaaacaatcatcaccatcagcgaatatacccgggagcaaaatttcagttatgcagcccttgttttagaggattta

SEQ ID NO: 43260 - DNA, 633 bp, Nitrosomonas europaea
atgacatcgctgcggacgcgggttcgtatggtcgaacgcttgcgggaacagggtattaaagatgaagtggtattggcagcaatgggttttatcccgcgccatctttttgttgaggcagccttggcatctcgggcatatgaagatgttgcgttaccgatcaattacggacaaaccatctccagtccctggattgtcggccgtatgactgaattgctgcgaaatggtggcagtaattcacttagaaaaatcctggaaattggtacagggtgtggttatcagactgcagttctggcaaaaatagcaagtgaagtctactcgattgagcggataggtcctttgttgacacgtacacgtattcgattacgtgaattgggtattctcaatattcatctgaagcatgctgatggtatgcggggcttaccggaagcagggctgttcgatggaattatgatgacagcagttataccggaaataccggagacacttctggaacaattggctatgggtggcagaatggtattcccaaagggaaacaggaagcaatatctttgtgtgatcgatcacacgaccgaaggttttgttgaaactatcttggatgaggtgatgtttgtaccgatacttcccggaactatc

SEQ ID NO: 43261 - DNA, 1647 bp, Nitrosomonas europaea
tgggagcagtttgtacaggccgcagggcgggttggtgcaaggttaacagattttggggtcaggaaaggtgatcatgttggtatcatggctgcaacatcacttgactgggaatatgcccaaatgggggcattgtttgcaggagccgttgttgctggaattgaccctgagtatccggcggaccagttaaatcatgtgatcgagaatcttgggttgtcagtcctgtttgttcagaatcgttcagtcttcgcaaaaattccattagaacttcgtcagcagatcagtgtatttattttctttgagggtgaatctcagcagaaaaatgaattcagcatgatcaatttactggtagagcaagaaactgatacttctatttgtttgccggatgtgttgccacaggatgaggcagtgatcgtattttcttctggtacaaccgggatgcccaaagcaattatctttacccatgaacaggttattatggcggttgaggccattatgcgggtatttaatgatttgagtagccagacgatacttttgtgctggttgccgttatcgaacctttttcagcgtattgtcaatttttgtgcaataaaaattggtgcatcgagttacatattgagtgatccgcgtgatttgatgcggtacgtcaaacaggtgaatccagatgttctgatcggtgtgccaaaggtacttgagcgagtgcattcgggggttgtcgaccatattgaaggtcgggtttggccattgcgtatgctggcgcgatgggcaattaggataggttacaagcgggctgcggcaaggagtgatcgaggtgattcttttggtctgatgaataaactgctatggaaacaggccgagaatatgtttttacgccgcctgcgaatggttttcggttcgcgggttcgttatctcgtcagtggatctgctgcgatgccggtttggctattgagatggtttgacgcaattggattaccggtatatgaagtttatggtattagtgagaatgttatccctgtcgcggtaaattcatctggcagccgtaaattgggggctgtgggtaaaccattattgccaaatgagataaagctcactatggatggtgagatccttgttcgaggcccaggagtgttcaagggttatcaggatagaaaggaagagagtaatttgcgtttttcaccagatggttattggcacactggtgatctgggagagctagatacagcaggatttctttctattgtcgggagaaagagcgatgttttcaaaacatctgcaggaaaatggattgctcctgtgagaattgaagaacgactgggacgtattgcttatgttgagcaaagtgtcgtatttcaatatgaatcaggcaaaattgttgctgtcattgtcgttgatttggagaaatgtgcacagaaaaccagtgcagtgcgctattctgaagtttcattacatatggaaaatatggctaagaataagcttcatcaaattctggagacagatatcaatgcagaattggaagatctgcctctttatcagcgaccggtttatgttgctgtgactgataagttttttacggtaagcggaggggagctaactgtcaatatgaaggtgcgtcgcagtattgttgcacagcggttttcagcgtacttcgaa

SEQ ID NO: 43262 - DNA, 4068 bp, Nitrosomonas europaea
atgagttattcgtttgccgagaaaaaacgtattcggaagagctttgccaagcgtgccagtattctaccatttccgtttctcctcgctactcaaatacagtcttatactgattttctgcaggcagaaattgcgcctggtaaacgcaagaatcaggggctacaggctgcatttaactcagtttttccaatagagagtcattctaataatgctcgtctggattttataagttatatgcttggttctcctgtatttgatgtcaaagaatgccagcaaaggggcttgacttacgcagctccgttacgtgccagggttagattgaccattctggacaaggaagcgtcaaagccgacagtcaaagaagtcaaagagcaggaagtgtatatgggagaaattcctctcatgactgatactggttcttttgttgtcaatggtacagaacgcgttattgtttcacagttgcatcgctcgcctggtgtattttttgagcatgatcgaggcaagactcattcatccggaaaattattgttttctgcccgtattattccgtatcgtggttcatggctggattttgagtttgatcccaaggattatgtttatttcaggattgatcgtcgccgcaaaatgccggttacgactctcctaaaagcgatggggtattctcccgcacaaattctcgcggatttttttgagttcgatcattttatcctcgtggacaataagattttcttcaatcttatacctgagcgcttgcgtggagagttggctggttttgatatagtttctgaagatggcaaggtttttgtacagaaagacaaacgaataacggccaagcatgttcgtgatttgcagcaggctaacctcactaaaattcctgtacctgaagaatttctgctgggaaagattctggctgcggatctcgtagataaggaaacaggggaaattattgcgctggccaacagtgaaataagtgaaacgttacttggacgaatcaggcaaactcagagcagtgaaatcagcacgctgtttgtaaatgatcttaactacggtccttatatttcacaaacattgaggattgatgagaccactgaccagatgtctgcccaggttgctatttacagaatgatgcggccaggtgagccacccactgaagaagccgttctggctttgttcaatggtttgttttattccccagagcgttatgatttgtccgtcgtcgggcggatgaaattcaatcgtcgggtggggcgcgaggaattaacgggatctacgactctatcaaatgacgatatcatcgatgttatcaagatactggtcgagctgcgcaatggtcgaggagagatcgatgatattgatcacttaggtaatcgtcgtgttcgttctgtgggtgagttggcggaaaaccagtttagagcagggctggcacgagtcgagaaggcggtcaaagaacgtttgagtcaggcagaatccgaaaatcttatgccacatgactttattaatgccaagccggtctcttccgcgattcgtgagttttttggatcgagtcagctatcacaattcatggatcagactaaccctttgtctgaggttacgcataaaagacggatttcagcattggggcctggtggtttgacacgggaacgtgcaggttttgaggtgcgagatgtgcatccaacccactatggtcgtgtttgtccgattgaaacacctgaaggtcccaatatcggtctgatcaactcactggctctttatgccagaaccaatgaatatggattcatagaaactccgtatcgaatggttagaaatggacgggttactgaagaagtcgtatacctttcagcaattgaagaaagtcaatatgtgatcgcacaggcgaatgcgaattttgaccagaatggggtatttaccgatgaagtcgtttcctgccgccacaaaaatgagtttactctggcatcaagagatcaaattgaatatgtagatattgcacctgcacaaattgtttctgtagcagcatctctgatccccttcctggagcatgatgatgctaaccgtgcactgatgggatcaaatatgcaacgtcaggccgtaccctgtttgcgtgccgagaaaccgttagtgggcacggggatagagcgagtagttgccgtgcattctggaactgccgtcagaacgatacgtggtggtgtggtggattatgtggatgccagtcgtatagtgatccgtgtgcacgatgcggaggctcgtgctggtgaagtgggtgtggatatctacaatcttacaaaatatactcgttcaaaccagaataccaatatcaatcaaagacctattgtaagaatgggtgatgtgctctctcgtgacgatgtaattgcagatggcgcatcgacggacttgggtgaactggctcttggtcagaatatgctaatagcatttatgccttggaacggacttaatttcgaggattctattctgatatctgaacgggttgtatctgatgaccgatttacttcaatccatattgaggaattggcagcagtcagtcgtgataccaaactgggtaccgaggaaataactgcggatataccaaacctgtctgaacgccagcgtgcacggcttgatgagtctgggatagtttacattggtgctgaagttgaagccggggatgtattggtgggtaaagtaacaccaaagagtgaaacacagctgacaccggaagaaaagcttctgcgagccatttttggagaaaaggcttctgatgtcaaagatacatctttgcatgtgccggctggtatttcggggacagtgatcgatgtacagatttttacccgtgagggagtggatcgcgacaaacgttccaaacaaataatcgcagatgaactgggccgctttaaaaaggatcttgctgatcagatgcgtatcgttgaagcagatgcgtttcaacgtgcagagcgcttgcttactggcaaagttgctgctggcggacctaaaaaactagccaaaaattcgaccatcactcgtgattatctcgaaaatgtggaaaagcaccactggtttgatatacgtctggtcgatgaaaacacaagtcttcaactggaacagatcaaagatagtctggttcagaagcgaaaactgtttgatcttgcatttgaagagaaacaccgaaaactttctcaaggcgatgaattaccgcctggtgtacagaaaatggtgaaagtctatatcgctgtaaaaagaagattgcagtctggcgataagatggctggtcgacatggaaacaaaggtgttatttccaagattgtaccgatagaagatatgccttatatggcggatggcacaccagttgatgttgtgctgaatccattgggtgttccttcacgtatgaatattggtcaggtactcgaagtgcatttgggatgggctgccaaggagctgggtaaacgggtgaatgaaatgctggcctctcagcgtaatgtttctgatatccgcgattttctaaataaaatttataacaatagtggtaaacaggaagatctgacttctctggaggatgatgaagtactggcattggcaagaaatctgtcgagtggagtgccttttgctactccggtgtttgatggtgcacatgagtcagagatcaaacagatgctgaaactggctggattgcctgagtctggtcaaactacactctatgatggtagaacgggggaagcttttgatcgtccggttactgtaggttatatgcatgtgctaaaacttcatcatctggtagatgacaagatgcatgcgcgctcaacaggtccatatagccttgttactcaacaaccattaggtggtaaggcccaatttggggggcagcggtttggtgaaatggaggtttgggcactggaagcttatggcgcatcctatacccttcaggaaatgcttactgtgaaatctgatgacgttaatggacggaccaaggtttatgagagtatcgtcaaaggtgatcataaaattgatgcgggtatgccggaatcattcaatgtactggttaaggaaatcagatctctggggcttgatattgacttggaagag

SEQ ID NO: 43263 - DNA, 1098 bp, Nitrosomonas europaea
atcagggctgcagtggtttaccagaaaggcgggccttttcagatcgaagatctgaggctggaagcgccgcgtaccgatgaggtgctggtacgcatcgtagcgaccgggatgtgtcataccgacatggtggctcgtgaccagctttatgatgtaccgctaccggtagtcctcgggcatgaaggttcaggtatcgttgaacagatcggtgatggtgtaagaaaagtggcagttggtaaccatgttgtacttacctatatgtggtgcggtcattgcaaaccctgcctgcgtggcgatctgacctactgcgagcatttttatgcgctgaatttcgggggagtacgtgaagacggcagtacttcgacctgtctggcaaacgacacccggagaccgattcacgatcatttttttggacaatcatcatttggcacatttgctctggtgcatgaacgcaatgtgatcaaagtacccgaaactgcaccactggaactacttgggccattgggttgcggcattcagacgggtgccggggcggtcattaatacacttaaagtcagcccgggcagcagttttgtagcattcggcgggggtgcggtaggattgagtgcggtgatggcggcacatgctgccggtgctacgacaatcatttctgtcgatgtagttccttcacgcttggcgctggcaatggaacttggcgcgacccataccatcaacagtcgtgaaacggatcctgttgaagcggttcacaagattattaatggaggggctgatttcactttggaatcgagtggacgcccggccgtattgcgccaggccatcgatgcactggcgatccgggggacatgcggtatcgtcggcgcgcctgcactgggtactgaggcgagtttcgatgttaacggcgtaatgacgacaggcaagcgcatcatcgggatcgtcgaaggggacagtaagccggaccttttcatcccggcactggtcgagctctaccagcaagggaaatttcctttcgacaggctggtgaagttttattccctcgatcagatcaatcaggctgccgaggatagtgaaaagggcatcacgatcaagccgatcatccggttg

SEQ ID NO: 43264 - DNA, 1912 bp, Nitrosomonas europaea
atgccacttcttacgctcgacaacgcctgcctggcttttggtcatcatgctttactcgatcatgccgcgcttcaactcgacccgggtgaacggatcgggctgatcgggcgcaatggtgccggtaaatccagcctgttacgcgttctggcaggtgagatcaagctggatgatggacaactgtgggtggcgccagggatgaatgtcgcctacatcccgcaggaaccgacgctggatgagagcgcatccgtatttgccgaagtggcgcgcgggcctgggtacgctggcgcagactctgctggattatcatgaagtttctcacgcactgggagaggagggggcggataccaaagcactgctcgatcgcatgcagcatttgcagggagtgctggaagcccaaaatggctggagtctgcatcataaggtggaaacagtgatcaaccggctcgaactgccggaagatgccattgcgggcacattgtcagggggggccagaaaacgggtggcgctggcacgggcactggttgtatcgccaaacgtgctgttgctggatgaacccactaatcatctggatttttcctccatcgaatggctggaagaaacattgcagaattttcccggcagcgtgattttcattacccatgaccggcgttttctggataacgtggcgacccgtatcattgaactggatcgcggtgagctgaaaagttttgctggtaatttctctgcatatcagcaaaagaaagctgaattgatggaagtcgaatcggttcataacagaaagttcgataaggtactggatcaggaggaagtctggatacgcaaaggcattcaggccagacgcacccgcaacgagggcagggtaagaaggctggaagcactgagattggaacgtgctgcccggcgggagcggatcggtaatgtcaatttccgggtggatgccgggcagcattccgggcagctggtcgcggaactggagcatgtgaccaaaagttttggagataagaccatcattcaggatttttcctgtcgcatcatgcggggtgatcgtatcggattgctgggccccaatggtgctggtaaatctaccctgctgaaactgatactgggcgaattgcagccggatagcgggatggttcggctgggtacccgcttgtccgttgcctattttgatcagttgcgagagcagctgaatgaagatatgacgctggtcgattccatcagccagggctcggagtttattgaaatcgatggtaagcgtaggcatgtcatcagttatctggaggatttcctgtttccgcctcagcgtgcccgctcacccgtgaaatctctgtccggtggtgaacgcaaccggttgttgctcgctcgcctgtttacgcgtccggccaatgtgctgattctggatgagcctaccaatgatctcgatatcgagacgctcgaattactggaaacgttattgcaggactataccggcacactttttctggtcagccatgatcgtgccttcattgataatgtggttactcaggccatcgtatttgaaggaaacgggcatttgcgtgaatatgccggcggctatcaggaatggctgcaatccagatcagctacgaaagccatccgaaaagagaacagtgattctcccgtgccggtagccggactcggccagatcaggaaagacaagtcatcccttcctgccggtttgagttatcaggagacaaatgagcttgcagcgctgccggggaaaatcgatgtactcgaacaagagcagatagtggttacccggaaactgagtgatcctgccctttacaagaataaccataatgaagcaatggaattgcaggcgcgtgctgcagcactggaaaaggagctttccctatactatactcgctgggaggcgctggaacataagcagacc

SEQ ID NO: 43265 - DNA, 855 bp, Nitrosomonas europaea
aatcagcgttatctgcccaggcaacctttgccggattccattcatcttgtctctgcgttgagtgaggcactggaacgagccgaactggtttttgtcgtcgtacccgttgcaggattacgcaccactttgcagcagatggtggcattgaacccatcattgccccttattctggcctgcaagggatttgaaacaggttccgcaaaacttccctgtcaggtggttgaggaagtttatccagcgagtatcacttgtggtgtgctatccggcccgagtttcgcccgggaagtggcacaaggccttcctgccgcgctgacacttgcttctcacgacgaaatttttgccagaagcgttgccggtgagattcgtacagcaagcctgcgggtttattcaggcaacgacgtgatcggggtggaggtcggtggagcactcaaaaatgtgattgcgattgctgccgggatttctgatggaattgcgtttggcaataatgccagagcagcgctgattacccgcgggctggcggaaattacccgattgggcatggcacttggcggatgccgggaaacctttaccgggctgacgggtatcggtgacctgattttgacttgtaccgggaatctttcaagaaatcgtcgggttgggatgatgcttgctgccgggcggcaattggcagagatcctgcctgaaatagggcatgtcactgaaggcgtctatacggttcgggaagcgtatggattgggacagcggctgcaaatcgatatgcccgtgactcaggcggtttacagtattctgtatgagcaggttccggttgagatagcgattcaggatatgcttgatcgtgagcctggagctgaaaca

SEQ ID NO: 43266 - DNA, 1227 bp, Nitrosomonas europaea
atgccagtcaacattcctcctttactacccgaacaactgctgccgatccccggcctgtcactaggtacagcagaagccagtatcaaacggcccggccgtaaggatatactcgtcatcacgctggcagaaaatacacgggttgcaggtgtgttcacccggaatcgattctgtgccgcgcctgtcacggtcgcccgatcacatcttacgggttcgctgccgatccgtgcactggtgatcaataccggtaacgccaatgccggcaccggtcagtccggcatcgatcatgcacacgccacctgtgcttcactggccaggctcatcggctgccagacccaacaggtactgcctttttctaccggtgtcatcatggagccgctgccggtagaaaaaatcatcacccatcttccgcaggccctggcaaatctggcaccagacaactggttcgccgctgcacaggcgatcatgacgaccgacatcgtgcccaaaggagtttcccgtcagatccagataaacggcacaacagtcaccattaccggaattgccaaaggctcgggaatgatccacccgaacatggccactatgctcggatatatcgccactgatgcggccgtgacacaacccttgctcgacgacctggtgcgttacgcaactgatcgatccttcaactgcgtcaccgtggatggagatacctccaccaacgatgcactgatcctgatggccaccggacaggctggcaatacgccgattactgtatcaaccgaccctgctttcatctcactacaggcagccatcaccgaagtggccgccctgctggcacaaatgatcgtgcgtgacggtgaaggcgccaccaaattcatcaccgttcaagtggaaagtggcaaaacccgggaagaatgcactaaagttgcttacgccatcgctcactctccactgatcaaaacagcctgctttgcgtccgaccccaatctgggacggattctggcagccatcggctatgccggtattgaagatctggatgttaatctggttcagctttacctgggcaatattctggttgccgaacacggaggccgtgccgccagctatcgtgaagaagacggtcagcgcatcatgcaggcaccggaaatcaccatacaggtgaaactcaaccggggaaacgcgtccactaccgtatggacctgcgatctttcctacgattacgtcaaaatcaacgccgattaccgcagc

SEQ ID NO: 43267 - DNA, 996 bp, Nitrosomonas europaea
atgatgtacaacctgctgcgcccgctactgtttctgcttgaccccgaaactgctcacaccgttacactggatacactcaacctgctgaagagaaccgggttgctgcccgatcgcaccatcgactgcactcctgttcgcgtcatggagctggattttcccaatccagtcgggctggcagccggcctcgacaagaatgggacctgcatcagcgcactggcctctctgggatttggctttatcgaagtgggaaccatcaccccgcgcccgcaggtcggtaatccccggccacgactgtttcgcattccacaggctgaagcaatcatcaatcggatgggattcaataacgttggtgtggataagctgatagaaaatgtccagcaatccggctaccgcggcatactgggtatcaatatcggtaaaaatgcggatacccctctgcagaatgcaatcgatgattacctgatctgtttacgcaaggtgtacctgcatgccagttacgtcactgtcaatatttcctctcccaatacccagcagctcagacaactgcaaaatgaaaccgagctggaacatttactgggcgcacttaaggcggaacaaacccgtctgagtgatctccacggtcgctacacgccactagccatcaagattgcccctgatctggaatccgaacaaattaccgtaattgcatcgctgttaatgaaacaccgcatggatgcggtgattgcgaccaacaccaccactgcaagagagggtgtcgaacatttgccacgcggcaatgaaaaaggtggattgagtggcgcaccattaacggaacgcagtaccacagtcatccgtcagcttgccaaccatctccagcatgccattcccatcatcggagcgggtggcatcatgtcagcccgggatgcgcaactcaaaatcgaagcaggcgccagtctggtacagatttattccgggctgatttatcgcggcccggatctggttacaaaaaccgtctca

SEQ ID NO: 43268 - DNA, 1959 bp, Nitrosomonas europaea
atggccacgatcgaatcaattttgcacgaaaaccggatattcccccctgccagtgaatttgtcaggaacgccaatctatccggaagggaagcctatgaaactctgcgccaggaagccgagcatgactataccggcttctgggcgaaactcgcacaacagtacattgcctggcacaaacctttcacacgggttctcaatgacgccaacccacccttttataaatggttcgacgatggcgaactgaatatctcgtggaattgtctggatcgacacctggcaacccaggctgacaaaactgccatcatctttgaatctgacgcaggagaagtgaatcactgcagttatcgtgagttacaccgccaggtctgtcattttgccaatggactgaaatcacttggaatccgtcagggtgaccgtgtcgtcatctatatgcccatgcggattgaagctgtagttgcgatgcaggcatgtgcacgcattggtgccatccattcggtagtgttcggcggtttttcagcaaaaagtgtatacgagcgcatcatcgatgccggtgcatccgctgtaatcactgcagatgaacagatccgcggaggcaggtaccatccactgaaagcaaccgtagacgaagcactggcgatgggtgacacagccacggtccacagtgtcatcgttttccggcacaccggtaccggaattacctggcagccggaacgagaccactggtggcatgatctcattgccggacaaccggatgaatgcgagccagcatggatcaatgctgaacaccccctgtttacactgtatacctcgggctctaccgggaaaccaaaaggcgtgcagcattcctcggccggttatctgctcggggcagtgaccagcatgcagtgggtattcgactatcatgcagatgatgtattctggtgtactgcggatgtaggctgggttaccggacacagctatgtcgcctatggcccgcttgccatcggtgcaactcaggtgatttttgaaggaactccgactcatccacatgccgggcgattctgggaaatcatccagaaacacaggatcacgactttttatactgcccccactgccatccgctcactgatcaaactgggatccgatctgcccgcaaaatatgatctttcttcattgcgcctgcttggatcagtaggtgaaccgatcaacccggaagcatggatgtggtattacacggtcgtcggccagtcacgctgcccggtagtcgatacctggtggcaaaccgaaaccggttgtcacatgatcgctcctgctcccggtgccatatcgaccaaacccggttcctgcactctcccgctacccggtatcgatgccgcagtggtagatgaaactggccacccggtagaacagggaaaaggtggatttctggtgatcaagcgtcccttcccttcgatgttacgcaccttgtggaatgatcctgaacgattcagaaaaacttactttccaacagatattgccggtggtcgttattatcttgccggcgattcagctcatcgggatcaggatggttatttctggatcatgggacgagttgatgacgttctgaatgtctccggccatcgtctgggtaccatggaaatcgaatctgcactggtggcgcatcctctggttgccgaagcagctgttgtagggaaaccgcacgaaatcaagggagaagtggtcgtagcatttgtcacactgagagaaaaactgcctgatgaccaacgggctgctgaaattgctgcaactttacgtgaatgggttgccagcgagattggtgcaattgctcgccccgaagaaatccggtttggtgaaaacctgcccaaaacgcgttccggcaaaattatgcgacgcctcctgcgcgccctggcaagaggtgagaccattactcaagatgtctcaacactggaaaatccggtgatcctcgaacaactcagccag

SEQ ID NO: 43269 - DNA, 1090 bp, Nitrosomonas europaea
gatcatcattccgaacgagccgcaactttcccggccgggtgcacaggcgttgcagttgcaatccgatctggcacttgaagccagacaggccggtttgtacggtttgttctatccgctatcgcatggtggaaaaattgcctctctggaagattatttgctggttgcggaacaggagggacgcacagaattttcccaggcgatctttgccagtcataccgccctcgatgcgcatatgttgtcgcgattcggaaacgcaatcatccggcagcagtttctgcaaccgatggcaaacggggaggcattaccctgctatggcatgaccgagcctggccagagcggttcgattccaggactgatcacaaccacggcgcatctgtccaatggtcgctggcatgtcaatggcaggaaatggtttatttccaatgcggatcgtgccacgttcatgacagttctcgcgcggacagccggcaaagaaacggccctcgatcatgccttatcgatgatcatagtacctgccgacacgccgggtttcagagtcgagcgccaactgatgatgatgggacatgcctgcggccagggagaagtttccctggctgatgtacaagttcccgaacattatttgataggggtgtgtggtggcggtctggagctgatgaacaaacggcttggccttggccggttgctgcgcgcgatgaactggattggccttgcccggcggtgtatggatttgatgggcgggcgtgttcattcaacccggggaaaactcgggcttctggtagaaaaacagcttgtacgccagcatttcttcaacacctatcaggcgattgccggtgcacgtgagcttgttcgcatcgctgcgcgcggcgttgatgcccagtgccctgatgaaatcgcgatcaacgttgccaaaatggccgcttcaagggctttatgcattgcttctgatagtgcaatgcagctgtatggtgcagaagggctgagtgacttgacaccgctttacggtattcatcgcattgcacggacttcccgcattctggatggcaatgatgaatcactgatcagctcggtggggcgccgcctgatcagtcat

SEQ ID NO: 43270 - DNA, 1611 bp, Nitrosomonas europaea
atgaatcacgccggcattatcgatctggttcctgccgaggttcgccaacagtggacaaatgatgggatttatcctgataaatccttatttgacctgttttgtgagcatgcgcggaaaaatcctgaaaaaccggctgtggtcacgctggaccacaccctaacctatcggcagttgctgcacaaagttacccgtctggcgaacagtttacggcatctgggggtggttgccggcgatgtcattgcttatcagctggccaatagcgcgcatcactgcgcaattgatctggctgcggcagcattgggtgccatcgttgcacctttcccgccaggacgcggacgccttgacattcaatcgctattgcagcgatgtgatgcgcgtgtaatcgtggttgaacccttgttcctgcaacaggatttatgtgaactgatcgaatcactgcggcctgcgttactgtcgctgcggatactggtggtggatggtgtggcacgaacaggctggcacacgctgaacgacctatttcaatcccggccgattgctaccgaagaactgcctgatgtcgatcctgattcacccgcacgtttcctgatttcttccggaactgaagcagatcccaaatggattgcttattcccataacgcactggcgggcgggcgtggacgtttcctgcagcatattcacacgcgggacaaagatttccgtgcgctttatctggtgccactgggaacggctttcggctcgtcagcgacattcggtgtgttgtcctggatggggggaaccctgattatgttgccgcggtttgatgttgtggcaacgattcgggcgattgggcaactcagaccaacgcatgtttttggtgttccgaccatgtttcagcgcattgcagctgatccggacctggcgaagatcgatatttccagcctggttgcaatcgtcagtggcggtgcaaaaatcgatgaaacctcgatcctgcgttgctgtggcgcattcggatgcagtttcatcaatctgtatggttcagctgatggcgtgaattgccatacgatgctggacgataatatgactaccgttctgcatacaaccggccgtcctaatcccgaggtatgctcgatcagaattgtcgatgatcggaagaacgaactggcgcagggccaaactggtgaaattgctgcgcgcggccccatcacgcctatgcaatatgtcaataatcccgagctggatgcgttgtaccgcgatgccgagggttgggtgtataccggagatctcggatttatcgatgaacagggtaatctggtactgaccggcaggaaaaaggaaatcatcattcgtggtggtatcaacatcagcccggcgcagattgaagatattgccgcatcccatcccgctgtcgtcagcgcagcctgcatcccggtagaggatgaagatctgggacaccgtgtctgcctgtgcctggtgatgagcgaaggtgccgagcggccatcgttggcgcaatttgcccgttttttgctcgatcgcggtctggagcaaaacaaactacccgagtatctgcgctatttgagacaactgccgctcagtccggcaggaaaagtcgataaaaagcagttgattgccgaa

SEQ ID NO: 43271 - DNA, 1284 bp, Nitrosomonas europaea
atgagtgcaatcgtagatgtaatcgcccgtgaaattatcgactctcgtggtaacccaaccatagaagccgatgtattgctggaatcgggcgtgcttgggcgcgcttcagtgccatctggcgcatctgtcggcacacgcgaagccgttgagctgcgcgatggagatgcacagcgctactatggaaaaggggtattgaaggcagttgaaagcgtcaatggtgaaatttctgaaacgatcatggggctggatgccatggagcagtgtttcattgataagaccctgatcgagcttgacggcagtgaaaacaaatccagactgggtgccaatgccatactcgccgtttcgcttgcagtggccaaagcagcagcagaagaatccggtctccccctttatcgctatctgggaggaatcaatgccaagtggttgcctgtaccgatgatgaatctggttaatggcggcgtgcacgcaaacaaccgtctggatatgcaggaattcatgattataccgctgggcttgccaaacctgcgtgaggccgtgcgttgtggcgcagaggtattcagcacactcagaacgttgctcaacaaaagaaatctgcccacgacagtgggtgatgaaggcgggtttgctcccagctttgctcgcaacgaagaggcactggctctgatcgtgcaggccatagatgaagcaggttatcaacccggctccgaggtggcgatcggagtggattgcgccagttccgaatttttccgggagggaaaatatcatctcgatgtagacggactcggtcttacctcggctcagtttgtagattatcttgccacctgggtggagaaatatccgatcatcagtatcgaagatggcatgagtgaacaagattgggagggctggggactgttgacggaaaggctgggtaaaacagttcagctggttggtgatgatgtgtttgtcaccaatacccgaattcttaaagagggtatcagtcgcaatattgccaattccattctgatcaagatcaatcagattggtacgcttaccgagacactgaacgcaatcgaaatggcaaagtgtgcgggctataccgccatagtttcccatcgttccggcgaaactgaggatacgaccattgctgacatagcagttgccaccaatgccttgcagatcaaaacaggttcactctcgcgttcggatcgactggccaagtacaatcaattgttgcgtatcgaggaagatctgggcgagatggcgcaatatgccggaagatcggcattctaccagttgaagcca

SEQ ID NO: 43272 - DNA, 1767 bp, Nitrosomonas europaea
gctgacgtgaaagttaagcaaaggaaatttgatgtagtcatcgtcggtgcaggcggggcaggtatgcgtgctgcactgcagttgtccgaagccgggttcaaggttgccgttctatccaaagtatttcccacccgctcacataccgtagcggcacagggagggattgcagcctcgctgggtaatgtaaccgaagatgactggcgctggcatatgtatgataccgtcaagggttcggactaccttggcgatcaggatgcaatcgaattcatgtgccgccatgctgctgaagtcgtgtatgaactggagcatttcggcatgccattcgaccggctggaaaacggcaagatttatcaacgtccgtttggcgggcaatccctgaattttggcggagagcaggccagtcgttcctgcgctgtcgccgatcgtaccggccatgcgatgctgcataccctgtatcagcgtaatgtcagtgccaatacccagttttttgtggaatggctgggactcgacctgattcgtgatcatgaaggtgaagtactggggatcaccgccctggaaatggaaaccggtgaaatcatgattctgcaggcgcgtgcaacactattggcaacaggcggtgccggtcgtatttttgaagcgagtaccaacgctttcatcaatacgggcgatggcctgggtatggttgcgcgtgcaggtattccgctggaagacatggaattctggcagtttcatccgacaggcgtgtatggtgctggcatactcatcagcgaagcagtgcggggagaaggaggttatctggtaaatgctgaaggcgaacgtttcatggaacgttatgcaccccatgccagagatctcgccagccgtgatgtcgtctcccgtgccttgatcacggagatcaggcaagggcggggatgcggaccgaaagaagatcacctgctgctgaagctggatcatctgagtgcagaaacgattacgtcgaaactgcccggcatccgggaaatcgcgctcaagtttgcgcatgtcgatcccctcgtagatcccattccggttgtcccgactgcccattacatgatgggtggcattcctgccaattatcacgggcaggtggtcgcgccttataagaccagtcctgatgaagtcgtaccggggctttacgccgttggagaatgcgcctgtgtctctgtgcatggcgccaatcgccttggcacaaattcactgctggatatcgtcgtattcggacgtgctgccggtaaccagatcatcaaggatctgaccagaaacaatcaccacaaaccactgccaccggatgcagccgaacagacgctgacacggcttgaccgcctggaaacccagaaggatggagaaaatgttgctgcaaccagcgaagctttacgtaaaaccatgcagacacattgcggcgtcttccgctttccggatgtgctgaaagaaggggtggaaaaaattggcgaagttgctgaacgggtcaggcatactgaaatttgcgacaaaagcagagtattcaacaccgctagagtcgaagcgctggaactggacaatctgattgaagtggcaatcgccaccatgattgcagcagaagcacgccatgaaagccggggggcacatactcgcgacgattttcccgaacgggacgatcagaaatggctcaggcattccctgtttttcagcaaagaccagcgcctggattacaagcccgtacgtctgaaaccactgaccgtggaatcattccctcccaaagcgagaacctat

SEQ ID NO: 43273 - DNA, 513 bp, Nitrosomonas europaea
atcaaatcacgtatccgtaccatcccgcattacccccatgaaggcatcatgttccgggatatcaccacactcctgaaagatccggctggactgcgctcgaccatcgacggaatcgttcaacgctatcaaaccgaaaagatcgataaagtcgtcggcattgaatcacgtggattcatcattgctgcaccggttgcgtatgcactgagcgccggattcgttcctgttcgcaaacaaggtaaattaccggccgaaaccattggctgcgattatcagctggaatacggttatgacaaagtcgagattcacgtggatgcgatcgataaaggggatcgcgtattactgatcgatgatctgattgcaacaggtggaacgatggaagctgcaatcaagctggttcaggaggcaggtggagaagtgattgaatgctgtttcgtgatcgatttgcctgatatcggtggaagcaggcgactgcgtcagcaaggtcatcgactgttttcgctctgcagttttgaa

SEQ ID NO: 43274 - DNA, 684 bp, Nitrosomonas europaea
cggctggtattacttcgccatgggcaaagtatctggaatcaggacaggcattttacgggctggggtgatatcgtacttagcccgcagggtgaacaggaagccctgagagcgggccatctgctcaagcaggcaggttttacttttgatgcctgcttttgttcagaattgcagcgtgccagcgatacactcgctatagtgcagtcagtcatgggtttgaatcatctctcgacataccggacctggcgactgaatgaacgtcattatggtgcattggaggggatgcgcccctgggctgctatccggaaattcggtatctggtcgacaatgaaaagccagatccgttttgatgcagcgcctccactgctgatgccggatgacccgcgtgcaccggtaaatcagccacgttatgcggcagtcgatcgcactcaacttcccttggcagaaagtatgcagcagacattggagcgagtgcggccgctatggcaggaaaccattcttcctgaaataaggcaggggaaacgtttgctgatcgtctcgcaccagaatcttttaaaaacgctggttatgcagcttgaagggctgacaggcgcacagatcatgcgcctgtcgattactactggccatccgctttgttatgagctcgatcactcacttgtaccggtgaagcgctactacttgtgagac

SEQ ID NO: 43275 - DNA, 1323 bp, Nitrosomonas europaea
gtgacgtttgcccaactgggcttgtccagtgaaattctccatgcagttaatgatgaagggtatgtgaatcccactccgatccaggcccaggtcattccttcgattctggctggtaaggatgtgatggccagtgcgcaaacaggtaccggtaagacagccggctttacattgccgctgctgtaccgtctgcaagcatacgccaatacgagtgtgtctcctgcccggcatcctgttcgtgccctgatcatggcaccgactcgtgaactggcgatgcagatcgacgaaagtgtcaggaaatatggaaaatatcttgccctgagaacggctgtcgtttttggtggtatcaatatcgagccccaaatcgcagcgctgcaggccggggtggagatactggtggctactcccggtcgcctgttggatctggtcgaacaaaaagcagtcaatttttccaaaaccgaaattctggtactagatgaagctgatcgtatgttggatatgggttttttgccggacatcaagcgggtgatggcgctgttatctccacaacggcaaagcctgatgttttctgcaacattctccggtgaaatcaggaaacttgccgacagcctgctgaagcagccggtccgaatcgaagcagcggtacaaaatacagtgaatgaatctatttcacatgtcattcactgggtaaagccagatagcaaatttgccttgctgctacacctcatccgacagcagaatctgaaacaggcacttattttcgtcaaaacgaaacatggtgcttcccatctggcgcagatgctttcccgccacgaaatctcggcggttgccattcacggcgacagaaatcagcagcagcgtacacaggcgctcgctgaattcaagcatggtgacgtgcaaatactggttgctaccgatgtcgccgcgcgcggtatcgacattgaaaagctgtcacatgtcatcaattatgaattacctggtaacccggaagattatgtccatcggatcggacgtaccggccgggccggtagtaaaggaaaggctatttctctggttagcgaacatgaaaaagaactgctggccaatatcgaaaaactgctgaacgccaaactggaaacagaacagattgccggttttgatgcggaacagtttgctcgcagcctgccagatcggaaaaaccggatgtcggccggtaactcccgctacggcaataagccgatggaaaatgggagtgagaaaagcagaagtgagaaacacaggaaactgccatcatcccagaaatactccggttctcgccgagggggaacgcaaaaatacagcgacccc

SEQ ID NO: 43276 - DNA, 1275 bp, Nitrosomonas europaea
gctgtccagacgaatgataatccgcgtttcgtcagtacacttacccgcaatacacttgcactgattctggcaggcggtcgcggaacacgtctgaaaaacctgacggactggcgtgcaaaaccggccgttccgttcggcggtaaattccgcatcatcgatttcacgctgtccaattgcgtcaactcgggagtccggcgcattggtgtggtcactcaatacaaggcacagagcctgatacgtcatatccagcgcggctggagttttctcgatggccggttccaggaattcatcgagctgttacctgcacagcagcgtacagaagaaggaacctggtaccagggcacggctgatgcggtcttccagaatctcgacattctccgcacgcataatcccggttatgtgctgatcctcggcggtgatcacatctataaaatggattacggtcggatactggccgaacacgtcgagagacaggcagatctgacgattgcctgcctggaagttccggtggaagatgccagcgcattcggtgtcatggcagtagatgacagctggcgtaccaccagcttcgccgagaaacctgaacatccggctccgattcccggaaagcctggtcatgctctgatcagtatgggcatttatgtcttcaatgcaaaatttctgtacgagcaactgatccaggatcacgatatggatcagtcctcacacgatttcggcaaagatgtgataccccgtctggtggcaagtaatgcccgggtatacgcacaccgcttccagaacagttgtgtcaatatggcttcaggtgtgccttactggcgtgatgtgggaacagtggatgcttactggaaagccaatatcgatctcacgactatcacgccggatctgaatctgtacgatgaagactggccgatctggactcatcaggagcaactgccacccgccaaatttgtgttcgacgatgatgatcgtcgtggtcaggcgctggattcaatggtatccggcgggtgcatcatcagtggtgcaacagtacgccgctccctgctgttttccaatgttcagatacgtggctacagcactatcgaagattcggtcatcctccccaatgtcagcatcgaccgacacgcctacctcaaacgggtagtggtggagaaggaatgccagataccagaaggccttaaagtcggtttcaatcctgatgaagacaggaaacatttttatgtcacggatgacgggattacgctgattacgccggaaatgctgggacagggcatccac

SEQ ID NO: 43277 - DNA, 2178 bp, Nitrosomonas europaea
ccgggttcgtcggaggattctgcacaatcattactgctgaccgccaggctgtacgatccctgttctttcctgggaatgcacgctgctccaaatggcaggctgatcagggtgtttcagccttatatgtcacgtgtgtggctgcataccctgtcgggctatcagccaatgcgaagcgtacatcaggacgggatcttcgaatgggagggggaaggggtcatgcacccctatctgctgcgtatggaaaatacggcaaccggggtgatcgaagaacggcatgatccctatgccttccccatgcagatttcaggccacgacttgtatctgttcaatgaagggcgcctgcttcaggcttatcatatgctgggtgctcaccgggtcaggaatcatggtgtcaccggcacacgttttgccgtatgggcaccgaatgccgaacgggtcagcgtcgttggagatttcaatcgctgggatggcagggtatatcccatgatggtgcatggccacagcggggtatgggagctgttcattccggatttacccgagggagcgatatataaatatgaaatccgcaatcggatcagcggtgagatcctgctcaagaccgacccttatgcaacgacatatgaactgcgccccaataatgccgcactgactccgatcgagcagaaatacgactggaaggatgacgattggatagcccggcgcaaaggctgggactggctgcatgcccctctcaacatctatgaactgcatgtcggttcgtggaagcgccatccggatggcagattctattcctatcatgaacttgccgatcatctgattccttatctgcaggatatggggtattcccatgtcgaattgctgccgatatcggaacatccgctggatgaatcatgggggtatcaggccaccggctattttgcggtgacgagccgctatggcagtccggaagcattcatgagcttcgtggacagatgtcatcaggccgggattggcgtgattctcgactgggttcccgcacattttccgcaggacagtttttcactggcgcggtttgacggcactgccctgtatgagcatgaagatccgcggctgggctaccaccacgactggggaacatatatcttcaattatggccgcaacgaggtgaaatcctttctgctctccagcgcccattactggctgtctgcttttcatatcgatggtttacgtgtggatgccgtggcttccatgctttacctgaattactcacgcaaggaaggagaatggctgccaaaccgctatggcggacatgaaaatctggaagcgatcgagtttctgcgggcactgaataccatggtgcacggggaatttccgggtgcgctgacattcgccgaggaatccacttcctggccggcggtatcccgcccggcctaccttggcggattgggcttctccatgaaatggaacatgggctggatgaatgatacgctgagttatatgcagcatgacccggtgcatcggcgctatcaccacaacgagctgacgttcaaccagctctatgcctacaccgaaaatttcgtgctgccgctttcgcatgatgaagtggtgcatggcaagaagtccatgctggacaagatgccgggcgatggctggcagaaatttgccaatctgcgcctgctgtttacctatcagatgacctgcccgggcaagaaaatcaacttcatgggaaatgaactcggccaggggcatgaatggcgcgtgggtcatgaactcgactggtacctgctggaacgtgatccgcatcgcggtatacaggcgctgacgcgcgatctgaaccacctttacctgaatacaccggcgctgcatgaactggatttctttgccgaaggtttttcctggatcgattgccatgacgtggagcaatcggtcatcagctaccagcgccacgccagagatggatcatttgtgctggtagtgctcaactttaccccgatactgcgtaccggttaccgtgtcggcatcccgggatcgagtgcttaccaggaagtgttcaacagtgattcaatttattacgacggcagtaatgccggaaatgccggaaaaatcagcccgaccgggcaaccctggtccggccagcctgattccatcatcattacactgcctcctttggcaggtgtcattctgaaagcggcagatggt

SEQ ID NO: 43278 - DNA, 2190 bp, Nitrosomonas europaea
ttgcatatggctttcgtcgaatcacggcagaaacgccacgaattcatcacggttgagcatctgttactggcattactggataatcccagtgctgcgaaagtgctggtcgcctgtacagtcgatatcgaagatttgcgcaaatccttgcaggatcatatcgcccgtcacactccggttgtcgaaggttccgaagacgttgacacccagcccaccctgggttttcagcgagtgattcagagagccattcttcatgtccagtcttccggcaagaaagaagtaaccggtgccaatgttctggttgcgatttttggtgagaaagattcacatgcggtttattttctgcagcaaagaggggtaacacggctggatgtggtgaattatatttcccacaagataggcaaggctgcgcaaagcagtgaatccgaaaaaaatgaggaaaatgctgatggtgaacagcaggattcaggcagtacactggaaaattacactgtcaacctgaacagccaggcaatcgccaaccggatagaccccctgattggacgtgaaaaggaagtcgagcgcgtcatccagacactatgccgccgtcgcaaaaacaaccccctgctggtgggtgaggcaggggtagggaaaaccgccattgctgaagggctggccagaaggattactgaaaaccgagtgccagatgtgcttgccaatcaccaggtttatgccttggatatgggtgcattgctggccggaacaaaataccgcggtgattttgaacagcggctgaaagtcgtattgaaacagcttaccgataaccccaaagccattttattcatcgatgaaattcataccctgatcggtgccggtgccgcatcgggtggaacgctggatgcatccaacctgctcaaacccgcactcagctcgggccggttgaaatgtatcggtgccaccacctacaacgaataccgcggagtttttgagaaagatcacgctttatcccggcgctttcagaaaatcgatgtctccgagcctgatatcggtgaaaccgtggaaattctgcgcggcttgaaatcccgttacgaaaaacatcacaacgtcaaatacaccgaggttgcactgacagccgcagctgaattatcagcgcgtttcatcaacgaccgccatttgccggacaaagcaatcgatgtcatcgatgaagctggcgcagcacagcgcatactgcccaaatccagacagcgcaaaattatcggccgccaggaaatcgaacaggtcatcgccggaattgcgcggataccgccacaaaacgtatccagcgatgaccgcaataaactcaagacactggatcgtgacctcaaagccatcgttttcgggcaggatgcagctattgatgcgctcacatctgccatcaaaatggcgcgcagcggtctgggaaatacctgcaaacctatcggctccttcctgttttccggacccaccggcgtgggaaaaactgaagttgcgcgtcagctcgcctacacactgggaatcccgctgcatcgctttgatatgtccgaatacatggaacgccatgccgtttcaagactgatcggcgcgccaccaggatatgtcggattcgatcagggtggtctgctgaccgagaccatcatcaagcaaccgcacgccgtactgctgttcgatgaaattgaaaaagcacatcccgatattttcaacgtcatgctccagatcatggattatggaacgttgacggacaacagcggacgcaaagccgatttccgtaacgtcatcatcgtcatgaccacgaatgcgggtgccgatgtgctcaccagaacatcgatcgggtttaccgaacataccaaatccggagatgaaatggtcgaaataaaacgactgttcacccccgaattccgcaaccgtctagatgcaatcatctcgttcacgtcactgactgaagatatcatattgcgcgtcgtcgacaagttcctgatcgaactcgaaacacagttacaagaaaagaaagtggatgtcacattcaccgacaatttgcgtaaatacctcgctcgccacggatttgatccgctgatgggcgcccgtcccatggcaagacttattcaggatatcatccgccgggcactcgctgatgaactgctgttcggccatctggccaatggcggtaaagtaaccgtggatattgacgaagatggcaaa

SEQ ID NO: 43279 - DNA, 1791 bp, Nitrosomonas europaea
atcaaattacttcccgatggattgatcagtcagatagccgcgggagaagtcatcgaacgtccggcttcagtattgaaagagttactggagaatgccattgatgcgggtacgactgacatatcggtcaacatcgcccagggtgggttgaaactgattcgtgtgaccgataacggtgggggtatatcaggagaagagctgcctcttgccctgacacgccatgcaaccagcaaaattgccagtcaggaggatttgtacagaatcaccagtctgggattccggggagaagggctggccagcattgcatcggtttcgaatttattgctcatcagccaccagccgggcggaaagcatgcctggcagatacgcagcgaaggcatacgggtcatgcaaccggaaccctcatcacacgcggcgggtactacagttgaagtccgggatctgtttttcaatcttcctgcccggcgcaaatttctcaaaaccgaagccacggaatttgcccactgtgaggaaatcatccgcaggatggcgctgtcccatgccggtattgccttcacgttgcggcacaacggaaatctgcgcggccactggcaatcggcagaagctgctgttcgcataaaaactgtgcttggtgaggaatttacccggtcggcggcatggatcgacgaacgatcagctggcatcgggctacagggtatgctggcgttgccggcgtattcacgcgctgcgcgtgacatgcagtatttttttgtcaacgggcgcttcgtgcgcgacaagctgattacccatgccctgcgcgaagcttaccgtgatgtactgcacctggatcgtcatgctgctttcgtgctgtatctggacatcgatcctgaacaggtggatgtcaacgtacatccgaccaaaaccgagatccgttttcgtgaagcacgggcaatacatcagtttatctaccatggtgtcagcaaggcactgtccttaccccgttccggtacggaattatcgcagtcatcatcacagctcatggcagatgacatagtgccgcctgctgaaaagcgtgtacctgccgcgccgatgctgaactaccccagacaaacagggcttccgtcggaaatgattgcgcagcctttcaatttttatcaggttttatccggtagcgaatctgattccactgccacgcagaacccatttcgtcaaaccggagcaggggagagcaatgagcatccggcactgcctccgctgggttttgccctgggacagcttcatggtgtttatattctggcgcagaactggaaagggctggtgatcgtggatatgcacgcggcacatgaacgcatcgtctacgaacaattgaagttgcagatggatgagcagacgctgtccgcacaacggttgctgattccggtgacatttcacgcggatagcctcgatattgccacggccgaggagaatcagtcgctgttgcagcaactgggtttcgaagtgaccgtattgacggccactacactggccgtgcgtgcggtgccagctattctgcaggatgctgatacggaaaagctggtgtgtaatgtgctggatgaaatcagaaacggagatcccggccagttacttgctgcccgccgcaacgaattactggcaaccatggcttgccatggcgccgttcgtgccaatcgtccactgacgctgatcgaaatgaatgaactgctgcgcaaaatggaagtaaccgaacgttcagatcagtgcaaccacggtcggccgacgtggtttgaaatcagcctggctgaactggacaaaatgttc

SEQ ID NO: 43280 - DNA, 873 bp, Nitrosomonas europaea
atggcaattctgatcgatcgtcatacacgcgtcatgacccagggaattaccggtaaaaccggacagttccatacccgccagtgtcgtgagtatgcctatggcagagattgtttcgtggcgggagtcaatcccaaaaaggcaggagaggagcttgagagtattccggtatttgcaacggtggaagaggcaaagcagaagacaggtgctaccgtatcagtgatttatgtacctcctgcttatgcgtctgcagcaatcgatgaagcggtggaagcaggactggatctggtggtttgtattactgaaggtattcctgttcgggatatgttgaggacacgagcccgtatgcgtggaaaaaaaacattgttgatcgggcccaattgcccggggatcataacaccgggtgaattgaagatcggtatcatgccaggcgccatccatcagcagggcagaatcggagtggtctcaagatcaggcacgttgacttatgaggcagtagcccaactgagtgagctgggattggggcagtctacctgcatcggtatcggcggtgatcctattaatggcctcaaacatatcgatgtcctgaagttgttcaatgaggatagtgagacagatgcagtgctgatggtgggtgaaattggtggtactgatgaagaagaatgcgctcgctgggtcaaggagcacatgaagaagccggtggttggtttcattgccggagtaacagcgcctcccggtaaacggatggggcatgccggtgcaattattgctggcggcaaagggacagcacaggaaaaaatcgaggtgatggaggcatgtgggattcgtgtgacacgtaacccggccgaaatgggtaagctgttgaaatcagtgata

SEQ ID NO: 43281 - DNA, 1146 bp, Nitrosomonas europaea
atgaaaattcatgaataccaggctaaagcgattctcagccgttacggggtgagtgtgccagccggggttgcctgtttcagcgtggaggaagcggtattggctgccgagaagctgggtggaaataaatgggtggtcaaagcacagatttacgctggcggacgcggtaagggcggcggagtgaaactggcaaaatccattgcggaagtccggcagtttgctgaagctatgctgtttgctccgctggtaacgcaccagaccggcccgcaaggtcggatcgttcaccgactgtatatcgaacagggagtcgacatccgccatgagtattatctggcactggtggtagaccgtacttcacagtgtgtgagtttgattgcaagtgatgccggggggatggatatcgaacaggttgcagccggctcgccggaaaaaatacacaaaattcagatcgatccgctggcgggattgaatcttcgggatgccgagagaatcgtgcgtgagatcgatttgcctgaatcgtgtcagtcggctgcgataactatgctggatgcgctgtatcgggcattcgatgaaaatgatgcttcgttgctcgaaatcaatccgctgattgtcacgccggataaccgcctgattgcgctggatgccaaaatgaatttcgatgacaatgccctgtttcgtcatcctgaaatcgttgccttgcgggatctggatgaagatgatccgctcgaggcagaggcgtcgcagcatgggctttcttatattccactggatggtgatattgcctgcttggtcaacggagccggtctggcgatggccaccatggacatcattaaactctatggcggtaatccagctaattttctggatgtgggagggggagcaaccgtagagaaagtgaccgaagcattcaagctgatgctgagaaaccccggtttgcaggcaatactggtcaatatttttggcgggattatgcgttgtgatgtgattgctgaaggggtggtatcggcagcacgtgaggtgaaactgactgttccattgattgttcgactggaggggaccaacgtggagctgggaaaaaagattctggcagattcgggattaacgatcatttctgccggcaacatggctgatgctgccagaaaagcggtt

SEQ ID NO: 43282 - DNA, 513 bp, Nitrosomonas europaea
cgcttcaacatggtagaacaacagatcagaacctggaatgtactgaatcaggacattctcgatttgctgtatcaggtcaaacgtgaagaattcgtacctgccgcttatcgtttcatggcattcgtggatatggagatcccgctggagcatggtgccgttatgttaacacccaaaatggaagcacggattctgcaggaactgcatatcagaaaaactgacaaaatccttgaggttggcaccggaacaggctacatgactgcattgctgtccaaactcgggactcatgtcttcagtgtggaaatcgtgcccgagcttcataccatggcgcacatcaatctgcagacgcacgacattaccaatgtcacccttgaactgggagatgccgctcgtggatggcccggtcacggaccttatgacgtcatcgttctgactgcctccacccccgttttaccagaggcatttcagcaaaatctggcaccgggaggtcgattgtttgccatcattggtgaagaa

SEQ ID NO: 43283 - DNA, 2307 bp, Nitrosomonas europaea
tcaagcgagctggatctacctttgcttccgctgcgtgatgtagtcgtttttcctcacatggtgatcccgctgtttgtggggcgtccgaaatctatcaaagctctggaagtcgctactgaagcggggacgaacattctgctggtcgcacaaaaatcagcggccaaagatgatccagcccctcaggacctttacagggtttgctgtgtttcgagcattctgcaaatgctgaaattgcctgatggtacagtcaaagtactggtagaaggaaattatcgggcaaaaattgaatcattcagtgattctgaaacctctttttcgggaaagactattcaggtcaggatcgaggaaacggacaccccggaaatcgaggcattacggcgcgcgcttctttctcaatttgaccagtatgtcaaattgaacaaaaaaattccttcggaaattctcgcttctttgactggtattgacgaagccgggcgtttggctgatacgattgcggcctatcttccattaaggctggaacaaaagcaggaaattctggaaatttttgacgttcagccacgcttggaacgattgcttggcctgctggaagctgagctggatattctccaagtggaaaagcgcattcgcggcagagtgaagcgccagatggaaaaaagtcagcgtgactattatctgaatgagcaggtgaaagctatccagaaagagctgggagaaggggaagatggtgccgatcttgaagaaatcgaaagaaaaataaaaacagcttctcttcccaaagaagcacttgccaaggctgaatcagaactgaaaaaactgcggctgatgtctcctatgtcagcagaagcaaccgtcgtgcgaaattatatcgatacattggttgctttgccttggaagcaaaagaccaaaatcagtaaagaattgaaacaggctgagtcaatcctcgatgaagatcattatggtttggaaagagtcaaggaaagaatcgtcgagtatctggcagtacaacagcgagttgccaaatccaaagcgcccatcctttgtcttgtcggtccgcccggggttggtaaaacttcattgggccgatccattgctcacgccacgaatcgcaaatttatccgtatgtctctgggaggaatgcgggatgaagctgaaattagaggacatcgtcggacttacattggctccatgcctggaaaaattttgcagagcatgacgaaagtcggtgtcaaaaatccgttgtttctgctggatgaagttgacaagatgggaatggacttccggggtgatccttcatcagctttgctggaggtacttgatccggagcaaaacagcacgtttgtggaccattacatcgaagtggaatatgatctgtcggatgttatgttcgttgcgactgcgaatacactcaatattcctcctgcactgctggatcgtatggaagtcattcgactttcaggttataccgaagatgaaaaactgaatatcgcaaaacgttatcttctgccaaaacagatgaaggatcatggtttgaacgaagatgaactgtccatttctgaatccgcactgcgtgacattgttcgctactacacccgggaagcgggagtacgctcgatggaaagagaagtatccaagatctgccgaaaagtcgttaaaacattgctggttaagaagagcaaggaaaagataatcattaattcgcgcaaccttagtaaatatcttggtgtgcgtcgttacacctacggtatggctgatgaaaagaatcaagtcggtcaggttacaggtttggcgtggacagaagtgggtggagaactgctgaggatcgaagcggtagtgttacccggtaaagggaaaacgattacaaccggtaaattgggtgaagtcatgcaggaatccatccaggcggcgctgtctgtggtcagaagccgttcaagaattctggggatatcagatgatttctacctgaaaaatgatattcacattcacctgcctgaaggtgccacacccaaggatgggccaagtgctggtattggtatctgtctggcaatggtatcagcgctggctggtatacccgttcgtgcatctgttgcgatgactggggaaatcacgcttagaggagagattcttccaatcggcggactcaaagaaaaactcctggcggctcatcgtggcgggataagtactgtgctgattcctgaagataatatgaaagatttgagtgaaattcccggaaacataaaaagtaaactgaacatcaagccggtaaaatggattgatcaggtactggagattgcattggaatataaacct

SEQ ID NO: 43284 - DNA, 717 bp, Nitrosomonas europaea
cggaatatgctggcagaccgggttatcctggttacgggcgcagggcagggtatcgggcgtgctgctgctctggcttatgcagaacagggtgccacggtcattttacatggccgtaaaaccgagaaacttgagcaggtttatgatgaaatcgaagcgcttggcagagcttcggcaatcattttgccattcgattacgagcaggctactgaagccggcattacggagctggttgaagcaattgcttctcagcttggcagactggatggtattttgcacaatgccgcctggacttacggcccgatgccgcttgcgtttcatacctcagcgcattggcagaccatcatacaagtcaatcttctgatacctgccatgctgacgcgtgcttgttttccgttgctcaatgcttctcctgatgccagtgtgatcatgacgggagatactcatggccagactccggcagcttactggggtgcttttgcagtggccaaagcaggagtggaggtgctggttaaaattcaggctgaggagtgggaaatttatccaaatttgcgcattaacacgttgattcccggtgccgtagatacaccacagcgtaccaaaacccatccaggcagcaataatcgtatattgcccaaaccaacagatctgatggaaacgtatctctttctgatggggccgaacagcgctgggataaccggcaaaacgtttgactgtcag

SEQ ID NO: 43285 - DNA, 1845 bp, Nitrosomonas europaea
atgtgcggtattgtgggtgcgattgcaaaaaacgatgttgtaccttttttactggaaggattatccagacttgagtatcgtggctatgattcagctggaatcgtggtggcggatggcatgttgcacagactacggacaacaggccgtgtttctgaactgagcaaactggtcgatagcggaaaaacatcgggacttactggtattgcacatactcgctgggcgacacatggcgtaccttctgaacgtaatgctcaccctcatttctcaggtgatcaaaaaaagattgctgttgtacataacggcattatcgaaaatcacgaaactcttcggcaacgtttacaacaggatggatttgagtttctgtcggataccgataccgaagtgattgctcacctgatttcatcttacctctgtaagaccaacgatttactggaagcagtctgccgttcccttgatgagttgcaaggcgcatatgcgatagctgtgatggaggaatcgcgccaggatcgtattatcgtagccagaaatggagccccgctcttacttgggatagatgatgatgggatttacgcggcttctgatgcctctgcactggtgcaggttacgcagagaatcgtgtatcttgaggaaggagatgtggcagagctgtccagtgatggatatcggattctgaattgcctggattcggtaaatggctatgaagtcactcgcaaaataactgaaagcagcctgacgcgtgatgcagtagaactagggccctattcacatttcatgcagaaggaaatctttgagcaacctgttgctgtggcgaataccctggaaatggtgttgaatgctcaatcggtatctcctcaattatttggcagtgaagcacaaagcattcttgcacagactcagggagtgctgatacttgcttgcgggacaagctatcatgccggtctggttgcgaaatactggctggaaacgattgcaagacttccttgtaatgtcgagattgccagtgaataccgttatcgtgatccaattgccgatccgaccacattggtcgtcggtatttcccaatccggcgaaactgcagatactctggctgcactcagttatgccaaatcattaggacatcgctacagtctggcgatttgcaacgtgccggaaagtgctctgatcagacaaacggatctgcgctttttgactcgcgccggccctgaaattggagttgcctccacaaaagcgtttactacacagttggcggctttgctgttgtttacagcagtgcttacaaagatacgcgatcagttgtcaactggagacgaacaaaaaatgattgccgcactgcggcatttaccggttgcaatacaacatgcgctgcaatgtgaaccggaaatcagaaaatgggccggggatttttcccagaagcaccatgctttgtttctggggcgcggtgtacattacccgatcgcactggaaggtgcgctgaagctcaaggagatttcatacatccatgccgaggcttatgcggcgggtgaactcaagcatggtcctctcgcactggtagatagtggaatgccggtagttgccatagcgccgaatgatgcactgctggagaagctgaaatccaatctgcacgaggtgcgtgcgcgaggcggggaattgtatgtcttcgccgatgcggattcacgtatcgaggagagcgagggagttcatattatcaggctggctgaacacagtggtgtactcagtcccatcttgcataccataccattacagttactggcttatcatgtggctctacagaaaggcactgatgtcgataaaccccgaaatcttgccaaatcagttactgttgaa

SEQ ID NO: 43286 - DNA, 882 bp, Nitrosomonas europaea
atgcccagcagcagagagatacgcaataaaatcaaaagcgttaaaaatacgcaaaagattacacgtgccatggaaatggttgccgcttccaaaatgaggaaggcgcaggatcgtatgaagaaagcgcgtccttatggcgagaagatacgcaacgtggctgcacatatgagtaatgccagtgttgagtatcgccatccttttctgataagtcgtgactctgttaaaagagtgggaatcattgttgtaacttcagataaaggtttgtgtggcgggttgaacacgaatgtgctgcgtagagcactcaatgaaattcgaacgtgggaaaccgaaggtaatcatgtagatgcttgctgcataggtaacaagggtttggggttcatgagccgccttggtactcaggtaatctcacaagtaaccgggttgggtgatgcacctaatatggaaaggttgattggtgcagtcaaggtagtcttggatgcatatacagaaggccagttggatagggtatatattttctataaccgctttattaatacaatgaagcagatgccggttatggagcagcttcttcccttgactgatgatcgtatcagtagtgaggatggcgaagccagacctacccgtgcaccgtgggattatatttatgaacctgaggcaaaaccggttatcgacgatatcatggtcaggtatatagaggcgctcgtataccaggcagttgctgagaacatggcttcagaacaatcggcaaggatggttgcaatgaaagcggcatctgataatgcaggtaacctgattgatgagctgacgctcatttataacaagtctcgtcaggcagccattaccaaggaattgtcagaaatcgtgggcggtgctgctgctgtt

SEQ ID NO: 43287 - DNA, 1536 bp, Nitrosomonas europaea
cagttaaatccatcagaaatcagtgaattaatcaaaagtaaaattgagggcctttccgttacatcggaatttcgtacgcagggaaccattgtatcactgacagatggtatcgttcgtgtgcatggtctttccgacgtaatgcagggtgaaatgctggaatttccgggtgggacatttggcttggcactcaatctggagcgtgattcggtcggtgcggttatcttgggtgcgtacgagcatctgaaagaaggagatatcgttaaatgtaccagtagaattctcgaagttccggtaggtgaggcattattaggtcgtgtcgtcaatgctttggggcagccaatagatggaaaaggacccattgctgcagagggaacagagccgatagaaaagatagctcctggtgtcgtatggcgtaaatcggtagatcagccggtgcagacagggttgaaatcaattgattcaatggttccagtcggaagagggcagcgcgaactgatcattggagatcgtcaaactggtaagacggcagtggcaatcgatgcaatcatcaaccagaagggtgaggatgtaatctgtatctatgtggcaatcggtcagaaagcatcatcgattgcaaacgtcgtacggaagcttgaagaagttggtgccatggcatatacgattgtcgtggttgcttctgcttctgaatcagcggctatgcagtatatcgcaccctattccggttgtaccatgggtgaatattttcgtgataaagggcaggatgcactcattgtttatgatgatttgaccaagcaggcatgggcttatcgtcagatttctctgctgttgcgtcgtccaccgggtcgtgaagcttatccgggggatgtcttttatcttcactcccgtttgctggaaagagcggcaagagtcaatgctgattatgttgaaaaagccactggtggaaaggtaaaaggaaaaaccgggtcgctgacggctttacctatcattgaaacacaggcaggtgacgtaacggcattcgtgccgactaatgttatttcaattacggatgggcagatattcctggaatctgatttatttaacgcagggatacgcccggcaatcaatgctggtatttctgtatcccgggtgggcggcgccgcacaaaccaaggtgattaaaaaattgggtggcgggattcgtttggcgctggctcaatatcgtgaacttgctgctttcgcacaatttgcttctgatctcgatgaagccacacgcaagcagctggagcgtggaaaaatggctacggagttaatgaaacaaagccagtacgcgacgttgaaagtttcagagatggcgttgacgctgtttgccttaaacaagggttactttgatgatgttgatataaagcgtgcacttgcttttgagtcggcattgaaaagtcatattcgcagtcatcatggtgcaatactggataagattgaagccagcaaagaacttgatgcagaaacagaaaaagcgttagaagcagccattcaggaattcaagcaaaacggaacatat

SEQ ID NO: 43288 - DNA, 531 bp, Nitrosomonas europaea
atggctgaagcgataacaattgcacgaccatacgcagaagcagttttcaagcttgctagggaaagtgggtctttgttttcctggtcagagacgcttgatgctgttaattcaatcgttcgggagtctcagataagagagctgatcagtaatccactgatttcttcagtaaagttgcgtgaaattattttcagcgtgtgtggtaaaaaactgaatgaggatggcaaacgattggtatcgctattgatcgataatcaacgattgctggtaatgccacagatccatgagttgtttgaacagcttaaagcgcagcacgaaagtatattggaggctgaagtagtgtcggcattcccgcttgattctggccagttggaaaagcttgtttcaattcttgaagcaaaatttcagcgaaaagttaaagcggaagtaagtgttgatagcgagctcattggtggtgtaagaattaaaattggtgatcaggtagtcgatagttctgtgcacggaaagctggaagccatggcgacggcgctcaaa

SEQ ID NO: 43289 - DNA, 1134 bp, Nitrosomonas europaea
gtgtctcatgtaatgaatacttatgcacggcttcctgttacctttgtcaagggcgagggagtctggctgtgggatgatcagggtaaccgttacctcgatgcgttatcgggtatcgcggtttgcggagtcgggcattgccatccagtgctggtaaaggcactgtgcgagcaggtatcgacgttgatccatacttccaatgtctaccatatccagcatcaggaacgactggctgacagattgaccagcctgtcgggcctggagaaagccttcttctgtaattccggagcggaagcaaacgaggctgccatcaagctggcgcgactttatggccataaccagggaatcaacctgccgacgatcattgtgatggaacgttcatttcatggccggacgatggcaacactgactgccacgggtaaccgcaaaacccaggcaggttttgaaccgttgctgaccgggttcgtgcgggtgccttacgatgatctggaagcagtcaacaaagtagcagccaacaacagagaaatcgtggctatcctgctggaaacctatcagggtgaagggggagtcaattttccacaggccaattatctgcaggggctgcgcaggatttgtgatcagaatggctggctgttgatgctcgatgaagtacagtgcggtctggggcgtacgggcaagtggtttgcttttcagcacagtgaggtcatgccggatgccatgacactggcaaaaggtttgggttctggcgtgccgattggtgcgtgtctggcgggtgggaaagcagcggaagtattcaaacccggtaaccatgcctccacctttggtggcaatccgctggcatgcagggcagcattgactaccctcgatatcatcgaacaggaagggctgatggataatgcggtaaccatcggtaatttcatgtgggaggaattcgggcgtcgtttacaggcttggcaggatgtgctgaaaattcgcgggcaggggatgatgatcgggatcgagttgccggtaccctgcagcgagcttgtgcctgaagcactgaaacgtcgtgtattggtcaatgtcacctccgagaaagtggtgcggttgctgccggcattaaatatgcagaaagcagaagcagaacaggtggtgacc

SEQ ID NO: 43290 - DNA, 900 bp, Nitrosomonas europaea
atgcagatcaggcattttttacaattcaaggattttgaccgccaggaatatgaatacctgttcgaccggacacgctggatcaaaaatgaattcaagcaataccgtcgctactggccactgaccgatcgtacgctcgccatgattttcgagaaacattcgacccgtacacgtctttcattcgaggcagggatgcaccaattgggtggtagtgctatttacctttcgacacgcgatactcagctgggtcgtggtgagccggtggaggacgctgccagggttatctcaagaatggtcgatatcatcaccttacgtactcacgagcatggggtcattgaacgctttgctgaaaattcacgggtaccggtgatcaatggtttgacagatgaataccatccctgccagattctggcagatattttcactttcatggaacatcgtggaagtattgcaggtaagaccgtagcctggatcggtgattccaataatgtatgcaatacctggctgcaggctgctgaggtgtttgacttcaacgtgcatgtttccacgccaccgggttatgaagtggagccggaacgggcgggtctgtatggcacggatcactacgaacagtttgtctctccgcatgatgcagtaaaagacgccgatctggtcacgactgatgtgtggaccagcatgggtttcgaggatgaggcggatacacgcaaaaatgattttgcagatttccgggtggatgctgagatgatggcctgtgccaaagaagaagccctgttcatgcattgtctgccggcacaccgcggtgaagaagtggatgcggaggtcattgatggccctcagtcagtagtatgggatgaagccgagaatcggctgcatacacaaaaagcactgatggaatatttactg

SEQ ID NO: 43291 - DNA, 1185 bp, Nitrosomonas europaea
aagaaagcagtactggcattttcaggggggctggatacctcagtcattttgaaatggctgcaggatacctatcagtgtgaggtggttacttttacggcggatatcggccagggcgaggagattgagccggcacgtgccaaagccgtacagtttggcatcagggaaatcttcatcgaggatctgcgcgaagagttcgtgcgtgactatgtttttcccatgttccgtgccaatacgatttatgaaggggaatatctgctcgggaccagtattgcccggccgctgattgccaaacgtcaggttgaaattgcgcagcagaccggcgcggatgcggtttctcacggtgctaccgggaagggaaatgaccaggtacgttttgagcttggttactatgcgttgcagccggatattcgggtaattgctccctggcgcgagtgggatctgacttcgcgtgaaaaactgctgacttatgccgagaagcagggtatcccgatcgaaatgaagcagaaggcaggatcgccctacagcatggacgccaatctgctccatatttcttatgaggggcgtgcgctggaagatccggctgcggagccggaggagagtatgtggcgctggacagtctcgcctgaaactgctccgagtgagcctgaatatctggatctggaatatgaacgcggtgatattgttgcattgaacggtgaaaggttgtctcccgcagccattctgaccaggcttaaccagttgggtggaaaacatggtatcggccgtctcgatctggtggaaaaccgttatgtcgggatgaaatcacgcggctgttatgaaacgcctggtggcacgatcatgttgcgtgcccatcgtgcaatcgaatccattacgcttgaccgcgaagttgcgcatttgaaagatgatctgatgccgcgttatgcagcgctgatttataacggttactggtggagtccggaaagaaaactgttgcaggtgctcatcgatgaatcccaggtgaatgtgaatggccgggtcagagtcaaattgtataagggtaatgtgatggttgtcgggcgtgattcccggaccgactcgttatttgaccccgacattgcgacatttgaagaagatggtggggcttatcatcaggctgatgcagcaggtttcatcaagctcaatgcgctgagaatgcggattgcaaaa

SEQ ID NO: 43292 - DNA, 2262 bp, Nitrosomonas europaea
acactgacacataacctcggatttccgagaatcggcgcacaacgcgaattaaaaaaagcactcgaaacttactggaaaggacaaaacgatgtcgatcaactgctggccacagcgcgtgcaatccgtaccggtaactggctgttacagcaaaaggcaggaatcgatctgatcccggtaggcgatttttcactgtacgaccacatactcgacatgaccacgttactcggagcgattcctcaccgtttcgggaataccggtgacaaaatttcgcccgatctgtactttgccatggcgcgtggcaccgccgaccagccggcaatggaaatgaccaagtggttcaacaccaattaccactacatcgttccggaatttgatgacaccacccaattccgcctggcatccgaccgattgttccaggaaatcgaagacgctaaagcactgggaataactgcaaaagctgtcctgatcggtccgctgacctatctgtaccttggcaaggaagtcacacccggttttcagcgactggatctgctcccccgcctgctgccggtttaccgggaaatcctgcaaaaaatcgcttcgctgggtgtggaatgggtacaaatcgatgagcccatcctttctctcgatctcgaacaaccctggcgggatagttttgcagaagcctatcacacactgcatgacggcagctgtcgcctgctgctcaccacttacttcggtacggttgatcaccatcttaccctgctcaagaatctgccggtggatgggctgcatatcgacgtaagcagcgccccggaacagctcgaatcatttctcaccgaagatttctccggtaaaacactgtcgctgggttgcatcgatggacgcaatatatggcgcgccgatctgtcgcaaaaactggaaacactgtcgcaggctgcatcccgatttgcgggtgaactctggattgctccgagctgctccctgctgcattgcccggtggatctggcactggaaacgaaactggagccggaaatcaaaaattggctggcattttccgctcaaaagctggaagaaatgactacactcgggcgtggattgaatcaaggtagagaatcagtcgaagcgattctgactgcctcggatgaagccaggcgatcgagaacggaatccagccgcatccataatccgatcgttcaccagagagtcgataatctgaccgagcgtgacagtcagcgtaaccacccctttgcaacccgaaaacatctgcaacagcagcgcttcaatctgcccctgctgcctaccactacgataggctcctttccacaaactgccactatccgtcaggcacgtgctgcattcagaaaaaatgagctcagtcatctcgaatatctgtcagccatgcgtgccgaaattcgggaaatgattcgcaaacaggaagaaatcgggctggatgtgctggttcatggcgaacctgagcgcaatgacatggtggaatatttcggcgaacaattatggggctatgccttcacggaaaatggctgggtacaaagctacggttcccgctgtgtcaagcctcccattttgtatggtgatgtctaccgtcctgaagccatgactgtcgaatggataaaatatgctcagagccagaccggtaaaccggtcaaaggtatgctgaccgggccggtcaccatgctgatgtggtcattcgtacgcgatgatcagccgagatcgaccactgcactgcaactggcgctggcaattcgtgatgaagtcgcagatctggaaaatgccggcatcggcatgattcagatcgatgaaccggcatttcgtgaagggctcccgctcagaaaacaggactggaaatcttatctggactgggcggtaaaagcattccgtgtcgctagttccggcgtgaaagacgaaactcagattcacactcatatgtgctattccgagtttcacgatatcctgccggccatcgccgaactggatgccgatgtaatcacgatcgaaacttcacgctcccgcatggaactgctggatgccttcgtgaaattttcctacccgaatgaaatcggccccggtgtgtatgacattcattccccccgggtacctgatgcatcggaaatgtttgaactgctgaaaaaggcttcccggtatatcgatcccacgctgttgtgggtcaacccggattgcggcctgaaaacacgcaactggccggaaacgcagacagccttgcaaaaaatggtggattgcgcaaaaaccctgcgcagcgcgctg

SEQ ID NO: 43293 - DNA, 1257 bp, Nitrosomonas europaea
aaccagcaactattcgaacgttccaggcaatatattccgggaggagtcaattcacccgtacgggcttttaaatccgtaggaggcacacctgttttttttcaacgggggcagggcgcctatttctgggatgtggaaggaaaatcctatatcgattatgtcggatcatgggggccactcattcttgggcatgcacatccggatgtcgtcagggcagtccagattgcagcaggacatggtacctcttttggtgcgccaacggctgcggaactggaaatagccgagttactgtgccgtttgctgccttctctggaaatggtacggctggtgagttccggtactgaagcgggaatgagtgccattcggctggcgcgtggctataccggcagaaatcggatcattaagtttgaaggctgctatcacgggcatgatgatgcgctgctggtcaaagccggttccggtgcgttgacttttggtcaccccagttcagcgggagttcctgctgagacggcaggccataccctggtattgaactataacgatgtggcaggggtagaagaaactttcagcaagatgggtactgaaattgcagccgtgattgtcgagccggtggctggcaacatgaatctgattaaagcgacctctcagtttctagagacattgcgcacattatgtacgaaacatggcagtttactgattctggatgaggtgatgaccggtttccgtgtgggcttggaatgtgcgcaaggattatatggtatcaaaccggatctgaccattctgggtaaggtgatcggagggggactacctatggcggcctttggtggtcggcgcgatgtgatggaatgtcttgcgccgctgggatcggtataccaggcaggtacactttccggtaatccggttgccgttgctgccggattggaaacattgcatcagatccaggtacctggcttcttcgacaaattgtcgaccatgactcgtaaactgaccgaggggttgactgcggtggctgcaaaacatagtgtggcgttctgtgcacaggcggtgggtggaatgtttggtctttatttcagaaaatctccaccggaaagttttgctgaagtgatggagagcgatcgtgaggcattcaaccacttttttcatgccatgctgaaagagggcgtatatttcgctccttccgcattcgaggcaggtttcgtttctgctgcgcacagtaatgaggaaatcgataaaacattggcagtggctgatcggatattt

SEQ ID NO: 43294 - DNA, 1260 bp, Nitrosomonas europaea; identical to SEQ ID NO: 43255

SEQ ID NO: 43295 - DNA, 867 bp, Nitrosomonas europaea
gcgctgctcgaagtaacggatctccgggtgctgctgcataccggccggcaaccggtacgcgctgtggacgggctgtcacttgccatccatccgggcgaaacatttgcgctgctgggggaatccggcagcggaaaatccatcacggctctttcgatcatgcgcctgctgcccgatgccggagaaatcgtgcatggcagtgtccggttgaacggagatgaactgctgaccctgccggaatccgccatgcgcaaagtacgcggtaatcgtatcggcatgatttttcaggaaccgatgctcagcctgaatccggtaatgaccaccggtgcacagatcggagaagttttactgcagcactccggtttacgtggtgcagcgttacagatacgcattctggaacttatgcgtcaagtaggcattcctgatcccgcccgacgcatggcagagtatccgttccagttctcaggcggcatgaaacagcgtgtcatgatcgcgatggcactggcaggcaaaccggaactcctcatcgcagatgaacccacgaccgcactggatgtgacgattcaggcccaggtgctcgatctcatgcgtggcttgcagcagcaggaaaacatggctgttcttctgatcacccatgatctgggtgtagtagcagaaatggcacatcgcgttgctgtgatgtacgcaggccaaatcattgaaacagcggatcgggaacgcttttttcaatcaccagcccacccttattcccacaagctgtttgcggcactgccgacaagaaagaaacgcgatcagggactgattgtcatcccggggaatgttccggctctttcaaaagtatttaccggttgccgttttgctgatcgctgt

SEQ ID NO: 43296 - DNA, 1194 bp, Nitrosomonas europaea
atgaatccttcactggaaaatcttcagttatatccgtttcagaaactcaccaagttgtttgaggatctcgtgccaagggattccctgccgactcctatcggtttgcatattggtgagccaaggcacagcacccccgaatttatcaggcaggagctgatcaacagtctcgaagggctggctcattatcccacagtacttgggactgacaggctaagagccagtattgcaacctggctcacacagcgctatcacctatcttccattgatccggataccgaggtcattccggtcaatggcagccgggaagcgttattttcatttgcccaggcggttatcgataccgatcacaaagctattcagccagcggtagtttgccagaatcccttttatcaaatctatgaaggggctgcattgctagcgggggcaacgccctattttctcaaccagctgccggaaaacaatttttcggcagatactgcacagttacccgatacggtgtgggaacgcacacaactggtgtacatttgttcccctaataatcctaccggcaaagtgttgactctggatgaatggaagcatctgttcgatttgtccgatcgttatggatttgtgattgctgcagacgaatgttattcagaaatctatttcgatgagggccatcccccactgggtgcgctggaagcggccgaaaaactcgggcgtagcggatttccccgtctggtcgtgttcagcagtttatccaagcgttcgaatgtaccgggaatgcgctccggttttgtagcgggagatgcgaccattctcaggaaatttctgctttatcgcacctatcatggtagtgccatgaatccggctgtgcaggcagcaagtaccgttgcctggagtgatgagcagcatgtggctgaaaaccgcaagctgtactatgagaaatttactggcgccatgcatatactgggggataccctgcctgtcagtatgccggatgcggggttttacttatggctgagaacacctgtcagtggtatcgagttttccaggcgtttgtatcgtgaaggaaatgtgaccgtgttgcccggcagctatctggcacgagaggcgcacggtatggatcctggtgaagatttcgtgcggatcgcactggttgcacccgtggtggaatgcatggaagcaatggagcgaatcagggacattgccaga

SEQ ID NO: 43297 - DNA, 978 bp, Nitrosomonas europaea
tttccacaaaaaagaatgcgccgtaaccgccgggatgatttctcccgccgtctggtccgggaaaatcatctgcggccagatgatctgatttatccggtattcgtactggatggcagtaatcgcgaagagaaagtggcgtcgatgcccggggttgtccggcaaagtattgatctgctcctgctccaggccgaaaaatgtttgcgtctgggaatccccgccctggcaattttcccggtgatcgatgcttccctgaaaaatctgactgccgatgaagcctataaccccgatggcctggtaccgcgcacggtgaaggaattgaagaaacgttttcccgaactgggggtgatcaccgatgtggcactcgatccctataccagccacggtcaggatggtctgatcgacgcaaacggctatgtgctgaatgatgaaacggtcagtgtactggaacggcaggcattgtcacatgcccaggcgggtgcagatgtcgtggcaccttccgatatgatggacggtcgggtagctgccattcgtgctgtactggatcgtgaccagtttatccatacccggatactggcctactcagccaaatatgcttccagtttttatggcccgttccgggatgcagtcggctcgtctgctacgctgggggcgggcaataaatacacctaccagatggacccggccaattcggatgaagccatctgggaagcggggctggatattcaggaaggtgcggatatgatcatggtcaaacccggcatgccttacctcgatatcgtgcgcagggttaaggatgagctgggcgttcctaccttcgtctaccaggtgagtggcgaatatgccatgctgaaagcggctgccatgaacgggtggctggatgaaaaagcctgtgttaccgaggcattgctggcgtgtaaacgtgccggtgcagatgccattctgacgtatttcgcagtggaagtggccggctggctgcag

SEQ ID NO: 43298 - DNA, 1530 bp, Nitrosomonas europaea
ctttatctgctgctcaacctcggtgaagtgatattcagccgcgccggtgcctcctgccgcattgtcattgcaccgcgattacgggcgcaggtgacgagcgagctgtacgcttacctgcagcaccattcgcatcgtttcctcagcaacaacttcgccggtgcgctagccagccgtatctcggaaacctcgaccagcgtcaacatgacattatggacgctggtgttcgatttcctgccaattgtcgtcacactgaccgtctcgatcatcctgctgtggtacgccagtattcccttgtcgctgtttacgctggtatgggcattgctctacctgagtatttcctactggctggcgcggcgctgccggccgctggcgcataaatcggccgaggcgcgcagcattacagttggtaaagtggtggatgccgttaccaaccttgccagcgtgcggttgttcgccatgctgggtttcgaacgcggctacctggaaagtttcctgaacaacgagattgccgcttcacggcgctggctctggtcgaatgagaaaatactctggttccagttcctgctggcgttgacactcaaggtaggcacactgctgtttgccttgtggttgtggcagcagaaccagatatccgtggccgatttcgtgatgagcgtcagcctctcgctgctgatcatcggggaggtgcgtaacatcagtcgtcgtttcatcgatctgttcgaatacattggcaatattgccaacggtgtgggtatcatcgtgcgtgaacatgaaatcgtcgatcgccccggcgcgcaaccattgcacattacccgcggctgtatcgaactgcgcggtgtcaccttcggctattctcccgacaatccggtattcgaaaatctcgatttgcgtatcgagggcgggcagcgcgtagggctggtgggctattctggttcaggcaaatcgacactgctcaacctgatcctgcggctgtacgacccacagcagggtagtattctgatcgatggtcaggatatccgggacgtcacccagcagtcccttcatgaacagatcagcctgattccgcaggaccccggactgtttcatcgcactctgctggaaaatatccgctatggccgtcccggcgctacccgggaggagatcgaactggctgcacgcggcgccgatgcacacgaattcattgaacgcatgcccaatcagtacgaatcactggtgggcgaacgtggcgtgaaactctcaggcggccagcggcagcgtatctccattgctcgcgtcatcgctaaaaatgcgcccatcctgatcatggacgaagccacttccagtctggattcgattaccgaacaggccatccagaacagcctggctgcgctgatgaagaacaaaaccgtgatcgtggtcgctcaccgcctttccaccatcgcacatctggatcgcattctggtattcaaccgcgggcgcatcatcgaagatggcagccacgctcaactgctggctgtcaacggtgcctatacccaactttggagccggcag

SEQ ID NO: 43299 - DNA, 1113 bp, Nitrosomonas europaea
attgcgctgcccggagtcatttttctggaaatgctcaaaatggtagtgattccgctgatcatctgctccattgcactcggtattctgaccagtggctctccgcaccagttgaagcgaatgggagcattcatcgtgccgtacttcatcatcacttctttcgttgccgtaggaatcggccttgccatcacgctcatcattcagcccgggcatacggtcggcaccagtatcgatacgctggcggctgccatgacggctgatggtggtataaaaacatttgacgatctgactgtcccgcaacgcatcgttaacctcatcccttccaatttcgtcgaagcagccatgcaaaccgacatgctcaaagtcgtaattggtgcgatttttctcggtgtagccgcgttgaccattccacgtgaaatcgcaaaaccattcgaggatttatgcctgttcggacaagtggccgcaatgaagatcatcagctgggccatggcactggccccttatgctgtattcggtctgatggtcgatgccatggttcggctgggcttcgatatactgacagcgatcggctggtatatgggttgtgtattgctgggactcgtgatcattctcggcttgtatctgttcggagcagccgttttcggccatcgtccgccattcgaatttttgcgcgccatacgtgatgtgcaactgctggctttctccacctccagttcagctgccgtcatgcctttatccattcgtgcagcagaagaaaatcttggtgtcagtgaagatatcagtcgttttgtcattcctgtcgggacgacgatcaatatggacggtaccggactttaccaggcagtagccgctgttttcctgtgccagatcttcaaagtggatctgagtttcacagaaatgatcctgctgttatgcaccacggttggtgcttcgatcggcacaccggccacgccgggtgtcggtattgccgtactggctaccattttatcgggcatcggtgtgccacctgccggaatcggcatcattttcggcgtcgatcgcattctcgatatgtgtcgcacgaccatcaacgttactggtgatctgactgctgtcgtcatcatggataaatggatg

SEQ ID NO: 43300 - DNA, 1212 bp, Nitrosomonas europaea
gtggcgttcctcgttcaaaaatatggtggcacttcggtaggcagcaccgagcgcattaaacaggttgcgcatcgtgtggctgagtttcgggcgcaggggcatgagctggtagtcgtcgtatcagccatgagcggagaaaccaatcgtctgatttcgctggcaaaagagattcaacccaatcctgatccccgtgaactggatgtcattctgtccaccggcgaacaggtaacgatcggattactggcgatggctttgcgtgagctggggatcaaggcaaaaagctataccggtcctcaagtcagtatcacgactgacagtgcccataccaaggcgcgtatcctgaagatcgatgaagaccccattcgtgccgatctggcagcgggttacgtgattattgtggccggattccagggcgttgatgaaacgggtgatattacgacgttggggcggggtggctcagatactacggcggttgcactggctgcagcgctcaaggcggacgaatgccaaatctacacggacgtcaacggtatttataccactgatccgcgtgtggtgccggaagcccggaaactggataccattacattcgaagaaatgcttgaaatggccagcctgggctccaaggtgctgcaaatacgttcggtggagtttgccggtaaatacaaggtcaagctcagggttctttccagctttgaggaaggcgaaggtacgctgatcacgtttgaggaagataacaagatggaacagcccataatctcggggattgcatttaatcgtgacgaatcgaaaatcacggtggtaggtgtgccggatcaccctggtattgcctatcagatactgggcccggtggcagatgccaatatagacgtcgatatgatcatccagaacgttgggcatgatgataccactgacttttcatttacggttcaccggaacgaatatgccagaacgatggatgtactgaaacaacaggtattgcctcatatcggtgcgcgtgaagtcattggcggggataaaatcgccaaggtctcggtgatcggggtgggaatgcgttcctatgccggtatcgccagcaaaatgtttcgtgttctggcagaagagggaatcaatattcgtatgattgcaacttcagaaatcaaaatttctgtcgtagttgatgagaagtatatggaattagcggtccgggttctgcacaaagcttttgatctg

SEQ ID NO: 43301 - DNA, 1435 bp, Nitrosomonas europaea
attctggccatcgatcaggggacgaccagcactcgtaccattctgttttcggcggaactgaaaatccttgcagtgcaacagaaagagctgaagttgcattatccgcgcaagggctgggtcgagcagaatccagaaaccatctggcaggatacgctcgaagtctgccgtgcgatcctggaacgcactgccggcagggcggaagcggttgctgccattggcatcaccaatcagcgcgaaacgaccattttatgggatcgtaagacaggcaaacctgtttatcctgccattgtctggcaggatcgccgcactggtactgtttgtgagcgattgagagcacaaggatttgagccgatggtaacagcccgaaccggcctgctgttcgatccctatttttctgcaaccaagattgcctggatattggataacgttgaaggcgtgcgtgcccgggcagtaaggggtgaactagcgtttggtacgatcgattgctatctgctctggcatctgacaggcggtcgagtacatgccactgatgtaacgaatgctgcacggacattgttgttcaatatcgtcgaacagcagtgggatgcagacctgttggcattgttcgatattccggcagcgattctgccggaagtccgcgataatgctgccggattcggggtgaccgacccggctttgttcgatcgggaaattcctgttggcggcatggcaggagatcagcatgcggcgctgatcggacaaaggtgcttccggccgggcatggtcaaatccacctatggtaccggtttttgcgctcatgaatatcggtccggatttcaggctttcacgacatcgtttactgaccacgccggcgtatcgtctgaatggcaagatggtttatgctgttgaaggatcgattttcgttgcgggtgcagcgattcagtggctgcgggacgggctggaattctttcaggatgcagcagctagtgaggcactggcgcgcagtgtgccggacagtaatgaagtgtatttcgtacctgcttttaccggcttgggcgcaccctactggcgaccggatgtgcgcggtatgatcagtgggttgtcacgtgatacgacccgggcgcatattatccgtgccgcactggaagcacagggctaccagaccctggatctgatggcagcaatagaggaagatggcggccatcaggccgacgtcgttcgtgtggatggagggctggtggcaaacggattcatgtgccagtttctcgctgatatgttgaacagaccggtggaagtaccgaaagtaacggaagcaacggcactgggtgcggcaattctggccggattggcagtggggctgttcgccaggctggaagcaactgaacattattggcaacgggatataatctacactcctgtgatgacagaagctgaaagaaaacgactgtatgccggc

SEQ ID NO: 43302 - DNA, 552 bp, Nitrosomonas europaea
atgaatcttcccaattttctgacgtggctgcgtatcatggcaattcccctgtttgtcggtattttttatctgccgacggactggatgtctccggccacgcagaatctggttgccaccatcgtatttgccggcgccgcgttgaccgactggctggatggctacctggcgcgggtgctcaaccagacttccgcatttggtgcctttcttgatccggtagcagacaaactgatggtagccgccgccctgatcgtactggtgtatctggaccggttggatgccccggttgctttgatcatcattggtcgtgaaattacaatttccgcactgcgtgaatggatggcgcaaattggcaaatccaagagtgtggcagtgtcttttctggggaagatcaaaacggctgcacaaatggtggcaattcccctgctgctctaccacgacagaatcaatgatgcgttcgattcacagacggctggcacctggctgatttacattgcagccattctgacattgtggtcgatgatctactacctgagagcagccattccacatgtg

SEQ ID NO: 43303 - DNA, 1068 bp, Nitrosomonas europaea
aggttgaaacagggttaccagaaacccttcctgctgatcgacagcaatatcattcgcaacaaggcccgacgattcaagacatccatgccacgcgtgcgcccgcattacgcagccaaagccaatccagatccacgtgtattgaaaacactgatcgaggaaggtgtgggtttcgagattgcttcaatcgccgagctcgatcttttgatgagcctgggtgtcccggcagccgaaatcttttacagcaacccgatgaaatcacgtgcctatatcgagtacgcggctgcgaaaggcgtggaatggtatgtgctggacagcatcgaggagttgcgcaagatcgtcagtatcaaaccggatgctaaactgtatttgcgtattgatactcccaatatcgggagtgactggccgctggcaggaaaattcggaactcatctggtcgatgtgagtgagatcatcgatgaagcggtcagactgaaagctgatttggcgggtgttacttttcatgtgggttctcagtgtcgcaatccgcagaactggcgagtaggaatcgagcgtgcccagactgtgtttgccagcatgcgcgaagccggtctcaagccacgtctgctgaatctgggagggggttatccggtacgccacgtcaagccgattccttctatcgaggttattgcagaagtcatcaacgaggctatcgccgacttgccggaagatattcacgtcatggctgaacccggacgttatctggtctctgattcagcctgttttgtatgccgtgtggtcggtacagccacgcgtaacggtaaacgctggatgtactgggatgccggaatattcggcggcatcatcgaagtgagcgaaggactgcgttacgagattctgacacagcgtaacggctctttgattccctggtcggttgccggccctacctgtgattctgtagacgtcctcatgcacgatgaaatgctgcctgaagatatccaggaaaacgatttcatctttattcccaacgcaggggcttacacaacttcctatgcaagtaacttcaatggctttccgttaccggatgtcgtt

SEQ ID NO: 43304 - DNA, 1104 bp, Nitrosomonas europaea
atgaaaacacgtgcagcagttgcctggcaagctggccagccacttaccatcgaagaagtcgatctcgccggccctcgtactggcgaggtgttggtcgaaatcaaggcaacgggcatctgccataccgattattacacgctttccggtgccgatccggaaggtttgtttcccgccatccttggccatgagggtgccggtatcgtggttgaagttggtgcagacgtcaaatcactccgtccgggggatcatgtcattcctctgtacacgccggaatgccgggaatgcaagttctgtctatcacgcaaaaccaatttatgtcaggccatccgtgcgacgcagggacgcggcctaatgccggatggcacttcacgcttctcactcgatggcaaggccattatgcactatatgggtacttcgactttttccaactatattgtcgttcctgaaattgctttggcaaagattcgtgaagatgccccttttgataaagcctgttacatcggctgtggtgtgactactggcattggtgcggtactgtttactgccaaagtggaagtcggagcaaatgtcgctgtattcggactgggaggaatcggcctgaacgtcattcagggtgcacgcatggcgggcgctgacaaaatcatcggtattgatctcaatcctgaacgggaagcattgggccgccaatttggtatgacgcatttcatcgatccaagccaggtggaaaacgtggtggatgctgtgatacaactgactgacggtggtgcagactacagctttgaatgcatcggtaataccacagttatgcgtcaggctctggaatgcacacataaaggctgggggcgcagcatcatcattggagtagccaaagccggcgccgaaatcagtacccgtccattccagctcgttaccggcagaaaatgggaaggctctgcctttggcggagcgcgcggccgttcggatgtgccacgaatcgtcgactggtacatggatggcaaaatcagcattgatccgttgatcacacacatattgaagctggaagaaatcaatgaaggcttcaagttgatggaagcaggcgaatcgattcgttcagtggtggttttc

SEQ ID NO: 43305 - DNA, 1806 bp, Nitrosomonas europaea
gcgcagatcaacttctggtacgtgctgattgcagtactcagcattctcttcatccagaacctttacaatcagtatacgcgaatagagccgattccctacagccgcttccagtctctgttggagcaggacaaggtgtccgaagtggccatcactgatcaacagatcttcggcaagctcaaggaatcgaccagtgaaaaattcaccgaattcgtcaccacccgggttgaatcggatctggcagaaatgctggataagcacaatgttacttatactggtgtcgtccagagtacctggttgcgcgatctgctttcctggatcgtaccgatggccgttttcgttggtatctggctgtttatcatccgacgaatgaataaaggcatgatgggaagcggcctgatgtcgatcggcaaaagccgcgccaaggtctacgtggaaaaagaaaccaaggtaacctttgccaatgttgccggggtggatgaggccaaggaagagttggtcgaaatcgtcaattttctcaagaatcccaaggaatacagccggctgggcggacgggcacccaaaggtatcttgctggttggtccgcctggtaccggtaaaaccctgttggcgcgcgcagtggcaggtgaggcaggtgtaccgtttttctcgatttccggctctgaatttgtcgagatgttcgtaggcgttggtgctgccagagtgcgtgatctgtttgaacaggctcgccagatggcgccggcaatcattttcatcgatgagctggattcactcgggcgcgcgcgcggtgcaggcggatttggcggccatgatgaaaaagaacagacactgaatcaattactggccgaactcgatggattcgatccttccagtggaattgtcctgcttgccgcgactaaccgtccggaaatcctggatgcagccttgctgcgcgccgggcgtttcgatcgtcaggtactggtggaccggcctgataaaaaaggtcgtcagcaaatcctgggtgttcatattggcaaaatcacactggcgcccgatgttgataccgaacagatcgcagcactgacacctggcttcacaggtgctgatctggctaatttgatcaatgaggctgcgctgctggcgacccggcgtggtggtcaggcagtcagcatggacgacttcaataatgcaatcgagcggatcgtagctggcctggaaaagaaaaatcgtctgctcaatccggaagaaaggcgtaccgttgcttaccatgaactgggccataccatggtggcacttgctctgccgggatcggatgaagtacataaagtttcgatcatcccacgtggtattggtgcacttggctataccattcagcgtcccaccgaggatcgctttcttatgacacgcaaggagctggaaaacaaaatggcggtattgctgggtgggcgtgcagcggaaaggttggtattcgacgagatttccaccggtgcttccgatgatctggcgcgtgctaccgatatcgcccgtgccatggttttacgctatggcatgagcgaggcaatcgggaatgtggtttatgatcgcgaacaaatggcgtttttgcaacctggttttcccatgccccaaagccgtgattacagtgaagaaactgccaataaaattgaccagactgtacgttcactgcttgatttggcgcttgaacgtgccattaaaattctggataaaaatcgggaactgcttgatcgaactgcgcagcaattgctggaaactgaaacactgaatcagccggagttactggagctgaaacgcaacttgcgtgcggaggaaacc

SEQ ID NO: 43306 - DNA, 1323 bp, Nitrosomonas europaea
aattctgttatgaagccaatttatgtaggactgctcggtgtcggcactgttggcggcggcacttataccgttctgaaacgcaaccagcaggaaatcactcgcagaaccggtcgcaatatcgtcatccgcatgattgccgatctggatcaggaaaaagtgcgtcatctgacagcaggtgatgatgtcatcgtaacttccgatgcgcttgaggttgcccgacaccccgaaatcgatatcgtcatcgaactgatggggggacaaaccattgccaagcaggcgatccttgaagccatcgctcatggcaagcatgtcattaccgccaacaaggcactgctggcaatccatggcaatgaaatcttcgcagccgcacaacagcgcaatgtcatcgttgcgttcgaagctgccgtggcaggtggcattcccatcatcaaggccttgcgtgaaggtctggcagccaaccatatcgaatggatcgccggcatcatcaatggaaccagcaatttcattctgtctgaaatgcgttccaaaggactggatttcactaccgttctggctgaagcacagcaactgggctatgccgaagctgatccgacctatgacatcgaaggcatcgatgcagcgcataaaattaccatcatgtctgcccttgccttcggtatcccggtccggttcgatcaaacctacatcgagggaattacgaaactggccaatgacgatatccgctatgctgaagaactggggtatcgcatcaagctgctgggtattaccaggcgcaccgccaacgggatcgagctgcgtgtccatccggcactgatcccggtcaaacggctaatcgccaacgttgaaggcgtgatgaacgcgatcatcgtcaagggagatgctgtcggcccgacactgtactacggtgccggagccggagcagaacctactgccagtgcagtcattgccgacctggtcgatgtgacccgtctgctcacttccggcccggaacaccgggtaccggtgctggcattcctgccggaactgctgtccgatactcccattgtgccgatggaagcagtcgaaacggcttattatctgcgactccaggttctggataaacccggtgtgctggctgacatcacccgtatcctggcagacaaccatatctccatcaacgccatgatccagaaagaacatgcggacaaggaggacaaggtcaacatcatcatgctgctgcacaaaacacgggaaaagaacgtcaacaccgccattgaaaaaattcagaacctcccggccatgactgataaaatcatccggatccggcttgaggagctcggcagt

SEQ ID NO: 43307 - DNA, 687 bp, Nitrosomonas europaea
ttttcgattagccgttatgatccagacaaggatgaaaagccgtacatgcaggattatgacgttgagcttgagcctacggataaaatgcttctggatgcgctgatacgcatcaaaaccatcgatgacagtctcagcctgaggcgctcctgccgggaaggtgtctgcggttccgacgccatgaatatcaacggtcgaaatggacttgcctgcatcacgccgctggccggcctgcgtgaaccggtggagatccgtcctttaccggggttaccgatcatccgggatctgattgtcgatatgagccagtttttcaaacagtatcactcgatcaaaccctatctggtcaacaatgatccaccgccggagacagagcgattacaatccccggaggagcgcgcccggctggatgggctctatgagtgtattctgtgtgcctgctgtacaacttcctgcccttcattctggtggaatcccgataaatttgttggcccggccggattactgcaagcctatcgctttctggccgacagccgggatcaggccacctcggaacgactggatgatctggaagatccctaccgtttattccgttgtcactccatcatgaactgtgtcgatgcctgccccaagggattaaatcccactgccgcaatagaaagcataaaaatcatgatgctgaataaaacggta

SEQ ID NO: 43308 - DNA, 1236 bp, Nitrosomonas europaea
ggcaaacaagagattgaactgcccattgtgtccggtaatgaaggcccggatgtcgtcgatattcgttcgctgtatgcccagagcggcatgtttacctacgaccccggttttgtgtcgacggccagctgcaaatcggccattacgttcatcgacggtgacaaaggtgttctgttgtaccgtggctatccgatcgagcaactggccacccgctgtgatttcatggaagtcagttatcttctgctgaatggcgagctgccgacacccgaccagaaagcgaaatttgtcgacaacatcaaaaaccacacgatgctgcacgagcagctgatcaagtttctcagcggattccgccgtgatgcgcaccccatggcagtcatggtcggcgtagtcggcgcattgtctgccttttatcatgacgccatggatgtctctgacgcacaacatcgcgaacagtctgcattccgcctgattgccaagctgccgacgatcacggccattgcctataaatacaatattggccagccgttcatctatccgcacaacgatctgggattcacggaaaatttcctgcacatgatgtttgccacaccggccgagcaatatactcccaatccggtcatcgtcagggcactggatcgcatcctgattctgcatgcagaccatgaacagaatgcctccacttcgactgtccgcctggccggttcgagcggagccaacccgtttgcctgtatctcagccggaattacctgcttatggggtccggcacatgggggcgcgaatgaagcctgcctcaacatgcttgaacaaatcggagatgtttcacgtatcaacgaatacattgcgcgagccaaagacaagaacgatcctttccggctgatgggctttggccaccgggtctacaaaaattttgatccgcgcgccacattgatgcgtgaaacctgccatgaggtcctggatgaactggggttacataacgaccggttgttcaagctggcgctagagctggaaaaaatcgcgttggaggatgactacttcattaccaagaagctttaccccaatgtcgatttctattcgggcatcgtacaacgcgcactgggtattccgacgtcgatgttcaccgccatttttgccacagcccgcaccgttggctgggttgctcagtggaacgaaatgatttccgatccggaacaaaaaataggccggccacgtcaactgtacgtgggcgcacctcgcagagat

SEQ ID NO: 43309 - DNA, 2838 bp, Nitrosomonas europaea
aaacaacttttagaagattcgaaactgttcggcaacaatgcggcattcatcgaaatgctctacgaacgctatctggaagatccatttgcggtatcggatcaatggcgccagtattttgattcactgcagccgacagaaaccatctctgtacgagacatccctcatactcctgtcgttgagtcactggtacgatctgccaccctgcacaaaccacctctgtccgggactccatcaaagcaggcgattgaacaaccgtctgatactgaaacacaggaacgcaagcaggttgctgttctgcaattgatcaacgcctaccggttcctgggggtacgcagagccaacctcgatccgctcgatctgcagcagaaacaggatattctcgaactcgatccgggatttcacgggcttaccgacactgacatggacaaggtgttcaataccggctccctggtcggtcccgagcacgccactttgcaggagattctacaccgtctgcagcaaacctactgcggcagcattggtgccgagtacatgtatattgcagacaccaaacagaaacgctggatacagaaccggctggaatccatcaacgcccagcccggttttacgccagagtacaaacgtcatattctcgagcgattaactgctgcagaaggactggaaaaatatctgcacaatcgttatgtcggccagaaacgcttttccggagaaggtaatgaaagcctcattccaatgctggacaagctgctgcaacacgccgggatatccggtgtacaggaaatcgtcatgggaatggctcatcgcggccgcctgaatgtactggtcaacacgttgggaaaaatgccttccgagctgtttcaggaatttgaaggcaagcacccacaagcgctgacttcaggggatgtcaaatatcaccagggattttcttctgcagtcatgacttcgggcggcatcatgcgtctggcgcttgcattcaatccgtcacacctcgagatcgtcaacccggtagtggaaggttcggtacgcgctcgtcagcaccgcttcggcgacaaaaacggagatcatgtcatcccggtgctgattcatggtgatgctgcctttgccggacagggtgtcgtgatggaaacgctgaatctgtcacaaacacgcggttatggcacgggtggaacgattcatatcatcatcaacaaccagattggtttcaccacatcggatccgcgcgacagccgctccacgttatattgcaccgatgtcgtcaagatgatcgacgcaccggttttccatgtcaacggagacgatcctgaggcagtagtactggctacagaaatcgcatttgattttcggatgcagttccatagagatgtcgtgatcgatctggtctgtttccgcaagcaggggcataacgagcaggatgagccgatggtgacccagccttccatgtaccgcgtcatccaccagcatccgggcacccgtaaactgtatgccgatgggctcatccgccagggtgtagtcgataacgccgatgtggagcatatggtgcagtcctatcaggatgccatggatgaagggcgtaaccccaatacgactatctgctatgactacaaatctcccaatgtggccaactgggtacccttccaggcttctgagaaatggaaccagccggtaacaaccggagtaccggttgaagatctgaaatatctgtcggaacgcctgactaccattccagccacattcaagttacaccccagggtcgaaaagattatccaggatcgccggaaaatgggggaaggcagtttaccgctggattggggaatggctgagaacctcgcctacgctgctctgctgaaagaaggttacccggttcgtatttccgggcaggattgcgggcgtggcactttttttcatcgtcatgccgtcctgcacgaccagaatcgtgagcaggatcaatgggaagatggaacgtatatccctttgcgccatatcacacccaggcagcctgattttgtcgtcatagactcgatactgtcagaagaagccgtactaggtttcgaatacggttatgccaccgcccagccaaatgagctcgtcatctgggaggcacaatttggcgattttgccaacggcgctcaagtagtcatcgatcagttcattgcttccggggaagccaagtgggggcgcctgtgcggactggttctgctgctgccgcacggttatgaaggccagggtccggaacattcatcggcccgtctggagcgatatctgcagctatgcgccgaatacaacattcaggtatgtgttccttccactccagcacagatattccatcttctgcggcgtcagatcatccggccgatacgtaaaccgctgatcgtcatgtcacccaaaagcatgctgcgccacaaggaagcagtttcatctctggaagaactggcaaatggtcgtttccagcccatcctccctgaaacggaagcattcgaaatcgagaaggtaaaacggctgatcgtctgcagcggaaaaatatactacgagctgacagcctatcggcgcgaacaccatatcaccaatatggcaatcatcaggctggaacagctttacccgtttcctcacgaagattttcaggcagaaatcaaccggtacgaccatgctacggaaatcctctggtgtcaggaagagccaggcaaccagggtgcatggcaccgtatccagcactatctgttgcgacatatgcggcctgatcagatactcgggtacgcacttcgcccctcatctgcttccccctcagtcggttatctggcgatggacagattcagacagaaagaattgatcgaggcagcgttc

SEQ ID NO: 43310 - DNA, 1269 bp, Nitrosomonas europaea
ctgatcgaagtcaaagtccccgcattatcagaatcggtagcggaagccacattgatcaactggcataaacagccaggcgagtatgttgaacggggtgagaacctgatcgacatcgaaactgataaggtcgtactggaactccctgctccgcagtccggaatcctggctgaaattatccggaacgatggcgctaccgtcaccagtggagaaatcattgcccgtatcgataccgctgccaaagagacaaaaactgctgcacagcagcctgctccgattgattccggacacctggaaatcacagaatctacggtagcatccatgcatccggctcagccgctcatgccgtcagccaaaaaagctgccgaggaaaatggtcttaccatggaagaaattgcagccattcacggtacaggccgtggcggacgcatcacccggcaggatgtgctggcccatgtcagaaacaaaaacagtgccgttaccgatcagcagtctgattcccgcaccgatcaatctgctgctggtataccccaggcagacacttccccgataccagtcgatcagacagaaaaaccagatcggctggaaaaacgcgtacccatgacgcgtttacgcatgcgcattgctgaacggctggtacagtcccaatctacagcagccattctgactacgttcaacgaagtcaacatgcaggcaatcatggatttgcgcgcccgttacaaggacagctttgagaaagaacatggtatcaaactcggctttacttcattttttgtcaaagctgtggttgccgccctcaagaaatttcctatcatcaacgcatcggtagatggaaatgacatcatctatcacgactattacgatatcggcatagcagtggccagtccacgtggtctggtcgtgccgatcatccgtgatgccgataagctcaccttcgccgggatcgaaaaacagattgctgatctggccagacgggcacaggaggggaaactcacactggaagaactgacaggaggtacgttctccattaccaatggaggcgtatttggctcgatgctctcgacaccgatcatcaacccgccccaaagcgcaattcttggcattcatgccaccaagcaacgcccggtcgtcgagaatgggcagattgtaatccggccgatcaactatctggcactttcctatgatcaccgcatcatcgacgggcgcgaagctgtcctgtcgctggtcgcgatcaaggaagcactggaatatccggtcagcccgttattcgag

SEQ ID NO: 43311 - DNA, 873 bp, Nitrosomonas europaea
gcgatcgaggtacggcaactgagcaaacgctacggtaagctggttgcactggataatatcgatctggtcgttcaaccgggggaattcttcgcgttgctggggcccaacggagctggtaaaaccacgctgatcagtattctggcgggtctgacccgggcaagccagggatctgccagagtaatggggtacgatgtgctgtccggatatcgtgaagcccggaaaaggctgggggtggttccgcaggagctggtgtacgacccctttttcacggtgcgtgagatgctggtcatccaatctggctatttcggaatcaggtgcaacgatgcctggatcgatgaaattttgcagcatctcgatctcgctgataaggcacatacgaatgtacgtgcgctgtcaggcggtatgaaacgacgtttgctgatcgcgcaggctctggtgcataaaccgccggtgatcattcttgacgaacctacggcgggggtggatgtggatttgcgccagagtttgtggcagttcatccggcagctcaatctcgaaggtcatacggtcgtgctgaccacgcattatctggaagaagccgaagctttgtgtaaccgtgtggcagtgctcaagcagggcagaatcgcagcgctcgacagtatgcataatctcgtacgcagtacccgggactatacgctggagttgcgtttatccaccgacacactgccatccgggctgggtacgtggccaggcgggcatgacggctgcctgcacaacctgaaaataaagaattacaccgagatcgagaaaatattgtcggtattgcgccaatccggaatcgaggtgctcgatatgcggttactccagcctgatttggagactgtattcatgaag

SEQ ID NO: 43312 - DNA, 2571 bp, Nitrosomonas europaea
atgcggtttgacaaattcaccaccaagtttcaacaggcactcgccgatgcgcaaagcatggcgctgggtcaggatcatccctatatcgaaccgcagcatctgctgctcgccctgatgcagcaggatgacggcagcatcacttctctgctgcagcgcgccggtgtgaatgcccaaccattgcgccaagcactgacgcaaagcctcaaacttctgcctaaagtggaaggtacgggcggagaaatcaatgtttcccgcgatctggccaatctgctcaatctgacggacaaggaagcgcagaaaagaggagatcagtacatcgcctcggaaatgttcctgctggcagcgctggaagacaaaggagaaaccggacgattgctgaaacaatatggagcgacacgtgctgcgctggaacaggcggtcgattccgtgcgtggcggagaaaaggtgaccgatgccgaagcagaaggcagtcgtgaagcattgaagaaatacacattggatctgactgagcgtgctcggtcaggcaagctcgatcccgtgatcggacgcgatgatgaaatccggcgcacgattcaggtgctgcagcggcgcaccaaaaataacccggtcctgattggcgagcccggggtcgggaaaacggcaatcgtggaaggattggcacagcgcatcgtcaacggggaagtacctgaaacactgaaaaacaagcgggtgctgtcactggatatggcagcgctgctggcaggtgccaaataccgcggagaattcgaggaacgattgaaagccgtgctgaaagaattggcgcaggatgaaggccgcaccatcgtgttcatcgatgaactgcatacgatggtgggagccggcaaggcggaaggtgccatggatgcgggcaacatgctcaaaccggcgctggcacgcggagaactgcactgcgtaggcgcaaccacactggatgaatatcgcaaatatgttgaaaaggacgccgcactggaacgccgtttccagaaagtgctggtggatgagcccggcgttgaagcaacgattgccattctgcgcggtctgcaggagaaatatgaattgcaccacggcgtggaaatcaccgatccggctatcgtggcagcagccgaactctcccatcgctatatcactgaccgctttctgccggacaaagccatcgatctgattgacgaagctgcagcacgcattcgcatggagcaggattccaaaccggaagtcatggataagctcgaccggcgtctgatccagctgaaaatcgaacgtgaggctgtcaggaaagaaaaggatgatgcttctaaaaaacgcctggcattgcttgaagaagaaatcagcaaactggaacgggaatatgctgatctggatgaaatactgaaagcagagaagtcccgtgcaaaaggctcacaggaaatcaaggaagaactggataaactacgccgtgaagaggaagctgcccgacgcaagggagatctgcagagagcttctgaattactgtatggccgtattccgcaattggaagcacagcttgccgaacagctccatcacgccgaatcggccgaggaagctgtacaaccaaagttattccgtacccaggtaggtgccgaagaaatcgccgaagtcgtttcgcgtgcaaccggcattccggtttccaagatgatgcagggtgagcgtgagaaattgctgttcatggaagacaagttgcatgaacgtgtcatcggccaggatgaagccgtccgcctggtttccgatgcaatccgccgctcacgctccgggcttgctgatcccaatcgcccgtatgggtctttcctgtttctggggccgaccggggtgggcaagaccgagctgtgcaaagcactggcaggatttctgttcgattccgaggaacacctgatccgggtagatatgtccgaattcatggagaaacattcggtcgcacgcctgatcggtgcgccaccgggatatgtcggctatgaggagggcggttatctgactgaacaggtgcggcgcaaaccctattccgtcattttgctcgatgaagtggaaaaagcgcatccggatgtattcaatgtcctgctgcaggtgctggatgacggacggatgacggatggtcagggccgtaccgtggatttcaagaatacggttatcgtcatgacttccaacctgggttcacaaatgatccagcaaatgagcggagacgattaccaggtcatcaaactggcagtgatgggagaggttaaaacctatttccggcctgaattcatcaatcgtatcgacgaagtagtcgttttccatgcactgggtgaagcgcatatcaaatcgattgcccggattcagctgagcaacctgggcaaaagactggcacaaatggaaatgaaactggtagtttcagaaccggcactgaccaaactggccgaagtcgggttcgatccggtattcggtgcacggccgctgaaacgagccattcaggctcagatcgaaaatccgttggcgaaagagctgctggaaggccatttttctgccggagatactattctggtggaatacagtaacggccacatg

SEQ ID NO: 43313 - DNA, 870 bp, Nitrosomonas europaea
atgttcacaggtagcctggtagctatcgttacacccatgctcgaagacggggcgctggatctcgacagattctgcgccctgatcgactttcatatcgaacagaaaacggatggtatcgtcgtggttggtaccacaggcgaatctcctaccgtggatttcgatgaacaccatctgctgatccgcacggctgtcacccacgcagccggacgcattccggtcattgccggcacaggcgccaattcgacgcgcgaagcaatcgagctgacggtattttcgaagaatgccggcgcagacgcctgcttatccgtagccccctattacaacaaacccacccaggaagggttgtaccaacacttcaaagcaattgccgaagcagtcgatatcccgatgattctgtacaacgtaccgggacgaaccgtagtagatatcagcaacgacactgcgttgcggctggcgcagattcccggtatcgtcggtatcaaagatgccactggcaacattgcgcggggatgtgatttattgcagcgtgtgcccgataatttcgcggtctacagcggagatgatgctactgcactggcactgctgctactcggcggtcatggcactatctcggtaacagccaatgtcgcaccccggctgatgcacgagatgtgcaccgctgcctttgccggtgacttggcccgggcacgggaaatcaatacccggctgttcaggctgcatattgatctgttcgtcgaagccaatccgattccggtcaaatgggccgtcgcaaggatgggattgatcaacgatagtctgcgcctgccattgacagctttatccagtcaatatcacgaactaatcagaaaagccatgctccaggctggcatc

SEQ ID NO: 43314 - DNA, 2049 bp, Nitrosomonas europaea
gccgaatcgctgctactagctgcacgtcagctgggattgcagacgtcgcccgaatgcgtgcgtggcgcggcttcctgggtcggctgcgatgatccgaatgccgccgtgcttgacattgcagcccaggctggcttatcggcaaaattcgtagagatatctctgactaggctttcgcccatcatgctaccagccttgctcgaactggatgacggccaaataggcctgctcatcgatatagatgccggccgcgcgaccattttgttgacgttggaaggcaaagtactggagcgactgctgccgatcgacaaccaccctcgtctgctattgctggtacacgaacgcacagccccgcgcaaggatcgagtgaatgattatttagtcaccacaaccgaccactggctgcgtgatatctttatttcgcactggaaaacgttatttgaactgtgtgccggttcgctgttcagcaacctgctggcgatctgcacggcgctgttcgcaatgcaagtttgggatcgcgtaatccccgcacgctcaatcaatacattatgggtactggcctccggcgtggccatggccttgctgctggaactgatgctccgcatgatgcgcgtaacgattgccgaccatttcggcaagaatgcggatatcaagctatcttctatgtttttcgcacgcgtgttggatattcgcaacgatgctcggcctcgttctccgggcagcttgatcgcccaactgcgcgatctggagcaattacgggaactactgacttccagtgcattgggtgtgctgatcgatctgccttttgtgttcgcctttcttttgatcatctgggtgctcggcggctggttggtccttgtgccactagccgccattccactgctggtactgccgggtgtgttagcgcaatatccacttgccaaactgtcgaaagagggtatggccgaagccgccctgcgcaatgccatcctgatggaatccatctaccgcattgaagacatcaaaaccctgcaagctgaaccgcgcttccggcaactgtgggatcaaaccaatttcattaatgccgatatcagcctcaaacagcgttatctgtccggtctgctgatgaatttatctcaaaccgtgcagcaactggcctatgcaggtgtcctcattgagggagtttatgccatcctagataccgatctttctttcggtgccgtaatggcctgctccatactcaccagtcgcaccatcgcccccctgtcccagattcctgctgtgctgtcgcgcctgcagaacgcccgtgtcggcaaagatggattggataaattgctggaattgccgatcgatcatcccgtcgacaaaaatacttatcacaaaccagtactgctgggtcgctacgaatttgagaacgtcagctacagtttcgatcctcaagaaaaaccggtactcacgataccgtgtctctctatccggcctggagagcgcattgccatcctgggccgtgtgggtgcaggcaaatccaccttgttgcgcgtgttggccggcctggcaatacctcagcaaggccgcgtgcttttcaacgacacacccattagcatgatcgacgtagccgatgtacggcgtgatataggcactgtcctgcaggaggccagtctgttctacggtagcctgcgcgaaaacttattgctggctaatccgctagcaactgatgaagaattgctagcggcgatgcgcctgtcatgtgccgatcaacttctgctcaaacaaccgcacggtctcgatcttttgttacgcgagaatggctttggactttcgggaggccagaagcagtcactgatactggctcgcacctttctgcgcacccccaatgtgctgctgctggatgaaccaacggcttcgctggatgaaaacactgaacggaacatcatcgagaacatgcgtcaatggctgggtggacgcacactgatcgtggctacccaccgctacccactgttgtccctggtagatcgcatcatcgtcatcgacagcggccgtatcgtgcgagacggcccgagagaggaaatactt

SEQ ID NO: 43315 - DNA, 414 bp, Nitrosomonas europaea
atggcagttgaaaggactttgtccattatcaagcccgatgcggtagcaaagaacgtcatcggacaaatctatgcacgatttgaagcggctggcctgaaagtcgttgctgcccgcatggcgcacttgtcgagagtcgaggcagagaatttttatgcgattcacagggaaagacctttcttcaaggatctggtcgaattcatgatttccgggccagtgatgatccaagtgctggaaggtgaaaacgcaattgccagaaatcgtgaactgatgggtgccacagatcccaggaaagcagaaaaaggtacgattcgcgcagattttgcagaaagtatcgatgccaatgcagtacatggctcggatgcacctgaaacggctgtcgttgaaatcgcctgtttcttcccgtctctggaaata

SEQ ID NO: 43316 - DNA, 1242 bp, Nitrosomonas europaea
gtggggttgtatgcgcagtgggcgctggcgttcttgccgattcagcactggcagacagccaacggggcgcaggtctatttcgtcgagaatcatgatttgccaatactcgatctcagtattgaatttccggcaggcagcagtaccgatacggcagaaacttccggccgcgccggactggtgcaacggctgatgagtatgggggcaggtgatctgtcagaagatcggattgccgagacactggcggatgtcggagcgaggctgggtggaacatttgatctggatcgggcaggactgtcactgcggacgttgagccatcagcaggagcgcgtgcgtgcgctggatgttttggcacagatcgttcaacgccctgaatttcttgaaaagattctggaacgggaacgtgctcgtattatcgcagccctcaaggaagcggataccaaaccagaggtcattgctgaccggacactgatgaaattgctgtatggcaagcatccttatggtttgcgtgagtcgggagaaccggatgcgcttgcagcgttgcggcggcaggatctggttgatttttaccgtgcgcattacacagctggcaatgcaatcattgcaatgataggggatatcaaacgggatgaagctgcccgtatcgcagagatgctgaccagaaatctgccgactgggaaaacgtataaaactttgccacctgtagaaaagcctgttccgatcatccagaagattgctcatccggccacgcaaagtcatatccagattgcctaccccgggttgagtcgtaaggatcctgattattttcctctactggtgggtaattacattctgggagggggtgggttcgtttcccgattgatgaatgaaattcgtgaaacgcgcgggctggcatatagtgtttacagtacgtttgcgccatatcaggaaaaagggccatttgaaatcggtttgcagacaaaaaaggaacaggcggaacaggccttgcagttgacacagaaaacgctcagggatttcgttgaacagggaccgaccgaagaagagttgcaagctgccaggcagaatatcgtgggagggtttcctttgcgtatcgacagtaatcagaaaattctcggatatcttggggttatcggtttttatgatttgccgctgacttatctggaagattatgtcaaggcggtggaaaaggtgactgtcgcgcagatcagggatgcatttaaacgccggattgatccggccggtatg

SEQ ID NO: 43317 - DNA, 2823 bp, Nitrosomonas europaea
aatttattcaacagtttaagcacgttatcacttgccagcggtaaaaccgttcagttttattcactgcctgcgctgggtgcggctggtttgggagcaatttcgcgcctgccggtttcaatccgcattgtgctggaatcgatattgcgaaattatgatgaaaaaaagatcaccgaaactcatgtcaggcagcttgccggttggcagccgagagcagaacgtacccaggagattccgtttgtggtggcgcgcatcgtactgcaggattttaccggcgtgccgctgctggttgatctggctgcaatgcgcagtgcagccaggaggttgggaaaaaatcctgaattgatcgaaccactggtgccggttgacctggtagtcgaccattcgattcaggtggattactacggtgacagccaggcactggcacgcaatatggaagtggaattccagcgcaatcaggaacgctaccagttcatcaaatgggggatgcaggcattcgatacatttggcgtggtgccaccgggaatcggtatcgtgcatcaggtcaatctggaatatctcgcgcgcggcgtgcatcagaaggatggactgatgtacccggatacactggtaggaaccgactcgcataccacgatgatcaacagtatcggtgtggtgggctggggagtgggagggatcgaggccgaagccggtatgctgggacaaccggtctattttctgacaccggatgtggtgggtgtcaatctgaccgggcggctgcgggaaggagtcactgcaaccgatctggtgttgacggtaacagaaatgctgcgtcgggccaatgtcgtgggcaaatttgtcgagtttttcggtgaaggtgcagcttcgctcagtctgccggatcgtgccacgattgccaacatggcacccgagtacggcgccactatgggtttcttcccggtggatgacgtaacactgacctacttccgtcataccggccgtaccgatgaagaaatcgacgcgtttgagcgctatttcaaggcacaggaattattcggcatgccgcatccgggagagatcgactacagccaggagttgacgctcgatctgaatacgatcgtgccttctctggccgggccgaagcgcccgcaggatcggatagcactcaaagatctgaaatacagctttactgaacttttcagcaaatctgtcaaggaaaatggttatggcaaaccggcagaagtgttggatgatacttattccacccgcgacagccgtcacgtggaatccaagctttgcatcgcccctgacaccagtcagagcgagttgacgttaccaccgggcagtgcgcgcaatgcggttgaaatggtcaataatcatcccacgcagcagactgctgtccctgtatcgctagcacgaccgattaagttgcatcatggcgatatattgattgccgcgatcacttcctgtaccaacacgtccaatccgagtgtactgattgcggcaggtttactggctaagaaggcggtggagaaaggtttgtcagtcaggaaacatatcaagacttcactggcacctggctcccgtgtcgttacggaatatctcggtgctgccggtttgctgccctatctggagcagcttggtttcagtctggccggttacggctgcaccacctgtatcggaaattccgggcctctgctggaagtcattgaagaaaccattgtaaaggatgatctggtatgtgcggctgtgctgtcaggaaaccgtaattttgaggcacgcgttcatcccagcattcgtgccaattttctggcttctccgccgcttgtggtggcctatgcaattgctggaacggtgctgaaagatcttacccgtgagccgctgggagagggtaaggatggcaagcccgtgtggttgcaggatatctggccggacagtgccgaaatcgaatcgatgatgaaatttgcgacccaggcagaaactttccgccgcttgtacagtgatttcacccgggaccacccgctctggaatggcattactgcggtgacaggcaggctgtatgactggccggattccacctatattgccgagccaccgtttttcgaggatttttctctggagatcgaccgaaccagaacaccggatgccattcatggtgcgcgtgcgctggcgatttttggtgactcggtgactactgaccatatcagcccggcgggagccatcaaggaatcttcaccggcaggacaatatctgctggcacatggcgttacccggatggatttcaacagttacggctcacgccggggcaatcaccatgtcatgatgcgtggtacttttgccaatgtgcgtatcagaaatctgatgatacccggcagcgagggaggcgttacgctgtatcgcggcaaggacgatcctgacggtaagcaaatgagtatcttcgacgcggccatgcggtatatcgaagatggaacacctgtgattgtattcgccggcaaggaatacggtaccggatcaagtcgtgactgggctgctaaaggcacgcaactgctgggcgtcaaagcagttgtcgcagagagttacgaacgtatccatcgcagcaatctggtcggcatgggtgtgctgcctctgcagttcaaggaaggcgatagcgtcagttcgcttggtattcagggcaatgagaaattcgagcttcctgatctgggcaatattcagccacagcaggaagtgacactggtcattcacgggcaagatggctcccggcgggaaatcagactacgttgccgtatcgatactgctatcgaggtcgactattattaccatggcggtattctgccttatgtcctgaga

SEQ ID NO: 43318 - DNA, 849 bp, Nitrosomonas europaea
gaaaaagtcaacatcctggctgaagcattaccctatatccggcgttttcacgataaaaccatcgtcatcaaatatggcggcaacgccatgattgaggaagcgctcaagcagggctttgccagagatgtggtattgctgaaactggttggaatgaacccggtcatcatccacggcggcggtccgcaaattgaccacatgctgaaacgggtcggtaaggaaggcgtattcatacaaggtatgagggttacagatgccgaaactatggacatcgtcgaaatggtacttggcggcctcattaacaaggagatcgtcaatcttatcaaccgccacggtggacaggcagtagggttgaccggaaaagacggaatgttcattcgcgccaaaagaatgctgatccaggataaggaaaaagccggggaatggatcaacattggccaggtcggtgaaatcgagtatatcgacccttcactaatcgcattgctcgatacccgcgatttcattcccgtgatcgcacccatcggtgttggcgaagatggagaatcctacaatatcaatgctgatcttgtagcaggccgtctggcagaaacgctcaaagccgaaaaattgattctgatgaccaacacacctggtgtgctggataagaatggtaacctgctcaccggtttgactgccggtcgggtggatgaactatttgcagatggcacgatttccggtggaatgttacctaaaatcaaatctgcgctggatgcagtcaagaatggtgtcaaatcctgccatatcatcgacggacgagtgcaacatgctctcctgctcgaaatactgactgacgaaggagtggggaccctgatc

SEQ ID NO: 43319 - DNA, 1359 bp, Nitrosomonas europaea
atgctgcctgcggagtttatcaaatcactacagaatctgattccttccgatcgactctatttcgatccggtggattgttacgcttacgcctacgataacagcaggaagttttttcctcccgagtgtgtcatattccctctgacgactgatgaaaccgcaaaaactgtccggttatgtaaccagttcaaaatacctctgacaccacgcggacgaggcaccggtacggctggcggcagcttggccgaacagggcggagctacgctctcactggagcagatgacacaaatcatctcgatcgacccccccaaccgggcactcgtcaccgagcccggtgttttaaacgaaaccattcaagctgctgccaaacctcatggctttttttggccacccgacccttccagtgcggcattctcaactattggcgggaatcttgccaccagcgcaggaggaccacatgcggtcaaatatggaacaacccgcgatcatgtgcttggattgaccgcagtaacagggaaaggggacattattaaaaccgggtgctataccaccaaaggtgtcgttggctatgatctgacccgtttgctgattggttcagaaggtacgcttgctgtcataacggaaatgacacttaagctgactccgctacctgctgccaaaagtggacttgttgcgcattatcaggatgctgacagttgtgcgtcagcaatcgtatctatcatgaaagagccacaaggaccgagtgctcttgagttcttggattcgggctcacttaatctcattcgtgccagaaatcctgagttattaccaagcgactctcaggccatgctgatgatcgaggtcgatggtacagaacatgaaatcccggaaacaacagcaaaacttttagctgcttgccagaactccgggttattgaaagcagtatccgttcagaatacggcagatttatggaaggtcaggaaaacattatcgcccttgctgcgggatattgcacccaagaaaatcaacgaggatatcgtagttccagtcgataaaattccccggttattggccggattatccgcactatgcaagcaatatcagattgccaacgtaaatttcggacatgctggaaatgggaatattcacgttaacctgctcatcgacccggacaaccccagcgaaagtgaacgtgcatataaatgcctggatcagatatttgatctggtcatcagcctcaatggcacactctcgggtgagcacggtataggctccgaaaagcgcccctatattggcaaggaactcaatgacgctactctgactttgatgaagcagatcaaactgacttttgatcctaataatattctgaatcctggaaagctg

SEQ ID NO: 43320 - DNA, 2802 bp, Nitrosomonas europaea
attattcccgagcccgtcactgcctcgtggttactggtagcagacgaatcttccgcaaccctggccaggcacctgagtaaccggctgcaatcatcgggacagcaggtaaccatcaccagccggatagatgatgatcttttgcagaatactgaccacatcgttcatctgccgggctggaacgatactcctgaccaggctgcggatacggtaacccggttgatggaggatgtgaagctgctggctgcccggatcgggaaaacacctcaattctggctcgtgacccgtggcggtacgctcattagcggatgcccggccgagtcggaatccagtccggcacagtctgcgctctggggattcggccgtgtcgtcatgaacgaatatcctcagctcgcctgcacactcatcgatctggtttgtaacccggcaaccgtcaatctggcagaccggctggtgaatgaactgcttgtcccggatggcagcaatgaaattgtgctttccgcagcagcgcgctactgcctggtcatgcaggaagcaacgaaccagcagatcaggacgacagagcagtcagagaaaaaggatgagcgatttcatcttgattttcacgtccccggacaattgcgcaacctcgtctggttgcctgatgttaagcgtcaactgggtgatgacgaggttgaagtatgtacccgggccaccggcctcaatttccgtgatgtcatgtacctcatgggcctgcttccggatgaggccgtcgaaaatggttttgcaggcgccagcctcgggctggaattttcagggatcatcagccgggttggggcacgtgtaaaaggcctgttacccggtgatgcggtcatgggattcggttcttcctgctttgccagccatgtcatcacgcgagcagatgccgtagcacctatgcccgagaactggtcgttcgaggccgcagcgactgtacccaccgtttttctgaccgtctattacgcgctcaagcagctggcagctctgcagccgggagagagggtactgattcacggtgcagcagggggagtcggtatcgctgccatccagcttgcacgttatcttggcgcggaaatttatgccactgcaggcagtgatgagaaacgggatttcgtcaaattgctgggagcggatcatgtgttcgattcacgcagcctggcatttgctgacgatattcttgatgccactgcaggtgaaggagtggatgtggttctcaattcacttgcgggtgaagccatgcgtcgcagtatcgatgtgttgaaaccctttggccgttttcttgaactgggcaaacgcgatttttttgaaaataccccggttggcttgcgtcccttcaagaacaatatcagctatttcggcatcgatgcggatcagttactgactgcgcgtcccaggcttgccgtacaactctttcatgaggtcatggcactgtttcgtgaacaggcactggcaccactgccttatcgggtattttcagccaatcgcattacggatgctttccgtgtgatgcagcaagcacgccatatcggcaaaattgtcgtgtctctggcagatgcacggccagatatcgaacagcctttacaacctgttccggcaatacgatttgaaagaaacagtacatggctggtcaccggcgggctttccggttttggcctggaatctgcccgctggctggcagaacggggtgtcgatcacttagtgctggcagggcgccgtggtatggatacgccaggagcaaaggaaatcatcgaaactttcgcggttcaaggggtaaaagtgatcgcacaggcgtgcgacatcactcacgctgcagcggttgatacgctgatcgaacgtatcggtaaaacactgcctcctctcaaaggtgtgctgcatgcagcagcggttttcgacgatcagctgatttccagtctcgatcagaagcgcatcagcaatgtcatggatgccaaactgctgggcgcctggcatttgcaccaggccacgctcggcacgccgctggattatttcattctgtactcctcggttactaccgcaatcggaaatccggggcaggccaattatgtggctgccaatgcagggctcgaagggctggcggctatgcgtcggcacatgggtttgccagccacctgcattgcctggggacctgtcagcgacacgggatacctcgcgcgtaatcaagccgtcagagacagtctcgaacagcgcctcggtaaaccgcctcttccggctgcagaagcgctcactcaactggatgttgcactcaatgacgaaaccggatttgttattcctgctgacttcgactggaatacgctgagccatctgctgccttcagcgagcggtaatcgttttgctattctcaaccggaacagacgcagcacctctcaaactaccgaatcgattgatattcggacgttcattattggaaaaacccgggctgaggtaacagaaatcgtacgtggctttgtagtggaggaggttgcgcagatcctgagcatcagcccggatcgtatcgagtcagggcgctccctgcatgatcatggtatggattcgctgatggcggtcgagcttgctctggggctggagcggcgctttggtatccagttaccggtcatgatgctcaacgatgcgcccacgattcatacagtcacggcacgtatcgtcgagaaactgacaaataaaggggatatgccggagggagaacaatcagtcagccaggtcaccgagtttatccgtcagcacggagaggaattgatgccggaagaaatcgacatcctgagtgaggatgta

SEQ ID NO: 43321 - DNA, 1227 bp, Nitrosomonas europaea
gctgctcctgcgtcggcggagtgtccaacccgttactcgtcgattcctgatgcctttacccgttttgaccgtttccccggctatgaaaaaatgctggttcccaaggcagcatccgagcgattgggtctggtaaatccgtttttccggtcacacgatggcgtggcgggagcaactacgctcatcggtggacgtgaattcatcaatttttccaattacagctaccttggactggccggccaccctgccgtgagccgagcggcaaaagaagctatcgatcgctatggtacatcggcatctgcaagcagactcgtggcaggtgagcgaccggctcagcgcaaactggaagaagcgctggctaatttatatgaggtggatgactgcatcgtatttgtcagcggacatgcgaccaacgtcagcacgatcggctgtctcttcggcccgaaagatctggtgattcacgacagtctcatccataacagtgtattgcaggggattcagctttcaggcgcagcccgtcgttcatttccacataatgacatggcggcacttgaacaaatcctggctgagatccgcgcgcagttcgaacgtgtgctgatcgttaccgaagggctttacagcatggatggtgatattccggatctgccggaactcatccgcatcaaacagcaccataaagcctttctgatggtggatgaagcgcattccctgggagtactgggagagacaggaaaaggagtacgggaacacttcggtatccaaggcaaagcagtggatatctggatgggcacgctcagcaagacattggctggatgtggcggttacattgccggagaacgggcgcttgtcgagcacctgaaatatgcagcaccaggttttgtctacagtgtcggtatggcgccctccctggcggctgcttctctggaagcgttgcgtatcatgcagcgagaaccggagcgggtagcacggttacgtgaacgagggcagcaatttctggagctgatgcaatctctgggcgtcaataccggccttgctcagggctatgccgtcattcccgccatcattggcagctcgctcaaagcggcccggctgtcaaaccagtttttcgatgccggtatcaatgtccagccgatcatccatcccgcggttgaagagaaagccgcaagactcagatttttcctgtcagccatgcataccgatcagcacgtacggtatacctgtgaagtcatg

SEQ ID NO: 43322 - DNA, 856 bp, Nitrosomonas europaea
aaaattcgtaaagcggtttttccggtggcggggctgggtactcgttttttaccagccaccaaggccagccccaaggagatgctgccggtggtggataagccactcatacaatatgctgtggaagaagcctgggctgctggtattaccgaaatgatattcgtcacgggtcgcagcaagcgcagcattgaagatcattttgataaaggcgtatgagctggaatccgagctggagcgccggggaaaaaccgagatgctgcagtacgtgcgcaatctgttgcccgacgatatgaagtgtgtgtatatccgccagtctgaagcactgggtctgggccacgcggtgctatgcgcccagccggcggtgggtgatgaaccttttgctgtgttactggctgacgatttacttgaaggtgaccctgtcgtgatacgccagatggtggatgtgtacgagtactacaagtgctcggtgctgggtgtgcagcaggtgccgcgtgaagatacgcgcagctatggcatagtggccagccagccgattcgtgatgatctggaagcagtacagttcattgtggaaaaacctgatccggaagaggctccttccaccatggcagtggttggacgttatgtactcaccccgcgcattttccatcacctgatacggttgggcaaaggcaccgggagcgagatacagttgaccgacggtattgctgcgttgatgcaggaagagcaggtgctggcctatcgttacaaaggccagcgttacgactgtggcagcaagataggctatttggaagccaccttggctatggcgcgtaagcaccctgaagtgggggcgcagtttgaacagctgttacagtcgttt

SEQ ID NO: 43323 - DNA, 1209 bp, Nitrosomonas europaea
catgtgcaaatcacctacatcaggagctgtatcgtgaaactctcgcaacgcgtccaggctatcaaaccttctcccactctggcagttactgccaaagctgccagactcaaggcagaaggaaaaaatatcatcggtctgggcgcaggtgaaccggatttcgacacaccgctgcatattaaggacgcagcgattacggcgatccgtaatggttttacgaaatatacggcggtgggtggaactgcatctttgaaacaggcgatcatctcgaaattcaaacgggaaaattcactggaatttatgccgggagagattctggtttccagcggagggaaacaaagcttcttcaacctggtactggcgacgatcgatccgggtgatgaagtcattattcctgcaccttactgggtttcctatcctgatatcgtattgattgccgaggggaagcctgtttttatcgataccggcatcgaagagaaattcaaaatctcaccggatcagctggaaaaagcgatcactcccagaacccgcatgttcgtcgtcaacagcccgagcaacccttccggcagtgtgtacagtttagaagaactgcaggccctgggtgcagtgttgcgtaaatacccggatattctgattgctaccgatgatatgtatgaacatattcttctgtccggggatgggttcgtcaatattctgaacgcctgtcctgatctgaaagcgcgtaccgtcgtgctcaacggggtatccaaggcttatgccatgaccggctggcggattggctactgtggtgggccggcagcaatcattaccgcgatggaaaatattcaatcacaaagcacatccaacccgaattctattgctcaggtggcggcagaagccgcattaaatggggatcagtcctgcatggttccaatgatcgaggctttccgggaacgtaaccagtttttgacaaatgcgttaaattccatcgcaggtattcactgtttgttatccgaaggcgctttttatgcctttgtagatgtaaggcaggctatcagccggttgaatactcaacagattttgcagaacagcagtgatattgctttttgtaactatgtactggagaaagctgaagtggctgctgttccaggttcggcgttcggttgcgagggctatatgcgactgtcgtttgcaacttccatggataacctgcaggaagctgtcaaacgtatc

SEQ ID NO: 43324 - DNA, 1311 bp, Nitrosomonas europaea
accgaatttgtcacctggtttcgttccgtcaccccccatatccatgccagccatggaaaagtcttcgtcatcgctttcgggggtgaagtcgttgagaacggaaaatttgttgagctggtgcaggatttcaatctgcttgccagcctcggcatccaactggtgctggtacatggtgcacgcccgcaaattgaatcccggcttcgggcaaatcagcaggaaatgagctatgtgcagggcatgcgtgttactgatgctgcaaccctgcaatgtgtgaaagaagccgtcggcaaagtacgggtcgagatcgaagccctgctgtcgatgggcttacccaacacacccatggccaatgccgccatacgggtagccagcggtaacttcgtaaccgcccggccggtcggtgtgttggaaggcgtggatctgcaatacacgggagaagtacgtcgtatcaatatcacggcaattctcgatcagctcgaacaagggacggtagtactgctctcccctctgggttattcgccgacaggggaaattttcaacctgacgctggaaaatattgccgctgaagtagctgccgctctccaggccgataaattaatttttctggtggatacaccaggaatccggcagcaaactgaatcaggcgccgtattactgccggaactcactgtcaggcagggtaaaacactacttgcaacaatggaaacagcaacagatcagccggatgaggatacccggctctacctgccatgggcgttacatgcatgtgaaaagggagtgaagcgcgttcatctcgtcagccgccatatcgatggcgcactgctgctcgaactgttcactcatagcggtattggcagcatgatcacacgtgacccgttgcaaatcatccgccaagctgaaatcgaagacatcggtgctattctccaattgatcgaaccattagagaatgcaggtatcctggtacggcgcaaccgggaattgctggaaatggaaattgagcgcttcacagtgatcgaacacgacaacatgatcatcgcttgtgcggcactctaccctttcccggatgacaaagcatgcgaactggcctgcctcgcagtacaccccgaatatcgcaaggcaggtatcggccggatactgatcgatcatcttgaagatcaggccagggaacaaggttaccgccgcctgttcgcacttaccacccgtaccactcactggttcgtagaacgcggcttttcggaaaccacccctgaccagcttcctcgactgaaacagaatttttacaactaccagcggcgttccaaggtattcgtc

SEQ ID NO: 43325 - DNA, 1326 bp, Nitrosomonas europaea
aaatttgatgtggtaatcattggtgcaggcagcgctggtttatctgctctgcgtgaggtaaaaaaacacactgacaacttcatattgatcaatgaaggtccatggggaactacttgtgcccgggtggggtgcatgccctccaaattattgattgaggctgccaatgctttttaccggcgagtcagttttaatgaattcggcattacgggtgcagatcagttgggagtggatcataaacgggttctgcagcgtgtgcgcagactacgggatgattttgtcaccagtacacttggggcaaccagggaattgggtgaacgggccatatcaggccgtgctcatattctttctccacatcaggtgatggtcaatggtgaaaaatttcatactcgtaaaatcatcattgcaactggttcccggcctgtcgtaccggagccctggcaaagtcttggcaaacgtttgtttacgacagatacgctgtttgaacaggaagctttgccagaacgcatcgctgttatcggtatggggccggtaggtctggaaatggcgcaggcactatccaggctgggtgtgcgtgttaccggctttggttccggcaggatgatcggcggtattactgatcctctcatcaatcaggcagcagtgacactgttatccaaagaattttctttgcatcttggaaccagagcggatattacggtaaatgtcgatagtgacgtgattacggtcaattcgggtgacattagaatcgaggtcgacagtgtactggctgctttggggaggcggccaaacatcgatgatatcaatctggaagcattgggtgtgccgcttgatgaaagaggtttgccacccgtaaatcctgatactttacagattgctgatctgccggtattcctggcgggtgatgtcaatcaacgttctcctgtattgcatgaagctgcggatgacggacatattgccggcttgaatgcaaccagagaaaaattggtttgtttcaaacggcgcgtgccactgactattgtattttctgatcctaatatcgccgtggttggaaaatcctttcgatcgctcgaacatgaagatatccgggcgggtgaggtagatttcagccgtcaggggcgggcacgttcggcccagtctaatcgtggtgtgctgcgtgtgtatgctgctgcaaacagtggccggctgctgggtgcagaaatgtgtgcaccggctggagaacattttgcgcatttgctggcactggcaatcgatcagtccttgagtgtatgggatttattgcgattgccgttttatcatccggtgctggaagaaggattgcgtactgcg

SEQ ID NO: 43326 - DNA, 981 bp, Nitrosomonas europaea
gtgtcttcacccattcgtattgccgtcaccggcgcagcaggacaaatcagctacagcctgttattcagaattgccgccggagatatgctgggcagtagccaacccgtaattcttcagctcctcgatattccggaatccggaaaggtactggatggtgttctcatggagcttcaggattgtgcttttccgttgttgacggacattatcgtaacgcatgatccgatgatagcatttgatcaggccgatattgcaatactggttggagcacgcccacgcggtaaaggtatggaacgcaaggatttactgcagaccaacggcgaaattttcagggaacaaggcagagccttgaaccaggtggtaaaacgagatgcgaaaattctggtagtaggaaatcctgctaataccaataccctcattaccatgaagaatgcaccagacttgtcgccagagaatttttcaggaatgctcaggcttgatcataaccgggcgctatcacaagttgccatgaagctgaaccagccggtcagccatatcagaaaaatgatcgtatggggcaaccattcatctacccaatttcctgatttatctcatgcagaaatcgatcatcaaaaagtgatcgatctcatcaaagatcagacctgggttgaaaacagtttcattcctactgtccaaaaccgaggtgctgtggtgatcgaggctcgcggcctatccagcgcagccagcgcagcaaacgccattattgatcatatgcgtgactggatttttggaaccagagacgatgactggatcacaatgggaattttgtctgatggcagctataaaataccgaaaggtgtaatttacggattcccggtagtttgtaaaaatggcggaaggaagattgtgcaagggcttgaaatcagcccattctctcgtaccagactggatatcgcttatgatgagctgacccaggaactggattcaatcaagcatttgttactc

SEQ ID NO: 43327 - DNA, 2661 bp, Nitrosomonas europaea
atgactcaaatgactgtagagcaatttgcgcatgatctgggtatgttacccggcttgttgctggaacagcttcaggctgccggggtagataaacgttctgcagcagattttgtcacggagcaggataagacccggcttctcgattatctgcgtaaatcgcatggaagtagcggaccaagaaccaggatcactctggcgcgtaaacaaacgacagagataaaacagtcagacagcacaggcaggccgaggaccattgaggtcaaagtcaagaaaacgcgggtgctgaccagacagaatgaacctgaggtgattgaaaaaagtgtgagtgaagaacccgcacctttgaaaatggtcgaaacgccggaaccgacgattgtaaagtcggttgtcgatgctgagcagatggccttgcgtgctgaagaagccaggaaaagatcagagttgattgcccgtcaggctgctgagctgaaagaaaagcaggaaaaaaggagacaacaggcagctgctcaggcgaacgtgaaaaaagaaccggccccggctgagcaggaatctgggccggcgacagctgtcacgccgggatcagtgactgaaatttcatccaaattgccggaaacaggtgctgcagccacgcctgctacttcaactgctccagcgacaacctcgacgactgcagcgaccaagggacatgctcctcagaaaccggttgtcaaaccggaagagaagggtgaaaagaaaaagaagccaaccaagcaggatgcctggaaggatgagccggtcaaacgtcgtgaaccgaaagcacgtggtgatctgtctggcgggcaggaatggcgcatgcgtaaggataagcacggcaaatataagtcagatgaattgcaatcccagcatgctttttcggtacctactgaaccggtcattcatgaagtcttgattcctgaaactatttcagtgggagctttggcgcagaaaatggcagtcaaagcagcagaggtcatcaaggtactgatgaaaatgggtagtatggtgacgatcaatcagatgctcgatcaggaaactgccatggtcgtcgtcgaggagatggggcatatcgccaagattgctgcgtcggataatcccgagtctttcctggaggaggttgatgtatcttccgatgaagccaggatggaaccacgcgcccctgtagtcacggtgatgggacacgtcgatcatggtaagacctcgctgctcgactatattcgcagaacccgtgttgcaggaggggaggccggtggaattacccagcatattggtgcctaccatgtcgaaacttcacgcggggtgattacatttctcgatacgccaggacatgaagcgtttactgcgatgcgggctcgcggtgccaagattaccgatatcgtcatactggttgtggctgcggatgatggtgtgatgccccagacgattgaagccattcaccatgcgaaggcggcgaatatccctattgtcgtggcggtcaacaaaatggataagccggaagccaattttgatcgtatcaaacaggaactggtcaatcatggtgtcgtccccgaggactggggaggtgatgccatgttcattggtgtttcagcaaaaaccggtctgggaatcgacgaattgctggaagcagttttattgcaggcagaagtgctggaactcaaggctgtccgggaggcgccagccaaaggcgtggtgatcgaatcccgtctggacaaggggcgtggtccggttgcgacggttctagttcaatctggcactttgagacggggtgatgcggttctgactggagccgtgtttggaaaaatcagggccatgctgaatgagcggggtaaatccatcagtgaagcgagtacctcgattcccgttgagattcaggggttgtcagaagtcgcagttgccggagaggtatttattgcgttggatgatgagcgcaaggctcgcgagattgctctttttcgccagggtaaattccgtgatgtgcgactggataagcttcaggtggcaaaaatggaggatgtattcggtcagcatgaggacgtcagtacacttaatctgatcatcaaagcagatgtgcagggatcttgcgaagcactggtctatgcgttgaagaagctggaaaccgatgaagtgaaaatcaatgtcgtgcacagtggagtgggagcgatcatcgaatctgatatcaatctggctctggcatccaaggctgtcgtcatcgggttcaactgtcgtgccgatctgggcgcgcgcaagctgatcacttcaaccggggtggatgtgcgctactacaacatcatttacgaagcggtcgatgaagtcaaaaaagcattgtcaggaatgatgatgccggatcgcaaggaaaaaatcctgggtatggtcgatattcgtgaaatttaccggatatccaaggtcggagtcgtggccggttgttatgtgctcgaaggattgatcaaacgtgatgcgctggtaaggttattgcgcgatggtctggtcatccatagtggtagtctggattctctgaaaagattcaaggaggatgttcgggaggtgaaatccggtttcgaatgcgggctttcattgaagaatttcaatgatattcagcagggtgatcagatcgaggtgtatgagattgttgaaactgctcgtgtgctg

SEQ ID NO: 43328 - DNA, 2145 bp, Nitrosomonas europaea
atggaagaagaaaagaaactgttccacgatacccggcaacctcccgggcacgcctatctcgccagctatttatggatacgcgaacaattcagcgccgatgccatcgtacattttggcacacacggtacccaggaatggacaccggggaaagagcgcggtctgtgggcgtatgactatcccaacattctggttggcaacctgccggtgatctatccctatatcgtggataacatcggcgaggccattcacgtcaaacgccggggacgcggggtcatcatcagccatcagacgcctgccttttctccggctggtctctccgatgatttcgtccggctcaatgacctgatccgggaataccagtcactggatcaaggcctggtgcgcgacaataaccgcaagctgatcatcgagcaggcagtcagaatgaatatccatcaggatatgcaatggaaagtcgctgatctggaacgaaatttcgacaattttttgcgggacatcgaagattatctcgaagatctcgggacagcccagcagccactgggtttgcatactctcggacgcgatgcggaacaggctcatcagatcagcaacgtcatgcagatgctcgggcaacccctctacgatctgctgggtatcgaagatgcccgcactctgctgcgcgaagattaccgcaaaattcagcaatccgaaccctatcgtttcgttgagacgtatgtcttctccgatcagccactgaacgatatcaacgatcccggattgcgagcgatggctgaacgcggccgcacatttcgcatgaatctgcacgcagccccggaaatcgattcaatcgtaaaaggattatcatcgcgctggatcgatccttcgtatggtggagacccgatccgcaacccggatgcactgccgaccggccgcaacatgtacggattcgaccctggaagagtccccactcgtgcggcttatgaagcgggcgggcaggcagtcgaacaattgattgccagctacaaactcacgcacgacaaatttccggaaaaactcgccttctcgatgtggagcactgaaaccatgcgccatctcggcatgctcgaggcacagatattctatgccatgggtgtgcgacctgtatgggatgagggcgggcgggtaaccggtatggaagtcattcccctgagcgagctggggcgtccccgtatcgatacggtcatttcactgaccggactgtatcgtgaccagtttccaaatgtaatggaacgattcaaccaggcaatcacactattggctgaacaggacgaacccgacagtgacaaccccatacgtgccaatacccggcgtatccgggcacaactgaagaagctgggagtaacacctgaaacggccagggaatttgccttgacacgtatttttggcaatgaaagtggtgactacagcacacgcctgacccaagccactctggcttcggataaatgggacgagaaggacggcaagctcgagaacctctatctgtcacgcatgtcctgggcttacgggccgaacccggcacactggagccagaaacttaccgatggcaaaggaaacgaaataaacgcctacgcggaacatctgcgcggcacgagtgctgcagtgttttcacgttcatccaacctgcgcggcctgctcgatacggatcatccattcgaatatctgggaggaatatcgatggcagtacggcatctggatgggacgagcccgcaactctatatttccaatctgcgcgatccggcacgcgccaggcttgagtcggcagaaaaattcatggccagggaattgcgtgcggtttaccagcacccgaactggatcagggaaatgcagaaagaaggctattccggaacattgcagatgctcgatacgatcaacaacttctggggatggcaggtcatggatcgtaatatcacccgggatgatcaatgggaggaatttcaccagagctatattgccgaccgttataacctcgacatgcgtgactggttcgagaaatcgaatcctgccgcgctggcccagatcgctgaacgcatgctggaagctatccgcaaggattactgggaagcaagcgaacagaccagacgcgaactggtcgaggtctataccgacatcgcaaatcgccatgatatc

SEQ ID NO: 43329 - DNA, 690 bp, Nitrosomonas europaea
gatgtgacctcgaacagccctcatccagtcattgaagccaatgggttaagccgtcattttggtgatcgtgtcgccgtacatgatgtaaacctgaaattgcaccgtggtgacattctcgggtttctggggccaaatggcgccggcaaaagtaccaccatgcgaatgctgaccggcaatctggcaccgagcagtggaagcgtgcatatttgcggaaccaatctgctggatgatccgctggaagcaaaacaccatattggttatctgcctgaaattccgccactctacaaggaactgacggtagatgagtatttacgctttgccgcccggctgcatggtcttgccaaaacatcgctgcaaattgccctggatgaagtaaaacagcagtgtgaactgaatgatgtgggaaaacgactgattggcgttctgtcgaaaggttatcagcagcgcgttgcaattgcgcaggcgatcatccaccggccgcaactgatcatcctggatgaacccacagtcggcctcgatcccaatcagatccagaaagtgcgcgcactgatttgtgaactcggcaagactcacgccatcattctttcctcgcacatcctttcagaagtggaaagtgtatgcaatcgcgtgcaaatcatgcatcagagcaaactggtgctggatgacagtctggataacctgaaacggcaa

SEQ ID NO: 43330 - DNA, 1458 bp, Nitrosomonas europaea
cgcttacgtggcgccctggaagagctgggcccgatattctcgaaactcgggcaagtgttatcaacccgtccggatctccttccaatcgaatacatcgaagaacttgtactgttgcagtctcgcgtgccgccaatgactgagagcgaggtcgtccgggtctctgaacaggaactgggtgtcccgtgggaggatgtattcaagtcatttgacccgaaccctctcgccgccggcacaatcgcgcaggtccatcgtgcgacgctcgaaaccggtgaccgggtcgttgtcaaagttcagcgacccactgctcgtgctgatatcgaacaggatctcgctctgttcgagatgtttgcggagaaagtcgggaagcgtcctgcgctcaatcaggtgatcaatatggaggatgtgttcaagcacctttccacctcgctccatcgtgaactcgactttcgccaggaggccaacaatattgagcggatgcggacagtgctcgcagactatgatcgtcttgccgtccccagcatacactgggatctgtccacatcccgattactggtgatggaagaaatccagggcattccgatcaagcaggcgccagccggtccagagcgtatccaggccgctcgccaactgttggagagctactacaaacagatcatcgtcgatggtttcttccatgccgaccctcacccaggcaacctgatgtggtggaaggactgcatttattttctcgatttcggaatggttggcgcggtaggagccgatcttcgcgagcatcttttgttaatgctgatggctctgtggcaggaagatgccgggtttctcaccgatgtcacattgatgatgacgaacgctgtcaatagcaacgatttcgatgtggctcaattccagagcgagatcggggaggtgatggcaaaatatcgggccgcctcgcttgctgagatgcagatcgggccgcttctgcaagaaatgagcaccgtctcgttacgacacggggtgccgctgccggcttcgctcacgcttgccaccaaagcacttgcgcaggtacagctggcgactgctgagcttgatccgacgctcgatccttacgacgtggcaggcaagtatctgatgcgtttgatggtcaaacgcatcggcgccgcgctcaatccaaaaacattcgtgtatcagtcgcagaagttgaaagtacggactctgcgcgtgatcgaagcactcgaaaacctcgtcggtgtccgccctggcggtccaaaacttgtagtgaacttcaaggctaattcgctggagaatatcgtgcgtcacacaggacgacggctggcgctcggcctgaccgctgcggcaagtattctgaccagcggactcacgaccatgtctacggctgttgccgagtgggtaccagtaacattcggggctgttgcaggtctgctgactcttggcctggttatcgatctgctgcgaggacgt

SEQ ID NO: 43331 - DNA, 1609 bp, Nitrosomonas europaea
atttcctaccgttcatccggtgttgatatcgatgccggaaatcgtctggtggaaaggatcaaaccatttgcacggcgcactatgcgcccggaggcactggggggtatcggcggattcggggcattattcgaagtacctggaaaataccggcagccggtgctggtatcaggcacggatggcgtaggcaccaaactcaagctggctttccagtatgcgcgacatgcaaccattggtatcgatctggttgcgatgagcgtgaacgatattctggtacagggtgctgagccactgttttttctggactatttcgcctgtggaaaattggatgtggaaattgccacccaggtggttcagggaattgcacacggctgtgaagatgccggttgtgcgctgattggaggtgaaacggcagagatgcctggtatgtatcccgaaggagaatatgatcttgcaggctttgctgtcggcgtggtggaaaaagatcggatcatcgatggttccggcatcagagagaacgatatcgtactgggaatcgcctcgagcggtccgcattccaatggattctcactaatccgtaaaattcttgatctgaatacagtgcaatctgacactcgtcttggtgaaaccagtcttatcgatgcgcttctgacaccgacccgtatttatgtgaaatccctgttgacgttgatggcagaattgcccgtcaagggattggcacatattaccggtggcggattactggagaacattccgcgtgttctgcccgacggcgtcatggcccatatcgacagcagcacctgggtacgcccttccctgttcgactggttgcaacaacatggcaatgtggccagggaagaaatgctgcgtgttttcaattgcggcatcggtatggttgtggtcattgctccggaacacgctcaaactgccatcgaaattttgcacaacgcgggtgaaactgtgtggcagatcggcgaaatcagacctcgtcaatccgaaacactccccatcgtcattgcctgaaagaaggcgccatgaaatcagtagtcatccttatttccggtcgcggcagcaacatgcaggcaatactggaagccggattgccggtcgccgcggtgatcagcaacaatccagcggcagaaggattgatgtttgctcagacccgtggtatcccgactcaggtaatcgatcatcgtacgtttccagaccggaaagcgtttgatgctgcgctggcagaaaccatcgatacctatcagcctgatctggtcgtcctggccggtttcatgcgtattctatcggaagcattcgtagatcattaccagggcaggctggtcaatatccacccttccctgttgccggcatttcccgggcttgatacgcatacacgcgcattgcaggaaggagtcaaaatccacggctgcacggttcatttcgttacatcgcaactggatcacggccccatcatcgcccaggctgccataccggtgttgactgatgacaccccgacaatgcttgccacgagagtactcgctcaggaacatcgtatttacccgcaggccgtgcgctggtttctgcaagggcaattgactctggtggaaaaccgtgtcgaaat

SEQ ID NO: 43332 - DNA, 873 bp, Nitrosomonas europaea
cgtaacggcatcatcggagcactgaccgaagatctgatcgataccagtgcagaatccactgaagcaatccgggcactgcgccatacgccctccggtgcttttggctcctgtcgctacaaactgaaaagcctggaagacaaccggcgcgaatacgagcgtctgatcgaagtattcaaggcccatgacatcggttatttcttctataacggcggtggtgattcggccgatacctgcctgaaagtctcacagcttgccggcacactcggttatccgattcaggcaattcatgtacccaagacggttgacaacgatctgcccatcactgattgttgcccgggattcggctcagttgcaaaatatattgccgtttccatgctggaagcaagtttcgatgtggccagcatggccaaaacttcaaccaaagtattcattctggaagtaatgggccgccatgcgggatggattgcagctgcaggcgggctggcttccaatgaagatcacgaggttccgatcattatcctgttcccggaagttacttttgatcaggaaaagtttctggccaaaacggatcattacgtcaaagaatacggctattgtacggttgtagtatcagagggcgtaaaaggtaccgatggcaaatttctgtccgatcagggattgcgcgatgccttcgggcacgctcagttaggcggagtagcgccggtaattgcgaatatcgtcaaaaatggtttggggctgaaatatcactggggtgtcgctgattatctgcagcgtgctgcgcggcatattgcttccggcacagacgtggagcaagcctatgccatgggtaaagcagcagtagaatacgcgattgccggacataattccgtcatg

SEQ ID NO: 43333 - DNA, 1107 bp, Nitrosomonas europaea
atgagtcagagtgattattatgaagtgctcggtgtaggccgggatgcggatgagaacgagctgaaaaaggcataccggaaactggcgatgaaatatcatcccgaccggaacgccggtgataccaaggcggaggaacgattcaagaacatcaaagaagcttatgaaatcctgtccgatccgaataaacgggctgcctacgatcagtttggccacgctggtttgaatggcgggatgggcggggcgggtgcacagggattcagtgatgccttcagcgatattttcagcgatcttttcggaatgcgtggaggaggacgctccagtgttcatcgcggagccgatctgcgctataacctggaaattacactggaacaggcagcccgtggtgccgaaacccagattcgtatccccaggcaggaagtgtgtgatacctgtcatggcagtggtgcaaaacctggtacttctcctaaaacctgtcctacttgtaatgggcatggtcagattcgcatgcaacaaggctttttctcgattcagcagacctgttcacattgtcagggtagcggtaaggtcgtctcagacccttgcggggattgtcatggggcgggatgggtcaaacgccagaaaacactgtcagtcaggattcctgctggtgtggatgaaggcgacagcatccggctgacaggagaaggtgaagcaggagcaaatggcgggcaggctggcgatctgtatatcgtcattcatcttgccagccatccggtctttcagagggaaggcaatcatttacattgcgaaataccgatcagttttacagtagccgctttgggtggagaaatcgaagtacctacgctcgatggtcatgcccgcatcaaggtgccggccggaacccagaccggaaaaattttccgtttgcgcagcaagggaataaccggtgtacgcaaccaatccacgggtgatctgctttgtcatgttgcggtggaaacaccagtcgatttgacggcgcgtcagaaagagctgctggaggaattcgaatcgatcagccagaaagatggttcacgtcaccatccgcgtgcaaaatcctggatggaaaaggcacgtgaatttttcgctgaa

SEQ ID NO: 43334 - DNA, 1932 bp, Nitrosomonas europaea
atggcaaaaataattggcatcgaccttgggactaccaactcatgcgttgccgtcatggaaggcaacaaacccaaggtcattgaaaatgctgaaggtgcaaggacgacgccgtcgattgtcgcctatgcggaagacaatgaaattctggtaggggcatcggccaagcgtcaggcagtcaccaatccggaaaataccctgtttgcgatcaaacggttgattggccgtcgtttcgatgaagaagtggtgcaaaaggatatcagtgtaacgccctacaaaatcgtgcgtgccgataacaacgatgcatggatagaagcacgcggaaggaaaatcgcaccgccggaggtttctgcacaggtgctgataaaaatgaaaaaaacggctgaagattatctgggtgagccggttacagaagccgtcatcaccgttccagcgtatttcaacgattctcagcgtcaggctaccaaggatgcaggccgtatcgcagggctggaagtcaaacgtatcatcaatgaaccaactgctgccgcacttgcattcggtttagataagaaggaaggtgatcgcaaaattgcggtatacgatctgggcggaggtacgtttgatatttcgatcatcgaaatcgcagaagtcgaaggcgaacaccagttcgaagtgctggcaaccaatggtgacactttcctcggcggtgaggatttcgactccagagtgatcgaatatctggtggatgaattcaggaaagagagtggtatcgatctgaaaaaagatatgctggcattgcaacggctcaaagatgcagcggaaaaagccaaaatcgagctgtcatccagccaacagaccgaagtgaatctaccctatatcacggcagatgcatcaggcccaaaacacctggctgtcaagatcacccgtgccaagctggagagtctggtcgaagaactgatcgagcgtactgcaggcccttgccggactgcgcttaaagatgcgggtttgtcggtttctgacatcaatgacgtcattctggtcggtggacagacccgtatgccgaaagtccaggagaaggtcaaggaaatcttcggcaaagagccgcgcaaagatgtcaatcctgacgaggcagttgccatcggtgctgcgatccagggcggggtgctgaaaggagatgtcaaggatgtgctgctgctggatgtgactccactgtcgttgggaatcgaaacactgggtggcgtcatgaccaagttgatccagaagaacaccaccattccgaccaaggcgcagcaggtgttctcgacagcggacgataaccagacagcggtgaccattcacgtattgcagggtgagcgggaagtggcctccggcaataaaagtctaggccagttcaacctgaccgatattccgtcagcaccccgcggaatgcctcagatcgaggtgattttcgatatcgatgccaacggtattctgcatgtttcagctaaagacaaggcaaccggcaaggaaaacaagatcaagatccaggcaagctccgggctgtctgaagatgaaatccagaaaatggtaaaagatgccgaagcgcatgcggaagaagacaaaaaagcactggatctggtcaacagtcgtaaccagtgtgacgccatgattcattcagtcagaaaatcactggctgaatacggtgacaaactggaaggggatgaaaaatccagaatcgaggcagcgttgaaagaggccgaggaagcactcaaatccggcgataaacagacgatcgatgccaaaacccaggcgttgaccgaagcttcgcataaactggctgagaagatgtacgcccaggagcaggcgcaggctggtcagcaggcaggtgccgggactgcatccgatcagtctcaggataagccggttgaaggcgaagtcgtcgatgccgaattcgaggaagtcaaagataaaaaa

SEQ ID NO: 43335 - DNA, 1221 bp, Nitrosomonas europaea
tttgaataccgtgatagccagctttttgtggaatcggtaccactggcagagattgccgctaaatttggtaccccctgctatgtttattcgagcgcagcaatccgcacgacttaccagatttttgatcatgcattcggacaacgggatcatctgatctgctacgcggtaaaagccaattcgaatcttgccatactgaatctgcttgctcgccttggcagcggtttcgatatcgtctctggtggagaattgcagcgcgtattgaaagcaggtggcgatccgcaaaaaacggttttctccggggtgggcaaaacacctgaggaaattcgtgccgcactggctgccaatattctctgtttcaatgtggaatcggaaatggagttgatggtactgaatgaaatcgccggacagatggggaaaattgcaccagtcagtttgcgcgtcaacccggacgtggatgccaatacccacccttatatttcgacaggaatgaaggaaaacaaatttggcatcccggccgctgaggctggacgaatctattcactggcgcaccagcttccccatattcaggtctccgggctggattgccacatcggttcgcaattgactgaaattgcacccttcattgaagcagccgataaaatgctcgatttactggcacgcctgcaaacaatgggcgtcactatcaaacatcttgatctgggtggaggactgggaattcgttatgatcgggaatcaccaccttcgatagaagcctacatcaaagcactgtgtacgatcgcagaaaaccatccgcagcaattgctcattgaacccggtcgttcaatggtgggcaacgccgggctgctgttgacccgggtacactacctcaaacatacgtcacaccgcaattttgccattgttgatgcggccatgaacgacatgctgagaccagctttatatcaggcttaccactcaatcctgccggtcaccaaacgaaccggggaaacgaaaacctaccagatcgtcgggcctgtttgcgaaaccggtgattttctcggccatgatcgtaacttggcactgacaaaaaacgatttgctggcagtcatgtccgccggagcctatggtatgagcatgagttccaattacaatacccgcccacgcgcagctgaagtcatggtggatggcagcacggtgcatctcatccgcgcgcgtgaaacggtggaagatctgtatgctctggaa

SEQ ID NO: 43336 - DNA, 1278 bp, Nitrosomonas europaea
atgcaatggcttgatcttccgcatgtacagcgtgcacaaggtaatgtacgcctgccgggttcgaaaagtatttccaaccgcattcttttgctgtctgcgctggctgaaggcactacgatggtcagcaacctgctggagtccgacgataccgggcggatgctggatgcattaaggctgctcggggtggcgatcgttcgcaccgatgatggcaaataccgggtggcaggatgtaaagggaaattcccggtaagagaagccgaactgtttctgggaaatgccgggacggcttttcgtccgctgactgcagtgctggcactgatgcagggtcattatcgtctttccggtgtgccacgaatgcacgagcgtccgatcggagatctggtggatgcattacgccagatcggggctgtaatcacctgtcttgagcatgaaggtttcccgccgctggagatccacccggcggtaattcgtccaggtaatatctccatcaaagggaatatttccagccagtttctcagcggattgctgatggcgctgccgctgacgggcgagccggtaaccatcgttgtcagtggtacgcttatttcacagccttatgtggcactcacgattgcacaaatggcacgtttcggcgtgcaggttaaacaggaatcctggcagcgctttatgctgcccgaaaatcagacttatcgcagtccgggaaagattgcagtcgagggagatgcatcctctgcttcttactttcttgcggctggggccattgcgggtggtccggtacggatcgagggtgcggggagtgacagctgtcagggagatatccgcttcgttgaagcactcgaggcgatgggagcacgtatcagcatggggagtgactggatagaatctggcgctcctgatggtggggccttgaaggcgattgatttcgactgtaaccatattcctgatgcagccatgacattggcgacaatggccttgtttgcacgaggtactaccacgctcaggaatattgcgagctggcgggtcaaggaaaccgaccggattgcagcgatgtctgcggaactgcgcaaactgggtgcccgggtcgaggcaggagatgattttctgcgaattacgccacccgatggtccgcttactgcggatgccgttatcgatacttacgatgatcaccggatggccatgtgtttttccctggtgtcattgagtgtgccggtgcgtatcaatgacccggggtgtgtggctaaaactttcccggattatttcgagaaatttgcagccatt

SEQ ID NO: 43337 - DNA, 1911 bp, Nitrosomonas europaea
atgagtaaaaaactgatcattgccgaaaagccttctgttgccagtgacattgcgcgtgccctgggtgggtttgtcaagcagaaggattattttgagagcgatgagtttgtggtgtcctcggcaatcgggcatttgctggagctgatcgtcccggaagaatatgaagtcaaacggggaaaatggagttttgaccatttgcctgttattcctccgcgttttgatcttgctccgatcgaaaagacgacagatcgtctgaagctgctcagcaaactgatcaagcgaaaggatgtcgatatgctgatcaatgcttgtgatgctgggcgtgaaggtgaactgattttccgttacatcgtgcgccatgtcggcagcaagaaacctatcaagcgcttgtggctgcaatccatgaccccgtcagccatacgcgaagcttttgcaaatctgttgaatgatgctgaagtacagtctctggcagatgcggctgtcagccgatcagaggcggactggctggtgggaatcaatggcacacgtgtcatgaccgcattcaattcacaggaaggtggattccataaaactacggtcggtcgggtacagacaccgacacttgccatactggtcgaacgggaagaagcgatcaaaaagttcgtggtgcgggattactgggaagttcatgctactttccaggcagaaagtggtgtttataaaggaaagtggtttgatgaaggtttcagtaagcgtaaggatgaatctgaatccagagcagatcgaatttgggaccatgccaaggcagaagtaatccgtgataaatgtgcaggacgaaccggggtcgttaccgaagaaagcaagccatcccgggaaaattgtcctctgctgtacgatctgaccagtctgcaacgtgatgccaacagccgtttcggtttttccgccaaggtgacattggggcttgcgcaggcgctgtatgaaaaacataaggtgctgacttatccccgtactgattcgcgtgcgcttccggaggattatccggcgatcgtcaaagatacgttgcaagtgctgaagggatcacgttacgaccgatttgccagccagattctggaatcagactgggtaaagccgaacaagcgaatcttcaataatgccaaggtttccgatcactttgcaatcatacctactgccctggtgccaaagaaactcaatgaagcggaggagaaactctacgatctggtcaccaaacgttttctggcgattttttatccggcagcagaatttctgatcacgacccgtatcacgcgcgtggaaaatgaacctttcaaaacagaaggcaaggtgttggtacatgccggctggcagacggtttatggcaaggtggaatccgcccaggggcaggaagaggaatcggtactggtggcagtcacaccgggcgagacagtactggcacaggaagtggcagtcgtggccggtaagacacgtcctcctgccagatataacgagtctacgttgctgtcagcgatggaaggtgccggaaaactggtggaagatgaagaattacgtgcagccatgagtgccaaggggttgggtacgcctgctacgcgtgccgccatcatagagggattgattcacgaaaactatgtcgagcgttcaggaagagagttacagccgacagccaaagcattttcgctggtgacgctgttgcgggggctcaaaattccagagctgatttctcccgagttgaccggcgactgggaattcaaattgcgccagatcgagcagggtcagctcaagcgtgatgttttcatggaaaagattgcggcgatgacgcgtcatatcgtcgaacaggccaagaatcatcgtgataaaaccatcagcggggattttgcgacacttcaggtaccttgtcccggatgtggtggggtgata

SEQ ID NO: 43338 - DNA, 402 bp, Nitrosomonas europaea
gatcatgaaatccagcgacgcacaggggtcggaatacccgtgatcttcgaaatagaaggagaagccggttttcgcaaacgtgaaagcgaagtactgcgggatatcgtcaggcagcagaacatcgtactcgctaccggagggggagcaatattacaccccgataatcgtgccttactgcggcagcatggtacggtggtttatctgtgtgcacccgtcacggaattgcgccgccgtacttatctggataaaaaccggcctctgctgcaaaccggaaacgtgcatgccaaactgattgagctatttacccaacgcgatccgctgtatcgcgaaaccgcacatatcatcatggacagcggtcggcaaagtgcccgtgctttcgtccagaaactgatacagaaatta

SEQ ID NO: 43339 - DNA, 1038 bp, Nitrosomonas europaea
aaccgcagttactccattcatatcggacaggggttgctctccagaatggatctgctgcttccccatctgcctggtaaaaaggctgcaatcgtcaccaataccaccatagcaccgctctacctggaaaaactgcgtagcgcgcttgccgagcatcacgtggaaaccttcgcgatcaccctgcccgacggcgaacggtacaaacactgggaaacgctgaatctgatctttgatgcactgctggaacaccgctgcgagcgcaggacaccgctgattgcactgggaggcggagtcatcggcgacctgaccggttttgcggccgccacctatttgcgcggcgtaccgttcatccagattcccaccaccctgctcgcgcaagtagattcgtccgtaggcggaaagaccgggatcaaccatccgcttggcaaaaacatgattggcgccttttaccagccgcaactggttctgactgattcagccaccctcaccaccctgccggacagggaactgcgcgccggcatcgcagaaatcatcaaatacggtctgatctatgacgcagatttcttcgactggctggaacagcacatgaactcactgctggcgcgtgatcctgcagcagtgaattacgcaatccgccgcagttgtgaaatcaaggctgaaatcgtttcgctggatgaacgtgaaagcggtttgcgggcgctgctcaatctgggccatacttttggccatgcaatcgagaatgccatgggttacggcgcatggctgcacggtgaggctgttgccgccggcaccctcatggcggctgatctctcccggcgtttgcagcgcattacctctcaggaggtcgatcgtatccggtacttgttcgaaaataccggattaccggtaaaaggcccgcgcatctcgcctgaacgctacctggaatcgatgcagctcgataaaaaagtaaaggagggcgccatccgtttcatcctgctcgatagtatcggcaaagcatcaccgggcgataccgtccccactcccctgctgcttgaaacattg

SEQ ID NO: 43340 - DNA, 1338 bp, Nitrosomonas europaea
attctgacgaaaaatccggcatccgggaaattattgcagacatacacaccctattccgaagctatggtgttcagtatgctggagcatgctcatgctgcccatctcgcgtggcgacaagtgcctttacacgagcggacggcgcttttgctgaagctggcagatgttttacgggaaaattccgaatcgtacgcccggctgatgacggaagaaacggggaaaaccatccgtgctgcccgtgctgaaatagagaagtgcgcctgggcgtgtgagatttacgcggataaggctgccgcatggctggctgaagaagagattgcggcggatggcataaagcatcgtgtcgttattgaaccgctgggagtcattctggcggtgatgccatggaattttcctttctggcaagtgatgcgtttcctgatcccggcgctgctggccgggaatggggccttgctgaaacatgcaaccaacgtaaccggctccgcgctgaaaattcaggaagccgtcaatgaagcaggattcccgaaagggctatttgtaaccctgcttgtttctcacacagtagttgaacaagtcatcgctcacccgctttgtcagggcgtttctttgacaggcagcgcagaagcaggccgggcagtcgcttctgttgccggcagacatctgaaaaaagtagtactggagctgggtggttccgatccattcatcgtattgggggatgcagatattccggccgcagcaaaagccgcagtaatcggacggtttcagaacaatggccaaagctgtattgctgcaaagcgcctgatcgttttgaaagaaatcgaagaggtattcaccagtacgttgctggccgaggttgaaaagctggtggtgggtgatccgctcgatgaggcaactgatatcggcccgctcgtcagtgaacaggctgccgagaccatggaacagttcgtactggatgcggttgccaagggagccatggtgagaacgggtggaacacggaaaggtgcgtatttcacaccgacggttctgactggtgttcattcagcaatggaagtcatgacgcaggaagtattcggtccggtcctgccggtcattacggcggataccgtggaggaagcgattacgcttgccaacgccacccggttcggattgggtgcaagtgtgtggagccgggatctggaaaaaggtgagcaggttgcgcgccaactggcggccggcgccacatttgtcaacagcattacaaaatcggatccgcgtatgccttttggtggcatcagagaaagcggtcttggccgggaactttcttactggggggtgcgagagttcgccaatatcaagactgtc

SEQ ID NO: 43341 - DNA, 2772 bp, Nitrosomonas europaea
atgagtgtggatatctctacgaaaccggtcatccgtgtacagaatgtcaatttacgttacggtgacactctcgcactcgatgctctcgacgtagagattcccgcccattgcatggcagggttgatcggtccggatggagtcggcaaatccagtctgatgtcgttactgaccggtgcgcgagtaatgcagcagggtcagatcgaagtcctgggaggcgatatcgcagatccggcacatcgtcgtgtggtctgcccacggattgcttacatgccacagggattgggcaggaatctgtaccacacgctctcggtattcgaaaatatcgatttcttcggtcagttgttcggtcacgaacagatcgaacgtcatcagcgtatcgacgaattgctcgaaagtaccgggctggcccctttccgggatcgccctgccggtaaattatcgggtggaatgaaacagaaactcggcttgtgctgtgcactgattcacgaccccgattttctggtgctggatgaaccgactactggtgtcgatccactatcacgtgcgcagttctgggagctgatcagtcgtttgcgtacacaacacgtcaatatgagtgtactggtttctactgcctatatggacgaggcagaacgctttgactggctggcagcaatggatgccggcaaaattcttgctaccgggactgcagccgagctgcgtacacgtactgacaccgactcgctggaagccgccttcatccggttattgccggcagaaaaacgcagaggttaccgagagatcattatcccgccacgcgatatccgggatgatcaggaaattgccatcgaggcacacgatctgaccatgcgttttggcgattttgtcgcggttgatcgggtcaatctgcatatttcgcgtggtgagatctttggttttctcggctccaacggttgtggtaaatccaccaccatgaaaatgctgaccggcctgctaccccccagtgaaggagaagcgtggctattcggtcaggtcatcgatgccggtaatctggctacccgtaaacgagtcggctatatgtctcaggcgttttcactctactccgagctgactgtgcgacagaatctggagctgcatgcaaagctgttccacctgcctgatgccgatattcctgcgcgtgtcaccgaaatggctgaacgttttctgctcgaagcagtcatggacagctttcccgatgctctgccgctgggtatgcgtcagcggttgtcactggcagtcgcagtcattcatcagccggatctgctgattctcgacgaaccgacctccggtgtcgatccaatcgcacgggacatgttctgggagctgatcatcggcctggctcgccgtgatcaggtaaccatcttcatttccacccatttcatgaacgaggccgagcgctgcgatcgtatctcgctgatgcatgccggcaagattctcgccagtgatacccctgccgcactgatcgagcgtagcggccattccacactggaagctgctttcatcagttacctgaaacaggcaagtggcatcagtgataaaccggtgaaaatgcctgttccctccactacccaggcccaggcgacggttgcgccagaggagactcacgctgtcatgacactcaatacccgtttcagtctgttacgcctgttcagctacaccttgcgcgaagcactggaactgcgccgtgatccgatccgcggttcaatcgcattattcgggactgtattactgatgttcatcatgggatacggtatcagtatggatgtcgagaatctgcgctttgccgtactggatcgcgaccagaccacactcagccggaactatatactcgatctcagcggctcacgttatttcatcgaacagccaccaatcactgattatggcgagctcgatcaacgtatgcgcagcggtgagttgagtctcgcattggaaattcccccgaatttcgcacgtgatctggcacgcggtgataacgtcagaatcggcgcctggatcgatggcgcaatgcccacacgcgccgagaatatacttggttatgtacaggcgatgcatcaaaactggctgctcgagcaggcacgccatcatgccacagatcatttacctgccgggctgatgacgatcgaaacacgttttcgctataaccctgacgtcaaaagtttgccggctatcgtccctgcggtgatacctatgttgctgatgctgattctggccatgctcagcgcactcagtgtcgtacgggaaaaggagctgggttccattctcaatctgtatgtcacgcccgtgaccagactggaatttctccttggcaagcagcttccttacattgccctggggatgatcaacttttttctattgtgcatactggctgtattcgttttcggcgtaccgcacaagggggatttcctgttactgacagtggcagcattattgtatgtgaccgccgctaccggtctcggcttgctggtttcagcctttacacgcagccagattgccgccatcttcgcgacatcgctggctaccatcatcccttcttcacgcttttccggcatgatcgatccggtttcttcgctggaaggcggtgcacgactggttggtgagatttttcccgccacgtactttctgacgatcagtcgaggaactttttccaaagcgctgggatttgctgagcttggctctttgttgctgccccttgcactcgccattcctgtcatcaccagtctggcggtcatactgttgaagaaacaggaacgttag

SEQ ID NO: 43342 - DNA, 1584 bp, Nitrosomonas europaea
atgtccaatctttttcatgagctgatttatcagtcagctgcccggtatcccgattccacagcattgatcgatcagaaacggcatctctcctatgcggcattatctgaagcagtgcaatcgattgccagcgctttgcatacgctcgggctgggtcgcggagaacgttcggccgtctatctcgagaaacgactcgaaacggtcattgccctgtttggcgcatccgcggcaggaggcgcgttcgttcccgtcaatccgctgctcaaagccgaacaggtcgcctatatcctcaaagactgtaatgtccggatattgataacctctgccgagagactcgatctgctcagcccggtattaccgcaatgtcatgatctgcatactgtgatcatcaccggtgatctgcacaaagcatcacttcccggattgaatgtcgtttcatggagacagacacagacactttcagatgctgcacggttaccggactgcatcgacagcgatatggctgcaattttgtatacctcgggaagtaccggcaaacccaagggagtggtgctctcccatcgcaatctggtgacaggcgccataagtgtttcccggtatctgaataaccggcctgatgatcggatactggcagtgttgccgctcagcttcgactatggattgaatcaactgaatactgcgttttacaccggagccactgccattttgatgaattacctgttgccgcgcgatatcctcaccacggttaaacaggaacaggtgaccggactggctgcagtgccgccattgtgggcgcagctggcgcaattggactggaaagatgcgcagagtctgcgctacatcactaattcgggcggcgcaatgccccgcgcgactctggcacatttgcgcagtgcgttacccgatacacagatttttctgatgtatggtctgaccgaagcctttcgctcaacttacctccctcccggggaagtggacaaacgaccggattccatgggcaaagcgattcctaatgccgaagtcatggtactgcgcgaggatggttcccattgcgcaccgggtgaaccgggtgaactggtacaccgcgggccgctcgtttcgctgggttactggaacgatgcggataaaacggctgcttgcttccggccgctgactccccgtcaatccggattgaccattcccgaacttgcggtctggtcgggtgatacggtgcgcatggatgatgaaggttatctgtatttcatcggccgacgcgacgatatgatcaaaacctccggctaccgcgtcagcccgactgaagtggaagaagtcatttatgcaaccgaaaaagttgctgaagcggccgctttcggggttccccaccctacactcggccaggctatcgtggtcgtggccgttcccagaaccggattcgcgctcgaccgggatgtgctgcaatcggcttgcaaacagcacttgcctgctttcatgcaacccgctttgatcgaattgagacaaaccagtctgccccgtaatccgaatggaaaaatagaccggaaaatgctggctggtgaatttcagcaggctttccaggcaggagaatcatga

SEQ ID NO: 43343 - DNA, 1230 bp, Nitrosomonas europaea
atgacgcatcccaaacatgcaccgatgacccagtttccgatacgcaaccactgtctcgtcatcggcgatcttccactcacgcgcctggcacaacgtattggaaccacccctttctatgcttacgatcgcaagctgatctctgcacgtattcaattcctcaggcagcatttaccggcaggtattcatctgcattacgccatgaaagccaaccctatgcccgccgtagtacagcatctggccgggctggtggatggtatggatgtggcttcggttggcgaaatgaaagtggcactggatgctggcattacacccgaaaacatcagttttgcagggccgggaaaaagtcgtcaggaactgatatgtgccattgcagcgggtatcgtcatcaatgtggaatccgagtacgagctggaaacgattgcgcaactggcagaagagaccggtttccagcccaaagtcgcagtacgggtcaaccctgatttcgagctgaaatcttccggaatgaaaatgggaggaggttccaaacagtttggtatcgatgctgaatgtgttccggcagtactgcaacgtatcgcacagctcaggttcgattttgagggattgcatattttcagcggatcacagaatctccgggtcgaagccttgcgggaagcccatgaaaaaacactgcaactgggtttacaacttgcttctacctcacccgtacctgttcgtgccatcaatatcggaggcgggtttggcgtaccttatttccccggtgagagcccgctggacttgaatgctgtgggaaccaatctgcaacggttgctggcagagattccctctcaattctcagctatccggttcgtgatcgaactggggcgatacatcgtggcagaagcaggtatttatgtttgccgcgtactggaaaaaaaaatatcgagaggacagacttttctagtcaccaacggcggcctgcaccatcatctggcggcatccggaaattttggccaggtcattcgcaaaaattatccggttgccattggcaataaaatgaaaatcgatgaaaccgaaatcgtttcagtagtaggacctctttgtacgccgctggatctgcttgccgaccggatggaactgtccagggccgaacccggggatctggtcgtcgtgttccagtcgggagcctacgggctgactgccagccccaccgcttttctcagtcaccctgcttcgctggaagtcctgatctga

SEQ ID NO: 43344 - DNA, 3598 bp, Nitrosomonas europaea
ggtacacatgtcaaccgcgaacgcatgatgcactacctgaaaacctggctgacaggcgaggatgtatcggctgcagcgccaccgattgaactacctgacagcggtatttatcatccggatgctgaacagatggtatttgcttctctccccgagtatctggactggtggcaacagcgacataaccagccctggcgtgataatccgatcatcggaatggaaactgccagcagttacctcagcgatgggcaaacacgtcaacttgatgaaacgatcgcagctattgaacgcgctgaaggagtgccactgattttttaccgggccagccgttctcgttccagatcaaccacccgttccccggaacaggatgagcaacagggtagaagatctgagggaaaaatgccgggaaacatacgaatagctgtacaaacaatcggtacagctgacagcagcggttttcccaaccccgcttcacaaccgatggatgtggctgatgaacctctgattatgctcgatggaaaaaccattttagatgtcctgatggtcaacacatttctgggaatcaacccggatgagcgcaaagcctggtatcgatcgcttgatatcccggtaatcaatttcatgcaataccgcaatggattatgccgaggataaaaccggtatcagcagctttatgctgccttttatgctgactgtcgctgaatatatcggattacaggatccggtactggttaccacgaacgaagatggagagctggtgtcgatgccggaacaaatggatctgctcatcggcaaactcatcaatctggctcggttgaaaacgctgccgaatgcagaaaaaaacgtcgcattattattctggaatcatcctccgggagaacataaccagggtgcatccaacctgaatgttccccgttcaatcactcacctgacagaacggttacgcgatgaaggttacgcgtttgataccgtcagtgaggatcaggtcatagcggctgtcggcgagatgctgcggccggtttatcgcaaagactccctgccggaactgatgcagacgcctcactgggattttctgccgctggtcacatacagggaatggtttgcaacactgcctgaggaagtacgcgaacggatcgatacatactggggaaaagcggaaagaagcccctgggtggtacagcacgaggacggtacaaccggttttgtgatcccgcgcctgaaactcggccgactggcagtactgccacaaccgccgcgcggagaaatcgcggatgaaaacgaagagaagttgtttcacgacacgaaaattccggtcaatcatttttatcttgctacctacctgtggatacgtacacagcaacccgcacatgccatcgttcattttggcacccatggcacgcaagaatggacacccggcaaggagagaggattgtgggcattcgatgatcccaatctactggcaggtaatgtgccggtgatttatccgtacattgtggacaacatcgcggaggcgatacatgttaaacgacgcggccggggagtgatcgtcagtcatcagacaccacctttttcccctgccggattgtctgatgatttcgctcagatcaatgatgcgattcgtgaatatgaatctcttgatgaaggactggtgaaagaaaacgcgcgcaagcagattattgatttggtgatcagaatgaacattcatcaggatatgtcgtggaaagttgctgatctggaacgtagctttcctgattttctgcgcgaaatcgaggattatctggaacatttggccattgcgcagcagccgctcgggctgcatgtgctggggcaggatatggagcgcgcccatatgatcagcaccgtcatgcaaatgctggggcagccactttacgaagcgtttggcttcaataatgctggagaggtgtttaccgaagattaccggcagatacaggcatctgcaccgtatcacttcgtcgatgaatgggtactgagtgacaaatcactggatacattaaaaaacaaaatacgcgttgaactcgctgaatgtggccgcgtatttgctgccacctttcgtacagccggcgaaatagaatcggtgctgcgcgcattggcggcgcgctggattgatccttcctacggaggagacccgatccgtaatccggatgccttgccaacgggacgcaatatgtatggctttgatccctcacgcatcccgacccgtgcagcatatgaggccggtaaggaatcactggaacatctgattctgacctatcagtcgactcacgatggacaatttccggacaagcttgcttttacgctgtgaagtacagaaaccatgcgccacctcagcatgttggaagcacagatcttgtatgccctgggagtgcggccgatctgggatgaaggcggtcgtgtaaccggtatggaaaaaattccattggcagaactgggccgtccacgtatcgatccggtgatatcgattaccggtctgtatcgtgatcagttccccaatgtcatggaacgtctcaacgaggcgatcgtgatgttggctgcagaagatgagccggctgaacaaaatttcgtacgcaccaacagcttgcgcattctggcggagatgctggcacgagggttatccagggaagatgctggtgcgatcgcgcatacccgtatctttggtaatgaaagtggaaattatggtactggcctgacagatgcaacactggcatccaatcggtgggaggaaggcgatggcaagctcgaacgacagtatctgtccaatatgtcctggacatatggtccgagtacagccagctggagcaagaaatacacagatagcaaaaacggtgaagtgaatgcttatgccgagcatctgcgcggaacacgtgcaacagtattttcccgctcatccaatctgcgcgggctgctcgataccgatcatccgtttgaatatctgggtggtatttccatggctgtccggcatctcgatggtgcggcgccgcaattatatatttctaatatgcgtgatccgaaccgcgcacaactggaagcggctgataaattcctcgcaaccgagctgcgatcagtctatcagcatccaaactggctggccgagatgatgaaagaaggttacagcggaactttacaagtgttgaatacgatcaataatttttggggctggcaggtcatggatcgcaacatcgtaagggatgatcaatggcaatcttttcatgagatttatataaacgaccattaccagcttggtttacgtgagtggttcgagcataaccatccggcagcactggcacaaattgttgagcgtatgctggaagcaattcgcaaggattactggcaggccggtgagcaaaccattcaggaactgataaccatctatatcgagctggcacaacagcatgatatccataccggtaacgaaactttcaaggcttatgtacaagagctgatgaccaattttggtatggctgcactggacaataaaccggcagaatcagcaaccaccacgctatcagatgctgtaccggctgattccgcgccgcaagtcaccggagaaactgaaaatatcagtgggcagcagatgagtgaa

SEQ ID NO: 43345 - DNA, 852 bp, Nitrosomonas europaea
tttggtgcaggggttctgaaaaaactgccggatatcatcgaaagttatggcaaccatattttgctggttaccggcgcgcactcctttatgaatactccctactggcggcttctgatcgatcagtttgagcatcgcgccatcacctggcgacatgccatggtagcggaagagccttctcctgctttgatcgatgacttcgtcatagattatgccaatgaacactttgctgcagtcattggcatcggaggtggcagcgtactcgatactgccaaagccgtagccgggttgctgcaagtacaacattcagtaatggattacctcgaaggagttggcccggagctgtcgtatcaggggccagccgtaccattcatcgctgtccccacgaccgccggcactggcagtgaggcaaccaaaaacgccgtactcagcgtgcaaggtgagaatggtttcaagaaatccttccgtcacgacaaactggttgctgaatatgcaatcgtcgatccggatttactggccagttgcccgcccggcgtcatcgctgccaacggtatggatgcgctgacacaattgctggaatcgtacgtatccctcaaagccaatgccctcaccgatgcactggcgatcagtggattgcaagctgttcgtgacgcactgctcccgttttatcaccagcaaggcgagctggcgcaacaccgggagaaaatggcttacgctgcactgctctccggtatcacgctggcgcaaacagggttgggttcggtgcatggcctggcatccccgctcggtgcgttctacccgattccgcatggtgtcgtttgcggtaccctggttgcagccgccacccggatcaac

SEQ ID NO: 43346 - DNA, 2658 bp, Nitrosomonas europaea
acagcatggcatgcgctgactctgccggaagtcaggcagatcctgcacaccgactcggccggtctgaaaacggacgaggtcaacgatcgctttgcccggttcggaccgaatagtctgatcccgcccaaacgccgcggaccactgctgcgcctgctgctgcaattccacaatgtcctgctgtatatcatgattgccgcagccgccattacggctgtactgggtcactgggtggatacaggcgtcctgctggcagccgtgatcatcaatgtcatcatcggtttcatccaggaaggcaaagcagaaacggcactcgattccatccgtgccatgctgtcaccacatgcgacggtcatccgagacggtactcgctatgagatcgatgcggccggactggtacccggcgatctggttctgctcgcttccggtgatcgggtgccggcggacatacgcctgatttcagtcaaagaactgcaggtcgaagaagctgcactgaccggcgaatcgctaccagtcagaaaacgaatcgagacagcactgccggacacgttacccggggatcgctacggcatggctttttccggcacactggtcgtttacggtcaggccagcgggatcgtcgtggcaaccggcagcgcaactgaactgggcaaaatcaatcgattgctggaagatactcagcatctgtccaccccattattacgccagatcgatcacttcggattcaaactggctgttttcatactggccgcttctgctgcgacttttctgttgggaaccctgtggcgtaaccatgcgccggcagaaatgttcatgatggcggtagctttgattgcttccgcaataccggaaggattaccggccatcatgacagtaacgctggcactgggtgtccagcgcatggcacggcgcaatgccattatccgaagactgcctgcagtcgaggcactgggatcagtgacagtcatctgctctgacaagaccgggacactgacgcgcaatgaaatgacagtgcagcggatcgtctgtgccgatcatacgatcgatgtcagcggagtcggttatgtaccgacaggtgaatacagtatcgatggacataccatcgaccctgcccattatccggcacttaccctggcgattcgttccggcgtgctgtgcaacgatgccttgttacgggaaaaggatggcctctggagcgtggaaggagatcccaccgaaggagctctgctgattctgggcgcaaagaacggtttttccaatcatcatgccaatacagcctggccgcgacgggacgtcatcccgttcgaatcccagcattccttcatggcaacgtaccaccatgacaatgagaatgaaccctggattttcgtcaaaggtgcgccagaacgcattctggatatgtgtaccacccagttgcagcagaatggtaaacagccgattgatatcgactactggcaacggatggtaagcgccacggctgctaaaggattacgcctgctggcactggcctgcaaacgatcagccccgcaggaagacagcctgaaaatcaatgatatgaaaacgggtttcactttacttgcgctggttggcatcatcgatcccccgcgtgaagaagccgttcaggccgtggccgaatgtcatcgggcaggtatacgggtcaaaatgattaccggggatcatgcagaaactgcccgtgctgtcggagcacaactggccatcggagccggcagaccggtactcaccgggatggaaatcgctgccatggatgatgataccttgcgtgacatcgtcatggatgtcgatatctttgcccgaaccagccctgaacacaaactgcgcctggtaaaagccctacaggccggtggtcaggtggtagcgatgaccggagatggagtgaacgacgcaccggcactcaaacgtgccgatgtcggtgtagccatgggaatgaaaggtactgaagccgccaaggaagcatccgacatggtactggccgatgacaactttgccaccatcgcttacgcagtacgcgaaggccgggttgtttacgacaatctaaaaaaattcatcctgttcatgctgcccaccaatggtggtgaagcgctcgtcatcatagccgccattctgtttgaattcaccctaccactcacaccggcacaggtgttgtggatcaatatggtgacagtcagtaccctagggctggcactggcttttgagccggcagaacgtaacatcatgaatcaccgcccaaggtcaccaaaagaagcgctactgtccggcttttttgtctggcgggttctgatggtatctgtattgatgatgattggcggactgggtctttttctgtgggagcagcacatcggggtcagcacggaaacagcccgcacgatggcagtcaatgccatcgtgatgtccgagatgttctatctgatcaatagtcgccatacctttgcatcagtccttcatctcgaagggctgaccggtaatcgttatgtcctgctggcgattgttgcctgcctgctgctgcagattacctatactcatctgcctaccatgcagtccatattcaattcgaccgatttgacgatgctgcaatggtgcaaatctatcgctgccggattgatggtgttttgtgtcatcgagattgagaaatcagtcatccgg

SEQ ID NO: 43347 - DNA, 798 bp, Nitrosomonas europaea
acgccgttaaacatagccgttgccggaagtaccggccgcatgggtcgggcaatcatggaaaccattgcagaagcagacgatctgcgattatccgcagcactcgagcaaccgggcaatccgtatctgtcacaagatgcgggcagcctgaccggaacacctccgggagtcgccatcagcagtgattatgtctctgcactggctggcagcgatatactggtcgacttcacgcgccctgccggcacgctgtcacaccttgccacatgtcgtaaactgggtgtcagaatggtgatcggcactaccggattttcaccggaagaaaaagacatcattcgtaatgccgcccaagacatcgccatcgtactggctcccaacatgagtgtgggagtcaacctgctgttcagattgctcgaagtagccgcaaaagcattgccggaaggctacgatgtcgaaatcatcgaagcacatcatcgtcataaggtcgatgctccctccggaacggccctgcgcatgggtgaagtaatcgcccaggcccagagcagggaccttgagaaagttgcgatttacggccgtgaaggcaataccggtgaacgccgtgcagataccatcggattctcgaccatacgtggcggagatatcgtaggcgaccacacggcattattcgccggaatcggtgaacgcctggaaatcactcataaagccagcagccgtaaaacatttgctgccggggcactgcatgcagcacgttttctcatgaccaggaaatccggattgttcgatatgcaggatgtattggggctg

SEQ ID NO: 43348 - DNA, 909 bp, Nitrosomonas europaea
atctgtggttccatcgcctatgacacgatcatggtgtttgaagatcgtttcaaacgccatatcctgccagacaagatccatgttctgaacgtcgcgtttctggtgccggaaatgcgacgggagtttggcggttgcgcggcaaatatcgcctacaacctgaagatgctggagggcaaaccgttgataatggcaacggtcggggatgatttccaaccctatacctacagactggaaaagcttgggctggcacagacacatatccgtcggatacaggataccttcacggcacaggcattcattactacggatctggatgataatcagatcactgcttttcatcctggcgcaatgaatttctcccatcagaacagtgtgaaagatgctatcgatgtcagtcttggtatcattgctccggatggccgggatgggatgcttactcacgcccgggaatttcatgaagccggtattcctttcatatttgacccgggccagggtatgccgatgttcagtggcaatgaactgactgatttcattgacatggcagattatatagcggtcaatgattatgaagctcagctgttacagtcagtcacaggctataaattgagcgagctggctacccgggtcaaggcgcttatcgagaccaaaggggcggaaggttcggtgatccatgcccaaggcaagcagtttcagatccctgctgttcgcccgcagaaagttgtcgatccaaccggttgcggagatgcctatcgtgccggattgctttatggcattgctcaggatatggattggcagacgaccgggcaacttgcatcactcatgggcacattgaaaatagctcatcgtggcggtcagaatcatcaatatcagcgtgatgagattggccagcgctactttgaagcttttggc

SEQ ID NO: 43349 - DNA, 378 bp, Nitrosomonas europaea
agcgttccggcagaactgaaatatacagaatcacacgaatgggtcagattggaagcagatggcagtgtcacggtaggaattacccagcatgcccaggaattactgggggacatggtattcgttcagttgcccgatgtcgggcgcgcgctggcacagcgtgaagattgcgctgtggtggagtcggtcaaggcagcatcggatatttatgcgccactgggtggagaagtcattgcagtcaactctgaagtggaaacatctccggaaaaaataaacgaggattgctacgcagcctggctgttcaagctcaaaccggccaatgctggtgaagtggatggtctgctcgatgccggcggatatcagaaactgctggatagcgaa

SEQ ID NO: 43350 - DNA, 2802 bp, Nitrosomonas europaea
atgagtctgaatacccgagcaaacattattcccgagaaaaacacgcccaacgaaaaagattatccgttgcgggaagatattcgtttgctgggacgtatgctgggggacaccatacgagagctggaaggtgaaacgatgttcaacctagtcgaaaccattcgccagacatccgtacgcttccggcgagatcaggatgaagcggccgaacacgagctcgataccatcctcaaccatctcagccacaaggaaaccatcgctgtcgtacgagcatttagttatttctcactgctgtcaaatatcgctgaagatttgcaccacaaccgccgtcgtcgtgcccatttgcgtgcaggctcccctccccaggatggcagtgtcacgctggctctgcaacgcgtagtgaaaaaaggcatcgatgccgagcaactgcagaatttttttgccagcgcattgatctcccctgtactgacagctcatccgactgaagtgcagcgacgcagcatcctggattatcagctgaagattcagcgcctgctcaaagaacgggatcgtacccagctcacacccaatgaaatgcgccacaacgaggaagatctgcgttccgccatccagacactatggcagacccgggtgctacgttccgtcaggctgacggtacaggatgaaattgagaatggcctgatctattaccactacacttttctccggcaaattccctatatctacgccaagctcgaggatatcctggaacgccacatggacaaggcagcgccgcgcattgcctcatttctacggatcggcagctggataggtggagaccgggacggcaaccctttcgttacccaccagatcatgctgcatgccgctgagcggcactcggcactgatacttgatttctacatcagcgaagtggaaagaatcggccagaccatgagtctgtccgagcgtctgatcaaggtcagcagtgatctggaaggactggcttccaccgcacccggcctgccggccagcaggatcgatgagccctaccggcgtgtatttctcggcatccatgcccgtctgatcgcaaccagcagacatctgggatcgtccattcgtggatgttgccaggaaaacaatgccgaaccttacgccgacagtgccgaattcgtacatgatctcgatatcgtcatccgttcattgagacaacaccggtcagacagactggcccagggggctttacgtgatctgcgacgggcggcagatgtattcggtttccacctggcaccgctggatatgcgccagcacagcaagattcatgaacaggtcatctctgaactgtatgagaaaaacacccgggacgaccggaattacctcgagatgtctcgctctgaacgtgttgaatggctgctggccgaactcaggcatccacgttcactggtcacctctttttcagatttctccgacgttacccagggcgaattacgcatcctgaaaatggctgctgaaatccagcgccgtttcggccacgccgcactgcccaactacatcatctcgatggcaaccggcgttgtacatatcctggaagtggcattgctgctgaaagaagccggattattgcaatttggtgatgacccgcgctcgaccgtaaacatcatcccgctattcgaaacgatcgatgatctgcgcggctgcgccagcgtcatggatgaattgttttctcttccggattaccgcaagttactgctttcacgagacaatctgcaagaagtcatgctgggttattctgacagcaacaaagacggtggattcgttacttcaaactgggaaatctataaagccgaaatcgagctgactcgggtattcgatcgccacggagtaaggctgcgtctgttccacggccgcggcggtacggtaggacgtggcggtggtcccagctatcagggaatactggctcagccaccaggcagtgtcagtggccagatccggctgaccgagcagggtgaagtcatcgccagtaaatatacagaccctgaaatcggacggcgtaatctcgaaaccctggttgccgccaccatcgaatccacactactggatcgtgatgccgtccattatcacgcaccccattatcaccagatcatggaagaactgtcttccagtgcgtgtgctgcctatcgcgatctggtctataaaacaccgggattcaagcagtttttcctggaatccaccccgatccgtgaaattgccggtctgcatatcggcagtcggccgacttcgcgcaaaccttctgacaaaatcgaagatctgcgggcgattccgtgggtattcagctggagcctgaatcgcacgatgattcctggctggtacgggtttggtacagccgtggaaaatttcgtgcagcaagccgggaatgagcaggaagcattgaaacaactgcaggagatgtatcgcacctggccttttttgcaaaccctgctgtccaacatggacatggtgctgtcaaagagcgatctgggtatcgcctcgcgctacgccgaactggtaactgatcccgaattacgacaaagcgttttcaccagcatccgcactgaatgggagctttgtatgaaatggctgtttgccattaccggctattctgaacttctgcaggataacccgactctggcgcgcagcatccgtatccggacaccctatatcgacccgctgaaccacttgcaaatagaactgctccgccgctatcgctcgggagatgatgacgataccgttcgtcgtgcaattcatctgactatcaatggagtcgctaccgggctcaggaacagcggttaa

SEQ ID NO: 43351 - DNA, 549 bp, Nitrosomonas europaea
atgaccatcccgtcgctttcacccccccggctggcgattctggctgctgtttcagccaaccgggtaatcgggctgaataatacactgccttggcatctgccggctgatctcaagcatttcaagcaactgaccaccggccagatcgtcgtgatggggcgccggacgtttgattcgattggcaggccactgcctgatcgtaccaatgtcgtgctcacccgacaacgtcactttaatcagcccggtatcctcacggcaggttcgatacaggaagtgctggagcatttttgtggtgacgatcggcagatcttcatcatcggtggtgctgaaatctatcagcagacgttgccgttctgccagcgtttatatctgaccgagattcagcaggatttcgcaggagatactttctttccggagtatgatcgtgacaactggcgggagatctcccgtgaaatgcatcaggcaacagatagcggcatcgaatatcacttcgtggtactggaccgcaagcagccggtcaatgcaggtgcctgttcgacagatttatcctga

SEQ ID NO: 43352 - DNA, 1893 bp, Nitrosomonas europaea
aacatcgaacatttgaactttcaggctgaagccaaccagcttttgaagctgatgatccattccctgtacagtaataaagaaatatttctgcgagagttgatttcgaatgcatcagatgcggcagacaagctgcggtttgaagggttgtccgatgcggcgctgtacgaatccgaccctgatcttaagatccgtattgcttacgataaagaggctcgcaccatcacgattatcgataacggtatcggtatgtccagacaggaagtgatcaataatatcgggactattgccaaatccggtacgcgtgaattttttgattcactgacaggtgaccaggccaaggatgccaacctgatcggacagtttggtgtgggtttttattcggcattcattgttgcagataaagtaaccctgactacgcgccgtgctggattgacaatcgaacacggtgtgcgctgggaatccggtggcgagggtgagtacacgctggaaactgtggaaaagccggatcgaggtactgaaatcgttctgcatctgcgggaaggagaagatgaactgctgagcagttttcagctgcgttccatcatccgtaagtactctgaccacatcacgcttcccattgtcatgaaaaaggaagtgtgggatgacgagagcaaatcgtaccggctgagcgacgaggatgaaaccatcaatcaggccagcgcgatctgggcccggccaaagaatgaaattacgcaggagcagtacgacgaattctataagcacgttgctcatgatttcgaaccgccacttgctcatgtgcatgcccgagtcgaaggtaagcaggaatatatccagttgctgtatatcccggctcatgccccgtttgatttgtttgatcgtgaacatcgtcatggcctcaaactttacgtcaggcgggtattcatcatggatgatgcggaaaaactgttgccaggatatttgcgttttgtccgcggtatcatcgattcaagtgatctgcccctgaatgtctcgcgtgagatcctgcaggaatcgaaagatatcgacagtattcgtgcaggctcagtcaagaaggtgctgggattgatcgaagatcttgccatgagtgacaagagtgaagatcaggaaaaattcaaaaccttctggcgcgaattcggccaggtgctgaaggaggggattgcagaagactatagcaaccgcgagcgtatcgccaagctgttgagattcacttcgacacatgatgaacgtgaagaacagaccgtttcgctggatgattacattgcccggatgaagccggaacaggaaaaaatctattacattactgctgacggcctgaaggcagcccaaagcagcccgcatctggagatattccgtaagaagggaattgaagtgctgctgttgtgtgaccgtatcgatgaatggctggtggccaatctgaatgaatatacgggcaagtctttacaatccattgccaagggtaatctggatctgggcaaactggaagatgaagaagaaaagaaagagcatgaaaaagaggctggagattttcaggaattgacaaacaaaatgaaggaagtgttgggcgaacaggtaaaagatgtgcgcatcacctaccgcttgacagaatcaccagcctgtctggtcgctgatactcatgatgtgagtggcaatcttggacgcttgttgaaatctgccgggcagaaagttccggacagcaaacctttcctggaaatcaatccacatcacccgatgattcagcggttgaaatatgaagaagccaagtttgccgactggagtcatattctgtttgatcaggctttactggccgaaggggggcagcttgaggatccggccggtttcgtcaaacgactgaatgatttactactgcaaaacatc

SEQ ID NO: 43353 - DNA, 2136 bp, Nitrosomonas europaea
atgattaatattgaaattgatggcaaacaggtaacggttgcgcagggtagtaccgtaatggatgctgccaggcagatcgggatctatattccgcatttttgttatcacaaaaagctgtcaatagcggctaattgccggatgtgcctggtagaggtcgaaaaggcacccaaaccgttacctgcgtgtgcgacaccggtagccgaaggaatgaaagtatcgacacattctcagcaggcggtgactgcacaaaaaggggtgatggaatttctgctgatcaatcatccactggattgtccgatttgtgaccagggaggggagtgccagctacaggatctcgctgtcggctatggttcaagcggttcccgttatcaggaacccaaacgggctgtgaccaacaagaatcttggtccgctcatagcaacggatatgacccgctgtatccactgcacgaggtgtgttcgttttggccaggagatcgccggaatcatggagcttggaatggctggccggggagaacattccgagattctgacgttcgtcggcagagcggttgattctgaactttctggtaatgtaatcgatttatgtccggtcggtgctctggtcagtaaacctttccgctattcagcaagaacctgggagttatcacgcagaaaatcgatcagcccgcattgcgggctgggtagtaatctggtcgtgcaagtgaaaaaaaatcgggtcatgcgcgtattaccgcgtgagaatgaagccgtcaatgaatgctggttgtcagataaagaccggttctcttatgaaggactgaattcggaagaccgtttgacggtaccaatgatcagaaaatccggacagtggcaggtatgtggctggcaggaggctttggcctatgctgctgagggcatcagcaatgtcgttaaaaatcaggggccgctgagtataggtgcattgggatctgctcatagcacgttggaggagctctacttactgcaaaaactgatgcgtggactgggcagtcacaatatcgatcaccgggtacgtcaatctgattttcgtaccgatgccgtattgcgtggagcaccatggctgggaatgcaaattgccgaggtttcacagttaaaagctgtgctggtcgttggcagtacactgcgtaaagaccatccgctgcttgcccagcggatgcgtcaggcagtaaaagagggggggcagttaagtctgatcaatccatcaggtgacgatcagttgaccaagattgcctatcgcgcgattgttgctccttcagctatgcttgacatggtattacaggtactgaaagcagcagcagaaatcaagaatattcccgtgcccgggcatattaaatctgcagcaaatgcagttgaagtttctgaagttgcacggggaattgcgaatagtctcatcaaccacgctccagctgctgtttttctgggtaatcttgctcagcatcaccctcattttgctgatctacactgtgcggcactggctgtttcgaaaataaccgaagcacagtttggtttgctgggtgaagctgcaaatagtgtgggagcctattctgcgggtgcgttaccatggagcaccgggactcattctgtaaataaaactgtatcagagaaggttggtttgaatgcgggacaaatgctagggttaggttcacctgatggtgaaccagcctgtagtgcttacgtactgttgaacctggagccggaactggattgttatgatacggggcgggcgcttcaggtaatgaataaagctgaatttgtagtttcattgagcagttacaaaggtaacattcctgattatgccgatgttattttgcctgttgctccttttactgaaacatccggcacttttgttaatactgaaggaaggatacaaagtttcagtggtgtagtacctcctctcggtgaagcacgtcccgcctggaaaatcttgcgggtattgggaaatctgttgcaattggaaggattcgattacgattcatcagaacaggttcgtgcagaaatagtgtctgcagaagaagaatttgtacgtggcttgaataacgctttggaagcgttttcaatttcagaaaatcatcaaaaaaatagtggcattgaaaggattggtgagataccaatttat

SEQ ID NO: 43354 - DNA, 747 bp, Nitrosomonas europaea
cgtgcagggtttgtggccgggaactggaaaatgcatggcagcctggttcggaatcaggagttgcttgatgcggttgtttcaggtactcgctcgttgcagaatgtatcctgtgtggtgtgtgtgccttacccctatatagcacagacacagtcagtgcttgagggctctcatgtgctatggggggggcagaatgtcagtcagtaccaccacggagcttataccggggaagtatcggcagatatgctggccgatttagggtgtcggtacgtgattgtgggtcattcagaacgacgaacactgttcggcgaagggaatcaggtcgtcgctgaaaaatttcgtgctgcacaagagcgttcgataacaccaatactttgtgtaggtgagaccctggctcagcgtgaatcggatgagactgaacaggtaatcgctatgcaactcgatgccgtgattgatctggcgggtatcgaagcgctcggacaatcagtcatagcttatgagccggtgtgggcaatcggtactggcaaaactgctactccccaacaggcgcaggatgtccataaatttataagaagtcggatagctgttcatagtggcgggattgctgagaatatccagatactttatggtggaagtgtaaaagcagataatgcacgtgaattgttcacaatgcctgatatagatggtgggctgatcggaggggcttcgctggttgctgcggagtttatttcgatttgtctggcagcacag

SEQ ID NO: 43355 - DNA, 735 bp, Nitrosomonas europaea
aaactcgttctcctgcgacacggagaaagtatctggaatcaggaaaatcgctttaccggctggactgacgtcgatttaacgcccaagggactaaaagaagccgaagaggcaggcagattgcttcgcgaaaacggtttctccttcgacattgcttatacatctctactcaaacgggcaattcgtacactctggatcgcactggacgaaatggatcagatgtggaccccgatcgagctcaactggcgactcaatgaacggcattacggggcacttcagggtttgaacaaagcagaaaccgccaaacaatatggcgatgaacaagtactcgtctggagacgcagttacgatatccgcccaccttccatcacaatcaacgacgaacgctatcccggctttgatcttcgctacagaaacatgtcatccggcgatattccgcttgctgaaagtctcaaggatacggttgcaagatttctgccctactggaatcagtcaatcgctccacaaatcaaggcagaaaaaaaggtaatcattgctgcacatggaaattcgctgcgcgctctgatcaaacacctcgataatatctcggaccaggatatcctgaattgcaatatacccacagggattccgctagtttatgaactggatgacgacttgaaaccactcaacagttactatctgggagatgctggccaaattggggaagccatttcggcggtcgccaatcagggtaaatcc

SEQ ID NO: 43356 - DNA, 1677 bp, Nitrosomonas europaea
ttcctcaaaccttataaactatcgttaagttttagtctggcagcgttattcctgactgccggaattaccttatcgctagggcaagggatacggctgatggtggatcgtggattcgctacacagtcgcctgatctgctgacccggtatgtgttggtttttctgttgttggtggtactgcttgcgataggtacgtttacacgttactactgggtgacctggctgggggagcgggtgatcgcagatatacggcgcaaagttttcgcacatctgatcgagctgcatcctggatttttcgaagccaaccgtagccttgagatccagtctcgcttgactgcggatatgactttgctgcaatccgtagtgggttcttccatttcggtagcgttacgtaacctgattatgctggccggtggcatcgtctggttgtttattaccaatgtcaagctgacggtgatcgttatgctgagtattccattggtcatagttcccatcttgctgtttggccgacgcgtgcgtgtgctgtcgcgacaaagccaggatcgggtagcggccgttggcgcttatgttggggaaatgcttgggcagatcaagacagtgcaggcctataaccatcaggcaatggataaaatgcatttcgatcagtatgttgaggatgcgtttcatatcgcccgccagcggacattacaacgtgcctggttgatcgcggtggtaattgttctggtattcggtgcgatcggtatgatgctctgggtcggtggcatggatgtgatcgaaggtaaaatcagtgggggagaactggcggcattcgttttttacagcatcatcattggctcggcggtagggtcgatatcagaggtactgggggaattgcagcgtgctgcgggggctgcggagcgaaccatggagctgttggaggagcccagccagatcagttcgcctgtcgatcctcgtcaattgccggcagtgacaggcaatatcgtgttccagcgagtatgttttgcttatccatcacggcctgaaatacaagtgatcaatgatttttcattggcggtacgcccgggtgaaacgttggcgctggttggtctctcgggcgcaggcaaatcaactttattcgatttgctgctgcgtttctatgatgtgcggtcgggctgcatcagtctggaaggtgtgaatatccgcgatctggatttgtctgatctcaggcgcagttttgcattggtatctcagaatcctgtgctgtttcatggcagtatcgagcagaatctgcgttatgcgtgcccggatgcttcggatgcggaaatcgaaatggcggctaaagctgcttttatacatgatttcattgtttctctaccacaaggttaccagaccagcctgggtgataccggactggggttgtcgggtggccagaaacagcggctggcaattacccgggctattctggcagatgctccggttttattactggatgaagctaccagtgcactggacagtcagagtgagcactgggtgcaacaggcaattaccagattgagtacaggcaggacaaccattgtcattgcccatcgcctgagtaccatcctgacttctgatcgcattgctcttattcatcatggccgtctggaagcactgggtacacacgtggaattgatggaatctagtgaactgtatgcgcgtctg

SEQ ID NO: 43357 - DNA, 1320 bp, Nitrosomonas europaea
gtgtcatttgaaaatttgaatctgcatcccgcaatcgtaaaagccgtactggcagcgggttatactgcccccacccccattcagcagcaagccattccggatctgatcgcaggccatgatgtcatggcaagtgcacagaccggaaccggcaaaacagccgccttcatgctgccggcattgcatcgtctggccacacccgcacaaattcgcggacgtggcccgcgcatactggttctgacaccaacacgtgaactggctctgcaggtttccgatgctgccagcaaatatggaaaattcctgccacgtatcaatgtcgtcagtattctgggcggtatgccctaccccctgcaaaataaactcctgtcacaaaccgtcgatgtactggtcgccacacccgggcgtttgatcgatcacatcgaacgcgggcggatagatttttcgcggctggaaatgctggtactggacgaagcagatcgcatgctggatatggggttcatccaggatgtcgagcgcatcgctctctcgacacccgcaaccaggcaaacgctgctgttctcggcaacgctggacgttgcaatcgagaaaatcgccacacgtctgctgaaagcaccgaaacgcattcaggtggctgctcagcataccaaactcgatcacatcgaacagcgtatgcattatgtagatgatctcacgcacaaaaacaggttactggaccatctgctgcgtgacaccaccatcaaacaggcaatcgtatttactgcaacgaaacgtgatgccgattccctcgcagataatctttcttcccagggacacaaggctgccgccatgcacggagacatgacgcagcgtgaacgtacacgcactctgaccggcctgcgtcagggccggctcaagattctggtggctacggatgtcgccgcacgcggaatcgatattgccgacattacccatgtcatcaatttcgatttgccaaagtttgcagaagactatgtgcatcggatcgggcggaccggccgggctggcgcttccggtatcgcagtttcgttcgcatccgggaaagatgttgctcatctgaagagaatcgaacggtttaccggcaatcgctttgaatttcatgtcatacccggtatagaaccacgtaccaaaccaagatttggtcgtagtgacgacaaaccaggaagaagaccatcttcctctgctgctgcacacaaaaccagacgttcatggtcggacaatcccaatacacgcacggcttccccaggtcaccgaggagacaaagatgctgggttcgggcaaccatttggtcgtgaaacccgtaaacgt

SEQ ID NO: 43358 - DNA, 1152 bp, Nitrosomonas europaea
ttggatatccatgaatatcaggccaaggaaatcctggctgaatacggtatcaagctggctgaaggcggattggcgcacactgtggaagaagcggtacaacgcagccgggaaatcgatggcaatgtgtgggtcgtcaaggcacaaatccattccggcgcccgtggtaaagcaggcggtgtcaaagtatgccggacacatgaagaaatcgaagtcgcagctgaatcactgctggggaaaaaactggtcacacaccaaaccggcccggcgggtaaactctgctccagactgtatatcgaagccggtaccgaaattgcccgggaagtgtatctcgctttcatgatcgatcgcagtcatgaacgtatcgtcatggtgggttccgcacaggggggaatggatatcgagaccctggcagccacgaatcctgatgccatcaaaaaaattcacatcgagcctgctgtcggcctgcaggatttccaggcaagaaccatggcttttgcactgggtctggaagatgttctgctcaatcacgccgtcaagacgatcagaggttgctaccgcgccatgcgcgatctggatgcgaacatactcgaaatcaacccgctggttgtcacgcgcaacaacgagctgatcgcactggatgcgaagatgagctttgatgaaaatgcactgttccggcgccaccggatttccgaattgcgtgacaactcacaaatcgattcgcgcgaaattgctgcagcggaagcaggcttgagctacgtcgggctggatggagacatcggctgcatgatcaatggcgccgggctggcaatggccaccatggacatgatcaaactggccggcggcgaaccggccaattttctggatgtcggcggcggcgcatctgccgagcgaactgaaaaagcattccggctggtactggcggataacaacgtaaaagccatgctggtcaatatctttgccggtattaaccgctgtgactggattgccgaaggtgtggttcaggctgtacggaatatcggaatgacggtccctctggtcgtgcgcctgtctggcaccaacgtggaagaaggccgccgtatcatcgctgacagcgggttgccgatcattactgcagaaaccctggccgatgcagcagagaaagtagtgcacgct

SEQ ID NO: 43359 - DNA, 780 bp, Nitrosomonas europaea
gtggcaattctcatcaatgagcagacgcggatcatcgtacagggctttaccggccggatcggcaccttccatgctcaggaaatgatcgattacggatctaatgtagtgggaggcgtaacgcccggcaaaggcgggcagaaacacctggggctgccagtattcaataccgtccgggaagcagtcgagcaggcaggtgcggaagccagcattgtattcgtcccgccggcatttgcggctgattcgattatggaagcagccgatgccggtatcaaatattgcgtatccatcaccgatggcattccaacccaggacatgatgaccgtcaaaaacttcttacgcctcttccctgaggaggacagaatgatgctgaccggccccaactgttcaggcactatcagccccggacgggcgatgttgggcatcatgccggggcatatttacagccgtggggtcgttggtgtcgtcggccgttccggtacactgggttatgaagctgccgaccagatgcgacggctgaatatcgggatttcgacttcggtaggtattggcggagacccgatcatcggcagttcgcaccggaatgtgctgcaaaagctggaagaagatccggaaaccaaagtcacgctgatgattggtgaaattggtggcccaatggaagtagaagccggactgttcgcaaaggaaaacatgagcaaaccgctggttgcctacattgccggcctgactgcacctcccggaagacggatggggcacgccggagcaatcatctcttcagccggt

SEQ ID NO: 43360 - DNA, 2205 bp, Nitrosomonas europaea
ctggtttctgcaatggcagttgccatatccaccgtgttgacggtcaatccgatccaggccgagtcgcaaccgcaaccgacgatgaacagtttttggtggccggatcaactggatctgagaccgttgcgccagaattcggctgagtctaacccgttgggcaaagcgttcaactatgccgaacagtttaaaacgctcaacctcaaagcggtgaaagaggatatcgcgaacgtgctgcatacttcccagccttggtggccggcggactacggcaactacggaccattgttcattcgcatggcctggcatagtgccggcgtgtaccgcattttcgacggacgtggtggcgcttccggcggatagcaacgcttcgaaccgctcaacagttggccggataacgtcaatctggacaaagcgcggcgcttgttatggccgatcaaatagaaatacggcagcaagctttcctgggctgatctgatggtgctggccggcaatgtggcgttggaggatatgggattcaaaaccataggttttgcgggtgggcgaccggatgattgggaagccgagatcgtcaactggggaacagaaaaggaatttctcgccgatgagcgccatgataaaagaggtgaactggcgaagcctctggctgccgtgcagatggggctgatctacgtcaacccggaagggccgggcggtaaccccgatccgttggcagctgccaggcatatccgcgaatccttcggccgtatggcgatgaatgacgaagagacggtggctctgatcgccggtggccataccttcggcaaggcgcacggggcgcataagccggaagaatgcgttggcaaggaaccggccgcggctggtatcgaggagcaaggtttgggttgggccaataaatgtggcagcggctatggcgtcgatacagtcaccagtggtctggaaggggcgtggtcgaccaatccggcgcgctggacgcatgactatttaacttggctgtacgctttcgaatgggaaacaaccaagagtccggccggtgcgacgcaatggattccgaagggcggcaaaggcgacaacttcgttccagacgcgcacgatccgactaaacgccatgcaccgatcatgtttacaaccgatatcgctttgaaagtggaccctgagtaccagaaaatctccaagcgttttctcgataatcccaaggaattcggaattgcgtttgccaaggcgtggttcaagctgacccatcgcgacatgggacccaaggcccgctacgtcggtgctgagatacctgcggaagactttatttggcaggatcctatccccaaagttgatcacaagctgatcgacgcccaggatatcgccaggctgaagtcggcgatcctggcctcgggtttgacgatacctgagctggtccggacggcatgggcttccgctgctaccttccgcggtaccgatatgcgcggcggtgccaacggcgcgcgcattcgcctggcaccacaaaaggattgggaagtcaatgatccagccgaactggccaaggtgctgactcgtctggaatccatccggaacaacttcaatcgtacgctgaaaggcggcaagaaagtgtcgtttgctgacgtgatcgtgctgggtggttccgcggccgtggaagaagctgccaggaaagccggttacaaggtgcaggtacctttcaaaccgggccgtatggatgccgcgcaagcgcaaaccgacgtcgagtcgttcgcggtgttggagcctaaagccgacggcttccgcaattattttggtaagggtaatgcgtattcgcctgcggaaatgctggtcgagcgtgcgaacttcctgaccttgagcgtacctgaaatgacggtgctggtcggcggcatgcgggcgctggatgccaatgctggtcattcccgacacgggatattcaccagccggcccggtaccttgaccaatgacttctttgtgaacctgctcgatatgtctactaaatgggcaaggtcggcaaccgagggtctttacgaggggcgggatcgcgctaccggccagattaaatggatagctacgcccgttgatctgatcttcggttccaactccgagttgcgtgcggttgccgaagtttatgcatcggacgataccaaagagaaattcgtacacgactttgctcaggcatgggcaaaggtgatggacctggatcggtttgacacacgc

SEQ ID NO: 43361 - DNA, 927 bp, Nitrosomonas europaea
ctgatggtttttaccggaacggccaatccgaaactggcacatgatgtagtcaaatatctgaacatcaatctcgggcgtgcaaacgttgggcgtttcagtgatggtgaagtcatggtggagatacttgaaaatgtcaggggtaatgacgtttttgtattgcaatccacctgtacaccgaccaatgacagcctgatggaaattctggtgatcgtcgatgcgctgaaacgtgcttcagccagccgtgttactgcggcaattccctatttcggttatgcgcggcaggatagaagaacccggtctgcgcgggtacccattaccgccaaagttgtggcaaatatgctgaccagtgtcggagtggacagggtactgaccatggatttacattccgaccagattcaggggtttttcgatattccggtcgataacgtctacggcatgccgattctgctcggggacatctggaagcatgactatcagaacctgatcgtcgtttcgcccgatgtgggcggcgtggtacgtgcacgccatcttgccaagcgcctggaatgtgatctggccatcatagacaagcggcgtcccaaaccgaatgaatccaaggtcatgaacatcatcggtgacgtcagggggcgtacctgcgtgatcatcgatgacatggtggatacggcaaacacattgtgtgaagcggcatctgcgttgaaacgggaaggtgcagccagcgtgatcgcctattcgactcatgcggttctgtcagggaaggcagtggaacgtgtccagacttcggatctggataaactggtggtaacggatacgattccgttaagagaagatgccagcaaatgtaaccgtattcatcagttaagcgtggccagcctgctgggtgaatccatgctcaggataagtaacgaaagttcgctgagctcgctgttt

SEQ ID NO: 43362 - DNA, 639 bp, Nitrosomonas europaea
tttccagcgccggccaaactcaacctgtttctgcacgtgatcggacgtcgggaagatggttaccatctgttgcagaccgtcttccgctttatcgaccattcagatcgactgcattttgacatcactcatgatggtgtcatcaggcatgagaacctgattcccggcctgacggaaacggatgatttatgcgttcgggcagcaaaattgttgcggcaacggtttggcagagagtcactcggagtgaaaattcatctggaaaagaacattccgctgggcggagggctgggcggaggaagttccgatgcggccacaacactgattgccctgaacaggctgtgggggatcaactggaaaagagaacgcctgatggcactgggactggaattgggcgccgatgtgccggtgttcatctatggcaggaatgcatttgccgagggagtgggggaagaactgcatgctgtcgatttgccatcggcctggtatgtcgtgctgacgccgcctgtccagatttccacagcggcggttttcaccagcaaagagttgacacgaaatacaattcctatcaaaatggcggccttttccatgggacaggggcataatgatcttgagcccgttgcgatgcgcatgcagcctgtcatt

SEQ ID NO: 43363 - DNA, 564 bp, Nitrosomonas europaea
ctcctggttctggtcgggtgtgccgggccggaggttcatcagggagaagtgactacagtcgtcattcaaccggtacaagagcaagctgatattgcgaatgagccttttgtactcactggcaggttggcagtgaatgccagacagcatcggttttccgggggaattcgctggcagcataccgggcagagtgatgaaatttacctgttttccccgcttgggcagatcgttgcagagattttcagggatcagaccggcgtgcgtctggttacttctgagcccgccatttatcgggcacagaatgcggagtatctcaccagccaggtactgggctgggagctgccgcttgccggtatgcggttctgggtgcgcggaacccattttccagatacggttgctgaaaaagatctggataagaacagacgtacggtagccattcgtcaggatgggtggcaggtggtttaccagaattattatcctgcacaggagggtatgtctgttttaccaagattgctggaatttagtcggccggatgtgaaaatgaggctgctggtcgatcagtggcag

SEQ ID NO: 43364 - DNA, 468 bp, Nitrosomonas europaea
atgaactattatacttttctggaaagtcctgtggatcgactgttactcacgagtgatggtgagtttcttacaggcgtgtatatggaaatagagatacagaaactgctgcctcgcatgacagatgactggcggcaggatgccgcccctttcgcagaggcgattgctcagttgaatgcttatttcgcgggggaactgattcagtttgatctgcccatgaaagcgactggcacaccatttcaggaagcggtttggcaatcacttagcactattccctatggtgagactgtcagttataaaaatatcgcagaacgcctgcacttacccaaggccgcacgtgcagtgggtatggccaatggtcagaatcccatttcgatcattatcccctgtcatcgtgttatcggtgccaatggcaagctgacaggttatggggggggaattcatcgtaaacagtggctgctggcacatgaa

SEQ ID NO: 43365 - DNA, 1287 bp, Nitrosomonas europaea
atcaaaataaggcgattgtcatccgttgatgaccatttccaggcagaactcgaccaattgttgagttttgaagtttctgtcgatagcgagatcgaacgcaccgtcactcaaatcctgcatcagatcagaacacatggggacagagcgttactcgagcttacacgccagtttgataatccggatattgaccggatcgaagaaatcgaactgccccgggatgagtggcaatctgctttgatgtcgttggataaggtacaacgtgaggcgttggagcaagctgcttcccgtatacgagcctatcatgaaaaacagttggcccaatcatgggattacgttgagctggatggcacgcgactggggcagaaaatcaccgcactggaccgggtcgggctctatgtacctggaggtaaggctgcctatccttcatctgtactgatgaatgcaattcctgcccgggtagcgggtgtcagggaattgatcatggtaacgccaacgccaaaaggagaaaaaaatccactggtgctggccgctgccgcaatctgtgaagtagatcgtgtttttaccattggaggtgcacaggcagtcgccgcgctggcttatggcacaaccaccgtcccaaaggtggataaaatcgtcggacctggtaatgcttatgtggccgcagcaaaacgacatgtctttggtacagtcggaattgatatgctggcagggccatccgaaattctggtgatctgtgatggaaaaaccaatcctgactggattgcaatggatctgttctcacaagcggagcacgatgaacaggcacaatcgatcctgctttgcccggataaagcattcctggatcgggtagcagacagtatttcccgcctgatcgatacattgccacgccgagatgtaattcgttcttcgctggagaaccgcggtgctttgattcatgtgcgtgatctggaagaagcctgcatgattgccaaccggatcgcccccgaacatctggagctgtccgttgatgagccggagcaatgggtggatagcatccggcatgccggcgcaatttttcttggacgatatacttgtgaagcactgggagactattgtgcagggcccaatcatgtccttcccacctccggtacggcacgcttttcctcaccactgggagtttacgattttcagaaacgtaccagcctgattcaggtctcagcagccggagcatccaggttgggtgaaacggcatccattctggcaaagggagaaggtctggatgcccatgccagatcagctgaatcccgt

SEQ ID NO: 43366 - DNA, 675 bp, Nitrosomonas europaea
ttgcagcaaaaggttgagcagttgcacagtttgttaggcaatattcagcgggattattctcctgccgtgtttgccagtagttttggtgctgaggatatggtactgacggatctcattgcgcgccattatcctgaaattggcatatttactctggataccgggcgcctgccggaggaaacctatgatctgatgcaaaaggtaaaagagcgttatggtgtttccattcatgcttattttcctgatgcatcggctgttgagcactatgtagcacagcatgggccaaacgggttttatgatagtgttgccttgcgtaagcgttgttgttacatacgtaaggttgaacctctgaaacgtgcgctggctgataaaaaagcctggattacggggatgcgtcgtgatcaatcgacgacacgtgaagaattagagctatcggcatacgatagcgatcacggtctgcacaaattcaatccactctgtgactggaccgagaaggatgtatggaattacatcaggcagcacgatgttccctataacgcattgcatgatcgcttttatcccagtattggttgtgccccctgcacccgggcgatcacgccgggtgaagatattcgctcagggcgctggtggtgggagaatcccgaatccagggaatgtggtttgcatacccggaaaata

SEQ ID NO: 43367 - DNA, 1647 bp, Nitrosomonas europaea
gagtcacttaaggctgaaagtgattatttgcgtggcacaatcgcacttggtctgttggatcgcattacatccgccgtgcccggcaacgatatcaagttgatgaagtttcatggtatttatgaacaggacgatcgtgagattcgtgatgagcgccgccgccagaaactggaacccgcttttcagttcatgattcgtgtacgcttgccgggaggcatttgtacgaccgaacgctggttaaagatctcagaactggcctgcgcacatggcaacgaaacattgcgcatgactactcgacagactttccagtttcactgggtgctcaagcagaatatcgttccgttgatccgtggtcttcatgaagtattgcttgatacagtagctgcatgcggagatgattcacgtggagtaatggcgactgtcaacccgcaattccctgcactgcaggcagaacttgcagcactggcaaaaacagtgagtgatcacgtcattcccaaaacccgggcctatcatgaaatctggtatggcgaagaacggattgcttcgtccgaaccggaagagccattctacgggcaaacctatatgccccgtaaattcaaaatcggattcgtaatcccacccaataatgatattgatatttatgcccaggatctgggttatatcgccatcattggtgaaaacgggaaaatagcaggtttcaatgttgcaatcggtggtggaatggggcgtaccgacaaggcgccacatacctatcctcgtactgcatcagtcatcggtttcattacgccggacagacttatttctgttaccgaagctgtcatgggtgttcagcgtgactatggcaatcgtgccgatcggtcacgtgcccgctttaaatacacaatcgacgataaaggactggactggatcaaacttgccattgaagatcgagccggaccgctcgaatcggcacgcccctatgactttacctccaatgcggatatctacgggtggattgaatcgggtgatggatttcatcacttcacactgtttatcgagaatggccgcttaaaccgcgatatgcttgataaaattgcacaaattgcacatgttcacaaagggcattttcgcctgactcccaaccagaatctcatgattgccaacgttgccacggctgacaaacctgagatagaagcattactaagagaaacaggattaatcgcctttaacgagcgcagtgtactgcgtttgaattcaatggcgtgtgttgccctgccaacctgcggcctggcaatggccgacagcgaacgttatctgcccgatctgattacgaagatcgagggaatccttactcggtacaacctgcaaaatgaaccgattacactcaggatgacaggatgtcctaatggatgcagtcgccctttcattgcagaaattggactcaccggtcgcgcgccaggtaaatacaacctttacttgggtggtggctttcacggccagcgcctcaatcgtctttaccgcgaaaatatcggtgaaccggcaatccttgaaacccttaacgaagtacttggtcgctatgcaacagaacggttgcctgatgagcactttggtgattttacgattcgcgccggtattatccgtgaggtaacggaaggacgcttctcgaatgac

SEQ ID NO: 43368 - DNA, 647 bp, Nitrosomonas europaea
atattacaaccggatcaaatccggaatataccattttatggatgcacgggctgggagccgatggcaatgatttcgtacctgttgtacaagcgctcgatttaccggaaatcccgatccgatttctatttccacacgctccccagcagcctgtcaccatcaatagcggatacatcatgcgagcctggtacgacatccaacatactgatttcgtcgaacaggaagatgaaaccgggatacgcagatcacagcacgcaatcgtagagttgatcgaacgtgaagatcgacgcggcatcccgccggatcacctcatcctggccggattctcacaaggtgccgccatggcactgcatacgggattgcgccatccggacaggctggctggcatcatcgccttgtcaggttatctcccacttgctcataagattgaacgtgaagcacatatcaccaacaggataacccccatattcatggctcatggcaacgatgaccccatcgtcccgattgaattggcacatgcctcactgcaacaattacgtgaatactactacccggtaacctggcatgaatacccaatggaacatacggtatgtgatcaggagctggtcgatatttcccgctggttgaaaaccatcctgaaataagaacag

SEQ ID NO: 43369 - DNA, 1683 bp, Nitrosomonas europaea
atgaccacgttgaagatcaccggaatgacttgcgactcgtgcgctacgcacgtcaagcaagcattggagaaagtgcccggcgtgcagtctgccgttgtgtcctacgccaagggtgcggcccagctcgaccttgaccccggcaccgcaccggacgcgctgaccgccgctgtggccggactcggctacaaggcaacgctcgccgatgccccgccgacggacaaccgcaccgggctgctcgacaaggtgcgcgactggatgggagccgccgacaagggcagcgacggcgagcacccgttgcaggtcgccgtgatcggcagcggcggggccgcgatggcggcggcgctgaaggccgtcgagcaaggcgcgaaggtcacgctgatcgaacgcggcaccatcggcggcacttgcgtcaatgtgggctgcgtaccgtccaagatcatgatccgcgctgcccatatcgcccatctgcgccgcgaaagcccgttcgacggcggcatcccggcgactgcacctgcaattgatcgcagcaagctgctggcccagcagcaagcacgcgtcgatgagctgcgccacgccaagtacgaaggcatcctggacggcaacccggccatcaccgtgttgcatggcgaagcgcgtttcaaggacgaccagagccttgtcgtccgtttgaacgctggcggcgagcgcgtcgtggtgttcgaccgctgcctagtcgccacgggtgccagcccggccgtgccgccgattccgggcttgaaagagtcgccctactggacttcgaccgaggccctggtcagcgacatcattcccgaacgcctggccgtgatcggatcgtcggtggtggcgctggaactggcgcaagccttcgcccgactgggcagccaggtcacgatcctggcgcgcagcacgctcttcttccgcgaagacccggccatcggcgaggcaatcacggcggcgttccgtgctgaagggatcaaggtgctggaacacacgcaagccagccaggtcgcccacgtggacggcgaattcgtgctgaccacggcgcgcggtgaaatacacgccgacaagctgctggtcgctaccggccggacaccgaacacgcgcagcctggcgctggaagcggcgggtgtcgccgtcaatgcgcagggggctatcgtcatcgacaaaggcatgcgcaccagcgcgccacacatctatgccgccggcgattgcactgaccaaccgcaattcgtctatgtggcagcggccgccggcacccgtgccgcgatcaacatgacgggcggcgacgctaccctggacctgaccgcgatgccagcagtggtgtttaccgacccgcaggtcgccaccgtgggctacagcgaagcggaagcgcatcacgacgggatcgagaccgacagtcgcaccttaaccttggacaacgtgccgcgtgcgctggccaacttcgacacacgcggctttatcaagctggtcatcgaggaaggtagcgggcggctcattggcgtgcaggcggtggccccggaagcgggcgaactgatccagacggcagccctggcaattcgcaaccgcatgacggcgcaggaactggcggatcagttgttcccctacctgacgatggtcgaggggttgaagctcgcggcgcagaccttcaacaaggatgtgaagcagctttcctgctgcgccggg

SEQ ID NO: 43370 - DNA, 927 bp, Nitrosomonas europaea
cataaaactgacgaccggcgcattatcagaggagatgagctgatcacgccggtgaaactgcttcatgatcatcctctgactgaacaggcgactgaaactgtggttactgccagacaggagtgccacgatattttgcggggagaggatgaccggttactggtggtatgtggcccatgctcgattcatgatgtggatgcggcagtggaatatgcttcccgactgagtcatctgcgtcaggagctgaaagatcagttacatatcatcatgcgggtttatttcgagaaacctcgcacaacagttggctggaaaggcctgatcaacgacccagacctggataacagtttcaacattgacaagggattgcggcttgcccgcgacctgttgctgaaactgggtaatataaatatgccggctgcaactgaatttcttgatctgatcagcccgcaatatgtggctgacctcatcagttgggcggccatcggcgcacgcacgactgaaagccagggacatcgtgaactggcctccggtgtttcgtgtccagtggggttcaagaatggtacctacggcaatctgaatatcgcaatcgatgcgattggtgctgcatcccacccgcataatttcctgtcagtcaccaaagaaggccgggttgctactttcaccaccaggggaaatgaagattgtcatatcatcctgcgcggcggaagatcaccgaattacgatgcagagagtgttgcttctgcggtcgaagcactgcggaaagccaagctgcctccttatctgatgatcgattgcagtcacgccaacagccacaaggattaccggcgtcagccggaagtggctgccgatgtggctcagcaaattgcggaaggaaactgctcaatcagcgggatcatgcttgaaagtcacctggtggccggcaggcagaat

SEQ ID NO: 43371 - DNA, 1044 bp, Nitrosomonas europaea
atgacaatcaaagcctatggcgcccgcgcgggcgaccttcccctcgagccaatgaacatcacccggcgcacgccaagtgcgcacgatgtgcagatcgacatcacccactgcggcgtgtgccattcggatctgcaccaggtgcgctccgagtgggcgggcacgctttacccctgtgtgccggggcacgagatcgtcggccgcatcaccgccgtaggcgcacaagtatcgggctacaagccgggtgatctggtcggtgtcggctgcatcgtcgatagctgccagcactgtgccgattgcaatgacgggttggaaaactactgcgaccacatggtcctcacctataatggcccgacatccgacgcacccggtcacacgctgggcggttactctcaacagatcgtggtacacgagcgctacgtgctgcgcatccgccattctgaagcgcaactggccgccgtcgcgccgctgctgtgcgcaggcatcaccacctggtcaccgctgcgccactggaaagtggggccgggccaaaaggtcggagtagtcggtatcggcggcctgggccacatgggcatcaagctggcacatgcgatgggtgcatacgtggtcgcgttcactacatccgaatccaagcgcgaggcagccagagcactgggcgcgcatgagacggtggtctcacgtaatcccgatgaaatggccaggcacgttggaagcctcgacttcatcctcaacaccgtagccgcatcacatgacctcgatgcattttttgcgctgctcaaacgcgacggcacgatggcgctggtgggtgcccctgccacgccacacccttcgcccaacgtgttcaacctgatcatgaagcgccgcagcctggcaggttcactgatcggtggtatctccgaaacacaggagatgctggatttctgcgccaaacacaacatcgtcgccgacgtcgaaatgatccgcatcgatgaaatcaacgaagcttatgagcgcatgctcaagggtgatgtaaagtaccgcttcgttatcgattgcgcttcgctcaca

SEQ ID NO: 43372 - DNA, 1110 bp, Nitrosomonas europaea
atgatgaatctcagtgaactggctccggactatatccgggcaattcagccctatcagcccggtaaaccaatctcagaattggttagagacctggggctgaataaagatgaagtagtcaaactggcttccaatgaaaacccgttgggtaccagtcccctggcaaaggaagccatgatccaggcgctcaacgaatcggcccggtatccggatggcagtggtttcgagctcaaggcagcgttgtccgaacggctgggcatgccggccgaccagatcgtgctgggcaatggctccaacgatgtacttgaacttgccactcgcatttttctgcacccggattcaaccgccatctattcccagtatgccttcgccatctatccgctgctggcccaggctgttggtgccagaggtattgccgtccccgcccgtaattatggccacgatctcgaagccatgctggctgctgttacgccggaaacccgtatcatattcatcgccaatcctaacaaccctaccgggacattgtgtgacgctagggatctgctgcgttttatggaacgtgttccgcaggatgtactcgtgatactggatgaagcctatgacgaatatctgccggaagcaaacaaggcaaacagtattgcgtggttgaagaatttccagaatctggtcatcacccgtactttttccaaagcttatggtcttgccagtgtacgcgttggctttgcgctggcacatgctgatatcgccaatctgatgaatcgtattcgccagccgttcaatgtaaacagtatcggtctggcggctgcacaggcagcgctcaaggatgttgaatttgtcaaacttgcctatatgacgaatcgtacgggcatgcagcagatgactcatggcctggaccagctcggtatcgaatatattccttccttcggtaattttgtctgttgccatatcgacgggcatccggctaatacgctgaaaatctacagaaatctgctgcagcagggggtcatcgtgcgcccgctgggtaattacgacatgctcaaccatttgcgggtaaccattggaatcgaagaagaaaacaagcggttcctgcaagcgctggaacaggcattgaaa

SEQ ID NO: 43373 - DNA, 1098 bp, Nitrosomonas europaea
agaaaaatctacaatttcagtgcaggtccggcagtactgccggaggaagtgttggagcaggctcgcgaagaaatgctggactggcacggcagtggcatgtcagtcatggaaatgagccatcgcgggaaagaattcatgtccatcgcggacgaaaccgaatctgctttgcgcgagctggcgggcattccggatcactataaagtactctttcttcaggggggggcatccagccagtttgccatggtgccgatgaatctgctcggcaagaagggcaaagcggattatgtcaataccggtcaatggtcggcaaaggccatcagtgaggccaaaaattacggttctgtccagatcgcagcttcgtcggaaagtgatggtttcaactcggttccaccgctggcgcaatggcatatctcgcctgatgcggcttatgtacattacgcgtccaacgagacgatcggcggagtcgaatttcagtggacgcctgatttatccgcagtagccggtgacaacaaaaacattccgctggttgccgatatgtcctccaatttcctgtcgcgtcctttcgatgtcagcaaattcgggctgatttacgccggagcacagaaaaatgtcggtcctgccgggttggtggtggtgatcgttcgtgaggatttactggatattccaccgcttgccggaacgcccgctatgttccgctataaaacgcatgcagataatgcttcaatgtacaatacgcctcccacttatgccatttacatcatggggctcgtcatggaatggctgaaaaaacagggcggactgactgcgattgaacagcgtaacattgccaaagccaaactgatctacgatctgatcgatgtcagcagtttttaccattgcccggtcaaccaggcagatcgatccaggatgaatgttccgtttacactgagtgatcccggtcttgatgacgcattcctgaaacaggctcaggcgcatggcctgattcagttgaaagggcaccggtcggtcggcggtatgcgagcctcgatctataatgccatgccgttggaaggtgtacagacattggtgaccttcatgcgggaattcgagaaaaaccat

SEQ ID NO: 43374 - DNA, 1977 bp, Nitrosomonas europaea
aagaatttgaccagtgcgattcgtgcactggccatggatgccgtccagaaagcaaattccggccatccgggtatgccaatgggtatggcggaaattgcagaagtattgtggaaccaccacatgcgccacaatccgacaaatcctgactgggtggatcgtgaccggtttgtactatcaaacggccatggttccatgctgatctatgctctgctccacctgaccggctacgatctgtccatcgaagacataaaaaatttccgtcagcttcattccaaaactccaggacaccctgaatacggctacacccccggtgtggaaaccaccacagggccgctgggacaaggtatcaccaatgccgtagggatggcgttggcagaaaaaattctggcagaagaattcaaccggccttatttcccgatcgtcgaccactacacctacgtatttctgggcgatggttgcatgatggaaggcatttcccatgaagcctgttcactggcaggaacattgaagctgggtaaactggtctgcttttatgatgataatggaatttccattgatggacatgtcgaaggatggtttacggacaacacccccaaacgcttcgaatcttatggctggcacgtcgttccagatgtcaacggacatgatcccgtagcaatacaggctgccatcgaagccgcgaagaaagtacaggacaaacccacactgatatgttgcaaaacagtcattggaatgggttcgcccaacaaagccaataccagccatgttcatggtgctgcgctcggaaatgacgaaattgctgcagcccgccctcacatcggctggaattacctgccattcgaaattccgcaagaagtttacgatgcatgggatgcgcgtgccaaaggtcaggcgctggaatccgcatggaacagcatgtttgcggaatacggcaaaaaatatccggcagaagccgctgaatttacccgccgcatggctgacgagttacccgtcgggtgggctgatcacgttgagggcactattagccagatcaatgccagggaagaaaccatcgcgacccggaaagcatcacaaaattcaattgaggcactggcaccggtattacccgaactgattggcggatcagcagacctggccggctccaacctcaccatgtggtctggttccaagggaattagcacagaatctaccggtaactatgttttttacggtgtccgggaatttggcatgagcgccatcatgaatggcctgtcgttgcatggcggaatcatcccctacggcggtactttcctgatgttttccgaatacgcccgcaatgctctgcgcatggcggcattgatgaaaattcgtaacattttcgtgttcactcatgattcgatcgggctaggggaagatggtccgacccatcagccggttgaacaaactgccacactgcgcatgattcccaatatggatgtatggcgtccgtgcgataccgttgaatcgatcgtttcatgggtatccgccattgagcgcagagaaggtccgtcatcccttatattcagccgccagaacctacccttccagaaacgggatgcagtaacgatcagcctgatcagaaaagggggatatatcctctctgaagcagcaaacagaaagccacaggccattatcattgcaaccggctcggaaatcgggttggcaatggctgcacagaaaacactggcagaaagcggtattgcagttcgcgtcgtatccatgccttgtacaaatatttttgacagacaggatcaggcgtaccgggacagtgttctgcccaagggaattgcacgtgtagctgtcgaagcaggggttaccgattactggcgtaaatacgtcggccttgaaggagatgtaatcggaatcgacagattcggtgaatcggctcctgcagaaaaattattcgaatatttcggatttaccgttgagaatgtcgtaaatgccgtgaaaagggttata

SEQ ID NO: 43375 - DNA, 930 bp, Nitrosomonas europaea
atcaatggttttggtcgtattggccggatggttttccggtgttccatagaggagtttgatgacattgaagttgtcgcaatcaatgatctgctggaaccggattatctggcttatatgctgacacatgattccgtccacgggcgcttcagaggagatgtatccgtcagcggaaacaatctgattgtaaacggcaaacagattcgtctgaccgccatcaaggacccgaccgaattaaagtgggatgaagttggtgcggatatcgtggtggagtctaccggactgttcctgaccaaggagctcgctcaaaaacatatccaggccggtgccaagaaagttgttttgagtgctccgtccaaagacgatacgccgatgtacgtttatggtgtaaatgataaagcatacggcggagaagccattatttccaacgcatcatgtaccactaattgcctggctccgattgccaaagtactgaatgatacctggggtatcaagcgtggcctgatgacgacggttcatgctgccaccgctacacagaaaactgttgacggtccttccaataaagactggcgcggtggacgcggaattcttgaaaatatcatcccttcctctacgggtgcagccaaagcagttggcgtagtcatccctgaactgaataaaaagctaacaggtatggcattccgcgttcctacctctgacgtttcagtagtggatttgacagtcgagcttgagaaagacgcatcttatgaagacatttgtaatgcgatgaaagaagcctcagctggttcaatgaaaggcatactgggatataccgatcagaaagtggtttccacagattttcgcggagaaacctgtacatcggtattcgatgcagaagcgggaattcagctcgacaagaattttgtaaaagtggtttcctggtatgacaacgag

SEQ ID NO: 43376 - DNA, 1176 bp, Nitrosomonas europaea
gtgtccgttattaaacttgtcgatcttgatctgaagaacaaacgcgtctttatccgcgctgatttgaatgttcctgtaaaagacgggaaagtgacatcagatgcgcgcattactgcctcgatggcaacgatcaaccactgcctgaaacaaggcgcaaaagtcatggtgacctctcatcttggacggccggaagaaggggtatggacagaagaaaattctctccagccggttgccgatgatattgcccggagactgggaaagcctgtccggttgatcaaagactgggtagagggtggatttgaagttgcatctggagagttggtagtcctggaaaattgtcggatcaataaaggtgaaaaaaagaacctcgaagaaaccgccaagaaatatgccagtttgtgtgatgtattcgtcatggatgcttttggtacagcacaccgtgcagaagcttcgacacatggtatcgccaaatatgcaccgattgcctgtgcaggtattttgcttaccgaagaactcgatgcgctgacaaaagccctgcatcagccagcacatccgctggtggcaatcgtaggcggatcaaaagtttccaccaaactgaccgtgctggaatcgcttgctgaaaaagttgatcagctcgtagtcggcgggggaattgccaacacttttctcaaggccgcagggaacaacattggaaaatccctgtgcgaggatgaactggtacccgttgcaaaatccctgatggataaaatgaacaagcgtaatgcaacgattcccatcgcagtagatgtcgtcgtcggaaagaaattcgctgaagatgaagctgctgttctaaaagcagccaacgctgtttctgatgacgacatgatctttgatatcgggcctgagagtgctcaagaattggtcgacatcatcatgaaagccggtacggtagtctggaatggcccggtcggtgtattcgaattcgatcaatttggagaaggaacacgcgccatagccaaggcaattgctgaaacggatgccttcaccctggcggggggcggtgacacaatcgctgccatccaaaagtacgacatctacgataaagtttcctatatatccactgccggaggagcattcctggagtttctggaagggaagaaattacctgctgtcgagattctggaattacgtgcgaag

SEQ ID NO: 43377 - DNA, 1413 bp, Nitrosomonas europaea
atgcgaagaacaaaaattgtagcaacgttaggaccggcttccagtaatgctgaagttctggggcgaatgctcgaagctggtgtcgatgttatccgtatcaatttctcacacggaacaaaagatgagcacatcgcttccgtagaactggttcgttcgctcgcccgctcgcttggccgtacagtcggtgtactggctgatttacaggggccaaaaattcgtatcggtaagtttgaacagggaaaaattcgactcaaaaccggggatgaattcatactcgatgcagaatgccagctgggaaaccaggaacgggtcggactggattatcgggaacttcctaatgatgtcgaagcaggcgccacgctcttattggatgatggacgtatcgttctgacggtggccaaagtcagagaaagtgaaatcttttgtgaagtgttgcagggcgggattctttccaacaataaaggtattaaccggaaaggcggagggttgagcgcacctgcactcactgcgaaagatttactggatatcaagacttccgcagtcattcgagcagattatctcgcagtatccttccctcgctccggtgacgatatcagacgcgcgcgcgcactgatgcaggaagctcaggggcatagtttgctcatggcaaaaatcgagcgctcagaagccattctggcactggatgatattctggaagcgtctgatgccatcatggtggcccgtggagatctggcagtcgaagtaggagatgccgctgttcccgccttgcaaaaacgcatgatacgatctgcacgtgaagcaaataagctggtaattaccgctacgcaaatgatggaatccatgatttccaaccctattccgacacgcgcagaagtatcagatgttgccaatgccgtactggatggtaccgatgcagtcatgctgtccgctgagtcggccgcagggcaatacccggttgaagccgtcgaagccatggccagagtttgtctcgaagcagaaaaggaatatacacccagtttgagagcacgccgttcccccgatacacagtcaatcagtattgaagatgccattgcgcgcgctaccatgtacgcagccggttcactcaatatccaggcaattgcagcattgacacaaagtggtgtaacagcgttgttcatgtcacgcagaagttcgaaagcacccatctttgcactcagcccgcaagaagataccctgggtaaagtcacccttttccgaggcgtttatcccatagaattcggacaaggactgtgtgatcccgaaatcatcctaggcatggctgaagacgagttactcaagcgtggtgcggtacgcgacgaagatctgataatcatgacgatcggtgaaccggttggcaaagctggcgggacgaacaccatgaagatcatcaaagta

SEQ ID NO: 43378 - DNA, 1047 bp, Nitrosomonas europaea
atggcactcgtatctttacgccagttactggatcatgcagctgaaaatgggtatggactcccggctttcaacgtcaataacctggagcagatccatgcgatcatgcaggccgctgatgaatgcgacagcccggtgatcatgcagggttcagctggtgcgcgcaagtacgctggagaagcattcctgcgtcatctgattgctgctgcggtcgaagcctatccgcatattcccgtggtaatgcatcaggaccacggtgcttcacctgctgtatgcatcaacgctattcgcagcggcttttccagtgtaatgatggatggatcgctggaagaagatggaaaaactccttcatcatacgaatataacgtcgatgtcacttccaaagtagttgcaatggcacatgccgtaggtgtttccgtggaaggtgagctgggctgcctgggatcgctggaatcaggtcagggtgaagctgaagacggtcatggtgccgaagggcagctgtcacacgatcagttactgactgaccccgagcaggcagccgatttcgtcaagcaaactggtgtggatgcattggcaattgcaatcgggacctcccacggtgcgtataaattcacccgcaaacccacaggtgatatcctcgctatccagcgagtcaaggaaattcatgagcgtatccccaatacccatctggtcatgcatggatccagctccgttcctcaggaatggctggaaatcatccgtgaatatggcggagatatgaaagaaacctatggagtgccggtagaggaaatccagcagggtatcaaatatggtgtgcgtaaagtcaatatcgatacggatatccgtctggcaatgacgggagcaatccggcgccatctggcgaaaaacaaaagtgagttcgatccgcgcaaatttctgaaagatgctactgcagctgccaaggatatctgtaaagcccgtttcgaagcttttgggtccgctggtcaggctggcaagatcaaacccatctcactggaaaccatggcaaaccgttatctgcgtggtgaactg

SEQ ID NO: 43379 - DNA, 1248 bp, Nitrosomonas europaea
atgcagaaactcgtcattcacggaggagctaagctccagggtgaaatcagtatttccggtgccaaaaacgcagccctgccggtactatgcgcatcgctgctgactgccgatacatttaccatccagaacctcccgcatctgcgggatatcaccaccatgctggcactgctcgaacagatcggtgtgcgcattttaacaaatgacccgggtacagcagaactgtctgctgccagcattaccaatccgaccgcttcttacgacatggtcaaaaccatgcgtgccgccatcctcgtactgggtccactgctggcacgaaccgggcaggcatatatttcactgccgggcggctgcgcaatcggcatgcgtccggtagatcagcatatcaaaggactgcaggccatgggagcggacatcagtatcgaacaaggctacatccgtgcccaggccggacgcctttcgggtacgcgtatcgtcatggatctcgttaccgtcaccggcaccgagaatctgatgatggccgccacactcgcctccggtaccaccatcctggaaaatgccgcgcgtgaacctgaagtagtcgatctggcggattgcctcattggcatgggagcgaaaatcgaaggggcaggcagtgacatcatcgtcatcgaaggagtggatcacctgcatggcagttcacatactgtcatgcctgatcgcatcgagaccggcacattcctgactgctgtcgctgcctgcgggggtgacatcaccctgacccggacacgcgcagatacactcgatgtcgtactcggtaaactgatcgagactggtgcggccatcgatacgggtgaagactggatccgcctgcgcatgcagcaccggccacagccagtcagtctgcgtaccgcaccctatccggcctttcccaccgatatgcaggcgcagttcatggcgctgaacagtattgctgacgggacctctgtcatgacggaaacgattttcgaaaaccgcttcatgcatgtacaggagctcaaacgtctgaatgcggatattcaggtcgaaggcaataccgcgatcgtgcatggcattccccaactcgatggcgccagtgtgatggcaactgatttgcgtgcctccgcctgcctgatcatcgccgggctggttgcgcagggagaaaccatcgtcgaccggatctatcacctggatcggggttacgaacgaatcgaacgaaaactggcacaggcaggtgcacaaatcaaacgcata

SEQ ID NO: 43380 - DNA, 1365 bp, Nitrosomonas europaea
aaaaaaacctggtcgggacgtttcagtgaaccggttgcgcaactcgtacaacgctataccgcatcgatcggattcgactaccgactggccgaatatgacatccagggttcgctcgcacacgcccgtatgctggctgccactggtatcatccagcccgctgatctggccgccattgaacaggggctggcacaaatccgtgaagaaatcagtaagggtgagttcgaatggcaactcgaacaggaagacgtccatctgaacatcgaacggcgtttgactgcgctgaccggagatgctggaaagaaattacataccgcccgctcacgcaacgatcaggtggccaccgacatccgactctacctgcgcaccgcgatcgacgaaattatcgacctcatccacacgctgcaatatgtactgctggatctggcagagcagcaagctgccacgatcatgcccggattcactcatttacaggtggctcagcctgtttcgttcggacatcatctgcttgcctaccatgaaatgctgcagcgtgacgggcagcgcctgcaggattgccgaaagcgcgtcaatcaactgccgctgggcgctgccgctctggccggcaccagctatcccgtcgaccgggcaatggttgcgtatgaactgggatttgatgatatctgccacaactcgctggacgccgtttccgaccgtgacttcgcgatcgagttctgtgcctgcgctgcactcatcatgatgcacctctcccgcctgtcagaggagctgatactctggatgaatccggccttcggtttcatccggctggcagatcggttctgcaccggctcgtcgatcatgccacaaaagaaaaatcctgatgtgcctgaactggtacgcggaaaaaccggtcgcatcaacggccatctggtcgcgctgctgaccttgatgaaatcccagccgctggcctataacaaagataatcaggaggacaaggagcctctgttcgatacggtcgataccctgaaggataccctgaccatttacgccgacatgctggccgggctgcacgtcaacccggaagccatgcgccaggctgcactgcgcggttacgcaacggccaccgatctggccgattatctggtcaaaaaagggataccgtttcgcgatgcgcacgaagcagtcgcccaggcggtccgtttcgcggaaagcaaggcatgtgatctgagtgaactctcgcttgcagatttgcgacaattttccgaagtcatcgaacaagatgtcttcgaggtattgacgctggaaggctccctgcaaagtcgcaatcatcctggcggcactgccccggaacaagtgcgtgaagccatctgtcgtgcccggtcacagtta

SEQ ID NO: 43381 - DNA, 1173 bp, Nitrosomonas europaea
atgtctggcaacagcatcggaaaactgttcagtgtcacttcattcggtgagtctcacggtccggcaatcggctgtatcgtagatggatgtccgcctggattaaccttgtcggtcgaagacatccaacaggaactggatcgacgcaaacccggcacttcccggcatgtcacacagcgacgcgaggcggatcgggtagagatactctcaggcgtatttgaaaacacaacgacgggcacaccgatcgccctgctgatccgtaacgaggatcaacgcagcaaggattacagcaagatcatggatgtttttcgccccggccatgcagactacacctactggcagaaatacggcatccgcgactaccggggaggaggccgttcatccgcacgggaaacggctgtacgggtggccgctggcgccatcgccaggaaatggctgcaacagcgctatggtattgtcatccggggttacatggcacagctcggctcgattgccattcccttcaaaagctgggatgtcgtcaatcagaatccgttttttgttgcagataacgattatgttcagaaactggaaacattcatggacagcttgcgcaaatcaggtaattcagcgggcgccagaatcaatgtcgtggcggaaggcgtaccggtcggctggggtgagccggtttatgaccggctggatgccgatatcgcttacgccatgatgagtatcaatgcggtcaagggtgtggaaatcggggccggattcaacagcattactcagaaagggaccgaacactcggatgagatcaccccggaaggtttcctgagcaacaatgccggcgggattctgggtggaatttccagcggccagccggttgttgtcagtgtggcgatcaaacccacatccagtatccgtctggcacgacgttcgatcgacaaggcaggaaatcctgtactggtcgaaacccatggcaggcatgatccctgtgtcggcatccgggcaactcccatcgtggaggctatgctggccatcgtgctgatggatcatgccttgcgtcaccgcgcacaaaatgcggatgtcgtctgctctactcccaggattcccggaagcaccacaaaccagatacatccagtagagatgcaggccagtgctccccgggcggaagatcctgaaccggatgaatcatcgtaa

SEQ ID NO: 43382 - DNA, 1377 bp, Nitrosomonas europaea
atgagtaatatcgcacctgaaattttcaaggcttatgacatccgtggcatcgtagaaactgcgctgacaccagcaacagtagaacttatcggccacgccattggctctgaagcacgcgagcgtcagcttaccaccatcgcgatcggccgcgatggccgcctgtccgggccggagctggcgcaggcactgacgaacggcatccgcaaaagtggaatcgatgtcatcgatgtgggtatggtccccaccccggtgctgtactacgccgcacacgaattatgcggctactcgggagtcatggtgaccggcagccacaatccgcctgaatataacggtctcaaaatcgtactgggtggcgaaacgctggcggcagaagcaatccagtcactgcgtctgcgtatcgagcaagctaacttccagcacggacaagggagttatcgtcagcatgacatcgtacaaagctatctgcaacgaatcatcgctgacgtcaaacttgcccggccggtcaagatcgttgttgactgcggcaatggtgtcaccggtgtgctggcgcccgaactttatcgccggttgggctgcgaagtaatcgaactgttttgtgaagtcgatggcaccttcccgaatcatcatcctgatccttcagtaccggaaaatctgcaggatgtcatccggacgctggctaccaccgatgctgaaatcggttttgccttcgacggcgatggtgatcgtctgggcgttgtcaccaaagacgggagcatcatttatccggatcgccagctcatgctgtttgctgccgatgtactgtccaggaaccctggcggtcagatcatctatgatgtcaaatgcacacgcacactggcaccctggatcatccggcatggtggtaagccagtcatgtggaaaacggggcattccttcatcaaggccaagctaaaggaaaccggtgcattactggccggtgaaatgagtggccatatttttttcaaggaacgctggtacggattcgacgatggtctgtatgccggtacacgtctgctggaattgctcagcaaacaggttgatccggctacggtactgcacgccctgcccgatacgatcaatacgcccgaactgcagatcaagctcaaggaaggagaaaatcatgccctgatcgcccagcttcagcgcgatgcagattttcctgaagccgaccaggtcattacgatcgatggcttgcgagtggaatacaaagacggattcggtctgatccgggcatccaacaccacgccggtcgcagtattgcgcttcgaggcggataatcgggctgcgctggaacgcattcagcaggatttccgccgggtcatcctgcaagccaggccggatgcagccctacccttctga

SEQ ID NO: 43383 - DNA, 930 bp, Nitrosomonas europaea
atgggagaggttgataatgttatccagcaaaagcttcattctcaggttgcactggtccgacaggtaagtgaatatatcattcacagcggcggtaaaagactgcggccggcattggtcatcctggctgcaggattgttcgattacaaaggcttgcaccatcacaacctggctgcggtcgtcgaattcattcacaccgcgacactcctgcacgatgacgtggtggatgaatccgaattacgccgcaaccaggccaccgccaatgctttatttggcaatgccgctagtgtattagtaggggattttctctactcgcgcgcttttcagatgatggtggaagtaggcaacatgcgggtcatggaggtgctggccgatgcgaccaataccatcgccgagggtgaagtgctccagttactcaactgtcgtgatccggatgtggaagaagaaaactacctacaggtcatccgtttcaaaactgccaaactttttgaagctgctgctcgattgggagcgatactgggaggagccactccggccgaagaggaagcattggcagcctatggcatgcacctcggtactgcattccagctggtggatgatttgctggattactcagggaacgatcaggatacgggcaagaatctgggagatgatctggcggaaggaaaaccgaccctgccgctgatatttgccatgcgctcaggcatacctgaacaggtagataccgtgcgccatgccattgaaaccggtgggaaggatgggtttgaaccaatactcaaaatcattcaggaaagtggtgcactcgattacgcaaagcaatgtgcccagaacgaagccaatatggccatttcggcaatcactgcaatccgtgattctatctacaagcaatgtttgctagaattggcagaatttgcaattacaagaaattattag

SEQ ID NO: 43384 - DNA, 656 bp, Nitrosomonas europaea
cttgacacaatcaactggtcggcagacggcctcattccagctatcgcacaagataaaaacaacggtaaaattctgatggtcgcctggatgaaccgcgaagcactcaaacgtactgtcgaaagcggtgaagcggtttactggtcacgctccagaaaaaaactgtggcataaaggcgaggaatccgggcatacccagaaaatcagtgcgatccatctcgattgcgatgaagatatccttctcctcagtgtggaacagaaaggaggaattgcttgccatacaggcagacaaagttgcttcttccgtcaattgaaaaatggagaatgggtcgtcacagaacctgttatcaaagacccgtcacaaatttataccaaatgacagcatcgaccatactgcagcggctggcacggacaatcgaagcacgaaagaacgctgatccttccatctcttatacggcaaaattgctgaacagcagccaggataaggtgctgaaaaaaattgctgaggaagccgctgaaaccatcatggcttgcaaagacaatgacagagaacagatcatttatgaaacggcagatttatggtttcattgtctgatcatgctcacccggcatgacatttcgccggaagatatattgcgggaactggaacgccgggaagga

SEQ ID NO: 43385 - DNA, 768 bp, Nitrosomonas europaea
ttagccaaacgtatcatcccctgtcttgatatcaaagatgggcgcgtcgtcaaaggagtcaattttgtctcgttgcgggatgcgggagacccggtcgaaattgcccgcagctataatgaacagggcgctgacgagctcgttttcctcgatattaccgccagctcggaaaatcgcgacttaattctgcatatcgtcgaaaaagtcgccgcacaggtgttcatcccactgacagtaggcggaggcgtccgtaaggccgaagatgtacgcaggcttttgaacgcaggtgcagacaaagtcagcatcaacacctcagcggtattgaatccgatgctgatcaaggaatcagcagatcactacggctcccagtgtatcgtgatcgcaatcgatgccagacaaatacctgatgcaaatcctgaatctccacgctgggaagtatttacccatggcggacgcaaacccactggaatcgatgcaattgaatgggctcaaaaaatacaagccctgggcgccggagaaattctgctaaccagcatggatcgtgatggtacgcgttccggattcgatctcacactgacacgtgcaatctccgattcagtcgatttaccggtcattgcaagtggtggtgtcggtcatctggatcatctggtggaaggtattctggcaggccatgccgatgccgtactggcagcaagcattttccattatggcgagtacagtatcctacaagccaaacaatatctgtcatcgcacgggatagaagttcgcctg

SEQ ID NO: 43386 - DNA, 576 bp, Nitrosomonas europaea
gcacaagtcacccgcaatactcaggaaacacaaatcacggtaacgatcaacctggacggccagggaaaagcggaattggacagcggagttcctttccttgatcacatgctcgatcagattgcccgtcacggcatgttcgatctgagtgttgccgcaaaaggtgatctccatgtcgatgcacaccatacagtggaagatatcggcatcacactgggccaggcgctgaatcgtgcagtcgctgacaagaaaggactcgtgcgctacggacatgcttatgtacctctcgatgaagccttgtccagagtcgtcatcgatttatcgggcaggcccggtttgcagttcaacaccacattcacacgcgcagtcattggtaatttcgatgtcgatctgatccaggaattctttcaaggctttgtcaatcatgccatggtaacgctacacatagacaatctgaccggtaaaaatgcgcatcatcaggctgaaaccattttcaaagcatttggccgggcgctgcgtatggcggtaacaaccgacccgcgctgtgataaccttatcccatccaccaaaggcgtgctg

SEQ ID NO: 43387 - DNA, 1044 bp, Nitrosomonas europaea
gtcattcgccaggaaatccttgcactgtcagcctatcatgtcccccctgccaaggatatggtcaagctggatgcaatggaaaacccctaccggttgcccccttttttatgtgaagaaatctcccggatagcggcagacacatccatcaatcgttaccctgatccacacgccgccgcgctcaaggaagtgctcagtaccacattatccgttccggccggaatggaaatcatgctgggcaatggttcagacgaaatcattcagatcatcatgctggcggcagcaaagccggaagcaaagctgctgacgatcgaaccgggatttgccatgttcaaaatgattgctacattcgcgaacatgcagtatatcggaattcccctgaaacctgatttttcgctagatatcgacaggatgctcgcagcaatcgagcgccatcagccttccgtcatattcctggcctacccgaataatccgagcggcaatctgttcgataccagcgctctggaaaagatcatcgaaatatccccgggactagtcgtaatcgatgaagcctatcatccttttgccggaaaaagtttcattggcaggcttgccgattatcccaatctgctggtcatgcggacactttcgaaactgggactggccggactccgcctggggctcctggccggcagaccggagtggctatctcatctggagaaactgcgcctgccctataatgtcaatgtgattacccagcttgttgcgacaaaaatcatgcagcactatgatgtgttgcagcaacaggcagatgcaatcagacaaacacgtaccagattacgcactttcctggaaaatctgaatggaatcgaggtgttcccttcgaatgccaacttcattctgttccgtctcgatggggccagccagattttcagattgcttcagcagcatggcattctggtgaagaatcttgacaacagccaccccttattaaaaaattgcctccgtgtaacggtaggcacacctgaagagaatgatcgtttctgcaacacactgcaagacctgatc

SEQ ID NO: 43388 - DNA, 420 bp, Nitrosomonas europaea
gcaaatatcctggtgatccatggccccaatctgaatcttctgggcagaagagaacccgccgtctacgggcaaacaacactggaagatattaacaggaatctgacggtcaaagcgcaggcagcacctgtagcattgagtatctttcagagcaatgctgagcatgagttgatcgaccgggtgcagggggccatgagtgatggtaccgatttcattatcatcaacccggccgcactgacacataccagtattgccctgcgtgacgctttggctgctaccagcctgccatttgtggaaatccatctttccaatgtttatgctcgtgaatcatttcgtcgtacctcttatttctcggatatcgcagttggggtcatcagtggtttgggtgctgcgggatatgaactggcgcttcaatttgctttg

SEQ ID NO: 43389 - DNA, 1347 bp, Nitrosomonas europaea
atgtttgaaaaaatattgatcgcaaatcgtggtgagatcgcgctgcgcatccagcgggcatgtcgcaccatgggtattaaaacagtagccgttcattctgaagcagatgctgaggccaagtacgtcaaactggccgatgagtcggtgtgtatcggcccggcagcctctgcacagagttatctgaacattcctgccattatcagtgcggctgaagtcaccgatgctgaagccattcacccgggttacggttttctatccgagaatgcggattttgccgagagagtggaaaaaagcggctttttctttattggaccccggccggatacgatccggttgatgggggataaagtcagtgccaaaaatgccatgcgacaggcgggggtaccttgtgtaccgggttccggtggtgcattaccggaatctctcgatgaggtaaagaagatcgttaaagaaataggctatccggtcatcattaaagcggccggaggcggtggagggcgcggtatgcgtgtggtgcataccgaagcagcgctttcaaacgcggtgattacgacacgtaacgaggcgcagactgcattcggcaatccggttgtttatgcagaaaaatacctggaaaaccctcgtcatatcgaatttcaggtactggccgacgagtacggcaatgtcgttcatctgggggagcgggattgctctatgcaacgtcgccatcagaagatcattgaagaagcacctgcccgcggtatttctgtacagttgcgtgacaaaatcggggagctgtgtgtcgaggcttgcaagcgtatcaattatcgcggtgtcgggacttttgaatttctttacgagaacaatgaattttatttcattgagatgaatacccggttgcaggtcgaacatccggtaacggaggcgatcaccgggatcgatctggttcaggcgcaaattcgtgtggcagccggagaaaagctgtctttgcagcagaaggatatcgtgttcaagggccatgccatagaatgccgtatcaatgcggaagatccctataaactgaccccatcggccgggcgcatcactcaataccatgctccgggcggcccgggaatcagggttgattcacatatctatcacaactatcgtgtaccaccttactacgattccatgattgccaaggtaattgcctatggcgatgatcgcgacctggctattgcccgtatgcgtatagcattgacggaaatgatcgttgaaggcatcaaaaccaatataccgttgcatctcgaccttctgacagattgcaatttcctgtccggccccgtttccattcatcatcttgaaggtaaactcgcgttgtataacaaa

SEQ ID NO: 43390 - DNA, 1161 bp, Nitrosomonas europaea
atgagtaactatctttttacttctgaatcagtatctgaaggccatcccgacaaggttgccgatcagatatcggatgccattctcgatgccatcctgcaacaggaccctcatgcacgtgtagcctgcgagactatgtgcagcacggggttgatcgtcttgtccggtgaaatcacgactgatgccacgatcgattacaacgccattccccggggtatcgtgcgcgaaatcggttataccagttccgagatcggctttgatgcaagcacttgcgctgtattgactgctttcaacaaacaatctcccgatattgctcagggggtaaatcgcagtaaagacgaggaaatggatcagggggctggagaccagggactgatgttcggttatgcctgcgatgaaacaccgcaactgatgccgttgccgatttactatgcgcatcgtctggtcgagcaacaggcaaaactgaggaaaagcggcagattgtcatggctgcgtccggatgccaaatcccaggtttccgttcgttatgaagatggattcccgaaaaacatcgaaacgatcgtcatctcaacccagcattctcccgatgttcctcgtgatgaactggttgaaggcgttatcgaagaagtcatcaagccggttttaccggccgagatgctgagcaatcatattcaatatctgatcaaccccactggccgtttcgtggtgggcgggccgatgggggattgcgggttgaccgggcgcaagatcatcgtggatacctacggtgggacggcacatcatggagggggcgctttttccggtaaggatccttccaaagtggatcgttcagccgcttatgctgcacgctatgtggccaaaaatattgttgcggccggcctggcgcgtaaatgcgaagtccaggtggcctatgcgatcggagtggcaaagccggtctcgctgatggtgcaaaccttcggtaccgggaaaatcccggacgggaaacttgctgaactgattgccagacattttgatttacggcctcgggccatcattcacgaactggatctgctgcgtccgatttatggcaaaacagctgcttatggtcattttggccgggaagaacccagctttacctgggaaaaaactgacatggcagagcagctcaaagcagatgcaggtatc

SEQ ID NO: 43391 - DNA, 1389 bp, Nitrosomonas europaea
gactgcaaggtggccgatttgtcactggcagactggggcagaaaggaaatcgccattgccgagacagaaatgcccggtctgatggcattgcgtgagcaatatgccgacaagaaaccgctggcaggtgcgcggattgcaggctccctgcacatgaccatccagacagccgtactgatcgagacactggtagcgttgggcgcggaagtccgctgggcttcctgcaacattttctctactcaggatcatgctgccgcagcgattgctgcccgtaacattccggtattcgcttacaagggagaatcgctggaagaatactgggattacgctcaccagatatttgaatgggccagtgatggttcgcatactgccaatatgattctggatgatggcggagatgcgaccctgctgctcattctcggcagcaaggctgagcgcgatccttccgtgatcgccaatccgaccaatgaagaagaacaagtcctgtttgcttccatccgcagccgtcttgccagtcatccgggctggtattcgcgtaatcttgccgcaattcgcggtgtgactgaagaaacgacgactggtgtccatcgcctgtacgaaatggaaaagaaaggcgaactcccgtttccggcaatcaatgtcaatgattcagtcaccaaatccaaattcgacaatctctatggatgccgcgaatcactggtggatggcatcaagcgtgcaaccgatgtgatgattgccggaaaaatcgccgtggtgtgcggttatggcgatgtcggcaaaggatgtgcacaatcattgcgtggcctgggagcaacggtctggatcaccgagatcgatccgatctgtgcattgcaggcagcgatggagggataccgtgtggtgaccatggacgatgcctgcgataaagcagatattttcgtcaccgctaccggcaatcttcgtgtgattacccacgatcacatgctgaaaatgaaagatcagtcgatcatatgcaatatcggccacttcgattccgagatcgacatcgcttcggttcagaaataccagtgggaaaacatcaaaccacaagtcgatcatgtgatcttcccgactggccgccgtattatcgtgctggcacaggggcgtctggtcaacctggggtgtgctaccggccatccatcttttgtcatgtccagttcgtttaccaatcaggtgctggcgcagatagagctctggcaaaatggtaaagactaccagaagaaggtatatgtactgcctaaacgcctcgatgaaatggttgcacggctgcatctgggtaaactgggtgtgaagctgactgaactgaccgatgaacaggcgcattaccttaacctcgacaagaacgggccctataaaccggaaatgtaccggtac

SEQ ID NO: 43392 - DNA, 882 bp, Nitrosomonas europaea
atgacacgcagaggcctcatccttgcgggagggtccggtacccggctgcatccggcgacgcttgcactgagcaagcagttgttgccggtattcgacaaacccatgatttattatccgctcagcaccctgatgctggcaggcatacgcgatattctcattatcagcacgccgcaggacacccctcgttttcagcaactgctgggtgacggagaacaatgggggctgaatctgcaatatgccgtgcaaccttcacccgacggcctcgcacaggcttttctgattggcgaggatttcattggtaaccatccttctgcactggtgctgggagataacattttctacggccatgatctccagcgtctgctgactcatgccatgatgcgcaccgaaggagccagcgtattcgcttatcatgtgcatgatccggaacgttatggtgtagtcgagttcaatgcacagggcaaggtattgtcactggaagaaaaaccgatacaaccaagatccagttatgcggtgaccgggctgtatttttatgatacgcaggtcgtcgatcatgccaaagcgctcaaaccttcagcacgcggcgaactggaaatcaccgatctcaaccgtctttatctcgaacagggcaacctcagcgtggaaatcatggggcgcggctacgcctggctggataccggtacgcatgcaaccctgctcgatgccagtcagttcatcgctaccctggaaaaccggcagggtctgaaagttgcctgtccggaagaaattgcctaccggcaaggatggatagatgcagcccggctggaaatgctggcccaattactggctaaaaatggttatggtcagtatctgctgaaaatactcagggaaaatgtgttctga

SEQ ID NO: 43393 - DNA, 1413 bp, Nitrosomonas europaea
atgaaaacgttatatgacaaactctggagtgaccatgtagtgcatgcggaatcggatgatccgaatggcatggttattctgtatatcgatcgccatctggtacatgaagttaccagccctcaggcttttgagagcctgaagctggccggacgcaaaccctggcggactggctcgattctggcggtagccgatcataatgttccaacgacggatcgaagcagtggtatcagcgatcctgtatcccgtttacaagtcgaaacgctggatcagaattgtgaggaattcgcgattaccgaattcagaatgaacgatgaacgtcagggaatcgttcatgtgatcgggcctgagcaaggtgcgacactgcctggtatgaccgtggtgtgtggagattcccataccagtacacatggggcatttgcttgtctggcatttggtatcgggacatccgaggttgaacatgttctggcgacacaatgtctggttgcccggaaatccaaaactatgctggtcagggtcgaaggggatctgccacctggtgtgacggccaaagatattgcactggctgttattggtgaaataggtacggccggcggtacgggttatgccattgaatttgccggcagtgcgatacgatcgctttccatggaaggccggatgacgctctgcaatatggcgatcgaggcgggtgcccgtgcaggtatggttggagcggatgaggttacgatcgattatatcaaggggagaccctttgccccgcagggagcactgtgggatcaggcggtggcttactggcgtacattgaaaagtgatgaagatgcggtgttcgatcggatggtggaattgaaggcagtcaacatcaaaccgcaggtaacctggggcacctcaccagaaatggtgactactgtggatgggtatgtgcccgatcctgcggatatcagcgatccgaccaaacgccatgatgtcgaacatgcactcgggtatatgggactgaagccgaagatgcccattcaggaaataacgctggataaagttttcattggttcctgtaccaattcacgtatcgaagatctgcgcgcagcagcagaaatcgtcaaaggaaaacggattgccccgaatatcaggctggctatggtggtccctggttccggtctggtcaaatcgatggccgagaaggaggggctggataaaatttttctgtcggcgggattcgaatggcgcgaacccggatgttcgatgtgcctggccatgaatgatgacagattgttacctggagagcgttgtgcctcgacttccaatcgtaattttgaaggccggcaaggccccggcgggcgaacacatctcgtcagccctgccatggcagccgctgctgcaatagctggccatttcgttgatgtgcgttcttttattcggtaa

SEQ ID NO: 43394 - DNA, 1122 bp, Nitrosomonas europaea
atgaaacaagtcggatttgtgggctggcgcggtatggtgggctctgttctcatgcagcggatgcgtgaagaaaatgatttctcattaatcgagtccgtgttcttttcaacttcgcaagtgggtgaaaaggggccggatattggccgggaagcaggattactcaaggatgcctacgatatcgcagccttgcgggaaatggatatcatcatatcctgccagggcggagattacaccggcgacgtttttaaaaagctgcgtgagtccggctggcaaggatattggattgatgccgcttctacactcaggatgagtgatgatgcaattatcattcttgatcccgttaatcgttcggtgatcgatgatgcattgaataagggtgtcaagaattatatcgggggtaattgtacggtcagcctgatgctgatggccgttggcggattgttcgaccaggacatggttgagtgggcaagtatcatgacttatcaggcggcatcaggggcaggcgcgcaaaacatgcgtgaactgttgcagcagatgggagaaactcacgatgtcgcaaaagatttactggaagatcctgcttccaacatattggatatcgatcgcaaggttgctgagaaattgcgtgacaaagaatttcccgctcagaattttggtgttccactggctggaagccttattccatggatcgatcgcgaggttgcacatggacagagccgggaagaatggaaagggcaggccgagaccaataaaattcttgggcacggcgatgaccccgtaccggttgacgggatttgtgtgcgagtgggagccatgcgttgccacagtcaggcattgacgatcaagttgaagaaggatattccactggaaaagatcgaggaaatcatcgcagcatccaacaaatgggttcatgtgattcccaatgaaagggaagccaccaccagggaacttactccggttgcggttaccgggaagctcgatattcatgttggccgcatacgcaaattgaatatgggaagtgaatatctctctgtttttacggtgggagatcagttattatggggcgcggccgaaccattgcgccgaatgctgcgcatcttggtcgaagataaggctgcataa

SEQ ID NO: 43395 - DNA, 588 bp, Nitrosomonas europaea
atggctgctgtgcaacatggtgcggatgccatcggctttattttatggccgcagagtgaacgatatatttcacctgaagaagcgggccggatcgtgaaatgcctgcccccgttcgtacgggcggtaggtgtgtatgtaaatcctgataaatcgtgggtggaggagaccagtgccactgccgggcttgatctcctgcagtttcatggggatgaatctgccgatttctgcagccggtttcatctgccgtatatcaaagctgttcgtgtccgggacgggctggatttgctacaatacgcgcaacattacgcgggagccagaggattattgctggatgcttatacagcaggaataccaggggggactggccatgtgttcgattggaaactcattcccgcagagttgccgttgccatggatactgtccggcggacttcatcccggcaatattaccgatgccatcggacagacacatctgtcagcaatcgatgtttcgagtggtgtcgaggtcgccaaaggtatcaaggatgtgaacaaaatttctgctttcatgcaaagagtgaggtcctgtgaagatgtacgatcttcctga

SEQ ID NO: 43396 - DNA, 1293 bp, Nitrosomonas europaea
atgattgatatccgaccagcaaccctggagagctggttaagctatctcgaaaaacttcaccctaaaatgatcgatatgggtctggaacgggtgaagaaagtcagagatgccttgaaattgaagccggagtttcccgtcattaccattgccggcacaaatggcaaaggctcagtctgcgcgatgcttgagtcgatactcggctgcgcatcctaccgggtggggtgttatacctcaccgcacttgttgcgttacaacgagcggatacggatcgatcgacatgaaatcaccgatgaagtcctgtgtgaggtattcgctgaaattgaatctgcacgtgaatcagttcagactacgctgacctattttgaattcggtaccctggctgccatgctgatattcctgcggtcgcgtgtggatgtggccatcctggaagtcgggttgggggggcgcctggatgcagtcaatgtgttcgataccgactgtgcgattctgaccagtatcgatctggatcatacggattacctcggatcgacacgggaagccatcggtcaggagaagatcggtatcttccgggcagacaaaccggcgatctgtgccgaaccggatatccccggcaatcttcgcgaaaagatgcgagccatgaatgtcagactctactgtatcgatgaagctttcagctataccgcagatcatctacaatggcgctatcaaggcgtgtccgggcgtcattgcagcttaccgctgccggctctcaagggagactgtcaattgcaaaacgcgagtgcagtgttggctgcactggacgtcctggaagaggtatttcctgtcccgatggatgccatccgtcgtggattggtcgaagtcaccctggcgggcagatttcaaatgatttcagcacgacctgtgatcattctggacgtggcgcataatccggcagcagctcgcagattgtcggccaatctggaaactctgccggtaaaagggtgtacttatgcagtggtagggatgctgaaagacaaggatatggccggcacgcttcgggcactgaaaaacaatgtggattgctggctgatctcgggtctggatgtagcgagaggtgcatcggcgaatgaagtcctgcaggcactcgaagaggccggtgttgaacggcggaatattctgcatgcgttcccggatgtgcagagtgcctatgtttacgcacatgaacatgccagtgatgatgatagaatatgcgtattcgggtcgttccataccgttagcccagtgatgacgggtttaggcgaatcagattcttaa

SEQ ID NO: 43397 - DNA, 1176 bp, Nitrosomonas europaea
atgacgaacgatctggatccggaaacactggccattcataccggtgttcaccgcagtcaattcaatgaacattcggaatcactttacctgacctcgagttttgtatttgacagtgctgcccaggctgcagcgcgtttttccggacaagagcccgggaatatctattcgcgtttcactaacccgaccgtgactgcaatgcaggaacggctggctgttctggagggtgcagaagcctgtattgcgactgcttccggtatgtctgccattctcacctgtgtcatgggcctgttgtctgccggggatcatatcgttgcttctcgcagcctgtttggatctactgtcagtctgttcaacaatattctcagtcgcttcggtattcaaacgacatttgtttcagcgacggatcctgctgaatggcaggctgcagtcaggcccaacaccaggttgtttttcctggaaacaccttccaatccgctgactgagatttccgatattgctgcactggcagaaatagccaaacgagccggtgtgtggctggcagtggataactgtttctgtacgccgatcatacagcagccactcaagctgggtgcggatctggtgattcattcagcaacgaaatatctggacgggcagggcagagtactggggggggccatcctgggtaaacgtgatttactcatggacagcggcatattcagttttctgcgtactgccggcccgtctctgagtgcattcaatgcctggatcatcctgaaagggatggaaacattgagccttagagtaaaggcgcattcggatcatgcactggaagtggcacgctggctggaaacccatccccgggtggggcgtgtgttttatcccggtctgccatcacatccgcaacatgagcttgcaatgcgccagcagaaaacaggagggggtatcgtttcgttcgaggtgaaaggcggcagggaggctgcctggcgtgttgtcgatgccgcccggctgatgtcgattacagccaatcttggtgataccaaaagtacactgacgcatcctgctaccacgactcacggacgaatcagtcaggaagcacgtgaagctgccggaatcagggatggtttgctgcgtatcgcggtaggtctggaatcaccagatgacctcaaggccgatcttgctcgcggattgcaataa

SEQ ID NO: 43398 - DNA, 1059 bp, Nitrosomonas europaea
atgaccaaattagaaaacgataccttcatccgtgccctgctgcgacagcctgtggactatacccctgtctggatgatgcgccaggctggccgttatctgccggaatacaaccagacccgtgcgcgggcaggcagttttctgtcactttgcaagaatcctgactttgccacggaagtaacattacaacccctggccagattttcactcgatgctgcgattctgttctccgatattctgacgatcccggatgcaatgggattgggattatattttgcagatggggaagggccgcgtttcgagcgcccgttacgcgaagaacgggaaatccgttcgttgatcgtacctgatcccgatactcatttgcgctatgtgacggatgctgtcaggcagatccgcacagcgctgaataatcgggttccactgatcggattctcaggcagtccattcacattggcatgctatatggtggaaggagcgggcagtagtgagttcaggcaaatcaagaccatgttgtatgcgcgccccgatctgctgcaccatattctgggtgtgacggcacaagcagtcactgcctatctgaatgcccagatcgaagcgggtgcacaggctgtgatgattttcgacagttggggcggagcgttgtctcacgctgcttatcaggagttttccttacgctacatgaaccagattctggatggcttgaagcgcgaacataatggtgatcgtattccgaatattctgtttaccaagggtggcggattatggttggaatccatcatggccagcggttgtgatgcaatcgggctggattggacgatcgatattggcgaagcccgccgtcgtacccaggataaagtcgctttgcaggggaatctggatccggccgtactgttttcctcaccggaagtgattgctgctgaagccgggaagatactggcaagttacggtcacggccatggccacgtatttaacctcgggcatggcatttcacagttcaccccgcctgagaatgcgctggcattgattgaagcagtccatgcgcaaagtgtgcgttatcac

SEQ ID NO: 43399 - DNA, 1593 bp, Nitrosomonas europaea
ggtaaagcattactgaatgatcctgtacaaaataaatccactgctttcacccgggaggaacgcgaacgctatggtttgcagggattgctgccatatagtgtgacggatatcgggaaacagcagcagcgggtactggccaatctgcgcagtaagaacagcaatatcgagaagtacggatatttgaacgacctgctcgaacggaaccagcggctgttttatcgcacgctgatcgactatattggtgaaatcatgcccctggtctatacgcccaccgtaggtgaagcttgcatgaagttcacacagattttcagaaaaccgcaggggttttacattactccggaagatcggggaaaaatcctgcctttgtttgagaactggccggagaatgatgtgcggatcatcgtcgtcaccgatggagagcgcatcctcgggcttggagatctgggcgcaaacggtatgggaataccgatcgggaaaatggctttgtatgtggcttgcgccggcattcgtcccgagtactgtatgccggtcatgctggatgtgggtaccagtaatcagatactgcgggaagatccactgtatctgggttacccgcgtccgcggctgactggtcaggattatctgtcactggtggaggaattcgtggcggccgtacagaataaatttccgcaggcattgatccagttcgaggatttcagcagtcagaatgcattcagattgctggatcgttatgccgggtcggttcgatgtttcaatgacgatattcagggaacggctgcggttacgctggcgggtatttatgcttcctgccggattacgcacaaaccatttgttgatctgaaaatcatgctgctgggaacgggttcggccgcaaccggtgtcgctgaactgttgttgtcagcattcatgatggctggattgagtgaagctgaagctcgttccagaatcagtttcgtggacaggcagggcctggtggtgactgttcgggaagagatcaagccgcgtgtccgatcctttgccagtgaacatgccgcaatggatttcgtgggtgcaattaccgctatccggccggacgtactgatcggtgcaacgggaactgcaggcgcattcgatgagatcgcgattcgtcaaatggcacgatgtcaggaacatccggtgatcatcgcactttccaatccaacctcacatacggaatgtactgctgaccaggcgtaccggtggagtgatggacgcgctgtttttgcaagtggcagtccatttgctccggtcacgctggatggacgaacccgttacccggcgcagggaaataatgtgtatatctaccctggaatcgggctggggatggtggccagccatgcacgtctggtcgttgagcatatgtttctggccacggccgaagaactggcgaattgtgtgttacctgaagaaatcgaacgtggatcgatttatccggagattgcccgggtacgcgatgtttcacaaaagatcgccgtcaaggtttgtcaggtggcccgtcaggagggactggccggcgtggatctacctgatgacctggaaacgtatgtgtacaccctgatgtatgagcctggttat

SEQ ID NO: 43400 - DNA, 1176 bp, Nitrosomonas europaea
atgcctacaacccgccactacgacattgtaatcataggaggaggaattcaaggcgcagccgttgcacaggctgccgctgcacttggctacaatgtgctggtgctggaaaaaactgctttggctgcaggaacttcgagccgttcaagcaaactgatccacggcggtctgcgttatctggaaagcggccagttcggactggtatgggaaagcctgaaggaacgggctgcgctcctgcgccttgcgccttcactggtcagattgcagccatttcatatccccatttacgatcagacttcacgcgatacgctgaccatacgcgcagggctcagtctctatgccctgcttgcaggattgagcaaaggcgcaggctttcattccataccaagaaggagatggggggagctggacggcctctccacgcgaggactcagacatgtcttccagtattgggatgcgcaaaccgacgatcaggcgctcacccgggcgatcatgcattctgcctcctcgctcggggtggaattacactgcccggctgaattcatccacgccagaatttccggagagatttgtgaaatcgaatttctggaaaacaaccaggcttaccagtgtacggcaagctcgctcgtcaatgctgccggcccatgggtcagtcaggtagcggaacgaatctcgcccgcaccaccggcatacccggtagagctggtacaaggcactcatctgatactggaaggaagtctggataaaggctgttattacctcgaatcaccacaggatcgaagagccattttcgcgctgccatggaaacagcatattttactgggcacaactgaaacagtattcgaaggagcacccgacaaggctctcccgctggtatccgaagaaaactacctgctgggttgcttccggtattattttcccgatcacggcgccacggtacgggaacgctttaccggcctgcgcgtactgcccgtatcgcgcaataatcctttcggtcgctcgcgtgaaactcacctgcaatgtgattcgcctgaatctccccggattgtgggaatttatgggggaaaactgactgtctgccgcgcaactgcccggaaagttctgcatactctgcggccttcactacccgtccggattcccaaagcagatatttcacaactgacactcaaactgccttaa

SEQ ID NO: 43401 - DNA, 888 bp, Nitrosomonas europaea
atgagtgcaacaatcatcagcggcagtcttatcgcaagcaaatttcgcgaagaactgaagcaacgcgtcaaaatactctcagaaacatggatgcaacccggtctggcagtaattctggcaggagataatcctgcctcttgcgtatatgtgcgcaacaaggcaaaaacgtgtgaggaattgggtatccgctccgaaatcttcaattttcctggtgatatttctcagaaagccctgttacagcaaattcaggatttgaatgtcaatccggaaattcacggtattttggtacaactgcctttgcctggccatatccggatcgatgaagtcattgctgccatcgcaataggaaaggatgtggatggctttcacccctgtaatgtaggtgcattggtaacaggtcacgccctgtttcatccatgtactccctttggagtaatgaaaatgctggcagaatatgatattccgctccaggggcagcatgcagtcatcatcggccgcagtaacatcgtcgggaaaccgatggccctcatgctgctggaaaaaggtgcaacggtcacggtttgtacctcacggacacgagatctggccagccatacccgtaatgctgacattgtcgtcatggctgcaggaaaagcgaatctgctgacaagtgatatgatcaggacaggtgcgacagtcatcgatgtgggaatcaatcgtttggcggacgggcggctttgcggagatgtcgaattttcaggagtgaaagaaaaagcaggatatatcacgccggttcccggtggagtcggtccgatgactatcgtgatgctgatgaacaatacgatcgaagctgccgaacgtgcgaaagcagtggctctggccggtggctggcacagttctgtgcaataa

SEQ ID NO: 43402 - DNA, 1287 bp, Nitrosomonas europaea
atggtcaagcctggcgacagtgtgcaggtcgaggaccctttgatcgtactggaatcggacaaagccactgtcgaggttccttcaccttattccgggatcatccgggaaatcagggtgcaaatgggcagcaaagtctccaaagactcggagatcctgaccatggaagtggtctctgcagaaagcgacaataaaacaacttcctcccagccacaaccatcagccggatcacagcctgcacaaccaacccggccgatcgaaacaggagccggtcaatccgaagaggagccggcagccaaacctgctgctacgacaacgaagccggccaccccctctgctcccatacaaataccggatcatacgatcgaccagcacaataagataattccccatgcaagcccttcggtcagacgatttgcccgcgagctgggagtggatctgagcaaggtagtgggaaccggccccaagcagcgcattctcaaagaagacgtacaagctttcgttaaacaagctctgacgggtggacgtaatgccaggggaggcacactcgatttattaccgtggccacatgtggattttgccaaattcgggccgatcgaactgaaatcgctgtcgcgtatccgggagatctcaggtgccaatctgcatcgcaactgggtcatgattccgcatgtcacgcagttcgatgaagcagacgtcaccgatctggaagcgctcagaaaaaaccataatgaaacccggcaaaacaatggcactaaactgaccatactggctttcctcatcaaagcagtcacagcagcgctgaaaaaatttccggagttcaacgcctctctggataacagcaccacggaaagccagctcatcatcaagcgctactaccacctgggtttcgcggccgatacccccaacgggttagtggttcccgtcatccgcgatgccgatcagaaaggagtaatcggtatcgccgaggagcttaccagactgtcctcacttgctcgtgaaggcaaattgaaaccgggcgacatgcagggcgcaagttttaccatttccagcctgggtgggatcggtggaacaggcttcacccccattatcaacgcaccagaagtagcaattctgggtgtctcgcgtgcaagtctgaaaccggtttaccagaacgggcaatttgttccgcgcctggtgcttccgctttcgttatcctacgaccaccgggtcatcgacggtgcatcagccgcacgcttcactgcacatctggccagtattctggcggatatgcgtcttgccctgttctga

SEQ ID NO: 43403 - DNA, 1173 bp, Nitrosomonas europaea
agaaatgtcgtcgttctcagtggcgcaagaaccgcgatcggtgattacggtggcgcgctgaaggatctggcgcctgccacgctggcagccataacggtcagggaagcaatcactcgcgccagcgtcgattctgacaagattgggcacctcgtcgccgggcacgttatccccactgaagcgcaggatatgtatctggcgcgcgtggcggcgctggaagccggcctgccgcagagtgtagcggcgcttaccctgaatcgtgtttgcggcagtggattgcaggccatcatttcagctgcgcaggccgtgatgctgggagatacggaagtggctatcgctgctggagccgagtcgatgagtcgaggaggatatcttcttcccgcactgcgctggggacaacgtatgcaagacagtaccgcagtcgatatgatggtgggcgcactgaccgatccgtttgaccgggtacacatgggaatcactgcagaaaacattgctgaaagatggagcattacccgcgagcagcaggatcgattcgcactggaaagtcatcggcgcgccattcacgctgttcacaacggctatttccgcgagcagatcgtaccggttgaagtttccacccgcgaaggtgtagcgatgttcgatacagaccagcacccgcgcgacaacatcagtatggaaacgctgggtaaactgcgccctgttttccgggaagacggcacagtcacggccggtaacgcatccggcatcaatgatggtgctgccgcactggtgctgatggaggaacgcgcagccgaacggaatcatcatcaaccgatggcacgtctggtcgcttatggccacgccggagtcaatccgcgctacatgggaatcggccccgtgcccgcagtcaaacaggcactgaaccgggccgggctcgatctggctgagatggatgtcatcgaatccaatgaggcgtttgctgtccaggcgtgcgcagtcgcccgggaactgaatttcgacccggacaaagtcaatccaaacgggggcgccgtggcactggggcatcccattggtgcatccggttgtatactggcaatcaaagccatttacgagctgcagcgtataaacggccgctatgcactggtcactttgtgcatcggtggcggacagggaatcgccgcaatttttgaaaaactc

SEQ ID NO: 43404 - DNA, 1614 bp, Nitrosomonas europaea
acccgatcccctgcctggctggctctgagtgcacatcagacggaaattgccaaccgccctctgcgcacgctgtttgatgaagatccgcaacgattcgacaaattctcactgcaattcaaagatctgctgctcgactacagcaagcaacctgtcgatgcaacgaccatccgtcttctgctggcactggcggaacagcaaaagctggtagactggcttggccgcatggctaatggtgaaaaaatcaatttcaccgagagccgggcggcactgcacattgccttgcgtgccaattcaccggttttcatggatggcgtggatgtcactcaggaggtcagacgggtattgcggcaaatcgaacagtttgtccagaaaatccacaaccagtcgcaccggggttactccggcctgccgattaccgatgtcgtcaatatcgggataggaggctctgatctggggccggtcatggtgaccgaagcactcaagccgtaccacttgccgcagcttcggactcatttcgtttccaacctcgacggcgctcatctttctgacacgctgcaacacatcaatcctgccaccactctgttcgtcatcgcttccaaaacgtttactacccaggaaaccctggccaatgcccattccgcccggaaatggtttctggcaggaggaggcagtaaacaggatattgcagcacacttcgtcgccgtttctaccaaccgtgaggcagtcagccagttcgggatcgatccggacaatatgtttgaattctgggattgggtaggcgggcgctattcgttatggtcagccatcggcctgccgattgcgctggcagtgggaatggaacatttccactcactgctggctggtgcgcaagcaatggatgatcattttctgactgctcccttcgagcagaatctgccagtcatattgggcctgattggtatctggcagatcaatttctttcatatcaccagccaggccatcctgccttacgatcagtccatgcatcgttttccggcttatctgcaacaactggagatggaaagcaacggcaagcgtgtcacccggaacggagaagctgtcgattacagtacaggcataatcatctggggcgagcccggcaccaatggccagcatgccttttatcaactgctgcatcagggtacacaaaagttcactgccgattttctggcaccgtgccgctgccatcacccgttatccgagcatcatcccatgctgctggcgaattttttcgcacaaaccgaagcactcatgcgcggaaaaactgaacaggaagtccggtccgagctggcaaaccagaatttatccgctgatcttgtggaacacctgcttcctcaccgtgttttcccgggcaaccacgccacgacctcgatcctgttcaaaaaactcgatccggcaacgctgggtatgctgatcgcactgtacgaacacaaagtatttgtacaaagtgtcatctgggaaatcaatccgttcgatcagtggggagtagagctcggcaaacaactggccggcaagattctggctgaattggccctggataaaccggtaaccggacacgatgcgtccaccaacggcctgatcaatttttacagagca

SEQ ID NO: 43405 - DNA, 1437 bp, Nitrosomonas europaea
cgggtgttgtttgtcacttccgaagtatttccgttatgcaaaaccggagggctgggtgatgtcagtgccgcattacctgccgcgctgcgtgaactgaaggcagatgtacgcttactcgtacccggctacccgtcagtactatccgggctcaaatacaaacgtaagctggcagaattcgatctcctgccgcacttccctccaaccacattattttcctcccggttacagatcaatgaatccgtcagtctgcccttatatgtgatccactgcccggaactctatcagcgaccaggcggcatctatctggatgacgacgggcaggactggccggataacgcacaacgcttcggcctgctgtcaaaaatgggtgcactcctcgccagtgatgccagcccgctctcctggataccggatatcatccattgcaatgactggcaaagcgggctcacacctgcttatctccactaccactccgggaagaaagcagccagcctgatgacactgcacaaccttgcttttcagggctgctttccacccgatgaagtagccaggctgggattgccacccgaaagcttcagcgtgcatggcgtcgaatactacggcaatctatcgttcctcaaggcgggaatctactatgcaacccggattactacggtcagccctacttacgcccgggaaatccagcatgagccgctgggattcggtttacagggattactggccgaacgcagcaacgccatcaccggaatcatcaacgggatcgataacaccgtctggaatccggcaaccgatccgcacatcgtaaaaaaatattcaagccgcaacctggcagcaaaaaaaattaacaagctcgctctgcaacgggagatggggctggaagaaaacgaaacgattccgctgtttgccggaatcagccgtctcagttaccagaaaggctacgatattctgttgcaggtcgcacccatgctggcagatctccctgctcaactggtattgctgggaaagggagatcaatctctggaaaaacaactcgttatgcttgcacaaaccaaccctgccagaattgccgtccgcatcgactacgacgaagcgctctcgcatcggatcaatgccagtgcggactgctttctgatgccttcccgctttgaaccgtgcggactgaaccagatgtacagccagcgctacggcactccgcccatcgtccatacaaccggcggactgatcgatacagtgactgatctggcccctgatactccagccggcgaatctgcaagcggattccattttcacgaaatgaccgcagatgcattcatgaatggaatcggacgggcaattgatgcctattacaacaccaggttatggaaaaccctgcagcacaatggcatgcgtaaggatttcagctggcgatccagtgctttggcatacctgtccatttac

SEQ ID NO: 43406 - DNA, 1275 bp, Nitrosomonas europaea
gaaatgcaatttcaggacatcaggcttgccgttgtcgggcttggctatgtgggccttccactggctgtcgaatttggccgcaagcgctctgtggtcgggttcgatatcaatcagcgccgcattgatgaactcaaaaacggaaatgactttacgctggaaaccacccgggaggagctggcagcagcaaagtacctgacgtacactacgaacatcgatgatctgcgtgactgcaattgctatattgttactgttcccacaccgattgacgaacacaaacgtcctgatctcactccacttatcaaagcttctgaaacggttggcaaggtattgaagaaaggtgacattgtcatctatgaatccacggtttaccccggctgtaccgaggaagattgtgtgccggtactggaacgtgtatccggcctgaaattcaaccaggacttttattgtggctacagtccggagcgtattaatcctggtgacaaggagcaccgcgtcaccaccatcaggaaagtgacatccggttccacttcggaagtcgctgatctggtggacgagttgtataacgaaatcattaccgtcggcacgcataaagcggaaagcatcaaggtggctgaagctgccaaagtgattgaaaacacccagcgtgatctgaacattgccctcattaacgaactggcattgattttcaacaagatgggaattgataccgaggccgtactcaaggcggcaggcagcaaatggaatttcctgccgttccgccccggtctggtgggtggccattgcatcggggttgatccgtattacctgactcataaagcccaggcgatcggctatcacccggaaatcatccttgccggtcggcggctgaatgacagcatggggacttacgtcgttgcccagctggtcaaggccatgaccaaaaaacgtattcaggtggaaggtgcccgggtactggtcatgggcctcgctttcaaggagaactgcccggatctgcgcaacacccgcatcgtggacattgtggctgaactcaaggactacaattgtgtagtagatgtatacgatccctgggtatctctccaggaagcacagcacgaatatggcattacaccaatcggaactcccaagcccggcagttatgatgccatcattctggctgtggcacatcatcaattcaaagacatgggtgcttctgccattcgcgcactgggtaaacccgatgccgttctgtatgacctcaagtatgtgcttgacccgcagggggcagatttgaggctg

SEQ ID NO: 43407 - DNA, 3480 bp, Nitrosomonas europaea
ctgaccgaaatcaaactggccggtttcaaaacattcgttgatcctgcggtggtgcctgtaccggggaatctggtcggaatcgttgggccgaatggttgcggcaaatccaatgtcatcgatgcggtacgctgggtgctaggggaatcacgcgcctcagcattacggggggagtcactgcaggatgtgattttcaacggatccgccacgcgcaagccgatcggccgggccagtgtcgaactggtattcgataacagctcgggcaaagcggcgggccagtggaaatcctacagtgaaatagccatcaggcgcgtgattcagcgcgatggggaatcatcctattacatcaataatattcatgtgcgccggcgggatatcaccgacatgttcctgggaacgggtgtcagcgggcgcggttacgccatcatcgaacaggggatgatttcccgcattatcgaggccaggccgcaggagctgcgcacttttctcgaagaagcagccggcattacccgataccacgaaaagcgccatgaaaccgggctgcgcctggctgatgcacgtggcaacctgcagcgtgtggacgatattctcgaagagctggacaaacagcagcagcatcttgaagcacaggcggaatgtgcggtccgttatcaggatttgcataggcagttgactgccgcgcaacatacactctggacgttgcataagcagcaggccgccgaatcacgacaccaggcacaggtagaggttgaacgcttggtgcaggaaatggaaaccatccgatccggtatgcaggaaacaggcgaaaagctggatgagttgcgcctgtaccaccgggtggtgaatgatcgtcagcatcagattcagggagcgttgtatgctgccaatggtgaaattgcgcgtatcgaacaaaacatccggcatattcgtgcaaacagagagcagctcgatcgtcagcttgctgaagctgaactgcaactgcagaaccacgagcagcaactgaacgaagtcaacgaaaacctgacgtcctggcaggataaactggagcaggcgaaaaattgtcacttgtcctgcaaagaggaacatatcgtggaagccgggaagctgccgcaaatggaatcggctgcgcaagcagaccaggtgcggttgatcgggttgcgggaaaagctggcgctggccagacagaatgagaaattgctgcaaaaccagcaggcgtatgccgaaaaaacgttgcatcagctggtggtgcgtcgcgaacgcctgctggaagagcagtcgagccagccggagatcgatccggtgcaactggatgagttgcagatggaatctgcagagcttgctgccatgctggagcagaagcagcattcactcagcacactggaaacgcaggcgtataccgtacagcaggaacgtgacgcgatcctgcaaatcattcagtcgctcgagcgggatatggctcgggcaaatgcccggtgtgatgttctgcaacgcttgcaggatcagatcgaagataaccaggagttgaatgcgtggatggccagacttcagttgaatctgttgccgaggctgtggcagcagatttcgattgaatcaggctgggaaacggcgctggaagccgtgctgcgcgagcgtatccaggcagttaccgtggaccggttggaacagatgctggagtgggaagcacagcggccatcggcaaaatgggccgtgtgcgaactcgttccggatcgaccagtgagcaatgacacggatcaacgaacatggaagccactcagtacattactgagttgccgcagcccggcggtgcaggccgtgctgggaaactggctgtacggtgtgttcgtcactgacagcctgacagctgcgctggctgacagatcgctgcttaccagcggagagatgctggtaacagcggaaggacacagtataaccagttgcggagtaagctactttgcgcctgattctgcagtgcatggtatcttgcagcgtcagcgcgaaattgctcaaatcagggaagaatgcgaacaaatcggacagtctgttttatcccaacagcagacgctggctgcggtggagcaggatgatcagcagatcgcggcggatatcgtacaacttcgtaaagtgatcgaagaaatcagaacgcagcagcacgaccggcaaatacagatcgtacggttgacacagcaaatagagcgtgtggcgcaacagcaggctcaacttgaaatcgaactggctgatctggcagtgcagatcgaagaagaatcatcacagaaacagcaggcagaaacagagctcgttgtgtgtgaggcggaaagagtagagctggaagctcaggtaaatcaggcagaatctgcctgccagtcatccgggcgggcactggcatcacagcgatcacgggtgcagcgtttatcggacaggttacatgaaacggctttcggtgagcaggattgtcagaacagagtcatcgattgtgaacggcgtatcggtatgattacccggaatagcgtcatcctgactgaaaacatgcaaaggttgcagcacgctcgtgctgatctggatgaatcgacactgacagcagatacagtacattggcagatacagcgcgatcagcatgaacaggcgctgatggcagttcggcacgagctggaaaatatggacgatacattgcgggaaatggaacaggcccggatgtatgctgaacaacggctgcaagaatgtggtgaggcggttggtcaggcgcggctccgtgagcaggaagcggaaatgaccgaagcccggtttgcagacaagctggcggaatcaggtgaaactatgctggaaatggtgccgcagttcgtcaatgaatcgccagcaaaactgcaaacacgtatcaaccggcttaccggggaggtcactgctctcgggccggtcaacctggcagcgttacaggagctggaggcattgaaatcacgccggattcatctcgaagaacaatctcatgatttacgtgaagccattacgacactggagcaggccattcgtcagatcgatcgtgaaacccgggagcgtttgcaggaaacattcgatcaggtcaatcagaatcttgccgggttgtttgcttccatttttggtggaggggttgcggagctggtgttgagtggtgaggatattctggatgcaggtgtgcaattgaatgctcatccgccgggtaagcggaacagttccatccatctgctttctggtggggaaaaagcattgacggcactggcgctggtattttcactgttccggctgaatcctgcaccgttctgtctgctggacgaggtggatgcgccgctggatgatagtaattcagtacgtttttgtgagctcgtcaagcgcatgtccggagagactcagtttcttttcatcagccacaacaaaattaccatgcagatggcgcagcagttgatcggtgtaaccatgcgcgagcagggagtttcccgggtggtgacggtggatatc

SEQ ID NO: 43408 - DNA, 1377 bp, Nitrosomonas europaea
atggaccagtatcgcgaagaacatgatgcaataggcacagtacaggtgcctgccagcgccctctggggtgcgcagacacaacgatcgctcaacaacttcaatatctcgggcgaacgcatgccgtcagccctgatccacgcactggcgctggtcaaacgcgccgctgccagtgtcaatcatgatctgggattactggacgagaacatcgcccgggcaatcatcaccgctgccgatgaagtgctggcaggagaacacgccggcgaatttccgttggtagtttggcaaaccggttccggcacacaaaccaatatgaacatgaacgaggtgctggccaaccgcgcttcggaaattctgggcggtacacggggcaaaggtcgcaaggtgcaccctaacgaccatgtcaacaaaggacaatcttccaatgacgtttttcccactgccatgcacattgctgccgtggaagccatccgcaaccggttgattccggcactggaagcactacgtaaaacattatcttccaaatcggcagcattttcggatatcgtcaagatcggccgcacacatttgcaggatgccaccccgcttacactggggcaggaattttcaggctatgtttcacagctcgatcatggcctggctcatctcgaatctgcgctgccgcatctgctcgaactggcgctgggggggacagccgtaggtaccggtctcaacacccatccggaatttgcacgccgtgtcgcggcagaaattgcacgcctcagcggctatccttttataacagctgccaataaatttgaggcactggccgcgcatgatgcactggtccatgcgcatggggtgctgaaaacactagcagctatactgatcaaaattgccaatgacgtccgctggctggcatccggcccgcgttgcggtattggtgaaatccttatcccggagaacgaacccggcagttcgatcatgcccggaaaagtcaatcctacccaatcggaagcagttgtcatgcttgcctgtcaggtcatgggcaatgatgttgcaatcaatctgggaggcgccatgggaaatttcgaactcaataccatgaaaccactgatcattcacaattttttacaaagtacacgtttgctcgcagatggtgcagaaagcttcaacacccattgcgcagccggtattacggccaatacagtacgaatcaagcagcatttacaggagtctctgatgctggtaaccgcgctcaatcctcacattggttacgacaaagcagcagaaatagccaaaaaagcccatcatgaaatgctgacattaaaagaagccgcaatcaggctgggttatgtcaccgcagaacaattcgatgtatgggttgacccacaaaaaatg

SEQ ID NO: 43409 - DNA, 1098 bp, Nitrosomonas europaea
cgccagcaggaagggctgtaccgttcacgtccggtgctggaagggccacaatctccacatgtcactatcgatggcagggattttctggctttttgcagtaacgattatctggggttggccaatcacccggccttgatcgaagctgcagcggaaggtgcgcggtgttatggcgtcggctcgggcgcttctcacctgatcagcggtcattttcgtgcacatcatgaactggaggaagcgctggcggcatttgtcgggctaccgcgcaccttgctgttttccaccggatacatggccaatatggcagtggtgactgcgctggcaggccggggagatgcgatctttgcagatcgcctcaatcatgcttcactcaatgatgctgctttgctttctcgtgctcgtttcattcgttacccgcatctcgatctcgataccctggcacggcagctggaaacgacgaaagcccggcgccggctggtcgtcaccgatgcggtattcagtatggatggtgatatggcaccggttgccgagctgctgacattgtgtcagcgctttgatgcctggctgctgctggatgatgcgcatggattcggtgtgctcggggaacggggtaagggcagtctgtatcattcgcaaagaatagaacgggatacaccctatctgatttacatggcaacgttgggcaaggcggcgggggtatccggtgctttcgtagcggcacaagcacctgtcgttgaaacactcatccagcatggccgcacctatggctatactacggcagcaccacctttgctggcgcacaccttactgaccagcctgcaactgatcagtcaggagagttggcggcgggaacgacttgctttgctgatcgagcgattgcggcagaggttgcactcccttccctggccattgctgctgtctgaaaccccgatacagccattgctggtgggcgaaagtcaggaagccgttcggctggatctggcgttgcgtgagcgtggtatctgggtgccagctattcgtccgccgaccgtaccacaaggcatggcacgattacgcatcagtttgtctgctgtgcatactgaggcggatgtcgatcgattg

SEQ ID NO: 43410 - DNA, 1470 bp, Nitrosomonas europaea
atggataatttattcgatgtggcagtcatcggtgcaggccctggtggctatgtggcggctatccgctgtgcgcagctcgggctcaacaccgtatgtatcgatgactggaaaaatgagcagggcaaacccagtctgggtggcacctgtctgaatgtcggctgtattccctccaaggcattgctcgaatcttccgagaatttcgaacgggccggacataaatttgccgaacacggcatcaaggtggatggactatcgatagatgtcccggccatgatcgctcgcaagaacaagatcgtcaaagcttttaccggcggcattggcatgctgttcaagaaaaataaagtgactgccctgcatggtcgcggaacgttgcaaaagcatgatcaggcacgtgatggcggtgatgacagctgggaaatccaggtgagtgccgatggaaaagagcagtcggtacatgccaggcatgtcatcatcgcgacaggttctacgccccgtactctgaaagtggcaccggtcgacgggaacaacgtgctcgacaatgcgggcgccctggctttgcaacagactcccgggaaactcgccatcatcggcgcgggggtgatcggcctggaattgggaagcgtctggcgcaggctgggtgcggaagtgaccctgctggaagcccaggctgattttctgccggcagcggatgaacaggtggccaaagaggcctataaagcgctgacacgcgagacaggactcaccattcataccggagtcgagatcaaatcgacccgagcaagtgaaaacggtgtggagatcgactacgtcgatcgtgacaagaatgcacagaacctgaaggtggacaaactcatcgtagccgtgggacgagttcctaacacttccggtctgggggctgaagcagcgggattgaagctcgatgagcgcggatatatcagcgtggatgaattctgccagaccagtctgcaaaatgtatatgcaattggagatgtcgtaagagggccgatgctggcacacaaggcttccgaggaaggtgttgccgttgccgaacggatagcatcaggccggcagggagcaactgattcatctggccatgtggatcttggaatgatgccatgggtgatctataccgcgccggagattgcctgggtaggtaaaaccgaacaaacgctgaaagcagaaggggttgcctacaaagcggggcagttcccgttcatggccaatgggcgtgcccgtgcattgggagaaacgaccgggttcgtcaaaattctggcggatgcggaaagtgatcgtatcctgggtgtacacatggtgggtccttatgtttccgagatgattgcagaagccgtagttgccatggaattttccgccagcagtgaagatctggcgcgtatcgtacacgcccatccctcactttccgaatcactgcatgaagctgcattgggcgtggataagcgggccattcatatc

SEQ ID NO: 43411 - DNA, 1293 bp, Nitrosomonas europaea
atggccaggaatgtcgtagtcattggaacgcagtggggagatgaaggtaagggcaagatcgtcgactggctgactgatcgggctacaggagtcgtccgtttccagggcggacacaatgcgggtcatacgctggtggtaggtggtgagaaaactgtattgcatctgattccttcaggaattctgcgtgagaatgtgacctgctacattggtaacggtgtggttctctcccccggcgccttactggaagaagtggatatgctggagcaggccggagtggatgtatccggcaggctgcgtatcagcgaaacctgccccctgattctgccttatcacattgctgtggacggtgctcgtgaactggcgaaggggatggaaaaaatcggtacgaccggcaggggaatcggcccggcgtacgaagacaaggttgcgcggcgtgcaatacgcctgcaggatctgtttcgtcctgaaaggcttgcctgcaaactgaaagaagtactcgattatcataatttcctgctgaaaaattactaccacgctgcaacggttgactatcaccaggtcctggatgattgtcagataaaagccgaaagaatccggccgatggtggcggatgttccaaaactgctgtttgaagccagtcaggctgacaacaacctgctgttcgagggggcgcaaggtgctttgctcgatatcgatcatggcacttatccctttgtcacctccagtaactgtatcgctggtgcggcttcggtgggtagtggcgtcgggccgcagatgctgaattacgtgctgggaatcaccaaagcctataccactcgcgtggggtcaggcccttttcctaccgagttgtcggatgcaaccggagaacacctggcacagcgcggtaacgagttcggttccactaccgggcgcccgcgccgttgtggctggtttgatgcggtggctgccaggcgttctattcagatcaatggagtttcgggattgtgtatcactaaactcgatgtgctcgatggattggaaacactgcgtatcggtgtaggttataaatcaaagcagtcaggcgagatgtatgacgccctgccttttggagcggatgatctggctgctgcggaaccagtttatgaagagctgccaggctggcaggaacgtacggcaggtatccggaatttcgatcagctgccccaggcagcacaaaactatctcaaacgtatggaagaagtctgccagacacccatatccatgatttcaaccggtcctgatcgaacagaaacgatcgtttttcaccatcctttc

SEQ ID NO: 43412 - DNA, 2310 bp, Nitrosomonas europaea
aacctgcctgaactgcctgccgatgtcatcgccctggtgccgatgcgtaatgtcgtgctgttcccgcacgtgatcatgcccgttgccgtcggccgcacccggtcgattgcagcgattcagcataccttgcagtcgaaagtacctgtcggcatcgtgctgcagaaaaacccttccgtcgatgaacctggactggatgcactttgccagattgggaccattgccaatgtcgtgcgccatatcgcttccgaagatggcacacatcacgctgtctgcctgggagtcgagcgcttccgcatcgaagcgctggttgaaggctatcccttccttgccgcacggatccggcgtattccggaagccattccggataccacacaagtggaagcactgacattgcaattacgcgaacgcgcaatggaaattgtatcgctgctgcctagtgtaccggctgaactggcacatgcactgcaggcgacgcgtgcaccctccgatctggcagacattactgccagcctgctcgatactgaagtggccgagaagcagaaactgctggaaaccatcgatatcgaggaacggctgcacagcgtgctgcaaattctggcgcgacgcatcgaggtcctgcgactttctcaggaaatcggcgaacgtaccaaagaacaaatggaggatcgtgaacgcaagtttctgctgcgcgaacaactgaggaccatccagaaagaacttggtgaagatggtgaaaatgagcaggaagtcgtcaagctagaggaagccatcactgctgctggcatgccgacagatatcgaacagcaaacacacaaggagttgcagcgcttacaacggatgcccgccgcatcgagcgaattttccatgctgcacacctaccttgaatggatgacagaactgccatggcaactgccggaagataaaccgatcgaccttgatgctgcacgtaccattctcgaggctgatcattttggactggaacgcatcaagcagcgcatcattgaatttctcgccgtacaaaagctgaaaccgcaaggccgtgcaccgatcctctgcttcgccggcccgccgggcgtgggaaaaacatcactcgggcaaagcattgcacgcgcgctacagcgcccgttcgtcagagtatcgttaggcggagtccatgacgaagcggaaatgcgtggtcaccgccgtacctacgtgggtgccatgccgggcaatatcatccaggggttgcgcaaggcgggtgcacgcaactgtgtgatgatgctcgacgaaatcgacaaaatgactgccagcgcgcatggtgatccagcggctgcattactggaaattctcgatccggaacagaactcgacattccgtgataactatctgggtgtcccattcgatctgagtcgcgtggtattcatcgccacggccaatgtcattgatcagatcccgccaccggtacgggatcgcatggaaatcatcgatctgccgggttacacccaggaagaaaaactgcagattgcgctgcgttatctggtgcaacgacaaagcgaagccaacggtctgcagacagatcaatgcatgctgacatcggcagctttgcaaggcatcattgccaactacacccgtgaagccggggtgcgccagttcgaacgtgaaatcggccggatcatgcgtcacgccgccctgcaaattgcacaaggcacacagcagcaggtacagatcgacgctcaaaatctggaagacattctggggccagagaaatatgaacatgaactggcacttcacaccgacctgccaggtgttgcaaccggtctggcctggacaccggtgggaggcgacatcctgttcatcgaggcgacgcgtatcaatggcagtggccgcctgatcctgaccggtcaacttggcgatgtgatgaaagaaagtgcacaagcagcgctcaccctggtaaaagcacgcgccgaagacttgcacattccaacctcagtgttcgagggaatcgatgtgcatttacatgtgcctgccggcgccatccccaaagacgggccaagcgcaggtgtggcaatgttcattgcactggcttcgctgtttgccaaccggccggtacggcacgatgtggccatgaccggtgaaatcagcctgcgtgggctggttttaccggttggcggcatcaaggaaaaaatattggcggcgcagcgtgccggtattcgaactgtactgctgccagcgcgcaaccggaaagatctgcatgatgttccggaagcaacacgcactgccatacagttcgtttttctggaaactgccgacaatgctgttcaggcagctcta

SEQ ID NO: 43413 - DNA, 1698 bp, Nitrosomonas europaea
atgaattttatccttttaaaggagcgtcacatgatgaacaagctgccacaacaggaagaaaacagacgcacggtagagaataggaaaaattatctgctgcgaagacaggcgcagtatcaatatgcctacgagtatgccaatacgattgctgtggtacgcaaactgccatgtcgggagataccagggcctggatactggctgcgtggcgggatcaatttgctgcagctgattccaagtctgccgagtctgctggtgacgtatatgcgctatttgcttggcaaaccgatggaaagctaccgcgactatattttttatccgtttagccctccgaatccggcactggtcgataactttcagcaggatctgatatttggcctgcaacgtgtcatcggggtaaatcctgtcgtattgcgcgccgtgacttctcagcatccgctgccacagaaattaccggaatctgaaatccagcgtgtttttgcaaagtatgttgatgaaactgactatgcgactgcaattacgcaaaagcgtgtgtatatcctggattatgcagatctggagatattgcagcgcaatcccggacaaatcgatggcggccgtaaacaatatgtcacaaccccgattgtggtgctgtttctgcaagcagatggcatattgcggccgattgccatccagctgtatcaggatgccgggcctgacaatcccatttatactccaaacgatggcaatctgtggctggcagccaaaacgtttgcccaggtcgcagatggtaatcaccatatactggttacccatgccacccgcattcattatgtgatggaagccattatcatggcctcacgccggcagctttataaatctcatccgctctgtgtgctgttgaatccgcatcttcgacatacactcaacgtcaatcatcagcacaccttcctgcgggatcgaaaagggcgccccggccggtatggtgagctgtttgccggagattatgatgcgacgactcagtgcatggccaatggtatgacaagttttgacttcagggcatcggccttccctaacgatattgccagccgggaagtcgataaccctgatctcttttatccgtatcgtgatgatggtgtgttgttatggaatgcaatccagcacttcgccacagaatatatcgatgtctgctatcaatcggatggggatgtggctgaagattgcgagattcaggcctgggcgcatgatatcggcgcccgggatcgcggcagaattcccgggtttcccgccaggtttgcatccagacaggaactggccgagactattggccatgtcatttttctatgtacggcattccattcgtgcattcatttcaaccagtacaaatatccgggttttgttcccaatatgcctcattcggcttatgcacctcccccggtggggaaaggtgcggaaatggatgcagacgggctgttgaagtttcaacccgcattccgggcggcatattcgcaaacctggacttatttccagacaaattttactgtcaatcgtatcggccagtatccgttgcggcaatttgacccggcagcacgtgatgtcatagagcgcttcagaaaacggctccaggaaatagaaggacgaatcgatcaaagaaacagcagccgacctgttccctatgaccggatgaatccaagaatcatcccgaatggggtaacggtttga

SEQ ID NO: 43414 - DNA, 618 bp, Nitrosomonas europaea
atgccggtacgtaccggccagattatcagcagttttaacaatccggcatgcatgtttcagcaaccgcgcctgctgccatggaaaagcacgctcgataacattgcgctgggtctcaaggcagctggtactgggcgtgacgagcgcacccgtcgtgcacgaatgctcggtttgcagactggtctcgcccacgaggatcttggcaagtttccccatcagttgtccggcggcatgcaaagccgcgtcgcactcgcacgggcgctggcaatcatgcccgatttgctgttgctcgatgaaccgttctccgcgcttgatatcggcctcaaggccgagttgtatgcactgttgctgcatcacttgaatacttgcagcctgggcgtactgatgattacgcatgacctcatggaagccatccgcctgtctgacacgattctggtcatggcgccgtctccaggtcgtatcgttcaccgcttcagaatcgatcttccggccatgcaacgggatgatgccttcgtctacaaaatgacagctgaactgctgcaggatagcgcggtacggacgagcttcagactggctccgataaaatccgagttgctgaccaggcaggagctgccatgctga

SEQ ID NO: 43415 - DNA, 2001 bp, Nitrosomonas europaea
atgtccatttcaccgacgttttccggatcttccctgcaaaagtcttcattatcagatcactcgaccatatcagaaccttttacggtcgttgacagggtgaacgggatttctgccgttgcactggatgatgccattacgcgcgctcgctcagctttgctggcgcaacagcgggaagatggtcactggtgtttttcgctggaagcagactgcacgattccggctgaatatatcctgatgatgcatttcatggatgaaatagataccgcactggaacgcagaattgccaatttcttgcgtaatcggcaggtaactgacgggcatggcggctggccgctgtactatggcggtgacttcgacatgagctgcagtgtcaaggtttactatgcgctgaagctggccggggattcaccggaagcagcgcacatggtccgtgcccgtaatgccatactggagcggggaggggctgcgcgctcgaatgtatttacccgcttgctgctggccatgtaccgccagattccatggcgcggtgtgccgtttgttccagctgaaatcatgctgctgccgcgctggtttccttttcatctgagtaaagtggcgtactggtcacggacggtgatggtgccactttccattctgtgtacactgaaagccaaagcagccaatccgcgtaatatccatgtacgtgaactgtttacggtcgacccggaaatggaaaaaaactattttccggtacgcaccccccttaatcacttgctgttgtatctggagcgactgggctcaaaactggaacctctgattccgtcgttcattcggcgcagagccttaaaaaaagccgagcagtggaccatcgaacggctcaatggaagagatggcctgggggcgatttttccggcgatggtcaatgcctatgaggcactgacattgctgggctacgaccatgatcatccattacttcagcaatgccgtctggctttgcgtgaactgctggtaaatgaaggggaagatatcacctggtgccaaccctgtgtgtctcccgtgtgggataccgtactggcttcgctggcgttgcaggaggatgaacgggctgataacgggccggttcgccatgctctcgactggctcgtgcccctgcaggcactcgatcagccaggcgactggcgaaatagccgccctgatctgccgggagggggctgggcattccagtatgccaatccgcattatccggatctggatgatactgctgctgcagcgtgggcgttatgtcaggcggatacagaggattatcgtaccagtattacccgggcagcagactggctggcgggtatgcaatcgagtaatggcggttttgccgcatttgacatagacaatgtgcactattacctgaatgagattccattcgcagatcatggtgcgttactggatccaccttcgagcgacgtgacggcgcgctgtatcggtctgcttgctctgaatggtgaggcaagacaccaggaaaccgtgaagcgcggattgacatttttattcaatgagcaggagccatccggcgcctggttcgggcgctggggtaccaactacgtttatggcacctggtccgtgctggaggcattgaagttagcgcgggtggatcatgatcatcaggcggtaaaacgtgcagtgcaatggttgaagtcggtgcaacgtgccgatgggggatggggagaaaccaacgattcgtatctcgattccgagctggccggacaattggaaaccagtacttcttttcagaccgcatgggcagtgcttgggctgatggcggcaggcgaggtggggagcacagcagtaagaaacgggatcgattatctgatccgtacccagagtgctgccggattatgggaagaaccctggtttaccgctccgggttttccaaaagttttctacctgaaatatcacggctactccaaatactttccgctatgggcgctgaaccggtatcgtgcaatgaatagcaggtctgttgtatga

SEQ ID NO: 43416 - DNA, 972 bp, Nitrosomonas europaea
atgtcggatgatgatcagatcagaatcgatggtgcgatagcgcgtaaaacaccttatggcatgctgcgtgaaccgaccttctcgggcatgctttcttttatgcgctgcaatttccgcaaagacctgacgggtgccgaactggtaatcagtggtattccactggatctggcggtgtcttatcgttccggtgcacgttttggcccgctggggattcgtcaggcttctgccgaagttgcttcgttaaagccttatccgtggggattcgatccattcgaacatcttgccgtgatcgattctggcgattgttttctcgacgtgcataacccgctgacgatccatggtgcgattgttgaccatgcacggcatattctggcctctggcgcacgtatgctgacattcggcggtgatcactcgatttcctatccgttgctgcaggcgcatgtggaaaagacaggtgctccgctgtcgttgattcacttcgatgcgcattgtgatacctggccggatgattcactcgcttcactgaaccatggctccatgttttacaaagcggtgcgggagggtctgatcgacgtcaaacgttccgttcagatcggtattcgcacctggaatgatgatttcatggggatcaatattctggatgccgatcggatacaccggcagggcacggatgcggtcgttgcagaaatcgagcgcatcgtcggaactcaaccggcatatcttacttttgatatcgactgccttgatccagcctatgcgccaggtaccggtacgccggtttgtggaggattgtctactgctcaggcactggcaatcattcgtggtcttacggcaatcaacctgattggcatggatatcgtagaagtatcgcctccctatgatcacagccagataacggcgcttgcggcagcccatatcgcctgtgatctgatctgtctgctggcaaagcgcaaggctgacgggctgttatag

SEQ ID NO: 43417 - DNA, 2226 bp, Nitrosomonas europaea
atgactgcattacttactgatctcaacccggaacagctggaagccgtcacctggtcacaccagtcagcactggtgctggcaggtgccggaagtggtaaaacccgggtgctgactacacgaattgcttatctgttgcaatcgggccgcacccggccacagaatatcctggcagttaccttcaccaacaaggcagcacgcgagatggtcgcgcgtatcggtgcaatgctgcctgtcaacactcgtgctatgtgggtgggcacatttcatggtttgtgtcaccgcgtgctgcgtgctcatcatgaagatgcggggttgccacaggcatttcagatactggatatggctgatcagctggctgtcatcaagcgtgtgctgaaggaacgatcactggatgaaaagatgttgccgcccagacaactgcaatggtttatcaataatgccaaagaagagggattacgagcctcgcaggtcgatgtgcatggcggtttcaatcagactctggccgaatgctaccaggcatacgaaattgtcagtatgcgggaaggtacggtcgatttcgccgaattactgctgcgctgctatgaattattgagccgcaatgaaattctgcgtgatcattatcgcagtcgtttcgaacatatattagtggatgaatttcaggataccaatcgcctgcagtataaatggatcaaattgctggcgggcccgggttcgcagcagcatgcagccatttttgccgtcggggatgatgaccagagcatctacgcgttccggggagcgcatgtcgggaatatgcgggatctcgaaaaggatttcagcgtaccgaagatcatcaggctggagcagaattatcgttcgcacggcaatattctggatgctgccaatgcgctgatcgaacataacaagggacgtttgggtaagaatttgtggactgcggcggggaagggtgaaccggtgcgggtatatcatgccgccacagatatggatgaaaccagtttcatcattgatgaaatcaaggcactgcatgccgatggcctggctctttctgatattgccctgctctatcgttccaatgcgcaatcacgggtgctggagcatggtttgttcaatgcatctgtttcctatcgtgtttatggcggtatgcgtttcttcgatcgtcaggaagtaaaacatgctttggcctatttacgactgatcgctttaccggatgatgacaatgccctgttgcggatcattaattttcctcccagaggaattggtgcacgtacattggaacagttacaggatcaggctgcgatgctcggcaccagtctgtggcaggcagcattcaaggtatatgagggagggaaagcggttgccaccaggaacagccagcccgggagaggaatagcaggttttgtcagcctggttttatccatgcagcaggatggcgagggcttgccgttaccggaaattatccggcgtgtgatcgatcagagcgggctggcagcacattatcaggctgaacgtgaaggtggcgagcgcctggagaatctcaaggagctgatcaatgccgcgaccagttttgtgcatgagtccgaagatgacagtcttactgcttttttggcacatgcttcgctcgaagggggtgagcatcaggcggaaggttatcaggatgcggttcagctgatgacagtacatgctgcaaaaggactggaatttcattcggtattcatcagcggtctggaggaaggtctgtttccccatgaaaacagccggaatgagcctgatggtctggaagaagaaaggcgtctgatgtatgtggcaatgacacgtgcccggcagcgcctgtatctgagttacgccgagagccgcatgttgcatggtcaggtgcgtgtgaacataccttcccgctttattgatgaaatcccacaagatcttttgaagaggctgcgctccgatttttccggaagaagttttcgtcagggggtgtcgggaacaggacaaaccgttgccagcactataaatagcagtcagaaaggcaggagtacgatggcagcagcagtcggaatgacatcatcagggctgaatagcgcaggttttcacgtcggccagcaagtatcgcatgccaaatttggcacgggtattatcctgaattatgagggtagcgggacggatatgcggatccaggtgaattttcaccaggcaggtacaaaatggctctcgcttgcttatgcaaaactggag

SEQ ID NO: 43418 - DNA, 915 bp, Nitrosomonas europaea
aagatcggtgttctgatgatcaatctgggtacgccggatgcgccgactgccaaagcactgagagcttatctgaagcagtttctgagcgagccgcgtatcgtcgaatttccacgctggctgtggtggttcattctgaatggcatcattctcaatgtccggccggccaagtctgccaaaaagtatgagcagatctggacatccgaaggttctcccctgagagtgcatactgcgcgccagacggcactggtagccgctttactggagcagcaggctgattcttcgctggtggttgaatatgcgatgattattggcaatccgtccattgcggaaaaattgcagcagatgaaagtacaaggctgtgaccgtattctggtattaccgctatttccccaatacgctgccagcagtaccggttgtgtgctggacggtgttttctccgaattgaggaaaatgcgtaatattcctgatattcgcactgtcaggcattaccacgatgatccgggttatattgcagcactggcacagaatgttcgtgattattgggaaaaacacggccagcctgacaaactgatcatcagttttcatggcgtgccgcgtaaaacattggagatgggtgatccctatcattgcgagtgtcagaaaaccgggcgattgctggctgaagcactggaactggcggatgatcgctatcagatatgttttcagtctcgttttggttttgcgcaatggttgggaccttatactgcggaaattctggcagagttgggtaaacagaaaaccgggcgagtcgatgtcgtttgtcctggcttcgtctcggattgcctggaaacactcgaagaaattgcactggaaggaaaagcgatttttaccgaggcgggcgggggtgaatttcattacataccaagtctcaatgaa

SEQ ID NO: 43419 - DNA, 1656 bp, Nitrosomonas europaea
atgctgcaaaatctgtctattcgcaatttcatcatcgttgaccatattgatctgcatttcaaatcaggttttacagttctgactggcgaaaccggcgcaggaaaatccattctgatcgatgcgctggaactcgtactgggaagacgggctgatacgagtcaaatcagatatggctgtaaacgtgctgaaattactgcacaattctccgtaaacactatccctgctttacaggagtggttagtggaaaatgcactggaagatgaaaccggtatatgtctgttgcgcaaaatcatggaatcgggtggacgttcacgcaacttcatcaacggacaccctgccaccctccagcaattacgcacggttggtgaatggctggtcgatattcacggccaacatgcccatcagttgctgatgcacggccacaagcaatgtgaattgctcgatgcctgggcaggtgaatcgaatcttgcccgggaagtagcctccgcttaccggcactggcaggatctgtgccagcaaagactcgcatgggaacagcacagcgaacaaaatttgcaggagcacgaaaccctgacgtggcaactccaggaactggccgccctgaatttctcactggaagaatgggaaaatctgcaaatcgaacataatcggctgacacatactgcaagcctgctggaaaccgcacaattcagcctggaatcattatcggaaaatgaaacggcggtactggcgcaactcagcacggtgctcacccgcctgaacagcctgatcgatatcgacaacacactcgaacccctctgcaaccagttgcaatcagctcagatacaactgcaggaaatcgtatatgaattgaaacgttatcagcagcaccttgatatcgacccccgcagactgcaggaaacagaaacacgcattgcagccattcatggaacagccagaaaataccgtatcatgccggaaatactgccggatttactggaaacaaccagacaacgcctggaatcattggaaaatgcagcaagcagcgaagcactgatgaaagcagagaaatctgccaggaataattttgagaatctcgccgccaggttgagtcaagcaaggcagcacgccgcagatcaattgtctggcttggtcacggaaaccatgcaaactctggcaatggcaggaggccgcttcaatgtggcattgatcccgataccctcgggtaatctgcacggcatggaacagatcgagtttcaggtgtcggcccaccgggatctgcccttacgcccgctgaataaagtagcctccggcggtgaactctcacgtatcagcctggcaatccaggtcattaccagcaaagccggcactgtccccactctgattttcgatgaagtcgataccggaataggcgggcgcattgccgcaatagtaggcaaattgctccagcaactgggaaaaacgcgacaggtaatgagcatcacacatctcccacaagttgcagccagaggagatcatcactggcgcgtatccaaaacctccgagacagaagatgagcaactgccggcaagccatatttcagaactggatgcagcagaaagaaccgaagaaattgctcggatgctgggcggtgaaaatctgactgccgccacgcgtcagcacgcagcagaaatgctg

SEQ ID NO: 43420 - DNA, 1023 bp, Nitrosomonas europaea
atcaatgctggcattgtaggtggaacaggttatacaggcgtcgagctgttacgtattctcgtacagcatccgaaagtcaaacttaaagtcattacatcccgacaggaagcaggtacgggagtggatgaacttttttccagtttacgcgggcagattgcgctcaagttcagtgatccggcgaaagtggatttcagcaagtgtgatgtcgttttttttgcaactcccaatgggattgccatgcagcaggcaaaagctttactcgattcaggaataaaagtgattgacctggctgctgattttcgtatcaaggatgttgctgagtgggaaaaatggtatggcatgacgcatgccgctcctgagctggtagccgaagccgtttacggtttgcctgaagtcaaccgggaaaaaatccgggatgcacgattgattgccaaccccggttgctatccaaccgcagtgcagttgggttttattccgctgatcgaagcgggggcagtagatgcggatcatctgattgcagataccaaatcaggtgtttccggagcaggtcgcaaagccgaaatacataccttatatgcggaagcatcagataacttcaaatcttatgctgtgccaggacatcgccatttgcccgaaatcaggcagggactgtccgagagatcgaatgggccgatcggattgaccttcgtgcctcacctgactccgatgatccgggggattcatgccacactctacgcaaggctgaccagagatgtcgatttgcaaaccctgtatgaaaaccgttatgccaatgagccctttgtcgatgtgcttcctgccggcagccatccggaaacccgctcggtacgtggttcaaatttttgccggattgcagttcatcgtccggggaatggtgataccgcagtgatactctcggttaccgataatttggttaaaggtgctgccggccaggccgttcagaacatgaatattatgtatggattaccggaaacgaccggtatccggcatgttccgctgctgcct

SEQ ID NO: 43421 - DNA, 996 bp, Nitrosomonas europaea
atgcacaccagaagaaacaataacccgtttttgtattcctgcctgaccctgtttatcctgattttcctgtctctgtcatcctctctggcgcaagccgggaaagtacgggaatactggattgcagcggaaaaaacagactggaattacgcaccgaccggtgcaaaccagatcgatctcgcaagtgatctgggagtctggggtaaaaccctgacttacaccaaatatcgttatatcggttataccgatggcagttactctcaccccctgccccagccggagtggatggggattctgggccccacgatccgtgctgcggtaggtgataccatcaaaatccattttctgaacaagaccgatatgccactttccatgcaccctcacggcgtgatgtacgataaggacaacgagggtgcagatggcggcaagggtggcagtattccaccgggtgagcgctacacttatacctggatcgtcgaccaggatgccggccccggcccgggtgatccttcatccatcgtctggctgtatcactcgcacgtgatggcagaggaagaagtcaatctgggactgatcggaaccctcatcatcacagctgccggcaaggcgtattcagacaagaatccggctccgcgcgatgtcgatcaggaattcatcgcgctgtacatgatcttcaacgaggaaaacgatgaggaaagcggcctgaaacatgcgatcaacggccggattttcggcaatctgtccggttttgaaaccagacgcggacagcgtgtccgctggcatctggtcgcactgggcaatgaagtggacaaccataccgtacactggcacgggcaaaccgtgctcgatcatggccgcagaaccgatgtcgtcgaaatcatgccggccagcatgacttccgtcgacatggttccccgctcaccgggcaactggctgtttcattgccatgtcaacgatcacatgatcgcaggtatggcgacccgctggctggtgaagtag

SEQ ID NO: 43422 - DNA, 1839 bp, Nitrosomonas europaea
atgaacccgacgacccacaccctgcccactcacaacctggacatgatttcggtcgaaacggcccgaacactcgacggcctgttcagagaacgtgtcagacgttctccccatgctacagcctaccgcgactacgatgtcagcgaggaaatctggcgggattacacgtgggacgacatggcgaatgccgtcaaacgctggcaaatggcactttcacaggaaaatctctctcctggtgaccgggtagcagtcatggcgcgcaactgcccgcagtgggtgatgtttgaacaggctgcactgggattggggctggtggtcgtcccgctttataccgaagatcgggcagaaaatgcggcctggtgtctggataatgcaggcaccgcgctactgctgctggaaaacatgacgcgatgggaagccatgaacgaggccatgaccggacttcagcaactgaagcgtatcgtcattctggatgcttccccggaagatgtacgccagacaggtgacaagcgcgccatcgccctgcaggactggctgccggaaacaccgggcgatatcccttccgtgcaaaacgaccctcatgtactggccaccatcatttacacgtcagggacgaccggccgcccgaaaggggtcatgctgagccacaacaatattctgtccaacgcatacagcagtgcacaggttgtcactgtcagaccggatgatgtactgctgtctttcctgccgctatcccatacgttcgaacgcacggcgggctattacgtacccatgctgtgcggtgccacggtagcgtatgcccggtccatccgccaattgcaggatgatctgctgatcatccggccgaccatcctgatttcggttcccagaatttatgaaagaatctatgcaggaatacaggccaaactggcggaagggcctgcaatttccagactgctgttcaaactggcggtcgatataggatacagccggtttgaacgacaacagaaacgagtcggctggcggatttcacacttgctgtggccgctgctcgataaactggttgcgcgcaaggtcatggaaaaactgggaggccgtttgtggcaggtcatgagtggcggtgcggcattatcaccggagatctcacgtgtcttcatcggcctgggattacctatcctgcaaggatacggcctgactgaaacgagcccggtcgtctgtgccaatcggttggacgataatctcccgtcaagcgtcggccgccctgctcccggtgtggaagtcaggctgggagaacagaatgccctgctgattcgcggacccaatgtcatgctcggctactggaacaatccggaagccactcatgccattctatccgcagacggatggctcaattccggagataccgccagtatcgatgcacaaagcagagtcaccatcaccggccggctgaaagacatcatcgttacctccaccggtgaaaaaatcccgccggccgatatggaggcagccattctgcgtgacccgatctttgaacaggtcatgatcgtcggtgaaggccgctcctatctgagcgcgctgacggtgctgagcaagcgcgggtgggaagttgtcgccacccactgcaatgcaaaaaatgatccccatgcactggcgtgcgacgagtatgcggaagaaatcattctggagaaaattgcgcgccagatcagcggatttcccggctatgccaaggttcaccgtgcattactgatttccgaaccctggacagtagagaatgaaatgctcactccaaccctcaagctgaagcggaaaaagatttatgagcactaccaaggtgaaatcgaccagctttatgccagccgttag

SEQ ID NO: 43423 - DNA, 828 bp, Nitrosomonas europaea
atgaagttgaagtttacgaaaatgcatggattgggtaacgatttcatcgtgatcgatgcgatcaatcagtccgtttctctcgatcctgccacgatccgccggtgggcagatcgtcatttcggtatcggattcgatcaattgctggtggtggaaaaacccggagaaagtggggatttccgttatcgcatcttcaatgccgatggtggagaagtggaacaatgcggtaacggtgcccgctgcttcgcccgcttcgtacgtgaccacgatctgacccgtaaaaacactatccgcgtcgaaaccgcatgcggcatcatcatgccaactgtagaggagaatggtgaagtctcggtcgatatgggcattccccgattcgatccggcccggattcctttcatcacgcaggaacgtgccctcacctacccgctgaatgtcaatgaccgggaaatcgagatttctgccgtctcgatgggtaacccgcatgccgtacaaattgtgccggacatcgatctggcacccgtcacgagcgaaggacctgcaatcgaatcacacccgtttttccctgagaaagtaaatgccggttacatgcagatcgtggatcgcacccatatccggttacgtgttttcgaacgcggaaccggcgaaacactggcttgcgggaccggcgcctgcgccgcggtcgtcagcggtatttctcgcgggctgctggattccgaagtacaggtaaccatgcgtggcggcaatcttcgtatccgctgggagggagaagatcagccggtctggatgaccgggccggccgtttcggtgtttgagggtacgattgatctgtaa

SEQ ID NO: 43424 - DNA, 1731 bp, Nitrosomonas europaea
atgcgcacactgatcacctatatcatggtttttccgaagcgcagcgcattcgtactggttgcgctgctgctggccggcattgccgaagcactcagcctgactgcactgcttcccctgttatccatcgcagtaggtgaatcgatcgattccagcatgggcaaactggtagtcgatacgctgcatcaggtcgggctgtcacccacactggaaatcattctgctggtcatcgtcggcggcatgtttctcaaaggtgcgattctattgctgaccaaccagcaggtgggccatacggttgcgcatgtcgccactgcgctgcggctggacctgatcaaggcgctgcttgccagccggtggcaatactatctgcgccagcctgccggtgcgctggcaaattcaatcgccaccgaggcttatcgtgccgccatgggttttgaacatagtgtcaatgtgctggcactggcaatcgaagcactggtatacggcatcgtagctctgttcatttcgtgggaagccacgctggcgtcactgttgatcggcactatcctgtttgtggtactcaatcgcctggtcagagcagccaaacgcgccggtaacaaacaaacccatttactgcgtcatctgctgacgtacctgtccgatgtactcggctcggtcaaatccctgaaagccatggcacgcgataacgtggccgatgccatactgcacgaacagacccggatgctggaaaaagcgacacgcaaggaagtcaccaaccgggcagccctacttgccctgcaggagcctatcctggcagccctgacagcaagcggcctgtatctggcactggtggtctggaaactgtcattgccggaagtcatggtcatggtctttctactgacccggattctgggattgctgaataaaacgcagcgccgttatcagcagctcgtggcccaggaaagtgcctactgggccttgcgcaatgccgctgaagaagcgcgcatggaggcagaaagatcgactggtacgctggtaccgactctggaacaggggttgaacctgcgccacatcgttttcggttatgaacgaaaaacgattttcagcgatttgaatcttgaaattccggttcactcgttcaccgcgctcattggttcctcaggtgccggcaaaagtacactgctcgatttactctgcgggctggctgaaccgaaatccggtgaaatcctgatcgacggggtatccttgcatcatatcgatctgcgccgctggcggcacatgattggctacgtttctcaggataccgtgctgctgcacgataccatcctgaacaatatccttgtgggtgagcctgcgatcagcgtcgaagatgcggaacgcgcactcagacaagccggcgcatgggattttgtcagttcattccccgacggaatccatactgtcgttggcgagcggggcggcatgctttcaggaggacaacggcaacgcatcgccattgccagggcattggctcaccagccgaagctgttactgctggatgaacctaccagtgcgctggatccggaaagtgaacgcatcatctgtgcaacgctgcagaatctggcaaaggaattcacgatcatcgccgtttcccatcaacccgccgtcatcaacgcggcaagccaggtattcatcgtttccaatggcaaagcagagttactgtccgatgctgctgcccacctgcctgatattacaggtgcgaaagaagggaactga

SEQ ID NO: 43425 - DNA, 831 bp, Nitrosomonas europaea
atggatacctacgcagtcatcggcaacccggttgcgcacagcaaatcgcccttcattcatgcccggtttgcacaacagaccggccggatcatccattacaccgccctgctcgcaccactggacaggttcgagcagactgttctggatttccggaaaaccggcggcaaaggcatgaatatcactgttcccttcaaattcgaagcctttacactcgccagccggctgaccgatcgcgccagtgctgcacgtgcagtcaacactttccggtttgaagaaacaggagaaatactcggcgacaacaccgatggtgtcggattgatacgtgatatcgaggttaatctgaatttcccgctggcaggcaagcgcattctgctgatgggtgcaggtggtgccgcaagtggcgtcatcctgccactgttgcagcagcagcctgacctgctggccatcgccaaccgcacgccagataaagcagtgtcattacaacgccaattcgccagttacagcaatatcacaaccgggcattaccatgattttgccgggcagcatttcgatctcatcatcaatgccacttcagccagcctgcacaacgaactcccccccgtaccggcagatctgttccgtaacgcttttgcctacgacatgctgtacagcagcaggctgacaccgtttctggagcttgccagggtgcagggagctggatatctggcagatggtgccggcatgctggtagaacaggctgcagaatcctttctgctatggcacgggatccgcccggaaacgcagaccgtcatcagacagctcagggataatctgcgccaccctacctcgtga

SEQ ID NO: 43426 - DNA, 963 bp, Nitrosomonas europaea
atgaccatgtattcacggatcattggcaccggcagttacctgccggagaaagttctgaccaatcaggacctcgaatcgatggttgataccagcgatgaatggatacggacgcgtaccggtatcgaacgacggcatattgctgcagaaggccagatggcaagtgatcttgcgctggaagcgagccggaatgccattgaggctgcagatatccaggcaaaggacatcgatctgatcatcgtcgcaacgacgacaccggacatgatctttccaagcacagcctgtattctgcagaacaagcttggtatgtccaacgggccggcctttgatgtgcaggctgtctgcagcggattcatttatgcactggccacggcagacatgtttgtcagctccgggaaagcgcgtaatgcgctggttgttggtgctgaagtctactctcgtatcatggactggaacgaccgcagtacctgtgtcctgtttggtgacggtgcaggagcagtgattctcactcgtgatcagaaaccggggatcctttcatcccatctgcatgcagatgggagttacagccaggttctcacagcacctgcgtcgatccattccggtaaaatacaagggacccctttcattaccatggaaggcggtacagtcttcaaattcgcggtcaaagtcctggaagaagccgcactggaagcactgcaagcgaatcagctgcaaccttccgatatcgactggctgattccacatcaggccaatattcgcatcattacctcgacagcaaagaaactgggtatccctgaagaaaaagtggtagcaacggtttcacaacacggcaacacctcggctgcttccgttccactggcactcgaccaggcagtacgtgacggtcgtatccaaccggaccagcatatcgtgctggaaggtgtaggaggaggattcacctggggatcagttctggtacgctggtaa

SEQ ID NO: 43427 - DNA, 939 bp, Nitrosomonas europaea
atgaaagccgctttcgtttttcccggacagggatctcagtcagttggtatgatgaatagctattccgagctgccatcggtacgtggaactttcaatgaggcatcggatatcctgcaacaggatctatggtcgctggtcagtaacggacctgaagacagtctgaatctcactaccaatacccagcctgtcatgctggctgcagatgtatccatttaccgggcgtggcaacaggcagggggaattgagccgcattatctggccggccacagtcttggtgaatacgctgcgctggttgcagctgaagtactcacttttactgatgccctgaaactggttcgttatcgtgcaaaagtcatgcaggaaaccgttcccgaaggaaccggaggcatggcagctattgtcggactagatgatgatatcgtctcttcagtatgcaccgaagtaataaatgcgatgccagatacatcgcttgaaccggcaaatttcaatgcgcccggccaggtggtgattgccggccattcccaggcagttgcccgagcagtagtgctcgcaaaatcaaaaggagcaaagctggcggtcatactgccaatgagtattccttcacactgctcgctcatgcaatcggcagcagaaaagtttgctcttctactggaagaaattgcgctgcaacctccccgcattcctattttgcataatgctgacgtccagcaacattctgaaaccgcttccattcgtgagatacttgtgcgccagctctatcgtccggttcgctggacagagaccattcaggccatcgcggcacagaatgtaaaatatgtcgtggaatgcggtccgggtaaggtgctgtccggactgaaccggcgcatcgataagaatctggaaaatatcgcgctgaccgattccggctcacttctcaaaacggtagaaacgttgaaataa

SEQ ID NO: 43428 - DNA, 744 bp, Nitrosomonas europaea
atgctactggaacataaaatcgcactggtaacgggcgcaagccgtggaatcggcaaagctatcgcacttgagctgggaaagcatggcgctaccgtcatcggaaccgccacttccgaaactggagccggccatatcagtcagtatctcagcgaagctcgcatttcggggatggggctgatcatggatgtcagcaacatcgagcatatcaagagtggtattgagaccatacaacaatcactgggagatgttgcaatactgatcaacaacgccggtatcacacgagacaacctgctggcccgcatgaaggacgatgaatgggataacgttatccagaccgatttgaaatccgtgttctgtctcagtcgtgccgtactgcgcaccatgatgaaagcacgcagcggtcggatcatcaatatctcatcagtagtgggcgcaaccggaaatcctggacaaaccaactatgcagcggccaaggctgggatgatcggtttcagcaagtcactcgcaaaagaaattggcagcagaaacatcactgtgaactgtgtagctccaggctttatcgataccgatatgacccgttctctttcgccagatcaacaacaatcactgattcagcatatccctctcggaagattcgggcgccctgaagatgtcgctgcggctgtcgtttttctggcttctccggcagcagactatatcactggagccacacttcacgtcaatggcggaatgtatatggagtga

SEQ ID NO: 43429 - DNA, 258 bp, Nitrosomonas europaea
atgggtgtatcaatggaaattactgaaatagagcagcgcatcaaaaaaatcgtagccgagcaattgggcgtcaacgaatcagatgtcaaaaatgaatcttcctttgtcagcgatctgggtgcagattcactggatactgttgagctggtcatggcgctcgaagaagagttcgaatgcgaaattcctgatgagcaagctgaaaaaatcaatacggttcaggaagcgatcgatttcgtagcagccaacgcagctcagtaa

SEQ ID NO: 43430 - DNA, 1032 bp, Nitrosomonas europaea
atggatatatttatccagtacggaatggcggctgccatccaagctatcagagatgccggcatcagtgatgtaagcgggttcaacgcagatcgtattggtgtgaacatcggctccgggatcggcggcctgcccatgattgaaaataccgatgctgcctatcatgctggcggcccccggaaaatctcccccttcttcatccctagtaccatcatcaacatggtagccggtaatctgtctatcatgttcgggtacaaagggcccaatcttgccatcgttactgcctgtacaactgccacgcactgtataggcagttctgccagaatgatcgaatatggcgatgctgatatcatggtctgcgggggtacggaatcatgtgttacaccacttgctgtcggtggatttgcttcagcacgtgccttgtcatcgaacaatgatgacccggcggcagcaagtcgaccatgggatctcaaaagagatggattcgttctgggagaaggagcaggtattctcgttctggaagagatggagcatgccagaaaacgtggtgcaaagatttatgcggaactggccggattcggtatgagtgcagatgctcatcacatgactgcaccctgtgaagatggagaaggcgcagcccgttgcatgacaaatgcattgtctgatgcgcaaatgcacgctgatgagcttcattacatcaatgcacacggaacatcgactccattgggagatattgcagaaacgattgcagtcaagcgctgctttggtgaacatgcaaaagatctggcagtcagctccaccaaatcgatgaccgggcatttattgggtgctgcaggaggtgtagaggcaattttttctgctttggctgtttatcaccagattgcccctcccactatcaatctcgatgacccggatcctgcatgcgatctggattatgtgcccaacaatgccagagaaatgaaaattgatgcagctctgtcgaactcgttcgggtttggcggaactaatggcacactagtcttcagaaaaatctga

SEQ ID NO: 43431 - DNA, 2622 bp, Nitrosomonas europaea
atgaataaagcagaacaatcttcacacacccccatgatgcagcaatatctgcggatcaaagcgcagcataccgataagctgctgttttaccgcatgggggacttttatgaactgttttacgaggatgccgagaaagcagcaaaattgctggatatcaccctcacccagcgtggatcctctgccggggaaccgatcaagatggcaggtgtaccgtttcatgcagccgatcaatacctggccagactggtcaggctgggtgaatccatcgccatctgtgaacaaaccggagatcccgccaccagcaagggaccggtagaacggcaggttattcgcattcttacccccggcactctgactgacgccggattgctggaagaacgcagcaacagtatcgtactggcactggcactgcatcgtggctcgatcgggctggcctggctcaacctggcggcgggcgatatgcgtgtactggaaacctcttcggataacctgacaagcgagctggaacgcctgcatccggcagaaattctattgccggaatcgctcgatctgccagcaacgttgaataattttgctggacccaaacgtttaccggactggcagttcgactatgaacatgccatgcagcaacttacccggcaatttggcactcgcgacctgaatgcctttggctgcgaggatttgcacgcagccatcatggcagctggcgcattgttcgaatacgtcagactgacacaacaaaccgcaacagatggatcatccgggcagttgcccggccatctgcatacattacaggtagagcgacaggatgcctacttgcgcatggatgccgccacacgccgcaatctggaaattacactgacactgcgcggcgaggatgcacccacactgtcgtctctgctggatacttgttcgaccgggatgggcagccggttgttgcgacactggctgcatcatccgttacgcaaccggatcacgctgcagcaacggctcgataccgtatccgacctgatcggggcacaaccggaaaccctctatgcgggtatccggcagcagttcaaacatattgccgatatcgagcgcattaccagccggattgcactgagaacggccagaccccgcgatctgtccggcctgcgtgacagcctgatgcgactccccggaatcatcgaactgatcgcaacctcggcagcagctgccgttcatcgtttcatcccgcccatgcaaccagatcccttactcacgcaattgctcgttcgcgcactgcaaccggtacccggcgcagtcatccgcgaaggcggcgtgattgctgacggcttcgatgccgagctggatgagctgcgaggcttgcagggaaattgcgatgaattcctgctacagctggaagcgcgcgaacgtgagcgtaccggaatcccgaatctcaaagtggaatataaccgggtgcatggtttttatatcgaagtgacccgcgctcaaggagaaaaaatccccccggactaccgccgcagacaaaccttgaaaaatgcggaacgctatatcattcccgagttacaggcattcgagcacaagacattatccgcacgcgaacaggcgctggcccgggaaaaaatgttgtacgaacgactgctggaacagctggctgatttcatcattcccttgcaggaaatcgcccgctcggttgcagaactggatgtcttgtgtgcctttgccgaacgcgccgctctgtccggctataccaaaccggtattcaccgatgatcccgttctgatcatcgaagccggccggcatcctgtggtagaaaatcaggtggagcactatatcgccaatgatgtacaacttggagcgatcacgcgggaaaaccggcaaatgctggtcatcaccgggccgaacatgggcggcaaatccacttacatgagacagacggcactgaccgtcctgctggcacattgtggcagctttgttccagcccaaattgcccgcatcggaccaatcgaccagattttcacccggattggtgctgccgacgatctcgcgggcgggcgttctacttttatggtggaaatgacggaagcagccggtattttacgcaatgcaactgcccaaagtctggtactggtcgatgaaatcggccggggtacctcaactttcgacgggcttgcactggcttttgccatcgcccgccacctgctgacccagaaccagagttataccctgtttgccacccactacttcgaactgacccggctggcagaagagttcccgcaagctgtcaatatccatgtcacagcggtagagcacaaaaggcgtatcgtttttctgcaccggatagaggaagggcctgccagccggagttacggactgcatgtcgccgcactggcaggtgtacctgatagagtcatcaggaatgctgcaaaaattctggcgagactggagcaggaaacgctcagcagaagccctcagcagactttatttgaaacagtcgaggaaaatgcgaaagccgtgcctgcttccgtgcacccggtgcttgattacctcgagcggatccaccccgatgaactgaccccccggggtgcactggaacagctttacctgatcaaatcgatgctcaatcaaacggattga

SEQ ID NO: 43432 - DNA, 1248 bp, Nitrosomonas europaea
atgtatcagcatatcaaagtaccaaccactggcagcaaaattcgggtaaaggatgattcttccctggttgtgcccgacaacccgatcattccttttatcgaaggcgatggtatcggtgtggatatcacacctgtcatgatcagcgttgtcgatggtgcagtaaaaaaagcatacggcgactcccggaaaatttcctggatggaaatatatgccggtgagaaatctacccgggtctatggtcaggatatctggctgccagatgagactttgcaggcagccaaagaattcgtggtatccatcaaagggccgctgaccacaccggtaagtggaggtatccgctcgatcaacgtggcattgcgccagttactggatctgtatgtgtgcctgcgcccggtacgctatttccaaggggtacccagtccggtcaaacaaccggagaaagtggacatggtcatatttcgtgaaaactcggaagatatctatgcgggaatcgaatgggaagccggaacggaagctgttgaaaaagtgatcaatttcctgacggcagaaatgggaattaccaaaatccgattccctcgttcctctgcgatcgggatcaaaccggtttcaaaagaaggcagtgagcgtctgatcagaaaagccatccagtatgcaatcgaccataaacgtcgctctgtcacactggtgcacaaaggtaatatcatgaagttcactgaaggtgccttcaagaaatggggttatgaactggcagcgaaggaattcggtgcggagctactggatggcgggccatggatgatactgcggcacaacggtaatgaaatcatcatcaaagatgtcatcgccgacgcctttctccagcaaatcctgctgcgcccggatgaatatgatgtcatcgccacccttaatttgaacggtgactacatttccgatgctctggccgcacaggtaggcggcattggaatcgcgcccggtgcaaatatgagtgacagcatcgcaatattcgaagcgacacacggcactgcacccaaatatgctggtaaggatcaggtcaacccggggtcaattattctgtcagcagaaatgatgctcagacatatcggctggcatgaagcagccaatattgtcatcagctcaatggaaaaaacgattcaggatcgaatcatgacctacgatctggcaagacttacgccgaacgccaaacaggccacttcttcagaatttgggaatgccatggtagcgaggatgtaa

SEQ ID NO: 43433 - DNA, 700 bp, Nostoc punctiforme
  unsure (1)..(700): unsure at all n locations
cccgatatagccctaatcaaaacctacctgctcactttgcaggataacatctgtgcggccctggctcaggccgatggtcacgccgaattcacggaagagtgctgggtccgcgaagaaggtggcggtggccgcagccgggtcttggttaatggcgctgtattcgaacaagctggggttaacttctcccatgtgtccggggcgatgttacccgcctctgccactgctcaccggccagagttggcgggccgcagttttcaggcgctgggcgtgtcgctggttattcatccgctaaatccttatctgcctaccagccacgccaatgtgcggttctttattgctgagaaacccggtgaagacgccgtgtggtggtttggcggtggttttgatttaaccccgtactacggctttgaagaagatgccattcattggcatcaggtagcgcatagcctttgccaaccattcggcgagcaaatctatccgcgctataaaaaatggtgtgatgactatttttatattaaacatcgccaggaagcccgtggtattggcggcctgttttttgacgatctgaatagtcctgattttatgacctgctttaatttcacccaagccgttggcgatggcttcctggcggcttatatgccaatcgtcgcgcggcgtanagccctgggcttggggtgatcgagagcggnaattccagctt

SEQ ID NO: 43434 - DNA, 210 bp, Nostoc punctiforme
aaggtcaagaaaatcgtcatcgaacaactgagtgttgaagatgcttccaaaatcactccacaagctaagtttatggaagatttaggagctgattccctggatactgttgaactcgtgatggctttggaagaagaatttgatatcgaaattcccgacgaagctgccgagcagattgtatcggttcaagacgcagtagattacatcaataac

SEQ ID NO: 43435 - DNA, 739 bp, Nostoc punctiforme
  unsure (1)..(739): unsure at all n locations
gcagtctgaccagcagccgcaagaggcgagcattacctttgagcaggtgagctttcattatccgcaagcgcgtactggcgccgcgttgcaggaggtgagctttcatgtgcctgccgggcaaattgtggcgctggttgggccaagcggcgccggaaaaagcaccgtggcgcgcttgctgctgcgttacgccgacccggacaaaggccatatccgtattggcggcgtggatctgcgtgatatgcagacggacaccctgatgaagcaactctcgtttgtgtttcaggacaacttcctttttgccgacacgatagccaataacattcgtctgggcgcgccggatacgccgctggaggcggtaatagcggcggccagagtggcgcaggcccatgattttattagcgctctgccagaaggttacaacacacgagtcggggaacgtggggtatttctctccggcggccagcggcagcgcattactatcgcccgggcgcttttgcaggatcgccccatcctggtgctcgatgaggcgacggcgtttgctgacccggaaaacgaagcggcgcttatcaaggcgctcgcggcggccatgcgtggccggacggtcatcatggtcgcgcatcgtctctcaatggtgactcaggccgatgtgatattgctgttttccgacggacagctcagggaaatggggaaccatacgcaactgttggcgcnaggcggcctgtatcaacggctctggcac

SEQ ID NO: 43436 - DNA, 683 bp, Nostoc punctiforme
  unsure (1)..(683): unsure at all n locations
catccttacgtgccacagtcatttaaatatcgctcttgaagcgggccagtgggtggttggtggtgtatgactgacnnacctattaccccttcgctgaagatgcggcacattacacannaccattanaacaggcctgtgacaaacacccaccccagagtattacccagtatttaagaaatggtgtgatgaatatttttacctcaagcatcgtgatgagacacggggtgtaggtggtttgnttttttgattaccaagatggtcaaggtgctttatatcgcgggccaaatcccaatggggaagcggctatttatagcaaccaggtgggaacaccagcaacccgcaattgggaagatttgtttgcttttgtgcaaggctgtggcagagcatttttaccagcctatgtacctattgtagaacggcggcatgggatggaatatggcgatcgccaacggaattttcaactctatcgccggggacggtatgtagaatttaacttggtttatgaccgaggtactatttttggtctgcaaacaaacggacgcaccgaatcaattctcatgtctttaccgcctttagtgcgctgggaatacggttatcaaccagaacccaattcccccgaagcggagttgtatgaaaccttccttaagccccaagattggattaactggacacccaaatagtgc

SEQ ID NO: 43437 - DNA, 1035 bp, Nostoc punctiforme
aaagcctattccgcagccagtgcaacatcaccgatgtcctccacccagatcgcacggcgcgatccaaccgaacacgatgttcagatcgaaattctcttctgcggcatctgccactccgacctccattcagtgcgtaacgagtggagcagcataatttccaccgtttatccgattgtccccggtcatgagatcgtgggccgtgtcactgaggttggctcggcagtgaccaagtacaagcccggcgacctcgcggcggttggttgcttggtcgattcggatggtacctgtcttaattgcaaagctggccttgagaatttctgcccgaatcaaatcctcaccttcaactctccagacaagcaccttggtggcgttacttatgggggctactccgatagcattgtcgttgatgaacgcttcgtgctgcgtgttccctccaacctcgatctcgccggggctgcaccacttctttgtgctggaatcacaacctattcaccgatgcgtcactggggtgtcactgaaggcaagaaagttggcctagtcggtcttggcggactggggcacatgggcgtgaagtttgctcatgcgtttggtgcccacgttgtcgtcttcaccacctcacccgataaaaaggaagacgcgctccgcctgggtgccgacgaagtggtcgtctcccgcaatgccgacgagatgcagaaacacgctggcagcttcgatttcatcctcgacaccgtttctgccaagcaaaacatcaacgcctatctcaacctactccgcctcgacggcaatatcacccttgtcggcgcaccggagaagcccctggatgtcgcggcattcagcctgatcatggcccgtcgcagtctctccggctcaaacatcggcggcatccccgaaacccaagagatgctcgacttttgcggcaagcgtggcatcaccgccgatgtcgaagtcattcctatccagaaggtcaacgaagcctacgatcgcctgctcaagtctgatgtgaaataccgctttgtgattgatatggcatccctg

SEQ ID NO: 43438 - DNA, 738 bp, Nostoc punctiforme
attaaagacaaagttgtaattattaccggcgcatcatcagggattggtgaagcaagtgcgaaattgcttgcaagcaaaggcgctaaagtcgtattgggtgcgcgacgcgatcgccaattgagacaactggttgatgaaattcaaagagatggcggacaagcagtctatcaagtgatggatgtggttaacccatctgatagcgctgaaatcgtcaaccttgccaaggaaagatttggaggcatcgatgttattttcttgaacgctggcataatgcccaattctccactctctgcattgaaaacggatgaatggaatcaaacagttgatatcaatatcaagggtgtactcaatggtatcgctgctgtgttaccaacgtttattagccaaaagtctgggcatgttatcacaacttcatcggttgctgggttaaaagcttatccaggtggtgcagtgtatggtgggacgaaatggttcgtgcgcgatttcatggaagttctacgcatggagtctgctcaagaggggactaagattcgtactgcgacaatttatcctgcggcaattaacactgagttgttaaatcagattaccaaccaagatatggctgaaaaaatgacagagttgtatgagcaatatggcatctcacccgatcgagtagccaatgttgtggcgtttgcgattgaccagccagaagacacaaacgtgaacgaatttacgattggcccaaccacgcagccttgg

SEQ ID NO: 43439 - DNA, 598 bp, Nostoc punctiforme
  unsure (1)..(598): unsure at all n locations
ggaaattacacaggaaaggttgcatttgtaaccggagcagcaaacggcatcggtcgagctacggcgctggcgtttgcccgtgagggcgctaatgtcgtggttgccgatgtttcagaacagggcaatcaagaaacggtgcgcctgatcgaagacctcggcggacgagtgcttgccgtcaagtgcgatgtgacgcgaaccgaggacgtgacggcggctctttccaagaccatcgaaactttcggacggctggactttgcttttaacaatgctggtgttgaacagaagaaagctgcaactgcggaactggaggaggcagaatgggatcgcatcgtcaacaccgacctgcggagtgtctttctatgcctgaagcacgaaatcccgctaatgctcaagcaaggtggcggcgcgatcgtgaacacatcatcgggtgctggggtcatcggcatcaagggcggagccgcatacaccgccgcaaaacacggcgtgatcggcctcaccaaagcggcggccctcgactacgcctcgcagaacatccgcatcaacgnccgtgtgtcctggctatatcgacacgtcgatgatggatcgcttcaccggcggc

SEQ ID NO: 43440 - DNA, 1419 bp, Nostoc punctiforme
atgaacatcaaaaagtttgcaaaacaagcaacagtattaacctttactaccgcactgctggcaggaggcgcaactcaagcgtttgcgaaagaaacgaaccaaaagccatataaggaaacatacggcatttcccatattacacgccatgatatgctgcaaatccctgaacagcaaaaaaatgaaaaatatcaagttcctgaattcgattcgtccacaattaaaaatatctcttctgcaaaaggcctggacgtttgggacagctggccattacaaaacgctgacggcactgtcgcaaactatcacggctaccacatcgtctttgcattagccggagatcctaaaaatgcggatgacacatcgatttacatgttctatcaaaaagtcggcgaaacttctattgacagctggaaaaacgctggccgcgtctttaaagacagcgacaaattcgatgcaaatgattctatcctaaaagaccaaacacaagaatggtcaggttcagccacatttacatctgacggaaaaatccgtttattctacactgatttctccggtaaacattacggcaaacaaacactgacaactgcacaagttaacgtatcagcatcagacagctctttgaacatcaacggtgtagaggattataaatcaatctttgacggtgacggaaaaacgtatcaaaatgtacagcagttcatcgatgaaggcaactacagctcaggcgacaaccatacgctgagagatcctcactacgtagaagataaaggccacaaatacttagtatttgaagcaaacactggaactgaagatggctaccaaggcgaagaatctttatttaacaaagcatactatggcaaaagcacatcattcttccgtcaagaaagtcaaaaacttctgcaaagcgataaaaaacgcacggctgagttagcaaacggcgctctcggtatgattgagctaaacgatgattacacactgaaaaaagtgatgaaaccgctgattgcatctaacacagtaacagatgaaattgaacgcgcgaacgtctttaaaatgaacggcaaatggtacctgttcactgactcccgcggatcaaaaatgacgattgacggcattacgtctaacgatatttacatgcttggttatgtttctaattctttaactggcccatacaagccgctgaacaaaactggccttgtgttaaaaatggatcttgatcctaacgatgtaacctttacttactcacacttcgctgtacctcaagcgaaaggaaacaatgtcgtgattacaagctatatgacaaacagaggattctacgcagacaaacaatcaacgtttgcgccaagcttcctgctgaacatcaaaggcaagaaaacatctgttgtcaaagacagcatccttgaacaaggacaattaacagttaacaaa

SEQ ID NO: 43441 - DNA, 588 bp, Nostoc punctiforme
ctgaccctttatcattcgcctatttctcctaactcccgccgtgtttggattactcttctggaaaaagggcttgaatttgaattagtagatataaagctggatggggaacagtttcaaccagagtttttggcaattaacccatttcatcacataccagctttggtggatgacgactttaatgtagtggaatctttagcaatcctggactatttagaggcaaaatatcctacacctgcgatgttgcctaaagatgctaaggatttagcgatcgcacggatggtacaactggtaactgtaaatgagcttttgccagcagcgacgacgtttttacctcagatattaggtttgcctggagcagatccagaaaaaatcgagaaggcaaagcataaaattgccacagtgctgaagttttttgaaaatttattagacgatcgcccttactttgctagtcacaacctcactctcgccgaagttgtggctggaactgtagtaaatgtgctgccaagtgttggcattttcttaagtgaatatccaaaattaaatgcttggcacgatcgcttaattgtacgtccatcgtggcaagctacc

SEQ ID NO: 43442 - DNA, 474 bp, Nostoc punctiforme
atgggtgtatctggttctggtaaaaccaccataggaaaactgctagcagactctttaagctgggagtttagtgacgctgatagtttccactcaccagagaatgttgataaaatgcggcgcggtatcccgttgactgaagctgacaggatgccttggttgcaagatttgcaaacagccatcaaacattggctgcaagaaaataaaaatgtagtgctggcgtgttcggctttaaaagacagctatcggcaatttttggtatcggatagcgatcgctgcaccaacgccaagagcgatcgcattaagctagtttacctcaaagggttttatgagttaattcaaatgcggttgcaagagcgtagcaatcattacatgagcgaaaaacttctcaatagccagtttgatactcttgaagaaccattagacaccatatctatagatgtcgcacaaccaccccagatcattgtccagaatatt

SEQ ID NO: 43443 - DNA, 1635 bp, Nostoc punctiforme
atggcaaagacaattctgtacaaggatacggcccgttggacattggaaaaaggctttgacgctctgaccgaagccgtcgctgtcaccctcggtcccaaaggtcggaatatagttttggagaaaaaatttggcgctcctcaaatcgtcaatgatggagtaactattgccaaagaaattgaactagaagatcccgctgagaataccgggatttccttgctacgtcaagcagcctccaagacaaacgatgtcgcgggtgacggaaccaccactgcaattgtgctggctcacgcgatgcttaaagaagggctacgcaacgttacggctggtgccgatcccctgacggtgaaacgggggattgataaagctacggaattcgtcatcgaaaaaattaaagaacacgcccgtccaattaaagattctagggacattgagcaggttgcaaccatttcagcgggtaatgaccccgaagtgggtcggattgtggctgaggcgatggaaagagtgggcaaagaaggtgtaatctctttagaagaaggcagatccacaacgactgaactggaagtcactgaaggaatgcgctttgatagagggtacgtttcgccttactttgtgactgatccagagcgaatggaggcagtgctggaagaatcccacattttaatcaccgatcgcaagattacaatggttcaagatttagtgccgattctggagcaaattgctcggacaggcaaacccctactaatcattgcggatgacattgaaaaagaagccttggcaactttagttgtcaaccatttgcgcggtgtgttgcgagtcgcggcggtgaaggctcccggctttggcgctcaacgtaaagccatgctggaagacatcgcggcgctcacaggtggtcaggtgattagcgaagatacgggcttgaagctagaaaatgtcaggttagaaatgcttggtaaagcccggcgagcgatcgttaccaaagacgacacaaccatcgtggcagaaggcaacgaagaagctgtcaaagctcgcatcgaacaaattcgtcgccaaatccaagaagttgaatcctcctacgataaggaaaaactgcaacaacggctggcgaaactggcaggtggtgtcgcggtgattaaggtcggtgctgccaccgaaactgaactcaaagaccgcaagctacgtctagaagatgcaattaatgccactaaagccgcagttgaagaaggaattgtgcccggtggcggtacaacaatagcacacattgctccccagcttgaggaatgggcaaagagccaaatgaaggatgaagagttgacgggcactatgattgtggctcgcgcccttcatgctccactacgtcgcattgctgataatgctggtgctaatggtgcggtgattatggagcgcgtccgtgaactgccctttgatgaaggatacgatgccgttgctaataaatttgtgaatatgttcgaggcgggcattgtcgatccagcgaaggtgactcgtagtgctttgcagaatgctgcatctattggtggtatggtgctgaccactgagggtgttgtggtagaaaaacctgacaagcaggcgaaagcgccagctggtgtcggccctggccctggcgaaggcttcgattat

SEQ ID NO: 43444 - DNA, 972 bp, Nostoc punctiforme
gaagggctggtgcatctattgcaattaggcgaataccagttaaataaaaatcagtttcaagaagctttagggacatttcaagcagttttaactattgtcagacttataaaagaacgccaactcgaagcgagaactctccacaatattggggtagtataccgtgaaatgaaaaactaccctcaagctttagagtattatcaacaagctttagctgttcgcatagatgtcggcaatcgccgtgggcaaggcataactcttaatgatattggcttagtctacgataaccaaaaacaatataccaaagcactggagttttatcagcaagctttagctattcataaagaagttagcaacaaggcagacgagggaacaactctcaacaatatcggggtagtataccgtaaaatgaaaaactaccctcaagctttagagtattatcaacaagctttagctgttcgcatagatataggtgatcgtcgcggacaaggtataactcttaatgatattggcttagtttactacaaccaacaagaatatcccaaagccttaaattattatcagcaagctttagctattcataaagaagttagcaacaagatagatgaagggacaacacttgataatattggtttagtttacgttaagcaaattgatttagtttctgataaacaaaaagattatactaaagccttaaattattatcagcaagctttagctattcataaagaagctagcaacaaggcagacgagggaacaactctcaacaatatcggggtagtataccgtaaaatgaaaaactaccctcaagctttagagtattatcaacaagctttagctgttcgcgtagatataggtgatcgtcgcggacaaggtataactcttaatgatattggcttagtttactacaaccaacaagaatatcccaaagccttagattattatcagcaagctttagctattcataaagaagtt

SEQ ID NO: 43445 - DNA, 825 bp, Nostoc punctiforme
gttcttgttgatacccaatggctggaaaatcatctcaacgatccaaacgtccgcattattgaagtgaatatgagtccagaaccgtacaaaaatgctcacatccctggtgctgtcttctggaacatctttacagacttactattgcccgatttgaaactgaatttggatgcgatcgcttttgagaggctgatggcacgttcaggtatcacaaacaacacaacagtaattgcttatggcagttatcctggaactggagcctggattttctggcttttgcaagtctttgggcatgaaaatgtaaaagttctcaatggtggctaccagaaatggaagtcagaagatcgtccactagcaactgagttatccacgtttcctgctactgattaccgtgccagagctactgatcctcatctgcgagtattacataatgaagttcaggcatcgattggtagaagcgatgtctacgacgggctacgcctacgcgtgttgttagatgtccgaacaattcaagaatactgtggtgagtggtttttcgatcagccaccaaaagaaggtcaacttactggtcatattccaggtgcagtgcatcttgagcataccttaactctgaatgaggatggaacttttaaatcattcgacgaattgaaaaatctttataccagtaagggcattacggctgataaggaagtttttccctactgtactatcggtgcgcgttctggatatatctggtttgtgttgaagtatttattaggttatccgaacgttcgcaattacgatggctcttggaatgagtggagtcgtctacctgatgtagctatagag

SEQ ID NO: 43446 - DNA, 1138 bp, Nostoc punctiforme
aagaatgtacattttgtcagttgaaaaacgactgacagaaattgtcggcgatgtgggtaaaaaactgcatacggcgcgatcgcgtaatgaccaagttggtactgatactagactctacctccgcgaccaaatccagcaaattaaaagcgaattgcgagaattccaaggtgttttactggatatagctgaaaagcacgttgaaactttgatcccaggctatacccatctacaacgcgctcaaccagtgagtttagctcaccacctattggcatactttcaaatggcgcaacgcgactgggaacgcttgggagatgtttctcgccgcgtcaatatctcacctttggggtgcggtgctttagcgggaactactttccccatcgatcgccactacacagccaaactattagattttgataatatttatgctaacagcctcgatggagtaagcgatcgtgattttgcgatcgaattcttgtgtgctgctagcttgattatggttcacctcagccgccttgcagaagaagtcattctttggtcatctgaagaatttcgttttgtcatcctcaaagatagctgtgctacaggttccagtatcatgccccaaaagaaaaaccccgatgtaccagaactcgtgcgggggaaaacgggacgtgtatttggtcatctccaggcaatgctagtgattatgaaagggctacctctggcatataacaaagacctgcaagaagataaagaaggtctatttgatagcgttaacacagtcaaagcatctctagaagcaatgacaattttgctcagggaaggcttagaatttcgtacccagcgtttagcacaagccgtaaccgaagatttctccaacgctactgatgtagcagattatcttgcagcacggggcgttcctttccgggaagcttacaacctcgtgggtaaggtggtaaaaactagtattgctgcaggtaaactcctgaaagatttggaattggaagagtggcaacaactacatccggcatttgcagcagatatttatgaggcgatatccccccgtcaagttgtggcagcccgcaacagtcacggtggtactggctttgtacaggttagcaaagcactcatagccgctcgcgctcaaatcgatcaataa

SEQ ID NO: 43447 - DNA, 1524 bp, Nostoc punctiforme
gttagtctgctaaaaaatcccttgcgcgttggtctgcaacaacaagggatgcctgaaccccagattatagttatctttggcgcttctggtgatctcacctggcgcaaactagtgccagcactttacaaattgcggcgagaacggcgcattccaccagaaactactattgttggcgtagcacgtcgagaatggagccatgaatacttccgcgaacaaatgcagaagggcatggaagaggcacatcctgatgtcgatttaggggaactctggcaagacttctctcaaggtctcttctacagtcctggagatatagacaaccctgaaagctaccagaaactaaaaaccttactgagtgaattagacgaaaaacggggcacgcgaggcaatcgcatgttctacctatcggttgccccttcattctttcccgaagcaattaagcagctaggaagcggcgggatgctagaagatccctacaaacatcgtctagtaattgaaaaaccctttggtcgggacttggcttctgcccaaagccttaaccaagtggtacagaaatattgcaaagagcatcaagtatatcgtattgaccactacttgggtaaagaaacagtccagaatttgctggtgttccgctttgccaatgcgatttttgaacccttgtggaatcgtcaattcgttgaccacgtgcaaattaccgtagcagaaaccgtgggcgtagaagaccgggctggctactatgaaagcgccggcgcactgcgggatatgttgcaaaatcacctcatgcaactttactgcttaacggcgatggaagcacccaacgcaatggatgccgacagcatccgcacagaaaaagtgaaggtactccaagctactcgtttagctgatgttcacaatctgtcgcggtcagcagtccgtgggcaatacagtgctggctggatgaaaggtcaagcagtgccaggatatcgcacagaaccaggcgttgaccccaactccaccacacccacttatgtagcgatgaagtttttggtggataactggcgctggaaaggtgttcctttctacttgcggactggaaagcggatgccgaaaaaagtgagtgaaattgcaattcacttccgcgaagttccatctcggatgttccaatctgccgctcaacagacaaacgccaatattttgacgatgcggattcagccaaatgaaggtatttccctgcgttttgatgtcaaaatgccgggggcagaattccgcacccgttccgttgatatggactttagttatggttcctttggcatccaagcaacatccgatgcctacgatcgcttattccttgattgtatgatgggcgatcaaacattgttcacacgtgcagatgaagtagaagcagcttggcaagtagtgacaccagccctttccgtttgggatgcacccgccgatcctactactattccccagtacgaagccgggacttgggagccagaacaagcagaactcttaattaaccaggatggccgtcgctggcgcagactc

SEQ ID NO: 43448 - DNA, 969 bp, Nostoc punctiforme
atgaccccagccacctccctgtttacccctgtggaagcagacctgcgactactagcagataacctaaaacagctagttggaaatcgccaccccattttgtttgcagcagccgaacatttattcggagctgggggaaagcgtatcagaccagcaattgtcctgctaatatcgcgggcaacaatgttagagcaagatattacaccgcgtcatcgccgcctagctgagattacagaaatgattcacacagcaagtttggtacatgacgatgtggtagatgaatcagacgtgcggcgaggcgttcctaccgttcatagtttgttcggtaatcgcattgccatattagcaggagattttctttttgcccaatcgtcctggtatttagcaaacttggacaatttggaggtggtgaaactcctctcagaagtcattatggatctggctactggagagatccagcagggactaaatcgttttgatgctggtatctctattgaaacttaccttcagaagagttattacaaaacagcttcgttaatcgccaacagttctaaagctgctgggttacttagtgaagtctcgcgggaaactgttgagcatctttatagctacggtcgtcattttggtatagcatttcaaatcgttgacgacattctagatttcaccagtacaacagataccttgggtaaaccagtggggtccgatctcaaaagcggtaatctaactgcacctgttttatttgcattagcagaaaaaccatccttagaagtgctaattgaccgggagtttgctcaagaaggggatttagagcaagcactagcactaattcaagatagtcaaggcatacacaaggcgcgggagttagctgctcaccatgctaagttagcaattgaacatcttgcagttctcccaccctcagaatctcaccaggcattgattaacatagctgagtacacactgagtcgcctctat

SEQ ID NO: 43449 - DNA, 2586 bp, Nostoc punctiforme
atgcaacctactaatcctaaccaatttacagaaaaagcctgggaagcgatcgcccatacccccgatattgttaaacaatatcaacaacagcaaattgaaagcgaacacctgatgaaggcgttgctagaacaagatggtctagcaactgggattctcaccaaagcgggtgttaacctccaaaaactgcgcgatcgcactgaacaattttttcaacgtcagccaaaagtatctggtactagcagttctgtttacttgggacgcagcttagatacacttctagaccgggcagacgtgtatcgcaaagagtttcaagatgaatatatttcaattgaacacttattgctggcttacgctaaagatgaccgctttggcaaagctttattccaagaattcggtttagacgaaggcaaactaaaagatattattaaacaagttcgggggagccaaaaagtgaccgaccaaaatccagaaggcaaatacgaagcactggaaaaatacgggcgtgacctcacagaagccgcgcgtaaaggtcaactcgatccagtgattgggcgggatgatgagattcgccgcactgtccaaattctgtctcgccgcaccaagaataatcctgtgctaattggtgaaccgggtgttggtaaaactgctatcgctgaaggattagcacagcgtattattgcaggtgatgtaccccagtccctcaaagaccgcaagctaatttctttagatatgggtgctttgattgcgggggcaaaattccggggtgaatttgaagaacgcctgaaagcagtattaaaagaagttactgaatctggcggcaatattgttttatttattgatgaaattcacaccgttgttggcgctggtgcaacccaaggcgcgatggatgcgggtaacttgttaaaaccgatgttggcgcggggtgaattgcgctgtattggggcgacaactctagatgaataccgcaaacatatcgaaaaggatgccgcactagaaagacgcttccagcaggtttatgtcgatcaacctagtgtagaagatagtatttcgattttgcgcgggttgagagaacgttatgaaaaccaccacggggtaaaaatttctgatagtgctttggtcgccgccgccgtattgtcgagtcgatatattagcgatcgcttcttacctgataaagccattgacttggtagacgaagccgccgccagattaaaaatggagatcacctccaaaccagaagaactcgacgaaattgatcgcaagattctgcaattggaaatggagaagctatcgctgcaaaaagaaagcgatgccgcttctcgtgaacgtctagaaagactagaaaaagaaattgccgatctcaaagaagaacaaagaaccctaaatactcaatggcaatctgaaaaagatatcattgacaaaattcaatccgttaaaaaagagattgaacgggtcaatttagagattcagcaagcagaacgcgattacgaccttaaccgagctgcggagttgaaatacggtaatttaactagtttgcatcgtcagttggaagcagtagaagctgaattggcaagtgcccaaagaagtggaaaatcactatacggggaagaagtcacagaagctgatattgctgaaattatttctaaatggacaggaattcccatcagcaagctggtggaatctgagaaagagaaactactgcatttagaagatgaactacgccaccgtgtgattggacaagaagaagcagtcacagccgtagcggatgcaattcagcgatcgcgcgctggactggccgatcccaatcgtcccatcgctagctttattttccttgggcctacgggtgtgggtaaaaccgagttggcgaaagcgctggcgggctatatgttcgatagcgaagatgcgctggtgcgaatcgatatgtcggaatatatggagaaacacgccgtctcccgtttaatcggtgcgcctccaggatatgtgggttacgaagaaggcggacaactaacagaagcgattcgccgccgtccttactcagtgattctctttgacgaaatcgagaaagcacaccctgatgtttttaatatcttcttgcaaattctcgatgatggtcgcgtcactgatgctcaaggtcataaggtggacttcaagaatgctattattatcatgactagcaacatcggttcgcaatacattcttgatgtcgctggggataatgctcactacgacgaaatgcgccgtcgagtcatggaagcgatgcggaatagcttccgtccagaattcctcaaccggattgacgaaatcatcatcttccacggtttagataagaaggaattgcggcagattgtgctgttgcaagtacaaagattacgccaaagattggccgatcgcaaaatatccctcaagctctcagatgctgcacttgactttttagcagaagtaggatatgacccagtttatggggcgcgtccactgaaacgggcgattcagcgagagctagaaactcaaattgccaaagccatcttgcgcggtgaattcaccgatggcaacaccatctttgtagatgtgcaaaatgagcgtctttctttt

SEQ ID NO: 43450 - DNA, 1404 bp, Nostoc punctiforme
ataaatatgtcttctactactgttcgtcgtaaatccaacacgttttatgtcattttgattgctggtgctgctgccctcggcgggtttttattcggttttgataccgctgtgattaacggcgcggttttatcattagccaaagcttttaacaccagtagttgggtgacaggactggcagtgtctctcgcgttactaggatctgcggtaggagccttttttgccggacagattgcagaccgttatggtcgagtcaaggcaatggtggtcgcttcggtgttgtttactatcagtgccattggctctgggatggccttcacaatttgggattttatcttttggcgagtattgggtgggattggaatcggcgttgctagcgtaatcgccccagcttatattgcggaatgttctcctacccatttgcggggaaggttaggatctctgcaacaattagcgatcgtagtgggaattttcgttgccttattgagcgactactttatcgctacgtcagcaggttcagcagactcgccgtttttgtttggggttgcagcttggcgctggatgttttggacagcagtcccaccagcagtattctacgggatggtagctttaacaattcctgaatctccccgttatttggttgccaaaggacgagaatcagaagctgttaacgttctgaccaagattttgggaggtgacgtactgccaaaaatcgaagaaattcggcagacagtgcttcgcgaacgccaacccaaattttctgacctcttaagcagaagtggcggactcctccccattgtttggataggaatcggcttatctgtattacaacaatttgttgggattaatgtaatcttttactacagtagtgttttgtggcgggcagtcgggttttccgaaaaagattccctatcaatcacggtgattacaggagccgtcaacattattacaacactgattgcgatcgcctttgtggataaatttggtcgcaagccgttgctaataataggttcaattggcatgaccctgaccttggggacaatggcttatatttttggtaatgctcccctagatgctgctggaaatccttccctcgccggaagcgctgggactgtggctctcatcgccgccaacctctacgtgttttgcttcggtttctcctgggggccgatagtttgggtgttgttgggagaaatgtttaataacaagattcgagcggctgcactttcagttgctgctgcaatccaatgggttgcgaatttccttatttccacaacatttcctcccatactccaatatttcggtctaggttctgcctatggactttatacaattgcggcggctacctcattctttttcattctcttttttattaaagaaaccaaaggaattgagttggaagacatg

SEQ ID NO: 43451 - DNA, 1059 bp, Nostoc punctiforme
tgccctatgactaactactttcgctccaatgttgatgcaatggctagctatgttcccggtgagcagccccaacgcggcacacagataattaaactcaacagcaacgagaacccctatcctccttcccctgcggcactagctgtactgcgaaatattgagggggagtggttgcggcggtatccagaacctttcggcggggaatttcggcaagccgcaagtaaagttttaagagttcctagcgattggattattgtaggcaatggcagtgacgaattgttgagcgtagtaattcgggcctgtgcagaacctggaaagaaggtagtttatccgatgccaacttatgtgctatatcgtacattggcagaaatgcaaggtgcagaaattattgaaatttcctacagcgaggactacagtttacctttggaagaaatggttgctgtcaatggttctgtcacattcattgcgtcaccgaatagtccatcggggcatctggtagcaattaacgagttgcgccaattagccaaccagttatctggagttttagtgattgacgaagcttatgtagattttaccgaagagaatgcgttggctttggtaaaggaatacgaaaatgtcatcataattcgtaccctttctaaggggtactcgttggctggactgcgattgggatttggagtggcgaatcctaaactgttgcagggattgtttaaagtgaaggatagctataacattgatgcgatcgcttgtgcaattggcacggctgctattaccgatcaagcttataaaaatgcttgtgtggcaaagattaaagcatcgcggaatcagctatcaacagacttaaaacaattaggttttcatatctgggattcccaaactaactttttgctggtacagcctccacaaagaaacgcggaatatctctatcaacaactgaaagaacagggaattttaatccgttacttcaagcagcctgggctagacgataaattacgcattactgttggcacagatgaacaaaatcaagttctagtagaagcgttgatttatttgttggggact

SEQ ID NO: 43452 - DNA, 735 bp, Nostoc punctiforme
tggaatccagaattatacgaacgatttgagtcggaaagaagtcgcccgttctacgacttagtagatatgatacatcggcaagaaaacttacgaattctcgatttaggatgcggaactggaaagttaacgaagtatttgcatgacacactagcagcacaggagactttagggatagatgcttctgagaaaatgctgcaaaaggctcgtcagtttgaaggtaacggactacgctttgagcaaggaaaaattgaggagaatccaggagatggggagtttaatgtgatattttctaatgcagcattgcagtggttgacggaacatgaggcgttatttgagaaattgcggggtaagttaaaacctggtggacagcttgctgtacaaataccaacgatggatactgagccagtacataaaatagcagttgagactgcaaaagaatttagtcaagaattgggaggatacgtgcggcgtttagaggtacttgctccagaaacatacgccaaactgctttatgaattggggtttgtgaagcaggaagtaaagcttcaggtgtatggacatgtgctgccttcacgagaagctgtagtagagtggtatcgcgggacactgctaacagcatacgaatcgaagttagatgcccaaacctatgaacgatttgtagaacgttatcagcagaaactcttccagttgctagaagacgagcgtccgttctttttcccctataaacgcatctta

SEQ ID NO: 43453 - DNA, 666 bp, Nostoc punctiforme
cagggactcactcgccgttttgggaagttaaccgcagttaataacctaagcatatctgtggaacaaggcgaagtgtttggattgcttggccccaatggtgcagggaaaagtacagttcttaagatgttgacaaccttgctgcctatcagtgcagggaaagcaaccttagctggctatgacgtgactcgtcaacccaatcctgtgagacgggctatcggctatgtaccccaggcgctctctgctgatggtagtctcacgggttacgaaaatctcttaatcttcgcgaagctgtatggaatacctgccaaaggacgcgatcgccgcatctatgaaattctagaatatatgggtttgcaagatgcggcgaaacgcttggtacgaaactactctggtgggatgatccgcaagctggaaatcggcatatcagttctacatcaaccccaaattttgtttcttgatgagccgactgtcggactagatcctatcgctcgaactcaagtatggcagcttgtattacaactctgtgctgattacggcacaactatatttttaacaacccactttttagaagaagcggatagcttatgtaaccgagtggcgattatgcagcaaggtgaagtcgttactacaggtacaccaaccgacttaaaagcttctttagataat

SEQ ID NO: 43454 - DNA, 1665 bp, Nostoc punctiforme
  unsure (1)..(1665): unsure at all n locations
caaattgctcaaacctcaaccaatggctctgcgtttagtggaaatcagtctacttttactaaggcagagtctgagcaacaaatcaaagaccggaaaattaatcctacacccaaagctgcttcccaacagatcgagaaagaatcgatgatgttgagtccccgccagcagagacatctagactctttaattgcacattttgtcaagcgtacccaagaatctaaaaggcttacccaagcttatcgttcttgtcatgccaatagcagggcagtatcagggttctttccctttatcaaggagatgatatatccaatccatgcagagcgtggagagggtgctagactctgggatgtcgatggcaacgaatatgtagacatttcaatggggtttggtacgcttttatttggtcattcgccatcttttgcgatcgcagccatccaagagcaaagcaagcaaggtatactaaacggcccacaatcgcgttttgcaggtcaattagctgagttaatttgtgagttaaccggtgcggaacggacagctttntgtaacgatggcacagaagcagtgatggcggctgtacgcatagcacgttctgttacaggacgttcaaaaattgctttatttgctggttcttatcacggtggttctgatggagttttggtcaaaggagtaagaaccaacgacggaacgctacgttctgtcccgatgacttcaggtattccatcatccttagctgaggatgtgatggtgctggagtatggtactcccgaatctctcaatattcttaaagacaatgctcataacttagcagcaattttagttgagccgatacaaagcagtcgcccagattttcagcctaaagagtttctatttcaactcagacaattaactcaagaaactggaactgttttaattttcgatgaggtggttactggctttcggatgcacccaggtggcgttcaggctttatggggtattcaagcagatatcacaacttatggtaaagctgttgctgctggtatccctattggggtagtggctggcaaagctgtttttatggatgcattagacggaggtatgtggaactatggagatgagtcttacccccaggtgaaaacaacttttttcgctggtacttttttcaagcatcctctcatcatgggtgtcgcctgggctacactcaatcacattaagaacagtggttccaaacttcaggaggagttaaatcaacggacaacccaattagccgagactctcaatagttactttgaacaaaagcaagtaccaattcgagtcgttaattttggttctctcttccgttttaattgccagactcaacttggtaatttatttttctatcacttgcttgcaaaagggatttatgtctgggaaggacgcactctttatctatctacagctcacactgataaagacgttgaacaagtaatttctgcggtcaaagaaagcgtagttgaaatgcaagcagggggattttttacatctgagcagacttcaaaaaatagcggacagacgagcgccaatcaaactttgactggctcatctttaaacttagctactgaatcgctctcggttacttcaaatgtaaagtctgctgatgagttgtttgaaaacctgattgagcaaatacctaatgctttgggaaatact

SEQ ID NO: 43455 - DNA, 420 bp, Nostoc punctiforme
attctggcactgcatgggccaaacttgaatttgctagggcagcgagaaccaggaatttatggttcgttgacactagctgaaattaaccgcctgttagaagaagaaggattcaagttacaggcgaaagtttttcccttgcaatcaaatcatgaaggaattttagtagatactattcatgaagcattaggacaacatcaaggaattttgattaatgccggggcatatactcacacaagtgtggcattgcgagatgcgatcgcggctgttaacttgcccacagtcgaagtacatctgagtaatatttaccgccgggaagattttcgccatcattcgtacatcgccccagttgcgatcgggcaaataagtggttttggtgttcaaagttacttgttgggcttacaagctttggtaaatcattta

SEQ ID NO: 43456 - DNA, 1338 bp, Nostoc punctiforme
atgaagtttgacaaaatattaattgccaatcggggagaaatcgcccttcgcattctccgcgcctgtgaagaaatgggaattgcgacagtcgcggttcactccaccgttgaccggaatgctctccacgtccaacttgctgatgaagcggtttgcattggcgaacctgctagcagtaaaagttatttgaatattcccaatattattgctgccgcattgacgcgcaatgcgactgctattcacccaggttatggctttttggcagaaaatgcccggtttgcggaaatctgtgccgaccatcatattgcttttatcggcccaactccagaagctatcaagctgatgggcgataaatccactgccaaagaaaccatgcaaaaagctggagtcccgacagtaccaggtagtgaggggttagtagaatccgaggaagaaggattaaaatttgccaaggaaatcggctatccagtgatgattaaagccacagcaggtggcggtgggcgaggtatgcgcctagtccgttctgaagatgaatttgtcaaacttttcttggcagcgcaaggggaagcaggagcagcttttggtaattctggcgtttacatcgaaaaatttattgaacgtccccgccacatcgaatttcaaattttggcggataactacggtaatgtcatccacttgggcgaacgagattgctcaattcagcgccgaaaccaaaagttactagaagaatcccccagtccggctcttgatgaagacctgcgtgagaaaatgggacaagctgctgtcaaagctgcccaattcattaattacagtggggcaggtactatcgagtttctcttggatagatccggtaaattctactttatggaaatgaacacccggattcaagtagaacatcctgtaacagagatggttactggaatagacttagttgttgaacaaattcggattgcccaaggagaaagactcaagctttctcaagagcaagtagttttgcggggccattcaattgagtgccgaatcaacgctgaagacccagatcatgactttcgcccttctcctggacggattagtggctatctcccccctggaggccctggtgttaggattgattctcacgtttacaccgattaccaaatcccgccttactacgattccttaatcggcaagttaattgtttgggccccagaccgacccactgctattaaccgcatgaaacgcgcactccgggaatgtgcaattactggactgcctaccactattgggtttcatcaaaaaatcatggaaactccacaatttttgcagggtaatgtctatacaaattttgtccaggagatgaac

SEQ ID NO: 43457 - DNA, 576 bp, Nostoc punctiforme
atgaatacatcaaaacctgaagtagttgtcattaccggggcctccgccggtataggaagagccaccgttcgcgcatttgccaagcgaggagcctatattggactagtcgcccgcagtcgtgatgggctggaagctgcgcgtcaagaagtcgaggcggctggtgctaaagcactggtgctaccaaccgatgtttccgaccccgaacaagtggaagcggcggcggcggcggtagaaaaagagtttggcccgatagatatctgggtcaatgatgcgatggcatcgattttgtcaccatttacagagattaaaccagaggaatttcggcgcgtaaccgaagtgacatatttaggatatgtttatggaacaatggcagcattgcgacggatgaagccacgcgatcgcggcacaattgtgcaagtaggttctgcccttgcctatcgctcaattcccttacagtcagcttattgcggtgataagtctgctattcgcgggttcacagattctattcgttgcgaactgcaccacgatcgcagcaatgttcacatcacaatggtgcaaatgccagcagtgaacacg

SEQ ID NO: 43458 - DNA, 784 bp, Nostoc punctiforme
ctcaaaggtcaaaaagcacttgtaacgggcgctagttctggcattggtgaagctatagctcgcaatttggcttcgtcaggtgcagcagtagttattaactatcattctgaagcccaagaagcccaaaaaattgttgatgatattaaaactgctaatggagaagcattcgctattcaagctgatgtcagcaaagaagaccaagtaaaagcgatgttcagcaaaatgctccaagaatttggcactattgatattttggtaagtaatgcgggcattcaaaaagactcagcatttatagatatgaccctcgatcaatggaatgcagtgattgggataaacctgacaggacaatttttatgtgcgcgagaagcggcaaaggagttcttgcgtcgaggtgtgaagcccgatatttcttgtgcggcaggtaagattatttgcatgagttcagtgcatcaagtaattccttgggcgggtcatgtgaattatgctactagtaaaggcggtatcaatatgatgatgcaaagtattgcccaagaacttgctcctcacaaaattcgcgttaatagtattgcccctggcgcaatcaaaactccaattaataaatcagcctgggatactccagaagcagaggcgaagttactacaattgattccagcaaaacgagtaggtgatgtagaagatatcgccaaagcagcagtttggctagcttctgatgactctgattatgttaacggtacatacaacactatttgtagatggtggtatgactttgtatccagggtttaca

SEQ ID NO: 43459 - DNA, 842 bp, Nostoc punctiforme
ggagcctcacttcaaaagcttgccaacggtgcagtccatagtgaggggcctgtttacttccacgaagatgatagcgttgtgtggagcgatgctcacggcaaccgcctgttgcggtggagtgccactgacaatgtgactgtcctacgagatccatctgattaccaaagcggtaattaccgagacttagagggtcgtctagttgcgtgttcatctggtttgcgtgctattatccgacgcgaacatgatggtgaatggaaggttttagtcgatcgcgaccaaggtaaacgcctgaacagtccaaatgatttggttgtcaaaagcgacggtacaatttggttcaccgatccgccttatgggattaccgagccaaaccaaggttatggcggcgaacaggaacaacccggaagttacgtctatcgctttgatccggcaacaggtgagatttatcctgtagtaacagatatggtgcgccctaatgggttggctttcagtccaaacgaaagtatgctgtatgtttcagatacagctgcgtttaatattcctggggggcctcatcatattcgtgtctatgaggttgtaggcgatggctatgtaaagaatgggcgtgtatttgcagtcattgagccaggacaaccggatggactgcgggttgacgaatatggcaatgtttttactagctctcaagatagcgtgcagatatacgcccccgacggaactcgcttaggaaaaatttttgtaccggagacatcagctaacctgactttcggtggtaaagaaggcgatcgctatttatcacagccgatcattcgttatatgttatcaaccttaatacccgtggtgta

SEQ ID NO: 43460 - DNA, 669 bp, Nostoc punctiforme
tttgctgttggtatttgtcaacaccccagaagtaatgtcaaagtatggaatctcaattctgacaaactccttcacactctgttaggacatcaaaaaccggttaactgcatcgcaatcagtcctgacgggcaatttcttgccagtggtagtaataaaatcaaaatttggaatttgcataaaggcgatcgcatttctaccctttggcattcattcacagttaatgctgctgctatcagccccgatggtacaatccttgctagtggcagttctgacaacaaaattaggctgtggaacccacacacgggagatccattacgcaccctcaacggacattcaggtgagataaaatcagtaatcatcagtcctgatggagaaattctctttagcgctagtgcagacaaaactatcaaaatttggcatttaactacaggcaaagtgttacataccttgactggacatttagaagaggtaagatccttggctgttagtcctgatggagaaattctctttagcggtagcacagacaaaaccatcaaaatttggcatttgcagacgggagagttactgcaaactatcacagaacactcagggacagtaaactctattgctattagccatgatggtcaatttttggctagtgctagttctgataaaaccatcaaaatttgg

SEQ ID NO: 43461 - DNA, 1428 bp, Nostoc punctiforme
ctatatgcctacttgcaacaccattcgcatcgctacatgagtagcagtttttctggggcattggcacatcgaattagcgaaacttctctgggtgttactcagacgatgcaaatgctaattactgaatttatgccagtaattgttgtgtataccgtcgctacgacgatactgtatcgctcctatcctcccctggctgcactcgttggcgtgtgggcagttctcttcatcagtatttcgttctggctagcaactcgctgccgaatttactcccggaaagccgcagccgccagaagtgagacaactggcatcatcgtagatacagtaacaaatctcaccagtagccgactgtttgctcgtttgggttttgaacgaggctatttgaatgagcaattaagccgcgaactcaaacaggtgagaaaatccaactggtactcggagcgaattcgctggtttcagtttatctcggcagccattctaaaaatcagcaccctgtattactcactttccctttggagtcaagggaagatcgctactgctgatttcgttgtcgcaactagcttatcgttattaataatcagtgaagcccggaatttgagccgccgctttctggaattttttgaacatatcggcaatgtcgccaatggtgtctttaccatcgttcaaccccacgagttggtcgatcgcgatcgcgcgatcgcacacccaattacccaaggtaagattgagtttcgccgagtgaatttcaattactctgatgaaaagaaagttttcaacaacctttctgtcaccatccaagccggacagcgtgtcggactggtgggcttctctggttctggaaaatccagctttgtcaatctaattctgcgtttgttcgacccccaatctggacagattattattgatggggtcgatattcgagacatgactcaggatgccctacacgcacagatcagcttgattccccaagatccgtctctgttccatcgcactttgctagaaaatattcgttacggacgcttggatgcaaccgatgaggaagtgttcgaggcggcgcgaaaggctaatgctcacgatttcattattcaaagtcaggatggttacaattctctggtgggcgaacgtggtgtcaagttatctggagggcagagacaacgcattgcgatcgctcgggtaatcctcaaagatgcgccgattctgattttggatgaagccacctctagcctcgattcaatcaccgaaaaagcgatccaagataccctcgacttagccatgaatgggaaaacagtcattgtggtggctcatcgactatctaccattgtccatctagaccggattttggtgtttgacaaaggtcacattatcgaagatggttcccacaccaaactgctggcactcggcggcgcttaccacaggttatggaaaatgcag

SEQ ID NO: 43462 - DNA, 1867 bp, Nostoc punctiforme
atgatcaaacgcctgcttgtggtcgagtctccgggaaaagtcaaaaaactcagtcaaattctgggttcggattggaaagttctagccagttgtggccacatccgagaactcagcaatgaaggggacgattccttgggcttcgtcatggacggcagtaatgttcggtgcaattacgttccgcgtgaccaacgagcgaaggaaacaattcagaaactcaagtctgcggtgaggcaggttgatgaagttgtcttagcaactgacccagaccgggaaggcgaaacaatcgcttggcatctcaaagaaacactgggtttaaaggaaccgaaacgagtaatttatactgagattacagcatcggcggtgcagagtgcgatcgctaatcccaaaaagctagaccaaaatttaatcggtgctgggttgtgccgagattgtctagataagttggtaggttataaaggtagccctttagtttgggcattgaataacggcgctaagagtgttggcagagtccaaagcgccacattgcacttaatttgtcagcgagaaaacgaaattctggcttttgtcccccaagattactggagtgtctgggtagattatgctgaaggatttcgggctttttacaaagggacggtcgattctgcaaaagatgcagcagaccaagaaactgaaactaacgatgacgcgaaagtaggtaatagtccagaacaccggaattaagcgcgttctttccgaagctgaggctacacgtttagttgaagaagcacagcgacatcctcatcaggtgattcattttgaaggaaaaatcgttaaccgccagccacctccaccatttacaacttctagccttcagcaagcagccggttcaaagctgaggtttgctcctgacaaaactatgattgtggcccaaaagctttatgaggcagggctgataacatatatgcgaacagactcagtaatgctgagtccagaattttgtgccagcgcccgtaaatggttagagcaaaatgatccgcagaatgtaccgcaccaagtcgccaagcatcgcagtagcaaatcggctcaagaagcacatgaagcgattcgtccaactgatgtgtttcgtccctcagttcagttgcgtttagaacttcctgatgatgagtttaatctgtatgtgatgatctggaaacggtcaattgcttctcagtgtcgtgctgctcaattgcgtaaaactttggtgattactcaatctggttccttactgtggtcagccagagggcaagtgattgaattttacggttatgctcggtactggaataatctcagcaaggatagtgttttaccttcattacaacagggacaagcattaaaactggagaatgctggacatgagaaaaagcagacgcagccaccaccccgttacagtgaaccaaaattggtacagttgatggaacgtaaaggaattggtcgcccaagtacctatgctcctactgttgctactttaaaaaaacgaaattatgttgagttaaaaaaagatcatctgcaaccgacagcgttagggttagaagttgatgcatttttgctcaaagcactgccggatttactagaggcggaattcacagcaaaaatggaagatgctcttgatgcaatttctgaaggaaaaaactcttggcagcattatttaactagttggaatcagaattactttataccagcgctctccaaagctaaaactgtagttgcgagttccccaaaaggtaaagctaatgtgataactgagcgcaaatatgaaacttccaaaacgcgatgccctgaatgcaaaaattttcttgccaaaattccgagtactaaagtcaaaaagaaatatttcctcaaatgcacaaaa

SEQ ID NO: 43463 - DNA, 1017 bp, Nostoc punctiforme
tttcaacaagtattcggtaaaccacctgaaactcaagccagtgctccaggaagagtaaatttactaggcgaacataccgactataacgatggcttcgttctgccaactgcgattcctcaatccacgacggtacagctaggtttgagtagcgatagccaccatcacttttactcggaaaatctgaacgagcaagtgagcattttagatataaaccattccccgtctggatttgccagttatatttttggctgtattgaagttttacaaaaagcaggatacaaaataccatcactttgtgtctacgttaaatcatcggttcctatgggttcgggtttgtctagcagcgcggctttggaagtggcaacacttcgggcagtacgccaacttctgaactttcccattgatgatgttgaaatcgcccaatttgcccagcaagcagaaattcactatgctggcgtgcagtgcggcatcatggatcagatggcttctagcttggctgatactgaacatatcttgtttttagatactcggactttaaaacgccgggtgatgcctttgccagacaacgccgaaattttggtgattgatagcggtgtaccccgcaccctggcaactagtggttataatcagcgtcgggctgaatgtgaggaggcggcgcgatcgctaggagttaaggcactgcgagatattactgatgttgaagtaacagaaaaactacccgaacctctacggcggcgtgcccgtcatgtggttacagaagataaccgcgtcttggaagtgttgcagggagtctcatctgagcgctttggtgaattgatgaacgcatcccacgccagtttgagagacgattacgaagtatccgtacctgcactggatactctagtagaactgttgcaaaaaactccgggagtgtttggtgcaagactcacaggtgcgggttttggcggggcaagtgtcgctttagttgtggctggtgaagcgagaagtattgcaacccatgttcttgaacaatacaag

SEQ ID NO: 43464 - DNA, 1293 bp, Nostoc punctiforme
attcatgaagtatttatgccggcgctgagttccaccatgacggaaggcaaaatcgtctcctgggtaaaatcgccaggggacaaagtggaaaaaggcgaaacagtggtggttgtagagtcagataaggcagatatggatgtagaaaccttttatgaaggctttcttgcccatatcatagttgaagctggtgaaactgccccggtaggatctgcgatcgccttcatagccgaaactgaagctgaaattgaacaggccaaatctcttgccaattccggcggcgtggctgctactactacctctgcccctgagccaatccccgccacagcctcagttgtaacacctgccttagcgtctcaaaatggctctaatcacaaagaaggcagacttgtagcttcaccccgtgcccgcaaattagccaaagaactcaaagttgatttaactacactccaaggcagtggtccctacggtcgcattgtcgccgaagatgtagaagcattgtccaataagggcaaacaacccgccactgccccagttgccccaccagcaactgtaccaaccagcgccccaattgcatccccagcacctcgcacaccagcacccgcgccagtggtagctgctgttcctggtcaaatcgtacctctaactaccttccaaaatgccgtagtgcggaacatggtagccaccatatccgtgcccgtcttccgcgtcggttatacaattaccactgacggattagacaaactttataaacaaattaaatccaaaggcgtgacaatgacagcgctactggcgaaagctgtagcagtgacattgcaaaaacacccattgttaaatgctagctattcagaccagggtattgtttatcattctgatatcaacatttccgtagccgtagcgatggatgatggcggattaattacacctgtgttgcaaaatgcagatgcagtggatatttattctctatcgcgtacttggaagtctttggtagaacgtgccagagcaaaacaactacaaccccaagaatacaacagtggtacttttaccctatctaatttggggatgtttggcgtagacaaatttgatgcgattttgccgcctggacaaggttcaattttagcgatcggggcatcccgtccgcaagtggtagcaacacccgacggtttatttggcgtgcgtcaacaaatgcaagtcaatattacttctgaccaccggattatttacggtgcccatgctgcggcgttcttgcaagatttagcgaaattgattgagacaaatcctcaatctttgacactg

SEQ ID NO: 43465 - DNA, 1246 bp, Nostoc punctiforme
ctaggactgaactgggatgaagggccgttttttcaatctcagcgcctggatctttataaagaagcagtacaaaaactgctagatcaaggattagcctatcgctgctacaccaccagcgaagaattagaagcgctaagagaagctcagaaagctagaggcgaagctccccgctatgacaaccgtcaccgcaacctaacaccagaacaacgtgccgcttatgaagcagaaggtcgttcttatgtgattcgcttcaaaatcgaagatgggcgggaaattgtctggaacgacctagtaaggggaaaaatgtcttggcgaggtagcgatttaggtggtgatatggtcatcgcccgcgcctcagaagagggtagcggtcaaccactatacaattttgtcgttgtagtggatgacattgatatgcaaatcactcatgtcattcgcggagaagaccacatcgccaataccgccaagcaaattctgctgtatgaagcaatgggtgcaaaaattccagagttctcccatacgccattaattttgaacatggaagggcgcaagctttctaagcgggatggtgtcacttccatttctgaatttcagaaaatgggctttactgctgaaggcttggtaaattacatgacattgctggggttggtcgccaccagactcgacgcaagaaatatttactttagaaacagcagctaaagagtttggctttgagcgtgtaaataaagcaggtgcaaagtttgactgggacaagctagattggttgaacagtcagtatatccacaatacgccagtagataaactcacagatttactcatacccttttgggaagcggctgggtataaatttgatggtggaagagatcgcgcctggttagaatagctggtaactttaattagccaaagtttgactcgtttagtagatgcagtacctcaaagccaactgttttttagcgatacagttgaatttagcgaagaaggcagtacacaactgaaacaagaaggttctactgctgttcttgaggcgattgtcacagctttagaaaatcagccgcaactgtcggaagccgccgcccaggacattatcaaacaagtggtgaaagagcaaaaagtcaaaaaaggcttagtaatgcgatcgctccgagcagccttaactggagatgttcatggccccgacctcattcaatcttggttactactaaatcagattggtttagacaaatcgcgtttgagccgggcaataaca

SEQ ID NO: 43466 - DNA, 1884 bp, Nostoc punctiforme
atgaaattctcttggaaagtcgtagtactctggacattgccggctttggtaattggctttttcttctggcaaggggcctttgcaggcgctcctactgacatgagcaagaatgcagctaatacccgcatgacttatggccgctttctagaatacttggacggcgatcgcgtcagcagtgttgatctctacgaaggcggtaggacagctattatcgaagcccgcgatccagacatcgaaaatcgcatccaaaggtggcgagtggatttgcctgttaacgctcctgagttaatcagcaagctcaaagaaaaagatattagttttgatgctcaccccatgcggaatgatggcgcaatctggggattgttgggcaatctcgtgtttccagttttattgattactgggttgttctttttgttccggcgttctagcaaccttcccggcgggccaggtcaagcgatgaacttcggcaaatctaaggcgcgtttccaaatggaggcgaaaaccggggttaaatttgatgacgtagcaggtattgaagaagctaaggaagaactacaagaagtcgtcaccttcttgaaacagccagaaagatttactgctgtaggcgcacggattcccaagggagtgctattagttgggcctcctggaactggtaaaactttattagcaaaagcgatcgcaggtgaagcaggcgtacctttcttcagtatttccggttcggaatttgtagaaatgttcgttggtgtgggtgcatcccgcgtccgcgatttgttcaagaaagctaaagacaacgccccttgtattatcttcattgatgaaattgacgcagtaggacggcaacggggcgctggtatcggtggcggtaacgacgagagagagcaaaccctcaaccagttgctcactgaaatggacgggtttgaaggtaacacaggcattattattattgctgctaccaaccgtcccgacgtactagactcagctttgttacgtcccggtcgctttgaccgacaagtaacagttgatgcacccgatattaaagggcgtttggaaatcttggaagtccattcacgcaacaagaaactagaccctagcgtatctttagatgcgatcgctcgccgcactcctggattcactggtgctgatttagctaacttgctcaacgaagcggcaattttgactgctagaagacgtaaagaagcgatcaccctccgcgaaattgatgatgcggtagatcgggtagtcgctgggatggaaggtactcctttggtggatagcaagagcaagcgcttaattgcataccacgaaattggacacgctttagttggcactttattaaaagaccatgacccagtgcagaaagttaccttaatcccacggggacaagcacagggtttaacttggtttactcccaacgaagaacaaggattaatttctcgttctcagttaaaagccagaattactggtgctttgggcggtcgcgctgctgaagaggtaatttttggggctgcggaagttaccactggcgctggtggagacttgcagcagttatcgggaatggcgcggcagatggtgactcggttcgggatgtccgacttagggccactgtcgttggaaagccagcagggtgaagtattcttgggtcgtgactggacaacccgatctgagtattccgaatctatcgcttcccgcattgatggacaagtccgagcgatcgtggaagaatgctacgacaatgccaagaagattgtccgcgatcatcgcactgtcaccgatcgcttagtcgatttgctcattgaaaaagaaaccattgacggcgaagaattccgccaaattgtggctgagtacgctgaagtccctgagaaacagcagtacgtaccgcaactg

SEQ ID NO: 43467 - DNA, 808 bp, Nostoc punctiforme
  unsure (1)..(808): unsure at all n locations
cgtactctagagatccccgctngattggggttaatgcgtcaatcggttgcgatcgccacggnaagcacacaattacgcccaagaaatcgccgcacccggacgttatgagtacgaaattcaggcggagatggaacggatctttcgagtccggggtgggatggggccagcttatccttcgattgtggcttctggcgtgaatgcttgcgtacttcactacatcgaaaataatcgtcaaatgcagaatggagaattactgctaattgatgccggttgtgcttacggttattacaactcggatattacgcggacatttcctattgggggtaaatttacgccagaacaaaagatgctgtatgagattgtattggaggcgcaaaaacaagcgatcgctcaagtaaaaccaggtaatcccttcaaattagttcacgatacagcagtgcgcgttatcactgaaggtttagttgaacttggcattctcaaaggtgaaattgataagttaattgaagaagagaaatataagccatattatatgcaccgcaccagtcattggttaggtttggatgttcatgatgtgggagtttaccagcacggtcaagacaaaccgcagattttacaaccaggccaaattctgacagtggaaccgggattatatattgtgcctgacacgaaactagcagaagaccaaccagagaccgatcctcgatgggttggcattggtattcgcattgaggatgatgtgttagttacacctgatggacatgaagtattaactgcgggagttcccaaggcagtgaatgaagtggaaaga

SEQ ID NO: 43468 - DNA, 1266 bp, Nostoc punctiforme
aaagattcgacatcctctgcaaccgtcgaagaaatcggagtagatccgacaatatttcacaatccagttaaaggtacaccagacaaaacctattcccttaaaggcggatacatccgcaacttccagtttaatccatctgaatacaatctaccatcagaatttgttgctggtttagataatactttcaaatggtcattgtataccgccaaacaagcaattgaacaaagtggttattggggtaatcaaactgttctggcaaaatgtggcgtaatcttaggtaatttgtcattcccaacaaaattatctaaccagctattctctccaatttaccagaaagctattaatcctgctgtcagagaacttttgcagtatgaagactttaatttagctgtcccaagtggaactacagcatctttatacaatgcgatgatatctggtttaccagcatctatcgttgctcaagcactatctctatctcagattaatttatgtctggatgctgcttgctcgtcatcattttatgccattaaactagcatctcattacttatggtcacacaaagctgatgtcatgttagctggagccatcagttgtgcagattccttattcgtgcggatgttattttctggtgttcaagggtatgcagaaaacggcatcagccgccccttagataaatcctctagagggctgattcccgccgatggtgttgggatggtaatgttgaaaagatattctgatgccattagagatggcgacaatattcttgctaccatctgcggtaatggactctcaaatgatggtaaaggtaagcacttactcagccctaatcctaaaggacaagtcctagcttttgaacgagcctataatgaggccaattttagtcccaaaactatcgattatttagagtgtcacgccaccggcacattactaggagatacaaccgaatttaactccatagaaacattctttggtcaaaatcaagctgcgcctctagtgggttctgctaaggcaaatactggtcacttgttaactgctgccggcatggttggcttgactaaagtgattttgagtatgtctcatggtgtaattccagcaactatgaatgtttcggaacctttaacttcagaaaaaggtacaatttctgccgataaaattgttagaacagctacagcatggcctaataataacgcaccaataaaacgagcggctattagcgctttcggttttggcggcactaattctcatctgattttagaacaaggaaat

SEQ ID NO: 43469 - DNA, 1875 bp, Nostoc punctiforme
gctagccgtaagccttccaaagtagaaggaatcaaggaaaatagtaattttttgcgtgaacctgtagcaactgaaatccttcaagatactacccattttaccgaaaatgcggtgcagcttttgaagtttcacggttcttatcagcaggataaccgcgacaaccgcactaagggacaggaaaaagattaccagtttatgctgcggacaaaaaatccgggtggtttagtaccgccgcagctgtatctggctttagataaaatcgctgatgagtatggcaaccacacgttacgagcaactacccgtcaaggtttccaactgcacggtattttaaagaagaatctgaaatcagcgatcgccacaattgtcaagaatctgggttcgactttgggagcttgcggtgacattaaccgaaatgtgatggcaccaccagccccctttaagaatcgcccagagtatcagtatgcttgggagtatgctcagaatattgctgacttgctgacagcacagacgggtgcttattacgaaatttggttagatggggaaaaagcaattagtgctgaagagaacccagaggtgaaagcagcgcgacagcgcaatgggaatgggacaattatccatgacaacgaagaaccgatttatggcacgtactatatgccccgcaagtttaaaatttgcgtgacggtgccaggggataattcgattgatttgtattctcaagacctgacattggtagtgattaccaataagaagaagcaattagaaggatttaatatttttgctggtggcggtttaggtagaacccacggtaaagaagaaactttcgctaggttagcagaccccattggttatgtggcgaaagatgatgtctacgacatagtgaaagcgattgttgctactcagagagattatggcgatcgcactgatcgtcgtcatgccagattaaaatatttaattaacgattggggcctagataaattccgtgcccaagttgaagaatattttgggaaatcagtcgaagccttcaaaccactgccagagtttaaatattacgacttcctcggctggaatgaacaaggtgatggcaagctattcttaggaatttccattgacaatggtcgaatcaaagatgaaggttcgtttcaactgaaaaccgctttgcgggaaattgtcgagcagttcaacttacacatccgtctgacagccaaccataacctgattttttacgatatcgaaccagatagcaagcaagctattcaagacattctcagccgtcacggtatcgtagacgaccctagtaaaatagaacctttagtacggtatgcaatggcttgtccggctttgcccacttgcggcttggcaatcacagaatcagaacgagcaataccgggtattttggaaagagttcgcgcccttttagataaagttggtttgcaaaatgaacattttgtggtaaggatgacaggatgccctaacggttgcgctcgtccctacctagcagaattgggctttgtcggtagcgctccagaatcttaccaattatggttaggaggttcgccaaatcagactcgactggcacaaccttatacagagaagctgcaccacaatgacttagaaatcttcttagagccaatttttgtttactttaagaaatctcggaaatcgaaggaaaaattcggtgatttttgcgatcgcgttggttttgatgccatccgcgagtttgctgctagctacgatcctaacaccgctaatggtgcaaacaaatcacgtcaccgggtcaatttgaaagaagaagtttatagcaagttgaaggaagtagcagaaagccaagggaagccgatgactcagttagtgactgaagcgctagaagcctacttc

SEQ ID NO: 43470 - DNA, 2277 bp, Nostoc punctiforme
atgagtgaatttaccaaaactctttgtccttactgtggtgttggctgtggactagaagtttcacccccagcccaacttggcaaagcaactaatcgagatggtcaaggaaatccgacttggcgggtgcggggcgataaagcccatccatctagtcaaggaatggtttgtgtcaaaggcgcaacgatcgcagaatctttagataaaaatagattacattacccaatggtgcgagactctttagatcaagagtttcggcgcgttagttgggatgaagcttttaatctcatcacgcagcgtattcaaacagtccgcttcacccaagggccagaagcgttatgtatgtatggttccggtcagtttcaaaccgaagactactacatagcccagaagcttatgaaaggctgtctgggtactaataattttgatgccaactcccgtttatgtatgtctagtgctgtggctgggtacattcaaagttttggctcagatggtccgccctgctgttatgaagacttggagttaaccgactgtgcatttttaataggcactaatacagccgaatgtcatccaatcgtttttaaccgactagagaaatatcacaaaaagaaccgcaaagtcaaaatgattgtggtcgatccccgacgcacgccaaccgcagaagccgccgacttacatttagccattcgtccgggtacagatatcgatttgttgaacggtatcgctcacttattgatgcgctggaactacatcgataccatgttcatggacgactgcaccagcaactttcccgcttatgctgaagtgattcgccactattccccggaagtggtagctcgtcaatgcggaatcagtattgaagatttagaaacagcagcccgttattggggtgaatctaggcgggtactttctttgtggtcgatgggtgtgaatcaatcatcagaagggacagccaaggtaagaactatcatcaatctgcacctgatgactggacaaatcggcaaacctggggctggccctttttccctgactggtcagccgaatgcaatgggaggacgcgaagccggaggtttggcacatttattacctggttatcgggttgtgaaaaatcctcagcatcgcgcagaagttgaggagttttggggacttaaaccaggacagatttcacccaatcccggtttgactgcttgggatatgattactggcttggaaagtgatgctgtcgggttattgtggattgcagctactaatccggctgtaagtatgccagatttggagcgaactaagaaggcgttgttgcgatcgccttttaccatttaccaagatgcttattatcccacagaaacctctgcctatgctcacgttttgctaccagcagcccagtggggtgaaaaaactggtgtgatgacaaactccgaacgggtggtaactctgtgtcaagcatttcgccaaccaccaagagaagctaaagcagattgggaaattttcgctgaagttggacggagattaggttttgaaaaagagttcgcctttgctaactcggctgaagtttatgctgaattcgtccaattaactcaaaatcgcccctgcgatatgacaggtatcagtcatgagcaattgacacaaggcccaactcaatggccttacccagccaagaaagtagagtcagtatttatcgatactgaaacaggactcttaagttttcagccagaagaagaaactttctctgacaaagaagccgagaagaagcgtaagtaccatacactcagaatgggaaaacggctttacactgatttacgctttcatacccctgatggacgcgctcaatttggggcatattactcaaagggattggcagaaccaccagacccagattatccttttgtgctaactaatgggcgactttacggacattggcatacccaaacacgcaccggtcgcattgaaaaaatttgcaaaatgcaccccgaaccgtttatcgaaattcatccccgtgatgcggcgaagttaggtattttagataatcagtgtgtgcaagtgcgatcgcgtcggggtaaagctcaatttcctgctaaagtgacaaaagcgatcgcacctggtacagtttttgtccctatgcactggggttcattatgggcagataatgccgaagctaacgccctcacccatccagaatcttgcccggattcgctgcaaccagaattaaaagcctgtgctgtgcagctgattccaatttctgtagaagttgcagtcaaagattatcaattccagtcatcacaa

SEQ ID NO: 43471 - DNA, 1578 bp, Nostoc punctiforme
atgacagacacaacaactacgactaccagcctcaataaattcgagaaattcaaggcgcaaaaagatggactcgccatcagggatgagatagagaaatttgccgccttgggctgggaagcaatggacgaaacagatcgcgatcatcggctcaagtgggtgggcgtattttttcgccctgttaccccaggcaagtttatgatgcggttacggatgcctaatggtattctcaccagcagtcagatgagtgttttagcccaagtggtgcagcgttacggagatgatgggtgcgccgatattaccaccagacagaatatccaattacggggaatcagaattgaagatttaccagatatctttaatagatttcacgcagttggtttaaccactatccaatcagggatggataacatccgcaatatcacaggcgatccggtggcggggttggatgcagatgagttgtacgacacacgagagttgatacagcagattcaagatatgctcaccaacaaaggtgaaggaaacccagagtttagcaacttaccacggaaatttaacattgcgatcgcaggtggaagagacaattcagttcacgctgaaattaatgatttagcttttgttcccgcatttaaggaagcgaatgggcaagaattctctaaaccaccgatatttggctttaatatcctcgtaggtggctttttctcagctaaacgctgtgaggcggcgattcctctaaatgcttgggtggctccagaagatgtggtagctgtatgtagagcagttttagaagtctttcgtgaccacgggccgcgtgccaatcggcaaaaatcccgcttgatgtggctaattgatgaatggggtttagaaaaatttcgagcagaagtagacactcgtttgggtaaatcgttattacccgcagccgcaaaagacgagatcgactgggaaaaacgcgaccacatcggagtatataaacaaaaacaaccggggctaaattacgcaggtttaaatattcccgtcgggcgactgtatgccgaagatatgtttgaaatcgctcgtctagctgaagtttttggcagtggtgaaatccgctttaccgttgagcaaaacatcgttatccccaacatttctgactcacggttagcaacatttttcacagaaccgttgctagaaagattttctattaatccaggtttactggcgcgatcgctagtatcttgcacaggcgcacaattttgcaacttcgctctcatcgaaaccaaaaaccgcgccctggaaatgattaaagccttagaagaagacttaatcttcaccaatccagtccgaattcactggacaggttgcccaaactcttgcggccagccccaagttgcagacatcggcttgatgggaaccaaaactcgtaaaaatggcaaaaccttggaaggtgttgatatatatatgggcggtaaagtcggcaaagacgctcatttaggaacttgcgttaccaaaggcgtaccgtgcgaagacttgcagccattattgcaagacttactaatcaaaaactttggggcaaaactcaagcaagaagccttagtaattagc

SEQ ID NO: 43472 - DNA, 4393 bp, Nostoc punctiforme
tttctctggcatattctccgcttaccgatgagtttttacgctcaaagatttgctggagaaattagcgatcgcactcgtcttaatgaccaagttgcagaggttctctcaggacaactggcaactactgtgattgatacagtaatggtcatcttctacatcctagtcatgtttcaatatgatgaaatactgacttctatcgtagttggatttgctgccattaatatcttgaccttgcgctggatttctcgacaacgcatagatgcaagtcagcgattgatgcaagaatacggtaaagcggctggtgcatcgattgccggactgcaatatattgaaactttgaaggcatcgggagtagagtcagatttcttctctaaatggtctggttactatactaaagcaattaattctcagcaggaattgggagtcgctaaccaaattttttcaggtttacctgtgttgttaacttccctttcatcagctttattactggttatcggtggctggcgagttattgaaggaaatctcagcattggaatgctcattgcttttcaagcgatcgttcagaattttcaagaacctgttaacaatttggttggctttgctggcactcttcaagagctagaaggaaatttaatccgtttggatgatatattaaataacccaactgacaatcaaatagaaaatagcaataattcgttgttatctgtgcagcaggatcgagatattgctcggcttcaagggtatatcgaattacgcaacttgacctttggctatagccgtttagactctcccctgattgaaaattttaatttatcagttcaaccaggacaacgggttgctttagtcggtgggagtggttctggcaagtcaacgattgccaaacttgttacaggactatacgaatcgtggtctggagaaattcgctttgatgaccgattaagagaagaaattgcacaggaaatattaactaattccatcgccttagtggagcaagatatcttgctattttcgggaaccgtcaaggataatttaactttatgggatactacagttcccgataaaaatttaagacaagcttgccaagatgctgctattgaagatgtagtgaattctctagctggagcatataattctgaattgatagaaggaggtacaaatttaagtggtggccaacggcaacgcctagaaattgcccgcgccttagcgcagaatccttctattctggttatggatgaagctaccagcgcgttggattcagaggcagaaaagattatcgatcaaaatctccgccgacggggttgtacttgtctaattgttgctcatcgcttgagtactatccgtgattgcgatgaaattattgtcttagaacgcggcaaggttgtgcaaagaggtactcatgaagagttgtggcaagtagaaggggtatactcgcggctgattagaagtgaaggagaagctcttgaggagataaaaaatggttaaccaaattagcgatcgccactttcaaggaaaagtatatcctcttaaaagcaatgagccaatcctactcaacgatccgcagactatttggatagttcactctggctctgtagctctgtttgccgtaacggtcaagaatggtgtaattgtcggaactcgccgttatcttttcagcagcgaatctggagaagctctatttggtactgctgctcaccacgactcaactgagagtcagatattggcaatttcaataggaaaagcagagttactaaaagtagaaagcgaatgttttcgggaattagtcgctaatgcagatatgaatgttgtggcattagtggaaggatggttgcataagttcaacgccacactcttgtcagccgttgtccctcccattcaaataagagcatctggacaagaacgattttcgctaattgctggtcaaactctgcaaccaaaatcaaatacagtcctttgggtacaagttcaagaaggagttttatactcgctaggaatcaaagaacttaccctagtatcacaaacaggaatagtgccactgactcatgctatatggatagaggcagatgatgcggctcaaattgctacagaaatcactagttccctacgagatacaaatactttactttctggactatctgtgcatagtcagcaattcctattttggaatcagctgagggaacagcaagaacgcaccgaagaactacagcgactaaaagcacgggaaaacctcaatcagcaggtgacgacagaagctttgggagagctagcatcgccactgatgcctccaaaagctgacttttttcagaaaggtgtaccactattagtagctgctggtgccgttgggaaaactttggggatgaaaatttctgctcctggtaagtcagaagacctcgaacgactcgaaaatcctttggaggcgatcgcacgagcttcacacttacggttgcggcaagttttactccgggataaatggtggcagcaagattgcggccctttggtagcatttcttcagaaagatgaagaaactcatccagtggcgttgctccctatttctgccaatcgctacgaactctacaatccaattacccaaacccgcaaccctgttgatgctgatattgccgctagggtagttccagttgcatatatgttttatcggtcttttccggataaagctctttctgtttttgatgtaattaaattcgccctcgccggtcgcagtaaagacttattgattattcttttcgccggtgttgtcgttactttattgggaatgcttgtaccgcaagctacagcgattttaattgataatgcaattcctgatagcgatcgcaattccttaatgcaagttggtttaggattactggttgcggcttttgcaacagccctatttcgtttggttcaaggattttctctgctgcgcttagaaacgacatctgatgcgtctacccaggcagcgatgtgggataggttgttaaatttacctgtctccttttttcgccagtacactacaggggatcttctatctcgcaccaactctgtgagccaaatacgtcgtcagctaggcggtacgattttaatccagctgattaccagtctctttgctttcctcaatttaggacttttattttactatagccctgaactatctctaattgctgttgcgatcgcaatagtaactattgctgtcactactatttcgggaatgattctggttcgtaaagttcatcccctcttagaaatcgaaggaaatatctttgggcaagttgtagagttaatcaacggtatatctaaactccgagttgctggggcccaaaagcgcggctttgccttttggagtaaaaattacagtcggcaaataaaactcgaacttagcactcaacaagttgaagacattgtggctgtgttcaacacggtgatgccaacacttacatctggaatacttttttggtttacagtccagctactaatgaaagctgaaatgactggcacagctggattaactattgggacttttctggcattcaatagtgcttttggtacttttgtcggcggggcgacagggatgagtaacacggtaactgatattttacaagttatcccacaatggaaacgcgcccagccaattgtggagatgttgccggaagtagaacataacaaagcagatccgggtaaacttatggggagaatcgctgtagaccgtgtttgtttccgctaccgaaaagatggcgctttaattttagaagacattaatatttatgctgaaccaggagaatttattgcactagtgggaggttctggcagtggtaaatctaccctgttgcgattgctactaagttttgaaacacctgaagacggcagcatttattatgatggacaagatttattggggctagatgttagtgctgtgcgccgacagttaggcgtagttttgcagaatggcaaaattatgtctagttcgatttttgataacctggctggtggtgctaggattaccttggatgaagcttgggaagcagctagaatggctgggtttgctgatgatatcgatgcgatgccgatgggaatgcatacggttatcagtgagggaggaggtaatctttctggtggacaacgacagcgattgctcattgccaaagctttagtgttgaaacctcggattttgctgtttgacgaggcaaccagtgctttagataatagaacccaagcaattgtgagcgaaagtttagataaactgcaagttactcgcattgttatcgcccatcgactgagtacaattcgcaatgctcatcgcatctatgtattgcaagcaggtaaggttgtacaacaagggagttttgacgagctagcttttatagaagggctatttgctcagttgatgcaaagacagatggcttag

SEQ ID NO: 43473 - DNA, 1101 bp, Nostoc punctiforme
gagtctagcaataagtttggctttaaactattttccgaagttctgaaagatgataaaggtgagaataatatttttatctcaccttcgagtatagcgatcgctctcgctatgacctacaacggcgctagcggctcaactcaacaagcaatggcaaaaaccctagaattacagggaataaatctaccagaaatcaactcttcttatgcggcagtattaaagcagcttttagaaaatccagatgcgaaagtacaactgagtattgctaactcgctttgggcaaatcaagatgttagctttgcaccagactttctcaagagaacccaggatttctatcaagctaaagtcagcaatttaaactttaaagatgccgccgcatctaatattatcaataactgggtaaaagaaaataccaaaggtaaaatcactaaaatagttgaaagtattgaaccataccaagtgttgtttctgattaacgccatatattttaaaggtaattggagtaacgaatttgacaaaagtcaaactgctcaataccctttttacgttacatctagcagacgaaaacaacacccaatgatgtcacaagaaggtgactatagatactatgaaagcaaagaatttcaggcggttagtttaccttacggtaaagatggaaaaatcagtttttatatctttctacccaaacaaagctctaacctcaaagctttttatcagaacttgaatgttgaaaactgggaaaaatggatgactcagttcaacaaacaaaaaggctttattcgcctacctcgcttcaaaacagattacgaagttacactcaatgatgccttgaaaaatttaggcatggaagaggctttcagcaacaaagccaatttttccggcatgggtaaaaattttgccattagccaagttaagcataaaacttttttggaagtgaacgaagaaggcactgaagcggctgcggctacttcagtgggaatagtagcaacatctttgagagatgaaccagaaccattccgaatgattgtcgatcgtcccttcttctgcgccattagggataatcagacgggaaacgttttgtttatgggttccatcattgatcca

SEQ ID NO: 43474 - DNA, 2418 bp, Nostoc punctiforme
atgtctgaattgcttcaagcagtcttagatagtgaagaaagaagtgatttgcgttcctttcttagtgaattacgccaacaagaaaagaagtacttgctgcggaacgacatactcaatgtatatagtgagtattgctcaaagtcccagaaaccagaggcttattacactacctctgagttaggcaaactgatttactatactcaggaaattattcaggaagattccaacttctgtttcatcatccgttcgaagattgctagccaagaagtttattggttgacatcagacttgagcattgagccgatgaccgtacaggatttgctggatttgcgcgatcgcttggtgaacaaatttcatcccaacgacggcgacctgctagaattggacttcggtccattttacgactacaccccaatcatccgcgaccccaaaaatattggtaaaggggtacaatttctcaaccgctatctatccagcaaaatatttcaagactccaagcaattgctggaaaacttattaaatttcttgcgcctgcaccattacaacggtgtccaactgctagtcaacgatcgcattcaatcacaacagcaactttccgagcaagttaagaaagctatcggctttgttaataatcgccccgatgatgaaccctacgaacaattccggtttcaattgcagtcaatgggttttgagccgggttggggtaacaccgcagcacgcgtgcgagaaactttaaatattctcgatgaattgattgattctgccgacccccagaccctagaagccttcatttctcgtgtcccgatgatttttagaatcgtcttagtgtcggctcacggctggtttgggcaagagggagtgttaggtcgtcccgatactggcggtcaggtagtttacgtccttgaccaggcaaagagcctagaaaagcagctacaagaagatgtcctgcttgctggtttagagaaattgaatgtcgagccaaaggtaattattcttacccgcttgattcccaatagtgatggcactctttgtaatcaacggctagaaaaagtccacggtaccgaaaatgcctggattttgcgagtgcctttacgggattttaatcctaacatgactcaaaactggatttcccggtttgagttttggccttatctagaaactttcgcgattgactcagaaagagaactacgggcagaatttcaaggcacacctgacttaatagttggcaactatactgatgggaatttaatagcattcttgctggcgcgacggctaaaagttacccaatgcaatgttgcccatgctttggaaaaatctaaatacttgttcagtaacctctactggcaagaattagaggagaaatatcatttctcattgcaattcacagctgacttgattgcgatgaatgctgccaattttgttgtcagcagcacctatcaagaaattgtcggaacaccggatagtgtgggacagtacgagtcttataagtgcttcaccatgccggagttgtaccatgttaccaatggtattgaattatttagtcccaaatttaatgtcgtaccgcctggagtaaacgaaaataattacttcccctacactcggactaaagatcgagtagagagcgatcgccaacgcctggcagaaacactctttactctggaagatcctacgcaaatatttggcaaactcgacgatcctaacaagcgccctctcttctcaatggcgcgtcttgaccacatcaaaaacctcacaggtttagctgaatgttatggtcaaagtaaagaattacaagagcattgtaatttaattttggtggcgggtaagttacgtgtagaagaatcaggcgataacgaagaacgtgacgaaattatcaaactctacaacatcattgacgagtacaatctccacgggaagattcgttggctgggtgtgcgcttgtctaaaactgattctggtgaaatttaccgagtcattgccgatcgccagggaatttttgtacaaccagctttatttgaagcttttggtttgacaattttagagtcgatggtttcaggattgccaacttttgccacacagtttggtggaccactagagattattcaagataaggtgaatggctttttgattaacccaacaaatttagatgaaacagccacaaaaattgtggacttcattactaaatgcgaacagaatcctaactattggaatgaaatttcgcagcgaggcattgaccgagtttacagcacctatacttggaaaattcacactagcaagttgttatcattagcacggatttatggcttctggaactttacctcgaaagagaatcgggaagatttgttacgttatcttgaggccttgttctatttaatttacaagccaagagcgcaacaactattagagcagcacaagtatcgg

SEQ ID NO: 43475 - DNA, 1797 bp, Nostoc punctiforme
atggccaaatttcaagatattgtcaattactttcgctctgactggaagttgagtgttttcagtattacagcatctagcatttacgaagttattgatttagttgtaccttatgcgattggacagattttaaacgttttgtctgctcaacctttggataaaccacttcaaagtgcgatcgcaactttttctgacatcaccaattacccagttaataaaactctatctttgagtgtattactggggttaattttcgttgtcacggtagtcagagcgcctacacaaccttggttaaccaattggtttcattgggatatagcttttagggcacgtcgagaaaaaaacgaaacagcgatcgctaaagttctgactataccgatagaattttatgatgaaaataaccctggacgtattgccggaagagtagctagaggaatttctaaccacacttgggtgtatccagaaattgccggacagttgattcctaaactagctcgtgtactggggatttttgtgtttatcttgttcattgagtggcgaattgcaattttatatctaatttcctttgtaattattctcagtttcagcttgaagaatttgcagcagttgattgggtacgaaagtcgcctggataaatatggagaggacaccgaaagccgcacttccgaattaatcaccaatatcaaaacggtgaaagcatttgcgacagaatctagagaactgaaacggcaaaagcaacgtttggatcgtgaactaacagtgcttgattatcgcattcacaaaggttatacgatactgggtacttggcaaagaactgtaattcagttttgtgtgtttacaattctgggtttgactttagcagcaacagtaaatgggagaatttctctcggtcactttgtcatgaccttaactctttctagtatggcttatgccgaattagaacctattagtagcttggcagaagtttttgcccgtcgttattcttctatgctgcggtttcacgaatttctgcaagagccaactgcatctgattcagctactcttttagaagagagcaaccagacagaatcaccttataaatttactggaaaagttgagttatcgcacctcagctttggatatgatgccaagcatcaagttttgcaagatattaacttgttgattgagccataccaaacagtggcattagtagggcgttccggttctggtaaatctactttagtgaaattgctgttgcgatatttcgaacctcaagaaggccaaattttgattgatggtcaagatattcggactttggatgtgggtaagtatagacggagattagcgatcgttcaccaagaagtagatgttttcaacggtacgatattggataatctcacctacggcagaccaaatgctagtttggaggaggttcaggaagcttgtagaattgccagagtcgatgaagtagtgcagcacttacctaaaggttattataccgtcgttggggaaagaggtgtcaggttatctggaggacaaagacagcgcttgggaattgcgagggcgttgctagtgaacccagacgtgctgatttttgacgaagccacctctagcttagattatgaatctgagcgttcaattcagctagcaatgcgatcgattcagggtacttgcaccactattgtgattgcccaccgtttaagtacagtgcgagaagcagataaaattgtagttctggagcaaggaaagattgtagaagtgggtagccacgatgaactcttgcatcaagaaggcatttaccgccgcttgcactccctacaa

SEQ ID NO: 43476 - DNA, 2076 bp, Nostoc punctiforme
aatcccctacttcaaggcgttggtttacctccctttgcagagattaaaccagaacgagtagtaccagccttcaatcagttgttggcagaactagaccagcagcttgccaccttagaagctagtgtacagcctacttggagtggtttagtagaacccttagaaaagctgacagaaaggcttacctggagttggggggtggtgaatcatttaatgggtgttaaaaatagcccggaactgcgcgaagctcatgaaatcgtacagccactagttgtacaatttatcaacaagctcggtcaaagtcaacctatctacaatgcttttaaagcactccgtaccagtgagaattgggcaactttagaattagctcaacagcgcattgtagaagccgccattcgagatgcagaactttctggtgttggcttagaaggagaggtaagagagcgtttcaacgccatacaaatggagttagcagaactttctaccaaattttctaaccatgtacttgatgccacgaaagccttcagcttaaccctaacaacacaagcggaaattgaaggtttaccaccaagcttagtgagtctagcagctcaagttgctcgtgcagcaggcgaaagtaacgccacaccagaaaatggcccttggcggattactttagacttccccagctatggccctttcatgcagcacagcacccggcgagatttgcgtgaaaagctctacaaagctcatatcacccgcgcttctactggcgatttagataacaaccccttaattgagcgcattttgaagttgcgccaagaactcgcagatatattaggctttaaaagttttgcccaattgagtctggctagtaaaatggctcctaatgttgaggcagtcaacgccctattagaagaactacgccatgctagttatgatgctgctgtcaaagacttggtagaactcaaagcttttgcagcagcacagggagcagcagaagctgaggatttaaaacactgggatatcagcttttgggcagaacgccaacgagaagcaaaatttgcctttactgctgaagaattgcgtccctacttcccgcttccccaagtgttagacggcttatttggattagtcaagcggctgtttggtgttactgtcacttctgccgatggtcaagccccagtctggcatgaggatgtgcgttatttccaaattgctgacgaaactggttctcccatagcctacttctacttagacccttacagccgtccagccgaaaaacgcggtggtgcttggatggatgtgtgcatcaatcgggccaaaatcactgaaaatggtgtcactgccatccgcttacctgtagcttatttggtgtgtaatcaaagtcctcctgtagatggtaaacctagtttgatgaccttctatgaagtagagactttgttccacgagtttggtcatggattgcaccatctgcttactaaggttaattatcccggagccgcaggcatcaataatgtggagtgggatgcagtggaactacctagtcagtttatggaaaactggtgctatgagcgaaccactttctttggaatggcgaagcattatgaaactggtgaagccttaccggagcattattatcaaaaactgctagcggcgcgtaattatatgagtggtactgctatgttgcggcagattcacctaagcagtcttgatttagaactacactaccgctatcaccctggtagtagtgaaactccatcagatgtgcgtcatcgcatagccaagactactaccgttttacagccacttccagaagatgcaattttatgtgcttttgggcatatttttgagggtggttatgcagcgggttactacagttacaagtgggctgaggtactgagtgctgatgcttttgccgcttttgaagaagctggtctagaagatgaagaggctataaaagctacaggtcggcgttatcgggatacggtactagcacttggtggtggtcagcatccaatggaggtgtttaaaactttccggggtcgtgaaccaagtacgatcgctttgctcaggcacaatggtttagtcagtgctgct

SEQ ID NO: 43477 - DNA, 522 bp, Nostoc punctiforme
caagagcctggggtgacagtatggttcactggtttaagtggtgcagggaaaactactatctgtcaattcgtggaaaaggaactgcggatacagggatacagagttgaagttctagatggtgatgcggtacgtcaaaatctatgcaaagggttgagtttcagtaaagaggatcgagaagagaatattcggcgtattggctttgtggctcatcttcttgcaagaaataatgtaattgttttggtttcaaccatttctccttaccgtaaggttcgagaagaagtgcgccaaaatattccaagtttcattgaagtatacgtcaatgcatcattagaagtttgtgaacagcgagacgtaaaagggttatataaaaaagccagaatgggggaaattaagaacttcaccggtattgatgatccttatgaaataccactccgtcctgaagtcgaatgcaaaactaaccaagaaaccctttaccaaagtgcaactaaagttttagaaaagctggaagagctgggttatata

SEQ ID NO: 43478 - DNA, 1167 bp, Nostoc punctiforme
gcacctgagattactgaagcaccaacaattagcgccacatcacctgaaattgctgaaacaccaacagttagcgccacatcacctgaaattgatgaagcattggtagttagcaccaattcacctgagattactgaaacaccaacaattagcgccacatcacctgaaattgatgaagcattggtagttagcaccaattcgcctgaaattgctgaaacaccaacagttaccgccatttcccctgaaattgatgaagcattggtagttagcaccaattcgcctgagattactgaaacaccaacagttaccgccacatcacctgaaattgatgaagcattggtagttagcaccaattcgcctaagattactgaaacaccaacaattagcgccacatcacctgaaattgatgaagcattggtagttagcaccaattcgcctgagattactgaaacaccaacagttaccgccacatcacctgaaattgatgaagcattggtagttagcaccacatcgcctgaaattgatgaagcattggtagttagcaccaattcgcctgagattactgaaacaccaacagttaccgccacatcacctgaaattgatgaagcattggtagttagcgccacatcgcctgaaattgttgagaaaacaagtatttttagggaaattattgataatgaacaagcagtagaatcagaaaatcctgaaatatcaacctttgcttatacctgggataatccagatattctagacaacccaacttctctacaagatgaggtaagcacagcacctaaagttgaacaaaatgcgatcgcagaaaatttgcccgcgcctaaaggttatgctactggtggtcatgttacagactcacgtgttgaaaatcgcgagcaaatagcaccctccgatacagtacctgcaatgcttacgcctggggagtttgtgattaataccagggatgcacagaaaaatctacccctactacatcacatcaacacgggtggaacaccgcaagatattattcttccaagtttacaaacacccaatcccatagaaccggaagcaacaatttctccagagactccgactaaagtcgattcttttccagacactgcattacagctaaaaagcgctgagactgattcacctgagatatcaaattctttaattcct

SEQ ID NO: 43479 - DNA, 786 bp, Nostoc punctiforme
ctaaatattgacaccacaagttacgatccccgcaatcctgttaacctgacaggtgtaaagccaactttcctcggcagtttcggctctagcaacagcgataatattacagttcagccaggaaaaacattctttgcaggtgacggagcagattttgtcgagggcactgaaggtaatacaatccaggctgggaatgatgatgacactgtactcgtaggtagtaactcttcagtctctgccggagatggtaacgatcaaattgtaattggtcaaaacggcgctgctcaaaatatcagtgctgatggtggcaatggtgatgatgttattaccgtagtggaagccaatggtaataataatttgtttggggcggaaggtaatgatactctcacagtcattgaaggttctcgccaatcattatttggtggtctaggtaacgacaccctcaccagtaacggcagcaataaccgtctgtatggtggttctggagatgacaaaatcttttctaataccaatgattcgctatttggtggcgatggtgatgatgtgctatttgctggtcaaggaggtagcaatcgcctcagtggtggtgctggtgcagaccaattctggattgctaacgccagtctgccatctagcaagaacatcattactgattttacagccggaattgacaaaatcgggctgggcggtattggtattactcagtttagtggtttaacgctattacaacagggtagtgacaccttagtgaaagctggaaatacagaattggcttcattagttggcatt

SEQ ID NO: 43480 - DNA, 975 bp, Nostoc punctiforme
ttgaacatctgtcgcatattaaatggtatgtggcaagtctccggcgcacacggacggatcaatccccaagctgccattgagactatgttcaaatatttagatgcaggctttaccacttgggatttagcagatcattatggccctgctgaggactttattggtgagtttcgctgtcaactaattgatactcgtggtaaagatgctttatctaaggtgcaagcgtttacaaaatgggtgcctcgtccaggtaaaatgacgaagaaattggtcgaggaaaacattgatatttccctgagaagaatgaatgtggaatcgttagatttgatgcaattccactggtgggaatatcaggataaaaattacttagatgccctaaaatatatggcagaactccagactgagggtaaaattaagcatctaggtttaactaattttgacacggaaaatttgaagctgattactgaagcaggtatcaaaattgtttctaatcaagtgcaattttcccttattgaccgccgtcccgaagttaatatggcagaattttgtcagcagcatgacatcaagctttttacttacggtacactgtgcggcagcttgttatcagaaaactatttgggtaaaccggaaccgcgaggatctgatctgtccactgctagtttgaaaaaatataaaaatatgattgatgcttggggtggttggcaattatttcaagaattgctagctattttgaaggaaattgctaataagcataaagtaagtatctcaaacgtagcagtgcgttacattttagatcagccaaccgtgggtggtgtgatagttggtgccagacttggtgtatctgaacatatagaagataacgccaaagtatttagttttagtttagatgctgacgatcgcgatcgcatcagtgccgtatctcgacagtcacgagatttgtatcagctaatcggcgattgtggcgacgagtatcggcga

SEQ ID NO: 43481 - DNA, 624 bp, Nostoc punctiforme
atgggtggcaaattaattgtatttgaaggggtggaaggctgcggcaaaaccagccaaatgcagctttgttctcagtggttggaaagtttgggtgtttctgtggtagtcactcgtgaaccagggggaacagagttaggcttacatcttcgccgcttactactagagaaggcagaggataaaccagttgcagaagtgacagaacttttattgtatgctgctgaccgatcgcaacacgtggaacaagaacttaaaccaaatctcgcagcagggaaatatattttatgcgatcgctacactgactctaccattgcctaccaaggatatggtcgcggtttgaatatgagtttaatcaatcagcttaactatattgccactgccggcttagaaagtgacttaactatttggctagatatcgatgtcgaagttggactaacccgcaaacggggagatggaatcgcattagaccgcattgaacaagaaacaatcgcttttcatcggcgcgttcagcaaggatacgcagagttagcagcatcttatccttcaagaattgtgcgggtagatggcagcttgagtaaagaagctgtgcaacaagtaattcaagaaattctgcgcgtacatttgaag

SEQ ID NO: 43482 - DNA, 423 bp, Nostoc punctiforme
attgatgagcaagaaatagaaaagctgtggcaagccttcaaagtattagatgtagacggcaacggagcaatctcaaccgacgaactgggggaagtaatgcgatcgctaggacaaaatcctacggaaacggggttgcgtgacttaatcaaagagattgacgtggatttgtcaggcactattgactttgacgagtttaaaacgctgatgatcgctaaggtaggcgatcgcgaaagccgcctcaagttagccttcagcgcctttgatgaagacaatagcggccaaattactgccgtcgagttgcggacggtaatgagtcaatttgggctgacagacgctgaattgaaagagatgctacaggaagtagatcatgatggcgatggctcaattgactttgaggaattttgtcagctagtactggaagag

SEQ ID NO: 43483 - DNA, 225 bp, Nostoc punctiforme
gaactttttgaaaaggtcaagaaaatcgtcatcgaacaactgagtgttgaagatgcttccaaaatcactccacaagctaagtttatggaagatttaggagctgattccctggatactgttgaactcgtgatggctttggaagaagaatttgatatcgaaattcccgacgaagctgccgagcagattgtatcggttcaagacgcagtagattacatcaataacaaa

SEQ ID NO: 43484 - DNA, 1230 bp, Nostoc punctiforme
acacgtaaacgcgttgttgtaactggtgttggcgcgattacaccgataggtaacacagcaacagaatattgggatggattattgagtggacgcaatggcattgactacatcacattttttgatgcgtctagccatgattgccgcattgctggtgaggtaaaaaacttcgatccacatgattacttggagcgcaaagatgccaagcgcatggatcgatttgcccaatttggggtttcagcagcaaaacaagctatagctaacgcgcagttagttattaatgaactgaatgcagaacaggtaggtgtcatgatcggttctggcgttggcggcattaaggtattagaagaccagcaaacgatctacctcaaccgtgggcccgatcgctgtagtccattcatgataccgatgatgatcgctaatatggcagcaggattgacggcaattcacacgggtgctaaagggcctaattcctgccctgtaactgcctgcgctgctggctctaatgctgtaggcgatgcgttccgcttaattcaagggggatatgccaaagcgatgatttgcggcggaacagaggcagctgtgacaccattatcaatggctgggtttgctgcctgcaaagccctttcttttcgcaatgacgatccggctcatgcttgccgcccctttgaccgcgatcgcaacggatttatattaggtgaaggttcaggaattttaattctagaagaactgcaacacgccctaagtcgcggcgctcacatttatgccgaaatgatcggctatggtatgacctgtgacgcataccatatcacttcccccgtccctggcggattaggtgcagcgagagccatagaactggcgctcaaagatgctagtataactcccgaacaaattagctacattaatgcccacggcactagtaccccggcgaatgattcaactgaaacctcagccatcaaaaaagcgttgggagaacatgcttataaggtggcaattagctcgaccaaatcgatgacaggtcatttattaggcggttctggaggtattgaagctgtggcaacagtactggcgatcgctaatgaccaaattccaccaacaatcaatctggaaaatcccgatccagaatgtgacttagattacgtgcctaactacagccgcgttcaaaaagtcgaggtggcaatatccaattcttttgggtttggcggtcataatgtcacactggcctttaagaaa

SEQ ID NO: 43485 - DNA, 1971 bp, Nostoc punctiforme
gctattaactcgatccgcttcttggctattgatgccgtagaaaaggcaaaatcgggacacccaggactaccaatgggcgcggctccgatggcttttgtcctctgggatcgctttttgaagtttaatcccaagaatcccaaatggtttaaccgcgatcgctttgtcttgtctgccggtcatggctcgatgttgcagtacgccctactctacctgacaggctacgatagcgtcaccattgaagatatcaaacaattccgtcaatggggttctaaaactcctggacacccagaaaactttgaaaccccaggcgtggaagtcacaactgggcccttgggtcaaggaattgctaatggagttggtttagcgatcgcagaagcacaccttgccgctaaatttaacaaacctgataccaagattgttgaccattacacctacgtaattgtaggtgacggttgcaatatggaaggaatttccggtgaagcttgttcttttgcaggacacttgggattaggcaaactcatcgctctgtatgacgacaaccacatttccatcgacggttccacagatgtggcatttaccgaagatgtttccaagcggtttgaagcttacggttggcacgtccaacatgtcgaagatggcaataccgatttagcagcgatcgctaaagcaattgaagcggctaaagctgtcaccgataagccttctttcatcaaagtaacaaccattattggttacggttcccccaataaagcaaacactgctggcgttcacggcgctgccttgggtgcagacgaaatagcattgactcggaaaaatttgggttgggaatacgagccttttgatgttccacaagaagccctcaaccacacacgcaaagcagtagaacgcggcgcaagctacgaagccgaatggaacaaaacatttgccgactacaaagctaagtatgcccaagaagccgctgaatttgaacgttacctaagcggcaagctacccgacggttgggataacgtactacccacctacacccccgaagacaaaggactacccacccgtaaacactcagaaacctgcctcaacaaactggcggcagttttacctgaattgattggtggttcggctgacttgacccactccaacttgaccgaaatcaagggcaagggcgactttcaaaaagggcactacgaaaaccccaacatccactttggtgtgcgggaacatgctatgggcgcaatctgtaatggtatagcgctgcacacttcaggattaatcccctacggtgctaccttcttgatcttcacagattacatgcgtgctgccattcgcttatctgccctttcccaagctggcgtgatttgggtgatgacccacgattccattggacaaggtgaagatgggccaacacaccaacccattgaaactctagcttccttgcgagctattcctaatttattagtgtttcgtcccgcagacggtaacgaaacctctggcgcttataaaattgcgattgaaaaagcgaagcaaaatgctccgtctctgttggcgttcactcgtcaaaacgttcctaacttggcaggtacatcggttgagggtgtggcgaagggtggatacaccgttgttgatagcgaaggtacacctgatatcatcttgattggtactggttcagaattgagcctcgccgtcagcgcagccgaaaaactcaaggctgaaggtaagaaagttcgtgttgtctcgctaccttcatgggaactgtttgaagcacaggatgcggcttataaagagtccattctgccaaaagctgtcaccaagcgtttgtctgtagaagctgccgctagtttcggttggcacaaatacgtgggtactgaaggcgatactgttagtatcgatcgctttggtgcttcggctccaggcaatgtttgtctagagaagtttggctttagcgttgataatgtgttagcaaaggctaaacaattg

SEQ ID NO: 43486 - DNA, 1725 bp, Nostoc punctiforme
atgctggaacacgatgtaattattgttgggggtggattggcgggatgtcgtgcggcggtggaaattgctcgcactgaccctagtttaaatattgctgtggttgcgaaaacacacccaattcgctcccattcggtggcggctcaaggtggtatggctgcatcgctaaaaaatgttgattcccaagatagttgggaagcacatgcttttgatactgtcaagggttctgattatttggcagaccaagatgctgtggcaattcttacccaagaagcgccagatgtggtaattgatttggaacatttaggcgttttgttctctcgcttacccgatggtcgcattgcccaacgagcttttggcggacattcccacaaccgcacttgttatgctgccgataagaccggtcacgcaattttgcacgaattggttaacaacctgcggcgttatggggtgcaagtttatgaagaatggtatgtaatgcgtctcattttggaagaaaatgaggccaaaggtgtggttatgttccatcttttggatggacatatagaggtggtgcgagccaaggcggtgatgtttgccactgggggctatggtcgcgtttataatactacctctaatgattacgcttcttcaggtgatggtttggcaatgactgcgatcgcaggtttgcccctcgaagatatggaatttgtgcaatttcatcccacgggtttatatccagtaggggtgctgatttcagaagcagtaaggggtgaaggggcgtatctgattaatagtgaaggcgatcgctttatggcgaattatgcacccagtcggatggaattggctccccgtgatattacctcacgcgcgatcgcttatgaaattcgcgctggtcgtggtattaatctcgatggtagtgctggtggtccctttgtctatctggatctccgccatttgggtaaagaaaaaattatgagtcgcgtccccttctgttgggaagaagcacaccgcttagtgggcgttgacgcagtaactcaaccaatgccagtccgcccaacaattcactattgtatgggtggtattccagttaatactgatgggcaagtccgcagtagtggtgatggtttagttgatgctttctttgcggctggcgaaacatcttgtgtttccgtacatggtgccaatcgccttggtagtaactccctgttggaatgtgtcgtttatggtaagagaactggggctgcgatcgccaaatttgtccaaaaacggaagttgccctctgtagatgagcaacgctatgtaacggaagcccagcaacaaatccaagctttactagaacaaccagggcagtatcgcattaaccaagttcgtcaagcctttcaggattgtatgactgagtactgtggtgttttccgcacagaggcattaatgagtgaagggttacacaaactagaagaaatacaacagcgatatccacaaatttatttagatgataaaggtagttgctggaatacagaactcgtggaagccttagaattgcgaagtttgatgatagtgggacagactattttagcatcagcgctgaatcgtcaagaaagtcggggcgctcatttccgcgaagattattccgagcgagatgatacaaactttctgaaacacacgatggcttactattcaccagcaggaattgatattcaatatcgaccggtggcaattactatgtttgagccaaaagaacggaagtat

SEQ ID NO: 43487 - DNA, 960 bp, Nostoc punctiforme
atggtacaggataggaagtcaacggttgtaatcacaggtgcctcttcaggggtcggtttgtacgctgccaaggctcttgctgaaaggggatggtatgtagtgatggcctgtagggatgtagccaaagctcaactggcagcccaatctgtgggaatcccgcatcagggcagctacactatcatgcatatcgatcttggctctttggatagcgttcgacaatttgtgaagaacttccgagcaagcggacactctctagacgctttggtgtgcaacgctgcaatttatatgcccttaataaaagagcctttacgcagtccagaaggttacgagttaactgtcaccacaaatcacctgggacatttccttttgtgcaatctgatgctagaggatctgaagaagtcatcttcagagccaaggctcgtaattttgggaactgttacccacaatccagacgaactgggtgggaagattccgccgcgtccagacttgggcgatttgcagggctttgcagaagggtttaaagagccgatctcaatgattgatggtaaaaaatttgaaccagtcaaagcttacaaagacagtaaggtttgtaatgtgctgactatgcgggaactgcatcagcgctatcacgaatcaactggtatcgtcttcaactctctctatccgggatgtgttgcagaaacgccactatttagaaaccactatcctctatttcagaaaatctttccattattccagaagtacataactaagggatatgtgtctcaggagttggcgggagaacgagttgcggcggtggttgccgatcctgagtacaatcaatctggtgtgtattggagttggggaaatcgtcagaaggaagatggtaaatcctttgttcaaaaggtttctcctcaagcccgcgatgacgacaaaggcgatcgcttatggcaactaagtgctaaattggtcgggctggct

SEQ ID NO: 43488 - DNA, 764 bp, Nostoc punctiforme
aaacgcgcactcattactggaggcagtcgtggcattggggcagcgatcgtcaagcgtttagctagtgttggcgctgatgtcgccttcacctatgctagctcacccgatcgcgcgaacgaaatcgtccaggcagcacaagcattaaatgtccaggctcttgctatccaagctgacagtgccgaagctagtgcagtggttgccgctgttgaggacactgtaaataaattgggcggcattgatattctcgtcaacaatgcaggcgtgctagcaatcggcccaatcgacgatttcacgctggcggacttcgatcgaacctttgccattaacgtgcgtgccgtgtttgtggcgacgcaagccgcagtcaagcacatgaaagagggcggacgcatcatcaacatcggcagcaccaacgccgaacgtatgccatttcctggtggcagcgtatatgccatgagtaaatctgctctgcaagggcttgtgcaaggactgtcgcgtgaccttggcccacgcggaattacgatcaacaacgtgcagcccgggcccaatcgctacagagatgaatccctcggaggggtgagtttgccgagatgctcaaaaagcacattgcggtagcccgctacggcacggttgatgaggtggcggggctggttgcttatctggccggccctgagtctggttacatcaccggcgcaaacctgatgattgacggagggttcagcgcataactgctgtccgattgagcgatggcacaaagcgccccctgg

SEQ ID NO: 43489 - DNA, 1491 bp, Nostoc punctiforme
caaaatctagagcttagttgctaccttttccccaacaaaccagccataatttttgaagaagaatcttttacttacaaagaccttgatgaaatggtaaatcgcgttgctaacggtctacgcagtttggatattagacgtagagatcgtgtagccttatttttaccaaacattccagaatttgtaatttcttatcttggcattctgaaaattggcgcggttgctgtctcaatcaacattatgctcaaaaccgatgaagttagatacattctcaacgattgtgctgccaaagcaattattacaacagagtcgcaaaccgagtatattcaagagccagacttacctcaattgcaacatattttgattgcagaaggtagagccaataaaggtattagtctaaaacaactgatggcaaaatcttctcctgaagcacgcgccgttgaaatgagtcgcgatgatcctgcaagcatcctttatacatcaggtactacaggctttcctaaaggtgctacactttctcatggcaatgttatttttaatagctattgtgctaattgttgctatcgcattcaaaagagcgatcgcttactgcttttcttacctttatcccattgttttggacaaaatgcaattctaaatgctggtatttctgcttgtacgactatcattttacagcgtcgatttgacccagatcaagttctagaaaccatcactacacatcaagtaacaatgctatttggtgtgccgacagtattcattaaactactgaacatggatacttctaactataacctggaaaacatccgctattacttttcagcagcagcaccaatgccattgcaagtagcagaaaattggtataaaaagtttggatttgtcatccatgaagggtatggcctaactgaaacatcgccatttgctgcttataaccacaacttgaactacaaactaggtagcgttggaacacccattgcaaatgtggaaatgaaaattgtagatggtgatggtaatcaggtagaaataggtgagttaggcgagataacaattaagggtgccaacgtcatgcttggttattggaaccgcccttttgaaaccgcagaagtaattaaaaatggttggttacatactggcgacattggtcggatggatgaagacggttttttctacgtaattgaccgttcaaaagacatgatcgttgtttctggattcaaggtatatccaacagaagttgaaaatgtcatttatcaacacccagcagtagctgaagtagctatatatggcgttcccgatcctctcaaaggcgagattgtcaaagcaaatattatcctaaaagctagtcagacaatcaccgaacaacaaatcattgatttttgttatgaaaggatggcagcttataaagttccccgtgtaattaactttgtaaactcaattccaaaaaactccactggtaaagtattaaagcgatttttacgtcaggaatcaatatctcaggtt

SEQ ID NO: 43490 - DNA, 1440 bp, Nostoc punctiforme
atcgtaactgtaggcgatcgcaatctgacaatcgacgaggttgtaaatgttgctcgtcatggaacacaggtgcgcttaactgataatgcagatgtcattcggggtgttcaagcatcttgtgattacattaacaatgcagtcgaaacagcacagccaatttacggggtgacatctggctttggcggtatggcagatgttgtcatctctcgcgaacaagcagcggaacttcagactaatttaatttggtttctgaaatccggcgcaggaaacaaattatcgttagcagacgtgcgtgcagctatgctcttacgtgcaaattcacatttgtatggtgcgtctggtatacgactcgaacttattcagcggattgaaactttcctcaacgctggcgtgacaccccatgtctatgagtttggctctatcggtgctagcggcgatttggtgccattatcctacattactggggcactaatcggtctagatcctagctttacagttgacttcgacggtaaagaaatggatgccgttacagccttgtctcgtttgggtttgccaaagttgcaattgcaaccgaaagaaggtttagcaatgatgaatggcacctcagtcatgacaggtattgcagctaactgtgtgtacgatgcgaaagttttgctcgctctgacaatgggtgtacacgccttagccatccaaggtttatacggaacgaatcaatctttccacccgtttattcatcagtgcaagccacatcccggtcaactatggacagcagatcaaatgttttctctgctgaaagattcatctttagttcgtgaagagttggatggtaaacacgaataccgtggtaaagatctgatacaggatcgttattctctccgctgtctggcacagttcatagggccaatcgttgatggggtatcagagattaccaagcaaatcgaggtagaaatgaactcagtcaccgataacccattgattgatgtcgagaaccaagttagttatcacggcggcaattttctcggacagtatgtgggtgtgacaatggatcgcctacgttattacatagggctattggccaaacacatcgatgtgcagattgcacttcttgtctcgccagagtttagcaacggcttaccaccctctttagttggtaatagcgatcgcaaagttaatatgggactcaaaggtttgcaaatcagtggaaactcgattatgccactgttgagcttctatggaaattccctagccgatcgctttcctacccacgccgagcaatttaatcaaaatattaacagccaaggctatatttccgcaaatttgacacgtcgttccgtagacatatttcagaattatatggcgatcgcgttgatgtttggagttcaagctgttgacctccgcacatataagatgaaaggtcattatgatgcacgtacatgcctc

SEQ ID NO: 43491 - DNA, 976 bp, Nostoc punctiforme
ggtattgttttgacagggactggctctgcggttccagatcagtgcttagataatcatcaactcaatcaaatggtggttacttgtgatgattggatcaaatctcgcacaggaattcaccgtcgccatcttcttccagccaaaaactcgctcacaactatggctactgaagcggctcaaaaagccatagatatggcaggtataacagcacaagacttagatttaattatcttagctacatctactcctgatgatttgtttggtaatgccagtcaaatccaagctcgactcggagctacccaagctgtagcttttgatttaacagcagcttgctctggttttgtttttggtttggtaactgctgcccaatttatgcggactggtacttatcaaaatgttcttctcattggtgctgaagttctttcacggtgggtagattggtctgaccgacgtacctgcattctatttggtgatggagcaggagcagtggttttacaagcaagtgaatatgattatctccttgggtttcaacttcatactaatggcacgcataatcagcattttgaaattggaattccaggaggaagagaaagtacttgttgataatattagcgttggtcaaggtacatataaacctattgcaatgaacggacaagaagtttaccgatttgctattcaaaaagtccctgaagttattgaaaaggcactattccgggcaggtctggatgttaaacaggtagactggctattgatgcatcaggccaatcagcggattttagaggctgtggctcaacgtttaggaattcctgatgaaaaaatcattagcaatttagcaaattacggaaatacttctgctgcttcaattcccctagctttggatgaagctgttcggcgagggcaaattaaagcgcacgatgttgttgctttagctgggtttggagcaggactttcttggggtgctgctatttttgagtggggt

SEQ ID NO: 43492 - DNA, 1506 bp, Nostoc punctiforme
agtgaatttgatttcattgttgtcggggctggttcagcgggatcggttcttgccaatcgcctcagcgaaaatccagcagttaaggtgctagttttagaagctggcggggctaatattcccccaactgtcgataacccctcaatatggcctacgttgcttggctcagaaatagactgggactataccagtgttccacaaccaagtttggaggggcgtatcacccatgaaccacggggtaagataccaggcggcagcagtaatttatatattatgatgcatatccgggggcatacatccgattacgataattgggcttacaatggctgtcccggttgggcttatcaagatgttttgccctacttccagaagttggaaaaccaagaagatgactctagtccgtgggctggtaaaggtgggccacttaatgtcatcaatgccaaactgcataatccgaatcctacatctgaagtatttattaatgcttgtttagagttaggctacccctacacaccagattttaatggcccaaaaatggaaggggttggttggcatcatataaacatcaagaacggtaagcgtcatagtatggcagatgcttatctaaacccggttttgaagcgacctaatcttactctcagtacggactcgcaagctacgaggttgctgttctccggtaagcgatgtaacggtttggagtacgcacagaatggtgaaattaaaactgcctatgctaattacgaggtaattgtctgtgctggtgcgctggagtctcctaagctgttgttactctctggtatcggcagttctagtcacttgcaagagtttggcattcctgtagtagcggatgtgccaggtgtaggcgaaaactttcacaatcatgtcctgactggggtaatttatgaaacaacgcagctagtaccaccacctaacttgaatttgtcagaaagtgcgttattttgtcagtcagaaccaggttggattggcccagatttgcaacttggttttgttcacgtcccttttgacatcattattggtcaaaactatcccaatgctattagtatcttgcctggtgttgtccgccccacatcgcgcggctggattaggttggcaagcagtaacccattagataaaccgcttgttaaccccaattatctcagtactcaagctgaccttgagcggttaattcaaagtgtggaaatagctcgtaacatatttgctacaaaggctttctctagctgggtcaaacaagaactgatgccaggatcggatgtgcaaacttatgagcagctacgagcatttgtcaagcacagggctgattcttatcatcatcaagctggttcttgcaaaatgggactagataatatggcagtcgtagatcctcagttgcacgtttatggtgtgcagggacttagggtagctgatgccagtgtgatgcctgtagtaccatcaggaaactgtcatacaggtattgtaatgattgcggagagagtttctgatctgatcaag

SEQ ID NO: 43493 - DNA, 1659 bp, Nostoc punctiforme
tttactgttggcgactatttattgcttcgtctggagcaaattggcatcaagcatatctttggcgttgctggagactacaatatggaatttctcgactatattgttaaccataatggcatcgagttaattcctacttgcaacgaacttaacgcatcctatgctgccgatggttatggtcggctcaatggtattgcggcattaataactacctttggtgttggtgaactcagtgctattaatggtgtcgctggcgcttatgctgaacacgttccggttgtagcgattactggtgctcctgcaactaaaattcaagctcttggttcacttgtccatcatacgcttggtactggtgatttctcaatgtttgcccgaatgtatgaacaggtaacggtggctcaagcatatttaacaaacgaaaatgcaacaacggaaattgacggagttttaggtatctgtttgctgaagaagttacctgtttatatttccatacctatggatgttgctctcacagaggtgtctgcaccgtctgattcctttatacccccagtattccagagtgatggcgctactttagccgaaatagttgatgtctgtgtaaacatactggaaaaagcttcccaacctgtgattcttgctgatattggtgtagctcgttatcacttgcatgaacaattgcgaaaactgctaacagctaccggatacccttatgccacgatgaatatgggaaaaggattgctagaagaaactcacccccaattcatcggtatatataatggtgctgccagtgaggaatctgtcagaaaacgtattgagcaggctgattgtgttttaactatcggtgctttgatgactgatttcaacacaggcaagttttctgccaaacttgaccccagccaaactattgaagtgcatgggcagtatgtaaaagttaaacatgctttatacaacaatgtagctatggcagatgtgctttctgctttaagtcaacggttgcagcgccgcgatcctcaaacgctaaacttcaaatcagcaacagagaatttagatgctggttttataacgccaatcgaaggcggctcttcggcaccaattacgcagcagtatttttggcatagatttgctcattttctccaagaagatgacattatcgttgctgagactggaacttgtttgtttggtgcctctatcgttcctttaccaaaaggagctactttcgttgggcaagtactttggggagcgattggctactctgttgcttcattacttggttgtgcgttggcgaagcccaccgcaggtatcgctgcatcacaacgtcgctctatcctactggttggtgacgggtctttccaaatgactgcacaagaactttcaactatcttacggtataacttaaaaccgattatttttttgatcaacaatgatggatatactatagagcgtgatattcatggtgaacgtatgccgtataacgacattcaaccttggaattatcatcagctccctaaggttttcggtggcaatggctggggaattaaagttagtaccgaatcccagttagataaagcattacaaacagctcaacaaaaccatgaccaacttgcttttattgaggttgtgatggataaaatggacagtccagaggttctgttgaagatgttg

SEQ ID NO: 43494 - DNA, 723 bp, Nostoc punctiforme
gtgcggaaaatcgttattgccggcaactggaaaatgttcaaaacccaggcagagactcaggagtttttgcaaggatttttgccccacttagaggaaaccccccaagggcgagaagtaatattgtgtcctcctttcactgatttaagcgttttgtccaagactttgcacggtagcctcatccaactgggggcacaaaatatccattgggaagaatttggagcctatacgggtgagatttctggcccgatgctgacagaaagcggtgtgcgctttgtgattgtcggtcatagcgaacgacggcaatactttggtgaaacggacgcaactgttaatctgcgcctccgaactgctcaaaggtttggtttgactccaattctctgtgttggtgaaactaaacaacaacgagatgcaggagaaactgaatcactgattgctctccaactcgacaaaggtttggtagatatcgatcagaataatttggtgattgcctacgagccaatttgggcaattggcactggtgaaacttgtgaagcagtggaagctaatcgaataattggcttaattcggagccagttgagtaatccaaatgtatcaattcaatatggtggctcagtgaagccaaataatattgatgaaatcatggctcaaccagaaatcgatggcgttttagtcggaggagcaagtttagaaccggagagtttcgctcggattgtgaattttcac

SEQ ID NO: 43495 - DNA, 1389 bp, Nostoc punctiforme
atgcgtgtttgcgttattggtactggctacgttggtttagttacaggtgcttgcttggctcatattggacatgatgtaatttgcgtagacaacaacgaagaaaaagttaagttaatgaagtctgggcagtccccaatttttgagccgggactctcagagattatgcagtctgccatccaaacacagaagattcattttacaagcgatctggctgctggagtttcccacggagaaattctgtttattgctgtgggaacaccacctttacccactggtgaaagtgatactcgttacgttgaagctgtagcccgtgggattggggaaaatctcaacggtggttataaggtgatagtgaataagtctacagtccccattggctcaggtgactgggtgcggatgcttgttttagatgggattgtagagcggcaaaaaacattggtacccgcaggtggagtaccgagtgatgagaaattatctgagtttgcagccgagtttgatgtagtgagcaatccagaatttttgcgcgaaggttcggcagttcacgacactttcaaccccgatcgcattgtactaggaggcaatagccaaagagcagtagccttaatggaacaactgtatgacccaattgtccaacgcaagtacgctgaagatcaatctttgcccccagtgccaattttggcaacagacttgagttcggcggagatgattaaatacgccgctaatgcctttttagccactaaaattagttttattaacgaagttgctaatatttgcgatcgcgtcggtgctgatgtcacccaagtagctaaaggtattggtttagactcccgcattggtaacaagtttttacaagctggtattggttggggtggttcctgctttcccaaagatgtctcggctctgattcatactgctgatgactatggttatgaagcccagttactaaaatctgccgttagtgttaacgaacgccaacgcttgattgctctggagaaactccaacaagttctgaaaattctcaaaggcaaaacagtcggactactcggactgaccttcaagccagataccgatgacttacgcgatgctccagccctcattttaattgagcagctaaacagactaggagccaaagttaaagcctacgatccaattatttcccaaacaggtatgcgtcatggtctttctggggtgctagtagaaacagatgccgaaagattagctgacggctgcgatgccttagtactcgtcaccgaatggcagcagtttagcactctcgactatctgaagatggcaaaattgatggcccaccccgttatcatcgatggtcgtaacttcctcgaccccgaaacacttatacgcgctggattccaatatgtaggcgtaggaagg

SEQ ID NO: 43496 - DNA, 726 bp, Nostoc punctiforme
gacaccatgaatgttgagcaaaaacgacgcgccctgattactggggccagtagtggaattgggaaagcaacggctttagcctttgccaaagccggaatagatgtcgccttagtcagccgttctttgaataagttagaggcggtggcagaagctgtacagcatactggggtagaagcgaaagcttacgctgtagatttagcgcggatctttgaagtaaaagaaaaaatccaagcgatcgcccttgattttggtgatatagacattctggtaaacagtgcgggccttgcctatacagccactttgagcgaaacccctctagaaggatggcaacaggtaattgacttgaatctgaccagcgtgtttcagtgcattttaggaattttaccttcaatgcgcgatcggggcacaggcacaattatcaacgtcgcttcaattgccgccaggcaaccgtttcctggttggggagcatacagcgtcagcaaagctggtttgattgccctctctcaaaccctggcacaagaagaacgcacccacggcattcgtgtcacagctatctctcctggcgcagtcaataccgaactttgggacacagaaacagtccatgtcaacttagaccgttctaagatgttaaccccggaaatagtggctcagtcaattctccacacagttctgttaccacaacaggcagttattgacgaattgaccctgatgcccagtgctggcgca

SEQ ID NO: 43497 - DNA, 1047 bp, Nostoc punctiforme
atggctaaaacgccagaatccttagaatcgtctatcaatgaaattacagatagagctttagatcgtgattgtacaaccttatcgcgtcacgttctccagcaacttcagagtttttcgccagatgcacaagatttgagtgcgctgatgaatcgcatcgccttagcaggtaaactagttgcacgccgtatgagtcgcgctggtttaatggaaggcgttctcggttttaccggggaagttaatgtccaaggagaatccgtcaaaaagatggatgtctacgccaatgatgtgtttatctcagtgtttaagcaaagcggcttagtctgtcgcctcgcctctgaggaaatggaaaatccctactatatccccgaaaattgccccattggtcgctataccctgttgtatgacccaattgatggctcatccaacacagataataatctcagcttgggttctattttcgccattcgccaacaagaaggaactgatagcgatggtaaggcaaccgatctcctcgccaacggacggaagcaacttgctgccggatacatcctgtatgggccatgcacaatgctggtttatactataggtaaaggcgttcattcctttgtcctcgatcccagcttaggagaatttattctcacagaagagaatattcggattcctaaccacggttccgtttacagcgtgaatgagggtaacttctggcagtgggaagaatcgattcgagaatatatccgctacgttcatcgcacagaaggctacagcgctcgttatagcggtgcaatggtgagcgacatccatagaattttggttcaaggcggtgtgttcctctacccaggtacaattcaaaacccagaagggaaattgcgcttgctttatgaaactgctcctctcgcctttttgattgagcaagcaggcggccgtgctacgacaggattggtaaacatcttggatgtagtgccaaaaaaactacatcagcgcacacctttaattattggcagtaaagaagatgtcgcaaaggtagagtcttttattcaaaacggacac

SEQ ID NO: 43498 - DNA, 888 bp, Nostoc punctiforme
atgccttggtctcggattattagtggaattgttgcgatcgctcttgctctttctgttacccttttgggtggctggtactttaccatcatgtttgcggttgtcatctttttgggtcaacaggaatattttaatttggtgcgagccagaggcatcgctcccgccgctaaaaccactatggctgtcagcctatttttgctagtaatttgtactattgatggcagtttagctgacgctgtgatgcccttagctggcacacttatctgtttttacctgttatttcagcccaaatttgccacgatcgccgatgtttctgcttctataatggggctattttacgtaggttatttgccgagttactgggtacgattacgagcaattgatagtgccgtttttagcaatctacctttagggggttactggcctacaacctgggcagacttctgggaaaaggcaagttatgcttctttaccacaaggttttacagcaacaatgctgacttttttgtgtatttgggcagctgatattggtgcttacaccattggcaaattctttgggaaaacccgtctgtctgagattagccccaagaaaactgtagaaggtgctgtatttggcattacttcaagtgttgctgtagccatagcaggagcctattatctccacttgcccagatccttgttgactggtttagcattgggtttgttgattggcattgctagtcttttaggggatcttaccgagtctatgctcaagcgggatgctggagtcaaagattctggacagttaattcccggtcacggtggtattttagaccgtactgatagttatattttcacagcacctttggtttattattttgtgacactactgttgccgctactatagagcttt

SEQ ID NO: 43499 - DNA, 1656 bp, Nostoc punctiforme
atggcaaagccaattgaatttaatttatttgcaccatacaacaaaggagccgcattaattggttctttttctgattggcaagaaataccaatggaaaaaggtaatgatggttattttcgtacaagtgttgaactaaaagacggtgtttataaatataaatttcgtgtccagtcaaattcatggttttttgagccagaacaatgggttgatgttacagacccttatgcaactgatatagatgaactgagtggaaaagatgatagtgttatccatgtaaaagattgcgaaagaattactgatacttatgtctggcaaaatgatgataaacctttacctgctgaccacgaattagtaatttatgaattgcacgttggtgacttttctggtggtgaggatgacccttatgcacgaggcaaatataaacacgtcattgaaaagttagattatttgagtgaactaggaatcaatgctattgagttgatgccacttaaagaatatcctggtgattatagttggggttataatccccgccacttttttgcaacagaatcaagttatggttctactgctgagttgaaaaaattgattgatgagtgtcatggcagaggcattcgtgtgataattgacggtatttataaccactcagaagcatctgctcctctaacacaaattgaccacgattattggtatcatcatgaacctcgggaccctgataataactggggacctgagtttaattacgaacattatgatgaaaaattagagattcatccagcgcggaaatttattggtgaaacaattcgtttctggattcaggaatatcatcttgatggtattcgttatgatgcagcacggcaaattgctaattacgacttcatgcactggattgttcaggaagccaaaaacactgctggtgcaaagcctttttataacgttgctgaacacattcctgaaactaccagcattaccaatgtagatgggccaatggatggttgctggcatgacagtttctatcactgcattctagaacatatctgcggtgatacatttgatttagagcgtctcaaagatgtcattgactgcaaacgccaaggctttttaggtgctacgaatgtagtaaattacctcaccaaccatgaccataaccacattatggttgaattggggaaccgtgagatttttgacgaagaagcctttagacgggctaaattaggagttgccatcctaatgactgctgttggcgtacctttgatttggatgggagaggaatttggcgagtacaaacccaaacaacccgaatcatcaaaaatcgattggactctgttaggtaacgatctcaatcgtagtttatttgaatcatacaaaggcttaaccaacctgcgtaaaagtaatcacgctctctacacagaaaatattgactttatccacgaaaatccagaggcaaaagtattagcttatactcgttggaatgatgaaggttctcgtgtagtcgtaatcgcaaatttctcagaaaatttcctagctggctatcatgttcctaattttcctagtgctggtacatggcatgaatggacaggcaattatgatgtcgaatctggtgatgatggcataataactgacttgggcccatacgaagccaaagtgtttgtatggcag

SEQ ID NO: 43500 - DNA, 1026 bp, Nostoc punctiforme
atcgacaacgctaacattgagaacgatcgcattttattaactcccaatgaaataaaatcaaaattacctttaacacaattagccgaacaaagagttttagcatacaggcaggaaatagaagatattctcgattttcaggatcggagaaagtttatagtagttgggccatgctcaatccacgacccaaaagcagcgctcgaatattctgaaaggttgaaagcgttgtctgaggaagttaaggataagctactactaataatgcgtgtatactttgaaaagccaagaacaaccgtcggttggaaaggattaattaacgatccagatatggatgattctttccatgtagagaatggtttattaattgcacgcgatttgttattaaaaattacagaattgggattacctgcgggtacagaagcactagatccaatcatacctcaatacattagtgaactgattacctggtctgctattggggcacgcacgaccgaatcacaaactcaccgtgaaatggcaagtgggctttcgatgcctgtgggttttaaaaacggtactgatggcaatattcaagtagctttgaatgccctacaatcagctagaaacccgcataattttctgggaattaatcaaaacggacaagtcagcgtctttcaaactaaagggaatggctatggtcacgtaattttaagaggtggtagtcaacccaactttgatgcagctaatgtcaaattagtagaagataaattaaaacaggcgaatttaccaccaagaattgtgatcgactgtagccacggaaatactaataaagattacaaattacaaggtgctgttttagaaaatattattcagcaaatagtagatggtaatacatcaatagttggcatgatgctggaatcacatttgtatgaaggtagtcaaccaattaccgataaacaagaagaattaaaatatggggtttctgtaactgataaatgtattagttgggaagaaaccgaaaaaattattttggctgcttacgaaaaactt

SEQ ID NO: 43501 - DNA, 1221 bp, Nostoc punctiforme
cggcgggttgtagttacaggtatgggagctattacccctttaggaaataccatcaaggaatattgggaaggattgattgcgggacgaagtggaattgatttgattacccaatttgatgcttctttgcatatatgtagaattgcaggcgaagttagagactttaacccttatgattatctagaacgcaaagatgttaagcatatatctcgttttgctcaatttggaatctctgcaagtcttcaagcgatcgccgatgctggttttgaaattaatgactctaatgctactcaagtgggcgttattgtgggcaacggtatgggcggcctctatactgtagaggagcaagaaaaagttctcctgactcagggatctaaacgctgtagtccttttacagtgccgatgacaatagctaacatggcagctggactaatagcaatttacacaggagctaaagggccaaacttttgtactgtttcagcttgcgctgctggaggtaatgctatcggagaagcttttcgctcaattcagttaggtcatgctttaggaatgatttgtggtggtacagaagctgtgattacacctctgtctatagctgccttcggttctgccaagacgctatcaaccgcaaatgaagaacccacccgtgcctctcgtccgttcgatcgtgatcgcaatggttttgtgatgggagaaggagcaggcattttattcttagaggaattagaacacgctcttggccgtggagcaaaaatctatgcagaaattgttggttatggtctgacttgtgatgcttaccacatgactgctccaactcctagcggagagggagtcatgagagctatggaactagctttaaaagatggtggcatattccccaacgaagtcagttatattaatgctcacggcactagcaccttagctaatgatgccatagaaactttagcgattaaaaaagctcttggcgatcgcgctttccaaattcctattagttccacaaaatcaatgactggccatcttttgggcgctgctggaggcatcgaagctgttgctacagtcaagagtgtggctcttgatttaattccaccaacaatcaatttagaacagccagatccaaactgtgatttagactatgttccccataaaagtcgaactcaaagagtagatgttgctctttctaactcttttggttttggaggacataatgtctctttagcttttaaa

SEQ ID NO: 43502 - DNA, 1155 bp, Nostoc punctiforme
atggaatccctaacctctcgtatgcaggatgtacagtcgccgattattcctgtggttggggaactgattaaaaactctccaggaacaatctctctaggacagggtgttgttcattacaacccaccaccggaagctattgaatttttatccaaatttttagccgatcctgctaacaatttatacaaatcagtcgagggaattcccccattgctgacagcaattgctggaaaattgcaagccttcaatggtattgaaatcaatggggaaaactgcatcgtcgtgacagcagggagcaatatgggatttatgaatgccattcttgctattactaacccaggcgatgaaattattttgaatacgccttactatttcaaccatgaaatggcgatcgcaattgctggttgtcgtgcggtgttagtggcgacagatgaaaattaccaactacgcccagaagcgatcgctcaagcaattactcccaaaacccgggctatagtcacaatttcgcccaataatcccactggagtagtctattcagaagcagcattgcgccaagtaaatcaaatttgtgacactcaccgcatctaccacatcagcgatgaagcatatcaatactttacctataacggcgtaaaacacgtttctcctggtgcatttgggaagagcaagtacactatttctctatttagcctttccaaagcatacggttttgctagttggcgcattggctatatggtgattcccaaacacttatttgtcgctatcaaaaaagtccaggatacaattttgatttgtccgccagtaatttcccaatatgcagctttaggggcattgcaagcgaaagaggagtatttgcagagtaatataggtgcaatttttcaagtgcggcaattagtactcgactctcttaaccgcctagaaggtttatgtagcattacacctgctaatggcgctttctattttttcctcaaagttaatactcagatggatgcttttgagttagttaaaagactaatccaggaacataaagtagcagtcattccaggtacaacttttggtatggatgacggatgttacctgcgcgttgcttacggtgcgctgcaaaaagagacagccaaagaaggtatagaaagattagtacaaggtttggaaactata

SEQ ID NO: 43503 - DNA, 1275 bp, Nostoc punctiforme
gctccagaagcagactcctcagtcttgcaaatttggggtgggcatcctttgcgaggtcatgtgaaaattagcggggcaaaaaatgcagcactggtaatcatggctggagccttgctgtgtccgggcgattgtcgtatccgtaatgtccccttattagcggacgtagaccggatgggtcaggtgctatcagctttgggtgtacgtttaacacggcaaggcgatattttagacatcaacgccagcgaaattaaaacatcaaaagctccctacgaactagttacccaactgagggcgagtttcttcgccattggagccattcttgcaagattgggagtagcacagatgcctttaccaggcggttgtgctattggggcaagaccagttgacttgcatgtgcgaggactgcaagcaatgggggctgaggtgcagattgagcatggcatttgtaatgcctacgtccctggcagcagccggagattaaaaggtgcgaagatttacttagatatcgccagcgttggagcgacggaaaacttgatgatggcggctaccctggcagagggcgaaacgatcatcgaaaatgctgccagagaaccggaagtagttgatttagctaacttctgtaacgcgatgggagccaagattaaaggggcaggtactagcaggattattgtagaaggagtgcccaaattgcattctgttgactacagtatcattcccgatcgcattgaggccgggacatttttattggcagcagcaattacccgttccgaacttcttctttcgccagtagctccagaacatctcataccagtgattgccaagctgcgggatattggggtgacgataattgaggacaagcctgaacacttacgcattctgccggcggaaactctcaaggcaacggatattgaaactcaatatcatccgggtttccctacagatatgcaagcgccgttcatgtctttgctgacattggccgaaggcgacagcgtgattaacgaatccgtctttgaaaatcgcttgcgtcatgcctcagagttaaatcgcttgggggcagatattcgtgttaaaggcaatgctgctttcgttcggggagtgccaaaattgtctggcgcaccagtattaggcacagacttacgagcatcggcagcgctagtcatcgcaggactggcggcagaaggacaaaccacaattcaaggattacagcacctcgatcgcggctacgatcggctcgatatgaagttgcagcaattaggagctaaaatccttcgtgtg

SEQ ID NO: 43504 - DNA, 771 bp, Nostoc punctiforme
ggtgggctaagtctacgctggacactgagaggaaagaaagcactgattacaggtgctaccaaaggcattggactagctgttgccaatgagttcttatctctaggtgcagaagtcataattgtggcacggaattctcaagatgttgaccaacaactaattatctggcgagaattaggattacctgcttatggaattacggcagatgttgcaactgctgaggggcgacaagccatttttgagcaggttggcaaaacctgggataaattagacatcctggttaataatgtgggaaccaatatcagcaaaaaagtactagactacacggctgctgaatatcagttcatcatccagacgaaccagatatcaatttttgagatgtgccgtctgttttaccctctactgcaaaatagggaaaatagcagcattgtgaatataagttctgtggcgggtttagtctcaaaccgtacaggcgctccttatggtatgactaaagcggctataaatcaattgacgcgatcgctatcagttgaatgggcttgcgatcaaattagggtaaataccgtagcaccttgggctattcgcactcctctaaccgagtctgtactcgataaccaagattttctcaaattagttctgtcccaaacacctatgggaagagttggtcaaccagaagaagtagcgggtttagtagcatttctttgtatgcctgcggcatctttcatcactggacaatgtatcactgtcgatggtggttttttggctttcggtttt

SEQ ID NO: 43505 - DNA, 825 bp, Nostoc punctiforme
atgggtactcgttcttatcgcccttatacccccagcactcgccaagttacagtttctgactttgcggaaatcacaaaaaccgagccagaaaaatccctaacgacctcaaagcatcgtgccaaaggtcggaataatacagggcgaattaccagtcgtcgtcggggtggcggacacaaacaactttaccggatcatcgattttaaaagggataaacataatattcctgccaaagtcgcagcaattgaatacgatcctaaccgcaatgcccgaattgcccttttgtattaccaagatggcgaaaaacggtacatccttcatcccaatggattgaaagttggaacaataattatttctggacccgaatctccctttgaagatggtaatgctttacctctatcgcggattcccttgggtactagtgttcacaacgtcgaaatgactcctggtaaaggtggtcaaatcgtgcgtgctgctggtgctagcgctcaagttgtggcaaaagaaggtgattatgtaactctcaagttgccttcgggagaagtccgcttaattcggcgtgattgctacgccaccattgggcaagtgggcaacaccgatgcgagaaacctgagtgcaggtaaagcagggcgcaatcgctggaaaggtcgccgtccgaaggttagaggtagcgtcatgaacccagtggatcacccacatggtggtggtgagggtagggctcctatcggtagatcgggacctgttacaccttggggtaaacccacattgggcgcaaagacacgcaatcgcaagaaacttagcagcaaattcattgtgcgtcgtcgccgt

SEQ ID NO: 43506 - DNA, 3723 bp, Nostoc punctiforme
aaacgcatcgtcttggttgctgggtttgaatcattcaacgctgacttgtacaggaaagcagcttttttggctaactctcgctgtcctgagttggatattcgggtatttagcgatcgcaatattaccagtcaacgcgccgaagtagaagcagcacttgatggggctgatgcatttttcggtagcctactatttgattatgaccaggttgtgtggctgcgcgatcgcattgcccaaattcccattcggctagtgtttgagtcagccttggaattgatgagtttaaccaagttgggcgactttgccattggcgacaaaccaaaaggaatgcccaaaccagttaaattcatcctcgacaaatttagcaaaggtcgagaagaagacaaacttgctggttacatcagcttcttaaagattggccccaaactactgaaatatgtcccagtgcaaaaagtccaagacttacgcaactggttaattatctatggttactggaatgctggcgggccagaaaacgtagcctcattattctggacactagcagaaaaatatttaaatttaaaagtcggcgacattcccccgttaatcgaaacccccaacatcggattactccaccccgattatcaaggattttttgaatccccccgcgagtatttggaatggtataaaacccattgtagagacgcgattcatcgcgtctctacaaaaccgattatcggtattctcctctaccgaaaacacgtcatcacaaaactaccctacattccccaactaattcgtagttttgaaaaagccgggttaactcctttacccatcttcatcaacggcgtagaaggacacgtggcggtacgagatttgatgacaaccgactatgaaattcagcaacgacaactaggtaatatagagactccctcactatcaagtgaagcagttaaagtagatgcgatcgtttcaacaattggctttcctctcgtgggtggcccagctggttcaatggaagcaggccgccaaatagaagtagcaaagcgcatcctcactgccaagaatgtaccttatattgttgctgcaccactattaattcaagatattcactcgtggacacgccagggtgtgggcggattgcaaagtgtggtgttgtatgccttaccagaattggatggcgctattgataccattcctctcggtgggttagtgggcgaaaatatttatctggttcctgaacgggtgcagcgattaattgatagggtgaaaagctgggtgtctttgcggcaaaaacctgcttcagaacgcaaaattgccattatattatatggatttcctccaggttatggtgctgtaggcacagctgcattattaaatgtgccgcgtagtttgctgaagtttctccacgcacttaaagaacaaggttacaccgtcggagatttaccggaagatggagaagaattgatttgctgggtgaaagaggcggatgaatctaatcctcttgtggggcagtcgtctcgcctgcccctagacaatggcgggcaggatgcccaccccactagtactgttaacgcccgtaccttagaaaaatggttgggatatctgcaaacttcccgcatcgaaaaacaatggaaatctctcacgggaactggtattaaaacttatggcgatgagtttcaaattggcggtgtgcaattaggaaatgtgtggataggtgtacaaccacctttggggatacaaggcgacccgatgcgcttaatgtttgaacgggatttaacgcctcatccacaatatgctgcttattataaatggctgcaaaatgagtttgaagctgatgctatagttcactttgggatgcacggaacggtggaatggttgcctggttctccgttgggcaatacgggttattcttggtcggatattttgttaggaaacttgcctaatctatatatatatgcggcgaataatccttctgaatcgatgttggcgaaacgtcgcggttatggtgtgttgatttctcataatgtgcctccttatgggcgggcaggtttgtataaggaattggtggcgttgcgggatttgatttcggagtatcgggaagatccgcagaagaattatgttttgaaggaagggatttgtaaaaagattgtggactctgggttggatgcagattgtccgtttgaaaatgcgaagaagttggggattgcgtttactccagagaatgtgcggatgtttagcggtcatgcttttgatgcttatttggtggagttatatgaatatttgcaggttttagagaatcggttgttttcttcggggttgcatactttgggggaaaagccgagtgaggaggagttggggtcttatttggaggcttattttggggatgaggaagaaggaaacgaaccgcagaggcgcggagaacacagagagaagagagaagaggaggaaagattattaagggatttgttgatgcaatctacggatgagttaacgaatttgttgagggggttgaatggggagtatattccgcctgcgcctggtggggatttgttacgggatggggctggtgttttgccaactgggaggaatattcatgctttagatccttatcggatgccttcacctgctgcttatgaacggggacgagaaattgctcaaaaaattatcgcccagcatttggatgaacatgggaaatatccagaaacggtggcggtaatgctttggggattggatgcgattaaaacgaagggtgaatctttggggattctgttggaattgctgggggctgaacctgttaaggaaggaactggtagagttgttcgttatgagttgaagccgttggctgaggttggacatccccgcattgatgtgttgggtaatttgtctgggattttccgggatagttttgtaaatattatcgaattattagatgatttatttcaacgggcggctgatgctgatgaaccggaagatcggaattttattagaagacacgctttagctttaaaagcccaaggtgtggaaaatgcatcggcgagattgttttctaatccggcgggtgattttggttctttggtgaatgataaggtggttgatggtaactgggaatctggtgaggagttaggcaatacttggcaaagccgcaatgtattcagctacgggagagaggataaaggtcaagctagaccggaagtgttgaatacgttgttaaaaactagcgatcgcattgttcaagaaatcgattcggtagaatatggtttaactgatattcaagaatattacgctaatactggcggtttgaaaaaagcagcagagaaacaaggcggtaagaaggttacaaccagctttgtggaaagtttctcgaaggatactacaccccgcaatttggatgatttgctgcgaatggagtatcgcactaagttggtaaatcccaaatgggcgcaagcgatggcgaatcaaggttctggtggtgcttttgaaatttcccaacggatgacggcgttgattggttggggtggtactgccgattttgccgatgattgggtttatgaccaagcggctgatacttatgcattagatgcagagatggcggaaaagttacgcaaggcaaatcctgaagcttttcgcaatattttagggagaatgttggaggcgcatgggcgcggtttctgggaagctgatggtgagaagttagataagttgcggcaattatatgagttgacagatgaggagttggaaggcgtg

SEQ ID NO: 43507 - DNA, 1528 bp, Nostoc punctiforme
gtagattatacaaaagtggaatcgctaccagaagtttggcctttggcatctcaacgatttggtgatgttgttgccctccgcagtcctcacgccaaaccagaaattgtgattacttatacacagttagcagagcaaatccaattatttgctgctgggttacaggcattaggagtgaagctaggcgatcgcatttccttaatttctgacaacagtccccgttggtttattgccgatcaaggcataatgactgctggtgcagttgatgcagtgcgtagttcccaagcggaaaaagaagaattgctgtttatcatcgctaatagcggtagtacggcaatagttgttgaggatttaaagacacttaaaaaactacaagaccgcatccaagatttaccaattcagtttgcgattttactttcagatgaagcaccaccgacagacggaaccctaaaggtactgaattttgcacagttgatcgaaattgggaaaaatcataattttgtgccggttaaacaaaatcgtgatgctttagcgaccctaatttatacctccggtactacaggaagaccgaagggtgtaatgctatcttatagcaatttgatgcaccaaataacaaccttcggcacagtattacaaccaaatgcaggcgacattgttctcagtatcttaccttcgtggcatagctacgagcggactgttgaatattacctactatctcaaggttgcacgcaaatttataccaacttgcgttctgtgaaaggagatttgagacaatttaaacctaattatatggtgggtgtaccccgcctgtgggaatcgatttatgaaggagtgcaaaagcagttccgggaacaaccagccaaaaaacaacgcctaattaactttttgttgggcattagcgacaaatatattaaagcgcggcgagttgctcagggattggatttaaataatcttcatgcttcagccatcgagcgattaacagctaagatccaagcagctgctttattacccctccacgccttgggagaacgactagtttatgccaaggtgcgagaagccacaggaggacacgtcaagcagatgattagcggtggtggtgcgcttcccagacacatcgataacttctttgaaattattggtgtgcagattttgcaaggctatggcttgacagaaacttctcctgttacccatgtgcgccgtccttggcgaaatttgattggtgcatcagggctaccactccccgctacagaagctaaaatcgtagatcctgagacaaaagcgcctttgccaatagagaagcgaggcttagtattgttgagggggccgcagattatgcaaggctattaccaaaatccggaagcgacagcgaaagcaattgatgctgaaggttggtttgatagcggcgatttgggctggttgacaccacaagacgacttagtgctgactggcagagcaaaggatacgattgtattgactaacggggaaaacatcgagccgcagccgatcgaagaagacgtgtttgcgatcgcct

SEQ ID NO: 43508 - DNA, 2118 bp, Nostoc punctiforme
gaggcagtggaatgcggtgcagccgcactgggaattattttaggatactataatcgcattgtaccccttgcagaactccgtcaagcttgtggtgtttcccgagatggcagtaaagcatctaatattctcaatgcggctcgcagctatggtttgcaggcaaaaggctttaaggtcgatttagctgggttacgcaaactgcaatgtccttatattgtcttttggaatttcaaccattttctaatagtcgaaggatttgccaaagacaaagtttatcttaacgatcctgccaccgggccgcgcacagtttcactcccagaattcgatcagtcttttaccggggtagtactagttggtgaaccgagtgcagaattccagccaggaggacggaaaccgagcctgacattatccttatgggatcgattgcagagttctctaggagcattggtttattgtgtgatcgctggtttgctgttagtgattcccggattagccatccctgcgttctcccaagcctttgttgataatgttttgattgaaggcagaagtgattggttgcgaccattaattttagggatgatcctcacagccatattgaatggttttttaacattgcttcagttgcaatttttgcgacgcatgaaaattaagctggctgtggggatgtctagccgattcttgtggcatattctccggctgccagtgagtttttacgatcagcgatttgctggtgaaattagtagccgtgtccgcctcaacgatagcttggcgaatctgctctcaggaagattagcgacgacagtaatttcagccttcaccgttatcttttatgccgcagtcatgttgcaatatgatgtcgttctcactgcgatcggcattgcctttgtaatcgtgaatgtcagcgtgtggcgatgggtttcacggcagcgcgtcgatgccaacttgcgattaatgcaagaacaaggcaaagtcaatggagtagcgatttctggactgcaaagtatggaaacgctcaaagcatccgggctagagtcagaattcttttcgcgctgggcaggttattacgctaaggcaattaatgctcggcaagaaatggatacgactaatcaaaacctaggtgtattgccgtcatttctcacctccattacatccatgcttttgctagcggtgggagggctacgggtaatggatggtgtactcagtattgggatgctcattgcctttcaagccttgatgcaaagatttttagagcctgtaaataatctggtgagtttagcgggtgaactccaggaaatggaaggcaatttgggtaggttagatgatgtgttacgcaatccgatcgatcctgccgtagagcgagacattagtatatcgccaactcaactacctgccgcaaacgttcgacttcagggctatgttgaactccgtaatatcacctttggctataaccgctctgcacctcccttaatcgaaaattttagtctttcacttaaacccggtcaacgagttgctttagtgggtggcagtggttcgggtaagtcaaccgtcgccaagttggtgtgtggattatacgaacagtgggcgggagagattttatttgatggtaaacccagaaaacatattccgcgatcgattctgactaattcaattgcgcttgttgagcaagatatctcactatttgcaggcactgtgcgcgacaatcttacgctttgggattcgactgttccttttagtaacttggttcgcgcttgtaaagatgccgctattcaggatgtagtactttccatgcctggaggctacaacgctgacctcgcagaaggggcatctaatttgagcggtgggcagcgacagcgattagaaattgcccgcactttagtgaataatccggcaattttggtgatggatgaagcgaccagtgcgcttgattccgaggcagaaaagacgatcgatcagagactccgggagcgtggctgtacttgtgtaattgtggcgcatcggttaagcacaattcgggattgtgacgaaattattgtcttcgatcgcggcaaggtggtacaacgcggtagccatgaagaattgcagaaggttgaaggtaagtatttgcaattgattcgcagtgaa

SEQ ID NO: 43509 - DNA, 741 bp, Nostoc punctiforme
atgacattattacaaggtaaagtcgcaattgtcacaggtgcatcacgagggattggcaaagcgatcgcaattgaattagcttcacaaggagcgatcgcagttgtcaattatgctagttcgagtgctgcggctgaggcagttgttacagaaattacagcagtgggaggtcaggcgatcgctatccaagcagacgtttctaaaggcgatcaagtagatgcactagttaacgccgtcatggaaaagtttagccgtgtggatatcttagtcaataacgcagggattacccgtgacacactgcttttgcgtttaaagccagaagattggcaagctgtgatagaccttaatctaactggtgttttcttatgtacacgcgccgtcagtaaaatcatgctcaaacagcgatcgggtcgaattattaacattacctccgttgctgggcagatgggcaacccaggtcagtccaactacagcgccgccaaagcaggtgtaatcggcttcaccaaaagcgtagccaaagaactggctactcgcggtattaccgttaacgccgtcgcccctggtttcatcactaccgatatgaccagcgatctcaataaccccgaagatatcctaaaatacatccccctcggtcgcttcggtcagcccgaagaagtcgctggaatggtgcgtttcctcgccgccgatcccgcagccaactatatcaccggacaagtttttaacgtcgatggcggaatggtcatg

SEQ ID NO: 43510 - DNA, 1587 bp, Nostoc punctiforme
ttagtattgggatctaattcctcagcaattaatcgtctataccgcatatcttcgctgatattattaagtacttggttacgtgtcgctttcaattattttggacaagtttatactgaattatctcaactacattttggcgatcgcttacgaaagcaaatctttgaacagttacaatccttatcgttaagttactttgccaaaactcgttctggtgaactaattaacacaataaccacagagatcgaaaggatcaggcagggttttagtggtgcagcatttttagtatctagagggataacaactcttgtctacttaatatcaatgtttttgatatcatggcaactgactgtaatttcagcattactctttacacttttaggtgtagggttatctaatctgaatgccagagtcagagaatcaagttttggcatgacaactgctaatgctaactttacatcaacagccatagaatttattaatggcattcgcactgttcattcttgtggtactcaagaatttgaacgccagcgttactacaaagctagcgataaggtagtaagttctacaactaaagttgtatttacttggacacttgtcaagccaattgccgaaggggcagccactacggtgttggtgggaatgattattttggcattcactagcctggttagtaatggaacgctacaagttgcttctttgctaacatttttctttgtactatttcgcttcattccgtttgttcaagatattaatggcacacgagcatttctcagtactctacatggctcggcagacaacattaaaaatttgttgaaaagtgatgataaaaattattttaagaatggaaaacttcagtttaacgctttagaaagggcaataaatttagtatctgtagatttcggttacgatgaccaaaatatagtactgcataacattaccctaaccattgaaaagggaaaaatgactgcactagtcggagcctctggtgctggtaaaaccacccttgctgatttaatccctcgattttacaatgccacagagggaaatgtttatatcgatgaagttgatataagactatttgaaattaactctctacgtcgtaaaatagctgttgtcagtcaggatacatttatcttcaatactgatgtttggcaaaatattgcttatggtactccacaagctactaatgagcaaattcaagaagctgctaaattagcgaatgcgctggaatttattttagaaatgcccgaaggttttaatacccaattgggagatcggggtgttagattatctggaggacaaagacagcgaattgcgatcgcacgggcactactacggaacccagaaattttgattttggatgaagcaactagtgctttagattctgtatccgagcgcttaattcaagattcattagaaaagctatctgtgggtagaacagtaattgcgatcgctcaccgtctttctactattgcgaaagcagataaagtcgtagtactagaagcaggacggatagtagaacagggcaagtatcaagaattactcgcacgccaaggcaagctgtgggaatatcatcagatgcaatac

SEQ ID NO: 43511 - DNA, 975 bp, Nostoc punctiforme
atgtttcctacacaccgcccccgtcgtctgcgtacccatcctcaactgcgccggatggttcgtgaaactgttttaacaacaagcgatttaatttacccattatttgccgtaccaggtgagggaatcgctaatgaggttaaatccatgcccggagtctaccaactttcggtagataaaatcgttgaagaagcaaaagaagtttacgacttaggaattccttctattattttatttggtattccggctgataaagatgtagatgcaactggtgcttggcatgattgcggtatcgtccaaaaagcagcgacggcggtaaaagcagcagtgccagatttgattgtaattgctgatacttgtttgtgtgagtacactagccacggtcattgtggttatctgcaagttggtgatttaacaggaagagttttaaatgacccaactttggaattgttgaagaaaacggcagtttctcaagccaaagccggtgctgatattatcgcgccttctgggatgatggatgggtttgtgcaagcaattcgtcagggtttggatgaagcaggatttcaagacacgccgattttgtcttatgctgctaagtatgcttcaggttattatggcccatttcgggatgccgcagactcgacaccgcaatttggggatagaagaacttaccaaatggatccaggtaatgcgcgcgaagcaattaaagagattgacttggatatcgctgaaggtgctgatatgctcatggttaagccagccttagcatacatggatattatctggcgggtgaaagaagcgagtaacttaccagttgcggcttacaatgtttctggtgagtatgcgatggtgaaagctgcggctctcaatggttggattgatgaagagcgcgtagttatggaaactttaactgggtttaaacgggctggtgcagacttgattttgacctaccatgccaaagatgcggcgcgatggtta

SEQ ID NO: 43512 - DNA, 969 bp, Nostoc punctiforme
atggcagaaacactattcttcaacgccttacgcgaagccattgatgaagaaatggcccgtgactccagcgtattcgttctcggtgaagacgtaggacactacggcggttcctacaaagttaccaaagacctgtaccaaaaatatggcgaactccgcattctagacacccccatcgctgaaaatagcttcactggtatggcagtaggggcagccatgacagggttgcgtcccatcatcgaaggcatgaatatgggctttttattgctcgccttcaaccaaatatccaacaacgctgggatgctgcgctatacttccggcggtaactttaaaattccgatggtaattcgcggccctgggggtgttggaaggcagctaggtgcagaacattcccaacgattagaaacttacttccaagcagtgccaggcttgaagattgttgcctgctccacaccaagaaacgccaaaggactactaaaatcagctatccgcgatgataaccccgtgttgttctttgaacacgttttgctttacaacttgaaagaagatttaccagaagaagaatatttactacccttagataaagccgaagttgtgcgccaaggaaaggatgtcacaattatcacttattctcggatgcggcatcatgtgctgcaagcggtaaaaacacttgaaaaacaaggttacgatccagaagttattgatttaatatccctcaaacccttggattttgatacaattggtgcatcagtacgcaaaacccataaagtcatcgtggtggaagaatcaatgcgaactgcgggtattggagcagaagtcatcgcttcaataaacgatcgcttatttgatgaattagatgcgccagtactgcggctttcttctcaagatatccccacgccttacaacggcaatctggaacgactaacaatcatccaaccagagcaaatcgtagaagctgtggaaaaaatggtg

SEQ ID NO: 43513 - DNA, 1239 bp, Nostoc punctiforme
atggcagattggcaaagaatcacaggtggtatcacagcaccaagggggtatcaggcggcgggaataaccgcagggttgaaaccttcggggttgccggatttagcattgatattttcagaggtggaagcgatcgcagctggtgtattcaccaccagtcaagttaaagctgcctgtgtcgaatattgtcgccaacgcttgcaagctaaacctagcgctcgtgccatcctttgcaacgctggacaagcaaatgccgctacaggtaatcaaggctaccttgataccctagagtcttctctggcaatagctcacgcactaaacatctcgtctgaatctgtcttattggcttccactggcgtgattggtcaaagaattaagatggatgcgttgcgaagtgggattcccaaggtagtagcagcactatcagcaacaggttcagatgccgcagctggggcgattatcactacagatttagtaacaaaatccattgccctagagacaattgtaggtgaacgccctgtcagaattgggggcattgccaaaggttccggtatgatccatcccaacatggcaaccatgttggcatttgttacttgtgatgctgtggtttccccagccctgtggcaacaaatgttagcaagagcggctgatagaagctttaattccattaccgtggatggcgataccagcaccaacgacagcttaatcgccttggcaaatggtcaatctcgtaccccagcaattatagaatggggcgcagaagcagagaaattagaagccatgttaacagcagtttgccagcatttagccaaagcgatcgctcgtgatggtgaaggcgcaacctgtctaatagaagtggaagtaacaggggcccatgatgaactctcagcccgacaaatagccaaaaccatcgctggttcatccttagttaaatctgcaatctttggacgagatcccaactggggacgcatcgccgccgccgccggacgtgcaggtataccatttgagcaagaaaacctgcaaattaagttagggaatttcttaatgttagaaaacgggcaacccttaacttttgaccgtgcagcagcgagtgcttatttgaaaaaagcagcgacgggtgcttatctccaagatgatacggtgttaatctccgttaatgttggcaacggtaatggtgtgggtaaagcttggggttgtgatttgagttatgactacgtgaggattaacgccgaatatactacg

SEQ ID NO: 43514 - DNA, 2559 bp, Nostoc punctiforme
attactgatttaaagcaggttgaagaaaccttgagactcagagagagggcacttgctgctaccagtaatggaattattattgccgatgccagacttccctataatccgattatttacgtcaactgcgcttttgagaaaataacaggctacactgctgctgatgtgattgggcaaaactgtcgatttttgcaacgcacagatagccagcaaccagcactcaatgaactgcgttcatctcttcaagctggaacaagttgcaaagttattctccgtaactatagtaaagatggtgtcttgttttggaatgagttgtgtatttctcctattcatgacgaaaatggcaaattaagccactttattggaattcagacagatattagccagcgcaagcaagccgaagccagtctgcgtcggcaagccctcacttttgaaaacatgcatgatggcgtaattatcacagatttaggcggaaatattattgactggaatcctgctgcccaaagcatgtttggctataccaaagccgagattttggctaaacatatcagtattttgcatcggccggaagtagccgcaacattaagcgccaaaattctcgaaaaaatcaaccagcaagcacgctggtcaggggaaatacactttctttgtaaagatggcagtcaggcaatttgcgaaacaacagtagtatctttacaggatgaacaaggagaaactgttgccactgttggcatcaatcacgacattaccgaaaataaacgagctaaagaagcattgcaacggcaattgcatcgcaccctattacttgaacaaattactcaagaaattcgtcaaagtcttgataccagcaaaatctttgagacggctgctacccaaattggaaaagcttttaaagccgatcgctgtctaatccattcttacattagcgaccctacacctcgaatccccctagtagcagaatataacacactccccggttattgctccatgctgaaattggaagttcccatgactaacaatcctcatgcagagcagatgatggcacaagaaagtgcgatcgcttccccggatgtatatgccgatcctttactccaggcagctgaacctatctgccgaaaaattgaactgaagtctatgctgtcaatccgcacctcctatcaaggagaacccaatggtgcgatcggattacatcagtgcagctattttcgccagtggacaccagacgaaatcgaattactagaagcagtggcggctcaactgggtattgctctcgcacaggctcagttactggaacaagaaacccaccgacgggaagaacttaccttgaaaaactttgccttggagcaggcaaaacgtcaggctgaagccgcaaatcgggcaaaaagtgagtttttggcaatgatgagccacgaaattcggactccaatgaatgctgttattggcatgaccgatctcctgctggatactgacctcaccccgcaacagcaagactttgtagaaacagttcgcagtagcggagatgctttgctcaccatcatcaacgacattctagatttctccaaaattgagtcgggaaagctggagttagaagaacagccttttgatttgagagcttgtgtagaacaggctatttctctattagccccgaaagctgcccaaaaaaatatcgaactagtttacctaatccaaccgcaagttccaactcagatcgttggcgatatgacacgtctgcgccaagtcttaatgaatctcctcaacaacgccattaagtttactgaacgcggagaagtggtactctctgttgaactgggggctggggattcagtcaagcagggggaaaattcctctcctctgcacccttccctcgttcggctacgcccttctctacgagaggctgcgccaacgactacgctcaggacaagctcacggcaagcccgcccctctgcctcttccgagtccccaatccaaattcaatttgccatcaaagatacaggtattggcattacaccagagaagatagagcggttatttcatcctttcactcaggctgatgtctccatgactcgacgatatggcggtacagggctagggctagtaattagcaagcggcttagtaagatgatgggaggaactctttgggtggagagccaagggattgttggtggcaatcctagtcctagatggaaaagtagaaaatcattatcatctccttactcttcccaaggttcaacattctacttcaccattactgcccaagtgcctgctgtaccagaagctgaatttagtaattcgccgatgcagcttcagggaaagcgcctgttgattgtggacgataatctgactaactgtcaaattatcagcttgcaagcagagtcttgggaaatggaaacttatgctgccaaatctgctaaagaagcgttagctcaacttgctcagggaatacagtttgatattgccattttagatatggaaatgccagcaatggatggtataaccctagctcgtcaaatccgcaggcaatctggttgtcaaaatctacctttagtgattcttacttcttta

SEQ ID NO: 43515 - DNA, 1560 bp, Nostoc punctiforme
atgaccaaagcacctgttgctcctgtggtgctagtcattttagacggatggggctactgcgaggaaaagcgaggaaacgctattgttgctgctaaaactcccattgtggacagtttatgggcagcttacccgcacaccctcatccgcacatcaggaaaagccgtagggttgccagagggtcaaatgggcaactcggaagttggtcatttgaacattggtgctgggcgagtggtaccgcaagaacttgtacgcatctccgatgcggttgaagacggttctattgccttaaacccagcacttgtcaaaatttgccaggaagttcgttctcggaatagcaagctacatctagtcgggctttgttctgagggaggggtacattcgcatattacccatctattcggactacttgacttagccaaaaaccagcaaattccagaagtttgtatccacgccattaccgatggtcgtgacaccgccccaactgacggtgtaagagcaatcacaatgctgcaaaattatatagaccgcacaggaattgggcgcatagtcaccctcagcggtcgctactacgcgatggatcgcgatcaccgctgggatcgggtcaaacgcgcctacgacgtgatgactcaagatggtgtgggtgataatcgcacggctgtggaaatcttgcaagcatcttacgccgaaggggtaaaagatgaatttgtcaacccaatccgaattgcaccaggtgcaatagaaccaggggatggagtgatatttttcaacttccgccccgatcgctccagacaactgactcaagctttagtcagtcccacttttaatggttttgaaagacagcaaatcacaccactgtcttttgtcacgtttacacagtatgattcagacttacccgtggctgtagcctttgagccgcagaatctcagtaatattctgggagaagtaatagccaatcatggtctgaatcagttccgcaccgccgaaacagaaaaatatgcccacgtcacctatttctttaatgggggtctggaggaaccttttgctggagaagatcgggaactagtaagcagcccgatggtagcaacttacgaccatgccccagcaatgtcagcagtagcagttacagatgttgcgatcgctgcgattcaaaagggtacgtattctttagttgtaattaactatgccaatccagatatggtagggcatactggtcaaatcgacgctaccattacagcaattgaaacagttgatcgctgtttaggacgcttattagaaagcgttatcaaagccggcggtacaacaattattactgccgatcatggcaacgctgagtatatgctggatgatgggggtaatccctggacagcccacaccactaacccagtcccctttatcttggtggaaggagagaaagtcaaaatccctggatatggtacaaatgtcgaactgcgaagcgatggtaagctatccgacattgcccccacaattctagagattttacaactgcctcagccaccagaaatgacagggcgatcgctgctgaaaacagcagattatgaa

SEQ ID NO: 43516 - DNA, 1680 bp, Nostoc punctiforme
atgctgcgactagaacatataagtaaaatttatcccacaggcgaagttctcaaagatatcaactgggaagttaaaccaggcgatcgcattggcttagtcggtgtcaacggtgctggcaaatctacccagttaaagatcatttctggggaaatggaacccaccgcaggcgaaattatccgtcctaatagcttacatatagcctacctcaaccaagagtttgaagtagaccccacccgcaccgttagagaagaattttggactgtctttaaagaagccaacgaagtacagttatctctggcgcacatcccacaagaaatggaaacggctagcccagaggaactggatcgactgatcgacaagttggatcgcttgcagcgcaaatttgaagccttggatggctacaacttagatgcacgcatcgggaaaattttaccagagatggggtttgggctagaagatggcgatcgcctcgtcagtgccttcagtggtggttggcaaatgcggatgagtttaggtaaaattctcctgcaaaaacccgacttgttgctgctggatgaaccgactaaccacctagatttagaaaccattgagtggttggaaaattacctcagagggctaattacgccgatggtaatagtctcccatgaccgggagttccttgaccgcctctgtacccaaattgtggaaactgaacgtggtgtttccagtacctaccttggtaactactcagcatatttggaacaaaaagccgaaagtcaatcagcacaactgagtgcttacgaacgccaacagaaagaattagagaaacagcaaacctttgttgatagattccgcgctagtgctacccgcagtacccaggcaaaaagccgggaaaagcaactcgacaaaattgagcgcattgaagcacctatcgctggggtaagaactctacacttccgttttccgcctgcaccccgcagtggacgcgaggtagtggacattaaagatttaactcatctttatggtgataaaatcctgtttttggcagcaaatctgctaattgaaagaggcgatcgcattgcttttcttggacccaacggtgctggaaaatctacccttctgcgcgtaattatgggcatggaaccacccacggaaggtagcgttcaactaggggatcacaacgttattcctggttactttgagcaaaatcaagctgaagccttggacttgaagaaaactgtcatggaaactatccatgatgaagttccagactgggataatcaagaagtccgcacgcttttgggacgcttcttattcactggtgatactgtatttaaggcagttggggcattaagtggaggagaaaaagctcgtttggcgttggcaaaaatgctcttacgtcccgcgaacttactaattttagatgagccgacaaaccacctagatattccagcgaaagaaatgctggaagaagcgctcaaaaattatgatgggacggcaattgtagtttctcacgatcgctactttatttctcaagtagctaataaaatcgtcgaaattcgtgatggtgaattccgcgtttacttaggagactatcattactatctccagaaaattgccgaagaaaaagaacaagcaaagttagctgcgatcgctgccgaaaaagctgctaagaaagctgcaaaagcttccaccaaaagg

SEQ ID NO: 43517 - DNA, 864 bp, Nostoc punctiforme
gagcagcgcattgaaaaagcacggcaagagggagcaatagaactcgatctcagcaagatagaactcactgagataccagaagcgatcgcatctctgacacagttgcaacagcttgacctctccagaaaccaagtgacccaactgccagaggcgatcgcatccttgacccagttgcaaacgcttgacctctccaataataaactgacccaactgccagaagcgatcgcatccttggctcggttgcaacggcttgacctctctaacaaccaattgacagaactgccagaagcgatcgcatccttggctcagttgcaagagcttaacctccgcaacaaccaattgacagaactgccagaagcgatcgcatccctgactcggttgcaacggcttgacctctctaacaaccaattgacagaactgccagaagcgatcgcatccctgactcagttacaatcatttgacctctcccacaacgaattaacggaactgccaaattcattaagtcgcctactgtatttagagatatttgattgtggaagtaatctactcagacaagttccatcagtcataaaagaactgaaagggttgaaagaattatatatttacgcaaacgatttagaagtaattccttcatggatttgtgatctgcatgtattagaaatactcagcattggtggcaaccaaatttcggaacttcctaaatcactggataaactccaaagtttagaatttatcattttaggagctgatgatggtggtaatccactgagcaaacttcctccatgcattcaacgaattaagcaaattcggaggatttgggcaaataactgtgaactgcattttttgcctgactggctgaatgaa

SEQ ID NO: 43518 - DNA, 1308 bp, Nostoc punctiforme
tcgcctaatcaggaacttttaccgctaactgctagagttcataatcatgactccctagaaattggtggatgtgatgtcacaaccctagttaagcaatttggttcacccttatatattttagatgaagaaaccttgcgttcagcttgtcagcaataccgagatgctttcaagcagtactacaagggcgaatctcaagtattgtacgcctcaaaagcttggaattgtttagcagtttgtgcgatcgccgcatcagaaggattaggaatcgatgtagtttctgggggcgaactttacaccgccctacaagcaggtgttagtcctgagaaaatctaccttcatggaaataataaatctcgtgaagaattaattttagcgatcgagtctggtgtcaccattgtggcggataactggtatgagttgcgtacccttgtggaaattgcccaacctggtcaatcaatccgcatcatgctacggctaactcccggtattgagtgtcacacccacgaatatattcgcacgggacacttagatagcaaatttggctttgatcccaacgatttagatgaagtatttacctttgtcagtcaacaaagcacccttgactgcgtaggggtacacgctcatattggttcccaaatttttgagcgccaaccgcatcaagatttagctgctgttatggtgcaatggctgcgggatgccggaaagtacggtttaaatattacagagttaaatgttggtggtggtttagggattaagtatacagaatcagacgatccccctagcattgaagagtgggtgaaggcaatttgtgaagttgtccaagaagcctgtgcggtcgaaaatctgcctttgccgaaattactgagtgaaccagggcgatcgctaattgccacagcttgcgtcactgcttatactgttggttcatccaaagttattccagaaattcgtacctacgtagcgatcgatgggggaatgtctgataatcctcgcccgattacttaccaatcagtttatcgggcagtagttgccaataaaatgtcttctcctgtaactcaaacagtcacaattgctggtaaacattgtgaatcaggagatattctgattaaaaatgcactactcccaaagactgaaccaggagatattctcgtagttatgggaactggtgcgtacaattacagtatggcatctaactacaaccgcttgccccgaccggcagcagttgtggtggcgaatggcgaagcgaatttaattttgcaacgtgaaacttatcaggacttaattcgacaagatagcctaccagaaaggctg

SEQ ID NO: 43519 - DNA, 992 bp, Nostoc punctiforme
atgcaaaatttgccgaatttccgcgattactacgaaattttaggagtatctaaagacgcttctggtgaggaaattaaaaaggtttatcggcgtttagcaagacaatatcaccccgatctgaatccgggtaacaaagaatctgaggaaaaatttaaggatatcggcgaggcttatgaagtcctttcggactcagccaagcgatcgcaatacgaccagtttagccgctactggaagcaaaaaggctttgcaggcaacaaacaaacaccaaaggctaaaacttggcagagtggtgctagcgatcgcaacggcaatcaagacgtagatccaagccaattctccgactttgaaagctttattaatcaagttatcggtgtcaaaaataagagtggggccagtaagtctagtaatggcaatactagcgatccgtttcgttcccccagaacaaaagttgcctatacagttaacactccacctcgcactacccgccgagatatagaagccagattaacgctaccactagaaaaagcttatcaaggtggtaatgaacgcatccgtttagaagatgggcgatcgctagaagttaatatgccactagggatggtgacaggccaaaccatccgtttgcgaaaccaaggcgttggtggtggcgatctatacttaaaaattaccgttgagcctcatccattatttaagctagaaggtttaaatattctttgccaagtaccagttactcccagcgaagcagttttaggaggacaggtagaagcaccaactttggatggcccagtgaaaatgaccattcccccaggagttaggtctggtcaaaaattccgactagggaataaaggttatcccagcgatgatggcaaacgtggcgatcaattagttgaaattcaaatagtcacacctaaaatattagtcaagaagaacgggaactctacgaaaagttacggcaaatcgaaacctttaaaccccgtgctgatttactgagt

SEQ ID NO: 43520 - DNA, 2084 bp, Nostoc punctiforme
  unsure (1)..(2084): unsure at all n locations
ataaatacataagacactttaggagaagagtaacgcatgggcaaggtagtcggcatcgacttgggtacaaccaactcagtagtcgccgttatggagggtggcaagccggtggtgattgccaatgcagaaggaatgcgaacaaccccctccgtagttggctttagcaaagaaggcgaaagggtagttgggcaaatggcacgccgccaaaccgtcctcaatccccaaaataccttttttgcagtgaaacgcttcattgggcgcaaatatgccgaacttagtccagattccaagcgtgtaccttacaccatccgcaaagatgaagtaggtaatattaaaattgcttgtccccgtcttaataaagatttcgccccagaagaaatttcggcaatggtgctgaagaaattggcagacgatgctagtcgctatttgggtgaaccagtcacaggggcagtgattacagtccccgcttattttaacgattctcaacggcaagcaacccgcgatgctggcagaattgccggtttagaggtgctgcggattctcaatgaaccgactgctgcatctttagcttatggattagatcggggtgacacggaaactatcttagtctttgacttaggtggcggtacttttgacgtgtcgattttagaagtgggcgatgggatatttgaggtcaaagctaccagtggagatacgcaacttggtggtaatgactttgacaaaataatagtagattggttagcagagcaatttctggaaactgaagaaatagacttaagacgcgatcgccaagcttacaacgtctgatggaagctgcggaaaagccaaaataaaactttctgctgtcagcgtactgatattaaactacccttcatcaccgcacggatgatgggcccgaacatctanaaactcgtttaactcgttcccagtttgaaggtttgtgtggtgatttggtagggcgattgcggacaccagtgaaacgcgccctcaaagatgccggactttcacctagagatattgaagaagttgtcttagttggcggttctacacggatgccaatggtgaaacagctagtgcgagacttgattggtacagaacctaacgaaaatgtcaatcctgatgaagtagtgggagtgggtgcagcaattcaagccggaattcttgcaggtgaactcaaagatgtgctgcttttggatgtcacacccctttctttaggattggaaaccatcggcggcgtgatgaaaaaactcattccgcgcaacaccaccatcccagtccgccgttctgacattttttccacgtctgaaaataaccaaaataccgtggaaattcacgtagttcagggcgaacgagaaatggcaggaaacaataagtctttaggacgtttcaagctgtatggtatcccgccagcgccacgaggaattccccaagttcaggtatcatttgatatagacgctaatggtattttacaggtaacagccttagatagaaccactgggcgagagcagagtatcaccgttcaaggcgcttccaccttgaacgagtcagaagtgaatcggatgattcaagatgcacagaaatacgccgatgtcgatcgcgaacggaaagaaagggtagaaaagcggactcgttctgaggcgttgattttccaagcagaacggcaacttagagaagttgcacttgaatttggtatgcagtttgcccgcagccgtcgccaaagaattgataatatttgccgagacttaaaagagagtctgaaggaaaatagcgatcgcggtatcgatcaagcctacgccgatttgcaagatgctctctatgagctaaatcgagaagtccgccagacttatgctgaagatgaagatgacgatttgttaggtactatccgtgacatttttactggcggtgataaggataaagaacgcgaatttcctagagatacatatcgggaacgcgattcattcggtaaggactatggtagagattacggtaaagactatggccgagacaatagccgagactatggccgagacaatagccgagacaatagccgagacagtcggtcttcctcttatgaaagccgtcct

SEQ ID NO: 43521 - DNA, 3367 bp, Nostoc punctiforme
aataatctgcggtttttagatgtcaatgaagctgctgttatccactacggctactcacgagaagaatttttgcaaatgcgaatgactgacattttccctccagaaaatgtatctatattcagagaatatttaggaaaaaggcacactaacttgcacttttctggacaatggctacatcggcgaaaagacggacagaatattgatgttgaagttgttacacatacaatagactatgctaattacaatgctcgattagttaatatccgagacattacagaacacaaacgaatagaaagaacacttcaagagcaaaatgagtttttgcggagaatttttgagagtataccattgatgattgcacttattgataccaatggtaaacttcagtgggtaaaccaagaatgggaaagtgttttaggctggaaatttaaagacttccaaactggtgatgtcttggaagcattatatcctaatgctgaatatcgacaggatgtgattaattttatgcagtctgcacaacacaattgggctgacttcataactcaggttcgggatggtgatttactagatacatcttggacaaatgttaaactttcaaatggtcaaattatcactattggtcaagatatcacggagcgcaagcgaactgaactggctctaaaaggtcaagccgaacgcgagcaattgatgcgaactgttgctcaacgaattcgtcaatctttgaatctccaagatattttgaatgcaacagttcaagaagtgcgagatttacttggggttgatcgagtagtagtttatcagtttgactcagaaatgatcggtacaatcatggcggagtcagtagaacctggatggagagtttctttgggggtagagatttatgatacgtgttttcaaacaggcaaaggagcggaatattaccaagtaaacaaacgagcgatcgctaatatttatgaagctggactaactgattgccatattcgcttattagaacaatttgaagtcaaagcaaatttagttgtacccattttactagaagtaagttctcaaacccctggctctcacctttggggtttattaattgctcaccaatgctctggctttcgtgagtgggaaaaaaatcaattagatttgctcgatcaagtgacagtccaattagcgatcgcaattcaacaatccagcatccttgagcaagctcaaactgaacttgttcaaagacaaaaagctcaagtcaaattaaaaaatgccttagctgaaaaagaagttctcttaaaggaagttcatcatcgagttaaaaataatttgcaaattgtctccagtttattacaactccagtctcaaacactcaaagatcctgaagccatcaaagttcttcgagaaagtcaaaaccgaattgagtcaatatctttaattcataaaaatttgtacacttctgctaatattgggcagattgatgttgtcgattatataagtaatttagcagcaagcctgctaatttcctatcaaatatggcctgagagaattactctagaaactgatatagattcagtgaatttgaatgtcgatcaagctattgcctgtggattggttattaacgaattagtctccaatgctctcaagcacgcttttcctaatcaacaagtaggtacaatcagtattgctctacgcaatatcaataatagtatcgagatgactatccaagataatggaattggtttaccagctaatttagattggacaaatactgattctttgggtctgtcattagtatatgacttggttacagaacagctagaaggcaacatcaccctagaacgtaatcatggaacaggattcaaaatcaaatttaagcagttaactttgcatcagtaaatatcaaatgggtcaagctaggattttagttgttgaagatgaagtgattgtggctagggctattgctagccaactcagtcaactaggttatgttgttacgggaacagcttcatctggaaaagttgccatagctaaggcattggaaactcaaccagagttagtattaatggatattattcttaaaggtgaaatggacggtattgctactgccagccatattcgcgagcagttagacgtacctgtaatatttttaactgcttatggtgataataatactttagaaagagccaaaattacccaaccttttggatacattgttaaaccatttactacaaaagatttaaagatagcaattgaaatcggtcttctaaaacaccagttagagcgtgaactccggcagaatcgagatcagttggcaacccttttaaactcaataagcgatgctgtaatcgctacaaatgagcagggaaaggtgacatttatgaatcccgcagccgagacactaactggctggcagcaaaaagatgctttaggaaatgaggcagcaaatatttttcatattgtcgatgaagccacagatactatattagaaaacccagtgacaaaagtgctgcgagagcagcaagttgtttatttagaggaattcacatctctgattagaagagacggaaaaagagttccaattggtgatagtgcttcgccactgaaggaagggccagataaaataaatggtgtagtagttgttttctgggatcttagcgatcgccgccaaacaaaagtgctagagaaagcattagaaaaggagcaagaacttaaccgtctcaaatccttatttatctctaccgtatctcatgagttccgtaatcccctgactgttattcaaacggcagtagagcttatagagatgaaaggaggaaatttgacagatgaaaaaagaggaatttatttaaagcgaattcaaggtgctgtgcagtctatggaaaaactcatggaagaagtgctgtttgtgggtcgagcggaggcaaaaaaacttgtatataaccctgctccacttaacttagagcaattctgtctagagttaattaaagatttttctattgttgaaagtagcgagtgtgaagttgtttttacctgtcatagcgatcgcactgacgctgtaatggatgaaggactattaaattatatgttcgggaatctcctctcaaatgcgattaaatattctccaagaggtggcaagattcagtttaatttaatatgcgatccaattgagaaggtagcaattttttatattcaagatcaaggtatgggcattccagaagcagatcaagctagactttttgaatcattttaccgaggctcaaatgtccaatcaattaagggtactgggttaggcttagtaatcgttaaaaggtgcgttgatgctcacaggggtcaaattagtgttacaagtcaaattggagtcggtactacatttacagtaattttgcccttaaat

SEQ ID NO: 43522 - DNA, 987 bp, Nostoc punctiforme
atgggcaagaaatatgatgtttatggtgtaggtaatgccttagtagatatagaatacgaagtatctccagagttactacaagagctaaagattgacaaaggtgtaatgacactgctagatgaagacagtcaaaatcatattttggaaaatctcaaaaatcttcattgccataagagttgtggaggttcagcagcgaacacaatggtggcaattagtcaattaggaggaaaagctttttattcatgtaaagtggctaatgatgaatttggagacttttacatcgaagatttactcaactctcaggtagataccaacttaaaaaatggcgaccgtcaatcaggaattacaggcaaatgtttggtgttagtaactcctgatgcagatcgcaccatgaatacatttttgggaattactgaaaaattttctacacaagaactagtatcatcagcgcttgctgattcagaatacatatatatagaagggtatttagtgacttctcccacagcaaaagaagcagctataaaggctagagaaatagctgaaaaagcaggtgtaaaaaccgccatgtccttatctgattacaacatggtgaaattttttaaagatgggttattagatatcattgggcctggtttagatttgatttttgctaatgaaagtgaagcattagaactagcagatacacaagattttcaagtagctgtagacaaactaaaaaccttgagtaagaaatttgccattactcgcggttccaagggttcagtagtatttgacggtcaggaattaatcgaaatcgctgcacctcaagtaaaagctatagatacagtaggagcaggagatatgtatgcaggagcttttctctatggaattacccaaagtatgagctatgaagaagccggaaaattagcatcgaccgcagcttctaagattgttacatcctatgggccaagattaaaaactgaggaattaaaggcattagttagtgct

SEQ ID NO: 43523 - DNA, 393 bp, Nostoc punctiforme
atgaagcgctattggtcgcgtttgcttgcgctggttttggttgtgtctatcggcttaatgggctgtactggcagtccagatagtttgactggggattatcgccaagataccttagctgtggtcaatgtgatgagacaggctctgaatctatcacaagattcatcagacaaaacagcagttcaagcagaagcgcgtcagaaaattaatgacttttcggctcgctatcagcgagttaactctgtttctggtcttggctcatttacaactatgcggacagcccttaattccctggctggacactacagttcttacccaaatcgtcccgtacccgaaaaactcaaaaatcgtttagagaaggaattacagcaggttgaggccgcactaaaacgtggc

SEQ ID NO: 43524 - DNA, 1998 bp, Nostoc punctiforme
attaattttacactccaagcgatcgctcagtttattagtgccgaacacagctgcatctttgaattatccgaagatcaaaggcgattcgacttgattcatgaatggtgtggtgaaaatgtcgagccattgatcgatcttgccaaaggttcgcctattgaaagttttccctatttctatactccgatcgtgcgtggcaaccatatacaaatcccttctgtggcagacttgccacctgatacagcagagagaaagctatttgagggcatgtcgtttcagtctgtagctgctgtacccatgcttcattctggtaaagtagttggatttgtcggtacagcgatgattcacttgtgtaaagcttggagtcaagaagatattaatctattgaagttggtaggtgaaataattgcgatcggtcgagccagacatcaagcagaagaagcgctgagaattgccaaagaagcagccgaaactgccaaccaagctaaaagtgctttcctcgctaatatgagccacgaactccgcacgcctctcaatgccatcctgggtttttctcagttaatggaacgagatactagcctcaactcaaaccaacgtgaatctttagctaccattaaccgcagtggcgaacacttactcaatctgattaacgatgtcctagaaatgtccaaaattgaggctggacaaatcattttcacccctgaagatttcgacctttatctgctgttgcaaacattacaagaaatgtttcaggtaaaggcacaaacaaagcaattattcctcaaatttgaaattgctcccaatcttccccgttatatccagacagatgaggggaaactccgccaagttctcattaaccttttggggaacgccgtcaagtttactcaaacaggcggagttactttacgagtcaggttggggagtgaacagggagcaggggagacaggggaggaagaactattaagccctgcccaatgcccaatgcccaatgccccatgccccattcccaatccccaatccccaatccccaatgcccgattccttcactttgaagtcgaagacactggacggggaatagcaccagaagaaatgaataacttgtttcagccttttgtccagacaacaagtggtatccaaaccaaggaaggaactgggctaggactgacaatcagccgccaatttgtgcggttgctgggtggcgatatttacttaacgagtacccctagacaaggttctacttttagctttgacatccaagtaaatttagccgcagcattgaaagtttcaccaaggttgaataagggacgtgtcatcgcgctagcaccaggccagccctcttaccggattctggtagtggatgaccgtaaagaaaaccgtgatttaattgtgcaacttcttggtagcattggttttgaaattgaggctgcgaataatggacaagatgcgatcgcaatgtggcaaacttggcagcctcatcttatttggatggatatgcggatgcctgtaatgaacggctacgatgcaactaaagagattaggatcagggaaagaaatacaaatacaaatcaccgcactgtaattattgccctaactgccagtgcttttgaagaacaacaggcgagtatcttagccgcaggttgcaacgacttggttcgtaagccatttcgtgagcaggtaatttttgaaaagatagctgaatatttgcaggtgcgctatatatgtacagaagaaagcagtgaagatgcaacagacaacaatctaaagaatattcaattttccattttggatcttcgctctgcaattaccattatgcctgcccaatgggtaacagaacttaatcaggcagccgttgaagtcgatgccgaaaggatttttcaactaattgagcaaattccaccaacacattctcctttggcagaaaaattgacaaatttagtccgaagtttctgcttcgatgaaattattgatgtaacggaagaaaattgtaactgagtcaactta

SEQ ID NO: 43525 - DNA, 864 bp, Nostoc punctiforme
atgaacctaacgccagaaagtaaagtactaattcaaggcttttgtgaatttatatcaggcactcatgttgctcaaatgcaagcttatggtacgaatttggtagcaggtgtcaatccgggatgtggcggacaggaactacatggactgccagtatttgacttagtagaggaggtaatagaacaatttggggtaattgacacaacgattatctgtgtagatccttacgacgtgctagatgctgcattagaagcgatcgcatctcatattagccagatcattattatcactgccggcgtgccacctttggatatggtgcaattactccgcaaagccgaagcctgtgaaactttggtaatcgggcctaacagtccggggatcattgtgccgggaaaaattcttttaggcactcaacctagtgagttttatactcctggggtagtgggaatcgttagtcgtagcagtactctcacctacgaagttgcttacgaattaacaaaagcaggtttggggcagtcgattagtgtcagtattggtagtgatgcgatcgttggttcctcctttctccaatggttgcaaattctggatgaggatgaaactacagaggcgatcgttttagtcggtcaaccaggtggtggtagtgaagaagcagcagcccggtatattgctgaggcaattgataaaccagtaattgcctacattgcaggtagacaagcgccaccaggaaaaagttggcggcaaacagggactttagcaacggttatcggacgcgatcctaactttggcacagcccaaagtaaattagctgctttaaaagaagcagaagttccagtagctgaacgcccttctcagattccagaattattg

SEQ ID NO: 43526 - DNA, 1005 bp, Nostoc punctiforme
acctggaatcgtcatcacattctttccctagccgacttcactaccactgaatacgatactgttttgcaaactgctgccagttttcaagaggtgctatcgcggcggacgaagaaagtgccaaccttgcagggacaggtagtggcgaatttattttttgaatcttctacccggactcgcagcagttttgaactcgcggcgaaacgtttaagtgcggatacgctaaattttgccgccgctacatcttcgatgactaagggagaaacaattctcgacacggcgaagacttatttggcaatgggaactgatattatggtagtccgccatcgagaggcaggagtaccaaatgcgatcgcggctgaaatggatcgtttaggtgtacgagttagtgtcctgaatgctggtgatggtcaacatgagcatccttcccaagcactgctagatttatttaccatttgtactctaattgacccagctagtccccgactggaacttttaaaggggaaaaagattgccattgttggagatattcttcattctcgcgtggcgcgatcaaatatttggagtttaatcgccagtggagccgaagtccatctggcagcaccaccaaccctcttacccaaattatttgccgagtacatctctgaagagttaggggtcagaagtcaggagttatcctcccacttccccactccgccactttttctacattggcagctagaaccagctttacaagatgccgactttgtgatgactctgcgcctacaaaaagagcgtatgacagctcatttattgccaagtttgcgagaatatcatcagctatttggcattacacgtacagaattgcaactttgtaaacctaatgttaaagttttgcatccaggccccgttaaccgtggtgttgaaattagttctgaattgatggatgatccagaatttagtcttattcaatcgcaagttactagcggtatcgctgttcgcatggcgctactatatttgttaggtagc

SEQ ID NO: 43527 - DNA, 3225 bp, Nostoc punctiforme
atgaaaacatctaccgaattgctagctcgtctggactattactaccagcaaatcaagacaattatcctggctcggcaaaatccgattactggtttactacctgcgagtacagcgattacagcccacggcgattatacagatgcctgggtgcgagacaatgtttatagtattttggcagtttggggtttagggcttgcataccgcaagattgatgacgataagggacgcacttatgaactagaacacagtgtcatcaaactgatgcgcgggttgttatttgcgatgatgcgacaggctcataaagtagagacatttaaacatactcagtcgctactcgatggactgcacgccaaatataataccgcaaccggtgacattgttgttggtgatgatgaatggggacatttgcaacttgatgccacatctatatttttgctgatattggcgcaaatgaccgcagcaggattgcaaataatttatacgattgatgaagtcaatttcgtccaaaatttggtttactacattggacgagcttaccgcacaccggattacggcatttgggaacgcggtaataaaattaatcgtggtaatgctgagttaaatgccagttccgtaggtatggcaaaagctgctttagaagctatcaacggactggatttgtttggtgtgcgtggtagtcaagcatcggtgattcatgtgctaccagatgaaatcgcccgcgcccggattactttagaatcgctattaccgagggaatctggttccaaagaaattgatgcggcgctgttgagtattattagttatcctgcctttgcagtggaagatttggagttacgcgatcgcactttaaacgatattatcaataaactcgcaggtaaatacggctgcaaacgctttttgcgggatgggcaccagacggttttagaagataatcagcgcttgcactacgaaccgtgggaactcaagcaatttgagcatattgaatgcgaatggccgttatttttcacttatttagttttagatggattattttgcggtgagcaagaacaagtaaaaaaataccaagaacttttagaatcattacttatagaacaagatggtttgcgtttactgccagaactatattatgtctcaggcgaaaacatagaagcagaaaagttagcaccccaaacgcaaccacgtttgcccaatgaaaatgtccctttggtgtgggcgcagagtttatattttctcggtgaaatgttgagtgaagggttactagcggttggtgatatcgatcctttgggaagacatttgtgtgtgggcaaacagcgcgaagcattggtacaaattgccttgttagcagaagatgaagatttacaaactaaactagaagttcacggaatagaagcgcaaacgcctactcaagtagaaccgattcaggtgagaaaagctggagaattctcagctatttatacccaaatcggacgtaacgataaacttggtttaactgggcgaccagttcgacggctgcggagtttgacaacatctagaatctttcggattcgtggtgaaacaattgtatttttgccttcattctcagactctcaacaattttacttaacccttgattaccattttctgttagatcaaattagaagcgaactagcttacatccaaaaatattggagcgatttaggtcgtcctaccttgactttaatgttgacgcacaccatgttagaaagtggttcggaagcattactagaattgatgcaagaactaaaagatggtatttgtaacggtgtgcgagtgaaattagggcggctaaatcagttaatgctgacggctggaatccaaagaattgattttcttcccaatgcagaattctcgcgatcgccagttaaaaatgctagcccacattgctattatttggcttatcatcctgataaaaactggcgcttagggcatactcaagaatttcagatggagtgtgaaaccaatttcggattattactttcttctttgcgtgcttcagagaatatctacgagcaaattgagttattgcaaactttaactcgcttgcagggaatgaaatttgatacagggtatggcggcccaggatatcctgtcaccgtaggcgatttacttgatgaagtttacaccaaagctggagatttaggcatttgggcagtagtgcgtcgggctgctggattacggcaaatggttgatatcagcctatcagatgcagtaacgagtattttggtaaggggtaagcaaattgctgtaggtaaagcttacagtgaagcgtccttgattactgtacccatgtcacacgatgaaattgccgataaaattaatcatttttgtcgtgaagatatccgcgatcgcgtcctaactcaagagattttaatctatcttggtatcttaattcgctcagaaccccaattatttcagggactgctgacgctgagagtcggctatctcatcttattgataaccagcgaactagcgcagaaattggatgtcactcaagatgaagcttacgatcgcttaatgcaactttcaccctttgaagtgaaaatgcgcttgcgtcaggtattaactggatatactggcatgagtaacctgttacgccaacaagaatcactacacgtcaagcaaaaagaaagtgatattgcttgggtggtgttaccaggaatcgccgaaggaatagaagttccaccaggtggttggcggcggtttcgtcaagccgagggtgcgactgggcgcgtaccaaaagactttttcaagcaggtttggctattaatgcaacattgcaagggtctagttattggggataaactagagcgccgcaatcgtttagatagtgagataatgttgtccgagatgacagcaggggaaagaaattttgctctgttagttgagcatttgctgaataaaatcgaagctccagaatatcgccaagttaatattgaagcattaatcgaattagctgcgatcgcagctaataatcccaagctgcaaatcgaagaatatattgtgttagatgtattgattggacacgcagtgcgattggcgtggttagaaaaccatagtcaacgcagcgatcgctatgatgaggataaggcgagtgcatggcgatcgttttacaatacttctcctagagattgcgctagttatattttgaaggcgtttaggttcttgacggaatttgtgaaggatttttaaacgcagaggggcgcgaag

SEQ ID NO: 43528 - DNA, 1179 bp, Nostoc punctiforme
ttagaaagtcgcaaccctgcggacaaaaccgaaatcgttgccacatacccccgttcccaagttaatgatgtagatacagcagtagcctctgcccgtaaagcctaccgcagttggcgcacagtcccggccccagctagggcagaatacatctttcgcgtcggggaaatattactccagcataaagaagaacttgcccagttaatcagtcgggaaatgggtaaacctctgacagaagctaggggcgatgtgcaagaaggtattgactgtgccttttacagtgctggcgaaggacggcgactattcgggcaaactacaccatcggaaatgtctaataaattcgccatgactgtgcgaatgcctatcggagtttgtgcgttaattactccctggaattttcctgtggcaattccttgctggaaagctatgccagctttggtatgtggcaatacagtcatccttaaacctgccgaagatacctccgcctgtgcaactaaattgattgaaattttccaacaagcaggtttgccaccaggagtaattaacttggtgcatggtgtaggagaagaagcggggaaagctttagttgagcatcccaatgtagatttggtatcgtttactggttcttcagaaacgggtgcttttgttggcgctacttgcggacgcactcacaagcgtgtctgtttggaaatgggtggtaaaaatgcccaaatagtgatggaagatgcagatttggaacttgccttagatggtgcagtgtggggtgcttttggaacaactggtcaacggtgtacggctaccagccgcctgattttgcatcgtgatatcaaagaaaaatttaccaccatgctctatgagcgtaccagtaagttgcgcttgggtgctggcaatgataccgacacagatattggcccgattatcaatgaaaagcaacttcaacaggtaagcaagtatttggatatagcccgtgaggaaggagcaaaggttttaattggtggggaaattgccagtgaaggctcattgaaaaacggttacttctttcaaccaactattttggatcgtgtaactcctgatatgcgcgtcgcgcgtgaagagatatttgggccagtagtggcattaattgaggttagttcctttgaggaagcgatcgcaattctcaacgatagcaattatggtctttct

SEQ ID NO: 43529 - DNA, 671 bp, Nostoc punctiforme
ccctgattggtacagctctatccttggctctaaccactaatattgccgtagccgaatccagtaaatcccccatagctcaatccagtagcgaatctactagcgcaccaacggaaatcaagatgtcgccagaaggtatgaaaattctgtgcgagtattttccgcttaactctcgctgtcccggcggcacagcacttacccctggtgcggctcctggtagcactacagcaccagcagaaaccacacctagcactgctcctggtagcactacagtaccagcagaaaccacaccgagtaacatcactcctcccgatagcactacagcaccaggaagcgttaccccacctgatagtggaactcccgaaagcactccagcaccaggaagtgttaccccacctgcacctggcgctcctagtaacttaactccagcaccaggaagcgttaccccacctgaacctggcgctcctagtaacttaactccagcaccaggaagtgttactccaactgaacctagcactcctagcaacttgactccagcaccaggaactactccaactgaacctggcactcctagcaacttaactccagcaccaggaaccgttactccatctgaacctggcgctcctacagaaccaggtgccaactctccaagtactccatctactgctcctgcc

SEQ ID NO: 43530 - DNA, 516 bp, Nostoc punctiforme
atggatttgaagtctctcgttcgtgacattccagattttcccaaacccggaattttatttcgggatattactacattactgcgcgatccagagggattgcgctacactattgactttttaacacaaaaatgcaaagaagctgaaataaagccagattatgtaattggtatagagtcaagaggatttatttttggctcacctctggcttatcaattaggggctggttttattcccattcgcaaaagaggtaagttaccagcagcagttcactcaattgaatacgatctagagtatggtactgactgtctggaagtgcatcaagacgctttacgtcacagtagccgagttttgattgtggacgatttgattgctacgggtggaactgcgagtgcaacagcaaagttagtgcagaaaattggctgcgaattagtaggatttgggtttattatcgagctacgggacttagaagggcgtaaatatttgccggacgtgccgattatctctctaattgaatat

SEQ ID NO: 43531 - DNA, 1401 bp, Nostoc punctiforme
cgggagcaagtggcaagaatgtctagcaagataaaatttggtaccgatggatggcgagggattattgccgatgactttactttccccaatgtgagaaaagtaacaagggcaattgccacttacttggaaacagcctacacaaaaaatagaccagtacttattgcctacgatactcgctttttagctgaccagtttgccaaaactgcggcccaagtactggcagacttgggttggactgtgaaaattaccgttcgggattgccccacaccagtaattgcctacaacgcccgtcacctaaattccgcaggggcgttaatgtttactgctagtcataatccagcaccttactgtggaattaaatatatacccgattatgctgggcctgccactccagagattactgatactattgtggcaaatatagaaagtgcatcggatgagttacctggaagtaacccatcaggttcaatttcaattttcgatccgaaacctgattacctgcaatttatctacactctacttgatatagaaaagatcaaaagggctaatttaaaggtaaagtacgatgctttgtattctacctcccgtggctatttagatgaagttttgcagcatagtggtgttcagttagaaagtttccacgattggagggatgttttatttggcggtggaatgccagaacccaaaggagaacaattagttgagttagtggaagcagtagtccgcgatcaagctgatttgggcttggcaacggatggagatagcgatcgctttggtattgttgatgaacaaggaactgtcctcactccgaatactgtgttgttagttctagcacgtcatttaattaaaaacaaaggtaaaactggcgcgatagtccgcactgtggcgacaacccacctgttggataatttcgctgctaaaaatgggctgcaaatttacgaaacagcagttggttttaaatacatcggtgaaaaaatgcgggaaactgccgtattaattggtggagaagaatcaggcggtttgagtattatcgggcatattcccgaaaaagacggggtattagccgatatgctggtggcagaagcgatcgcttatgaaggtaaacctttaagtcagatggttaaggaagcgatcgctgaagccgatgggccactttacaacaaccgcctagacttgcacctcacagaggctcataaaaccgccgttatcgactcctttactaaaaacccacctacagaggtagtaggaattaaagtcaaggaagtcgggcgtaaagacggtattaagctgtatttagaagaaggtagctgggttttactgcgtccctccggtacagaaccactggtgcgcgtctacctagaaaccaacactcccgaaaaactcacccaaattgcccaagag

SEQ ID NO: 43532 - DNA, 975 bp, Nostoc punctiforme
actattttagtcacaggaggagccggatatattggctcccatgctgcattagctctgaaaaacgcaggttatgaagtaatcgttttggataatctgtcgaacggacatcgagaacttgtagaagaagttttacaggtaaaattgattgttggagatatgagcgatcgctctcttctcgatgacatattttcaactcacaacataactgcggttatgcatttcgctgcttacatcgcagtgggtgaatctgttaccgacccagccaaatattaccaaaataatgttgcaggcactctgacacttttagaagcaatgcttgctgcgtcagttaacaaatttattttttcttctacttgcgctctttatggtgtaccaaagttcgttccccttaccgaagaacatccgcaagatcccattagtccctacgctattagcaagtggatggtagaaagaattttatctgattttgatacagcctataatttaaagtctgtacgtttccgttactttaacgccgcaggtgctgaccctaataggttgttgggtgaagaccacgaacctgaaactcatctcataccgttagtactactaactgcttttgggaagcgtgaatctattttgattttcggtacagattaccctaccccagacggaacttgtatccgcgattatattcatgtgactgacttggcacaagcccatattttaggtttagaatatctactcaaaggtggagaaagcgaagtatttaatctaggaaatggcagtggtttttcagtcagagaagtaatagaaactgctaaagagataacaggcaaagaaattaaaatagaagaacgcgatcgcagaccaggtgaccctcctattttagttggcagcagcgacaaagcaactaaaatcttgggttggcatccagagtatcctaatttaaacgaaattattgcccatgcttggaaatggcatcaacaacgacat

SEQ ID NO: 43533 - DNA, 1518 bp, Nostoc punctiforme
tttacagtttggtcgccgctattagatagcgtcactgtaaaaactttgacaccacaggagcaggttattcccctcaagcctcagtctgagggatactggcacgcgaaagtgaatgatgtgtatccaggcacgctttatcggtatgttttgaatggtcaagacgcttttgccgatcctgcgtcgcagtatcaaccggaaggagtgcatggcccgtctcaaattgtcgatcatcagtttgagtggacagatgaagagtggactggtatccctgtggagtcgatgattttctacgaactgcatgttgggacattcacacctgaaggaactttcaccgccatcatttctcgtctaccggaacttagggaactgggaattaatgcgatagaaatcatgcctattgctcagtttccgggagacacccatattgaagcgtctctggcatatcgcaactggggctatgatggcgtttacccttatgccgttcaaaattcttatggtagcccagccgaactgaagcaactggtaaatgcttgccatcaaaataatatcgctgtggtgttggatgtggtgtataaccactttgggccagaaggcaactatatgagtcagttcgccccctacttcactaaaacctataaaaccccttggggcgaagcgctgaatttcgatgatgcccatagtcagggtgtgcgaaattattttattgaaaatgcgctttactggttgcgcgagttccacattgacgcattgcggcttgatgctattcaagcaatttatgatttgggggcgaagcatttcttgtgggaactggcggaagcagttcatcatttctcacaacaagggcaaaaatggaaacgccatttaattgccgaaagtgacttgaataatccgcaaatcattcgtccagcagaattgggtggatatggtcttgatgcccaatggagcgatgattttcaccattcattgcacgcactcttgacaggcgatcgccaaggatattatcaagattttgggcaaactgctcagttggcaaaagcttatgaagatacttttgtctacgattggaagtacgcaccacaccgcaagcgatttcatggtatatcttgccgcgatcgcaatttatcacagtttgcaatctgcattcagaatcacgatcaaatcggcaatcaaatgaaaggagaacgcctcactcagaggatctcttttgaaggattgaagttagctgctggtgctgtgctgctttcgcctaatttacccctgttatttatgggtgaggaatatggagaaactgcacccttcatttattttgtcagtcactccgatcccgatttaattcaagcagttcgagccggacgcaaacaagaatttgaagcattccactatgcagacgatcccccagatcccgaatcggcagaaactttcctaaagtctaaactcaattggcaattacgtcatgaaggaaatcataaagttctgtgggattggtatcgtcagttaattaatttacgcaagacgcat

SEQ ID NO: 43534 - DNA, 624 bp, Nostoc punctiforme
ttagaaggagtgattttagatgttgatggcacactggtattaagtaatgatgttcatgcaaattcttgggtagaggcatttgcagcttatgggttagaagtgccatttgaaaaagtcagaccacttataggtatgggtggagatcaacttattcccaaagtaacgccaggattaaataatgaagaaggaactggcaaagcgatcgccgagcgacgcaaagaacttatattgaacaaatatacacggcaaattactgctgccaatggtagcagagacttaatattaaagatgcaaaaatcgggattgcatcttgttgttgctagttcagcaagttctcaagaactagatatattacttaaaattgcccaagtagatgatttaatatcggaagtaactacatccgatgatgcggaagcatctaaacctgctcctgacattgtacaagccgccttgaaaaaaggaaaaatggcacccgatcgagtagtgatgctaggagattctccctatgatattgagtctgccggtaaagcaggggtaggcgtgattgctttgcgttgcggtggctttagtgatgaacaactgtctcaagcgctggcaatttataacgatccagaagatttgcta

SEQ ID NO: 43535 - DNA, 2250 bp, Nostoc punctiforme
accacgatcgcccctgaacaggttaatagcatcgtttggaatcagcataacgatccctttgaaatactaggttctcatcccatagaacaagacggcaaaaccgtctgggctgtgcgggcctatctaccaaatgcaagtgcagtatgggtcgttcttcctgaacaacggaaagaatacccaatgcaaacagtgcatcatcctcacttttttgaatgcactattgaaaccgcagaactggcaaactaccagttacgaattaaagaaggggaacatgagcgtgttacttatgacccttacgccttccgttctcccaatttgacagactttgatttgcatttgtttagtgaaggcaaccatcaccgaatatatgaaaaactgggagcgcaccccacggaaataggcggcgttaagggcgtttattttgcagtttgggcacccaacgcccggaatgtttcattgttaggagatttcaacctttgggatgggcgcaaacaccaaatgcgtaaagggccaactggggtttgggaattgtttattcctgaaatcggtatgggagaacattacaaatatgaaatcaaaaattttgaaggacacatttacgaaaaatccgatccctacggtttccagcaagaaccccgcccgaaaacggcatccattgtcactgatttagatgcttacacctggaatgacgaaagctggatggaaaagcggcgacacactgacccccttacccagcctgtctcagtttatgaagtgcatctaggctcttggttacacgcttcgagtgccgaacctgctaaactgccaaatggtgaaactgaaccggtagttgttgtttcagaacttaagccgggcgcacgtttccttacctaccgggaactagctgaccgactcattccttatgtcaaagaattgggatacacccatatagaaatgctgcccattgcggagcatccctttgatggttcttggggttatcaagtaactgggtactatgctcccacctcccgttttggcagtcccgaagatttcatgtattttgttgacaaatgtcaccaaaatgatataggggtaattgtggattgggttcctggtcacttccccaaagatggacatggtttagctttctttgatggtagccacctgtacgaacatgctgacccccgcaagggcgaacacaaaggatggggtactttggtgttcaactacggtcgccatgaagtcagtaatttcttagcagcaaatgccctcttttggttcgacaagtatcacattgatgggattcgtgtcgatgctgttgcctcaatgctttataacgattattgccgcgaaccaggagaatggttgcccaaccagtacggcggcagagaaaacctagaagcagcagattttctgcgtcaggtaaatcacattatctttagttatttccccggtattctctccattgctgaagaatctacttcttggccaatggtatcttggccaacctatacaggcgggctgggctttaacttgaagtggaatatgggctggatgcacgatatgctggattacttcagcatggacccttggttccgccagttccaccaaaacaatatcacctttagtatgtggtacaaccacagcgagaactttatgctggctctgtcccacgatgaagtggtgcatggtaagagcaatatcatcggcaaaatgccgggggatacatggcagaagttagctaatatccgttgtttatttacctatatgtttgctcacccaggcaagaaaactatgtttatgagcatggagtttgggcagtggagtgagtggaatgcttgggctgatttggagtggcatttattgcagcatgaaccacaccaacagttaaaaacctttttccagggtttgaaccatctctaccgttctgaaccagttttgtacacccaggattttgctgaacctgggtttgaatggattgactgtagcgataaccgccatagtgtagtttcattcatccgtcgtgataaggattctgatgattttgcgatcgtagtttgcaattttacaccgcaaccccattctcactaccgcatcggtgtaccgcagaagggattttacactgagttattcaatagtgatgcacgtcaatatggcggtagcaatatgggtaacttaggcggtaagtggactgatgattggtctttgcacagtcgtccctattcgctagatttgtgtttgccacctttgggtgtgttgattctcaagttg

SEQ ID NO: 43536 - DNA, 1401 bp, Nostoc punctiforme
atgagcaaaggtaccctgtttgataaagtttgggacttacacaccgttggtacacttccctctgggctgacgcaactatttattgggcttcacctaattcatgaagtcaccagtccccaggcctttgctatgttacgcgagaggggtctaaaagtactgtttccagagcggactgtcgccacagtcgatcatattgtgccgacagaaaaccaggcacgtccttttgttgatagtttggcagaagagatgattcaggcgctcgaaaataactgccaagaaaataacataactttttacaacatcggttctggtagtcagggtatagttcatgtcatcgctccagaactcggactgactcaaccaggaatgacgatcgcttgtggagatagccacacttcgagtcatggggcatttggtgcgatcgcatttggtatcggtactagccaagtgcgggatgttctcgcttcccaaactctcgccctttccaaactgaaagtccgcaaaattgaagttaacggcaacctgaacccaggagtttacgccaaagatgtcatcctgcatatcatccgcacccttggcgttaaaggtggtgtgggctatggctacgaatttgcaggtacgacatttgaacaaatgaatatggaagagaggatgactgtctgcaatatggcgatcgaaggcggtgctagatgcggctatgtcaatccagatcgagtcacctacgattacctcaaaggcagagattttgcgcccaaaggagcagattgggataaagcagtggcttggtgggattccatcaagagcgatgttgatgcccagtacgatgatgtagtcgtattcgacgctgcggaaatttctcctactgttacctgggggattactcccggtcaaggtatcggtgtcaaccagtcagtgcctcaaccagaagaactgcttgaagaagaccgatttattgccgaagaagcttaccgctacatggatttatatcctggtcaacccattaagggtaccaaaatagatgtctgctttattggtagttgcaccaacggcagaattagtgatttacgggaagcggcgaaaatcgccaaaggccgccatgttgcagagggaatcaaagcctttgttgtccctggttctgaaagggtgaagcaagaggcggaaactgaaggactggataaaatctttcaggaagctggatttgaatggcgtgaaccgggatgttctatgtgcctagctatgaaccccgataagctacaaggaagacaaatcagtgcctcctcgtctaaccgcaactttaaaggaaggcagggttcatcctccggtcgaacattgttaatgagtccggcaatggttgccactgctgcaattaaaggcgaagtctctgatgtgcgcgagttgctg

SEQ ID NO: 43537 - DNA, 951 bp, Nostoc punctiforme
tccccaattgcttgtaatttaccccgtgtcactatcgtaggtgcgggtagggttggtagtactttagctcaacgtgttgcagagaaaaatctggcagatgtagttttactagatattattgcgggaatgcctcaaggtttggcgctggatttgatggaagccaggggaattgaaatacataatcgccagattatcggcacaaataattatgctgatacatctggttctcaaattgtggtgattaccgcaggacttccccgcaaaccagggatgagtcgggatgatttgctgaaaactaatgccaagattgtggtggaagcggcaaaaaatgcgatcgctcattctcccaatgctatttttattgtcgtcaccaatccgttggatgtgatgacttatttagcttggcaagctacaggtttaccacgcgatcgcattatgggtatggctggcgtgttagattctgcccgttttgaagccttcattgccctagaattgggcgttttgcctgccgatgtcaaagcgatggtattgggtagccacggcgatttaatggtgcctttatctcgttatgctaccgtcaacggcattcccatcacggaattgctggatgcagccacaattgaacgcttgatagaaagaacccgcaatggtggcgcagaaattgtggaattgatgcagacgggtggtgctttttttgctccggcatcagctactagcgtgatggtagagtcgattttattaaatcaatcgcggttgttgcctgtggcggcctatctgcaaggtgaatacggtttagaagatgttgtgattggtgttccttgtcggttgggatgcggtggaattgagagtgtattggaattgatactcagcgatgaagaaagagagggcttgcatacttcggctcaatctgtgcgtcaaaatattgagcgatcgcaggaaattttggctaac

SEQ ID NO: 43538 - DNA, 348 bp, Nostoc punctiforme
atgccattaattaaagtgcaaacttctgtatctgctcctcaaaaagctgaaattgaatcaatgcttttaaatctatctgccaagttagcgaaacatttgggaaaaccagaatcttatgtaatgactgcttttgagccagaaattcctatgacctttgcgggaaatacagacccggtttgctacattgagattaagagcattggcacgatgaagccagaccaaaccgcagcaatgagtcaggaattttgccagcagattaaccaaactctaggtgtacctaaaaatcgcatttacatcgagtttgcagacgctaagggggcaatgtggggctggaacggcacaaccttt

SEQ ID NO: 43539 - DNA, 1356 bp, Nostoc punctiforme
atgactcaaaactccctaaacgattccggtactcaatcgtctaaaacgcttgggttgaaaccagcactaacagcagcactagcaagtttagaagtaccgctagatcaagaattagctcgataccgacgcacgcgaaatggtttagtgtcatcaaaccaacgccgtgttgcaagttatattagcagtcaaacccagtctttgagtgccattcctacaacattgggaacaactcagtcatcagtaacggaaattaaaactaacgtgccgcctgctgtacctgtgaatcatcagggaaccccagcgccagttacagaaattgacgtaccaccagcatcttctgtagctgtgaattctgagatgaaccgagcgccagttacggcaaatatcgaagaactaaataatctcaatgtgccctctacccaagattctgctaaaacacaaactcaacttccaccgccaccgccgaattttagtagcagcatcgtgccagcaattgttaaagatactaagagcgaaaatcttttgcagacagataacacccctaagcacccagatgactacttagaatctagtgaagcactactgcgaagtctgacagaagaacaaccagaaacccaaaaaccaagcaattctagtgacagtctgctatcacctttaggtatcggctcaatgttgctgctattgttagcaagtcttaccttgggttatgtagtattcaatcctaaaggtttgcctcaatggaatttagccaatttgtttaacggaaactcgtctcccgcaccaggaaatactgaagaagttgggagtaatgtccagcctcagatccagccaccaagcacatcatctatgtatcccaatctagctgcccaagagtttcctgatgtgagagatcctaacgatctagttggcttacaacctaaagtccaaccaaccgtcgcagtagtgcctaatccaggcgttcgccaaaaccctgtaaatcctcaagcgccattgtctaaccccaatacagccctaaaaccgacaaatccgatcgctttagcgccagtaccaactgtacaacccttacctcccctaaatttacctcccatttcaacggcaaaaacctcaccccagccaatagcagcctcaccaaagcctaatgcagaaatcaaaccaggaacagatgggttctaccatgtcgtgatagataataaaggtgcagcttttgcttcagcacggcaagtaattcctgatgcttatttatcacccaacaaagaattgatttatcttggtgcttttaagactaaagagcaagtacaaaaacaaatgcaattattacaggcaaagggaattaaggcacgagttcagcaaccataa

SEQ ID NO: 43540 - DNA, 552 bp, Nostoc punctiforme
atgctcaaactttacggtggcgctcgtagtcgagcctcaattgttcaatggtatttagaggaaatacaagttccttacgaattcgtcaaactcgatatgcaggcgggtgaacacctcaagcctgaatatttggcaattaacccagttggtaaagttccagcaattattgatggggattttcagctttgggaatctggagcaattttgctgtatcttgctgagaagtacggtaaaaccccaccttcactagaggaacgtgctgtattttcccaatgggtattgtttgccaatgctacccttggaccaggaatttttgtagaagcaagtcgggagcgggaaatgccccgcttgttgactccgttaaatgaaattttcagtaagcaaccttttttgcttggcgatgagttcactgttgctgatgtagcagtgggatctattctgagttacattcccgtcatgctgaagctagacctcagttcttacccatccgtgttgaactatataaagcagttatctgagcgtccagcatttcaaaaaagtattggcggacga

SEQ ID NO: 43541 - DNA, 1230 bp, Nostoc punctiforme
ttgtatttgggtatcgacttcggtacatctggcgcacgcggcgtggtaattgacgaggaagcctattgtattcaggctgaggtgagatatcccttccaagactcaacagccaccattacgccaaaaatttggcaggaggctttgtttgtactgctggaacaaatacctgaccaattgcggcgaaaaattaaagcgatcgcaattaatggtacttcttccaccgtcttactagttgatgctgctggtaatccaacagacgcgccactgatgtataacgatgcgcggggatcattgctgctagagcatttgaggagtatagcaccccctaatcataccgtgttaagtgccacctccagcctagccaaacttttgtggatgaggcaattaccctcttttagtgaagcgagatattttctgcatcaggcagattggctggggtttctcctacatggacagttaggaattagcgattatcataatgctttaaagctgggttatgacgtggaagagttgaaatacccagaatggctagaaaaactgcaaataccgattcagctaccccacgttttaactcctgggactcccattgccgaattgcgtcctgaaattatggataagtttggttttagccgtgattgtcttgtatgtgcaggtacaactgatagtattgcggcttttttagccagtggtgcaaaattacctggtgaagccgtgacttcccttggttcaacattggtactaaagttattaagtcgtacccgtgtagaagatgccagatatggaatttacagccataggctaggtgatttgtggctgactggtggtgcttctaatactggaggtgcagtacttaagcaatttttcaccaacgctgagttagaaagccttagtcgggagattgatgcttcaattgccagggagttagattattatccgttgttgaaggcaggcgatcgttttccaattaacgatcctaatttagccccacgtttggaaccacgcccagataatccagtggaattcttgcatgggttgttagaaggtattacacgcatagaagcacgagggtatgaattattacagcaaatgggagcagacaagttaagtcgtgtttatactgctggcggtggcgcggctaatgatacttggactgcgattagggcgcgttatttacagattcctgtagtagcttcagtgtatacagaagctgcttacggaacggcgctgttg

SEQ ID NO: 43542 - DNA, 534 bp, Nostoc punctiforme
ggaattcttttctatggattacctggatgtggtaaaactctactggcaaatgcttttgctaatgagtctggcagatatttctttaaattctcccctgctgatattgtcagtgtttggataggtcaaagtcaaaaaaatattcgagatatctttgctcaagctaagaaaaaagctccttccgttttatttattgatgagttagacagtattgggtttaatcgtaacgaagacaacgcccatacagaccaaaaagcaactattaatcaattactcatagaactaaataatcttcaaaatagtgacgtaattgtgatagctgctactaattatttgagcggtatagatagtgctttgaaacgttctggtagattggattggaagattcctatctttccaccatctcaagtagaaagaatagaactcttcatacactacctgtcaaaaattgatatgaatcagctagttaactttgaaatgctggcagagaaaagtatgaagtttacgtcatcagatatcgagttagtttgtcgggaa

SEQ ID NO: 43543 - DNA, 885 bp, Nostoc punctiforme
attgtagtccttggggcagggcccgcagggtgttccgcaggttatcacttggctaaaagtgggcataaagtcatgcttatagataaggactgtttccctagagataagacttgtggagatggaatcagccttggatcggttcaagcattatccacaatggggatatatccagacgatattaaacgtttagcctctgagtacgctcaaatcgatggatttctgctcggagtttcaaacgagattagccatctgtgtcccacagagcttaaaggctattgcatacctagatttgtattcgacaatcttctttatcaaaaagcaatcaatgcagggtgtgtagctcgaacgcagagaattagcgatattgaaggctatcaccaagaactttatagtgattttgattacataattgatgcacgtggtgtctatgcaggagaagctaatgcgatcgcaattagagcttactggagtataaaagtggcggattttccaaaaatatatctctcaaaagctcaaatttactttgataaagcttttggggttaatggatatggttggatatttcccgtagcggtagactcagaattggtcaagctcaatgttggtgtgggagtgtggctagatgaatatcaaaagaacaatacaaacattattcggcttttcaatgaatttgtgcagcgtaatcaggctacaaaacaactcttaagcttagtagttagtcagcaaaaacctaaagcctatcccctagctaccgcaaaacgagctaacacagtcagctatggcaaggttttcaaaattggtgatgctgctaatctaacagatcctttgactggtgaaggaatcgcaaatgctattctcagtggcttatatgtgacgcaagcgatt

SEQ ID NO: 43544 - DNA, 945 bp, Nostoc punctiforme
attatgactaaaacagccctagttacaggaataactggtcaagatggctactatctcagccatttgctcctcaaccgtggttatcgagttgtaggattagtacccccgcatcgacaacctaatttgacaaagctgggaacactggcgaatcaggtagaaatttttacggttgacttgagggatagtagggcgctattgacagcagttgagcaactacgtcctcaagaaatttataatttggcggctcccagttttgtacccgactcctggaacgacccattaggaaccctggatttgatcactggtacagctaccagacttttggaagctgtacgacaggttggtttgtctaccagattttatcaagccagcagttcggaaatgtttggcgatgtatttagttcgcctcaagatgaagaaacgccttttcgtcccaaaaatccttatgctgcggccaagatgcacgcccactggacgatggtgcatcacagacagcgctatggattatttgcctgtagtggaattctatataaccatgagtctcctctacgcgcacctcagtttgtaacccgaaaagtttctttagcagccgcatcgattaaattgggtttaactgacaccttagaaatgggtaatttagatgccaaacgtgattggggctttgctggagattacgtagaagctatgtggctgatgttgcaagtcgatgaaccagaagaatatgtgattggcactggtaaactgcacagtgttagagatttagttgccacagcttttgagtctgtcggattggattggacgcgctatatagttttaaataccagtttattgagacaagatgagcattttcaactagtagctgaccccagtaaagctaaaagaaatcttggctgggaaccccaagtgagctttgaagaacttttagaaaaaatggtaaaaacagat

SEQ ID NO: 43545 - DNA, 789 bp, Nostoc punctiforme
attatggatttgcaactccgtggcaaagtcgccttaataactgctgctagtaaaggtttgggcaaagctacagcgaggcaatttgcccgtgaaggtgcaaaagttgccatctgcgcccgtagtgaatcaattgacacaactgctgcggagattgcaagcgaaacaggtacagaagtgctatctctgcgtgcagatgttaccagtcaagcagatattgagcgggtaattaatactacagtggaaagatttggtgggttggatatcctcgttaccaacgccggaggcccacccgcaggtacttttgacgatatcgatttggcaacttgggaaacttcgatcaacttgactttgctaagtgcggtacgtttggtaaagttcgctttacctcatttacgccaatctaccacaccagcgattctgaccatcacctcaacctcaactaaacaaccagtcgaaaatctcgtgttgtccaattccattcgattagcggtgattggtttaactaaaactctcagccaagaactaggtagcgataaaattcgcgtcaacagcattctaccaggatggacatatacagaacgggtggaagaattaatcaatgcgcggattgctaaaagtggtgaaacaaaagaagcagaaattgctagagttagtgcgacagttcctttaggtcgtattgggacaccagaagagtttgccaatgttgctgtctttctaagttcaccagccgcatcctttgtgaatggagtcatgctggaagtagatggcggagctattcagggcacattt

SEQ ID NO: 43546 - DNA, 1440 bp, Nostoc punctiforme
gccctcgttacacctggggggcgatcgctaacttataagcaattgcgcgataatgttgttggactggtatcccaactcaacagctttggattgacacggggagaacgcatagccattgccatgactaatggttcgccaatggctattacctttttggctgctgcgctatgtggcactgctgcacccttaaatcccaaatacaaacaagacgaatttgccttctactacgaagatactcaggcaaatgcactgattaccttgtctggggaaccagaagcagcgatcgccgccgtcacacccaatatgatgctgattaatgccaaggtaaacgctgacggtacattgagctttgaattagtcaaaacaggctcaaaaccaagagaatcatcgaatcccgcagcccccaacgccgatgatttagctatgattctccacactagcggcactaccagccgtccgaaacgtgtgccgattcgtcatcgcaacttaatcgcctcagccaacaacattattactgcttactcactcacagatgctgacactacactttgcctaatgcccctgttccatgttcacggattggtgggttgtttgctgtcaaccctagcatcaggcggcacattaatttgtcccaatggttttaatgccttagagttttggaaactcgtagatacctacaaaccaacctggtactccgcagcgccaaccatgcaccagacaattttggcccgtgctagccgcaacacagaaattgtccaagctaatcgctttcgtttcattcgctctagtagcgcttccttgcccccgattattattgagcaattggaggcaactctcaatgctcctgtggtggaatcttacagcatgactgaagcatcccacttaatgaccaccaatcccttaccgccaaaagagcggaaaccaggtagtgtaggttatggctttggtgtggatgtcggcattatggattctgaaggcaacctcttatctcagggaagcttgggtgaggtggtggtaaaagcacccaatgtcattgatggctacgaaaacaacccagaagccaacgccacagcttttgtcaacggttggttccgcactggagatcagggtactgtggatgcagacggctatctccgcttgactggacgcattaaagaattaattaaccggggtggggaaaaaatttctcccttagaagtggatgatgttttattgcgtcatcccgccgttgctgaagccttggcttttgctgttccccacaaatctttaggtgaagatatccacgctgctgttgttcttaagggagaagtcggcgaaaaagaacttttagcccactgttcaacaatgttggcagacttcaaagttccaaagcaaattcacattttggatcaactacctcgtggtgctacggggaaactgcaacggttggctatggcgaaa

SEQ ID NO: 43547 - DNA, 585 bp, Nostoc punctiforme
ctgcgtttgtacgattttttaccttcaggtaatggttataagatacgtcttttattcacacaactaggtatgccttttgagagggtagagcttaatattttgaaaggcgagactcgaacaccagagtttttaagtaaaaatcctaacggaaagatacctattctagaaattgagccagggcaatacttagcagaatcaaatgccatattggtatatctgagtgaagggacagaatttttgccttatgaccgctttttacgagcgcaagtgctgcaatggttattttttgaacagtatagccatgaacctttcattgctacatcaagattttggatttctattttaggtaaaactgaagaatatagtgaagctatcaaggaaaaacgcgaaccaggttatgcagcacttagcttgatggaaaaacatttaacctctaacactttttttgtaggagagcgttatacgattgctgatattgccttgtttgcttacactcatgtagctgacgaaggtgggttcgatttaacaccattttctgctattcaagcttggataaaaagagtcaaagctcaaccaagatatatc

SEQ ID NO: 43548 - DNA, 2103 bp, Nostoc punctiforme
tctgactgtggagcatcttgcctggtgatgattagtcgctattggggtaaacgctttaatgtcaaccgcatccgagatttaactaacgtcagtcgcagtggagcatcaatgcggggtttgacagccgcagcagaaagtatcggcttttctacccgtccggtgaaagctagcttcgataaactagcccaacaacccctacctgcgatcgctcactgggaaggtaagcactatgttgttgtctatgaagtcaataaaaaacgggtgattattggcgaccccgccatcggtcaacgtacccttaccgctagcgaatttaaagccggttggactggttatgccctgttattgcaacccacagacttactcaaagaaacccaagaagcgactacagcattttggcagttttttgatttagttaaacctcactcgcaagtactgttagaagtgtttctcgcttcggtgttgattcaggtgtttggactagttacacctctatttacccagctactgttagaccgagtaattgtacagggtagtactttaactttaaatgccgttggtttaggcttactaatttttggttttttccgcgttgctctgaatggactgcggcaatatctactagatcacacagccaatcgtctgtcactaacactgctggtaggttttattaagcatacctttcgcttgcccctagctttttttgagtcgcggtacgttggcgatattgtctctcgcgtccaagaaaatcaaaaaattcagcgcttcttaactggagaagcactatctattggtttggatttgatgacagtatttgtctatctggcattgatgttttggtatagctggcaaatggcattgttcagtttagcgatcgtcccgccttttgtattcttggcgctggtcgctacaccttttttgcgccgcattagccgcgaagtttttaatgcttcagctaaagaaaacagttatttgattcaatctctcacgggtattcgctcagttcgctcaatggcaattgagcaaacagtccggtggcattgggaagaactgctgaataatgtcattaaaaagacctttagcggtcaggtaattagtaaccaactacaaatttttagttctagtatcgaatcactagttactacaggattactttggtttggtgcatggcaggtaattcaaaatcaactgactattggacaattaattgccttcaatatgttattaggtaacgtaattcgacctttccaaagactcgttgtcctgtggaatcagttgcaagaggtgatcatttccactgagcgaattaatgatgttttagaagcagagccagaagaagatttacaatttcaaccccgtcagagtttaagtagtttgcgcggtcatattgtatttgaaaatgtgacttttcgttatcatccagaaagtgagattaacgtgttagaaaacctcagttttgaaatcaaacctgagcaaactatagcggttgtagggcgtagtggttctggaaaaacaaccctctccaaactgattttagggctatatctgccgacggatggcaaaattttgattgatggtcaagatgtgactaatatttctctgcgatcgctccgctcccaaattggcgttgtagaccaagatacctttttgtttggcggtacgattcaggagaatatcagtattgctcatccagaagtttcgcaagaagaaattattgaagcggcgcggctagcaggagcagatgagtttattaagctaatgccaatgggctacgaaacccaaattggtgaaggtgggggtatgttatccggtggacaacgccaacgcctagcgatcgctcgtgctttgttaggaaacccctgcttcttgatattcgatgaagcaaccagtcacttagacgctgaatctgagcggattattcagcacaacctgacaaaaattcttcaaggacgcacaagtttaattattgctcatcgtctctctacagtgcgtaatgctgacttaattttggttttagatcggggcattttggtcgaaagcggcactcacgagcaattaatcgctaaaaaaggacattatttttatctcaatcagcaacaacta

SEQ ID NO: 43549 - DNA, 3189 bp, Nostoc punctiforme
atgaccccgactgtctctcaatctcataccaaaatcatctcacaagcaattgagcaactgcgctctttttgccaagttaatcttcagtctagctggctataccaggaatctaacctgattattactgatgttgtcgctgctgatttgtctcattggcaacctgttcagttgaatgctaaagaacatatcgcttggacaggtgggaaaaatgtactatggctagtgcaaaggttggtagtgccccaagatttacagggttatcctttagctgggttatctttgcggctggcgctggtttggtgggcagattctgctgagatttatgtgaatggggagttagtactggagggtgatttatttgattgttcgccgagagtgcttctcagtcagggggtaacaccaggggaagagtttattgtggctttgcggttagtgagtccgggacattgtgatggtgctttagtgcgatcgctcctagtttatgagtctactgttgataataatcccgatccgggttttgtggctgatgaattagctgtggtgcagctttatttggaaaggtttgcgccggagaagttggatgctttggtagaggtggtggaggaggttacgaaccgcagaggcgcagagggcacagagaagggagagttagcaaagtcgtttttgtctctacgtcaaaatttaattcaatccgatatcttagccgagggttggggggatcaaaaatctaaaattttcttattgggtcatgctcacttagatttagcatggctatggcctgtgagtgaaacttggaatgcggcgcaaaacacttttgagtcggttctgaagttgcaagaagatttccctgagctaattttctgtcattcgactcccgcactttacgcttggattgaagaacatcgcccggatttatttcaggcgattcaagcacaggtagctgctggacgttgggaagttgtcggcggaatgtgggtggaaccggaactcaatctaattgctggtgaatcaatagtccgtcagctattgtatggtcaacgatacatccaggaaaagtttggacagttttcaactatggtatgggttccagatacttttggtttctgtgcaactttaccgcagtttttcgctaatgccggaattgagtattttgtcacccaaaagttgcggtggaatgatactactaaatttgattatggggctttttggtggcgatcgcctgacggtagcgaagtctttagtttgatgtctgcacctatcggtgaaaacattgacccagttaaaatggcatcctacgctctggaatggcaatcccaaactggtttatcagaatccttctggcttcctggtgtcggcgaccacggcggcggccccactcgtgatatgttagaaaccgcccaacgttggcaaaagtcgcctttcttcccagatttagaattcacgacggctgaaaagtatttacagcaaattgtagagacgcgatggatcgcgtctgtcagtaattataattcccccccagcctccccagctccccctgccttccccacctgggatgacgaactatacctcgaattccatcgcggttgttacactacccacgcagaccaaaaacgctggaatcgtcgctgtgaaaatttattgtatgaagctgaactatttgctaccttggcaaccataagttgtggtgcgacatatcctaaagcagaaattgaagcagcttggaagcaggttttatttcaacagtttcacgatattttacctggttcttcaattactcaagtttacacagatgcgttaccccagtggcagcaagtggaaaaagtagggatgaagatattacaagaatcacttttagcgatcgcatctcacattaccttatcagaaccaccaaaacccaatagtttacctattttcgttttcaattctctcaattggcagcgttctgaggtagtctctgttgccttacccacatcacaagaatggcagatttacgatacttctggaaagcagcttgtctcccaattatctgaaccatcaaccctactatttctcgccaccgaaattccacccgtaggctaccgcatattttggctttccccctcatccccttcattccccccatctccttcactcctctcagactggattttagaaaatgaattcttgcgagttgttatcgatcctgatactggagatttatcaagtgtttttgataaaacttatcaacgagaacttttgagtggtgcgggaaatcaactacaagcttttaaagatagcggtcaatattgggatgcttggaatatagaccccaattatgcccaacatcccttaccctcaacaaatcttcaatctattcagtggctagaagaagggccagtacaaagtcgtgtgcgcgtggtgcgtcaattgggtgaatcggaattttgccaagactatattttgcaagctggttcacctttactgaagataactactaccgtcaattggcaagaaaatcatgtattggtgaaagctgcttttcctctgaatatcgaagcagactttgctacttatgaaattccctgtggcgcgattcgccggacaactaaaccgcaaacccccgcagaagaggcaaaatgggaagtccccgctttgcgttgggcggatttaacaggagaaacacaggagggtattcacggagttagtttgctaaatgattgtaaatatggttacgatagcaaaccaaatcaactccgcctaacactgctacgcagccctaattggccagactcagaggctgataaaggttttcatgagtttacatataccttgtatcctcatgctggtagctgggaatcagcccatacggtacggcgtggctatgaattgaatataccgttacaagtgatattgaatcctcctaatgaaaaccctcccctttctactggtaaagatgggttgggggtgagtttcctagatttatcagctgaaaatttaatcttgatggccttgaagccatctgaagataacccacagcagttaattctacggtgttatgaatgtcacggagaaacagccgagttatctttgcaaagtaatttagggttaaatctaggagatacagtagatttgttagagcgttcctctactactgaattctcatctaggcaacaaatttaaacaatacagccttggaaaatcggcggtgta

SEQ ID NO: 43550 - DNA, 756 bp, Nostoc punctiforme
cggggaatattagccattgtgcatggactcggagcccacagcgatcgctacagtaatgtaattcagcatttgattcccaaacaatatgctgtctatgccttagacttacgtggtcatggacgctcaccaggtcagcgaggctatatcaacgcttggagtgagtttcgagaagatttgggagcttttttacagttaattcagactcagaatcctggctgcccaatttttcttttgggtcatagcttaggcggggtgattgtcttagattacattctgcgctatccccaacaagcatcagttttgcaaggtgcgatcgctctcgcgccaaccttggggaaagttgggatttcaccgattcgggtgcttttaggaaaaatgctctcacgggtgtggccgcgtttcacattgaatacaggcattgacatcagtgctggttcacgagacccgcaggttttagctgcgatcgctcaggatacactgcgacatacccttggtactgcccgtctagctacagaattctttgcaacagttgattggattaatgctaaagcaggtgattggcaattaccattattgattctccacggtggtgcagaccgagtggctttacctgcgggaagcgacatcttttatcaacggataaattatacagataagctgagaattgagtacccagaagcctatcatgaaattcagcgtgacctcaattatcgagaggtaatggcagatttagagaattggttggagcgacaccta

SEQ ID NO: 43551 - DNA, 528 bp, Nostoc punctiforme
atgtctgccaaagtagttgaaattctctcatccgaagaaatccgtcgtaccctaactcgcctggcctctcaaattgtggaaaggacgcgtgatttgtcccaactggtgcttcttggtatttataccaggggtgcgttattagccgaattgttggcgcgtcagattgagacactggaaggtgtagctgtgtcagttggcgctttggacattacattttatcgagatgacctcgacacaattggattgcggactccaacgaaaagtgaaattccttttgaccttacgggaaaaacggttgtactagtagatgatgtgatttttaaaggacggacaattcgcgctgctttgaacgcagtcaacgattacggtaggccagaggtgattcgtttagctgtgttagtagacaggggtcatcgagaattaccaatccacccagattttattggaaagaagttgcctactgctaaagaagaagttgtgaaagtttacttacaaaattacgatggacgagatgcagtagagttgatt

SEQ ID NO: 43552 - DNA, 1206 bp, Nostoc punctiforme
ggtaataagtttgaggttaattgtgcgctatctttgcgtaagtccctgcatccaggaaacatagtacaacttgatgaaagtcagacattggcaatagctaaagttaagcctcgcctacatattcgtagtggtgggaatgacggtattgtcgtagaaattagcgatcgtctttttcaagaaggtgtagaaattggggacttgatccgggtagatacaaggctacagtttgcttttgaaaaactgccaagctatcaaactggcggcttaactttggaagaagtgccagatgttacttacgaagacatcgggggactagatgatcagacagaagcaattaaggatgcgatcgaactaccctacgtctaccaaaagttgtttgaggaatatcaacttgtccgtcccaaaggaattttattatatggacctcctggctgtggtaaaaccatgattgccaaggcagtagctaatagtttgacgcaaagcatccgcagccatcttcaggaggtagaacaaaaaattattctctatcaagaactcagcaaaaatcctgataatcaggatgctctagttgcttatcaacaactcgccaataattctcgatcgccagaaaccgttgctctgatccaaaacaatatttctccagaggagacacagcagcaattagtagcagatttacgcctgagtaatatcgatttggaagatatcaataactctttagaacgaattcagaatatcctacgacgtgaggatggaatccgcagttttttcttaaatgtcaaaggaccagaacttctcaacaagtatgttggtgaaacagaaaaccgcatccgcaaaatatttgcagaagcaaaacgccgtgctactttctatacgccagtagttatcttttttgatgaaatggaggcaatgtttcgcactaggggttcaggacgttcatctgatgtagaaacaactattgtgcctcaatttttggctgagatggatggagttgaagccacagaaaatatagtgattatcggagctagtaaccgaccagacatgattgatccagctattcaacgacctggacgcttagatattaaaattaagattgatctgccttcgcgtgattcagcaatagcaattttggcgcttcacttaacacctgatttgccactacagccctacggtttaacaaactttaccgattcaacagtttctactgtt

SEQ ID NO: 43553 - DNA, 1497 bp, Nostoc punctiforme
atacgtaaagtctctactactcccttaagcgaccaaaagcccggtacttctgggctgcggaaatcagttaaggtttttcagcagccccactacctggaaaattttatccaatccatcttcgattctgtaggggacttgcactctcaaaccttagtcttgggtggcgatggtcgttattacaatcgccaagctattcaaatcattttgaaaatggctgcggctaatggcattgggcggattaaagttggccaacgaggaattttgtctactcctgcaacttccgcgattattcgcaagtatcaagctattggtggcattatcttgtctgctagccataatccgggcgggccaaatggtgactttggcgtgaaatataacattagcaatggtggcccagcaccggaaaaggtaactgaggcgatttacgatcgcagtaaagtcattgatagctaccaaattctggaagcaccagatgtagatttagaaactttaggtgaatcacatttgggagagacggtagttgaggtaattgactccgtacaggattatcaagagttaatggaatccctatttgattttgaacggattcagcaactgttgacaagaggaaattttcggttcagcattgatgccttacatgcggtagctggcccttatgcccatgccatttttgagcaacgtttgggcgcaccagtgggaactgtgcaaaatggtacacccctggaagactttgggggcggacatcctgacccaaatctagtttatgctcatgatttggtggatattttgtatggagagaatgcgccagattttggggcagcttttgatggagatggcgatcgcaatatgatcttagggcgtaagttctttgtcacccctagcgatagtcttgcagtgttagccgcaaacgccaagctagtccctggttatagtgaaggtttagccggggtagcgcgatcgatgcctactagccaagcagtagatcgagttgctgctcagattgggattgaatcttacgaaacacccactggttggaagtttttcggcaatctcttagacgcgggtaaagcaactctgtgcggtgaagaaagttttggcaccggttctaaccatatccgcgaaaaagatgggctatgggctgtgctgttttggctgaatatcctagcagtccggcaacaatctgttgagcaaattgtacgggaacactggcagacttatggacgcaattattactcccgccatgactatgaagagatacagacagagcaaggcaacactttaatagaaagactgcgttctttattgccaaaccttaaaggtaagcaattcggtaactatcaagttgaatacagtgatgactttagttataccgaccctgttgatggtagcattagcgagcaacaaggtgttcgcattggctttaccgatggctcccgcattgtagtgcgactttctggtacgggaactcaaggtgcaaccctaaggcatcatgtaaaa

SEQ ID NO: 43554 - DNA, 1008 bp, Nostoc punctiforme
gtgattagagttgcaatcaacggtttcgggcggattggacgtaactttgcgcgttgctgggtgggtagagagaatagtcaaatcgatcttgtcgctattaatgacacatcagatcctagaaccaatgctcacctgctgaagtatgactcgatgctaggcaagatcaaaggtgctgagattagtgccgatgataactctatcatcgttaacggtaagaccattaagtgcgtatccgatcgcaacccagaaaagttgccctggagagattggggaattgacctaattatcgaagcaacaggcgtatttactagcaaagaaggagcgctaaagcatgtgaatgctggagccaagaaagttctgattaccgctcctggtaaaaacgaggatggcacttttgtggttggtgtgaatcatcatgattatgaccacaacatacacaacattatcagtaacgctagctgtactaccaactgcttggcaccaattgccaaggtattgaacgataagttcggcatcatcaaaggtacgatgaccaccacccacagctatacaggcgaccagcgtttgctagacgcttctcaccgggatttgcgacgggcgagggccgcagcgataaacattgtacccacctccactggtgcagcgaaagcagtggcgctggttatcccagacctgaaaggcaagcttaatggcgttgccttgcgtgtaccaaccccgaacgtctcaatggtagatttcgtagttcaggttgagaagcgtactattactgaagaagttaaccaagctctcaaagatgctgctgagggcccacttaaaggcattttggactatagcgaactagaattggtatcttccgattatcaaggtagtgatgcttcttcgattgtcgattccagcttgactttggttatgggcaatgacttagtaaaagttatggcgtggtatgacaacgagtggggttacagccaacgagttttggatttggcagaattggtagctgagaagtgg

SEQ ID NO: 43555 - DNA, 2320 bp, Nostoc punctiforme
gtgttgggatacagccctgtggacagaattttctaacccacaaattcaggaattttggcaagtcttaccagtggatatggagggagaaagagagacattttccttctcttccaatccttcagtaacagtctcagatgggacttccagccctcacagcctccaaccccaaaaacgactcccagccgcgaatttaatcatctcaaattatccatttgttgctagctggaacactgctgctgcttgtttaacaatggtggcgcaacagctagaaaactctgtgcagctggaatgggtgcaacgtcaactcagaggacaacgcccaaaacaggttgtggaagcaggagaaaagttagggttagtgatgcggcggttacaagtgagttggggtgagttgcgacaactgtcatttccagctttactgttgtggaattctgactcaccccagagtccatcctgggtggtagcttatggagttaagggtgatcgcttaattatcgctaaccctctaaatcccgatcgcatttgtgaaagcttaccacagtccatagttgaggcatcgtgggatggacgattgtggcaagtagaactcatatctaaacaagaaacatttaaccttagttggttcaccccagcagtttggaagtataagggattactaacagaagtattattagcatcttttaccttgcagcttttggggttaacaacaccactaattacgcaagtagttattgataaagtaatggtgcaggggagtttgccgactcttgatgttatggcgatcgcacttctttgtgtagccatatttgagtccgtacttggcattctgcgcctattcatctttacccatacagcccgtcgtctggatttaagtttatcagcacagttatttcgccatctgatgcgtctgcctttggcttattttgagtcgcggcgcgttggagacacagtagcacgagtccaggaactcgaacaaattcgtcagttcctcacaggtacagcattaactgtgattctagatagcatctttgctgtggtgtacctagcattgatgttttactacaacgtcccactcacctttgtggctttagcagtactgccgctatttgcgactttgacgatagttgcaacaccaattctgcgtaactggctcaacgaaacttttaaccggagtgccgatagtcaatcctttttagtagagacaatcacggggattcattccgttaaagcccatgcagcagaaccagtagcccgcgatcgctgggaaggcttatttgctcgcttcatccgcacaggttttaaagcctctaccacctccaatatcagcagcaacattggtgactttctcactaatttttccaccatgctgattctctggtttggagccaaattagtcatcgaacaaaagctcacaatcggacagctagttgcctttcaaatgctatctggcagagtcacgggcccacttttgcgcttagtacagttatggcagaccctccaacaagtgctactttctgtagatcgcattggtgatattctcaacgtctccccagaagctgaactgggaacggggctagttttaccaccactgaaaggacaagtcaccttcgagcaagtatttttccgctaccgtcccaactttgaagcaattctgaggggaatctctttcaatgctgaaccagggcaatttgttggcattgtcggacgtagcggttctgggaaaagtaccctatctaagctattgcaacgtctctatcagattgaatcaggacgcattcttattgatggttttgatataaaaagcgccgatttagcctcactgcggcaacaagttagtgtagttctccaagaagactttttattcaacggttccattttggaaaatatcactctcggtactcccgacattaccgcagagcaagtggtagaggcggcaagactagcagtagcacacgacttcatcagtcaattaccctacggttacgaaaccaatgtgggtgaacgcggtacagctttatctggcggacaaagacaacgtattgccctcgcaagattatttctttcccaagcgccgattttagttttagatgaagctaccagcgctttggatagtgaaaccgaacaacaagtactacaaaacctgcaaaaagtttccgctaaccgtaccgtgtttctgattgctcaccgctttgcccctctcaaacgcgctgatttgattttggtattagaacaaggcgtgattgccgaacgtgggactcactcagagttattgcaacaaaagggtttgtattggtcactatatcaacgccagcaagcaaac

SEQ ID NO: 43556 - DNA, 3465 bp, Nostoc punctiforme
tatagagaagaagcaagagtagaacctgttgattctaccgacgctgctgatgaatatctcccttgtccttatcgggggttgtttcattttggccccaatgatgcggatgttttctgtgggcgggaaatatttatcgaagaactttatagtgcaactaaaaccaataattttattccggtgctaggtgcatcaggaagcggtaaatcttcggtggtattagcgggattagtccctaagttacaaacagcaggtcattggcagtttactcactttcgtcctggttctgaccctttccatgctctagctttagctcttgttcctctttatacacctaatttagatcaaacagaccaaattgcccaagcccgaaagatggctggttacttgcaagatggttctgttattctcttagatgtttttgctaaaattcagcaaaatcaccctaatcatcgggtactactgattgctgaccaatttgaagaaatttacacactctgtaacaatcaagaaattcgccgtaagtttctcgactgcttattagccagtttagtaactcctacttccctgacttcatcagctacggtgttagtgacaacgatgcgggcagattttttgggaaatgctctctcctatcgtccctttgctgatgtcttgcaaaatgctgacgtgaaactggggccgatgaatcgggaggaactaacagaagtcattggaaaacctgcccaaaaatttggggtgacatttgcagacggactggtagaacgcattctggatgatgtggaaaaccaaccgggaaatttacctttgctagagtttgctttaacagagttgtggaataagcgaacaggtaaacaattaactcacaaaatctatgaagaaattggtcaagtagaaggtgcgttagctcgtcatgcggatgagaaatatggcaacttgacagatgatgagaaggaaaaagtgcggcggatttttattcaattggtgcgtccgggtgagggagcagaagatacaagacgcatagcgatgaaagcgcaattgggggaacaaagctggtctttggtaaaaaaattagctgatgctcggttggtggtgacaagtcgcaatcttagcagtcaagaaacagtagaagtagtccatgaagctctgattcgcaattggggagaactgcgacaatggatgaatacaaaccgcgtttttagagcttggcaagagcgattgcgagcagcaaagggacaatgggaagcaacaaataaagattcggggtcattgttgcggggtgcagcattagcagaagcagaagaaaaactgaaggaacgcccagaagacttaattgatgaacaagaatttatcgagcagagtattaaagaaggaaatcgccttaaacaagttgaagcagcccgcagaaagcgcgaaatcagaaccgcctgggcaattgcggcaggttcagtggtggcggtggtaattagcagtggattgggtttgacggcatggaatcagacgaagcaggcacaactcaatcaagctgaatctctgagtagatattccttatctctaattaatgaacataaagacttagaagctttcgtcacagcaataaaagcaggaaaaatcctgcaaagccaacacacaactaaactagaaactttcaatgctttgcagacagttctggttcagggaagagaacgaaaccgcttagaagggcatcaaagcgcagtcaatagtgtgagtttcagcccggacggcaaaaccatcgccacggcatcacaagacaagacagcgcggttgtggaacctgcaagggcaactgctgcaagaattcaaagggtatcaaggcacagtcttaagtgtgagtttcagcccggatggcaaaaccatcgccacggcatcatctgacaagacagcgcggttgtggaacctgcaaggtaaactgctgcaagaattcagagggcatcgcagtggtagaggtatgagtttcagcccggacggcaaaaccatcgccacggcatcagaagacgggacaacgcggttgtggaacctgcaagggcaactgctgcaagaattcaaagggcatcaaggcagtgacgaaggtgtgagtttcagcccggacggcaaaaccatcgccacggcatcacaagacaagacagcgcggttgtggaacctgcaagggcaactgctgcaagaattcaaagggcatcaaggcgaagtctcaagtgtgagtttcagcccggacggcaaaaccatcgccacggcatcatctgacaagacagcgcggttgtggaacctgcaagggcaactgctgcaagaattcaaagggcatcaacgcggtgtcaatagtgtgagtttcagcctggacggcaaaaccatcgctacggcatcatctgacaagacagcgcggttgtggaacctgcaagggcaactgctgcaagaattcaaagggcatcaaggcctagtcttaagtgtgagtttcagcccggacggcaaaaccatcgctacgtcatcagatgacaagacagcgcggttgtggaacctgcaaaggcaactgctgcaagaattcaaagggcatcaaggcgaagtctcaagtgtgagtttcagcccggacggcaaaaccatcgccacggcatcagaagacgggacagcgcagttgtggaacctgcaagggcaactgctgcaagaattcaaagggcatcgcagtggtagaggtgtgagtttcagcccggacggcaaaaccatcgccacggcatcagctgacaggacagcgcagttgtggaacctgcaagggcaactgctgcaagagttcaaagggcatcaaaacgtagtctcaagtgtgagtttcagcccggacggcaaaactatcgccacggcatcctgggactgcacagcgcggttgtggaacctgcaagggcaactgctgcaagaattcaaagggcatcaaggcgcagtcaatagtgtgagtttcagcccggacggcaaaaccatcgccacggcatcagttgacgagacagcgcggttgtggaacctgcaagggcaactgctgcaagaattcaaagggcatcaaagcggtgtcaatagtgcgaagttcagcgcagtcaatagtgtgagtttcagcccggacggcaaaaccatcgccacggcatcatctgacaacacagcgcagttgtggaacttgcaagggcaactgctgcaagaattcaaagggcatcaaggcctagtcttaagtgtgagtttcagcccggacggcaaaaccatcgccacggcatcatctgacaacacagcgcggttgtggaacctgcaagggcaactgttgcaagaattcaaagggcatcaacgcggtgtcaatagtgtgagtttcagcccggatggcaaaaccatcgccacggcatcttatgacaagactattaaactctgggatctagatttacaccctttaatgaggcgcagttgtgattcggtacgcgattatttaacc

SEQ ID NO: 43557 - DNA, 840 bp, Nostoc punctiforme
atgagaaaattttttaatttctgcttcgaagttgaattttatctaaagattgctattacttgcaccattgttcagcaaatattttattggttgttgcacaatatagaactcaattttataactcaagtgctgttatactggcttgttggttctatttcattttatagcattggtcttttcatcgaaaaggtaattaaaaacaatgataatttgagagagaaactaactgccagagttaagaaagtcaaaacacaaccatttccttcctttactgcgaaaggtatcattactggagaaatcaaaagtttcatagcagctttaattattctctacttagcgccagaggtaaatagaggaaatagtttgctctcaaaccttggatggtttttgatgagaataattgttgctgatttctgtttttacgtttctcattcgctacttcacagaaaatttttacaaaaaatacatttaaaacatcatgagtttgccgactcatcaagttttgttgctggacataagagtttgactgaatatattattgttactattacagaccttttgcctatctttatatttgggtatgacatcacccaactatgtgcttggactattataggtaatgcttacaaccttgaaggtcatagttctttatcaatattttttgttccatcagattttcacgatcttcaccacagttgtttcaagagaaactatggaattcaaggattttgggacaggttattcaacacactaaaccctcctacaaagaagccaggaattatgttccctgtagcttatttggagcatatcaccatgaagttatctaatcctttaaattga

SEQ ID NO: 43558 - DNA, 1050 bp, Nostoc punctiforme
aagcccgacggacgcaaactaaagttatacagtcgctacccaattactagtcagttagaagccactagccctagtaatgagccagtgcaagctaatccccacttgcgctggcaccccttgcggggtgaatgggtagcttatgcgagtcaccgtcaagggcggacattcatgccgcccccagaatataatcccctcgcacctaccaccaaccctgagttcccaacagaactaccccaaggtaagtatgacgtggcagtgtttgataaccgctttccctcaatgactcccacagccaacaatccacctgataccatcgtggaaacgttaccagctaatggagcctgtgaggtagtggtttttacgcaagatgcccgcgcctccttgagttccttagagttggatcatctagatttgttgttggaagtctggggcgatcgcacccgcgaactaggactaaatccgcaaattcagtatgtgctgccctttgaaaataaaggggtagaggtgggtgtaacattgcaccatccccacgggcaaatttacgcctatccttttataccgcctgttccggcgcggatgctgtcaatgcagcaggagtattatgaaaaacatcggcggggtttactgcaagacttgattcagaaggaaattgcagacaatcgacggattatttatcaagatgagtatgcgatcgcatttgtccccgtatgcgctcgttacccctatgaagtctggattgcaccgaaagagccagttagcactttcatggatcttaccccagaacaacgttggggacttgccaaagcgttaaaaactgtcactctcaagtatgacggtttgtggaatcgcccgtttccttacttgatggcttggttccaagcacccacggatggtttagcccatccagaagcgcatttacacgccgagttttttccaccatatcggacaagcgaaaggctgaagtatctggcgggaaccgaacttgcagccgggatgtttgccaatgatgctttaccagaagaaaaagcaaaggaactacaagctgtggtg

SEQ ID NO: 43559 - DNA, 1550 bp, Nostoc punctiforme
cacccacggccattgttaaagcgatcgcgctggcaatctttaaatgggctgtggaaattttcatttgatgaccagggaaaatgtgtcgaacccagcgattttagtcaatggtctaattatatagaagttccttatgcgcccgaatctaccaaaagtgggattaacgatcgcgggtttcatccaaactgctggtatgagcgagaatttgaaacaccaccaggggacggcagattactgttacactttggcgctgtggactatcgcgctcgtgtgtgggtaaacgataaatacatagccgagcatgaaggcggacacacctctttcactctcgatattacccatgccttaaatgacagtggtactacaaaggtaacagtgtgggcgcaagacgatccgcacgacctcgccaaacctcgtggtaaacaagattggcacttgaaaccccatagtatttggtatcctcgcacaagtggtatttggcaaacagtttggctggaacgtgtaggtgagacttatatcggtaatcttcgttggattcccgactgcgaacggtgggaaattgggtttgaagctgggctggctggtaatttacttacttcgggtgtacaaattaaaattaaactcagcgctggcggtcgggtgttagcaagcgatacctatgaaatattcaatggagaaattacccgccgcattgttctgagcgatccgggtattgacgattgccgtaatgaattactgtggagtccagaaaagccgacgctgatagatgctcaaattcagctatgggataaagattgtcttttagatgaagtgcaatcttatacagcgatgcggactgtgagcattcagcgcgatcgctttatgctcaacggtcgcccctactatctgcggctagttctcgaccaaggctattggcctgagacattaatgactccacccagtgacgaagcattacgacatgatgtagaactcgtcaaagctatgggttttaacggagtacgcaaacaccaaaaaattgaagacccccgctttttatattgggcagacgttttagggttgttagtatgggaggagatgcccagcgcttaccgcttcacaccgaaagctgtggaacggatgacccatgaatggacggaaatcatcaagcgagatgtcagccatccttgtattgtggcgtgggtgccgtttaatgaatcttggggtgtgccaaatttggttgaaacggcggctcatcgtaactacgtgttagctatgtatcatctgactaaaactctcgatccaactcgcccagtaattggtaacgatggttgggaaagtacagatactgacatcctcgctattcacgactatgaacgccagcctgagcgattagcccatcgctacagagcggatattcaaatatcggatttatttgagcgtagccgtcctggggggcgtatcctcaccctggataactatccccatcagggacaaccagtgatgttgaccgagtttggtggcatcgcttatgcccccattgaccaacctaatgccgatcaagcttggggata

SEQ ID NO: 43560 - DNA, 854 bp, Nostoc punctiforme
atttccctgaaacctctccgaaaccaagttgttgtcattacaggtgcctctagtggcattggcttagtaaccgctagaatggcggcaaaacagggtgcaaagcttgtcctggcagcacgaaatgaagatgctctccgtcaactggttgatgaaattcgcgccaaaggtggacaggcgatttatgtcgtagctgatgtcgggcaagaagaagatgtgaatcgcatcgccgaaagagcgatcgctgaatttggcggttttgatacgtgggttaacaatgcaggcgtatcgatctttggtcgctgtatggatgtttcaatccccgacatgaagcggatgtttgacacgaacttttggggcgttgtgtatggctcccgcgctgctgttaaccactttaaacaacgcaaaagcggcagtggggcgttaatcaatgttggcagctttctgggcgatcgagcagtggcggttcagtcaacctattccgcttcaaaacatgcgctgcatggttggacagatgccttacgaacagaattagaggctgaaggcgctcctgtatcagtaacattgattcaccccggacggattgacactccatacaacgaacatgcccgcagctacatgccaaaacaacccgcacatcgcggcatgatctacccacctgaagcggtcactgaagcaattttgtatgccgctgaacatccgaaacgagatatgtttgtcggttttcaagccaaggctctggcagtattggctggcatctcaccacgtctcacagacaagttgatagagctttgggcgtttccctcgcaacagtccgatcgcccctcgcgcgatcgagaagacagtgcgctctatcg

SEQ ID NO: 43561 - DNA, 855 bp, Nostoc punctiforme
ttacaagaacaacaaccaaagccgccgtttcctgaacaacagcaagaagtgccaggactagagtcacagatgaacccgaagccagattatggcgaaaattcttatcgcggttctggaaaactgcaaggtaaagcggctattatcacaggtggcgattctggcatcgggcgggcagtcgcgcttgccttcgcccgcgaaggtgctgatgtgctaattgcttatttaaacgaagaaccggatgcagaggaaaccgttcgcatcgtcgaaaaagagggacgtaagtgcgtcgctattgcaggcgatatccagcaagaagcgcaatgtcaacagatcgttgagcgggcgcaaagtgagttcggcaaaatcgatatcctcgttaataatgccgctttccagatgacgcgagaaagcctcgatgagatttcgtcagaggagttcgatcgcaccttcaaaaccaacatctacgcgatgttctacctgtgcaaagccgcagtgccacacatgcagccaggtagcgccatcatcaatactgcttccatcaatgcagctgaaccaaagccgaagctactggcgtattcggcaaccaaggcagcgatcgtaaactttactggtgggttggcgcagttactggccgaaaagggcatccgggtgaacgctgtcgcgccgggtcctgtgtggacaccgttaatcccggcgacgatgccaaacgaacaggtgacacagttcgggcagcagtacccaatgaagcgccccgcacagccagccgaacttgcaccggtatacgtgctgctagcttcttccgaagccagttacgtttcaggcgcggtgattcccgttactggcggtcagcccgtt

SEQ ID NO: 43562 - DNA, 813 bp, Nostoc punctiforme
tataacttgaacggtaaaactgtactgattacaggtggctcgcgggggctagggctagttatggcacgccagttgattcaagcaggagcgcgtttggcgatttgtgcccgcgatccagaagaattggagcgatcgcgtattgaactagaacaacgaggtggagaggttctggctgtaccttgtgatgtgactgacaaaactcaggttgagcagatggtacaacaggtacgcgatcgcttcggcgcgatcgacatcttaatcaacaacgctggcgttgattttgtcggtccaatggatctgatgacggtggaggactacgacgatgcgatgaagttgcatttttgggcaccgctttacgccagctatgcagttttgccccaaatgcgcgaacgacatcaagggcggatagttaacatttcctcaattggtggtaaggtcgttttcccccacatgctgccatactgtgctagcaagtttgccttaactggattatcagaaggaatgcgggcagaattggctcaggagggaattagtgttacaaccgtatgtcctggtttaatccgcacaggcgctcctgaaaatgtcatatttaaaggtcagcaccgtaaggaatatgcctggttcagtattagtgattctttgcccttgctctcaatgagtgctgaagttgtagcttacaaaactattgctgccttaaagcgaggtgacgcagaaataattctgtcccttccggctcagattgctaccagatttcatggactgtttccagggctaaatactaatttgcttacttgggtaaattggttactacct

SEQ ID NO: 43563 - DNA, 972 bp, Nostoc punctiforme
caggaaaatgatgacaatttatcggaagcatccaagctactacggcaaggaattcaacagcagcaagctggtgaattaattgcggcgctgaagtctttacaacaagctttggggctatttcaggcagttggggatttgcaaaaacaggcacaggcgctttcttttttaggattggtaacttatagcgctggagactataaaggcgcgatatcttactcggaggagtgtttgtctttgctcaataacacctcaaatttagcattgcaaatgcaagcactttcccatttaggaaattcataccgtcatttgaatgaccacaacaaggctattgagtttctagaaaagtgtttgaaaataacgcaacagctgcaagacaaacggagtcaagttgcagcattgaataatttgggattggtatataaatctttgagtaactttacacaggctattgagtatcagcagcaaagcctagagattgtgcgagaactcaaagataactggggcgaagaacaggtactcaaaaatttgggtaatgcttggtatgctttgaataattattcaaaagcgatcgcatattatgagcagtgtgtagtactagcacgctctttaaaaaatgttcgcagtgcttctcaagtactaaaaaatctaggtaatgcttgttatgctttaggtgattatgctaaagctattaagtattatgaagatcggttgctattagctagagaaattcaggacaaacgtagcgaggaacaatctttaggtagtttaggagttgcttgtgaagctctgggtgactataacaaagcaattacatattatgaacaacgtttgctcttagctaggaatatcaaagaccgtcgtagtgaagaagaagctctcgatcgtttgagagtcgcttgctacgccttgggtgattatgtcaaagctatgcaataccagcaaggaacatcttcaaatagttaaaaagcaaaa

SEQ ID NO: 43564 - DNA, 549 bp, Nostoc punctiforme
gcaattaatgattacactcaggctattagaattaatcctaatgttgccgtagcttataaaaaccgggctgaagctcgttctcatataggagataatcaaggagcaattgaggattatacccaggcaattaaaattaatccccattatgctgatgcttataaaaaccgtgggattgctcgttatttattaagttctcagccaggatttcctcaagcaatcaagattaatccaaaagatgccatagcttataaaaagcgtggtaatgctcgttctgatttaggagattttgaaggagcaattgaagattatacacaggcaatacagattaatcctaattatgccgatgcctattataaccgtgataatgctcattctgacttaggagattttgagagagcgattgaagattatactcaagcaatacaaattaattataattatgccgatgcttattacaatcgtggcaatattcgtttagaaatagccgataaacagggagcgattgaagattttcataaagcagcagacatctatcgtaaagaaggtaag

SEQ ID NO: 43565 - DNA, 1848 bp, Nostoc punctiforme
atggcaattaaagaacaacctaaatcacctcgttttcggatcgttgctaatatattactggctgtatcagggctattcctgctcttaaatttatttttgcctggtttatttgcttctggccctactggtgttccttacagcctatttattcatcaagtacaagaaggggaagtcaaccgcgtttctgttggtcaaaaccagattctctacgaactaaaaacagaaaatggcgagccgggtccggtgtttgcaactacaccaatctttgatttagagttacccaaactgctagaagaaaagggagttgaattcgctgctacacctccacccaaaaatacttggtttacaaccctcttaagttgggtgattccaccactgatttttattgggatttggcagttctttctcgcccgtggtggcggcggtggtcctcaaggtgcgctttctattggtaagagcaaagctaaggtttatgttgaaggcgaatcagctaaaatcacctttgcagatgtggctggggtagaagaagcaaaaactgagttagtggaaattgtggatttcctcaaaactccggcacgctttacgcaaattggcgcaagaattcctaaaggtgtgttgttagttggccctccgggtactgggaagacacttttagcgaaagccgtagcaggagaagctggagttccattcttcagtatctctggttccgagtttgtggaattgttcgtcggcgtgggttcttccagagtgcgggatttgtttgagcaggcgaagaaacaggctccttgtattatattcattgatgaattagatgcgatcggtaagtctcgtagcagtaacggcttctacggtggtaacgatgagcgagaacagaccctcaaccagttactaacggagatggacgggtttgcggctggtgatgcaacggtgattgtcctagcagctaccaaccgccccgaaagccttgattctgcattgctgcgtccaggtcgctttgaccgccaagtgttggtagaccgtcctgatttatctggtcgggaagcaattctcaagattcacgctcaaaaggtaaaattaggaaatgatgtagatttaaaagcgatcgctactcgtacccctggttttgctggtgcagatttggcaaacttggtaaatgaagcggcattattggcagctcgcaatctgcgtgaaagtgttgctcaagaagacttcgctgaagcaattgagcgagtagtcgccggcttagagaaaaagagtcgcgtgatgaacgagactgagaaaaagattgttgcataccatgaagttggtcatgcaatggtcggggcgctaaccacaggaaacggacgcgtagaaaagatttcgattattcctcgtgggatggctgctttgggctacactctgcaattaccaactgaagacagatttttgatgaatgaagatgaattgcggggtcaaattgcaactttattaggtggacgttccgccgaagagattgtgtttaacagtattacaacaggtgcttccaacgatttgcaacgagcaactgacttggcagaacggatggtaacatcttatggtatgagcaaagtcttagggccattagcttaccaacaaggacaacaatcgatgtttttgggtaatggtggggctaatccccgacgggcggtgagtgaagacacatccaaagccattgatagcgaagtcaaggaaatcgtggaaacagcccacgaacaagccctagagattctcagacagaatcgagacttgctagaagcgatcgctactcaactgttagaaacagaagtcattgaaggcgaaaaactgcacgatttgttgagtcaggttaaa

SEQ ID NO: 43566 - DNA, 1314 bp, Nostoc punctiforme
ctctactacttagcaaaagcgcaagaacatattggggaagtggaagaggctttgtataactatcaagaggcactaaaactttgttcggatgaatatgaaactgaaaaagctgcaattttacatgatttagcggatttatacgttaagcagggtaactatcagcaagccctgacgatatgccagcaggttatgaaaattgatgagaaagataataataagctcggtaaagctaagtcccttagtcaaatagcagatattaagagagaattaggtgaacccgaagaagcacttaaattgtatatggaagtactagaacttactcaagaaacaggggataaaaattttctatatactgtacaaaataacattgccactcttcaagttgatcttggtcaaactgatgcttgggataacctattaccaagtttagtttcacatagaacgcagtccgaaaaccttgaggataaaattccactcctcagcaatacagcatcgctgaggcttaaacaaggtgaaatagaagaggcaagagagattttagaacagttgaacaaattactgcctcaaattgataactcttggctcaaggcaatgcttttacataatctagctactttccgctcagaatgtggtgatcgtgagcttgctttagagctttacaatcaagctcttgaactgcacagaaagaatggcgatcaaccgcgtgaagcaatgacacttcaggagataggaattctctatgagcgtcaaaataatgtcagtgaagctttaaagtttctcgaagattcttaccagttgtcattgaagattggaaataaagacactcaagcccatgttttaccacgaatcgcatcgatactgattgatcaagataatttagatgaggccgaagagaaattaaatacagctttagcaatactaaatcaatttaacaatccaaaacatcatgcgctcgctcttagagaaatgggacggcttaaaataaaacaagaaaattataatacaggagcagattttttaggggaagctttagagaaatgtagttcagttgttgatgttgttcttcgagctactattctcaagcttttaggagaggttttatcctttcttggtgaagtagatgttgcatttgagcatttaacagaatccctcaatatttaccaaaaattaaattggactaatgatgtcgaaaaagttagagggctaattaagaatactcaactaataaagcctatgcggttgtatcaatcagcagcaaccgaagcagaaaaaggtaatgcaagagcggcacttgatttacttgagcaagcccta

SEQ ID NO: 43567 - DNA, 2262 bp, Nostoc punctiforme
actctcacactcaaacttcgaggtatgagttgcgctggttgcgccaacaacatcgaaaaggcaattcgctctgtttctggggtgattgactgtaacgttaactttggagcagaacaagcggccattcggtacgatcgctctctagcaagtttagagaaaattcaaactgcgatcgcagctgcgggatactcttctgactcactccagtcagaattgctctctgaagaagatgatacagagattgcgagtaggcaagcattacaacgcgaacttttcctcaaggtaattgtgggaggtgtaatcagcattttcctctttttggggtcgttgcccatgatgactgggctaaacttccccttaattcccagctttttgcaaaatccttgggtacagttagcgctgacaacacctgtcattttctggtgtggtggatctttttaccgcaatggctggaaatccctcaagcgccatacggcgacgatggacacgttgattgctttgggtactagtgcagcgtatatatattctttgtttgtaactgttttcccgaatttttttattgttcagggcttgatacctcatgtttattatgaagttgcagccattgttattaccttaattttgctggggcggttattggaaaatcgcgctaggggacaaacttctgaagctatccgcaaactgatcggattgcaagccagagatgccagagttattcgtgatggtagagaaattgatgttcccattgccgaagtcagaatcaacgatgtaattttggtacgtcctggtgaaaagattccagtcgatggcgaggtgattgcaggcgattcgacagtagatgaagcgatggtgactggtgaaagtttgccagtcaaaaagcagccaggagatgaagtgattggggcgacgattaacggtgcgggtgcatttcagtttcgggtgacacgagtcggaaatgatacgtttttggctcaaatcgtcaaattagtgcaacaagcccaaggttctaaagcaccaattcagcgcttggcagatcgagttacaggatggtttgtaccagctgtgattgccgttgcgatcgccactttcgtcatttggtttaatttcacgggcaacctcaccctagcaacaatgacaacggtgggtgtactgattatcgcttgtccttgtgctttgggtttagccactcccacttctgtaatggtggggacgggcaaaggtgcagaaaatggcatcttgattaagggtgcggatagcttagaactagcacacaaaattcaaaccatcgttctagataaaactggcactttgactcagggtaaacccacggttacagactttgtgactgtcaacggtacagctaatggtaatgaaatcaagcttttacagttagcagcaacggtagaacgaaattctgagcatcctttagctgaagcggtggtaaaatacgcccagtctcaagaagtgagtttaatagaggtaaagaattttcaggctaatgcaggtagtggtgtccaagcagttgtttcaaatcagcttgtgcaaattggtacacaacgctggttaacagaacttggaattaacaccatgactcttcagcagtataaagatacctgggaaactgctggtaaaacagtcattttgattgctgtagatggcgaactacaaggaataatgggtattgccgatgccctgaaaccttcatcagcagcagtggtgaaagcattacagaagttaggtttagaagtagtaatgcttactggagacaatcgtaaaacggctgatgcgatcgcagcagaagttggcattgaacgaatctttgccgaagtgcgtccagatcaaaaggcggcgattatccaatctctacaaggggagataaaaaaatcccccaattcaaaatctaaaattgtggcgatggtaggcgatgggataaatgatgcgccagccctagcacaggctgatgtgggaattgctattggtacgggaacagatgttgcgatcgcagctagcgatatcaccctaatttctggagatttgcaaggaattgttacagcaattcaactcagccatgccaccatcaacaatatcaagcaaaatctcttctttgcctttatttacaacgtcattggtattcccattgcggctggaattttgttccctatatttggttggttactcaatccaattatcgccggagctgcgatggctctttcttcgctctctgttgttagcaatgctctcagattgcgtaaatttcaacca

SEQ ID NO: 43568 - DNA, 777 bp, Nostoc punctiforme
cttaaaggtcaaaaagcacttgtgacaggtgctagttctgggattggtgaagcgatcgctcgctatttggctgcatcaggtgcagcagtagctatcaattaccattctgaagctgaatcagcccaaaaaattgttgatgatatcaaagctgctaatggagaagcattcgctattcaagccgatgtcagtaaagaagaccaagtaaaggcaatgttcagcctaacccttaaacaatttggcactattgatattttagtaagtaatgcgggcattcaaaaagactcagcatttatagatatgaccctcgatcaatggaatgcagtgattgggataaatctaacaggacaattcttatgtgctagggaagccgcaaaggaattcttgcgtcgaggtgtgaagcctgatatttcatgtgcggcaggtaagattatttgtatgagttccgtacatgaggtaattccttgggctggtcatgtgaattatgctactagcaaaggtggtattaatatgatgatgcaaagtattgcccaagaacttgctcctcacaaaattcgggttaatagtattgctcctggtgcaatcaaaaccccaattaacaaatcagcttgggataccccacaagcagaggcaaatttactaaaactaattccagcgaaacgtgtgggaaatgtagaagatatcgccaaagcagcagtttggttggcttctgatgactctgattatgtcaacggtacaacactatttgtagatggtggcatgactttatatccagggttt

SEQ ID NO: 43569 - DNA, 2085 bp, Nostoc punctiforme
gcttttggctcacccggcatcgatcctcgatggactcatgccaataaggatgcagtcggaacagcttattttacctctagtcgcgtttggtttactgtttgcaacggtgttgtgacagaagtctaccaccccacagtagacaaaccccaaattcgagatttgcaatatctaatttctgatggcaaaagctttttccatgaggagaaacggcatctcgaatcaaaagttgaacagatgtggactcatggtttaggatatcgcgtcactaattccgatccacaagggcgttatgctgcgatcaaagaagtgattgctgacccccatttatcctgtattttacaacatacaaagttaataggagagcgcgagtttatctcgcaactccagctatacgctttgtgtgcgccacatttggaagttggcggcagaggtaacaatggttacgtcatagaagttgctggacatcagattctaacggccgagaaagcaggaagatggatggtgctaggtgcaacggttcccttcagccgtctttcctgtggttacgtcggtcaaagtgatgggtggacagatttagctgataatttccagatggattgggagtttgaccgtgctttggatggcaacattgctttgactggacaactaaatctagatgagagtcacgagttcactttgggactggcatttggtacaactctgcacaatgcaatttccacactgtttcagtcgctaaatattccttttcaacagcagaagcaacattatatcgaacagtggaagcgatcgcgccagggcatcaagccattagaaaatatttcattcgatgatggtaacttgtatcaccacagcattagtctgcttttggcccatgaagacaaaacttatccaggtgctttaattgcttccctagcaattccttggggtgaagccaaagacgaccaagaccaagggggatatcaccttgtctggacgcgggatatggttagcagtgtatcaggtttattggctgctggggagacagaaacagcagtgcgatcgctcatttatctggccacgagtcagcaggaagacggcggttttgcccaaaatttctgggttaatggggaaccttactggaagggtattcaactagatgaagtgggatttcctattctactagcatggctactgcaccaacaaaaaataccactgaactttgatatttatcccatgattttacgggcagcaggttatttaattcgtcacggcccggctacccaacaagaacgctgggaagaaaatagcggctattcaccttctacactggcatctaatattgccgctttaatctgtgctgctcaatttgttcgtgaacgtggggatgaagtaacagcaaaatttatcgaagaatacgccgattttttagaatgtcacgttgaagtttggacagttactaccgaaggtactcttgtacctggcatcaatcggcattacatccgcattactcctacagatattaataatcctcaacccaacgaaaatcctaatcagggaactcttttgatcagcagtcaacctcctggtgaaccagcagaatttcctgcgaaagaaattgtggatgcaggctttttgcaactagtacgctatggaattcgtaaacctgacgatccgattattgttgattccgtcaaagtaattgatgcagtcttgaaagtaaatacacctgttgggccttgttggcatcgttacaaccacgacggctatggacaacaagaagacggtagtccttacactggttggggtaaaggacgcgcttggcctctcttgacaggagagaggggacattatgaattagctgttggtggcgatgtcaaaacatatatcaaggcaatggaaggatttgcttcagacacttgtttgctaccagaacaggtttgggatgaagcagatagacctgaaagccacatgtatttaggaagaccaacaggttccgccatgcctttaatgtgggcgcacgcagagtatatcaagctgctacgctcaaatcatgacaatcaggtatttgattttatcccagaggtggcgaatcgctatttaggcgaa

SEQ ID NO: 43570 - DNA, 1434 bp, Nostoc punctiforme
aaaaccgaagccgcgctcaagcaagccaaagaaaccgcagatgctgccaacctcgccaaaagccagttcctctctaatatgagccatgaactgcggactcctcttaacatcatccttggctttacccaactgctgctgcgaaatcgatcgctcaactcacagcaacaagaatatcttgacacgatcaaccgcagtggcgaagacttactgaccttaatcaatgatgtattggaaatgtccaaaattgaagcaggtcgagttatcctcagcgaaacaaattttgacctctacgggcttttggatcgtctgcaacagatgtttgcattgaaagcccagtcgagaggattacaactcattttggagcgatcgccaaccatcccccaatacatctgtgccgatgagagtaaattacgccaagttctagttaatctattaggaaacgcaattaagtttacgcgcatcggtcaagtaaccttgcgggtagaaactcctaaccaaaacatcacaccagatgaacccatcaccctgaacttcagcgtcgaagatacgggttgcggcattgctgattctgacttcaatcgtctatttgagccatttgtccaaacagaggcgggacaaaaagctcaggaaggtactggacttggattacccatcagccagcgatttgtgcaactcatgggcggagatatcagggtgaatagcacgctaggaaaaggctcaatttttacctttgatatccgaactcgtgcagtaattatggataccttgccaacgcctgcaccaagtcggcaagttatcggtttagaaaagggacaacccagctatcgcattctgattgttgaggataaactagaaaatcggcagcttctagttgagttgttaacacccgttggctttgaggtacgggaagcggtaaatggtcaagctgcgatcgaactttggcaaaattggtcgcctcacctcatttggatggatctacggatgccaattatgaacggatttgaggcaaccaaacatattaaagcagcaggcgctcaaaccccagttatcattgcattgaccggaagcgcatttgaggaagaccgcttaacagcactgtccgtaggttttgatgactttgtgcgtaagccatttcggacgaccataatttttgaaaagatggctgaatatttgggtgttcgttatgtatatgctgatgaacgagaaaagcaggaaaaagcatcttggccttctaacgcttcattcatcacacctaaattaacggttgcagatttaagcgtcatgcctagcgactggattgagcaactgcatcaggcagcgctccgaataaatgctaaagaaattcttatgctgattaaacaaattcctgagcagcacgctcatctgatcgtggcactaaccaatctcgtagactgcttctgctttgaagaaatt

SEQ ID NO: 43571 - DNA, 729 bp, Nostoc punctiforme
actgctttaattactggtgcctctagtggtattggtaaagcttttgcccaagaactagctgcacgcaatacaaatcttgtactcgtagctcgttccaaagagaagctaagtcaattagctaaacaactacaagaacaacacaaaattcaagtagacgttataatccaagacctcacggaacctaatgcagctgctactgtatttgatgccactaaagcaaagggattaactattgacttattaatcaataatgctggttttggttactatggcgactttgccgaaggggatggagaaaggcaaattaaaattgtgcaattaaacattttagcattagtagatttaacccataaatttctacccttgatgcggcaacgacggtctggaagtattattaacgtatcctctattaccgcatttcaaccgataccatacctttctgtttatgctgccagtaaagcttttattctcagttttagtgaagcactatgggcagaaaatcgtcaatatggtgtccgtattttggttacttgtccagggccaatagaaacaaatttttttgcggaagctaattttcctccagcgctggcaagtagtacggataaagtgtattcttccgaaaaagttgtttgggagtgtttagatgctttggaaaaaggctatccaactgttattagttctgatactagcactcaaattagaagcaaattatctaggctcgtaccgcgc

SEQ ID NO: 43572 - DNA, 648 bp, Nostoc punctiforme
tttaatgcagaaccaggacaagcgatcgcattagttggagctactggcgcaggaaaaactactataattagcctactctcccgcttctatgatgtgtcaggcggtgctataaaaattgacgatatagaagatatccgaaaagttacacaagcaagcctacgttgtcaaattggcgttgtctcacaagacaccatgatttttagctatagcgttgccgaaaatattgcctttggcaatccccaagcaacaacagcagaaattgaagcggcggcaaagattgcaaatattcataactttatcttgaccttaccccaaagctatgaaacgcaattaggagaacgggggataaatctcagcaaaggacaacaacagttaatcagcatcgcccgcgcagttttggtaaacccgcgcatcttgattttggaagaagcaactagtaacattgatggccaaacagagaacttagttcaacaagcgatcgctaatttacttcaaggtcgcaccagctttatcatcgctcaccgtctggctaccgtcactaacgcagacaaggtattagtcattgagcaaggacaaatcatcgaacaaggtatacatacacaattgatggagcaaaaaggagtatatgcaaacctttattctctacaa

SEQ ID NO: 43573 - DNA, 1628 bp, Nostoc punctiforme
aaagcttatatcattgtccccattttatatggtagtcagatttggggattactagcgagttatcaaaattctgattcccgccaatggaaaccaggagaaatcaacattgtagttcaaattggcaatcagttgggtgtggctttacagcaagcacaattactggcgcagactcaaaggcagtcacaagcattgcaagaagctgtgattacagctgatgctgccaaccgcgccaaaagcgaattcctcgccaacatgagccacgaactgcgtaccccactcaacgccatcctcggttttacccaaatcatgagccacgatcgggctttatctactgaacatcagcaaaatctagcaatcatcaatcgtgctggcgaacatctcctcaacttaatcaacgacattctggaaatgtctaaaattgaagccggcagaataacattaaatctcaacagttttgacttaattcgcctcttagaaaacctcgaagagatgttgcgtttccgcgccacttccaaaggcttagaattaaattttgaatatacatcttaccttccgcagtatatccaagctgatgaaagtaaactgcgtcaagtattgcttaacctcttgggaaatgcaatcaaatttaccgatctggaagagttatgttacgggtggcaatggagaatatgggggagaaaattttacctcatcctcctcatctcttcttcgaggttacagacactggtcgcggtattgcgccacaggaaattaacttactgtttgaagcgtttggacaaactgaaaccggtagaaaatcgcaacaaggaacaggagtaggtttagcaattagccgcaaatatgtggaactaatgggcggagatattagcgtgactagcattattggtgagggaagtacatttgcctttgatattcaaattgatctagccgcagccagcgaaatccagatccaacaaattagacggcaagttctgagtttagcacctgctcaaaacgaataccgcatcttggtggttgatgactctatagacagccgtttagtgttagtaaaaatcttgacatctattggttttgcagtccaggaagcggcaaatggcacggaagcgatcgcactttggcaacaatggcaaccacacctaatttttatggatatgcggatgccaattatggacggctacgaagccaccaaaattattaaagctagagaagaaacttcaatcccaaatcgcaagacgattattatcgccttaaccgctaacgcctttgaagaacagcgagaggcaacaatcaaagctggttgtgatgattatattaacaagcctttccgtgaagaagaattattaaaaaaattgagcgaatatttagaagttaaatatatttatcaagaagataactatcagataaaaaatgcaaaccaacaaataacagaatcaatcttgaagcttacagatttagttcctctattgtctgaaatgtcgcctgaatgggtgaaacaggtgtatactgccgcagcccaatgtagtgatgacttaattttagaattgattgaacaaattccttcagaaaatgctacgttgagcaattttattcagaatttggctcataatttccagtttgagaaaattatg

SEQ ID NO: 43574 - DNA, 1864 bp, Nostoc punctiforme
atggttcaggttcgctatggtggacagaacggtcaacagtatgaacttgctatcagtgacgaacacgttgtagtgcgtaccgaaagccgcagtactctaattggtgcaagaccgtttgaagtcgcacctgtgtcacccacagctcgtagcatcctcaatcaattcgagttaacaacgcggtttcggcaagcgggtgtagaaattttgcgtgcgaaagttccgactcagggtgtcgctttgcgcgatcgcgcccgtgaaattctcaaccaagagtctgaagtccaatttgccggacgtgtcttgatcgatccagcctccagccaaccgataatttacaccgaaaacctctttgttaaattcgataatgaagaagaatcaagggtctgccaagagatattgggacgttacagcttaacaattaaacgccgacttgaatatgcgcgaaatgcttattttgtcaatgcacctacaaatactggtatagcgatctttgacatcgccgagagacttctgaatgaggaatcagtcgaactgtgccatcctgaactagtgcgtgaatcacgccaacgtcaggtttttccccagcagtggcacttaaagcaaacaacaattaacggtaaggtaattaacgcccatgccaacgttgaagcagcttggaagttgagcgatggcacaggagcaattattgcaataatcgatgacggtgtggatctcgatcatgaagaatttcgttcctctggaaaaattgttgccccgcgcgatgtcacacgtaaaaatgacaatcccagaccgggaaacgacaataaccacgggacagcttgtgcaggagtagcttgtggcaacgggaaatttggtgcatctggtgtagcaccaggcgcaaaactgatgccgattcgtttagcttcgtcgttgggatcacaggatgaagcagatgcttttatttgggcggctcaaaatggtgctgatgtgatttcttgtagttggggtccagcagatgggacttggtttgagccaaacgatcctctacacaagcaaaaagtacctttgcctgactccacaagattggctatggactttgcaatcaataaaggacgcaacggcaagggatgcgtaattttattcgcggctggcaatggtaacgaaagtgtagataacgatggctacgccagctaccaaaaggtaattgcgatcgcagcttgtaacgactttggcacaagaagcgcttacagtgactttggtcaggcggtgtggtgcgcctttcccagtaacaatggtgatagttctcaaacccctggaatttggacaaccgatcgagttggtgtacttggctataattccggtaatgtaaatctgggtgatgctggaggtaactacacgaacgaattcggcgggacttctagtgcttgtcctggtgcggctggtgtcacagcattgattattgccagaaacccaaatctgcgttgggacgaagtacgagacattattaaacgctcttgcgatcgcatcgatcaagctggaggtaaatatgatgccaatggtcgcagccctttctacggttatggtcgaatcaatgctctcaaagctgtagaattggccaagccggcgcaaacatcgcccattagcatattcaaggcagtacaagatatcccaattaacgacttgcaaacatcaacattgtcgttggcgatcgctaataccagcctcctgaaatccatcaaagtgaatgtagacatcgagcatacttatattggcgatcttgtagttactctccttcccccagtgcaaataggcatacttcccatcattctgcacgatcgccaaggtggagctacagataatatcaaaacaacctatgacgaggtaa

SEQ ID NO: 43575 - DNA, 963 bp, Nostoc punctiforme
caaaggcgtaaacttggacgttcagaactagaagtatcaccaatatcttttggtggcaacgtatttggctggactattgatgaaaatagttcatttgagattttagatagctttatagaggctggaggtaattttattgacacagctgatgtctattccaagtgggttccaggaaatcaaggtggagagtctgagacaattttaggaaaatggctcaagcagcgcggtaatcgtgaccaagtggtgattgcaactaaggttggcaacgatatggatgttagaggccaagggctttctcgtgaacacattcaacaagctgtggaagactcgttgcagaggttacaaaccgattatatcgatctatatcaatcgcatatcgacgatgaaaacactccacttgaagaaacccttgaaacctacgcagaattgattcgtcagggaaaagtacgtgcgattggtgcttcaaactatagtgcagagcgtttggggcaggcattagaaattagccgtcagcatggctatcctcgctacgaaagccttcagccccgttataacttgtatgaccgagatggttatgaacaggatttacaacaaatttgccaagaacaggaaattggcgtgattaactattcctctctgtgcagtggttttctctctggtaaatatcgctcagaaaaagatttgtctattagtcttcgtggtaattctgtaaaaagatatttaaaccctcgtggcttgcaaattctagaggcaattgatcgggtggcaacgacttataattttactcccacccaagtttctctggcatggctcattgctaatcccagtattactgctcctattgttagtgcaacaaaggttgagcaactcaacgatatcatcaaagctgtcaatataaagctcgatcaagatgctattgaccttctcaatcaagccagttcctcaaacacctagtacggctac

SEQ ID NO: 43576 - DNA, 756 bp, Nostoc punctiforme
atcatgaatagcaatattaagaaacttacaggtaaagttgccctagttacaggtggttcacggggtattggtgctgcgatcgctaaacgtctggctgaagacggcgcagacattgccatcagttacgccacctcatcggaaacggccgcgatcgttgtccgggaactcgaagaaaaaggcgttagtgccgccgctttcaaagccgaccaagccgatcctctccaggttgggaatttggttaagatggtcgccgaacgctttggtcgtctcgatattctcgtgaacaacgctggtatatttgtccttggtgtagttggcgattctgcaagcgatattgcctcctttgaacggcagtttgcgatcaatgtcggtggcgtagtggctgccgtccgcgcggctgtaccactcatgactgaaggtggacgaatcatctccattggctcctgtgttggaacccattccctttgggcaggaatctccgattattcagcaactaaatctgcgatcgctggctacacgcgcggatgggcacgtgacctggggtcgagggcgattacagttaacgtcatacagccaggcccaattgaaactgatatgaacccatctgatagtgattttgcggtaattcaaaaagcagccacagcgctcaaccgctacggtaagccagaggaagttgcagctgcggtcgcttttctcgctagtcctgacgcagctttcatcaccggtgcaacacttgatgttgatggcggcatgaat

SEQ ID NO: 43577 - DNA, 1416 bp, Nostoc punctiforme
ggacatgcaaccagtctcaaggactacgaaaatttgtttccggtgattagtctaccagccatcgctaaaacttatcaggaagatgaagtatttgcctacatgagagtagctggctacaatcccgtcacgatcaagcgagtaactactctaagcgatcgcttcccagtcacagacgaacattaccaagcggtgatgggaactgacgattcattagcagcagcagggattgaaggcaggctctacttagctgactataaaattttagatggtgcaatcaacggtacattcccacacgagcaaaaatatctctatgctcccctagcactatttgccttacccaaaggttcagatcccacccgtctattgcgtccggtagccattcaatgcggtcagaccccaggcccagattatccaattgttactcctaactccggtaaatacgcttggctttttgccaaaacgattgtccaaatagcagatgctaacatccacgaagctgttactcacctagcaagaactcatcttttagttggtgtttttgcgatcgcaactgctcgacaattgccactcacacatcccctcagaatcctgctgcgcccgcattttgatagcaccttagcaattaacgatgccgcccaacggattctcattgctccaggcggtggtgtcgatagattactctcatcatcaatcgataactctcgcgttttagcagtgctagggttgcaaagctatagttttaacagcaccatcttacctaatcaattccaacagcgcggtgtagacgatcctaatctattgcctatttatccttaccgggatgatgccctactaatctggaatgccattcatcaatgggtttgggactacctgaacctttactacaccacggatgaagacattcaaaaagacagagcattgcaagcgtgggcagccgaaatcccagcttacgatggtggtcgtatccccgattttggcgaagatgggggcatcaaaacgctaaattacctgattgatgccactacattaattatttttactgccagtgcccaacatgcagccgttaactttccgcaaaaagatttgatgggctacgccgcagccataccattggcaggttatttaccagcctcaactctcaaaagagaagttaccgagcaagactaccttaatctgctcccccctttagatcaggcacaacggcaatacaacctactcagcttattagggtctgtatactacaacaagctgggcgagtatgagcaaggatacttcacagacgagaaagtaaaaccattgttacaggcattccaaagtcatcttcagcaggtagaaaataccatcaagcagcgtaatttgcaccgcccaccctatgagtatctccttccttctaaaattcctcagagcatcaatatc

SEQ ID NO: 43578 - DNA, 1512 bp, Nostoc punctiforme
ctgcgccgcttgaaaatcaaattagctgtgggtatgtccagccgtttcctgtggcatatcctccgcttacctgtgagcttttacgctcaacgatttagcggagaaatcagtaatcgtactactctcaatgaccaagtagctgatgttctggcgggacgattagcaactacaatcatcgatacatttatggtgtttttttacgccctagtcatggtgcaatatgactgggtgctgaccttaattgtagttagctttgctgccgtgaatgtcttaactttgcaactaatttctcgtcaacgtgtagacgcgaatcaacgattgattcaagaatatggtaaagctgctggtgtatctattgccgcgcttcaaagtatagaaacactcaaagcatcagggttagagtcagatttcttttcccggtggtcaggttattacactaaggctcttaattcccagcaggaactgggggtgacaaaccagacattctcagtattacccacgcttttatccgccctttcttcaatgttgttgttggttgtcggtggattacgggttatggatggacatcttagcatcggaatgcttatagcctttcaaggtttgatgcttaactttcagcagcctgttaacaatctggtcaactttggtacaactcttcaagaactggaaggtaatttaattcgccttgatgatgtgctggataatcccattggggagggagcaggtggagatgggggagtaacatcctcctcatccccctcatctgcttatcttgttcccaaattgcagggatatgttgagttgcagaatattacgtttggctatagccgcctggaaccgccactgattgaaaactttaacctctcaattaagccgggacagcgagtagctttggtaggtggaagcggttctgggaaatctaccgttgccaaacttgtaagcggactttatcaaccttgggcgggagaagtttactttgatggtaaacctagagagcaaattccccaacaactgcttacaaattctgttgcaatggtggagcaggaaattttgttgtttggcggtacggttagagataatttgactctgtgggatactactgtaccagataaaagcctgatgcgggcatgtgttgatgcagcgatcgctgatgtaatcctctctatgtccggtgggtttgatgccgaacttatagaaggtgctgcaaatttaagtggcggtcagcgacaacgcttagaaatcgctcgtgctttagtgaataatccttcaatcctgatcatggatgaagccaccagtgccctatatgcagagacagaacaaatcattgaccggaatctgcgccgccgaggatgcacctgtataattgtcgctcatcgattaagcaccatccgcgactgcgatcaaatcattgtcctcgaacgtggaaaggtagtacaacttggcactcacaaagaattgtggcaagtcgatggtgcatattcgcgcttgctaggcacccaagggtagagacgg

SEQ ID NO: 43579 - DNA, 492 bp, Nostoc punctiforme
atgggtgtatctggttctggtaaaaccaccataggaaaactgctagcagactctttaagctgggagtttagtgacgctgatagtttccactcaccagagaatgttgataaaatgcggcgcggtatcccgttgactgaagctgacaggatgccttggttgcaagatttgcaaacagccatcaaacattggctgcaagaaaataaaaatgtagtgctggcgtgttcggctttaaaagacagctatcggcaatttttggtatcggatagcgatcgctgcaccaacgccaagagcgatcgcattaagctagtttacctcaaagggtcttatgagttaattcaaatgcggttgcaagagcgtagcaatcattacatgagcgaaaaacttctcaatagccagtttgatactcttgaagaaccattagacaccatatctatagatgtcgcacaaccaccccagatcattgtccagaatattagaacggctttgagactt

SEQ ID NO: 43580 - DNA, 834 bp, Nostoc punctiforme
atgtcagatttgattttaaataaactttttagcctaaaagatcgggtagcagtagtcacaggcggttctggtgtacttggtggagcaatggcaaagggtttagcccttgctggagcgcgggtagtcgttctaggccgcaatgaagcacgggcgagtgcagtagtaagtgatattactgctaacggtggagaaagtatggctgtactggcagatattagcgatcgctcccaattagaaatcgctagggaagctattatacagcgttgggatcagatagacatcttggtaaacatggccggtggtaatattcctgctgccacaattacccctgatgccactatttttgatatgccacatacagcttttgaggaagtagttagcctcaacttactcggtactctattgcctagccaagtttttggtcaagcaatggtcgaaagaaatcagccatctggttgtattgtcaatatttcttctatgtctgccattcgggcgatcagccgcgtggttggctactcagccgctaaagccgggatagataactttactcgttggttagccgtcgaacttgcccaaaagtatggggatggaatgcgagtaaatgcgatcgcgccaggtttctttattggggaacaaaatcgagatttactcctaaatgcagatggcagtttgaccgaacgcgggcaaaaaattatcgagcatacccccgccggacgtttcggcaaaccggatgaattactcagtaccttgatttggttatgcagttctggttctagtttcgtcaacggggtagttataccagtagacggtgggttcagtatctacagtggagtt

SEQ ID NO: 43581 - DNA, 1380 bp, Nostoc punctiforme
atgcggattctatttgttgcagcagaagcagcacccattgcgaaagtaggaggaatgggtgatgttgttggggcattacccaaatttctgagagaaatggggcatgatgtgcggatattcttgccttactatggcttcctgccagacaaaatggaaattcccaaagaacccatctggcgggggtctgccatgttccaggaatttgctgtttatgaaagcgttctgcctggtactgatgttcccttgtacttatttggacatcccgtcttcctacctcgccgcatttattctggagatgatgaagactggcggttcactttcttttccaatggtgcagccgagtttgcctggaattactggaaaccagacattatccattgtcatgactggcatacgggaatgattcctgtatggatgcaccaagatccagatatcaccacagtgtttaccattcataacctggcttatcaagggccctggcgttggtatttagaaaaaattacttggtgtccttggtatatgcaaggacacaacacaatggccgcagcagtgcaatttgccaataaggtaaatacagtttcgcccacttatgccgagcaaatcaagacacctgcttatggtgaaaccttagaaggtttgctgtcttttattagcggtaagttatccgggattatcaacgggattgatactgaagtttataatcccgaagatgacaaatatattgctcaaaccttcactactgagactttagataaacgcaaagctaacaaaattgctttgcaagaagaagtaggattagaagtcaattctaaagcctttttaattggaattgttacccgattagtggaacaaaaaggtattgatttgatcttgcaaatcctcgatcgcttcctatcttatacagatgcacagtttgttttattgggaacaggcgatcgctactatgaaactcagatgtggcaattagcatctcgttttcccggacgcatggcaacttacttactgtataacgatgccctgtctcgccgcatctatgctggtactgatgccttcttgatgcctagtcgttttgaaccatgcggtattagccaaatgatgtctttgcgctacggttctgtacctattgttcgccgcacaggtggattagttgacaccgtaagccatcacgaccccgaaaatgccgcaggcaccggttattgctttgaccgctatgaaccgctagaccttttcacttgtatgatccgagcttgggaaggcttccgtttcaaaccgcaatggcaagaactacaaaaacggggcatgagtgaagattttagttggtataaatctgctaaagagtacgtcaagttgtacaggtcaatttacggtttgccagaagaa

SEQ ID NO: 43582 - DNA, 954 bp, Nostoc punctiforme
gtttctagtcccccacgcactattcggatcggttcacgcaaaagccaacttgctctagttcaaacctattgggtacaagagcaactccaaaaaagctttcctgatatcacttttgaagtccataccatgtctacccaaggcgacaaaatccttgatgtagcattagctaagattggcgataaaggactttttactaaagaacttgaagttggaatgctcaatcaagagattgactttgcggttcattctctcaaggatttgccgactaacttaccagaaggattgacactggcagcaattactgaacgggaaaatccagccgatgccttggttgtgcatgaaaagcacaaagataaacaaatcgatactttacccgaaggtgcagtaattgggacatcttcgctgcggcggttagcacagttacgccaccacttcccccactttacttttaaagatgtgcggggaaacttgattacacgattggcaaaactggatgcaggcgaatacgatgccttaattttggcagccgcagggttagaaagattgggaatgagcgatcgcgttcatcaaattatccccaaagaaatctccctccatgccgttggacaaggtgctttagggatagaatgccgtgctgatgatagtgaattgctaactctactcaaagcaatcgaacatcctgcaacacgcgatcgctgtctcgccgaacgttcttttctacgctctttagagggcggatgtcaagtacctattggtgtaaatacagaaatctctggtgagaatttgaccttaacaggcatagttgccagtatagatggtcaaaagttggtaaaagataccgtcactggaattgccaataatgccgaagcgctaggcacagaactagcagaattattgcggcaacagggagcgcaagaaattttatcagaaatttttgcggtcattcaacgcggt

SEQ ID NO: 43583 - DNA, 1161 bp, Nostoc punctiforme
atgggtcgtgtaggcgtattattactcaatctcggtggccctgataagctagaagatgtcgggccgtttttgtataacctattttccgatccagaaattattcgcctaccgtttcgctggttgcaaaaacccctagcctggtttattgcctcgcggcgaaccagaacatctcaacaaaattataagcaaatcggtggtggttccccactacggcggattacagaagcgcaaggggaagctttaaaaaaacagttgggttatttagggcaagaagccaatatctacgtgggaatgcgttattggcatccttatacagaagaagcgatcgcacagatcactcaagacaatatagaacacctggtaatattaccactatatccccagttttctatcagtactagtggttccagctttcggcttttagacaaactttggcaagaagagccaaaacttcagcccattgaatacaccgttattccttcttggtacaaacaaccaggctatctccaagcaatggcggaactgatagcccaagaacttgagcagtttccaaatccagacgaggttcatatattcttcagcgctcacggcgttccgaaaagctacgttgaagaggctggcgacccttaccagcaagaaattgaggaatgtactgctctgattatgcagactctcaatcgtcccaatgcccatactttagcttaccaaagtcgtgtcggcccagtagaatggctccaaccttatactgaagatgcgcttaaagaattaggcgcacaaggcgtaaaagatttggttgtcgtgcctatcagttttgtctcagagcatattgagacactgcaagaaattgatattgagtatcgggaagtagcagaggaatcaggaattcacaatttccgccgcgttccggctcctaatactcatccagtatttattaacgcacttgcagagttagtaattgatgcgctgaaaaaccccagcttcaagctttcgcaagctgcccaaatgaaaaaaatggtgaaaatgtacccccaagaacgttgggaatggggtctaacaactagtgctgaagtctggaatggtcggattgctatgttgggctttattgccttaataattgagctaattactggtcacggcttcttgcacatgattgggcttttg

SEQ ID NO: 43584 - DNA, 1536 bp, Nostoc punctiforme
actcctaactctcatttcctcggtgcggctgataccgattatgcggtggaagagataagaacaaaagcggcgcaagctttccaaagcgttcgtcaacaattgggtaaaacttatttgccgttgattaatggggaatatgttaatacgccggaatttgttgattctctcaacccttctaatttcagtgaagtagttggtaaagtaggcttaatcagcgttgaacaggctgaacaggcgatgcaagcagccaaagcagcgtttcctgggtggagaaaaacacctgcgaaacaacgcgctgatattttgcggaaagcgggtgatttgatggaactccgccgcgccgaactttcagcttggatagttttggaagttggaaaaccagttaaggaagctgatggagaggtttcggaagcgatagacttttgtcggtactacgctgatgagatagaaaggctggataaaggtgttaattatgaccttgccggggaaactaaccgttatatctaccatccacggggaattgttgtagtaatttctccctggaattttccgcttgcgatcgcatgtggaatgactgtcgcagccttggtttcagggaattgtactcttcttaaacctgcggaaacatcttctgtaattgcagccaaactcacagaaatcttgatagatgctggttttcccaaaggtgtgtttcaatacgtgccaggcaagggttcgcaagtcggcgcttacttggtaaatcatccagatacgcatgtaattgcttttacgggttctcaagaagttggctgtagaatttacgcagaagctgcaatattaaaacccggacaaaagcacatgaaacgggtgattgctgaaatgggcggcaaaaatgccatcattgttgatgaaagtgctgatttagaccaagcagttgtaggggtagtgcaatcggcatttggttacagtggacaaaaatgttctgcggcttccagggtgattgtgctggaaccgatttatgaagcctttgtgcaacgattggtagaagcgacaaaatccttgaacattggggaagcagagttacctagtacccaagttgggcctgtgattgatgccaatgcccgcgatcgcatccagaagtatattgagataggtcggcaatcagctgaggtagccttggaattaccagcacccaaacaaggatattttattggccctgtgatttttagtgaagtatcgccaaatgcggtaatttcccaggaagaaatttttggccctgtgctggcggtaattcgggtgaaagatttccaggaagcgttagcagtcgccaacgggacaaattacgccttaactggtggactttattctcgaacaccttcgcacattcagcaggcgcagacagaatttgaagttgggaatttgtacattaaccgcaatattaccggagcgatcgttgggcggcaaccctttggtggattcaaactttctggagtcggttctaaagcaggcggtcctgattacctactgcaattcctagaaccacgcgcggtaacagaa

SEQ ID NO: 43585 - DNA, 837 bp, Nostoc punctiforme
tcggtagcttttagtccgaatggtaaacttttagctactggtgataccaatggagaaattcgcttgtacgaagttgctaatagtcagcaacttatgacttgtaaaggtcatactggttgggtttggtcagtcacatttagtcccgacggtcaggttcttgccagtggtagtaatgatcaaacaataaaactgtgggatatcagtaatggtcagtgtctaaaaactttggagggccatagtggtggggttcgttcggtcacttttaaccctgacagtcagcttcttgctagtggcagtgatgaccaaacggtgaagctgtggaatatcagtacaggcaaatgtttgaaaacgttacaggaaaatggttgtagtatatggtctgttgcctttaatccaaaaggtgatgtgttggcaagtggaaatgatgactataaagtaaggctgtgggatattaacagcaattcatgtattcacactttagaaggtcacactcaacgggtatactcagtctgtttcagcccagacggtaatacaatagcaagcgccagccatgatcaaacagttaaactttgggacacaagtactggtaaatatattaaaactttgcaggggcatacagacttggtacattcagttactttcagcgtagatggtagcgctcttgttagttgcggtgatgaccaaacagttagggtatgggatttcgtaagtggtcaatgccttaaaactctacaaggacacaaaagtagggtatggtcgttagcaatatgtataaatcaaaatatttgtgctagtagcagtgacgatcaaacggtaaaattatggaatatgagcact

SEQ ID NO: 43586 - DNA, 840 bp, Nostoc punctiforme
tcagttgctgtcagcccaactgataataatattcttgccagtggtagtaatgaccaaacagtgacactgtgggatattacggctggtaagtgtatcaaaactttacgagaacatggtaggagagttacatcagttggctttagccctgatgctcacttgcttgctagtggtagcgaagaccaaactgtaaggttatgggatctaagtactagtaaatgccttaaaatattgaaaggacatagtaatcgagttacatcagttacttttagtgccgacagctattttttggctagtggtagcgatgaccaaacaataagaatatgggatattaccactggtcaatgcctcaatgctttacgagaacatagtggtagaacatggtcagtcaccttcagtcctgacagtcatgtattagctagtggtagtcacgatcaaacagtgaaactttgggatgttcgtactggtaggtgccttcatactttacaaggccataccgagtgggtttggggagttgcctttagcccaaatggtggtatgctagctagcggtagcggagaccaaacgattaaactctgggatgtcagcactggtcagtgtattagaactttgcaagaccatacaaatactgtatattcggtcgcttttagttcggatggtcgtatactggcgagtggtagtggagaccaaacagttaagctttgggatgttaacacaggtagctgtttaagaactttattaggacatactagatgggtttggtcagtcacttttcgttctgacgatcagactgtggtcagttgtagtgaagatgagacaattaagatttgggatgtacaaaca

SEQ ID NO: 43587 - DNA, 795 bp, Nostoc punctiforme
tatgacaatatttatgtctttggagacagtttatctgatattggtaatgtatttaatgccactaatggaattattcccccaagtccaacatactatgatgggcatttttctaatggcccaaattgggttgattatcttgcctccgatctaggattaacatcaaacctgaaaaataactttgcttttggtggtgcgactacaggaattgagaatattggtttagctactttaccaggattacagcaacagataaataactttgtagcagcagaaactgccgatcctaatgctctatatattatttgggctggaactaatgactacctaagttactttttcgatggggagccaaatcctagcaatacagtggcaaatttatcaacagcgttgacatcacttgttgctgatggcgctaaagatatcatggtcgtcaacttaccagatttgggaaaatcaccttttgcaaatttcaccagtgaacgttccaacttatttagcacatttagcagcgaacataactctagcttgaatacagaactcaaaactttgagtcaacaattaagtcctgatatcaacattatagaactgaatgttaattctctatttgataggatcgttgctgctccagaggaattcgattttacaaacgttactaactcttgcattagcaaagacttatcagtagtgcctatagatgttcccacacaacaagttttttgtaaccctgaagaatttttgttttgggatgaagtgcatcctacaactactgctcataagctaattggagaattagcc

SEQ ID NO: 43588 - DNA, 885 bp, Nostoc punctiforme
gatatggaaatgttgccttatctctcagatccctttcgcggtactattgagcgctgggtgctgagtcatgaggagtcctccttaaccttggagtattgcgcggcaacagatgccctgaatgcagccaaactttctattaatgatattgatttgatgattgtggcctcagtttggcctgaacaaattggatttggcaatgccgcctttctcgcccgtaaactcggtcttgtaggtgctgcatggaatcttgatggaacctgtgggagtacgccagttgtacttcaaacagcctctgctttggtgcgagcgggagagtatcgcaatgtactggtagttatttcatgttcgtattctcgcgtttttgacgagcaagatactgtgtcttggtttcttggtgatggtgctggagcttttgtagtcagttcaatggaaggaaatcagggtattcttggtactaagacagttcatacaggtgcgctgtgtgaggtcgtatctgctgaactgacaaaggatgaacaaggaaattcacgagtccgtatgcagactggtaacggtgcgaaggctctacgagaaacggctgcggagtttctttctatatgttgtgagggtgcgatcgcatctgctggtgtaacgttagagcaaatcgacttttttcttttcaatacccctactgcttggatgacacgcttctgcacgcggctactaaatattaacccagagcgcacgatcgatctctaccctctatatgcaaatatagggccagtactgactgtggcaaatctctatcatgctgcacatttgggtaagattcacgaaaatgacttagttctcatttatggttctggtgcagcaggtgttgcctctgcaagtgtaatgcgctggggt

SEQ ID NO: 43589 - DNA, 912 bp, Nostoc punctiforme
atgttaggacaattattagacggacgttaccaaatcctccaagtcttaggtggaggtggattcggtcaaacctatatagctcaagatacccatcgaccaggtttcccgaaatgcgttgtcaaacaccttaagcccgtcactcgtagccccgaatttctcgaaactgctagacggctatttaccagtgaggcagaaacgctagaacaactgggcaaccatgaccaaatccctcggcttttagcctattttgaagataaccaagagtttttcttggtgcaagagtttattgaggggcatacgctaaaagcggaactcttacccaatcaaccttgggcagaatatcaagtgattcaacttctccaacagatgttgggtattctgcaatttattcacagccacaacgttatccatcgagatatcaaaccagacaatataatcaggcggcaacaagacggtaagctagtgctgattgattttggcgcagttaaacaagtccaaactcaactgcttacagtttcagggcgcactggggctactattatcattggtactccaggatatatgtctacagagcaggggcaaggtaagccccgttccaacagcgatatttattctttgggtattattggtatccaatcgctaacggggttacatcctattaactttgaggaagatcaagatactggtgaaatttcttggcaacatcaggctaatgtcagttctgagttggcatctgtgctatctaagatggtgctacatcactttaaacagcgctatcaatctgcagctgaagttttacaggtgcttaagaatcttgatagtaaagtagaagcgcaatcacttcaatcaccatcttttagacaaccatatcaagcttcactttctcaacaaaactcaattgagtatccgcct

SEQ ID NO: 43590 - DNA, 2133 bp, Nostoc punctiforme
aaaaattaccagtgtgttttgcagttgagtgaagaagactgtggagccgccagccttgcttcaatttgcaaacattacggacgttttttaagcataaatcgcagtcgagatgccgttggaactggacagctaggaacaactttgctgggtttaaagcgtggatctgagaatctgggttttaatgccagggcagtgaaagcttcacctgcgatcgtggatagaatcacagaaatcaatctaccagcaattattcattggcggggttatcattgggttgttttatacaccaagcgcggcaataagtacgttattgccgatccagctgtgggtatccgttatattaaccaagaagagttaacagaagcttggaatggggtgatgctcttactagagccagatccagtccgcttttttgagcagcccgcagaagaagcaaaaggtggcttaagtcgctttttagtacgcatcttgccttatcgtggactgctaactcaagttttaacgatcaatattgtcttaggtctgttggctctaggtactcccgtcttgatccaactgcttacagatgatgtacttgtgcgtggagatacccagttactcactgttgtgatctcagccgttgtagttatgagcttattcggcagtactttgcaactattgcaggcgattatgattgctcattttgggcagcgactgcaattaggattagtcttggaatttgggcgaaaaattctccaattgcctttaaattactacgaagctcgtcgtagtggtgaaatcactagccgtctgcgagatatcaacgacatcaaccagttggtatcgcaaattgtagttcttttacctagccaattttttgttgccgtggtttcttttggcctgatgctgttttacagctggaaactgacaatggcagtcgtagtttttgctgggttaattaccctctctacgctaccctttttacccatcctccaacaaaaaacccgcagtctcttagttttagggacggaaaatcaaggtgttttggtggaaacatttaagggcgcacaagtaatcaaaactacaaatgccgctccgcagttttgggatgaatttcaaagccgctttggctgccttgctaacttgacttttagcaccatccaaatcggtattatcaacggtactattagcaagcttatagctagccttggtggtgtgattttacttggtttaggaagtatcttggtgattaatggggaattaagcattggtcaaatgttggcttttaacgccttacagttcaatgttctggctttaattaactcactggttggcttagtagatgaatattttcgctctcaaacagcaatttctcgccttctagaagttatcgatgcgacaccggaagtagtcggaggtagccaaaagccggttgtccaaatttctagtgatgcagacattcgctgttcccatgtccaatttcaccaccctggcagagttgacttattagaggatttttctctcaaacttcctggagggaaagcgatcgctttgattggtaagtcaggttgtggtaaaagtactttagcgaaagtgattgcaggcttatatcagcctaactctggcaatatccgcattggtttctataacatcaacgacctttccctggattgtttgcgacaacaagtagtctatgtaccccaagaacctcatttctggagtcgctcaattttagaaaacttccgcttaggaacaccttatatttcctttgaggaaattgtcaaagcttgccagatagctgatgcagatgagtttatcagccaacttccgaatcagtatcaaacagttttaggggaatttggggcaaatatctctggtggacaaagacaacgattagcgatcgctagaggcattcttaccaatccacctgtactgattttagacgaagcaacagctggactcgatccagtcagtgaatctcacgtactagacaggcttttggaataccgagaaggcaaaactactattttgattacccatcgtcccagcgtaattaatcgagccgattggattgtactactagataaaggtcaggtacaaatacaaggcgatcttgagacttttctctctcagcaaggagagcatttaaagttt

SEQ ID NO: 43591 - DNA, 1395 bp, Nostoc punctiforme
attatcaaagcattcgaggttgtccttggcaaaaatggcgtagtgcaacgccgtgaagaacttattacttatgaatgtgatggtttaactggctatcgccaacgtccggctgtagtagtattacctagaacaacagaacaagttgcccaagtggtaaaaatatgcaatcagtattctatccccttcatcgcacgcggttctggtactggtctatctggcggtgctttaccagtagaagactctgttttgattgtcacttccttaatgcggcaaatcctcagcattgatttggaaaatcagcgcacaattgttcaaccgggcgtgattaatagttgggtaacacaagccgttagtggtgctggtttttactacgctcctgacccatctagccaaattatctgctctattgggggcaacattgctgaaaactctggtggcgtacattgtcttaaatatggtgtcaccactaaccacgttttaggattaaaaattgtcacgccagaaggggaaattgtagatttaggcggacaaatacccgaaatgcctggttatgatttaacaggtgtgtttgttggttctgaaggcactttaggaattgccacagaaattactttgcgaattctcaaaagtgcagaatcaatttgcgtactgttggcggattttaccagtattgaagctgctggagcaactgtttctgatatcatcagcgctggaattattcctggcggtatggaaatgatggataacttcagcatcaatgcagttgaagatgttgtcgccacaaattgttatccccgcgatgctactgctattttgctaatcgaaattgacgggctagaagtggaagttgcaggaaataagcagcgagtgactgaaatttgtaaaaagaatggggcacgaaatgtcacttctgctagcgatccagaaaccagattgaaattatggaaaggacgtaaagctgcttttgctgcggctgggcatttaagtccagattattatgtgcaagatggtgtaattccccggactcagttgccttttgttctgcatgaaattgaggcattaagcgaacaatatggttatcgtgttgctaatgtatttcatgctggtgatggcaatcttcatccattaattctttatgataattctgtgcctggagcattggaacaagtagaggaaatgggtggaaaaattctcaaactttgtgtccaagttggtgggagtatttctggtgagcatggcattggtgcagagaaaaagtgctatatgccacagatgtttagcccagttgatttagaaactatgcaatgggtacgacaagtttttaatcccaaagggttagcaaatcctgaaaagatattccccacaccacgaacttgtggtgaagcagcaaatgca

SEQ ID NO: 43592 - DNA, 1104 bp, Nostoc punctiforme
gagtctcaaaattatcttgatttagctaagtctttagcaaaagaatttgcccaaactgctgtagagcgggatgctcaagggggcacaccaaaacatgaacgcgatcgcttgcgccaaagcaacttactgaaactgatcgtacccacagaattcggtggtttagggcaaagctggattactgttctgcaaattacccgcgagtttgccaaagttgatagctctattgctcacgtcttttcttaccaccatctaggtgtagtaatccctcatatctttggttcagcacagcaaaaacagcgatattactcagaaactattcacaacaattggttttggtgcaatgctcttaacccattagataaaagaactactctgacaccagaaaatgattatttccgtctcaacggcattaaaagcttttgctctggctctcaagactcggatatattgccgattactgccactcatcaagaaactaatgaattgaatattctggtaattcccacccaacggcaaggcgttacagttcatgatgattgggataatatggggcaacgccaaacagacagtggtagtgttacttttgaaaatgtgttggtataccctgaagaaattcttggtagtagaaacaaagccaatcaacccttcaatactattcgtgcctgcttgactcaattgaatcttgctaatatctacctgggaattgcacagggagtatttgaagctgctaaaacatatacttccactaataccaaaccttggctgacatcaggtgtagagagtgcaacccaagatccttacatccttcagcactatggcaaaatctgggttgatctccaagcagccgtgtatcttactgagcaggcgggagaattactacaagcagcttgggagcaggaatggtcacttaccgccgaacaacgggcagaatgtgcgctcttagttgctactgccaaagtcttcgcaactaaagttggtttagacattaccaaccgaatatttgaagttatgggcgcacgcgctactagtgccaaatatggctttgatcgttattggcgtaatctccgcacgttcactttgcacgatccagtagattacaaaatc

SEQ ID NO: 43593 - DNA, 1428 bp, Nostoc punctiforme
tctccttccgaagctgaaggattgggtaaagggatcgaaagcagttttggactgaatttaatcccactaccggcaaatcctttatttggtaccgatgggattcgcgggcgagtcggagaattgctgagtgcgcccttagcattacaagttggtttttggacggggattgttttacgtaaccatgctactcaaataggaccagtcattctcggacaggactctagaaactccagcgatatgctagcaatggctttgagtgcagggttaacagcagcaggattagaagtttggtatttgggattatgtcccactccttgcattgcctatctcaccagcatcagtgatgcgatcggtggagtgatgatttctgccagccacaatcctccagaggataatggaattaaggtttttggtgcaaatggtggaaagctaccgcaaatattacaggcagaaatagaagcgggactgcgtgggaaaatatcacctattgctaaagttagcaattgcggacggcattactcacgttttgagttagtggggcattatggcgacgcgttaaaaaaacccttaaacagtaccctcaatcttcagggaatgaagattgttttagacttggcgtggggtgcagcagtcggattagcaccgtcagtatttacagaaatgggggcagaggtaatctgcttgcataacgaagcagatggtgatcgcattaatgttaactgcggttccactcatttagatattcttgccgctacagtccaagaacacaacgccgacatcggctttgccttcgatggcgatgccgatcgcgtcttagcagtagacaatactggcaggcaagtgaacggcgattacattctctacctgtggggacggcatttacaaaaaaaccaacaactaccagacaacctgattgtatctacagtcatggccaacttgggctttgaaaaagcttggcaacaaattggtggtaaattaattcgtaccgccgtcggcgatcaatacgtacaagccgaaatgcagcgaactgggggaatgttaggcggcgaacaatcaggtcatattctttgccgtcattatgctgtaactggagatggcttattaacagccttgcatatggcagctttggtgaaagaagcgggtgtttctctagcagaattagtagatcaaagcttccagacatatccgcaaatattgcggaacgtgcgagttacagaccgcgatcgccgtttggggtggcaagattgcgaaccggtgcaacaagcgatcgcccttgctgaagcggcaatgggtgattctggtagaatcttggttcgcgcctctggtacagaaccagtaatcagagttatggtagaagccgccaatgccgaacttaccaactactggacaaatgaattagtttcaaaagtccagcaacacctgatggac

SEQ ID NO: 43594 - DNA, 977 bp, Nostoc punctiforme
ttaggcatagcaattaccggaagtggctcggcagtaccagcaacttccctacacaaccagacattaactgaactagttgaaacatcagacgagtggattgccacaagaacgggaattcgtcaacgacgattagcggtgtcatctgagtcgttaagtggactagctactgctgccggcagtcgagcgatcgcagcttcaggaattagaccagaagacctagacatgattttgctagcgacttccacccctgagatttgtttggtagtgcttgtcaagtacaggctcaattatgagccaccaacgcagtcgcctttgacttgacagcagcctgctctggctttgtgtttggtctggttacagcagcccaatacattagaacaggtgtctataaaaatgtactgttgataggggcagatatcctctctcgctgggtagattggcaagatcgtcggacttgtgtactattcggcgatggtgcaggagcagtagtattacaggcttctaaaagcgatcgcttattaggatttgcccttaaaagtgatggcactcaaaaccatcacctcaatcttgcttatgcaggcgcttcccaagaattgctccctggtgtaaacatcactaaaggcacttatcaacctattactatgaacggcaaagaagtctaccgctttgctgtgcaaaaagtcccagaaatcatagataaagccttatttcaagctaaccttaaggttgaccaaatagattggctagtgttgcatcaagctaatcagcgcattattgatgccgttgctcaacgcctaaatatcccagaacataaagttataagtaatctcgcccagtacggcaatacctcagctgcttccatccccttagctttagatgaagcagtacgacaaggtaaaattaaaccccatgacatcgttgcgacatccggctttggtgccggtcttacctggggcgcggcaattttccaatgggga

SEQ ID NO: 43595 - DNA, 867 bp, Nostoc punctiforme
aaaactgcatgggtgtttcccggacaaggatctcaaacgctgggaatgggaatagacttattagatatacccttcgctaaagacaaatttgcccaagccgaggaaatcttgggctggtctgtaaccaaaatctgtcaaaacgaagaagccaagttatcacagacgctatatactcagccaagtctttatgtgatagaaagcattcttgcagatcttctccaagaacgaggacaacagccagatttagttgctggccacagtttgggagaatattctgccctttatgtagcgggtgtctttgagtggtcggctggtttatatctagtaaagcgtcgtgcagaactcatggataatgccgtgggtggaatgatggcagctttgatgaactttgaccgcgaacagttagaaaaagtcattgcccacacgcctgatgtggttctagcaaatgataatagttcggctcaggtggtaatttcaggcacaactgaagctgtacaagcagtgatgactcaagttaaagccaagcgtgctattcccctaaaagtttctggagcatttcattcacatttaatcgcaccagcagcggctgaattccaaaacattttagaatctgtggaatttcaaccagctactgtgccagtcttatctaatgtagaaccaattccgtctattgatgccgagattttaaagcagcgcctcaacaaacaaatgactggttctgtacggtggcgtgaaatttctttgcaattaccagctaacggtatccagcgagtagtagaagttggccctggtaaagtcttaactggcttgattaaacgtagcagccctgacttaatattagaaaatatccagagtggtgctgattta

SEQ ID NO: 43596 - DNA, 1809 bp, Nostoc punctiforme
atgggaaaagttattggaatcgacttaggcactactaacagttgcgtcgcagttttggagggcggtcaaccactggtgatctccaattctgaaggtggacgaactactccaagtattgtgggatttggcaagagtggcgatcgcttggttggtcaattggcaaagcgccaagccgtaaccaatgccgaaaacacaatttacagtattaaacgatttatcgggcggcgttgggaagacactgacacagaacgcgaacgtgtaccctacaactgtgtcaaaggtcgagacgataccgttgatgtccaaattcgctcaaaaaactacacaccacaagaactatccgccatgatcctgcaaaagctgaagcaggatgcggaaaactttttgggtgaagaagtcactcaggcagtgatcaccgtacctgcatattttacagatgctcaaagacaagctactaaagatgctggcacaattgccggattagaagttctgcgaatcatcaatgaaccaacagctgcggctttagcttttggattggaaaagcaagaccaagagcaactaattttagtatttgacttaggaggcggtacttttgacgtatcgatcctgcaacttggggatggcgtttttgaagttaaggctacttgtggtaataaccacttaggtggagacgactttgataatgcgatcgtgcgttggctgatggaacgcttccagcaacaagagaaaatcgacctttcccaagataagatggcactgcaacgcctacgggaagcagcagaaaaggccaaaattgaactctccagcatggtgaatacttccgtcaatctgccgttcatcacatctgatgagaccggcccaaagcatctagaaatggagttcagccgctctaaatttgaggaactggcagggaaattaattgaaggtactatcgaaccaatgatccaagcactcaaagatgcggatctgaaaccatcagccatagatcggattattttagtaggtggttctacccgaattcccgcagtccaaaacgcgctgattaagtttttcaatggcaaagctcccgatcgctctatcaaccctgacgaagcggtagcattgggagcagctatccaagcaggggtcttgggtggggaagtcgataatcttttattgttggatgtcacccccctgtctctgggaattgaaaccttgggtgaagtattcaccaagattattgaacgcaacaccacaattcctactagtaagtcacaaattttttccacagcagttgatggacaaacctcggtagaaattcacattctccaaggtgaacgggcaatgtcacgggataacaagagtcttggcaagtttcttctagcaggcattcccccatcgccccgtggtgtgccgcaaattgaagtatcttttgaaattgatgtcaacggtatcttgaaggtttctgcccaagacaaaggcacaggtagagaacagagtatcaggattaccaatacaggtggcttgagtactaacgaagtcgaacggatgcgccaagaggccgaactgttttctgaagaagatagaagacgtaaagaactggttgaactcaaaaaccaagcagataatctgttgttcagttacgaatctaccatcaaggataatagcaactttatcggcgagcagatgaagactttggctagtgaaaaagtttcacaactccaagctgcaatgattgactccagcatctcgactgtggaatttaagcagcgcttagacgagttccaacaaacactgtttgcaattggtgctgatgtctataaccgagct

SEQ ID NO: 43597 - DNA, 1086 bp, Nostoc punctiforme
gaagcaacggaagctgaattccgcgtggaaggttacgaaaaaattgagtttagtcttgtctatgtaaatggtgcatttgatatcagtaacagagaaattgcagacagctatgagaagtttggccgttgtctgactgtgattgatgctaatgtcaacagattatatggcaagcaaatcaagtcatattttagacactatggtattgatctgaccgtagttcccattgtgattactgagcctactaaaacccttgcaacctttgagaaaattgttgatgctttttctgactttggtttaatccgcaaggaaccagtattagtagtgggtggtggtttaaccactgatgtagctgggtttgcgtgtgctgcttaccgtcgtaagagtaactatattcgggttccgacaacgctgattggtctgattgatgcaggtgtagcgattaaggttgcagtcaaccatcgcaagttaaaaaatcgcttgggtgcatatcatgctcctttgaaagtcatcctcgatttctccttcttgcaaacattaccaacggctcaagttcgtaatgggatggcagagttggtcaaaattgctgttgtggcgaactctgaagtctttgaattgttgtatgaatatggcgaagagttgctttccactcactttggatatgtgaatggtacaaaggaactgaaagcgatcgcacataaactcaattacgaggcaataaaaactatgctggagttggaaactccaaacttgcatgagttagacctcgatcgcgtcattgcctacggtcacacttggagtccgaccttagaattagctccgatgataccgttgtttcacggtcatgccgtcaatatagacatggctttgtctgcaactattgcggcaagacgtggctacattacatcaggagaacgcgatcgcattttgagcttgatgagtcgtataggtttatcaatcgatcatcctctactagatggcgatttgctctggtatgctacccaatctattagcttgacgcgagacgggaaacaacgcgcagctatgcctaaacccattggtgagtgcttctttgtcaacgatttcacc

SEQ ID NO: 43598 - DNA, 1476 bp, Nostoc punctiforme
gacgcaatcgtgattgggtctggtattggtgggttagtaacagcgacccaactagcggctaagggggcaaaagtgctggtgctggaacgttatttgattccaggtggtagcgcaggttattttgaacgccaaggctaccgatttgatgttggtgcatcgatgatttttgggctaggacaaaacggcactacaaacttactcacccgtgctttgacagctgtgaatgttagccaagatgcgatcgcagatccggtgcagattcactatcatctaccccaaggtttagacctgaaggttgaccgggtttatgaaaaatttttgcaaaatcttattgctcattttccccatgaagaaaaagggattcgtcgcttttatgacgaatgccaaaaagtattcaagtgtctcaacagcatggatttactgtcgttggaagaaccttggtatttactgcgggtattttttcagcatcctttggcgtgtctcggtttagttaagtatctgccccaaaatgctggggattttgccagacgctacatcaaagatcctaaactattaaaatttatcgatatggaatgttattgctggtcggtggttccgtcagacatgacaccaatgattaatgctggaatggtcttttctgacaggcattatggtggagttaactatcccaaaggcggagtaggacaaattgcccaaaaactggtggaaggtctagaaaaagctgggggtaagattcagtacaaagctagagtcacgaaaatcctcacagaaaagggaaaagcggtaggtgtgcaactggcgaatggtaaagtatatcggggtaaacgcatagtttctaatgccacacgctgggatacgtttgagcaactactaccagcagaagaaatgccacttaatgagaaaaagtggcaacagaattatcaaaaatctcccagcttcttgagtttacatataggggtaaaagagtcagttttacctgtggggacagagtgccatcatattttgctggaaggttgggaaaagatgacggcagtggaagggacaatttttgtttcgattcccacattgcttgacccagatttagcgccaagtggatatcacatcattcatgccttcacgcctcactggattgatgattggcaagaactttctccaagcgagtacaaagcgaagaaagaagaggcggctgggcgaattattgaccgcctagagaagatttttcctggcttagatgctggattggattatctagaggtaggcacaccccgcacccatcgccgctttttgggtcgtcaggatggcagttatgggccaattcccaggcgtaagctgcgggggttattgaagatgccctttaatcgcacagccattccaggactttattgtgtcggggatagtacctttcctggtcagggattgaatgcagtagctttttctgggtttgcttgcgcccaccggattgctgtagatttagga

SEQ ID NO: 43599 - DNA, 855 bp, Nostoc punctiforme
attacgggtaaaaccaaactgctaggggtaattggacatccggtagaacattcgctgtcgccagcaatgcataatgctgcgattgctaatttaggattagattatgtttatcttccctttcccatagcaccagagaatttagaagtagcgatcgcaggctttgccgttattggtgttgtcggctttagtgttacaatcccgcacaaacaggcaatcatgcccctgctctcagaaattacccctcttgctcaaatgataggggctgtgaatactgttagtcgccaaaataaccaatgggtggggacaaacacagatatagaaggatttatcgcccctttgcagacaacctataagcaagattggagtcagaaggtagcggtaattttaggtaatggtggcgcagcgagagcagttgtagcaggttgtcaccaactaggttttgccaaaattcatgttgttgggcggaatgtgcagagattacaagaattccgcgatagttggagcaattcacctataagtgaaaatttgcaagttcaccaatgggaggaactttcaaagctaattccccaagctaatctgctggtaaacacaacccccatagggatgtatcccaaggttgatgagtcgcctttgagtatagaggaaatagcgaatttaccaacgggtgcgatcgcttacgatttaatatatatccctaaaccgacgcaatttctagagcttgctcaaaaacaaggtgcaattgcgatcgatggcttagaaatgctagtccagcaaggggtagcagcattaaaaatttggttgcagcaggaaaatatacctgtagaagtgatgcgccaagctttactaaatcaactt

SEQ ID NO: 43600 - DNA, 923 bp, Nostoc punctiforme
tcccgtgttttgtgcctcggtgaaattttgtttgattgtttagccgatcaattagggttaaagctggaagaagttaaatcctggactccctatccaggaggggcaccagctaacgtagcctgtgctttagtcaagctggggacgacagcaggatttatcggagccgttggtgaagatgaaccaggaaatgcactggtcaagctattacaagatgtaggtgtagatacgacgggggtacaacgccaccctacagcaccaacgcggcaggtttatgttacacgggatctggctggcgatcgcaccttcgccggatttggtcagtatgacaccgcagaatttgccgatactcgcctgcaagccaaacaattgccagatgcgctgtttcaagaggcagattttctggttttgggtactttggaattagcctatcctgaaagtgaacaggcaatttaccgcgccctagagttagcagaacattacgatctgaagattgttctagatatcaattggcggcctgtatttggacgagccaaaaatcgctcatcaaaaaattccagaattatttaagcgagtagatttcctcaaactctccaaagaagaagctgaatggctatttgaaaccgcagattcctggagccattacttaccgcttggcttcaattgaaggagtattagtaacagatggtgaaaacggttgtacctactgtctgggtgagaacgaaggcaaattaccttccttttccatccccgtagttgataccactggtgcaggagatagctttttggcaggatttatccaccagttgagtcattacggcatccacagcttgcgagatgctgaaactgcaaaacgcatcgtcacttatgccagtgctgttggggcattgactaccattaaaccaggtgcgatcgcttcccaacca

SEQ ID NO: 43601 - DNA, 795 bp, Nostoc punctiforme
gaacagatattacaagatcgttatcaaatccaacaccaacttggtaacaatggaattcgtcaaacttggcttgcaaaggatttactagcctctgatggcgaaaattcgaccgttgtggtcaaacttttagcctttggcggtactatacagtgggatgatttaaaactttttgagagggaagcacaaattcttaaaacaataaatcatccccgcattcctagatatatagattatttttgtatagacgatcgcactctctggtttggcttaatacaacaatatattcctggtgagtcgcttaaagaaaaacttgctcttggcaaaaggtttactgaaaagcgagcgagaaaaatcgctggtgagattttaaatattctcatgtatttacatgagttaaacccaggggtgttacatagagatataaaaccgagtaatttaatatggggcgaagataatcggatttatttagttgattttggcgcagtacaagataaagcggcaagagaaggcgttactttcaccgttgtgggtacttatggttatgccccaatggaacaatttggtggtcgagcagttccagcttccgacctttatgcactgggtgcgactctgattcatttgcttactgggacttgcccctctgatttacctcagcaggatttgcgactgcaatttgcagaccgagttaatctcagtcctagttttgccagttggctacaaaagttaatagaacccgctcccgaacaacgatttcctgatgcccgccaagcgctgaatgctctcaaatctggtctg

SEQ ID NO: 43602 - DNA, 627 bp, Nostoc punctiforme
tttggcaaaaagcaagttatgcccacaccagaagaagctttgtcaggaagggcacagtctatgtcagtacctgctgctcattatgtcaacaagaatccgttaaaagctccttatcccgatggattagagaaggcaatttttggcttgggctgtttttggggtgcagaacgcaaattctggcagcttaaaggagtttacaccaccgcagtgggttacgctgctggatttacacccaaccccacttatgaagaggtatgtagtgggcgaacaggtcacaatgaagtggtgttggttgtgtttgatcccaaagtaattagttattctgaactgctcaaagtcttttgggaaagccacaatcctacccaagggatgcgccaaggtaatgatgctggcactcaataccgttcgggaatttatgtatattctgaaagccaaaagcagctagcagaagcatcacgagaagcttatcagcaagctctcaacgatgcaggttatggcaagattactacagaaatcttagatgcaccagaattctattacgccgaagcttaccatcagcaatacctggctaaaaatcctaatgggtattgtggtttaggagggacaaatgtttcttgtcccgtgggt

SEQ ID NO: 43603 - DNA, 990 bp, Nostoc punctiforme
caaggttttagcgcatttattactaatttaggaatacgcgatacaactgatgattttgtatttattaaatcagaagttccttgtgttgctgatggagtcttcactcaaagtcttttcgccgggccaagtgttactattagccgcgacaacttaaaagattcacaagtacaaggaattgtcgttatatctaagaatgcaaatgtcgctaatggtgcagttggcattgctgatgcccaagaagttttacaattagttgcaactgaaactggaattgctgcacataatatggtgatagcttctacaggcgtaattggcaggcgttacccgattgaaaaaattcgagcaggtttattaggattgggcaaaaaattgactcctgctgattttaatgccgcagcccgtggtattatgaccaccgatacagtatcaaaactagctacacgacaagtaggaaatgccaagctggtaggaattgccaaaggtgttggcatgattgagcctaatatggctactctcttaactttcttttttactgatgcggcaatttctgcaaatagccttcgttctatttttcgctctactatagataaaacctttaactgcttgagtgtagacactgacacttctactagtgactccgccgtgattctagctaatggaatagccggtgaagtttcagaggcggattttgccagcgcattgcaagaagttgcacaagaattggtgctgaaaattgccagagatgcagaaggtgccaccaaaattattgaggtgactgtagattcagctattaactatgtacaagcgaaaaaagtagctaaagcaattgtcaattcaccattagtaaaaaccgccgtctatggggcagatccgaattggggacgagttgcgatggctataggtaaatgtgaaaatgaacagcagatcaatccagaacgagttgttattagttttgatgacgtgaaagtttatcctatagcaatcctaaat

SEQ ID NO: 43604 - DNA, 1596 bp, Nostoc punctiforme
ctattgcgtacttcttctcttcagctctgttttgcaattttagctggtattttcagcggcggcactgctgctggtctaattgccctaattaatacgacattgagtcaaaatcagccatcaaaaactatactaatttggagttttgtcggtctttgtttactgcggttaattgctaatttcgtttctcaagttttattgatacaactttcacaaaaagcaattctcaatttgcgggtacttttaacccgcagtattcttgcctcgcccttacgtcacttagaacaaataggtgctcatggacttttagctgttctcactgaggatattcaaacaatctctaacacagttattactgtcccttttgtgtgcattaatattgccatcgtgattgcctgtctgatttatctgagttggttatctaaaattgttttcctcataggtattagctttatgttcctgggaatattcagctattcactaccaatgatgaaagccatgtcttttttaaaattggctcgtgagcaagaagatagattatttaagcatttccgtagcgtcattcaaggcacaaaagaactcaaactacatcgccgacgacggcaagcatttctctctgaagaactccataccactgcttcatcattccgccgtcataatgttgtgggtatgagtatctttgctgcggctgctagttgggggcaagttctattttttgttgctattgggttacttttattcatcatccctactatcaataaaattccacctgcaattctatctgcttatgccctaactattatctatttgatatcacctctagagtatattatgagtatgatgcctagcataactaaagccttagtagctttaaaaaaagtggagtctctgggtctatcattagcaagttattcaaacgaaatttgtgataatgtttcactggcatcagatcaatattggaactgcttagaactggtaaatataacccatgcttattatcaagaacgggaagaaagcaactttatccttgggcctattaaattaaaatttcatccaggagaacttgtttttattgtaggaggtaacggtagtggtaagtctaccctcgctaagttaattagtgggctttacattcctgaaacaggaaatatttatctagacgatcagctcattgataatcataatttagagtggtatagacagcaattttctgtagtattttccgatttttatctttttgatcgcttcctgggtttggatagtggcgatctggatattcagactcgaaagtaccttattgaattgcaattagaccataaagttaaggtcaataatggagtactttctaccacggacctttctcaaggacagcgcaaacgtctcgctctagttactgcttatttagaagatcgtcccatttatatgtttgatgagtgggcatcagatcaagatcctgtattcaaggaaattttctatactcaacttctggtagagctaaagaagagaggaaaaactgtactagttattagtcacgatgaccaatatttttacctggcagatcggattgtcaagctggaatacggccaagtgaaaactgaa

SEQ ID NO: 43605 - DNA, 1449 bp, Nostoc punctiforme
atgactgaaccccaaaacttgacaactgctgatggtattccagttagcgataaccagaactcactcactgctggagcgcgtggccctgtattaatccaggatttccaccttatagaaaagctggctcatttcaacagagaacgtattcctgaaagagttgttcacgctaaaggtgctgctgctcacggcactttgactattaccaatgacattacccgctacagtaaagccaaacttttttctgaaattggcaagaaaacggaacttatcttgcgtttttctacagttggcggagaaaaaggttcagcagatgccgagcgtgaccctagaggtttttccctcaagttttatactgaggagggtaactgggatcttgtaggtaacaatacccctattttcttcatccgcgaccctttgaagtttcctgattttatccatacccaaaagcgcaatccgcaaaccaattgcaaagaccagaatgcaaagtgggatttttggtcactcagtccagaatcgcttcaccaggtgacgatcctcttttcagaccggggaattcccaaaacccatcgacacatggacggttttggtagccacaccttcagtttaattaatgccgagggcgatcgcgtttggtgtaaatttcactttaagacgctgcaaggacatcaaaccttgacagaggaagaatccgctaagattaagggcgaagatcccgatcatgcgactcacgatttgtttgaagcgatcgctaaaaaagactatcctaagtggcggatgtgtattcaggtgatgaccgaggagcaagcggaaaaacatcctgacaatccttttgacttgaccaaagtttggaaacaaggcgaatatcctttaattgaagtcgggatattagagctaaatcgtaacccagagaattattttgccgaagttgagcaagccgcttttagccctagtgcagtggttcctggcgttagtttctctccagacaaaatgctgcaagctcgaattttttcttacccagatgctcaacggtatcgcttgggtggtaactatcagcaactacccgttaaccagcccaaatgtccagtgatgcattatcagcgagatggctttatggcatcggggaacaacggcggtagcgttcctaactatgaaccgaatagtgctgagggtacgcccaaagaaaatccagcttatgcagaaccacctagtcatttgggcgatgtcacagtcgatcgttacagtcatcgtgaaggaaacgacgattatactcaagcaggtaatttgtatcggttactaactcctgagcagcaggagcgtcttgctaaaaatattgtcggcagtctctctcaagcaagagaggacatccaaatgcgtcaactttgccacttcttccgggcagatgtttcttatggtcgtcgtgtagctgaaggattgggcattgcgatcgat

SEQ ID NO: 43606 - DNA, 804 bp, Nostoc punctiforme
cgtcactcctacgttttagcaattggaggtggagccgtcctagatatggtaggatacgcagcagcaacggctcatcgaggaattcggctgctacgagtaccgacaacagtattagggcaaaacgattcgggtgtaggggtaaaaaacggaatcaatgctttcggcaagaaaaactttttgggtacattcatgccgccttatgctgtcttaaatgactttgattttctgactagccttgacgatcgagattggcgatcgggtattgcagaagcggtgaaagtagcgctgattaaagatgcagatttcttcgatttcattatgactaatgccgataaattggctaatcgggatatggacataatggaaagattgatctatcgctgttcgcaattgcatttagagcatattgctggtggcggcgatccatttgaaatgggttcatcgcgtcctttggattttggacactgggctgctcataaactggagcatttaactaattacagtttacgtcacggcgaagctgtagcgatcggcattgctttggatacgacctattcatatttaacaggtcaactcttgaaatctgagtggcaaagtgttctatatacgctcagtaagctaggattcacattatacgtgccggcgctgacagagcaattagatcgactagaccatcccgattgtctatttagggggctaaccgagtttcgcgaacacttgggaggaaatttgacaattacccttctagaaggaattgggcaaggaatagaagtccaccaggtggatttgtcgttgtatagagat

SEQ ID NO: 43607 - DNA, 834 bp, Nostoc punctiforme
atggcaatcgaatttactaagtatcatggtctgggcaatgattttattctgattgacaatcgctcgtcatctttgcccgttttgactccagagcaagctatccaattatgcgatcgccattttggtatcggtgctgatggtgtcatttttgctctacctggagaaaacggcactgactataccatgcggatttttaattctgatggttcagaaccagaaatgtgtggcaatggcattcgctgtttagctggctttttggcagatttagaaggtcaatcccgaaataaagattcatatcgcattcatactttgggtggtgtaatgactccccaactcttatctgatggtctagttaaagtagacatgggtttacccagattactcgctggcgaaattcctactactcttgcacctgttgaagaaaaagtaatctctgtgccgttggaagtggcggggaaaacttgggaagtaacttgtgtaaatatgggaaatcctcactgcattacctttgtggaagatgtagcagcaattgaactagaaagcataggcccgaaatttgagcatcacccagcttttccccaacgcataaatactgaatttattcaagtggtacgccgtgactatttgaaaatgcgggtgtgggaacggggtgctgggattacattagcttgtgggactggtgcttgcgcttctttagtggctggtgtgttaaccgggaaatgcgatcgcactgccactgtagaattacctggtggtcccttgcaaattgaatggtcagaaatcgaccaacgggtttacatgacaggcccggctgaacgagtcttcacggggaaa

SEQ ID NO: 43608 - DNA, 846 bp, Nostoc punctiforme
actgccaaactccttgatggtaaagcaatagccgcaaaaattcagcaagaactttctgtagccattacacaattacaaccagaaattggacgaccccctggtttagcagtgttaatggttggcgacaacccagcgtcagccgcttatgttcgtaataaagaaaaagcctgtgcaaaagttggcatcgcctcttttggtaagcattttcctgccgaaacgacctttagggaattagaaaaggttattgctgcactaaacgacgatgaacgcgtggatggcattcttgtacagttgcccttacctgaccacttagatgctgtggctctgctacatcaaattgatcccgataaagatgctgatggactgcacccagttaacttagggcgactagtacggggagaaatcggtttacgcagctgcaccccggatggtgtgatgcggcttttgcaagaatatgagattccattgcaaggaaaacaggcagtagtggtgggacggagtattttggtgggtaaacctatggcgctgatgctactagaagctgatgctacagtgacgatcgctcactcgcgatcgcatgacctcaaaagcatcacccaaaatgctgatattctaattgcagcagcaggtcgtcccggactcatcactgctgatatggtaaaaccaggcgctgttgtggtagatgtgggaatgaatcgtgtcaccgatgctagtggtaaaagtcgcttaattggcgatgttgactttgaatcaactgctggtgtagcaggtttcatcactcccgttcctggtggtgttggtccgatgactgttgccatattgttacaaaatacattcaccagctat

SEQ ID NO: 43609 - DNA, 930 bp, Nostoc punctiforme
atggtagcaactgataacgttcaaaagacaccaccagaggaagccacatttaacttagtagcctatctcaaagagcgacaaaagctttgtgataatgctttggatcgggctatccccatcatttatccagaaaagatttatgaggcgatgcgctactcgttattagctggcggcaagcgtgtacgtcccattctttgccttgctacctgtgaaatgatgggtggcactatcgaaatggctatgccaacggcttgtgctgtggagatgatccacacaatgtctttgattcatgacgacctcccagcgatggataatgacgattaccgtcggggaaagctgacaaatcataaagtctatggcgaagatgtagcgattttggctggggacggcttgttagcacttgcttttgagttagttgcccttaaaacccccgcaaacgttaacagagagctaaccttgcaggtcattgttcgtcttggtcgggcgctgggggcagctggtttggtcggtggtcaagttgtcgatttagagtgtgaagggaaatcagatatttctctagaaacgctaaatttcattcatagacacaaaacttccgcccttttggaagcttgcgtagtttctggcggaattatcgctggggcatcaactgaagatgtacagcgactaacccgttatgctgaaaatattgggctagcattccaaatcatagatgatattctggatatcacttctacaaaagagcaattaggtaaaacagctggtaaagaccaaaaagcgaagaaagttacctatcctagcctttggggacttgaagaatcgcgcttaaaagcccaagagctagttaaagtagcttgtgcagaattagaaccatttggagacagagccaagccactccaagcgatcgctcattttattaccagccgcaataac

SEQ ID NO: 43610 - DNA, 834 bp, Nostoc punctiforme
atgacaaatcaagctcctatcccggttattgtcaacggtgctgctggtaaaatgggccgtgaggtgattaaggcagtggcgcaagcccctgacttaaacctagtgggtgcaattgaccacagtttagaacatcaagataaagacgctggagaattagcgggtttaagcgaacccctggaagtgccaattaccaatcaattggaaccgatgttagggtatgtagctggcgacagacagtctcctccaggggtaattgtagactttactcatcctgattcagtttatgacaatattcgtagtgcgatcgcctacggtattcgtcctgtagttggaaccactgggttaagtccagaacaaattcaagacttggcagactttgccgacaaagctagcactggttgtctaattattcctaatttttccattggtatggtgctgttacaacaagccgcgatcgcagcctcaaaatattttgatcatgtggaaattattgaactgcatcacaaccaaaaagctgatgctcccagtggtactgccattcaaacggcgcagttactaggagaattgggtaaaacttttaaccctgctcttgtagaagagacagagaaattaccaggagcgaggggtagcatagcagatgaagggattagaattcatagcgtgcgcttgccaggactgattgctcatcaagaagttatttttggcgcagcaggacaaatttatactttacgacatgacacgagcgatcgcgcttgctatatgccaggagtgctactagcgattcgcaaagtcttagcgctaaagtcgttagtatatggattagaaaagatactt

SEQ ID NO: 43611 - DNA, 1524 bp, Nostoc punctiforme
atgaaattggcttactggatgtatgcaggcccagcccacatcggcactctgcgaatcgctagctcttttaaaaatgtccatgcgatcatgcacgctcccattggcgatgactactttaacgtcatgcgctccatgctatcgcgggagagggatttcactccggtaacaaccagtgtcgtcgatcgcaacgttttggcacgcggctcccaagagaaggtagtagataacatcgtccgcaaggatgccgaggaacacccagatttgattgtgttaactcccacctgcacctccagcatcttgcaagaggatttgcacaactttgtcgaacgggcgcagttggaagcgaaaggagacgtaatgctggcggatgtaaaccactaccgctataacgaactgcaagccgccgatcgcactctcgatcaaattgtccaatactacattgaaaaagcccggaagcggggcgaattagctgagggcaaaactgcaaagccctcggttaacatcatcggtactactaccctcggtttccacaacaatcacgattgcaccgaactcaagcggctgatggctgatttgggaattaaggttaataccttgattcctgaaggtgcttcggtgaatgacttgaaaaagatgtcccaagcttggtttaacctggtgccttaccgtgaactcggtttgaccacagcgcgttacctggaagaacaattcggcacaccttatatagacattactccaatgggtgtagtggaaactgcccgttgtattcgcaagattcagcaggtaattaacgctcaaggtgcagaagtcgactacgaaaacttcatcaatgaacaaaccctccatgtctctcaagctgcttggttctcccgttcaattgactgtcaaaacttgactggcaaaaaagctgtggtctttggtgacaacacccacgccgccgccattactaagattctggcgcgagaaatggggattcatgttgtttgggctggaacctactgcaaatatgatgcaggctggttccgcgaacaggttagcgagtattgcgatgaagtgctaatttccgaagatcatggtgaaattggggatgcgattgctcgtgtcgaaccctctgccattttcggcacccaaatggaacgccacgttggtaagcgtttggatattccctgcggcgtaattgctgcaccaatccacgtccaaaacttccctattggttacaaaccatttatgggttacgaaggcacgaatcaaattacagatttaatctacaattccttcactttgggaatggaagatcacctgttagaaatcttcggtggtcacgataccaaagaagttattactaggggaatttctgctgattctgatttgaattggacaaaagatggtcaagcagaattgaataagattcctggatttgtgcgcggcaaagtgaagcgaaatactgagaaatttgcccgcgatcgcggtttcaaagaaatcaacgctgaggtgttgtacgccgctaaggaagctgtgggggcg

SEQ ID NO: 43612 - DNA, 741 bp, Nostoc punctiforme
atgacaggtaaattaaaagaacaagtagcaattatcactggggcttcagcaggaattggagaagcaactgcgatcgcattggcggcagaaggagcaacagtagtattggctgctaggcgtggcgatcgcattcaggcattagcagaacggattgaagctagtggtggcaaggcattgcccattgtcactgatgtgactgatgaaaaccaggtaaatcacttggtggcaaaggcaaatgtcgaattgggaagggtcgatatccttgtaaataatgcagggattgccttactcggaaccattgaagctggaaatagctcagactggcggcgatcgttcgacatcaacgtactgggactgctatatgctacccacgctgttttacctctgttgaaggcgcaaaaatcggggcacatagtcaatatctcctcagtggcaggtcggacagcacgggcgggtgtgggtgtttataatgctactaaatggggcgttaatgccctctcagaagctttacgccaagaagtccacaaggacaacatccgcgtcaccattattgaacctggtttagtggatacggaaattgacaaccaaattaccgatccagttgccaaacaacgcattgaggaacggcgcaaggcaattacacctctgcatagtgaagacgttgctgctgcgatcgtttatgccgtcacgcaaccgtcgcgcgttaatgtcaacgaaattcttatccggccaacgggacaa

SEQ ID NO: 43613 - DNA, 1206 bp, Nostoc punctiforme
ctacgggttgctgttattgggtcaggccctgctggttcatctgccgcagaaacactggcagcctctgggattgaaacctacctatttgagcggaagctggataatgcaaagccttgtgggggcgcaattcccctatgtatggtgagtgaatttgacttaccaccagagattatcgatcgccgggtacggaagatgaaaatgatttcgccttccaatcgggaggttgatatcaatctgataaatgaagatgaatatataggaatgtgccgccgggaagtgctggatggctttttgcgcgatcgcgcggcaaaattaggcgcaaatttaattaatgccactgttcataaacttgatataccaggaaacaataccgatccctataccatccattacgttgaccatacagaaggtatatcacaggggattgccaaaaccctgaaggtggatttaatcattggggcggatggggctaattctcgcgttgccaaagaaatggacgctggggattacaattatgcgatcgctttccaagagcgaattcgcttacccgaagacaaaatggcctactataacgacctcgccgaaatgtatgtcggtgatgacgtttcgaccgatttctacgcttgggttttccccaaatatgaccacgtagctgtcggtactggcacaatgcacatcaataaagccagcatcaaacagttacaagctggtatccgcgcccgtgcttccgaaaaattggcaggcggtaaaatcatcaaagtagaagcgcaccccattcctgaacatccccgtccccgtcgtgtcgttggtcgcatcgctttggtgggagatgctgctggttacgttaccaagtcctctggtgaaggtatttattttgccgctaaatctgggcggatgtgtgccgaaaccattgtagaagcatctaacagtggtagccgtattcctacagaaggcgacctcaagatttacctgaagcgttgggataaaagatacggactcacctacaaggtgttggacattctgcaaagtgtgttctatcgttccgacgctacccgcgaagcgtttgtggaaatgtgtgatgacctcgatgtacaacggctaacattcgatagctatctgtataaaacggttgtcccagctaatcccatcacccaattgaagattactgccaaaaccattggtagtctaattcggggtaatgccctt

SEQ ID NO: 43614 - DNA, 1026 bp, Nostoc punctiforme
ctaagtgcaagtgcaaatgtcaattctccccttcggcaattagcagctgccaaagggaagctttatggcgcagcagtttctagtgaatttttgctacaagagaagggttacgctgacctaattgctcgtgaatgttcgatagtgacaccaaatggtgaattaaaatggaacgccactgaaccacagccaggaaaatttacttttgagtcagcagatgcgatcgctggtttctgccaaaagcataatatacaattgcatgggcatacccttttctggcacatgggaaaaccagactggctaccttacccccccactcttaaaatgctagaacgccatattaaaggagttatggggcattatcgcaatagccctgttttaaagtcttgggatattgccaatgaaattatcgctgatagtgaaaatgaaactgataatgctacctacggtttgcgtaaaggggtaaaacgagaattaattcgagatttgtttttaattgcggcttcagttgataacaccaagaaattttacctaaacgatttcggcatcgaaggcgctacatggaaatcagatcgtttcttaaaaatggtcgaatatctgaagaatagtgacgttaaaattgatggtgcaggtatacagtcacatctatggttttctactgcttatggttttgataagaaaggatttaattctgtcttaaaacggcttaacgatcttcaagttaaaccaataatcacagaattagacattatcattgatgccccactgcctgatagtattaaaaagctagatcagatggtagccgacagttacaagcgatatcttgacctctgctttgcggctggagttgatactgtaattacatggggaatcaccgaccgtcatacctggatacgtcatcccgactggatgccaggaaaaacctttagaaacaatccaagtctttggaaatttctgcgtccacttcccttcgatgaaaacctgcaacctaaacttgctcgcaacgctattgcccaggcttttcagcaa

SEQ ID NO: 43615 - DNA, 456 bp, Nostoc punctiforme
cggttcacttgtatgagtgcaattcaagttgtaaacttactcaactcgattttctcaactttcgatcgcctcactgaacaacatggtttgaagagaatcaagactattaacgatgcttatatggtagttggtggcttacctacacgccgcccagatcatactcaagcgatcgctctatttaatactgaaaataaccaaaacttcaacaaccgtatcggcatccatagtggttccgtagtggcgggagtaattgacctcaacaaatttgcttacgatctctggggagacacgctaaacatcgctagccgcatggaatctcaaggtattgttggtaaaatccaggttacagaagatatttataagtccttgtgtaataaatttttatttcaaaagcggggtgaaatcgaagttaaagggaaagggaaaatgacaacttattttttggttgggcaaaag

SEQ ID NO: 43616 - DNA, 523 bp, Nostoc punctiforme
  unsure (1)..(523): unsure at all n locations
gttggcgaagacctgacgcgaagactcctcaaaacaccaaagcgagtggccgaggcaatgcggtttcttaccagtggctacaaccaatcccttgaagaactcgttaacgatgccatctttgatgaagggcataacgagatggtactagtccgagatattaatttttttagtctgtgcgaacaccacatgctgccatttatgggtagagcgcacgttgcttatatccccaaccaaaaagttgtaggactgagcaaactggcccgcattgttgagatgtattcccgtcgcttgcaagtccaggagaggttaacccgccaaattgccgaagcaattcagacaattctagaacctcgaggcgtagccgttgtgatggaagctagccacatgtgtatggtaatgcgaggcgtacagaaaccaggttcttggactgtcactagcgcaatggnttggcgtgttccaagaagagcataaaacccgcgaagaattttttaacttgattcgccatcaaccaacattcttttag

SEQ ID NO: 43617 - DNA, 618 bp, Nostoc punctiforme
atgcgcgttaaaatttgcggcatcactcaaccacagcagtctatagcgatcgcttctctgggcgcaacagcgctaggatttatttgtgtaccaaactcacctcgctacgtgactacatcccaaattcgggcagcagtggcagaactcccggcagatattgacacaattggagtttttgccaactctagtattgttgaaatcagccagatagttgttgattctgggttgacgggggttcagttacacggtgatgagttaccagatttttgctaccaattacgccaagctttaccaaatgtcgaaattattaaagcacttagaattcgcagtcttgagcatctgggcacggcggctgattacacaaaatacgtagatactttactactggatgcctaccatcccgaacaacttggtggtacaggtaaaaccttagattggaaaatattagagcaatttaaccccaattgcccttggtttttagctgggggattaacagcagataatattgtggaagctttaagtcaggttagtcctagtggcgttgatttatctagtggtgtggaacgcgcacctggagataaggatttagataaagtaagcaagttgttcgagaaattg

SEQ ID NO: 43618 - DNA, 816 bp, Nostoc punctiforme
atgactataaaatttggtttaattggtggtggggtaatgggagaagcgctcttatcccgccttatcgcgcgtggaatttatcaatcatcagaagtcatagttagcgaaccgctaccttcacgtctagattttttgcaacagcaatacggtgtttctgtgacgacagataatagtgaggttttcacccaagccaaagaagttgtctttttggcagtgaaaccgcaggtgttcagcgcgatcgcacaagaattagcagatattgatattattaatagagaacaatcacccttgataatttccatattggcgggtgtgcccttaaatcagctagaagctgcatttgtgcaattgccagttatcagagcaatgcccaacactccagccactgtgggagcaggaattaccgccatttgtttaggtgcatatactaataccaagcatcaccaaatagcacaacaagttttttctgctgtgggcgaagttgtggaagtctcagaagggttgatggatgcagtcacagggctatctggtagcggccccgcttacgtggcgctgctagtagaatcacttgctgatggcggagtatccgcaggtttacctagagcaattgccaatcaattagcattgcaaaccgtactgggaacagcgaaactgttgtatgaaaccaaaatgcacccagcagaacttaaagatcgcgttaccagtcccggtggtacaactattgccggaattgccaaactagaacaggcaggatttcgttcagctttaattgaagcagtgaaagctgccacagagcgatcgcaagaactgggaaaa

SEQ ID NO: 43619 - DNA, 2616 bp, Nostoc punctiforme
atatttcccttcgatctggatcagtttcaaaaagatgcgatcgcgtccctaaacgctggacgctccgtagtcgtgtgtgcgcccacaggttcgggcaaaacattagtcggggaatacgccatttatcgcgccctatcgcgaggaaaacgtgtattttatactactcccctaaaggcgctgtcgaatcaaaaattacgtgactttcgagaaaaatttgggtttgatcaagtcggactgttaactggagatgcctccattcacagggatgcaccgattttggtgatgaccacagaaattttccgaaatatgctctatggcacacccatcgggcaagtcggcatctcattagtagacgtggaagcggtgatacttgatgagtgccactacatgaacgatcgccagcgcggtacagtttgggaagaatccatcatctattgtcctcgggaagtgcaactggcagccctctcagcaacggttgccaacagcgatcaactcaccgattggttaaatcgcgttcacggcccaacagacctgatttactccgattttcgcccagttcccttggaatttcacttttgcaatcccaaagggttatttcccctgttgaatgatagcaaaaccaaaattaatccccgccttcttcaaaagaagaagagagggggagaaagggacaggggaagaagtggtagaccggaagctcctggcataatttatactttgagccagttagagcaacgggatatgctaccagcaatttattttatcttcagtcgccggggatgtgataaagcggtggcagaagtgggtgatttatggctggtaaataatgaagaatcccagatattgcggcaacagattgatgactttttagcccgcaatcccgaagctgggcgttctggacaaattgcacccctataccgaggaattgctgcccaccacgccggaattttgcctgcttggaaagcactggtagaagaactatttcagcaagggctgattaaagtagtattcgccacggaaacactggccgcgggaattaatatgcccgctcggacaacggtaatttctaccctttccaagcggactgacaccggacaccgcctgttaaatgcttccgaattcttgcaaatggcgggacgggcaggccgtcgggggatggataaacaaggtcatgtggtgacagtccaaactccttttgaaggagccaaagaagcggcgtatttggggacatctaagccagatccccttgtaagccagtttacgcccagttatggcatggtactcaacttgctgcaaacccataccctagagcaaactagggaactgatagagcgcagttttgggcagtacatggccaccttgcatttaagaccagaatacgatgagattgccgaactggaaaaacaattagctcaactacatgagcaaatcgccgcagttgatgaaaatgaactggctatttatgaaaaattgcggcaacgtctgaaagtagaacgccagatattgaaaaccctgcaagagcaagcacaggaagatagacaagaagaattggggatgatgttggactttgcagtgtcaggaactctgttgagtctcaaaggcaaaaacatcacagtgtcttcacccgtaaccgcagtgttagtgggaaaatcgcctggttctggtcaagctccctacttggtatgcttggggcatgataatcgctggtatgtggcaaccacaggggatgtggtcgatttgtatgcagaattgccgcgaattgaggtatcacctgatgtactaccacccccagagatgcctttgaagccaggacagtcacgccgtggtaacgaagaaacctttgcgatcgctacgcgtattcccaatccgatagaatctttgcatctggcaccagaggtagcagaacaactcagtcgcactgctgccgtccaagaacaactagaagctcatcccttacatcaatcaggcaatgctgccacgcttttcaagcgtcgcgccaaatacgtcgaactagaagccgaactcgaacagttgcaagggcaagtagagcaacagtcacaacgtcattgggaagaatttctcaatttaatcttaattctgcaacactttggcgctttagataacttagtacccacacaattagggcgaattgctgccgccattcggggtgagaatgaattgtggttgggtttagtattcgctagtggtgaattggacaacttagatccccaccatttagccgccgccgccgccggtttagtgatggaaacaccccgtccagatagcaaagttaactttgagcttagtaatgaagtggcagaagctttagcaaaattgcggggaattcgtcgccaaatgttccaactacaacggcggtataacgtagcgctgcctatatggttagagtttgagttaattgccatagtagaacaatgggcgctcggaatggagtggacagaactctgcgaaaacaccaccttggacgaaggcgatgtggtgagaattctccgccggacgttggatttattatcacaaataccccacgttccccatctgccagactctttccagcgtaatgcttatcgggcgatgcagttgattgatagattccctgtg

SEQ ID NO: 43620 - DNA, 2049 bp, Nostoc punctiforme
cttttacgacaaatagccgatcaagtaggtattgccttagcccaagcccaaatgttgtatgcagaaactcaacagcgaagagaacttgaggttgctcgtcatcaagctgaattagcttctaaaaccaaaagtgcctttttagcaaacatgagtcatgaaatccggactccgatgaatgctgtgctggggatgacaggtttaatgttagaaactcccctaaactcggagcaacaggattttatcgaaactattcgtattagtggagatgctcttttaagcctcatcaacgaaattttggatttgtccaaacttgaggctggggaaatggcactagaaactctagattttgacttatctacctgtctagaagaggtgttggaattattagctccctcagcccataataaaggattagaaattgcagccttaatctatcccaacgttcccacccaactccaaggcgatgctggccgcttgcggcaaattcttatgaacctgatcagcaatgcgatcaagttcaccagcaatggagaggtagtagtcagagcagaattgcgttcgctttcctctactacagccaccatctattttgccatcacagataccggtcttggcattacctttgaagaccaatgcagactttttaccccatttacccaagtagatgcttccaacacccgcaagtatggcggcacaggtttgggattagccatctgcaagcaactggtaagcttgatgggaggagaaattggggtagaaagtcgattgggtaaaggatctaaattttggtttgaagtcactttcgcccagcaactttacccgatttcctcagaaagcgaacgcgaacttctgattaatcgacgcttgttagtggtggatgataatgccactaatcgcaaaatcatccaccatcaagctacccgttggggaatgctcgtagatcaggctgcttcggctactattgccctcaaagctattgaggagactgccaagcaaaaaaatctctatgacattgctgtgattgatatgcacatgccagaagtagatggcatgaccttgggagagcaaattaaagcaaattcagcgatcgctgggctacctttgattatgctgacctctactaatcaacgcgatgaaatccaacgagcgctaaaaataggatttgcggcttatttggtcaaacctgttaagccgtcccgactcctcgataccatcatgactatcttaggaacgcagataaaggaggagacagaagtcagaagtcaagagttcaaactaaaagattacgaaaacaacagcaacgatcattcttctagctcccgcctcctggctcgtgacttccataaattaagaattctcttagctgaagataatctggtgaatcagaaagttgctttgaagcaactccaaagcctaggttatagcgctgatgttgctggtaatgggaaagaagttttgcagctattagaaaaaatcccctacgatttaattttgatggattgccaaatgccagttctcgacggtttagaaactacaaaagaaattcatcgttggcaagaaagcagctttgtcagtagtcgtcgccctgtagtaattgcgatgacagctaatgcgatgaaagaagatcaacagatgtgtctagatgcgggaatggacgactatctgagcaagccagtaatcaaagaaaaattggcggcggcgctacagcgttggggaagtgtgatattccaggcaaaagaaatatatgttttagagcagaagaaaggttctaaaacagatgtaggttcagttgacctcccaattgattgggaacgcttgcatcaactctcagaaaacaacccagaatttgaattggaactactggaaatatttgttgaagatatgcaacctcgtttagagattattaaaatagcgatcgcagataatgactatgagcagctagcgctccaaacccatcaaattaaaggtgctagcgccaatgttggagctacaaccatgcatctagcagcacaaaaattagaacaattagctcacaatcaagaacgtcga

SEQ ID NO: 43621 - DNA, 1128 bp, Nostoc punctiforme
aatcgtctcaaagatgagttcctcgctgttctatctcacgaactgcgttctcccctcaacccgattttgggctgggcaaaacttctgcaaacccgcaaacttgatgaagcaaagacagcttatgccttagcaaccattgagcgcaatgccaagttgcagtctcagctaatggaagatttactggatgtttcccgtattcttcaaagaaaactcagcctgaagatcagttctgttgatctgtccgccgttattgaagtggcccttgataccgtgcgtctagcggctcaagccaagtcaattgaactcaagacggaatttgaaccgaatatagggcaagttttgggcgatcccagtcgcttgcagcaagtcgtctggaatttgctctctaacgccgttaagttcacagaggatggtggtcaggtggaaatccggcttgagcgcgtgggtacacaagcgcaaatccaagtcagtgacacgggtaagggcatcaatccagaatttctgcctcacgtatttgattacttccgtcaagctgacaataccacaacaagaacctttggcggcttggggcttggtttagcgatcgctcgtcaaatcattgaactgcacggtggagcaatccaagcagaaagtgagggagatgataaaggtgcaacctttactgtgttgttacctatcaagagtgtcgagcctcaaacaagtgaagacaagggtttggctaacgattcccctaatcttgaaggggtaaatgtgatagtcgtggacgatgaagttgacacccgcgaactaatagttttcaccctgcaacagtatggtgcttctgtgcgtgccttcgcctcagcatcccttgcactagatgcttttagggttgagaaaccacatattattttaagtgatattgggatgccagaaatggatggttatatgctgattcgggaaattcgtagacgcgaagcggcttgtcgtcagacatcgctaccgcctgaacaagggggagagattcaagcgatcgcactgacagcttatgctggagagataaacgagtcaaaaattctccaagcaggatttcaaaaacatttgactaaaccaatagaaccagtaaaattagcgatggtaattgctagccta

SEQ ID NO: 43622 - DNA, 1464 bp, Nostoc punctiforme
cgccggacaaaaattgtcgctactattggccccgccactagtagtcctgaaatgctcaaggcgattattgaagcgggagccacgacgctacggctaaacttctcccacggaactcatgccgaccatcagcgtagtattcgcttaattcggcaaaccgcttttgaattaaatcaaccagtggctattctccaagacttgcagggcccaaaaattcgcttggggaagtttgacaacgggtctatagttttggcaaaaggcgatcgcttcaccttgacaaaccgtccggtggtaggtacgcaggaaattagctgcgtcacctacgattatttagccgaagaagtcccagttggtgcaaaaatcctcctcgatgatggacgagtagaaatggtcgtggaggagattaaccgagacaaaggtgatttgcattgtcgcattaccgtgcctggtaaactttctaacaacaaaggtgtaaactttcccggcgtttacctgtcaattaaggcaatgaccgacaaagaccgagaggatctgatgtttggtctagatcaaggtgtagattgggtggcactttcctttgtccgcaatccgcaggacatgatcgaaattaaagaactaatttctagtacaggcaagcaagtgccagtggttgccaaaattgaaaaacatgaagccattgaacaaatggaggcagttctggctttgtgtgatggcgtgatggttgccagaggtgatttaggcgtagaattgcccgcagaagatgttccggtactccaaaagcggctaattgctacagcaaatcgcttagggattcccatcatcaccgccacccaaatgttagacagcatggtgagcaatccccgtcccactcgcgcggaagtgtcagatgtggcaaacgcgattttagatggcacagacgcggtgatgctctccaatgaaaccgccgtcggtagcttccctgtagaagcagtagcgacaatggcgcggattgccgagcggatggagcaggaagaagcccaacacttaaacttgcgttccgtgagagattcccggcgctccattcctaatgcgattagtcaagctgtaggtcaaattgccgaacaactaggtgcagctgcaattatgaccttaacgcaaactggggcaactgctcgcaatgtctctaagttccgtcccaatacaccgattttggctgttaccccccatgtgaatgtagcgcggcagctacaaatggtgtggggagtaaaaccgctattggtgctaggattaccttccactggtcagaccttccaagctgcgattaatgtggctcaggagttgaagttactgtcggagggagatttagtagtaatgactgctggcacactccagggaatttccggctccacagatttgattaaggttgaggtggtgacggcggtattaggtcacggaattggattaggacaaggtttagtgagtggtcgc

SEQ ID NO: 43623 - DNA, 816 bp, Nostoc punctiforme
ttacaaggtggcaaatatgtaattgataaagtccttggacaggggggatttgggattacttataaggcattgcatgttgagctaaaccggacagttgtcatcaagacacccaatgaatatctcagccctgacccagaatatggcaagtatatagaccgatttattcaagaagggcgaacactagcacgcttgtctcaagaccctcatcctcatattgtgggagtaattgacttgtttaaggaaggtactatccactgcttagtgatggattttgtaccgggagaaaatttgtttgaggcagtaaaacgtagaggtgcgttaccagaagcagagattgtaccctgtatccgccagattggggaagctttagtggtggtgcatcaggcaggtttagtacacagagatgcccatcccggaaatatcatgctgcggagtaatggcaaagcggttctgattgactttggcattgctaaagaactcgtgcctaaaactttgagttcaaaaggtattgcaggtaatgaggcatttgcgccttatgagcagatgagcagaggtagtcgagatccaacggtcgatgtttactgtctggttgccacactctattatgcggtgacaggtcaacgccctacaacttctctggctcgcaagctagacaatactttcctaattccacctaaacaaattaatccaagcatcagcgatcaattaaatcaagcaattcttaagggtatggcgctagaggcaaaagaccgccctcagtcaatgcaggtatggttagcaatgttagagcaccaaaagcaacagcctctactacct

SEQ ID NO: 43624 - DNA, 1485 bp, Nostoc punctiforme
cagtttctctggcatatcctgcgattgcctattgggttttatgaccaacgttttgctggggaaatcagtagtcggatgcaactgaatgaccgagtggcggaagtactctcagggcctttggcaaccacattaattgacgcagtaatgatggttttttacctgctgataatgattcagtatgaccaattattgagtgcgatcgcagttggttttgctgcaattaatattttcgccctcctatttttatcgcaaactcgtgtcgatgccaatatccgcttggctcaggaatatggcaaagttggtggcgtaacagttagtggcatccaaaccatagaaaccataaaagcttctgggctggagtcagatttatttgctcggtttgccggttattacgctaaagcactcaacgcccaacaggaattaggcttaaaaactcaaattctcaccacattaccgacgattttgacagccctgaccacagcttctattctactggttggcggctttcaggtaatgaacggtaatctcagtattgggatgctcgttgcctaccaaagtttaaccctaagtttcttagagccagttaatagcctggtcaatttcggcagcacgctgcaagatttagaagctgacttaaatcgccttgatgatgtgctgcaaaatcctgttgatttggaagtggaggagaggcagggggaagggggcagggagcagggagcaggggaggcagggggagcagggggagaaattactttttcatctctatggcaattacagggacatattgagttacgaaatatcacttttggctacagtcgggtggaacctgccttaattgagaattttagcttaactgttcaacctggacaacgcatagcgcttgtggggggaagtggttcaggaaaatctacgattgctaaattaatttgtgggctttatcagccttgggcaggggaaatctgttttgatggtgtagagcgatcgcaaattaagcgttctgtattggctaactcattggcaatggttgagcaggatatctttttatttgcggggactgtgcgagataatatcactctttgggattcaactgtgccagaagctgatttggtgcaagcttgtcaggatgcagccattcatgatgcgatcgcttctatgcctgcaaaatatgactttgaattgattgaaggtggtatgaatatcagtggtgggcaacgccaacgtctagaaatcgcccgcgctttggtgagaaatcccacaatattagtactggatgaagcaaccagcgccctcgatgtagaaaccgaattgatgattaaccataacttgcgacagcgtggttgctcatgtattgtagtagcccaccgcctgagtacaattcgtgattgccataaaattattgttctagaccaaggtaaaattgtccaaagtggtacccatgaggaattatggcagcaaggtggaacttatgttcgcctactccacgca

SEQ ID NO: 43625 - DNA, 801 bp, Nostoc punctiforme
cccgaacccctcactggtaaaacaatcttggtgacacgttcagttggacagtcgagtacatttagcgatcgcctcaccacattaggtgcaacagtcatcgaaatgcctaccttagaaatcggcccgccctccagttgggaagctttggatgatgcgatcgctcatttatctcagttcgactggttaattctcacttctagcaatggcatagattacttttttgaaaggttaatcgcccaaggtaaagatacccgtgccttagcaggtgtaaaaattgccgtcgttggcgagaaaacagccaatagtctcaaacaatactctctccaaccagattttattccccccaactttgttgcagattctttaatagaaaatttcccagagaaactggatggtaaaaaagttttattccccagagttgaaagtggcggaagagaaattttggttaaggaattaactctcaagggagcaaaggtgatagaagttgccgcatatcaatcctgttgtcctagtagtattccatctggagcagagttagctctccaaaaccataatgtaaatgtaattacctttgccagttctaaaactgtgcaatttttctatcagcttactgaaaagatattctcccaaaattctgatgttagtcaactcttagagaacgtttgtattgcttctatcgggcctcaaacctctaaaacttgtcatgatttattcgggcgtgtagatgtggaagcccaagaatatactttagatggtttaacccaagcattaataatatgggcaacaaattattagtatcaa

SEQ ID NO: 43626 - DNA, 1176 bp, Nostoc punctiforme
ctcccattttctgggaaacttgcccaggagttcctgagtacttatggttctcctctttatgtttataatggcgatcacttgcgcgaaactattgagtgcattactaaagcaatcagttatcgccgcacgcaatttcggtttgcaagcgttactaatggcaatattgccctgttaaaaatttttcgctcatttgggtggggacttcacgctaatacgccaggagatatctacctgggattgcaagctggtttcgatcctagtgagattgtttacagtggtagcaatttgaatcgggctgagatgatacaagtcttaaattggggagttacaacactcaatctcgatagtctcgctcagttgcagttgtgctgcaaagttttgcccaaacacagagagaaatctattcggctgggtttacgcctcaatttgcccgaaattaccggagatagccgcattggtgtgcgtcctgaagaatttggtgatgcgatcgctttaactcgtgaagttggattaaagctgagtggtttacacttttatcgagggactggaaccaatgccacagaagcatttacccaagtgattgatgcagtcatagccacagcacaactgttaccagattgggaatatttagattttggtggtggctttggctatccatatcaccacaacaaaacagcctttgactgggaagtctttggcgctgagttaagcgagagaattactcatttagggcggaaaattgatttggtgattgaaccgggacgaagtgcgatcgcaggatgtgcaactttgcttgctcaagttgtttctgtgaaatggcaaggagaaaaacagattattggagttgataccaccgttgccaatctttcagtaccatcagtacacggtggctaccgagaaatattcacttggaagcaagcagacaatcttcgctccttattcacaactgatatttgtggtaataccacctattcacgagattatctgggtaaaaattgccaacttccagcgttagaaattggtgatatcgttgccattctagatgtcggtgcttatggttatgctatgtcgtctcactttttacaccgccccaaacctgctgaagtcttgctagaaaatggcacacatcgcttgattcgtcggcgggaagactacagtgttttactaacaaatcag

SEQ ID NO: 43627 - DNA, 1641 bp, Nostoc punctiforme
attgaatttcgtcaggaaactatttactttctggtggtagatcgcttttatgatggcgatccagataacagcgaaggtgaaaattcagaactctacgatcccaatagacaagaatggggtaagtactggggtggtgacttgcaaggtgtcatcgataaattagattatctcaaaaatatgggagttaccgccctttggctaactccactattcgagcaagtagaagagttatttattagcaatgcggcgatgcatggctattggacaaaagactttaaacggattaatcctcgctacattgctgatggagaaaacccttctttaaatgctacccaagaagaaaaaaatacgacctttgatcggttagttacagaactgcacaagcggaatatgaagttggtgctggatattgtctgcaaccatagcagtcctgatactagtggtagtaaaggtgaattgtatgatgatggcgttaaaattgctgatttcaatgatgatgtcaatcattggtatcaccactatggcgaagtgcaaaactgggaagacgattggcaagtacagaattgtgaactagcaggtcttgcaaccttcaatgaaaataatacagaatatcggcagtatattaagtcagcaattaaacaatggctagaccggggtgtggatgcactgcgggttgatactgtcaagcacatgccgatttggttttggcaagaattcactggcgagatgaccaatcacaaaccagatgtatttatttttggtgaatggatttatagtaatccgagtgacgatcgctcggtggaatttgccaatcattcaggcatgacacttctagactttgggctatgtgtggcaattcgagccgcattgggccaaggttcagaaatgggattccaaacaattcaatacatttttgaccaggattatcgctatagcggggcaacagagttagttaccttcatcgataaccatgatatgtgccgcttccaatcgctgaatccagatccagcgatgttgaaggttgcgatcgccctaattatgacatctcgcggtattccctgtatatattacggcacagaacagtatttacataacgatactgatggcggtaatgacccatataatcgcccgatgatggaaaattgggatactgatagtgaggtttatcgttgtattagattgctgtctggtttacggcggctaaatcctgctgtgtcaatgggtagccattggcagaaatacttgaccgccgatatctactgttatgtccgccgctatcgtgattctctgtgttttgtagctttaaaccggggaggggaagttattctcccagaagtagaaacagaattgcccgatggcgagcatacttgcgtagtgactcgcaataagtatgaagtaaaagacggcaagatttataaccttgtattagaagaacggggagtgcttgttttcagccacgttggggaacggatcaaagcacagacaattgtgcgcgttcaactcaatggtgtggatacccaacccggtgaaatcattgtggtgacaggagattgcccagagttgggtaactgggatatcagcaaagcatatcctttggagtatatcaactcaaatacttggtctgctgagattccctttgat

SEQ ID NO: 43628 - DNA, 3306 bp, Nostoc punctiforme
ggaagaatgcaagatgtgaatcgattaattgaaagaattagtcgtgatgaccacaaactgacggtcatttatggtcaatcaggagtaggtaaaagttccctggttcaggcagggctattaccagctttaaaacaaagagccatagatgctcgtgatgtcgtgcctgttctgttgcaagtttatacagattggacaaaagttttaggaacttgcttcgtagaatcattagaagaagttagaggcttaagttttcctctgttcttagactcgatggcaggttttgtagaagagttgaacaaaaatatagagaaaggtttgttaactgttctgatttttgaccagtttgaagagttcttctttgcttataaagaccaagataaaaggagacctttttttgaatttatccgagattgtcttaatattccttatgtaaaaattattctctctcttagagaagattatctccattatttactagagtgtaatcgcctaactcatttggatgcaattgataacaacatattagataaaaaaattctttattacttagggaacttttcgcctgaagatgctcgctctgtaattcaaagcttaacagaaagttctcagttttatctagagccaccgctaattgatgagctagtacgagatttagctagagatttcaacgaaattcgccccattgaattacaagttgtaggagcacaactacaaactgagaaaattacaactttgattcagtaccaagaacaaggccctaaagaaaaattagtagggcgattcttagaagaagtagttaaagactgtggtaacaataacgaacagttcgccaagctagttttgtatttgttaactgatgaaaataatactcgtcctctgaaaaatcgtgctgaattagaagcagatttagcattagagcctgcaagattagatttaattttgaaaatcctggtgaaatcaggcttagtatttcaagtaccaggatttccggctgatagatatcaattagttcatgactatttagtaccatttgttcgtgaacaacaatcagcccgattaattgctgagttagagaaggagaaagaacaacgaaaactcaccgaagccaaacttaatcaggttttgacacaacagctaagaactgcacgcaaacaaactgttacattaataggattaataactgcaataagtgtaattgcagtaggggttacagcagcttacatcaacacttctctgacatcagatatttcttcaaaagatgacatagggcttggagagctagtatcagctattaaagtaggtaaaaaactaaagtttttatcaataggggtgatacctgaaactcggctaaaggttatttcaaatctgagtaatgcaattcataaaattaaagaaatcaaccgtatagaagggtatgataaagcaattacagcccttagctttagccaagatagcaaaatgttagctacggcaagtgaagatggcaaagtcaaaatattgaatatttctgatggtcaagaaaggatctggtcagctcacaaaaaaagtgtaacatctattagcttcaactctgatggaaaaatgttagctaccgtcagcgaagatggtaatgcaaaaatctggaatattccagaacgtaaaagctggagtactcctaaatttaaaccaataaaaattttgaaaatcgataaagatggtctaggcttcattacatttagtcctaacgataaactactagctactactactaagaataaaacagttaaaatctggagttgggaagatggtaagcttaagagcttaccacaaagatttaatgacaaaaacataattgtaaattttagtcctgacaacaagacagttgctacagggggacggtatgacactgttaaactttggaaactgacaccaaaaaaacttgaaaataagcctactgagatttatgattctggcacatttaccatgaatttcaacaacagtggtgatgctattagcttgtttaataaacagggaaacctaagagtttggtctactgatgataaaccacacctcatcaaaagtgctgaaaatgtttgtaagaattcatttggattgaaagattttttaaataatagtcttgataatcaattaagcatattccaggatagtgaagataagaaaactttctttgaaactataatatttcaaggtcaatgttctaattacaatatttttaaacatgatgatagcattacttatacaagcttcagtcctgatagcaagctacttgcatcagctagtaaagatggagttgtgaagatttgggatattgacgacaataaattaccttcgttccagagaaccgatagagatgaagatataaataggaaaataaggtttagttttgatggtcaaacagtcgctcttggcagttctgacaatagtatagaacttcaaaaccgtgatggcactcacattaaaactatccgaggagatagttcaattcttagctttagtccagataatcaaacacttgcaactggaagccctgacgatatcttaaagctctggaaactagataccaacaaggaaattactttaaaaggtagcaccaataagatcacaaccattgactttagccctgatggtaatttggttgctgctgccagtgcagataattttgttagactctggcgcagtagtgacggaacatttataggacatttaaagggaaacacaaaacaagttaccaatgtgagctttagccctaatagtcagataatagctactatcagtgatgacaataaagtgcaactttggaatagccgcgatcgcagcttaattcaagccttgaaaacagatagtgataaagttacaactgttatatttagtcatgatagcaagatgcttgctatctgtgatgacaatttagttaaactctataaaagtgatggtactcccgttaagccattgattggacataatgccaaggtacaaagcgtagagtttagtccagatgacaaaaagctcatgtcagttagcgctaatagtggtgagataaaaatttgggatatcagcaatagcgaaccgcttcaatctattgataactatggcatgatcagcgcaaaatttaatcctaatggcaagtacattacttctattaaccagaattatactgtcaagctatggactgttgaaggagaaccacgcgcaacactcaaaggacataatgacacaatcacaaaagtagattttagccatgatggtacaaaaattgtaactagcagtgctgataatactataaaaatttgggatataaatcagctt

SEQ ID NO: 43629 - DNA, 894 bp, Nostoc punctiforme
ttacaaaaacacattaaaggtgttaatgatgttgcgtttagttttgataataaatatattgcttctgcaagtgctgataacactgtgaacatctataacggtaacggtaattttatcaaacaactttcaggatttagtaatggaataaatgatgatattagcattgataaggttagctttagttctgatggaaaaatcattggtgctactagctgcaaaacttattggtcgaatgagatttatcgctctaagtatgttatgaagttttggagtattgaagatagtgccaagtttcaagagttaaaatctattaaaggtcacgcaaatttttcatgtaataatatagattcttttattaggtttagtcttaataaaaaaacagttgcttccgttagtaaagatgatagtttaaaactttgggatttaaaaggcaagccgctagcaaccttatggggtcatactgattgggttaatagtgttgcgttcagccctaataaaaaaatcatcgcttctgctagtgacgacaaaacagtaaggttttggaatagaaatggtaaattgcttaaaccgattataaaacacggtgataaagtcaatagtgtgagtttcactcatgatgggaaaattattgcttctgctagtgacgatcaaattataagactctggaatcttgatggtaaattacaaaaaccaaccatccgcgatcctgataaaattacaaatatacgcttccaagctgatgataagaaaattgcctttattagtggttcttctgctaaattggggaatttagataatggaaaaattgaacccttaaaaaccgattatagcagtaatactttaagttttgataatgacaacaaaatgctagctgttggttctgattataataca

SEQ ID NO: 43630 - DNA, 849 bp, Nostoc punctiforme
atgatcggcaagctactagaccatcgttaccaagtaattcgagtcctcgcaatgggaggatttggtcaaacctatattgcccaagatactaggcggcccggcaaccccatttgcgttgtcaagcacctcaaacccggaactgaccccagagtttttgatactgctaaacgcctgttcaacagcgaagccgaaaccttagaaaaactgggcaaccatgaccaaatacctaggctgctagcatactttgatgaaaaccaagaattttatttagtacaagaatatattgaaggacataccctagctgaagaacttacacctggtaaacgctggagtgaaagtcaagtaattcaactattacaagaagttctggaaattctcgaatttgtccacagccaaggcgttattcatcgagacatcaaaccggataatatcattcgtcgcgcctcagataataagttagttttagtggactttggggcagtgaagcaactgcgtacacagatggtgacagtcgggggacaagcatctgccacagtcgttattggcactcctggctatatgcccacagaacaagggcaaggcaaaccccgccccaacagtgatatttattccctcggcatcattgccattcaagcactaacaggattattgccaacagcattgcaagaagacccggaaacgggcgaaatcatttggcagcaatcagtaaccgtaaactaccgactggcagcagtgttgacgaagatggtgcgttatcacttcaaagaccgctaccaaaacgccacggaagcgctgcaagcatgtaaagatgcgattaatccagtacctacactttctcaacctcaagaa

SEQ ID NO: 43631 - DNA, 1752 bp, Nostoc punctiforme
ttaaaagggcatgagggtagcgtcaacagcgctagctttagtccagatgataagttaattgtgacagctggtgcagataacaccgcccgtgtctgggatttttcaggcaaacagctagtggagttaattgggcatcaaagcaatgtttatagtgcgaattttagccccgatggtaagctgattgtcactgcctcttttgatggtactgcccgtatttgggatatttcgggcaaacagctagttgagctaaaaggacaccaaggtaatgtttatagtgcgaattttagctcagatggtaaatggataatcacggcaagtgcagataaaactgcccgtatttgggatatttctggtcagcaaatagcgcaaattacagggcatgaaaacattgttaccagtgcgaattttagctcagatggtaaacggataattacggcaagtgcagataaaactgcctgtatgtgggatttatcaggtaagctattggtgcagttgaaagggcatacagatacggtatggagtgcgaattttagccccgatggtcagaggatagttacagcatctgatgataaaacggcgcgagtgtgggatttatctggcaaggtgctagcagagttaaagggacatggtgatagcgtatacagtgctagctttagtccagatggcaagttgattgtgacagcttctattgatagaactgcgcgagtatgggatgctacaggaaaagtaataggtaaactggaagggcatcagggaagtgtaaacaacgcaaagtttagctttgatggaacccagattgtcactgcatcatctgatggttccatccttatatggaacacttctaagaagatatttatcgaactattagggcatctcggtgaggttttcagtgccagttttagcccagatggtaagcagattatcactacatcaaaagatggcacagttaggatatggaacactttaaacaagcagataactgaaattaaagcacaggttgctgtccaaagcgcaaattttagccccaatgggaagctaattgtcaccacatcttcagagaaatttgctcaagtgtgggatacctcaggtaaaattttaacggaacttaaaggacatgagagtcgtgtaaatagtgcaacttttagtcctgatggtaagttcattgtcaccgcatctgacgatacaacagcacgaatatgggatatttctggtaagctgctaactgaactaaaagcagatcacggtagggttgttagtgctaattttagttatgatggcaaacagattatcactggatcgggcaatacagcctttatatggaatacatcaggcaagctgataagtaaattagaattaaaaggaccccagtactctgttatcagcgccaattttagccgcgatcgccagttaattgtcactgcatctcatgatggcagtgcttggatatgggattcttccggtaaagtaataacaaaaatagagtttccgaataacataactgaaaactatagcgaaaatcgtgtttacggcgctgatttcactccagatggtaaatatttagtaacggtaacttccgatggaggtagagtctgggatatctccggtaagctaatagctgaattcaaaggacatcaggatgaagtcatcaattttagtttaagtccagatggtaagcagatgctcacggcatctgatgatagaactgtacgagtgtgggatatttccaataagtcactggctcaaataaattcg

SEQ ID NO: 43632 - DNA, 2272 bp, Nostoc punctiforme
attaccagtcttgcttttagtcctgataatcaattctttgtcactggctctaaaagtggtaatgtgaaaatttgggatacctcaggcaaactcctaaatgaactaagaggacatgaatatcaaataaatggtataaactttagctctgatggcaaatctattcttactgtatctttggattttgcaagagtttggagtaactctgggaaattgctagcagaaattaaaggcaaacagaagcatgacgctgctttaacaagtgcaagcttgagtccagatggcaagttgattgttaccggatattcaagttttcaacaaaatgcttatttgtgggatagttctgggaagcagcagatggaacttcaagggcatcaaaactttgttaatagtgtaaattttagtccagatggcaagttgattgttacagcatcggatgacgaaactgcctgtatttgggatacgactggtaagctgctaaacgaattgaaaggaaattccagtaaagtaaaaagcgctagttttagtcctgatggtaaaaaaattattactacatcgagcgatggtactgctattatttgggatacttttggtaagctgcttgccaagtttaatataggtttcccaattagtagttatagctcaactagggtgaattttagccctgatggtaggttcattattgctcaaattgagggtggtttcactcgtttgtggggtgcagatggcactgtgatttccacagatgagagtttaggaaatatcacttttagtcctgatggtaagttaattgccattgtacgtagaggtggtagcgcttctgtggggattcctgaggaaaaaaaactagcaatacttcagatagagccttatcttgtgcagagagtcatttttagccataacagtaagtttttcgtcacaatatctgaaattcctttctcctctgtcgataaaatccaagtatgggatgttggtaagcttgactggatgacagaaacatcaaaatagtttaacatctgtgcgtttgcttatttagggaaaaggagacgaacgaaacccttaaggttaaagcaatagaaacattttgaagcaaatcggaattaaaagcataagactgattcttttcctcattgccctttccctcttccctttcacatgattcatctttaaaattatgactttcactaagtttgcatgtgggtgcatattgttgttaatatcggcttgtttatttatccccaatcgccaactaattgtcaccgcgtccactatttttaaagatattgctcaagcgtcaggtgcttcaaaatattcacctattgaacttaacccctacgcaagtacagttgaaaatgccagttttagccctgatggaaggtttattatcactggatttgataatggaactgcccgtatttgggataaaagtggtaatctaatcactgaattaaaagcgggagaaaataaagtaaaaagtgccttttttagtcctaacagtaagtttattgtcacctcatctaaccgcacaaaaatatgggacacttcaggaaaaaaactagtggaattaaaagggtataatccaagtattagtcctgattgcaagtttattgttacaacctttttgggcgctacgctatgggatacatcgggtaaactgctagtggaatttaaagaggataaagataatcctgttatgagtgctagctttagccctgatagtaaactaattatcacggcattacgtaatggtattgtacgtgtgtgggatacaaatggtaaactcataactgaatttacagctgatcgcaatcttctcaaaagtgctgtttttagtccaaatggtaagctaattttcactacttcttttggtacttctagagtatgggatattttaggtaagctgctagcagaactcaaaggtcgccatctatcgattcaaagtgccaattttagtcctgatagtaagctgattgtcaccacatctttaaataatagtgacttttttaataggaatgcccaagtgtgggatacatcaggtaaagaaatagctgaacttaaaggacatgaaggggatgttacaggggcgaactttagccctgatggaaagcgcatagtcactgtttctaatgatgggactgcccggatatgggatacaaatggtaaaatgctgcttaccttgaaaggacatcagggaaatgttagcaaagctagttttagccctgatggacaacttgtaattaccgcttctgatgatggtacgtcacggttgtgggat

SEQ ID NO: 43633 - DNA, 639 bp, Nostoc punctiforme
atgaaactttatagtgttcctatttcaccctttgccgcccgcgtgcggttgtccatctatcgcaaaggtctaaacattgaaattgtcccaccgccagaaggaggcattaaaagtgatgcctatttagctctgaaccctatgggacaggtgccgactttgttattggactctggttttgcactcccagaatcagcaacgatccttgaatatctagaagatgtcttcccaacaccatctttgcgaccgactgatgttgaggatttagcccgtgttcgtttgttcttgcgcctcccagattttcatattcgaccatccatctttgctttaagaggtatgcgagatccagctaatcgcaatgaggacgtggttaaaactcaatttgaagttctcgatcagggcttgtcatatatcgaccattacctgagcgaagatgtctgggcagtgggtaatcgaccgtcaatcgctgactgtgcccttgtcccgatattcaatatagtcagtttcatggtattggtctataaccactcggatatcatcagcaagtatcaaaagcttagtgcttattggcaggcagccaagaccgatgaaattaacgccaaagtgattgccgaacaactggctgccataccaaaagcttag

SEQ ID NO: 43634 - DNA, 1164 bp, Nostoc punctiforme
atgaaagcactttgctggcacggcgctaacgatgtacgagttgatacagtacccgatccaaaaatcatcaatccgcgtgatgcgattgttaaaatcacgtcaacggcgatttgcggttctgatttacatctttatgacggttacatccccacgatggaaaagggcgacatccttggtcatgaatttatgggggaggtggtcgagctaggcagtgccgtcaagaatgtgaagataggcgatcgcgttgtcgttccctttaccatttcctgcggctcctgtttcttttgtcaaaaagatttgtggtcgctgtgcgataactccaaccccaacgcttggatagcggaaaaactcatgggtcattccccatctggtcttttcggctactcccatatgatgggtggctatgctggaggtcaagctgaatatgcccgcgttccctttgccgatgtcggtttattcaagattcctgatggactaacagacgaacaagtcctgtttctgacggatatcttccccactggctatatggcagcggaaaactgcgatatccagccaggagatactgtagcgatctggggctgcggtccagtcggacagtttgccattagaagtgcatatatgctaggtgccgagcgcgtcattgctatcgatcgagttcccgaacgcctacagatggcgaaagacggcaaggcagaagtccttaactatgaggaagttgaagttggtgaagccctcaaagatatgaccggtgggcgcggtccagatgcttgcatggatgctgtgggaatggaagcccacggtacgggtccagatgcgttttacgaccaggtaaagcaagccgtgcgtatggaaaccgaccgacccactgccctaaggcaagtgattgttgcctgtcgcaaaggtggcactgtgtcaattcctggtgtttacggcggctttgtagacaagataccgatgggtgctgccatgaacaaagccttaacatttaaaatgggacaaacgcacgttcataagtacttgcgcccgttactcgatcgcgtccaaaatggcgatatcgacccatcttttgtaatcacccatcgtctgccactagaacaagcaccgcacggctacgaaattttcaagcacaagaaggacaactgtatcaagatcgtgctcaagcca

SEQ ID NO: 43635 - DNA, 795 bp, Nostoc punctiforme
gcgatcggtcaaggaacctggtacatcgacaacggtgaccgcgcctctgcgatcgccgctttgcgccaaggactcgatctcggcatgacccatatcgacacggcggagatgtacggcagtgccgaggaggtggtcgccgaggcgatcgctggacgacgcgatcgggttttcctggtttccaaggttcttcctggaaatgcttctcggagagggacgatcatagcctgcgagaaatcgctcgctcgacttcataccgatcggctggactcttatctgttgcactggcgcggtcaacacccactggaggagacgatcgctgccttcgagcagcttcagcacgaggggaagattctctgctggggcgtgagcaacttcgatgtgcctgaccttgaagcagtccagaagatcgctggcgagggttctctcgtctgtaatcaagtcctttaccatttgagacagagagcgatcgaacacgctgtgatcccctggtgtgagaagcatggggtcgccgtagtcgcatacagcccgttcggtcatggggattttcccagctcgcgcacaaccgcaggtcgcgtactacaggaaatcgccgccgcccataacgccacccctcgccaagtcgcgctccgatttctggtgcggcattcctcgctcttcgcaatccccaaagcatccaaccccaaacacgccgctgaaaacgcgggagccggggaactcaatctgacccaaaccgaactcgatcgaatcgacgcagccttcccgaccggatctcgtccccgcgtgcttcccatgctg

SEQ ID NO: 43636 - DNA, 747 bp, Nostoc punctiforme
atcattttgattactggcgcaagtagtggtattggtactgcttgtgcgagaatcttcgctggtgcgggtgcaaaactaatcctagcagcacgacggttagaacgtttgcagcagctaaaagatgctctcattaaagaatttggtattgaaattcatttattacagctagatgtgcgcgatcgcaacgctgtcgaatctgccatctctactctaccgcctgcctggtctaacatcgacattctgattaacaatgctggtctaagtcgtggtttagacaagttgcacgaaggcagctttcaagactgggaagacatgattgatactaacgttaagggtttactttatgtttcccgttatgttgttccgggaatggtgagtcgcgatcgcggccatgtggtaaatttaggttccattgccggacatcaaacctatcccggtggcaatgtctactgtgctaccaaagctgctgtgagagcaatttctgaaggtttaaaacaagacttgttgggaacgcgggtacgtgtaacttccgttgaccctggtatggtggaaacggaatttagcgaggtgcggtttcacggaaatactgaacgtgctaaaacggtctatcaaggagttatcccactgacagcagatgatgtggctgatgtgatatttttctgtgtgacgcgatcgccccatgtcaatattaacgaagttgtgctgatgcctgttgaccaagctagcgctacgttagttaatcggcga

SEQ ID NO: 43637 - DNA, 1059 bp, Nostoc punctiforme
gtgagtccaactgctcaatccacggcaagtgcgcgtcgcgtggtatttccttttacggcaattgtgggccaggaagaaatgaaactggcgctcctattgaacgtgattgaccccaagattggtggtgtaatgatcatgggcgatcgcggtaccggtaaatccacaactatccgggcgctggcggatctgctgccagaaatttctgtggttgccaatgaccccttcagcagcgatcctagcgaccccgacttgatgagtgatgaagtccgccaactcttagaacaaggggcggaaattcctgtagctcataaaaaagtccaaatggtagacctgccgctaggagctacagaagaccgagtttgtggcacaatcgacattgagaaagctttatctgaaggtgtcaaagcctttgaaccgggactgctggcaaaggctaaccggggcattctctatgtagatgaagtcaacttactagatgaccacctcgtagacgtgctactagattccgctgcgagtggatggaacactgtagaacgggaaggtatttctatccgtcacccagcacgttttgttcttgtgggttctggaaacccggaagaaggcgaactacgcccgcaactgctcgatcgctttgggatgcacgcagaaattcacaccgtaaaagaaccagccttgcgggtgcaaatcgtggaacaacgggcggattttgaccaaaatcctctagtatttctcgaaaattacaaaccccaacaagaggcattgcaagagcaaattgtcaatgctcaacagcttttgccagaagtgaagcttgactatgaactgcgggtaaaaatttctgaagtctgttctgaattggatgtagatggtttgcggggtgacattgttagtaaccgggccgcgaaagccttaacagcttatgaaggacgcactgaagttacagttgatgatatctgccgtgtgattaccctatgcttgcgtcacagactccggaaagaccccttagaatcgattgattctggctacaaagtcgccaaagtttttagccgcgtctttggcgta

SEQ ID NO: 43638 - DNA, 1365 bp, Nostoc punctiforme
atgacactacaaagctttggtgtgattggattagccgttatgggtgagaacatcgctctaaacgtagagcgcaatggcttcccaattgcagtttacaaccgctcccgagaaaaaacggatgcgtttatggcgcagcgtgctacaggacggaacgtcaaagccgcctttactctagaagaattcgttgccttattggaacgtccccgcaaaattctagtaatggtgcaagctggtaagccagtggatgcggtgattgctcaactcaaacccttgttagaggaaggcgatatcattatcgacggtggcaactcttggtttgaagatacggaacgacgcactcaggaattagaacccgctgggcttcggtatcttggtatgggtgtcagtggtggtgaagaaggggcgctgaatggcccatctctgatgcctggaggtacaacaagctcttacgagtttctatcaccaattttcaacaaaattgctgcccaagtcgatgatggcccttgtgtaacctacattggccctggtggttctggccactatgtcaaaatggtacacaacggcattgagtatggcgatatgcagctaattgctgaagcctacgacttgctgaaaaatgtcgctggattaaaccccagtcagctacatgatgtgtttgctgaatggaataccaccgatgaactcgattcatttttgattgaaattacgaagaatatcttcccatatattgacccagaaacaaataaacccctggtggatttgattgttgatgcagcaggtcaaaagggaactggacgctggactgtacaaactgcattggaattgggagttgctattcctacaattacagcagcagttaatgcccggattatatcttcgattaaagatgagcgggttgcagcatctaaagtcctcactggccccagtggcaagtatgacgggcaaactaaagactttatcaataaagtacgtgatgctctctattgctcaaaaatctgttcttatgctcaagggatggcgttgctatccacagcttcaaaaacatataactggaatttggatctgggcgagatggcgcggatttggaaaggtggttgtattattcgcgctcgctttttgaataagattaagaaggcttttagcgaaaatccagctttgcctaacttgctgttagctcccgaatttaagcaaacaattcttgacagacaaactgcttggcgggaagtgattgcgacagctgcaacagttggaattccagtacccgcatttagcgcctccttggattattttgacagctatcgccgcgatcgcttgcctcaaaatctaactcaagcacaacgcgactactttggcgcacatacctac

SEQ ID NO: 43639 - DNA, 807 bp, Nostoc punctiforme
ctcccgattattgatattagcgccttagtttctggaaaaggaaatctctattccgccgcatctcagattcggcaagcgtgtcgagaatcgggatttttctatattatcggacatggtgtagacgaaaatttgcagcagaggctcgaagaactcagccgccagtttttcgcccaggatttggaaactaaacttaaaattcgtatggctttggcaggtattgcatggcgaggttattttcccgttggtggcgaactgacatccggtaaacctgacttgaaagaaggtatttactttggcactgaactcccagacgaacacccactagtgcaagctggtactcctatgcatggtgcaaacctcttccccgccaacatgccccaatttggcgaaacagtacttgaatatatagaggcgatgacaaagttgggacacactctcatgactggtatagccatgagtttgggattagaagaatcctactttgctgatcgttatacttcagatcctctagtgttgtttcgcatctttaactatcctcctaatttatcaccgtcagatggtaatccgatatggggtgttggcgaacatactgattatggggttttaactattctcaaacaggacgactcaggcggattacaagttaaatccaaatcaggttgggttgctgcgcctcctgttccaggttcctttgtctgtaacatcggcgatatgctagacaaaatgacgggaggtttctatcgttctacacctcatcgcgtacaaaaccagtcccaaaatcaccgcctttcattccccttctttttc

SEQ ID NO: 43640 - DNA, 564 bp, Nostoc punctiforme
gcgaagcaactggtgagcagtttattacaaggagttaacttgtacttaattggcatgatgggcgttggtaagacgacagtagggcccttactagcaaagcatctgggttatgggtttttggatcttgatggtgtcattgccaaagctacagataaatctatcaatcagttatttgccgaagaaggtgaagcagggtttcgccaaatagaaagtgatgtactttcacaagtttgtgcttttacaaaattgactatagcaaccggtgggggcattgtattacggcgagaaaactggggttacttgcaccacggtttgatagtgtggctagatgtgccagttgaactaatttacaggcgtttagctgaagataccaccagaccactgttgcaagatgctgatctcaaaggtaaattgcgatcgctcctcgaacaacgaacaccactttactctcaagccgatttgcacatcaccgtccaagagggagaaacacccgaagacattgccaacagaataattgaggtaattcctaacgttctcaagccacaagcttctcattaacaagat

SEQ ID NO: 43641 - DNA, 870 bp, Nostoc punctiforme
gaatacatcagacaaactgaagccactcgtgtgcgtgtactcagtgaagcactaccttatattcaacaattcgccggtcgcactgttgttgtcaaatatggtggtgcagcgatgaaagatagcacactcaaagacaaagttatccgcgatattgtattcttatcctgcgttggcttgcgtccaatagtagtacacggtggtggcccagaaattaacagttggttagataagctgggaatcgaaccacaatttaagaatggtctgcgagtcactgatgccgccacaatggatgtggtggaaatggttttagttggtcgagttaacaaagaaattgtcgcgctaattaaccaagctggtggattggctgtaggactttgtggtaaagacggtaatctatttacagcccgtccccaaggtcaagaaggcatcggttttgtgggggaagtcagtaatgttaacatcaagattttggacaccctcgctagcaatggctatattccggtagtgtctagcgttgccgcagacgagacagggcaagcttataacattaacgccgatactgtagctggagaaattgctgcggcactaggagcagaaaagttaattttactgaccgacacaagtggaattttaaaagattacaaagaccaatctactttgattccaaaagtagatatccgcgaagcccgcgagttaattgtcaatgggatagttaccggtgggatgattcccaaagttaattgttgtgtgcgatcgcttgctcaaggagtccgtgccgcacacatcatcgatggtcgcattccccacgccctgttactagaaatctttactgatgttgggattgggacgatgattttgggttcgcaattt

SEQ ID NO: 43642 - DNA, 1899 bp, Nostoc punctiforme
cgctcctggaaaattgaggatagcgaagaactataccgtattgaaggttggggacaaccctatttttccattagcgctgctggtcacgttaccgtttcacccaaaggcgatcgcggtggttccctagacttgtttgaattggttaactccatgaaacagcgcaacttgggacttccgatgttgattcgcttttccgatattttggaagaccggattgaacggttgaatgcttgttttgccaaagcgatcgcccgctacaactaccctggcgtataccggggggtgtttcctgtcaaatgcaaccaagagcggcatttgattgaagatttagtcaagtttggcaagcctcatcaatttggcttagaagctggttccaaaccagaattaatgattgccctggctgtcttagatacaccaggagcgttgttagtttgcaacggctacaaagaccgagaatacatcgaaacggcaatgttagcccagagattagggcaaacaccaattatcgtcttagaacagattgaagaggttgatttggtgattgatgccaatcgccagttaggtattaaaccgattttgggtgttcgtgctaaactcagtacccaaggtatgggacgttggggagcctctagtggcgatcgcgctaaatttggtttgacaatgcctgaagtcattgaggctgtcgacaagttacgggaagctaacctgctcgattctttgcaattgatgcacttccacatcggctcacaaatctctgccataaatgtaattaaagatgccatccaagaagccagccgcatttatgtggaattggcgatgctgggggcagatatgaaataccttgatgtcggtggcggcttgggcgtagattatgatggctcccaaaccaacttctatgcgtcgaaaaattacaacatgcagaactatgccaacgacatcgtggcagagttaaaagatacctgtgcagagcgccaaattaccgtaccaacactgattagcgaaagtggacgtgcgatcgcttctcatcagtcggtgctgatttttgatgttctcagtactagcgatgtccctctcgattccccagaacctccacaagagggagaatccccaatcattaattatctttgggaaagctaccaatctatcaaccaagagaattaccaagagttgtatcacgacgcggcacaattcaaagaagaagccatcagtcgcttcaacttaggaattttacgcctcagagaacgagccaaagccgaacggctatactgggcttgttgtcagaaaattctcaacatcactagacagcaagaatacgtacccgatgaactagaagaccttgagaaaatcatggcttccatctactacgttaatatgtcagtgtttcaatcagcaccagattgctgggcgatcgaccagctattccccatcatgccaatccaccgtttggatgaagaaccaatccggcgaggaattttagcagacctaacctgcgatagtgatggtaaaatagaccgctttattgacctgcgcgatgtcaaatcggttttagaactacatacctacaagcccggagaaccctattatttagggatgttcttgaatggagcttaccaagaaatcatgggcaatttgcacaacctatttggcgatactaatgctgttcacatccaattaacgcccaaaggctaccagattgaacacgttgtcaaaggtgacaccatgagcgaagtagtaagctacgttcagtatgactccgaagatatggtggaaaacattcgccagcgttgtgagaaagcattagaagaaaagcgtatcaccctagcagaatctcagcgattactgcaaacctacgagcagagtcttagaagatacacgtatctgaatagttagttaggaatg

SEQ ID NO: 43643 - DNA, 453 bp, Nostoc punctiforme
atcgcaatggaacgtacatttttagcaattaagcctgacggagtacaacggggattagtgggggaaattatccgtcgctttgaaactaaaggttttaccctagttggtttaaagttcttgaaagtcagtaaagaactggctgaacaacactatggtgttcaccgggaacgtcccttttttggtagtctagtcgaatttatcacttctagcccagtggtagcgatggtatgggaaggtgatggtgtcgttgcatctgccagaaagattattggtgctacgaaccccttaacatccgagccaggaacaattcgcggtgattttggcatcaatattggtcgaaacttaattcacggttctgatgctccagaaaccgcacaacaggaaatagccctatggtttaaagatgaagaattagtcaactggcaaccacacataaccccttggttgcacgag

SEQ ID NO: 43644 - DNA, 900 bp, Nostoc punctiforme
cgaatcgggcgactcgtgcttcgcgctggcctcgataatcccaatatcgagtttgtaggcattaacgacctagtaccaccagacaacctcgcttacctattaaagtacgactcaacccacggtcaattaaagcacaaggttgaagccaaagaagatggtattctcattgacggacatttcatcccttgtgtgtcgatgaggaatccagcagagttaccttggggaaaattaggtgcagattatgttgtagaagcaacgggactcttcactgattacgaaggagccgcaaaccacctaaaagcaggtgcaaagcgcgtggtaatttctgctcctaccaaagatccagatagagttacgactctactcatgggtgtcaatcatcacctatttgaccccggcaaggatatcattgtctccaatgccagctgcactacaaactgtctagctcctatagcgaaagtcatcaatgacaactttgggttaactgaaggattgatgaccacagttcatgctatgactgccactcagccaactgtagacggtcccagcaagaaagactggcggggtggtcgaggtgcaagccagaatattattccctcctccacaggcgcagctaaagctgtagcacttgttttaccagaattgaagggtagattgactggtatggcattacgggttccgactcccgatgtctctgtagttgatttaactttcaaaactgccaaagctactagttacaaagaaatctgtgctgccatgaaggaagctgcggcaggttcacttgcaggtattttgggatacacagatgaagaagtagtttccacagattttcaaggcgatacccattctagtatcttcgacgcaggtgctggaattgagttgaactccaacttcttcaag

SEQ ID NO: 43645 - DNA, 1467 bp, Nostoc punctiforme
cgtcgaaccaaaatcatttgtactgttgggcccgctacatctgcacccgaaaatctgcgaggcttggtagaagctggaatgaatgtggcgcggctgaatttttcccacggcgcttacgaattccatgcccaaactgctcactatctcagacaaattagtaatgagcagcaaaagccgatcgcaattatgcaagacctctgtggtcccaagattcgtttgggaactttaccaccggaagggttaaatttagaagctggtactgaagttacttttgttttgcaagaaaagggtgagagtattgacgaactccccctaccattgccgactctgttcgcaatggtgcgaccaggtgaaccgattttaattaatgatggtcgcgtcaagttaattgttaccgatcgcgatgccgatcgcattcgcgcccaagtgaaaactggcgggttaatttccacacataaaggagtaaatctaccacaaactcctttacctgttagttccatcaccgaaaaagacttactggatctacgctttgggattcagttgggtgtagattgggtagcggtgtccttcgtgcaatcaccacaagacttagaacccgccaagcgcatgattgaagcggctggtgcttccatccgcttaattgccaaaatcgaaagagcagaagcactagaaaactttgattccattctgaaagttgccgacgcaattatgattgcccgtggcgatttaggggtggaagtgccaattcacgaagtacccctcattcaaaaagatattattcgccgttgcaatcgtgctggcaaaccggtgattacagccacccaaatgctagagtcgatgattagcgcccccgatcccacccgcgccgaagcaactgatgttgccaactccatcttagatggtacggatgcggtaatgctctctggtgaaacagctgtcggacaatatcccatcgccgccgtccagatgatgcacaacatcgccgtgcggacagaacaggctctagatgagggtagtaaacatgcttggtgtcatgaagcaggcagtcttagcgttaccgaatctgtagcagaatctgtgtgtcgcatcgcttatgaaacaggttcacgggcaattctctgtaacacttcatcaggaaatacagcgagaatggtgtctaaatatcggccgacttctcccattattgccctcacctccgatatcaccgcttatcgccaactagcgctttcttggggtgtggaagctttgctgatcccaccagtccaccatgctgaagagatgtttaccaatgtggtgaacacagttgtagatatgggtctagccaataagggcgataaagtagtgattacctctggtgttccaattggtaaatcgggcacaactagtttaatcaaagtgcattccattggacagccaatatccgcataagccacttagaatagggctgtggctcaagatagtaagcaa

SEQ ID NO: 43646 - DNA, 1002 bp, Nostoc punctiforme
atgtctaagaatttactagaacaattgcgagaagtgactgttgtggtcgcggatacgggggatatccaggcaattgaaaagttcaaaccccaagatgccaccaccaatccttctctgattactgctgcggcgcaaatgccagaatatcagggaattgtcgatcaaactttactgcaagcgaagaaagatgctggagacggagccacccaagcacagatagtttctctagcttttgaccgtttagcagttgcttttggattaaagattttacaaattattcccggtcgtgtgtctacagaagtagatgctcgcttgtcctacgataccgaagctactctgactaaagcacgggatttaattgcccagtataaagctgctggaattggccgcgatcgcgttttaattaaaatcgccagcacttgggaaggtattcgcgctgcggaaattcttgaaaaagaaggtattcactgtaaccttaccttgttgtttggtcttcaccaagcgatcgcctgtgcagaagccggcgttaccctaatttctcctttcgtcggtcggattcttgactggtacaaaaaagataccggacgcgatagctacccagcaaccgaagatcccggagttttgtcagtcaccaaaatctacaactactacaagaaattcggctataaaaccgaagttatgggagctagcttccgcaaccttggtgaaataactgaacttgcaggtagcgatttgttgacaatttctccatcacttttggctgaattgcagtcaactgttgcagaactgccacgtaaacttgaccccgccaaggcagcaagtttgtcaatcgaaaagatatccattgacaaagctagctatgacaaaatgcacgctgctgaccgcatggcaactgacaaactagacgagggcatcaaaggtttcaccaaggcattagaagaccttgaaaaacttttggcagaccgactagttcgccttgaaggagaggtagtagcaagccat

SEQ ID NO: 43647 - DNA, 903 bp, Nostoc punctiforme
cggaggaaatgtaccgctcttcttcgggccgctatcgatcgcggcattacattctttgacaccgccgaggtctacggcccgttcctaaacgaagaactggtgggtgaagccctcgctcccttccgcgaccaagtggtcatcgccaccaaattcggattcgacatcagtccaaattccgatccccgtggcatgaagggttcgcccggactgaatagccgaccggagcatattaaggaagccgtggagggttcgctcaagcgactcaaggtagaggcgatcgacctcctctatcagcaccgggttgacccgaacgtgccgatcgaagacgtggcaggagcggtgaaggaactgattcagtcaggtaaggttaagcactttggactctcggaagcaggagtgcaaacgattcgtcgcgcccacgccgttcagccgatcgctgctctccagagcgagtactcactgtggtggagaaagcctgaagcggaagtgataccgaccctagaggaactcggaatcggttttgtcccctacagtccattgggcaagggctttctcacgggcaagatggacgaaagcacgaccttcgacagttccgatttccgcagcactctgcctcgcttcactaaggaggctctcaaggcgaatcaggccctgatcgatctgctcggcagcatcgcagaacagaagcaggcgacacctgctcaaatcgcgatcgcttggctactggctcaaaagtcgtggattgttccaatcccaggcaccacgaagctgcatcgcttggacgaaaacatcggggcagtctcagtggaactcacgcccgacgatctgcgtaacatcgatgacgctgcctccaagatcgcggtgcaaggcgctcggtaccctgaaaagttggagcaaatgacc

SEQ ID NO: 43648 - DNA, 1818 bp, Nostoc punctiforme
tggcggttgtttttgcgtctagtgccttacgcccgtcgtaacggacaactattggcgctgtcgatgtgcctactcatacccatcgccctagctaatgccgtccaacctctgttgattggccaagttatctccctaattcgcaatgaaccaagcgcttacgaatttctcaggaatcgccccttgtccgaaggattaaatatcctggagggattgttgtttgtggcgatcgcaatccgattgatttttacaggctaccagggttatttagtacagaagctagggcaacaaatcaccgccgcaattcgccaagatttatttcagcacgtaacatccctagcagtacgcttttttgaccgcacacccgtaggtaaattaatcaccagaatcaccagcgatgtggaagtcttaggcgatgtcttttctactggggcaattggcatcgtgtccaatttgttttccatgctggtgattttaggtttaatgttttccattgaatggcaactgacttgtttgctgctattgatgctattaccagttacctggttaattgtttacattcagcaacagtaccgcaaagccaattacaaagggcgggaagaactttctatattgaactcacagctacaagaaaatgtccttgggattaacgtagtgcagttattccgtagggaaaaatttaatgccgaactgtttcgtgccaccaacagccgctacacacagcaaatggatcaaaccattttttatgattcatttatttcagcaaccttagaatggattgggctgattgcgatcgcagctgttttgtgtatgggtggttggttactgttaggaaaaagtatagcttttgggactttatcggcatttgtcttgtatgcccagcgattatttgaccctttaagggattttgccgaaaaatttacagtaattcaagctggttttactgccattgaacgcgtaggcgatatattagatgaaccgatagaaatccgcgatcgcgccaatgtgcgcttctcaatatttgatgctaaattcggctacatagacgaaatcgttgcaaatctagaatccccagatactacttccccgcctgaactgggagagatttgctttgatcgtgtctggtttgcttataaaaatgatgattacgtaattaaagacttagatttcaccattcgtcctggtgaaaaagtggcattagtcggtcccacaggtgccggcaaaacttcgatcatccggcttttatgccgcctctatgaacccaccaaaggacgcattctcatcgatggcgtagatattcgagaagtcccacaggcagaactgcggcgctacatggcagtaattttacaagaaggttttttatttgctggcgatgttaaaagcaacatttctttaggagatggttataccattgaacagattcaacaagcagcagagcaaaccaacattgcccaatttatagaagaactaccccagggttatgatactcaacttcgagaacggggcacaaatatttctagtggtcaaaagcaacttttagcctttgcacgggctgctattcgcgatcctcaaattttggtgttagatgaagctactgctagtttagatgttggcacagaagctttagtgcaagaggcattaaaccagctaatgctcagacgtaccgctattattattgctcaccgcctgtctacgattcgcaatgtagaccggatttttgttctcaagcgtggcgaattaatcgaacagggaagtcacgaccaactactggaacagggagggctttatgcaactttgcataacttgcagatgttgggaagt

SEQ ID NO: 43649 - DNA, 1797 bp, Nostoc punctiforme
atggcaaaagtagttggaattgacttaggaacaacgaactcctgcgtggcagtgatggaaggtggtaaacctactgtaattgctaatgctgaaggttttcggacaacgccatcagtagtggcatttgcgaaaaatggcgacaacttggttggccaaatcgccaaacgccaagcggtgatgaaccccgaaaatacgttttactcagtcaaacgctttatcggtcgccgctacgatgaagtgagtaacgaagcaactgaagtttcttacaaagttctcagcagcaacggcaatgtcaaattagattgtccgatagctggtaaaccgtttgctcctgaagaaatttctgcaaaagttcttcgcaaactagttgaagatgccagcaaatatcttggtgaaactgttagccaagctgtaatcaccgttcccgcatactttaacgactcccaacggcaagcgacaaaggacgctggtaaaattgcaggtattgaagttctgcgaattatcaacgagccgactgctgcttctctagcttatgggtttgacaagaagagtaacgaaaccattcttgtatttgaccttggtggtggtaccttcgacgtatccgtgctggaagtaggagatggagtttttgaagtactagccacatctggagatacacaccttggtggtgatgacttcgataaaaaaatagttgacttcttagctgaaaagttcaagaaagccgaaggcattgaactacgcaaagacaaacaagctttacaacgtctgacagaagccgcagaaaaagccaaaattgagctttctagcgttacccaagcagaaattaacctaccatttatcaccgctacccaggatgggcctaagcacctggatacaaccctgactcgtgccacctttgaagaactttgttctgacttaatcgaccgttgccgtgttcctgtggaaaacgctctccgcgatgccaagttaagcaaaggcgatattgatgaagtggtgttggttggtggttctacccgtattcccgcagttcaacagattgtgaagcaggtattgggtaaagaccccaaccaaagcgttaaccctgatgaagtcgtagcaattggtgcagcaattcaagcaggtgtactgaataatgaagtcactggcatcttattgttagatgtatcaccactttctttgggtgttgaaacattgggtggcgtgatgaccaaaattatcccccgcaacaccacaatccccaccaagaaatcggaagtcttctccaccgcagtggatggacaaaccaacgtagaaattcacgtccttcaaggtgaacgcgaattttctaacgataacaagagtttgggaaccttccgccttgatggtattcctcctgcaccacgtggcgttcctcaaattgaagtggtgttcgatattgacgctaacggtatccttaacgtcaccgctaaggacaaaggtactggcaaagaacagtccatcagcataactggtgcttccaccctggataaaactgacgttgaccggatggtaagagaagctgaacaaaacgcttcatctgacaaagaccgacgtgagaagattgaacgcaagaaccaagccgactccttggcataccaagctgaaaagcagttacaagaattgggcgataaagttcccgatgctgacaagactaaagttgaaggtttggtgaaagaactgcgggaagcagttgcgaaagaagacgatgagcaaatcaagaagctcaccccagaattgcaacaagctctattcgctgttggtagtaacatctatcaacaa

SEQ ID NO: 43650 - DNA, 1461 bp, Nostoc punctiforme
gcagaactgcctataaatatgttagccgttaaaacccgttctttatgggaccctttagatgaattgcaagactatgaagactattttccagttttgcctaaacctaatattatcaaaacataccaaagtgatgactctttttgtgagcaacggctttgtggggcaaatccttttgttttacgtcgaattgagcagatgccagatggcttcgcctttaccattttagaattgcaagaaaaatttggtgactctattaacttagtagaaaaacttgcgaatggaaatttatatgtagctgattacagagcgcttgcgtttgttaaaggaggtagttatgaaagaggtaagaagtttttaccaacccctatagctttcttttgttggcgcagttctggttttagcgatcgcggtcaactagtaccgattgttatccaaatcaaccccgcagatggcaaacagagccagctaattacacctttcgatgaccctttaacctggtttcatgccaagctttgtgttcaaattgctgatgctaaccatcatgaaatgagtagccatctgtgtcgaactcactttgttatggaaccctttgctattgtcacagcccgtcaactagccgagaaccatccccttagcttactgctaaaaccccacttccgtttcatgttggctaataatgacttggctcgtaagcgcctaattagtagaggtgggcctgttgacgaattgctagccggaactctgcaagagtcattgcaaattgtcgttaacgcatatacagaatggagcttagatcagttttccttacctactgaactaaaaaatcggggtatggatgatccagacaacttacctcactatccctatcgagacgatggcttattattgtggaatgccattaaaaagtttgtgtctgaatacttgcagatatactacaaaactccccaagatttagcagaagacttggaattacaaagttgggtgcaggaattagtttcccaatcaggcggacgagtcaagggtattagcgaccgcatcaacacattagaccaattagttgatattgctactgcggttatcttcacctgtgggccgcaacacgctgctgttaactactcacaatatgaatatatgactttcatgccaaatatgcctcttgctgcttataaacaaatgacatcagaaggcactattcctgaccgtaaaagtctattatcatttctgccaccgtcaaagcaaactgctgaccaattatcgattttatttatcctgtcggcctaccgttatgacagattagggtactacgatgataaatttttagacccagaggctcaggatgttttagctaaattccagcaggagttgaatgaagcagagcgggaaattgagttgaataacaagagtcgtttaataaattacaactatctcaaaccaaggcttgtgactaatagtattagcgtg

SEQ ID NO: 43651 - DNA, 759 bp, Nostoc punctiforme
atgatcgaagttgagcatttaagtaaaatatacggttccaccccagcgattactgatgttacttttagtgtcgaacctggggagattttagggcttctggggccaaatggcgctggtaaaactacaaccatgcggattctggcaggttatttaccagcaacaaatgggaatgcccgcattgctggttatgatgtccatgaaaattctctagcggtacgccaacgaattggttatttacccgaaacaccgccgttatatccagacatgactgtggagggatttttgcattttgttgcccagattaagggagttccagcaggcgatcgccccaacaaggtaacagccgctatcaaacgctgcaacttagaagataagcggcgggtaattattcgcaaactctctaaaggatatcgccaacgtgtaggaattgctcaagcgatcgttcacgatccaccagcgatcattctcgatgaacccaccgttggactcgatccccgacaaataattgaggtacggaatttaattaaaagcctcgctgggactcatacaattattctttcgacgcacattctgccagaagtgagcatgacttgtagccgcgtcgctattattaatcgcggcaaagttgtggcaactaatacaccagaaaacctgatgactcagttgacaggcggttccgggtatgagttggaaatagaaggagaagctgccctagcgaaacaggtattgcaaaatgtcgcgggtgtgagtctgatcgaa

SEQ ID NO: 43652 - DNA, 1617 bp, Nostoc punctiforme
gatgtacttgtcattggtggcggtacagccggaacaatggcaggtatcaaagctaaacaagcaaatcccgatgcagaggtgctgattttagaaaaggctaacatccgacggagtggtgcgatcgcaatgggtatggatggggtaaacaccgcagtcattcctggtcattctaccccagaacaatacgtgcgcgaaatcaccttagctaacgacggtattctcaaccaaaaagctgtatatcaaacaggcaaattaggttatgaagtcatccaagaattagaaagttggggggtgaaatttcaaaaagatgtccaaggcaactatgatttaaaacaagtgcatcgtgtgggtaaatatgtcttacccatgccagaaggtaaagacctcaaaaccattctcacccgccaagtcaaacgccacaaagtcaaagtgacaaatcgtgtcatgtcaacaagggtgttagttaaagaaggtggtgctgttggtgcagtaggatttgatgtcaggaacggcgattatattgtcattcaagccaaagcagtcatcttgtgtacaggtgcttgcggcagattaggattaccagcttctggctatctctacggcacttacgaaaatcctaccaatgccggagatggctattcaatggcttatcatgcaggagcagaactcagcaatattgaatgctttcaagttaatcctctaattaaagattataacggccctgcttgtgcttatgtcgctgggccttttggcgctcatactgccaacgccgaaggaaatcgcttcattagttgtgactattggagtggtcaaatgatgttggaaatctggaaagaattaaactctggtaaagggccagtccaactgaaaatgacccaccttgatgaagataccattgctgaaattgaatcaatactttgggcaaatgaacgaccgagtagagaacgctttcatcaaggcagaaatgaagattaccgcactcacggcgtagagatgcacatttccgaaattggcttatgtagcggtcatagtgcctctggtgtgtgggtaaatgaaaatgctcaaacaaccgtccctggtttatatgcagccggagacatggccagcgttccccataattacatgattggggcatttgttttcggtcgcatagccggaactgatgccattgaatatatccaagatttagattttatcgaaccagatacagactttttagaagctgaaaaagccagaatttatgcacctttaactcgcccaaatggtgtacctcacacccaggtagaatacaaattaagacgcttagttaatgattatctgcaaccaccaaaatcaggcaataaaattgagattggtttgaaacattttgtccaatatcaacaaacattagatgtaatgggcgcccgtgaccctcatgaattgatgcgtagtctagaagttcactttattcgtgactgtgcagaaatggcagccagagcatcattatatcgtcaagagactcgttggggtctttatcattaccgcttagattatccagagaaaaataatgaagagtggttttgtcatgtcaatttaaagaaagatgaattaggacaaatgatattgtttaagcgtcct

SEQ ID NO: 43653 - DNA, 819 bp, Nostoc punctiforme
gttggtttagtaactttagatttgatttaccttgctgaatctgctcctaaaaataatcagaagattgtcgctactgactatactgtagcggcaggtggcccagcaacaaacgcggctgtgactttcagtcatttaggtaatcaggctacagtcttaggtgtagtgggttctcacccaatgacacagctaattcgaggtgatttggcaaattacaaagttgcgatcgcagaccttgagcctaccactgatttagcaccgcctgtctcctcaatcattgtcacccaagccacaggtgaaagagccgtggtttccatcaatgctgtcaaaactcaagccagtagcgcatctatcccaccagatattttgcaaaatgtcaacatagtactgattgatgggcatcagatggctgtaagttatttcatagcccaagcagctaaagccaaaaatattccagtagtaatcgatggtggcagttggaagcctggatttgagcaaattttgccgtttgtagattatgctatctgttcagctaatttttatccgcccaactgtcagactggagaagacgtttttgcctatctggccggctttaacatttcttacatcgccattacccacggacaaaaaccaattgaatacttgagtcgcactgcatctggtatcgtagatgtgccgcaaatacacgcggttgatacattaggggctggagatattttccacggtgctttttgtgattacattttaagggaaagttttactgatgcgctggcactggcagctaagattgctgctgattcttgtaaattttttggcactcgg

SEQ ID NO: 43654 - DNA, 939 bp, Nostoc punctiforme
gataatcatcgcttgcggctgttttcgggctctgccaatttacagctgtctcaagaagtcgctcgttatgtcgggatggacttggggccaatgattcgcaagagatttgcggatggagaactttacgttcaaatccaagaatcaattcggggttgtgatgtctatttaattcagccatgctgtcaacccgtaaacgatcatttgatggaattattgattatggttgatgcctgtcgtcgagcttcggcgcgacaggtgacggcagtaattccctactatggctatgctcgtgccgatcgcaaaacggcaggacgagagtctataactgccaagctggttgctaacttgatcaccgaagcaggtgccaaccgcgttctagcaatggatttacactcggcgcaaattcaaggctatttcgatattccctttgaccatgtttatggttctccagtattgctggattatctagcaagcaaggaattgcccgaccttgtggttgtttcccccgatgttggcggtgtagcaagagccagagcatttgccaaaaaattaaatgatgctcccctggcgattattgacaagcgtcgtcaagcacataatgttgcagaagtgttaaatatcatcggcgatgttaaaggcaaaacggcagtgttggtggatgacatgattgacactggcggcacgatcgcagaaggagcgcgattactgcgtgaagaaggagcgcgtcaggtatatgcctgtgcaactcatgcggtattttccccaccagcgatggaacgattatccagtggtttgtttgaggaagttattgtcaccaatacgatccccataccagaaaacaatcgttttcctcaactagtggtgttgtcagtagctaatctcttaggagaaactatctggcggattcatgaagatacttcagttagtagtatgttccgc

SEQ ID NO: 43655 - DNA, 3372 bp, Nostoc punctiforme
agttcccaatcctttcatgtcatcaaacctagaaaacttaataataaaaagcacgacagggtgtaaagacccttaaaataatcaggatttgtattctcatactccaaggcaacgactatgccccgccgtgacgacctccggaagattctactgttaggctctggcccaattgtgattggacaagcctgtgagtttgactactctggcactcaagcctgcaaagcgctgcgagaagaaggctatgaagtagttttggtcaactcaaaccctgcaacaattatgaccgacccggaaacggccgatcgcacttacattgagccgttaactccagaattggtcgaaaaagtcattgaaaaagaacgccccgatgctttattaccaacgatgggaggacaaaccgccctcaacctcgccgttgctttagccaaaaatggcgtgttggaaaagtatggcgttgagttaatcggcgctaaactgccagccatcgaaaaagccgaagatcgaaaactgttcggtgaagcaatggcaagaattggggtagctgtgtgtcctagcgatacagccgaaactttggaagaagccaaagctgttgcccgtcaaattggtagttatcccctaattattcgtcccgctttcactatgggtggaagtggcggcggtattgcctacaaccaagaagaatttgaagaaatggcacaggtaggtatagatgccagtcccgtttcgcaaattctcattgaccagtctttgctgggctggaaagaatatgaactcgaagtgatgcgtgatttggcagataacgtggtgattatctgttccatcgaaaaccttgaccctatgggcattcacaccggggactctattaccgttgctcccgcgcaaacccttactgataaagaatatcaaaggctgcgggatatggcaattaaaatcatccgcgagataggtgtggaaactggcggttctaatattcaatttgccgttaatccgcttaatggggatgtggtggtaattgagatgaacccccgcgtttcccgcagttcagctttgtcttccaaagctacgggttttcccatcgctaaaatggcagcaaaattggctgtgggctacaccttggatgaaatcaaaaatgacatcaccaagaaaactcccgcgtcctttgaaccgacaattgactatgtggtgacaaaaatcccccgtttcgcctttgaaaaattccccggttctgacccagtactgacaacccaaatgaagtctgtcggggaagcaatggcaattgggcggactttcaacgaatccttccaaaaggcgctgcgatcgctcgaaacaggacgcgctggttggggttgtgataaagccgagaaattacccagtggcgaacaaattcgcgcccaactgcggacacctaaccccgatcgcatttttgccgtgcgtcatgctttgcagcaaggtatgactattgaagaaatctatgaactgactggtattgaccgatggttcttagataaattacagcaactcctagatgtcgaaaaattcctgaagcggacacccttgcagcaactgacaaaagagcaaatttatgaagtgaagcgggacggatatagcgatcgccagattgcttatgccaccaaaaccactgaagatgaagttcgcgcctaccgcaagtcactaggaattatccctgtttacaaaaccgtagatacctgcgcggctgagtttgaagcgtttaccccctactactattctacttacgaagaagaaacagaggtaatgcccgcaaccaagccaaaagttttgattttgggtggtggccctaaccggattgggcagggaattgagtttgattattgttgttgtcacgccgcctacgccttgaaggatgcggggtatgagacaattatggtcaattctaacccagagacagtttcgacagactacgataccagcgatcgcctttactttgagcctttaacaaaagaagatgttcttaacatcatcgaaactgaaaatccagtcgggataataatccagtttggcggacaaaccccgctaaagttggctattcctttacaagagtttcttaacaatgacacttcaggattgaacactaaaatttggggtacatccccagattccatcgatatggcagaaaaccgggaacggtttgaaaagattctccaagagttgaatattgcccaaccgcctaacggtattgcgcggagttacgaagatgcgctgattgtcgccaaacgcatcggctatccggtggtggtgcgtcccagctatgtgttggggggacgagcaatggaaatcgtttattctgatgctgagttggaacgctacatgagctttgcagtactcatagaaccagaacatccgattttgattgataagtttttggaaaacgccatcgaagtcgatgtagatgcgatcgccgatcacactggacgggtagtaattggtggtatcatggaacacatcgagcaggctgggattcactcaggtgattccgcttgttctttaccttccatttccctatcaccagcagttctcaatcaaattcgcacttggacggtgcagctagcacaagcgctctcagtcgttgggttgatgaatatccaatttgctgttgtcggtgcaagcagctattctccccaagtttatattctggaagctaacccccgcgcctcacgtacagtgccatttgtatctaaagcaacaggcgtacagttagcgaaactagcatccttaattatgtcgggtaaaaccttagaggagctaggtttcaccgaggaagtcattcccacacatattgctgtaaaagaagcagtattaccctttaataaattcccaggaactgatacaatattgggcccagaaatgagatccactggtgaggtgatgggaattgacagcgactttggccgggcctttgccaaagccgaattgggcgctggggagcgtttaccactgactggaactgtatttgtatcaatgagcgatcgcgataaagctgccgctggtgctgtggtgaaggagtttatcgatttgggctttacagtgatggctacccttggtacacggcgagttcttcttgaacaggggttaaatattgaattagtgttaaaactccatgaaggccgtccccacgttttggatgcaatcaaaaatcaaaaaatccaacttattatcaacacaccttccggggaagaagcccatactgatgctaggttaatccgtcgcacagccttagcttacaaaattcccatcattactaccatcgctggcgcaaaagctaccgtcgccgccatccgttctttacaaaatacaactttggacgtaaaaaccattcaagagtactgcccgatt

SEQ ID NO: 43656 - DNA, 336 bp, Nostoc punctiforme
cacaattgcgggcggcggggattgagccagaagtgtgatgggcaaatattggctagtagtagtttagacgacactatcaaagtgtggtcagtgacaacaggcagagaaattcgcacccttagtggtcattccaacgaggttaaatatgtcgccatcagtagtgatgggcaaatattggctagtcatacttgggacaagactatcaaactgtgggaagtcgcaacaggaagagaaatttgcaccctcagtcttttcgacccagctcattccgtcgcctttagccccgatggaagttggctggctgctggtgatgtcagcggaaatatcaaaatttgg

SEQ ID NO: 43657 - DNA, 2106 bp, Nostoc punctiforme
gtatggcctgggaatgtatatcccttgggtgctaattgggatggaaaaggtacaaattttgctttgttttcggaaaatgcaacaggtgtagaactttgtttatttgatgctgataatcatgaaattcgcttgcctttaacagaaaaaaataattttgtttggcacgcttatctaccaggagtaggtcctgggcaacgctatggatttagagtacatggcccttgggccccagaacttggtcatcgctttaaccctaataaactattaattgatccctatgccaaggcaattgatggggaaattagcgataccgcagctatttttggctactctttagatgcgccagagcaagacctagctttttccgatttagataatgccgaaattatgccgaagtgtattgttgtcgatcagtcttttgattggggagatgacaaactactttctataccgtggcacgaaactattatttatgaaactcacgttagaggttttactaaattacacccagaaattccagaagaattacgtggtacctatgcagggctggcacatccagttgctattcaatatctacaacaactaggaatcacatctgtggaattgatgcctgtgcatcactttttatcttctccaggatttctggtaaataaaggactgaaaaactattggggttacgattccattaattatttcaccccctattctggttacagtgctaatggctcagtcggacaacaagtgaccgagtttaagcagatggtcaaggacttacactctgctggcattgaagtaattttagatgtagtttataaccacactggcgaaggcaatcatttagggccaacattatcgctacgaggcatcgataatgctgtgtactatcgcttggtcaaagataattctcgctactacatggacttcacaggctgcggcaactctctaaatgtgcgtcatgcccaagttctgaagttaatcatggatagcctgcgctattgggtaacagaaatgcatattgatggctttcggtttgatttagcttcggcattagcgcgagaactatatgaagtagatagtctcgcagctttttttgatattattcatcaagatccagttctggcagatgtaaagctaattgctgaaccttgggatttaggagaaggtggttatcaagttggcaattttcctttacgttggtctgaatggaatggcagatatcgtgatactgtaagggatttttggcgtggtgaggatgatagcctcggacaatttgcttactgttttactggtagccctgacctttaccaagcaaacgggcgtaatcccagtgccagtattaatttcatcactgctcatgatggcttcacgctcaatgatttggtcagctataacgaaaaacataatcaggacaacggcgaagatagccgggatggggaaagccataaccgctcttggaattgtggtgtagaaggagaaactaatgacccagatgtaatccgcttacggcaacgtcagcgacgcaactttttagcaactctaatgctgtctcaaggcatacctatgctattaggaggagatgaaattggttgcactcagaagggtaacaacaatgtatactgccaagataatgaaattgcctggcgtgattggagtttacaaaagtctaattccgaactactagattttgcccgcgaactgatttattttcgtcatcagcatccagtatttcggcggcgtaagtggtttcaaggccgtcctattcacggttttgggatcagtgatattggttggtttaatgacgatggcagcgaaatgactgaaaagcagtggctagttagttatgccaaagctatggaaattttcttgaatggcgaaggcattgttactcctggccgccgtggtgaacggattattgatgaaagctttttgctattttttaatgctcactacgaaacgattgagtttgctttacccaatgttttccaggatagggaatgggaaatagttattgacaccaacgaacctcgcttccttagcccaggaaagttggttatgggtgagcaaactgtgccagttacagatcgctctctcatagtgttacgtcgt

SEQ ID NO: 43658 - DNA, 990 bp, Nostoc punctiforme
atgactagcaatttagaagctcaacttttagcactgcggcaagaaggagaaaaagcgatcgcagccgccgacaccctagaacgtctggaagaactcagagttaactatctgggtaaaaaaggggaactgggggcgctgttgcgaagtatggggcagatgagcgcagaggaacgaccaaaaattggagcgatcgccaatacagtcaaagaatctctgcaaactagtctagaccagcaacgtgttgccctcgaagccgcgcaaattcaggtacagctagaggcggaaactctcgatgtaacgatgccaggaatttacagtccccaaggtcgcattcatcccctcaacggcattatcgaccgggcgctggatatctttgttggtatgggctataccgtagctcaagggccagagatggaaacagattactacaattttgaggctctcaacaccccgccagatcaccccgcccgtgatatgcaggataccttctacctgccagatggtaatcttttacgcactcatacttcgtcagtgcaaattcgttacatggaaagagaagaaccaccgattcgggttgtagctccagggcgagtttatcggcgagataatgtagacgcgactcactcggctgttttccatcaaatagaacttttagccattgatgagggactaacttttacagacctcaagggcacaattaaagtatttttacaagcaatttttggcgatttacctattcgcttccgcgccagttatttcccgtttactgaaccttctgctgaagtggatttgcagtggaatggtcgctggctagaggtgatgggctgcggtatggtcgatccaaatgtacttaagtctgtaggttatgacccagaagtttatactgggtttgctgccggttttggtgtagaacgctttgcaatggtgttacatcaaatcgatgatattcgtcgattgtatgctagtgatttgagatttttgcaacaattt

SEQ ID NO: 43659 - DNA, 1167 bp, Nostoc punctiforme
atgaaagcagtttgctggaacggtgccaacgatgtacgggtagaaacagtacccgatccaaaaatcattaatccgcgtgatgctgttattaaaatcacgacaacagcaatttgcggttctgatttacacctttataacggctacgtccctacaatggaaaaaggcgatatcctgggtcatgaaatgatgggggaagtcgttgaaataggtagtgccgtcaaaaatttaaatataggcgatcgcgtggttgtaccattccctatcgcctgtggtaactgctggtactgtcaacatgacttctggtcattgtgcgataactctaacccaaacgcttggttagcagaaaaattcatgggttattcaccctctggtatttttggctactctcatatgctaggtggctacgctggtggtcaagctcaatatgcccgcgttccctttgccgatactggtttgtttaagattcctgatggactaacagacgaacaagtagtgtttttaacagatatcttccccaccggatatatggcggcagataactgtaatattcagcccggtgatattgtcgcagtctgggggtgtggcccagtcgcacaattcacaattaagagtgcttatctacttggtgctgaacgagtcatcgctatcgatcgaattcccgaacgcctacagatggctaaagatcaaggcaaggcagaaatccttaactatgaggaagtagatgttggtgaagccctcaaagaaatgacaggtggacgcggcccagatgcttgcattgatgctgtggggttggaagcacacggcacgggtctagaaggagtatacgacgaagtaaagcaagcagtgcgtctggaaacagaccggccccatgtgctgcggcaagtgatgattgactgtcgcaaaggcggtcacgtgtcaattcctggtgtttatgtcggcgttgtagacaaaatacctatgggtgctgccatgaacaaagccttagtattcaaaatgggacaaacgcacgttcataagtacttaaacacgttactcgatcacatccaaaatggcaggatcgatccatctttcgtgatcacccatcgtctaccgttagatgaagcaccccggggttacgaaattttcagagacaagaaggaaaactgtatcaaagttgtactcaaacca

SEQ ID NO: 43660 - DNA, 1287 bp, Nostoc punctiforme
gtgaaaaaagtattatcaatcatccttggcggtggcgcgggtactcggctttacccattaaccaaactccgcgctaaaccagcagtaccagtagcggggaagtaccgcttaatcgatatccctgttagtaactgcataaattccgaaatattcaaaatctacgtcctgacacaattcaactcagcttctctgaatcgtcacatcgcccgtacctataactttactggctttaacgaagggtttgtggaagtgctagcggcacaacaaactccagaaaaccctaactggttccaaggtacagcagatgcagtgcgtcagtatctgtggttaatggaggaatgggatgtagaagaatatctaattctctcaggcgatcacctctaccgcatggattatcgccagtttatccagcgtcatagagatacaggagctgatattactctctcagttatccccatagacgagcgccgtgcctcagattttggtttgatgaaaatcgatgactccggtaggataattgactttagcgaaaaacccaaaggtgaagcattaacccaaatgcaagttgatacaagtgtactgggattaacaaaagaacaagcccaaaaacaaccttacatcgcttcgatggggatttatgtctttaaaaaagaggttttgttcaagttgttgagagaatctgtagaacggacggattttggtaaagaaattattcctgatgcctctaaagattacaacgttcaagcttacctttttgatgactactgggaagatattggaacaattgaggctttttatcatgccaatttagccctgactcagcagccccagccaccctttagtttctatgatgaacacgcaccaatttatacccgcgctcgttacttacctccgactaagcttttagattgccagatcacagaatcaattattggcgaaggttgtattttgaaaaattgccgcattcaacattcagttttaggagtgcgatcgcgaattgaatctggttgcgtcattgaagaatctttgctcatgggtgcagatttttaccaagcttctgtggaacggcaatgtagcttgatagaaaatgacattcccgtaggtatcggtacagacacgatcattcgtggtgctatcatcgataaaaatgcgcgcatcggtcacgatgtcaaaattgttaataaagataacgtgcaagaagctgaacgcgaaaaccaaggtttctatatccgcagtggcatcgttgtcgtgttgaaaaatgctgtaattcccgatggaaccatcatt

SEQ ID NO: 43661 - DNA, 1680 bp, Nostoc punctiforme
tctattattcaagctctaccaacagaagtcgtatatctcattacagctggtgaggtaatcgactctttagcctctgtggtgcgggaattggtagaaaattccctagacgcaggtgcaacgcgaattgtggtttctttatggccgcagcaatggcgaattcgtgtcgcagataatggttgtggaatgaacctagatgatttgcaacaagcagccacagcccacagcaccagtaaaattcgctctagtgccgatttatggaaaattaacagtttagggtttcgtggtgaggcgttacacagcttaacaactctggcagatttggaaattttgagtcgtcctgtggatggaaaattaggatggcggattagctatggcaatggtgggaaagttgtgcaagttgaagtaactgcgatcgcacctggtacagtagtgacagtttccaatcttttcggtaattgctcatcacgtcgtcagggattgcccacaacagcacagcaaatgaaagccgtgcaagccacaatttaccaaatcgccttatgtcatccccacgtcacctggcagatttggcaaaatgaccgtcaatggttcaccatttctccggctagaacaactgggcaattgctaccgcagattttaccccaagtgcgacaaggtgacttgcaagaagtcaaactcgaaatacccaatcctccccactccccactcccttgtacaaacgcgattcatcgcgtctctccccactcagcactcactttagtggtaggattacccgatcgctgtcatcgtcatcgtccagattgggtacgtgtagccattaatggacggatggttaagacaccggaactagagcaaacgatattatcagcatttcacagaacattaccacgcgatcgctatccaatttgtttcctacatcttgccatttcccccgatcaaattaactggaatcgcaatccagcaaaaacagaaatttacctcaatgaaatcatttattggcaagagcaaattacccaagcaattaaccaagcgctcagtatctcttcttccaatctcaaagaagctgttcacacaacacgagttagtaaattactcaaagccgcagaagccaaaggcggctacaatttcaatcctcaaaatcccaaggaagatcgcaaaaatcctaattccttgaaggctgtcgctcaagttagcaacacctatattgtggctgaacatccaggtggtatgtggttagtagaacagcacattgcccacgagcgagttttatatgagcaattatgcgatgattggcaacttgtccccgtcgaaccgccaatcattctttatcaattgtcgctagcgcaagtatcgcaattgcaacgcataggtttagacatagaatcctttggcgagcaactttgggctgtccgaaacatacctgcacctttgcaacagcgagacgactgtgcagaagcaattttagagcttagttggggaggcgatttacaaacagcccaagtagctgtcgcctgtcgcagtgccattcgtaatggtacacccatgaatcaacaagaaatgcagacacttttagataattggcaacgcactcgcaaccctcgcacctgtccccacggacggccaatttatttatctttagaagaatcagccttagcccggtttttccggcgtaattgggtaatt

SEQ ID NO: 43662 - DNA, 1611 bp, Nostoc punctiforme
atgctcattatcctgatattattaataataatgcttgtcggcgtaactgcctttaatagttttgttagccgctatttgctagatatcattactgaagaaaaagattttaatgaatttattaatacattattagtttatggtgctgcccttgtctgcgtaacgctcttagtaggattttctaaatttgttagaaaacaaatcgctcttgattggtatcaatggctaaataatcatattttagaaaaatatttgagcaatcgtgcctattataaaatcaattttaaatccaatattgataatccagatcaacgaatatcccaagaaatcgaaccattgattagaaatgctctcactttttcggctacttttttagagaaagtgctggaaatggcaacttttttagtaattctctggtctctttcgcaatttgttgcagttgtattagttgtttatacgataataggcaatttaattgctgtttatttggctcaagaattaaataagattaaacaagaagaactcgaatttgatgcagactatacttatggactgactcatgttcgtaatcacgctgaatcaatagctttctttcagggagaaaaacaagaattaaatataatcaaacgaagatttaataatattattaaaagtgctaaacgcaagattaattgggagttaactcaggatatttttaacagaggatatcaggcggttatccaaatatttccatttatagtatttgggcctttacagattagaggtgaaattgaatttggagaaattgcccaagccagtttagcttgcaatttgtttgctactgctatggcagaattaattagagaatttgcaacttcgggacgattttccagttacgttcaacgtttgggtgagttttcagatgcgatagaatttgtcaacaaagagccagagaaagtaagtactattaaaacaatcgaagaaaatcatctcgcttttgagaatgtcactttacaaacacccaactatgagcaggtgattgttgaagatttatcattgtctgttcagccaggagaaggtttattgattgtggggcctagtggtcgaggtaaaagttctctgttgagagcgatcgctggtttgtggaatgcaggtactggtcgtctggtgcggcctccattagaggaagtgttatttttgccccaacgtccttatataattttgggaactttacgcgaacagttactctatcctcatacaactcataagatgaccgatgcagaactcaaagaagttttacaaaaagtcaacctacaaaatttattgagtcgagtagatggctttgatacagaagttccttgggagaacatattatcgctgggagaacaacaacgccttgcatttgcacggctactaattactcatcctagatttactatattagatgaagcaacaagtgctttagatttgaaaaatgaagagagtttatatcaacagttgcaagatacaaaaacaacttttatcagtgttggacatagagaaagtttgtttaattatcatcaatgggttttagaactatcaggagattctagctggcaacttattagcatacaagattatcaactacaaaaatca

SEQ ID NO: 43663 - DNA, 999 bp, Nostoc punctiforme
atcataatttctgatgaaactctccgggatggagaacaacaagcaggtatcttcttctcttatccaactaagcaaaaactagcccatttaattgcccaaactggagtagatagattatctatgatgccccgtgttcatgagcaagaagaagagctagtcaaatcattagtatcggaaggattggatagtctgatcgctgctgctaccatgacgggaaagcagtatatcgatcaagccaaaatgtacggagttaagcgcatcatccttttctacggcctttccgatcgcctgctgtttctgcgagatcctcagatccgtttgttgaacgagtttaaaggaaaaaccattgatgatgatatcccaaaaaaagtaattgagagaattcgccaaaacgccattgatttaattgtcgaaaacttgcactatgccactacagttgctggactcactgtagactttgccgccgaagatgcctcaagagccgattttgactttttagtgcaatgtatccgctcttttagcccttatctcgaccattttatgctctgtgataccgttggagtcctcactccagaaaagagctatatctggattaacgacctgctgcaacgtacaactggggttgctttcggggtacactaccacaatgacatgggcttggctctcgaaaatactctccagtctgtcatcgccggagcgactttagtatcgggtacgttttgcgggattggtgaacgagccggaaatgttgccattgagcaggtattgaatgggttgcgagtccgctttggaattgaagtcaaagggattaattatgatgcgatcgccgccgtgactgattacattgagcaactgggaattcgtcctgctcccccttactctcaaactgctcaacgccacgaatcaggcatccatgtcaattctttgtttagcgaccctcaaagctatgctgctttgccttacaacaccatagaggttctcttcggtaaatggagtgga

SEQ ID NO: 43664 - DNA, 1728 bp, Nostoc punctiforme
atcgctaaactcagtgcttatctacgaccccattggcgggaagcgtcattaggcattctcgctttgttgtctgtcaatgcactgggcgtttatatcccttggttgattcgtgctggtgttgataaactctcaacaaccttcaactggaacgaaatactacattatgtagtaatcattgtcttgctcagttcggcgatgtggctaatgcggatggcatcacgcatttggctatttggggtaggtcgtcaggtggaatttgacctgaaacaacggatttttgaacacttactcaagctggagccggcttattttgccagtaatactgctggcgatttgattaatcgggctaccagtgatgtggacaatatcaaacggttattgggttttgccgttttgagtttggcaaatacggtgtttgcctacgccctgacactgccagtaatgctagcgattagtgtggatctgacgctagcatctctggcagtttacccttttatgctcttgttggtgagtctgtttagcgatcgcttacgcaaacaacaagcagcagtccaagagcaactctctgaaatcagcgaactcatccaggaggatattagtggtattgccttaattaaaatctatgcccaagaagcaaacgagcgtcgagccttctccaagaaaaatcagcagctattgactgctaacctggaattggcaaaactccgaaatacactttttccgctaattggtggactagctaatatcagttcgttggtaattatctggctagggacagcgcggatgtcttctggagcgcttcaggttggcgattttttagcactgttaatttatgtagagcgtctagttttccccacagcccttttaggattcacaattactgcgtaccaacggggtgaagttagtatagatcgccttgaatctattctctctgtcacaccgaaaattcaagatgcagccgatgccatacatctaccagcagctgaacttaaaggggaagtgacagcgaaaaatctcagctacagttaccctggttctactactccagctttagaaaacgttaactttactattgctcctggagaaaccgtggccattgttggggcaattggttcgggaaaatccactttggcgaatgctttaccgcgcttgttggatattgaatcaggacaattgtttttagatgggctggatattactaaaatagctttggcagatttacgaggtgcgatcgcttacgttcctcaagatagttttctatttagcactacaatcaaaaataatatccgctatggcgatccaattagcgaacaagagcagatagaatctgttgctaaacttgccaaaattgaatcagaaattaaaagttttcctcagcaatatgaaactcttgttggtgaacgcggtattactctttctggtggtcaacgacaacgtactgccttagctagagctatgctggtcaatgcgccagtgttaattttggatgatgctctctctagtgtggataatcaaacagccacgcaaatcctcaaaaatctctccagtggtactgaacgcaaaacagtaattttcattacccatcaattatctgcggcggctgcggctgacagaatttttgtgatggaaaagggaaaaattgttcaaataggcaatcacttagaactattgcaacaacagggtttatacagaactttgtggagccagcatcaagttgaggaattactg

SEQ ID NO: 43665 - DNA, 1017 bp, Nostoc punctiforme
tatcgaattgttgccattcctggagaagggattgggccagaagttgtagaagcttccttaaaaattctgcaacacgttgctaaaattcaaggatttaccttacaggtagactatggttggctcggcgcaactgcctttgaacaactgggtagttacttccctcaagccactaccgaactgtgcgatggagccgatgggattgtatttggtgcagttagtcaaggcggattgctggaactccgaaaacacttcgactttttttgcaatcttcgtccaatccgtagcgttaacagccttctgcataaatctagtcttcgaccagagaaaattcaaggacttgatattctcatcgttcgagaactggtgagtggaatctattttgggccgtctggacgctcctcagatgaacgaggaaattatggataccatacgatgcgctattacgatgaagaaattcgtcggattgctcgtaaagctttagagcaagcccaataccgtcgaggattactcaccgtagctcacaaagaaaacgccttacctcatttgcattggactcgtctagttcaagaagaagccacaaagtttcccaacgttattgttgaaccaatgctggtggataacttagccatgcaaatggttctgaatccccaacggtttgatgtaattttggcgagtaatttgtttggagatattctcagcgatattggcggtgcattagttggctcaattggcttattaggatcggcaagtcttaacgctaatggatttggtttgtacgaggccattcacggtacagcgccagatattgcaggcttaggaattgctaatcccctcggaaccttgggagcttgtgttttaatgcttcagcaatggggagaagtgcaggctgcccaacagattattgcagcgcaagaccgaattttagctaagggataccgaacagctgatttgtttacccaaggcgaagaaattttagttaatactgcaaccttagttgaccttttacttgaagaactt

SEQ ID NO: 43666 - DNA, 1635 bp, Nostoc punctiforme
aaacggattgaatctgacgaacatttctatggttttggtgaaccgactggtttactagatcagcgatcaaaagtgaaaaccaactgggcatcagatgcgatcgattacggcatcatgacagacagtatgtatcaggcaattccctttttcatcgccttgcgtcctggattgggatacggacttttttttaatactacttattggagccgatttgatctgggcgcacaacagcctggagtctggcagatggaaactcaggggagcgaactagattactacattatttatgggcctgaacctgcgaaaattatccagacttacacccagctaactggacggatgcctttgccacctcgatggtcattaggttatcaccaatgtcgctggagttatgagtcacaagatatagtacgcaaactagctgatgaatttcgtcagcgtcgcattccctgtgatgttattcatttagatattgactatatgaatagctatagggtttttacctggagtcccaagcgatttgctgatcctcaaaaattaatcggaaatcttaagcaagatggatttaaagtagtgacgattgttgatccgggagtcaaatacgagccagaagcagattacaaagtctttgacgagggattaaagaataactatttcatccgaaaaactaatggtcaattgttccacggctatgtttggccagacaaggctgtctttcctgattacctacgtcctgaagttagagattggtggggaaattggcaaaaaagtttgactgatattggtgttgccggcatctggaacgacatgaatgaacccgcactggatgaccgtccattcggcgatcctggtgacaagatttcttttccccttgatgcaccacaggggccaattgaggaaataaccacccataaggaagttcacaatctttatgggctaatgatggcacaggcatcttatcaaggagcgaaaatatctcgtccgactgaacgctcttttatattgacacgctctggatatgctggcattcaacgctggtcagctatctggacaggagacaatcaatctctgtgggaacacttggaaatgtccataccaatgctttgtaacctgggactatcgggtattccctttgttggtagtgatattggggggtttgcggggaatgctacggctgaactatatgcgcgttggatgcagctaggaatgctttaccccttgatgcgtgggcattcagcattaactactgcacagcatgagccttgggtatttggcgatcgcatcgaaaaaatttgccgcgagtacattgaactccgttatcaactactaccttacatttacactcttttttggttggctgcaactactggcgcaccaattcttcgcccacttctgtatgatttccccaatgacccaaaaaccttttctcttgccgatcaagtaatgcttggcccctccttactagcggcaccaatttaccgtccaggcgttgaacatcgtgccgtctacttgcctgaaggttgttggtatgattggtggagtggggaaacttttataggacccattcacattcttgcttatgcaccactggagaaaatgccgttatatgttcgtgctggctcaattattgcgatc

SEQ ID NO: 43667 - DNA, 939 bp, Nostoc punctiforme
aaaattatcgttactggagcagcgggctttattggttctcaccttgtatacatcttgctacaacaaggggaagaagtaattgggattgatgaattcaatgattattgcgatcccatgttgaagcgcaagaatgttgcacacttacatagctcacctggctttacattaatcgaagcagatattcagtttttagattggcaggaactcttaaaagatgttgatgtcgtttaccatcaagcagcacaagcaggtgtcagggcaagttggggtaaggcttttcgaggttacacggaacggaatattaatgctacgcaagttttgctagaagcggctaaagatgcaaaacacttgaaaagattagtgtttgcttcttcgtcaagtgtatatggtgatgcagaaactttacccactcacgaaggaatttgccctgaacctgtttctccttacggcattactaagctagcggctgaaactctgtgcagactatatcacaaaaactttggtgtgccatatgtatcattgcgctatttcacagtctatggccctaaacaacgcccagatatggcatttcataagttctttaaatccattttgcaggatgaggcgattcctatttacggcgatggccagcaaacgcgggagtttacatttgttggtgatatagtcgcggccaatttagccgctgcttccacaccccaagcagtgggagaaatttttaatatcggtggtggtagcagggtggttttagcagaagtcttagatacgattgaagaaatcgttggcaaaccaatcaaaagaaaccacatagaaaaagcgatgggagatgcacgccacactgctgctgatgtatctaaagcgcagaaaattctgggatatcagccacaagtctccctgagagatggcttgacacaggaatggcggtggattaagtctttgtat

SEQ ID NO: 43668 - DNA, 948 bp, Nostoc punctiforme
cggcaatcaagagatgaagcagatagcttactacgtatcggtgaacaacaatacgcttcaggatatgccgataaaacaattgcatcttgcttgcaggcactagaactatatcactcaattggcgacctaaaagcacaaggtctgacttacaatttgcttgcaaaggcttatatccagattgatagtgcaaaagaggcggaagatgctttacgacgaggattagcgatcgctcgtgatacgaaagacttccaagctcagatttttgtgctaaataatatcggtacatttctcctccaagaaggagaatctgctgctgctggtaaaacagttgaagatgcactcgcaattgctcacggtgtcaaaaacattgaaggggaaggactatctttgagcaatttgggtttggtaactgctaggttgggagattacaacaaggcgattaaattgtatgaaaacgctttaattttccgccgtcagactggcgatgccattggtgaagcaaataccctgaataatttaggtgatgcctacctagcatcgggaaattatcaagataccattgctagttatggtgaagcgatgcggacagctaaaaccaaccgcgatcgcaccaatgaactacgcgcaattgacggtttagtgaaagctcacactgctgttggacgctatgaacgggcttttgatttactagagcaacgtttagcactcgctaaagaattgcaaaatttgcgagaagaattaaaatcttttgagtcttacgctcagttatacaaacaacaaggtaattatctaactgctcgtaatttttacgaaagggcgattatactggcgcggacattggaagacagcaagcaagaagtccaattgctggatcagctaactaaaatgcttcagcggaaataggggcaatctatgcccctactttcgtatttaatttgattaattcaa

SEQ ID NO: 43669 - DNA, 1878 bp, Nostoc punctiforme
atgtgcggaatcgttggatatataggcactcaagcggcgacagacattttattggctgggctggaaaaactagagtacaggggctacgattctgctggaatcgccactgtttgggaaggtgaagttaattgtgtacgggcaaagggcaaactgcataacctacgctctaaactagaacaaatagaagctcctgcccagattggtattggtcacactcggtgggcaactcatggtaagccagaagaatacaacgcccatccccatttagatacggcaaagcgagtggcggtggtgcaaaatggcattatcgaaaattaccgcgacttacgcgaagaactcaaagcaaaaggacaccagttcgtttctgaaactgatactgaagtaattccccatctcatagccgaatttttaaagaatatttccccctcatcttcctcatctcccttcttggaggcagttcgccaagctgttaaccacttacatggggcatttgcgatcgcagttatttctgctgactaccccgatgaattgattgttgtccgtcaacaagcgcctttggtaattggttttgggcaaggggaattcttttgtgcatctgacacgccagcgatcgttgcctacacccgtgcggtgctacctttagaaaatggcgaaattgcccgtctcactcctttaggcgttgagatttacaattttgctggcgataggttgaaaaaacaaccccggctgcttaacttcaatcctgcaatggtagaaaagcagggattcaaacacttcatgctcaaagaaattcatgagcaaccaggagtagtaagagctagtttagatgcttactttaatccagccgaatctaccgaatcgccaatcaatcttggtttacctgcggatttatacaacgatttagaacaaattcagatcctcgcctgtggtaccagttggcacgcagcattaatcggaaaatatttaatcgaacaattagcagaaatttcaactcaagtacattacgcttctgaatatcgctatgcaccatcacccgtgacggctaacacgttgattatcggtgttacccaatcaggcgaaacagccgatactctagcagctttgacgatggaaaaagaacgtcgccaagggagagaacctaaatatcaagcgcgactactgggtattactaatcgccccgaaagcagccttggtcatctagtgccccatgtcatcagtaccttagcgggaattgaaattggggtagcggcgacaaaaacttttactgctcaactgatggcattttatgctttggcattggatttagccgcccgtcgtcagaccgtttcaaaagacacattagataaaattattaacgggttgcggcagattcccaaagaaattgaggcaactttggaaagtcaggaacgtttaactgaacagctagcccatgaattcgccgaaacccaagatttcatttttgtgggaagaggaattaacttccctattgctttagaaggggcgttgaaattaaaagaaatcagctatattcacgccgaaggttatccggctggagagatgaagcatggcccgatcgcacttttagatgcgaaagtaccagtagttgcgatcgcaattcctggtagtgtgtacgaaaaggttatttctaatgcccaggaagccaaagctagagattctcgcttaattggcgtgactcctgtcaacgatggcgaagctgcggaaatctttaacgatcttcttcccatctctcatgtagaagaattactttctccgattttgacagtagttcccctgcaattattggcttatcacattgccgcccgtcgcggtttggatgtcgatcagcctcgtaaccttgctaaaagtgttactgtagaa

SEQ ID NO: 43670 - DNA, 2607 bp, Nostoc punctiforme
gaccatctacaggtggatcgaagtaagctaagtcaaatgtacttgcactatgtcgagacgaaggataaatatcctcacgcggtattgctgtatcgggtaggagatttctttgaatgctatttccaagatgctgtaaaactagcgcaagaattggaattagttctcactagtaaacaagctggcgaacagggacgggtggcgatgtctggtgttccgcatcacgcttgggaacgctacgcgacgctgctagtagaaaagggttatgcagtcgtaatttgcgaccaagtagaagatgcttcggaagctgctggtagattggtgcggcgggaagtaacgcgcattcttaccccaggcactttgctggaagaaggaatgctgaaatccagtcgcaataattaccttgcagcagtggtaattgccgcaaatcattggggtttagcttatgcagacatctctacaggcgaatttctcacgactcaaggtagtgatttagaacatctgacacaggaattaatgcgcttgcaaccttcagaggtgttagttccaacaaatgcgcctgatttaggtagtttgctgcgtccgggagaaacttcgcctcatctaccggagtgtttgccaccatcattttgctatagtttgcgatcgcaagttccattttctcaaggcgaagctagacctcgattattgcagaaatttaaggtgcgatcgctcgaaggactcggttgcgatcgttttcccctcgctgttcgtgcggctggcggtcttttagaatacctggaagatacccaaaagcaaaacccagttccccttcagagactccgcacctacactgtcaccgattacctaattgttgatagtcaaacccgccgtaacctggaaattacccaaaccgtccgggatggaacttttcatggttccctactctggtcattggatagaactagtacagctatgggtgggcgggctttacggcggtggttattgcaaccactactcgatattaaaggcattcgggcgcggcaagatactatccaagaattgatggaaaatacacccctgcgtcaagatttacggcagttgttacgccaaatttatgacctagaacgcctcactggaagggcaggttctggtacagccaatgctagagatttagtagctttggcagattccctctcacgtttaccagaattatcgcacttagtaactgaatcacattctccattcctcaaagctctgcagaaagtcccaagtgtgttggaagaattagcacaaaagttacacgcgcaccttgtggagtcgccacccatactaatcaaagaaggcggattaattcgtcctagcgtcaatcctcttttggatgagagaaaagcaactgtagaagcagaccagcaatggattgccaacttagaagttgatgagagggctaagacgggaatttcgacattaaaggtaggattcaacaaaacttttggctattacatcagtatttctcgtaccaaagctgaccaagtacctgctaattacatccgcaagcaaaccctgaccaatgaggaacgttatatcaccccagatttgaaggaacgagaagcccggattctctcggcgcgggatgatttaaatcagttggaatatgaaatttttacggcgttgcgggaagaggtagcacaagaagcggaagtaattcgcaatctatctcgtgcagtggcggcggcagatgtattgtgtggtttggctgagttggcagtgcatcaaggttactgtcgtccagaaatgttgtcgggaagggaaataaacattgttgatggccgtcatccggtggtggaacagtctttacctgcgggtttctttgtgccgaattcgactcaattaggtcaagagtcattagtcagtagtcatctgtcattagcagataatcaagaacaaataacaaatacttctctacgagaggctgcgccaacgactacgctcagtacaagtgaccaaggacaaatgaccaatgacaatcccgatttgattatcctcaccgggccaaatgctagcggcaaaagttgttatttgcgtcaggtgggattgattcagttaatggcgcagattggtagttttgtaccagctagattggccaaattgggaatatgcgatcgcatttttacccgtgtaggtgcagtagacgatttagcaactggtcaatctaccttcatggtggaaatgaatgaaacggcgaatattctcaaccatgctacatctaggtcgctggtattattagatgaaattggccggggaacagcaacatttgatgggctttccatcgcttgggcagtggcggaatatatcgcagtggatattcgggcgcgaacgatttttgcgactcattaccatgaattgaatgagctagctagcattgtaccgaatgtggctaattatcaagtgacagtgaaagaattacccgaccaaattatctttttacaccaagtccaaccaggaggcgcagataagtcttacggtattgaagcgggaagattagcgggtttaccagcagtggtgattcaacgagccaaacaagtgatggggcaaattgagaaacatagtaagattgcgatggggctgcaa

SEQ ID NO: 43671 - DNA, 381 bp, Nostoc punctiforme
atgtcttttgaatatcctcaagattttagatacctcgattctcatgaatacgttcgaatagatggcgaaattgccactattggcattactgagtttgccgtacatgaattgggtgatatcgtctttttggaactgccagaaattggcgatgctcttaccaggggagaaaactttggcacaattgaatcagtgaaagccgttgaagaactgaattcaccagtcacaggcactgttatagaacgcaatgaagccttaattaattctcctgaagaagtttcagaagacccctatggtgagggatggtttttgaaagtgcgcgtcaatgaccctggtgaaattgaggatgccttgacagcagatgagtatcgtgcacaggtggaa

SEQ ID NO: 43672 - DNA, 651 bp, Nostoc punctiforme
ggacgcttactccgcaccctcaatggtcatagtgactcggtaaaagccgtcgccgtcacccccaatgggcaacaggtgatttctgcttcctctgacaacaccctgaaagtctggaatctggcaacaggggaggaacaattcaccctcaatggtcatagtgactgggtaaaagccgtcgccgtcacccccaatgggcaacaggtgatttctgcttcctctgacaacaccctgaaagtctggaatctggcaacaggggaggaacaattcaccctcaatggtcatagtgactgggtaaaagccgtcgccgtcacccccaatgggcaacaggtgatttctgcctccgatgacaacaccctgaaagtctggaatctggcaacaggggaggaacaattcaccctcaatggtcatagtgactcggtaaaagccgtcgccgtcacccccaatgggcaacaggtgatttctgcttcctctgacaacaccctgaaagtctggaatctggcaacaggggaggaacaattcaccctcaatggtcatagtgactgggtaaaagccgtcgccgtcacccccaatgggcaacaggtgatttctgcctccgatgacaacaccctgaaagtctggaattttttaactggaaaggttattaccactttc

SEQ ID NO: 43673 - DNA, 1611 bp, Nostoc punctiforme
atgcaagagtatgatgttgtgctgatcggtgctggacacaatgggttagtttgtgcggcttacttgttgaaagctggttatagcgtcctgttactggaaaagcgctctgttccaggtggtgcagcaacaactgaagaatgtttaccgcaagaggctcctggatttaaatttaacttgtgcgctattgaccatgagtttattcacttggggccagttgttgaagaattagaattagaaaaatacggcttgcattatttggagtgcgatccagttgttttctgtcctcatcctgatggcaagtatttcttagggcataagtcgctagaaaaaacttgtgcagaaattgctcgttataatgaacgtgatgccaaaaaatacgcagaatttgtagattattggcaacgagcaatcggtgcaatgattccgatgtttaatgcaccgccaaagtcaattatagatattgttggcaactacgatatcaaaaaattcaaagatttattttcggttattggttcgccaaacaaaacgctggactttattcgcactatgttaaccagcgccgaggatttacttaacgagtggtttgatgaagaatttctaaaagcgccactagcaaggctagcatcagaacttggtgcgccaccatcgcaaaaaacccttgccattggtgcaattatgatggcgatgcgtcataaccctggcatggccagacctcgcggcggaactggcgcattagtgcaagctttggtgaatttagtcacaagtaaaggtggcgttattcttacagatcagcatgttgaaaaagttttaattgatgatggtaaagctgttggcgtgcgggttgctggtggtaaagaatatcgcgccaaatatggggttatttctaatattgatgccaagcggttgttcttacaaatgactgataaaagtgatgttgatggagccgacccagatttatgggaaaggttagaacgccgcattgttaacaataacgaaaccatccttaagatagacttagctttagacgaaccactgcattttccacaccacgctcacaaagatgaatatctcgttggttctatcttgattgccgattctgtggctcatgtagaacaggctcatagtaaatgtactttgggagagattcctgatgctgacccatcaatgtatgtggtgatgcctagctacttagaccctacattagcaccaccaggtaagcacactgtatggattgagtattttgccccttatcaaattgccggtgcagaaggtactggtttaaaaggtactggctggacagatgagttgaaaaataaagttgcagatagagtggttgataagttggcagactatgcaccaaatgtcaaaaatgcaactatcgctcgtcgtgttgaaagtccagcagaactaggagaaagattaggtgcttacaaaggaaattattaccatgttgacatgactttagatcagatgatatttttccgtccattaccagaaatagcaaactacaaaacgccaattgataatctatttttgactggtgctggtactcatccaggtggttcgatttcgggaatgccgggacgcaattgtgcccgcgcctttttacag

SEQ ID NO: 43674 - DNA, 1353 bp, Nostoc punctiforme
aaattaccaaaaggcccgcaaagcccagcagttttacagatgctacgctggattactagccccatgtcatttatggaaacttgtgccaaaagatatggggatatgttcaccatcaggttagacagcaaatctccgccactgatatttgtcagtaaacctgaagtgctagagcagattttgacaaacgatatcaaggggttagaagcacctggtgatacaaatctggtgtttgaatctttgcttggtaagcattctgtgattaccatcagtggtgcggaacaccaacgccaacggcagttgttattgccaccttttcacggtgaaagaatgcgaagctatagtcaaataattagtgatattaccgagaaagtcattagccaataccagatagggcaacccttcaatatccggtctgttacccaagctattaccctgcgagtgattatgcaagctgtgtttggactagatgaaggcccacgcgccgaaaaattacagcattgtttggctgaaatgctggaaaaaggaagttctgtgttgagtgccgctttgctttattttccagctttgcaaagggattttggcccgattaatttctggggaaagcagatgcgccgacagcaggcagctgacaaacttatatacgaagaaattcgagaacgtcaagaacaaccagacccatcacgcacagatatcctcagcttactcatggcagctagggatgaagcaggtcaaccaatgactgatgaaaagttacgcgatgaattaatgactctgttggtcgcaggccatgaaaccacagcaacagccttagcatgggcattttactggattcaaaaaataccaacagtacgccaaaagttactgaaagaactagatagcttgggtgataaccctgaccccagcaccatttttaaattaccctacctcaacgctgtttgttccgaaactttgcgaatttacccagtagcgatgctgacttttgccagagtagtcagaactcctctatctttgggtggctacgaacttgaaccaggtataggtgttattggttcaatttacttgacccaccaccgagaagatttataccccgaacctaagcagtttaaaccagaacgctttttagaacggcaattttctccctatgaatatttaccttttgggggtggtgcaaggcgctgtattggtctagcatttgcccagttggaaatgaagctagcactcgccaaaatcctttccacccgtgaattagaactagttgacaatagtgaagtacgacctaaacgccgtggtttagtgacaggccaagatcgtcccatccagatggttgtcaccagccaacgtcaggtgaagttt

SEQ ID NO: 43675 - DNA, 1641 bp, Nostoc punctiforme
ttattatcttatcggtctttatcccaaccaaaccaaatcgcttatactttcttggtggatggagataccgaagaagtcaaactaacttatcaagagttagaccaaaaagcacgagctattgcggtagaactccagagcttaaaagctgcaccaggcgaaagagctttgctgctttatccatcaggattagaatttattgtggcttttttcggatgtttatacgctggggttttagctgttcccgtatatccaccccgacgcaaccaacgcatgacgagactgcaagctattgtcaaagactcagaagcaaggtttgccctcactacagcatccgtcttgactaatattcaacaaggctttgctcaagaaccagaattaacagctttgcattgcatagccattgacaagattgttagtgatgcttctaattggcaaaagccaccactggagaaaagcacgttggcttttctgcaatacacttcgggttctacaggaacgccgaagggtgtgatcgttactcatggtaatttgttgcaaaattcggagtatatcaagtcagcctttgaactcacaccaaatagtgtgtctgtaacctggttgccaagcttccatgatatggggctaattgatggggttttgcaacctctgtatacaggttttccgagtgtcatgatgtcaccagcatcctttgttcagcaaccgattcgttggctgaaggctatttctgattacaaagcaactcattgtggtggcccgaactttggctatgaactttgtgtgagtaagattactccagaacaacgagccaacctggatttgagtagttggtgcagcgcctatagtggtgctgaacctgtgcgtcgagaaactttggaaaagtttgccgcaacatttaaatcttctggtttccaagctaaatttttctatccttgttatgggatggctgaagcaacgctaatgatttctggtggaggtgttgcagatgagccagtttactgtgtagttgatccaaaggcattagaaaaaaatcaaattatccaggtgagtgaagatactccaaaggttaagcatttagtagggtgtggctatgcgtggctcgatacaaaaattgcgatcgccaatcctcaatcgttaactttgtgcgctcccgaacaagtaggagagatttgggtatcgggatcaagtatcgccaagggttactggaatcgaccagagcaaacaaaggaaacttttcatgcctatttagcagatacggcggaagggcctttcttacgcacaggagatttaggatttttaaaagatggtcagttgtttatcactggacgactcaaggatgttgtgattattcgaggatgcaaccattatcctcaagatattgaactgacagtagaacaaagccatcaggcactaaaagcaggttccggtgcagcttttagtgttgacattgatggcgaagaacaattggtaattgttcaggaagtagaacgaacttatttacggcatctcaacctagatgaggtagttgaagctatcaagacatcagtctctcaaatccatgagctacaggtttatgcagttttgttgctgaaaaccggaagtattcctaaaacttctagtggtaaaattcagcgccatgcttgt

SEQ ID NO: 43676 - DNA, 2271 bp, Nostoc punctiforme
  unsure (1)..(2271): unsure at all n locations
atgaagttacgttcatatatgtttttaggtttttttctgagtctgctcctaacttttttgcctttttcgagcaatttcataaatgctgcaacaccgacagcagtcgcacctgtatctgctgtctcattcacccaaggggtaaaaaaaacggtgttggacaacggcttaacagtgctaaccaaggaagtccatactgctccagtggtgagtgtgcaagtttggtataaagttggttcccgtaacgaggttaagggagaaaatggcatttctcaccagttagaacatttgatgttcaagggtacaactgcccgcccagtgcagtttggaagattgtttagtgccttgggtagccagttcaatgcctttactagttatgacgaaacagcttacttcggcacagtgcaacgagacagactcgaagcattgttgacactggaagccgatcgcatggaaaattccttagttgggtctgaacaactcacaagtgaaaagcgagtggtgatctctgagttacagggatacgaaaattcaccaggctatcgcctgagtcgggcagtgatgcgagatgctttccctaacagagcttatggcttaccagtgggaggcacaaaagctgatgtagagaaattcacggtagagcaggtacggaattattaccaaacctactacagcccagaaaatgccacgttagtaattacgggggattttgccacagaacctgtactcaaagttgttaaagaaacttatgggaagttggcaaaacgatcgcaacagggcaatgtaaggggaaatgtcgccccatcttctccagttgccgctactactaaaaaagcaccgattgttttgaagcaaccaggaagtgcggcactactgcaagcagtctatcctttaccagatatcaagcatcctgatgtgccggcaattgatgtgatggatgccattctcacaggtggacgtagctctagactttaccaggctttggtagaatctggacttgccagttcagtaagtggcggtgctgccgaactcattgaaccaggttggtatgaaattaatgctacagcggctccgggtaaagagttaagtaaaattgcccaggtgcttcaggaatctttaggaaagttgcaacagcagcctgtcaccacagaagaattgacccgggcgaaaacgcaactgcaagcctcatatatcttgggtaatcaagatattactagtcaagcgacccaactcggatataaccaaacgatcgcgggcgattatcattttattgaacagtatctcgctgcgatcgctaaagtcaccccagcccaagtacaaaaagtagcgaaaacttacctaaatccggctaaacaaaccattggcttctttgagccgactcaaccagatgggaaaccagggacttctagcgctggttctgggcgcacagtcgaaaatttcagccccggtaaacctgtagatccggcacaactagctaaatatctcccacccgccacatcagcaacagattcggccaaacaatcgctaccagaagagtttactttaaataatggtttgcgggttttgttgttacgcgatcgcagcctccccaccattaacctaagtggacaaattgacgctggtactgaatttgatggtaatcaaaaagctggattagcgaatttgactgcggccaacttaatgaatgggacgcagactaaaaatgctcttaccctagcaaaaaccttagaagacctgggagccgatttgagctttagtgctagccgtgagggagtgaacgttagcggtgaaggactttcaaagaacctgccgatattgattcaaactctggcagatgtgttagaaaacgccactttccccgccgaccagctagaattgagccgtcaacgggcactgacaagtcttaaagtccagctagatgatcctagagggctaggacgacaagtattccagcaggcaatttatcctgaaaatcatccatttcatagctttcctacattcgagagcttaaaaagcattagtcgtgatgacttgcttggcttctatcagaaatactaccgaccagatagcacaacgatcgcaatagttggagacttcgatccagttaaggtaaaaactttgctgaatcaggcatttggcaaatggcaagccacaggtaagccacctgtgctgaaaatatcagccgtgccaataccgcaaacttcgacacgtttaggactttatatatncgccccaagnagtgtgttatntgtcctcagttgcctggtgaaacac

SEQ ID NO: 43677 - DNA, 1644 bp, Nostoc punctiforme
agccaatttgatgttttagtagtcggcgctggtgctgctggactatacacagcgctgtgtctaccagagtccttgcgagtcggcttgattaccaaagaaactgttgctttgtccgctagtgattgggcacaaggtggtatagccgcagccgtttccccggaagattctcctacgctgcacattgaagataccatccgggcaggtgcaggtttgtgcgatcgcactgctgtagaatttctcgcacaacttgcccctaaatgcattcaatccctagttgacttgggggttgcttttgaccgtcatggtcaagccttggctttaactttagaagctgcccattctcgcaaccgtgttctccacgctgcggacaccacaggcaaggaagttacaaccactctcaccgcccaagtattacgtcgcccgaatattcaagtcattcagcaagctttggctttgagtttgtggattgaacctgaaagcaatcgctgtcagggaataagcttgttttatcaaggtaaaatcacatggattaaagctggtgctgtgatcttggcaacaggtggcggcggtcaggtatttgcccaaactactaacccggctgtgagtactggtgatggggtagcgatcgcatatcgggctggggctatcctccgcgatttggaatttgtgcaatttcaccccactgccctgactaaacctggtgccgatcgctttctgattagcgaagctgtacgcggcgagggggcacaccttgttgataatgaagggcgacgttttgcctttgactaccaccctgcgggtgaactcgcacccagagatgtggtcagtagagcaattttcagccatttacaacgtactgccgttgatttagcgactgcccatgtgtggttggatatgcgccccatccctgccgacaagattcgtcaccgctttcccaacatcatcaaagtttgccagcattggggagttgatgttttccatgaaccaattcctgtagcgcctgctgcccattattggatgggtgggattgtcgcggatctgatgaatcgcacgaatattaagagtttgtacgcggtgggtgaaactgctagtaccggggtgcatggggcaaatcgccttgccagtaattccctgttggaatgtattgtctttggggcccagatgagccaaatagagttggaaaatattgggttgccgtcacaaataccagtgttgccatcacggaaatttagtgttgatgcaaatgagtggcacatccagcaagcacaactagaaacactcagagagaagttaccacgtctagtttgggaaagtgctggtatttgtcgggagcaatcaaagttggaaactgcgatcgccactgttgaatcttggcaacaagatttcgctgctttgcctttaagtcaattcttgcttgctttacacccaacagaatcagctagttttgagttcccagatgttgaacgacaattgcgactttgggcagaaacccgcaatttattagatgtggctgatttaattctcaaaagtgctgcttttagaaccgagagccgaggcggacactaccgtttagactatcctcaaccagaccccaattggcaagttcacacacttgtccaaagaaatcattggtggaaatctcca

SEQ ID NO: 43678 - DNA, 1464 bp, Nostoc punctiforme
atgactctttcattccaagaattaggcatttcccaagaacgtgtcgcacaactagaaaaaatcggttttaccgaaccaactaacattcaagtccaagcaattccccaattgctgggtggtcgtgatgtagtaggtcaatctcaaactggaacaggcaaaaccgcagcgttttcactgcctattttagagcggctagatattaatcaaaaagccgtacaagccatagttttaacaccaactcgtgaattagcaatgcaagttcacgatgcgatcgcccaattcatcggtgatgaaggattgcgggtgttagcaatctatggtggtcaatcaattgaccgccagatgctacaactcagacgtggcgttcacatggttgtgggcacaccaggacgggtgatcgatttactcgatcgcggctgtttaaagctcgatcaagtgaagtggtttgtgttggatgaagcagatgaaatgttgagcatgggctttatcgacgatgtgataaaaatcctctcgcaagcgcccgtagatcgccaaacagctttattctcggcaacaatgccaccatcgattcggatgttggtgaataagttcttgcgatcgcctgcaactgtcaccgtcgagcagccaaaagccgctcccaacaagattaatcaggtagcttacttgatcccccgccactggacaaaagctaaagctttacagccgattctggaaatggaagatccagaaacagctttaatctttgtccgtaccagacgtacagccgcagaactcaccagtcagttacaaggggctggtcacagtgttgatgaataccacggtgacttgtctcaacaagcacgggaacggttattagtcagattccgtaaccgtcaagtccgttgggtagtagcaactgatattgcagcacgagggttagatgtcgatcaactctcccatgtaatcaacttcgacttacccgatagcgtagaaacctacgtccaccgtattggtcgtactggtcgtgctggtaaagaaggaacagcaatttctttagtacaaccatttgagcggcgcaagcagcaaacatttgaacgtcataaccgtcaaagctggcaattactctcaattccaacacgcgcacaaattgaagcgcggcacatactaaaactgcaagaacaggtgcgggaagctttgacaggtgagcgtttagcttcattcttgccaattgttagcgaactaattgaagaatacgatgctcaagcgatcgccgcagccgcattgcaaatcgcttacgatcaaactcgtccggcttggttgagttcagatgtggaaataccccaagaggaatcttctgctcccaaaccaagattgggcaagcgtcgtgaatcttccagcgatcgcccccgttctgcgtggaaatcagatagtaacaatggtgaagaaagacattcttctcccaagccaaaactgcggacaagtggg

SEQ ID NO: 43679 - DNA, 921 bp, Nostoc punctiforme
gtggaaaatgtcacattggggcagaatggcccagttgttacacccttgtgcataggcacttgggcttggggtgataaactattttggaattatggcgatcgctacggtccagaacagttacaagaagcctttaccgcagccttagaagctgggattacgttctttgatactgccgaaatctacggaatgggaaagagcgaggaatttttagggcaatttctgcaacacacacaacaacctgtacaaatcgccacaaaatttggccccgtaccgtggcgatttacagcccaatctgtctctgatgctttaacagccagcctcaaacggctacaacttgagcgaatcgccctgtatcaagtgcattggccttttgccttctttttaagtcaacaaactttgatgaatgccttagcggatgaagtgaagcggggcagaattgcggcagtcggtgtgagtaattactcagcagagcaaatgcgagacgcgcatcaaatattagcggatcggggagtgcctttggctgtaaaccaagtccgttattctttactcagtcgccaaattgaaagcaaaggtattttggcaactgcgcgtgagttgggtgtgactatcttggcatacagtcctttagcacagggattactcacaggaaagtacagtattgatagtgctgaaacccccactggtgcgagaaaaatagactcgcgatttaagaaagaaggtctgcaaaaaatttccccagtcatatctttgctacgtaacttcggggaaaaatacgatcgcactcctgcccaagttgctcttaactggttaattgctcagggtaacgttattcccattgctggggtgaagacagccgaacaagtacggcagaatgctggtgctttgggctggagattgagcgacgatgaaattggagagtta

SEQ ID NO: 43680 - DNA, 903 bp, Nostoc punctiforme
gatattcccattcctgaacctccaccaggagaagctttggtacgcgtcttgcgtgcaggtatctgtaacactgatttggaactactcagaggctactatccttacactggtattttggggcatgaatttgtcggcgtggttgaaaaagggccagaacacttagttaaccaacgtgtagttggagaaatcaacgctgtgtgtggccattgtcggttttgtcggagtggacaactaactcactgcgaaaatcgcacagttctaggtattgtcaatcggaatggagcctttggtgaatatctctgtttgccggtggagaacttacatttagtacctgataatgtgcccaccgaagtagcaacatttaccgaacccatagcagcagctttggaaattcagcagcaagtaccattgcatccaaacgacagggtgctagtggttggagatggcaaactagggcagttggtagcacagacactagccttaactggctgcgaactcttggctgtggggcgacatcaagagaaacttgccaacttagaggcacggggaattaaaactggtttagctgatgctgtcaaagatggatatttcgatatctcagtagaatgtacaggcaacccagaaggatttgcgatcgcccggcgtgccctccgtccccgtggtacgcttgtacttaaaagtacttatgctggcaacctcagcctagatgcttcttctttagtagtggatgaaatcaccctcatcggctcccgttgtggcccctttactccagccctccagctactagccacaggacaaattgacgtacaacccctgattcatgccacttacccccttattgaagggcttgcagcttttgaacacgcccagagtcggggtgttttaaaaatcttgctagaaatt

SEQ ID NO: 43681 - DNA, 954 bp, Nostoc punctiforme
tccgccgatcgcaatgcgaaaactaggcagcttctggggatgaaaggtgcagctgctggggaaacttcaatttggaaaattcgtttgcagctaatgaagccgattacctggattcccctaatttggggcgtagtctgtggtgcggcttcttcgggtaactatacttggacactggaaaatgtgttgaaagtattaacctgtatgctgctggctgggccattgatgacgggttacacccaaatccttaacgattactacgatcgcgaaatcgatgccatcaatgaaccctatcgcccgattccctctggcgcaattcccctaccccaggtaattattcagatttgggtattactgattgctggctatggtttggcgtttgcgctcgatgtgtggtctggtcatgaattcccgacaattacagcgatcgcaattatcggttcattcatcgcctatatttattctgcacctcccctgaaactcaagcaaaacggctggctaggtagttacgctttaggtgcaagctatatcaccctaccttggtctacaggacacgctttgtttggcgatctcaattccacaattgtgattttgacaatgttctacagcttggctggattgggtattgccattgtcaatgactttaagagtgtagaaggcgatcgccagttaggattaaattcattacccgtaatgtttggtatcaccactgcggcatggatctgtgtagtgacaattgatgtatttcaaggatttatcgcagcttatctcgtcagcatccatgagaatttgtatgcagcaatcctggtactattaatcatcccgcaaatcaccttgcaagatatgtatttcttgcgcgatcctgtgaagaatgatgttaagtaccaagctagcgcccaaccttttctagtgctgggaatgctggtaacaggtttagcgctgggtcatgctggcgtt

SEQ ID NO: 43682 - DNA, 1068 bp, Nostoc punctiforme
aaagcactaattctctctggtggaaaaggtacacgcctacgtccccttacttatagcggagccaaacaactcgtaccagttgcaaataaacctgttttatggtatggcattgaagaaatggtcgctgctgggattactgatattggcatcatcatcagcccggaaactggagcagaagttcaagggaaaactggaaatggagaatactttggagcaaacatcacctacatcgtccaagagcagccactcggacttgctcacgccgtccaaatcgcccgtccgtttttagaaaattctccctttgtcatgtacttgggcgataaccttattcaactaggtgagttacgttactttctgcaacaatttagccagcaacagccggatgctttgattctcttgcgttcagttgccaaccctagcgcctttggtgtggctgaggtagatgatacaggacgggtattacagttaattgaaaaacccaaagttcctccttcaaatctggcattagtaggagtttatttcttttctcacctcatctttgatgcgatcgcaaatatccaaccttctgccagaggcgaactggaaattactgatgctattcaatacctaattaatcaggaaaagcaagttttagcatacaatctcaaaggttggtggttagatactggcaagaaagatgacttattagaagctaaccgattgattctcgatacctatttgatagcatcagttcttggcgaaatcgatgcccaaagtcagattattggacgagtccaaatcggtgcaaaatctcaagtaattaactgcacaattcggggaccagtagtcattggtagcaattgtcatttagaaaactgctttattggcccttatagtagtattgctaacaatgcgacactgattgatactgatttagagcatagtgtgattttagaaggcgctaaaattgccggaattcatcagcgtattattgatagtgtgattgggcaacgggcacaattgactcttgcacctcgccgccccaaagccttgcgatttctaattggcgatgactgtcaaattgaacta

SEQ ID NO: 43683 - DNA, 735 bp, Nostoc punctiforme
atccaaatgaactacgacatcaaagacaaaaccattttggttacgggcgcaaatcgcggcatcggcaaggcgatagttgagtcatttattgaacacggagccaccaaagtctatgcggctgttcgtcagctcaacagtgtctcctcattggttgagcaatacggcttacgggtagtaccaattccggttgatttaggcgatccccaatctattgttgctgctgctcaaactgccccagatgtgcaaatagttatcaataatgcaggagtctttcaagctggaactcccttagctgagaatgcgatcgccgctctcgaatttcagatgaagatcaatgtatatggattgctctacatggctcaggcgttttccccgatactcaaagccaatggaggtggtgtctttgtccaaatcaattctgttgcttcgctcaagggtttccctgactctgccacttactgtgcctcaaaagctgctgcctattcaatcacccaggcattacgagaactattgagtgagcaggacacgcttgtgctaagtgttcaccctggcccgattgccacggatatgggcgatgcggcaggaatgagccaggttgcacagccacctgcacttgtggcagacgggataataaaagctctcaaagctggggattttcacgtctttcctgactcgatagcgaaacaaatgggcgatgtttataaaagctttgcccaaaatgtcattgaggtgtca

SEQ ID NO: 43684 - DNA, 1143 bp, Nostoc punctiforme
atgaaagtcctggttattggtggtgatggatattgcggttgggcaactgctctttacctttccaatcgaggttatgaagttggaattttagatagtttggtgcggcggcactgggataatgaactaggtgtcgaaactctcactccgatcgcactaattcaacaacgtctccagcgctggcaagatttgacaggtaaatctatcgacttgttcatcggcgatattacaaattacgaatttcttagcaaaaccttacatcaatttcagccaaatgccctagtgcattttggtgaacagcgttcggccccattttccatgattgaccgagaacacgcagttctcacccaggtcaataatgtagttgggacgttgaacttgttgtacgccatgcgggaagatttcccggactgtcatttggtgaagctgggaacgatgggtgaatacggtacacccaacatcgacatcgaagaagggtatatcaccattgaacacaatggacgtaaggataccctaccttatcccaagcagcctggctcgatgtaccatttaagcaaagttcatgatagtcataatatccactttgcttgccggatttggggattgcgggcaactgatttaaatcagggcgtagtttatggtgtcttaaccgaagaaacggggatggacgaactattgattaatcgcctggattacgatggtgtgtttggtacagcactaaaccgcttttgtattcaagccgcaattggacatcccttaactgtctacggtaaaggtggacaaactcgtgggtttttggatattcgggatacagtacgatgtgtggaattagcgatcgctaaccccgcacaacctggtgaattccgcgtatttaaccaatttaccgaacaattcagcgtcggtgatttggcattgatggtgaaaaatgctggtaacgctatgggattgaaggtagaaatcaatcacttagataatcccagagttgagaaagaagaacattacttcaacgctaaaaacactaaattgctcgatttaggtttacagcctcacttgctctctgattctctactcgattctctgttaaactttgctattaagtatcagaaacgagtcgatcacaagcaaattatgcccaaagtctcttgg

SEQ ID NO: 43685 - DNA, 1107 bp, Nostoc punctiforme
atgagaattgccctatttactgaaacctttttacccaaggttgacggcattgtaacgcgtctgcgccatactgttgaccatctacagcgtagtggtaatcaagtgctggtgattgcccctgatggaggcatcactgaacacaaaggcgctaaagtttacggcattactggctttcctctgccattgtatccagaattgaaaatggcacttcctcgcccagccattggttatgctttagaagagtttaagccagaggtgattcatgtcgtgaatccagccgttttgggtttagctggcatattttacagcaaaatcctcaaaatacccttagtagcgtcttaccatacccatttaccccaatatcttcaacattacggcttggggatgctggaaggttttctttgggaactgctcaaaggcgctcataatcaagcagctttgaatctgtgtacctccacagcaatggtggaggaactgacaggacatgggattgaacgtgtagatttatggcagcgtggggtggatacggaattatttcaccccgatttagctaatgtagagatgcgatcgcgcctatcccaaaatcatccagaaagtccattgctactttacgttgggcggctttctgctgaaaaagaaattgagcgcatcaaaccaattttagaagcaattcccgaagcgcggttagcattggttggagatggcccacaccgtcaagcactggaaaaacactttgctggcacaaatacttattttgttggatatcttatgggacaagaattaggttctgcctttgcgagtgctgatgccttcatatttccttcccgtacagaaacactaggcttagtactactagaagcgatggctgctggctgtcccgtggtagcagcccgttccgggggaattcctgatattgtgacagacggggtaaatggatatctttttgagccaacagaagatgttaaaggagcaatcgccgctactgttcgcctcttagaacaaaaagaacaacgagacatcatccgtcaaaatgctcgccaggaagcagaaagttggggttgggcagctgcaaccaatcagctacaagattactaccagaagataata

SEQ ID NO: 43686 - DNA, 489 bp, Nostoc punctiforme
acacctacatctaccgaactacagggtataaatgagactgcgatcgcctctgaaattaaaacaactttcacatctgaagaaattcaaaaattattaccccaccgctacccatttttacttgtagataaaataattgactacgttccaggtaaaaaagctgttggcgttaaaaatgttactatcaacgaacactatttccaaggacatttccccggccgtccactgatgccaggggtgctaattgtcgaagcaatggcacaagttgggggcattgttcttactcaaatgtcttcggtagaaggcgggctatttgttttcgctggtatcgataaagttcgctttcgccgccaggtcgtaccgggggatcaactagtcatgacagtggaactgttatgggtaaaacaacgtcgtttcggtaagatgcaaggtcgtgccgaagttgacggtcaacttgcttgtgaaggggaattaatgttttctctagtcaac

SEQ ID NO: 43687 - DNA, 3984 bp, Nostoc punctiforme
atgttcacacacgtcaagtccaccattagacacattgcgcctgataacttacgcggacgtagtttaatcaaggtggtctatgtcgtgcttgagtcccagtaccagagcgcattgtcgcaagcagttcgcacgattaacgcgaacaatcccaacttggcgattgaaattagcgggtacttgattgaggaactccgcgaccccgaaaattacgaggagttcaaacgagaaattgagaatgcgaatatcttcatcgcttccctcattttcatcgaagacttagcacagaaagttgtagcagcagtagaaccacaccgcgatcatctcgatgtttctgttgtctttccctccatgccagaggtaatgcgcctgagtaaaatgggcagcttttccttggcacagttgggtcagtcaaaaagtgcgatcgcgcaattcatgcggaaacgcaaagaaaaatccggtgcgggattccaagatgggatgctgaagcttttgcgaaccctaccgcaagttctgaagttccttccaatggacaaggcacaggatgcccgaaatttcatgctcagttttcagtattggctaggtggttctccagaaaacctggaaaacttcttgctgatgctagctgataaatatgtatttaaaggtttagaaaaacagaattttgcaccttctacgtatgaacagccggtggtttatcccgatctagggatttggcaccctttggctcccaatatgtttgaagatgtcagagagtacctcaattggtacacagctcgtaaggatatttctagcgatctaaaagatcctttagctccttgtgtcgggttagtgttgcaacgcactcacctagttacaggggatgatgcccattatgtagcaatggtgcaggagttggaagcactaggggcacgggtattacctgtgtttgctggtggtttggatttctccaagcctgtggaagcctacttctatgaaccaaataccaacacacagttggtagatgcagtgatatcgctgactggttttgctttagtgggtggcccagccagacaagaccatcccaaggcaattgaagcactcaaacgcttaaatcgtccttacatggtggcgttacccttagtattccaaaccacagaagagtggatggatagcgatttagggttacatccaattcaagtagctttgcaaattgcgattcctgaattggatggggcaattgagccgattatattatcgggtagagatggagctacagggaaagcgatcgcactgcgcgatcgggttgaagctgtcgccgaacgcgctttaaaatgggcgaacctccgccgcaagccgaagctggataaaaaagtcgccatcaccgttttcagcttcccgccagataaaggcaacgtgggaaccgccgcttacttggatgtattcggttccatctacgaggtgatgaaagctctcaaaaataacggctacgacttaccagaattgccagaatcagccgaagcgttgatgcaagaagtcatccatgacgctcaagcgcagtacaacagcccagaactcaacattgcttacaaaatgtcggttcctgagtatgaggcacttaccccttactctcaacgcctagaggaaaactggggcccacctccgggacatctcaacagtgacgggcaaaacttgctgatttatggtaagcaattcggtaatgtcttcatcggtgtccaacccacatttggttacgaaggcgacccgatgcggctgttattctcccgttcagctagtcctcaccacggttttgctgcttactacacttacctagagcaagtttggaaagctgatgctgtactgcactttggtacacacggttccttggaattcatgccaggtaaacagatggggatgtctggtgattgttatccagataacttgattggctcaattcctaacctgtattactacgcagccaataatccgagtgaagcgacaattgccaaacgtcggagttatgccgaaacaatttcttacttgacaccgccggcagaaaatgctggtttgtacaaaggtttgaaggaactcagcgaattaattgcttcctaccaaaccttaaaagatagtggacgaggtgtttccattgtcaacagcatcatggataaatgccggatcgtgaatctggataaggatattcacctaccagaaaccgatgccagagacatgagtgccgacgaacgggataatattgttggcaacgtctaccgcaagttgatggaaattgagtcgcggttgttgccttgtggtttacacgtcattggtaaaccgccaagtgcagaagaagcgatcgcaactctcgtcaacattgctagtctagatcgtcaagaagatggaattcaaggcttgccgggaattatcgctaacagccttggacgtaacattgacgatatttaccaaaataacgacagaggcattttagaagatgtccagttactccaagacatcaccttggcaacccgtgcagcagttaccgcccttgtccaagagcaaatcgatgcggaaggacgagtctctttagtttcccggttgaatttcttcaacatgggcaaaaaagaaccttgggtagaatcattgcataaagcaggttatcccaaagtcgatagcgccgccctaaaacccctatttgagtatttggaattctgcctagagcaagtttgtgccgacaacgaactcggagcattactcagaggcttggaaggtgaatacatcctacctggccctggtggcgatcccatccgcaacccggatgtcttgcccacgggtaagaatatccatgctttagatccgcaatccatacccacaacagcagcagtccaatcagccaaaatcgtcgtagacaggcttttggtacgtaacaaggcagaaaacgaaggaaaatggccagaaaccatcgcctgcgtcctttggggaaccgataacatcaaaacttacggcgaatccctagcgcagattatgtggatggttggcgtgcgtccagttcccgatgccttgggacgggtgaacaagttggaattgatatctctagaagagttgggacggcccagaattgatgtggtaatcaactgttctggtgtattccgcgacttgttcatcaaccaaatgaacctgctagatcaaggcgtgaagatggcagctgaggcagatgaacccttagaaatgaactttgttcgcaaacacgctttgcagcaagctgaagaaatggggattaatctgcgtcaagcagcgacgcgcgttttctccaacgcttctggttcctactcgtcaaatatcaacttggcggtagaaaacagcacttgggatagcgaagccgagttgcaggaaatgtatctcaatcggaaatccttctccttcaattccgataaccccggaatcatggacgaatcccggcagatttttgaaagtacattgaaaactgctgatgcaactttccaaaatctggattcttccgagattagcttaacggacgtttcccactactttgattcagatcccactaagttagtggcaagtctgcggggtgatggtaaaaaaccagcatcttatattgcagatacaaccacagctaacgcccaagtgcggacattatcagaaaccgtgcgtttggatgcgcgtaccaaattattaaatcccaagtggtacgaggggatgctatctcacggttacgaaggtgtgcgcgaactctccaagcggttggtgaatacaacaggttggagtgcgacagccggcgctgtggataactggatttatgaggatactaacgaaaccttcatcaaagatgaagaaatgcagaaacggttgttaaaccttaatccccattctttccgcaagattgtatcaactttgttggaagtgaatggacgcggttattgggagactagcgaggataatttagatcgtctgcgcgagttgtaccaagaggttgaagaccggattgaagggatagaa

SEQ ID NO: 43688 - DNA, 1095 bp, Nostoc punctiforme
ccttctttgtctactcaaacctctagctcattatttacgctcacagttgccccggcaaaagtcatccgtggttctggggtattgcaagcagccgcagcagagatcgcctgtttgggaagtcgtcccttaattgtggcaggtgaatcgactctcgctatcagccgaaagaatttgcaaccagttttagaaacgcaacagttacatcctgttcaagcttcttatggtgcagattgctgcgaagctagcctgaaatctttacagaagaaggcaaaagaacataaagctgatgtgattattggtgttggtggcggcaaagccttagatacagcaaaattactcgcgcagcagttacagttgccagtggtgacaattccgacatcaggggctacctgtgcagcttggagtgccttgtcgaatgtttattcggaaaatggggcatttctctacgatgtggggctgtctcgttgtcccgatttactgatactcgattatgacttgattcaaactgcaccacaacggactttagtagctggaattggtgatgcgatcgctaagtggtatgaagcctctgttagcagtgggcatttgcaagacactttaattattgctgcggtgcaacaagcaagagttttgcgagatatcctcttgcaaaagtcagccgccgccttgaaggaaccaggtagcgaagtttggcgagaagtcgtagacgcaagtgttttattagctggggtagttggaggacttggaggggcccagtgtcgcacagttgctgcccatgccgtgcataatggtttaactcatatttcaggacatggcagtattcatggcgaaaaggttgcttttggaattttggtgcaactgcgtttagaagaaatgctacaaggcaatcaactagcagcatcagcacgacaacagttgttaaagttctacacagaaattggactaccccaaaaattaagtgatttgggattgggcaatattacattaggtgagttacaaacagccgccgaaattgctctagttcctaattctgacatccatcgactaccgtttaaagtcgcgccagaacagttgatggcagcaatggtttccacc

SEQ ID NO: 43689 - DNA, 1179 bp, Nostoc punctiforme
atgagtttaaattggattgtcccagcagaacgcatacaaaaactaccaccttatgtatttgcccgtttagatgaactaaaagcgaaagcacgggaacaagggttagatttaattgatttgggtatgggaaaccccgacggtgcaacaccagcaccagttgtagaagcggcgatcgcagccttgaaagatcccgccaatcacggttatccgccctttgaaggcactgctagttttcgtcgtgccatcaccaattggtatcatcgccgttatggtgtggttctcgatcctgatagcgaagctttgccattgctgggttctaaagaaggattaacccatttagcgatcgcctacgttaaccctggtgatttagttttggttccttccccagcttatcctgcacattttcgcggcccggcgatcgcaggcggcaaaatccacagtttgattcttaaaccagagaatgactggttaatcgatttagctgccattcctgatgaggttgcaagacaagctaaaattctctatttcaactatcccagtaatcccactgctgccacagccccccgcgaattctttgaagaaatcgtcgcttttgcccgcaaatatgaaattttgctggtgcatgatttatgttacgccgagttagcttttgatggttatcaacccactagcttgctagaaattcccggcgcgaaagatattggtgtagaattccacaccttatctaaaacctataatatggctggttggcgggttgggtttgtggtggggaaccgccatgtaattcaaggtttacggacactaaaaactaacttggattacggtattttttccgccttgcaaaaagcagctgaaacagctttgcagttgccagatgtctatttgcacgaagtacaacaacgctaccgtacccgccgtgattttcttattgacgggttaggagagttgggttgggatatccccagaactaaggcgacaatgtatctttgggtgaagtgtcccgttggtatgggttccacagattttgccttgaacgtgttgcaacaaactggcgttgttctgactccaggtaatgcctttggggttgcgggtgagggttatgtaaggatcagtttgattgccgactgcgatcgcttgggtgaagctttacatcgtttcaagcaagctggcatccgctat

SEQ ID NO: 43690 - DNA, 1494 bp, Nostoc punctiforme
gattatattgtaattggtgcaggttcggctggttgtgtcgtcgcaaatcggttgacagaagatgccgaaacgactgtattgttgctagaggcaggcaatccgcctaacttaccagaacacgaaattcctttagcctggacaaaactttggggtacagaggcggactgggcatattttacagaagaagaaccatatatcaataaccggaaaatttattgtccgcgcgggaaagtcttaggtggcactagtgcgatcaatgccatgatctatattcgaggcagtcggcttgattatgaccattgggagaaattaggcaatgttggttggagttatgaagatgtgttgccctatttccagaaatctgaaaatcagcaacgaggagcatctgaatttcatggagttgatggattgttgagtgtgacagatcccttagctcccagcgtcatctcacaaaaatttctggaagccgctattggacttggctatgagcgcaatcctgattttaatggcacacaacagcacggagccggattttatcagttgacaattaaagatggtaagcgccatagtacggcgactgcgtttctactaccgattttggagcgtcccaacttaaccgtcaccactggcgcgttagttactagattattgtttgagggaacgcaaactgtaggcgtagaatatatccatcaaggaacgatacaccaagttcgggtagaacaggaagtgattctaagtgctggtgcgatcgattcgcccaagctgttgatgctctctgggattggcaatgcagaacatctacagaatttcgacattcctgtagtcgttgatttacctggtgtcggtcagaacctccaagatcatattttagtcggcgtagcacacgaagcaacccaggatttgcaacccgatttaaccagcaatattgcagaagttggattgttcctacatactgaaggtcgtttagatgctgtgcccgatttacagtttttctctggccctgttttgtggacacatcctgcttatgcacgttctgcgccaggattcacggctacagtttgtgtgactaatcccgaaagtcgtggtagtgtcagtctgagttctgctttttccaaagacccagctataattcggatgaattatctccaaagtgaatctgatttgcaaaagctgctggcaggggtcaaaattattcggcagatattccactcaagtgtatttgatgagttgcgaggagaggaagcagcccccggtgctgataataagagtgatgaaacactcctagcttacatccgggaaacctgcgacagtgtataccacccagtcggcacttgtaaaatgggaactgacgctgattcagtagtaaaccccgaactacgagttcatggtgttgctggattacgtgtagttgatgcatcaattatgccaactattaccacgggaaacacaaatgcacccacaattatgattggtgaaaaagcagccgatttgatt

SEQ ID NO: 43691 - DNA, 1164 bp, Nostoc punctiforme
ttaaaggaagcgaaacttactgccgatgctgccaatcatgccaagagcgattttcttgcaaacatgagccacgaactgcggacaccgctcaacggaattttaggctatgcccaaattcttgcccggactgcatctgacgaaaaacaacagcgtggcatcgatattatctatcaatgtggttcgcatttactgactttaattaacgatattctcgacttatctaaaatcgaagctggcaaactagaattacagctggttccattttatctacctgcgtttctacaaagtgttgtggaaatctgccgcattaaagccgaacaaaagagtattgaatttatttatcagccgccggagaattcagcaatgggtattgtcgctgatgagaagcgtctgcgacaagttctgattaacttgctgggaaatgccattaagtttaccgacaaaggcagtgtcacatttagggtggaagtgcttttaggagatataactaatcttcgcttctatattcaggatacaggcatcggcatgagtccccagcaattagagaaaatcttcctcccctttgagcaagtcggggatagcaaacgccaaagtgaaggaacgggattaggacttgctatcagccagcgatttgttgagttgatggctagtaaaatccaggttgaaagccaattaggggttggtagtaagtttttctttaatattgactgtgcgatcgcaactgattgggtacaagcaaattccctaacatcatctggcagaattatcggatacgctggtgttggcaaaacctctgtgaaagagaatcgcaaaaaaatcctgattgtcgatgaccgttgggaaaatcggtcagtgattgtcaatcttttggaacctcttggttttgaggttatcgaagccagcaacggacaagagggtttagaaaaaattacacgcgatcgccccgatacgatcatttgtgatttagccatgcccgtaatggatggctgggaaatgctcaaacaattgcgtcaatccgaaactttacgtgatgccattgtgattgtctcttctgccagcgtctttgagaatgaccgccaaaagagtttggatgctggtggtaacgatttcttggcaaaacccgtgcaagcagatgaactttatgctgtattagccaagcaatta

SEQ ID NO: 43692 - DNA, 840 bp, Nostoc punctiforme
ttggcaagtggtagtcgtggagaaacgaaactctgggatttaagcaagggtgaattaatagatacattatcagagtatccttgggttatacctgggctagtggatgaagtgaattccctggcttttagtgcagatggacagactttagtgagttgcggtgcagattccacaattaaactttggcacgtgggtgctttagacttgatagatattttgcataaacataatggtgtagtgcggtgtgctgcctttactccagatggcagaatgctagctacaggtggagatgacagaaaaattctgttttgggatttaatgcatcgtcaggttgcgatcgcagtttctttagatgatacagctgcccattccctagttttgagtcgagatggcgaaactctggttacaggtagctatcgtaaaatcaaagtctggcgcaccttaccccagacggggatcaaaagtttaaaggacgcacaacctctgcataccctcatgggtcattctcacatcgttcgttctttagcaatcagtgcagatgctaaactgctcgtgagtggtagctgggatcaaacaattaaaatttggcaattggagacaggagaattacttcatactcttaaaggacatagagatagagtatatgcgatcgccttaagtcccgatggacaaattatcgccagtggtagtgctgataaaaccatcaaattatggcatctacaaaccggggagttactaggtacgtttacaggtcatggaaatatagtcacagcattagccttcacagcttctggggagatgttggttagcgggagtttggataagacaattaaaatttggcaa

SEQ ID NO: 43693 - DNA, 1625 bp, Nostoc punctiforme
ttaaaaagttcctatacagttgtagttattggttctggttatggtggtagtattgccgcatcgcgtttagcacgagccggacagcaagtgtgtattttagagcgagggaaagaatttcaacctggtgaatatcccaaaactcaaagcaaagcattggcacaaatgcagatagatttgccacaacatcatctaggttcgcacacagctttgtatgactttcatgtgaataaagacattaatgtctttattggttgtggactaggtggaacatctttagttaacgccaatgtgtcattacaagctgaaccgcgtgtatttgcagattcacgctggccaaaggaattgcgtgatgatgtcgggactttattagccgcaggttatcgtcgtgcagaggaaatgctcaaacctactccctaccctgaaaattttcctccactaccaaaattacaagctttagaaaagtcgtctaaatatttgaatgaaaagttctatcgtccccccatcaatgtgacattccaagatggggtgaatcatgtcggtgtagaacaaaacaaatgtaatctctgcggtgattgtgtttctggctgtaataataaagccaaaaacaccgtgttgatgaattacctcccagatgcaaaaaaccacggtgcagaaatctatacacaagtttccgtgcgacgagttgaacgtcaggggaatcgctggctagtccattaccaattattaaacacgggacaagaaagctttaacgctcccacaatgttcgtcagtgctgatattgtgattctggcggctgggacattgggatctacagaaattttgctgcgttctcaagctgctggtttagcggtatctgagaaattgggacataattttacaggcaatggagatgttctagcttttggctataacaccgaagcagtaattaacggtatggttttggcgatcgcccggagaatgcccaagaaccagtagggccatgcatcaccggtatcatagatatgcgagaacagccccaattagataacggactagttattgaagaaggctcaattcctggaggtctggctgctatattaccccaaacccttgcggcggctgccaaaattttaggtaaagacaccgactctggtttaggcgatcgcatcgaagaaaaaatccgcgaagttgagagtttgactcatggtgcttacactggtgcagtccgcaacacccaaacctacttagtcatgacccatgatgatgcagccggacagatgtacttagaaaatgaccgtctccgcattaaatggcaagatgtaggaagccaacccatttttcaacgagtcaataatcgtcttacagaagccaccgaacccctaggtggtacacaaattcctaaccccatttggtctgatgcctttggtcatgacttagttacagtccatccactaggaggctgtatcttagcggaagatgctgaacacggtgttgtcaaccataagggacaagtatttgctagcaaccaaggaacaaacgtctacgaaaacttatatgtcgctgatggttctatagttcctcggacattaggtgtaaatccattactgacaatctctgctctagcggaacgctgctgtaccctcatt

SEQ ID NO: 43694 - DNA, 777 bp, Nostoc punctiforme
cctcaactcagttggacaaacgtagttttttttactacgtttcatgccttagcacttatgtctccttggtttttctcctggtcagcattaggtttgctagtgtttctccactggttattcgggagcattggtatttgcctgggatatcatagactactgagccataagagtttccaagttcccaagtggttagagtatgcgatcgccctaattggagcgctggctttgcaaggtgggccaattttttgggtaggtggacaccgccagcatcacgcccacacggaagatattaatttagacccctactctgctcaaagagggttttggtggagtcatatattatggattttctacccacgcccagaattttttgactatgacacctataaaaaatatgcccctgatttagcaagacaacccttttattgttggctggatcgctactttttgctattgcaaatacccttcgcactactcctatatggattaggaggatggccttttgtgttctacggagtatttctcagatgtgtcttgctttggcactcaacctggtttgtaaactcagcatcacacctgtggggttatcgcacgtttgatgctaacgatggcgctcgtaatctttggtgggtatccctcgttacttatggagaaggatggcacaacaaccatcatacttatccccacatggcaaaatccgggttgtcttggtgggagattgatgttacttggtggagcatcctagttttgcagactttgggtttagccaaaaaagtt

SEQ ID NO: 43695 - DNA, 1380 bp, Nostoc punctiforme
ggcttgttttatgctacacccgccgccgatggtatattatctcgcattagaataccaggtggaattattagtagtcagcagtgccgtgcgatcgcagatatagcagaccagcatggtggtggctatgttgatgtcactaatcgagctaacctacaagtccgcgaaattcgcacggggatcaatagtgaggttttgcagcatttacaggatatgggattgggttctcgcaattctgttgtagaccacatccgtaatattatgaccagcccaactgctggtattgacgcgcaagaattaatcgacactcgcccttttgtccaagattgggataattatattgctgcacatccggcgctttcgggactgtcggcaaagtttagcgtttgctttgatggtggtggaattattcgggtgtgcgatcgcttgaatgatatcctatttgctgctgtcttagttgacggtaatgtttacttccgcctctatctcagtgtcgggacaaagggtcaaccgcctagcgatacggggattttgttaacaccagagcaatgtttacccgtcttagcagctttaacagaggtctacctagctcatagtaatactacaaataatcgtcggctacgtctcttagagttattgaatactttgggttgtgaaaattatctccaagaagttcagcagcgtctacctttttctcttttatgcagtaacctaaccccccaacccccttccctcgtagggaagggggagaaattctcccctctcctgcaaggagaggggttgggggagcggttagatgctaaatatcagcatattggcatccatccccaacgacagcaaggcttattttacattggtgtcgtcttacctcttggacggttggagagtaaccagatgaagggtttggcagatttagcagcaaaatatggtagtggcactcttcggttaaccccctggcaaaatttgctgctaacagatattcctcagcaatgggttggtgatgtccaaagtaaaattgctttcttaggattagatatctcagcaactaacatcaagagtgcgttaattgcctgttctggaaacaaaggttgtgcctcttctgccacggacactaaaagtcatgctttggcattagtagaatatcttgaaactcgcgttactctggattgcccagttaatatccactttagtggctgcgaaaaatcctgcgcccagcatagcaagagtgatattactttgctcggtgtcagcattgaggatggcaatggaactgtagaaggctatcacgtttatgttggtgacagcgagcataaatttggacggaaaataatatatcaatatgtgacttttgccgaactacctgcattaataaagcggatgcta

SEQ ID NO: 43696 - DNA, 825 bp, Nostoc punctiforme
aaagctgttttggctttagcaattagtccagatgggcagactttggttagtggtagcgaggacaatataatcaaagtatggaatctaaacaatagcaatgaaatccttacccttactggacattcaaaacaaattaattctgtagcgattagtcccgatagtcaaactttggctagtggtagtgatgacgatacaattaagatttggaatttgaagactggtgaggaaattagcactatcaaagcgaattcaggaactgtcctgtctatagcaattagcccagatcagcaaatgatagttagtggtagttctgactcaagagtaaggctatggaatctgaaaacaggagagtgtattaaaactttagccacacatgcatatagagttagttcagtagcaattagccaggatggatctactgtagctagtagtagctgggatacaacaatcaaaatttggccaaaatcaactttaactgggcatttaaaacctgttaccagtattgccattggcttaaatagtcaaatcttagtaagcgctagtgtcgatagaagaattattgtatggaatctaaatactggagagaaaatttatactcttgatggacattcagatgttgtcaactctgtggcaatcagtccagatagtcagaaaattgtaagtggcagtgatgacgaaaaaattaaagtttggaatttaagcaatgggcaagaagcttacactgtcaatggtcatttagatggtgtgaatgcacttgtatttagtccagatgggcagattttggtcagtggaggtaaagatactacgattaaggtttggcgaata

SEQ ID NO: 43697 - DNA, 942 bp, Nostoc punctiforme
atgcaaactaaacaacttggcaattcggagcttcacattaccccaattggctttggtgcttgggcgattggtggaggtggctgggcttttggttggggagcgcaggacgatcgagaatcgattgaagcgatcgctcgcgctctcgatctcggtgttaattggattgacaccgcagctatctatgggctgggacattctgaggaggttgttgctaaagcgctcaaaggtcgatctagtcgcccctacatttttactaaatgctcaatgatttgggatgaaaagggcgaaattggtcgcagcctgaaggcggattctgtacggcgcgaagttgaagctagtttgcgccgactggatattgaaaccattgacctctatcaaatccactggcctaaccctgctacagaaattaaagaaggctggacgactcttgccaagcttaaagatgaagggaaggttcgctatatcggggtttcaaatttcaatgtcgaacagttgaaacgtatccaggaaattgcaccagttacctcattgcaaccgccttattcattggttaagcgcgatgtcgaaaacgagattctgcctttttgtcaggaaaataacatcggtgtgattgtttattcacctatgcaatctggcttgcttacaggaaagatgacatctgagcgggttgccaatttaccagatgatgattggcgtaagaagagtgatgagtttcaggagccacgtctatctcgtaacctgaagttagtcgaggtgttgcaggacattggtaaggaacacgatcgctccgccggagaggtagcgatcgcttggactttaaacaatccggcggtgacggctgcgatcgttggcgcacgcaatcccaagcaggtagaaggaatcatcgctgctggggaatttcgccttaatcagcaggagctagatcaaattgctgctttcctg

SEQ ID NO: 43698 - DNA, 1284 bp, Nostoc punctiforme
ccaggacaacaggtcaaaatcggcccaaccaagttgctgattaataatgagtgggtaaatagtgtcagcaatcgccgatttgaaacaatcaacccaactacaggtgaggtaatctgtgaagtctcagaagcagatgccccagatgtagataaagcagtacaagcagcccgcaacgccttcactaatggacaatggagaaaaatatctgccacccgtcgcggcgagttactttacaagttagctgatttaattgagcagaatatcgatgagttggggcagctagaaactctcgacaacggtaagccattacaagattcattcggtgacttgaggttagtcatcgcttgctaccgttactatgcaggttgggctgacaaagtacaaggtaaaactattccgattaacaggccatacttttgctagccatgaaccggtgggtgtcgtgggtcaaattatcccgtggaatttccccctgttaatgcaggcttggaagttagcaccagctttagcaactggtaatacagtagttctcaaaacagcagaacaaacaccattatcagcactgcgggtaggcgagttgattattgaggctggtttttcgcctggtgtggtgaacatcttatcaggatacggcccaaccgccggggctgcgtctacgcaggttcccacgatgccatattctttaaccaagggcaatgctgctgtgctggttcgcggctgtttgtcgaagagaaatgttatgacgagttcgttgctagaactgtagaaagagcaagagcgcgggttgtcggtaatcctttcgatgccaaaacagaacaagggccgcaggtagacaaagaccaattcgatcgggtgatgagctatatcgaatctggaatgcgcgaaggggccgagatgctatgtggtggtaatcaagttggcgacaaaggttattttattgcacccacagtctttgctggtgtccgcgatgacatgaagattgcccaagaggaaatttttgggacagtgatgagcatcatcaagttcaaagatattgatgaagtcattcaacgggcgaatgccaccatgtaagggcttgctgccgcagtgtggactcaggatatcaaagcccatgcgatcgctaacaatctccgggctggtactgtatgggtaaattgctacgacgtatttgatgctgctgcaccctttggtggatttaagcaatctggtattgggcgagaactaggcgaatatggcttgcagcaatataccgaagttaagaccgttaccatcaaattgtagtac

SEQ ID NO: 43699 - DNA, 1281 bp, Nostoc punctiforme
tctcccctaattgcgatcgcccaaaaaacccgcaaagctgcaagtaaactggcgattctctccactgaggcaaaaaatcaagcaattattgcgatcgcgcaagctttagaatcagctaaagatgaaattttacaagcaaatattgctgattgtgaagctgctaatgccgaaggaattcccaaaccgctttataagcgcttgcagttggatgaacataaattaagagatgcgatcgttggggtacaagatgtcggtaagctagacgatccagttggtaaagtgcagattcaccgcgaacttgacactggcttaattctcaaacgaattacttgtcctttaggtgttttggggattatttttgaagcacgtccagaggcggcgattcaaattgcttccttagcaatcaaatcgggaaatggtgtgattctcaaatgtggcaaagaagcggtgcgttcttgtgaagcgatagttaaggcaattaagcaaggattgtcacatactgctgttaacccagatacggtacagttactgacaactagagaagaaactttagaacttttgaaattagataaatatgtggatttaattatccctagaggttctaattcctttgtacgctttgtacaggaaaatacacgcattccggtactaggtcatgctgacggaatttgtcatctttatatagataaagctgctgatatttctaaagcagttccgattactgtcgatgccaaagcccaatatcctgctgtttgtaatgcaattgaaactttgctagttcaccaatcaattgctacagaatttttaccaaaagttgctgatgctttgcaagaacgccatgttgaattaagaggcgataaacgtaccttgaaaattttaccgaacattgtatctgcaacagaaatagactgggaaacagaatatagcgattatattttgtcaataaagattgtagactctatagaagatgcgatcgcacatattaacgaatacggttctcgtcatactgacgcgattattactgaagattcaacatctgttgaaactttctttggactagtaaattcagccaatatattccacaattgttctacccgatttgctgatggtttccgttatggtttcggtgcagaagtagggattagtacgcaacaaatgcctccccgtggccccgttggtttagaaggattagtgacatacaaatatcaaatgactggtgatggacatattgtcgctacttacaccggggctaatgctaaagcttttactcatcgagactta

SEQ ID NO: 43700 - DNA, 1149 bp, Nostoc punctiforme
gccatagccccccacggtggacagttggttaaccgtatcgccacaccagagcaaagagaagagtttctctcaaaagctgactttttgccgcgagtgcaacttgacgatcgcgccgtttcggatgtagaaatgattgcgatcggtgcttttagtccactcacgggttttatgagccaagaagactacgatcgcactgttacagaaatgcgactagctaatggtcttgtgtggtcaattccgattacactatcggtcactgaagaagtagcttccccattgcaagaaggtggcttaatccgtctggataactccagaggtgaatttattgcagttttgcaactcacgcaaaaatataattacgacaaaacccgcgaagccattaatgtctaccgcactgatgatgtcaaacatccaggcgtgcaggtactctatagccaaggtactgtacatctggcgggtgatatttggctgttgcagcgcgaacctcatccccagtttcccacttaccaaatagatccatctgcctcacggcaactatttaaagataagggttggaaaacaatcgttggtttccaaactcgcaaccctatccaccgcgctcatgaatatattcaaaagtgcgctttagaaattgttgatggtctatttttgcacccattagttggggcaacaaaagaagatgatattgccgccgatgtgcggatgcgttgctatgaaattttgctggaacattactaccccttagaccgggtaactttggcaattaatccagccgcaatgcgctatgccgggcctcgtgaggcaatattccatgctttagtccgcaaaaactacggctgtactcactttatcgtcggacgggatcatgctggcgttggtgactattacggtacttacgatgcacaatatatctttgatgaatttgccccaggcgaattgggcattgtgccgatgaaatttgaacacgctttctactgcacgcgcactaagcagatggcaacatctaaaaccagtcccagcaggccagaagaacgtattcacctatcggggacaaaagtccgagaaatgctgcggcgtggtgaattacctccaccagaattttctcgtccagaggtagcagcagagttggcacgggcaatgcggatagaa

SEQ ID NO: 43701 - DNA, 2979 bp, Nostoc punctiforme
atggtagacttgttgcggcagctgcgcgatctgtgttcgccagaaggacaggcaacaaatgaccaagcatcctcagccgtcaaattaattgaacaactaaatatcaacgaagcaatccgcgcggctcgtgctttcgctctgtattttcagctgattaacatcatagagcaggaatacgagcaaaggcagcaactgagtcgctatgaagcagaaacagagcctacagactcagaaagagcatctaatgtcaattactcgtccaatcaaagagaagatgatgcgcctgttagcaagggaatagcagcagaattgctagcaaagaactatctagaaaaagcgcaagtcaaaccaaaagggactttcgctgccttgtttccctatttattcaaacagaatgtaccaccccagcagattcaacgtctcattgctcatctagatgtgcgcttagttttcacagcgcacccgacggaaattgttcgtcataccatccgagataagcagcgacaggtggtacaactcttgcaaaaactggataccttagaaaaccatgctggtggtacaggtggcggatatgcttgggaagcagcagatgtccgcgaacaattgcttgaagaaattcgcctctggtggcgcacggacgaacttcaccagttcaaacctactgtgctagatgaagtagattatgccctccactacttccaagaagttttatttgatggcattcctcaactttataaacgtttcaaacatacactatctaatacctttccttggctagaaccaccaagtaaaaacttttgttcttttggctcttgggtaggctcagatagggatgggaacccatcagttacaccagaagtgacctggcaaacagcttgctatcagcgcaaaatggtcctggggagatatattcagtcagtgaaaaatctgattgaattgttgagtgtgtcgatgcactggagtgatgtcttaccagatttgctggaatctctagagttagatcagtcccagttgagtgaggtatatgatgcactggcgctgcgttatcggcaagaaccctatcggctgaaactcgcttatgtactgaaacgactagaaaatactcgcgatcgcaatctagctttgtacaatcgggaaacgccaaaaaatcaagatagtcccctgtatcgttcgggagacgattttttagctgaactgcggatgattcagcgtaacttgacagaaacaggtttaagctgtcgagatttagaaaatctcatctgtcaggtagaaatttttggttttaacttgacacagctagatatccgtcaagaatcatcccgccatgctgatgcgctaaatgaaatcctacaatacctgcaaatattacctcaaccttacaacgaactatctgaggagcaaaaagttgcttggcttacaggagaactgcaaacccgccggccattaattccagcagaattgccattttctgaaaaaaccaacgatgtaattgaaacctttcgcgtcgtgcgatcgctgcaacaagaatttggtctaaatatctgccaaacttacattatcagcatgtgccgcgacgtgagcgacgtgctagaagtactactgttagccaaagaagccagactttttgaccccgccatagccgtgggaaccattcaagttgtccccttatttgaaacagtagaagacttacaacgctccagaagcgtcatgcggaaactgtttgaactcccgttatatcgcgctttgttagccggtggctacgaacaaacaaaaacagagagtgttgtcgtggatgaaaattcatcctcccttgcctcccctgccccccctgcttcccccgcttcccctgccccctccccctcccccctcacccctaacttgcaagaagtgatgctggggtattctgacagcaacaaagactctggttttttaagcagcaactgggaaattcataaagcccaaaaatcactgcaacaaatagcagaaggctacgatataaatttgcggattttccacggacgcggcggttctgtagggcggggtggtggccctgcttacgaggcaattttggctcaaccgggtcatagtatcaatgggcgaatcaagattaccgaacaaggagaagttttggcttctaaatactccttgttggacttggctttgtaccacatggaaaccatcaccactgctgtgattcaagctagcctgctgcggacagggtttgatgatattgaaccctggaatgagattatggaagaattagcagcgcgatcgcggcaacattatcgggctttaatttatgaacagcctgattttgtggactttttccatcaagtaacccccattgaagaaattagccagctacaaattagttcccgtccagcccgtcgcccatctggtaagaaagatttaagcagtctgcgagctattccttgggtatttagttggacgcaaacccgctttttgcttccttcctggtatggcgttggcacagcgttacaagaattcttgaatgcagaaccagaagaacacttgaaattaatgcgctacttttacgttaagtggccctttttcaagatggtgatttctaaggccgagatgactttggcaaaagtagatatgcaaatggcacatcactacgttcaagaattgtcacaatcagaagatcaactccgctttgctaaggtttttgaccaaattgccagcgagttctatctcacaagggatttggtgttaaaaatcaccgatcacaatcaattgttagatggcgatcctgtcttgcaacgatctgtgcagttacgcaatggcacaattgtccccttgggatttatccaagtttccctgctcaagcgcctacgccagtctatgaatactaatgccacttctggagtcatccattctcgttacagcaaaggcgagttactacgaggtgcattgttaactattaatggaattgcagccgggatgagaaatacaggt

SEQ ID NO: 43702 - DNA, 1905 bp, Nostoc punctiforme
atgcacttgagcgaaatcacccatcctaatcagttgcacggtttatctgttcgccaactgcaacagattgcccgtcagattcgagataagcatctccaaaccgtagcagttaatggtggacacttggggccagggttgggtgttgtagaattaacactaggactttaccagacactggatttagatcgggataaagtgatttgggatgtaggacaccaagcttatccccacaaactgcttacaggacgctacgatcgcttccacacccttagacaaaaggacggagttgcaggttatctcaaactctgtgaaaacaaatttgatcactttggggctggacatgcttctacaagtatttcagcagcattaggcatggctttagcgcgagacttgaaaggcgaaaaatttaaagccgtcgctgttattggggatggggcgctgactggaggtatggcattagaagccatcaaccatgcgggacacatgccaaaaactaacctgttggttgttctcaacgacaacgacatgtccatatctcgcaacgtcggcgcaattccccgctatctgaacaaaatgcgcctcagccagccggtgcaatttattaaagataatcttgaggaacaatttaagcagattcccttcgtgggtgaatctctgtctcccgaactcggacgcatcaaagaaggtatgaaacgtttggctgttcccaaggtaggggcagtgtttgaagaactcggctttacctacattggaccagtagatgggcataatctcgaagaattgattaccacctttcaacaggcacatcagatacaaggccctgttttagtacatgtggcaacagtgaaaggcaaaggctatgaaattgctgaactagatcaagttggctaccacgcccaaagtccctttaacgttgcaactggcaaagctattccttctaataaacccaaacctccagcttatgccaaagtcttttctcacactctggtaaaacttgccgaacaaaaccccaaaatcgttgggattactgcggctatggcaacgggaacaggtttagataaacttcaagccaaactgcccaatcaatatgttgatgtcggcattgctgaacaacacgcaatcaccttagcagcaggactggcaactcaaggaatgcgccccgtagctgccatttattctaccttcctgcaacgtgcttatgaccagataattcatgatgtctgcatccaaaatctgccagtgtttttctgcctagatagggcaggaattgtcggatctgatggtcccactcaccaaggtatgtatgacatcgcttatctgcgttgcattcccaatatcgtcatcatggcacccaaagacgaagcagaactgcaacgtatggtagtaactggtgttaaccataccagtggcccgatcgctatgcgctaccctcgcggcaacggccacggcgttcccctgatggaggaaggttgggaacctttggaaatcggtaaaagcgaaattctccgcaccggcgatgacgtgttaatcgtcgcttatggcacaatggtttatccagggatgcaagctgctgaaattctcagcgaacatggcattgaagcaactgtaatcaatgcgcgttttgttaagcctttggataccgagttgattttgcctttggctaagaaaatcggccgcgtcattaccttagaggaaggttgtattatgggtggctttggttctgcgatcgctgaagccttaatggatgcagatattctagttccagtcaagcgattcggtgtaccagatgtgttagtagatcatgctgaacccaatgaatctaagacagaactaggtttaactagtcatcaaatagcagaaagagttttgcaagctttctttaagcagcaagtatctgctgtggtt

SEQ ID NO: 43703 - DNA, 1419 bp, Nostoc punctiforme
atgtacgaaaagattaccccccccgcagccggagcaaagatcgccttcaaaaatggtgaaccaatcgtaccggacaatccaattatcccttttattcgcggcgacggcacaggcatagacatctggcctgctacccaaaaagttctcgatgctgcggtagccaaagcatataagggtcagcgtcaaattagctggttcaaggtttatgctggtgacgaagcttgcgatttatatggtacttatcagtatttacctcaagatactctaacagcaattgaagaatacggtgtcgctattaaagggcctttgactactcccgttgggggaggaattcgttctttaaatgtggcactacgacaaatttttgacttgtatgcctgcgtgcgtccttgccgttactatgcaggtacgccctctccccacaaaaatcccgaaaagctggatgtaattgtttatcgagaaaatacggaagatatttatttaggcattgagtggcgacaaggtagcgaaattggcgatcgcttaattaaaattctcaatgaagaactaatccccgccaccccagaacatggaaaaaaacgtattcctcttgattctggtattggcattaaacccatcagcaaaactggttcccagcgtctagttagacgtgccatcaaacacgctttgctattgcccaaaaacaagcaacaagtgactttggtgcataaaggcaacatcatgaaatacaccgaaggcgctttccgcgattggggttatgaactagcaaccagcgaatttcgccaagaaactgttactgaacaggaatcttggattttgagtaacaaggaaaaaaatccgaatatttccttggaagaaaatgcccgccagattgaacctgggtttgataatctaactccagacaagaaagcgcaagttgtcaaggaagttgaaactgttcttaacacaatttgggcaacccacggcgatggcaaatggaaagagaaagttttggtgaatgaccggattgctgacagtatttttcaacaaatccaaaccagaccggatgagtattcgattttggcgacgatgaacttgaacggtgattatttgtctgatgccgccgcagccattgttggtggattgggaatgggaccaggggcgaatattggtgattctagtgccatatttgaagctacccacggcactgcacccaaacacgccggcttagatcggattaatccaggttcagtgattttgtctggtgtgatgatgctggaatttttgggttggcaagaagccgcagacctaattaagaagggtttaagcgatgcgatcgcaaatagtcaagtcacctacgatttagctcggttgctagaaccacctgttgaacccttaaaatgttctgaatttgccgacgcaattattcagcattttggt

SEQ ID NO: 43704 - DNA, 1725 bp, Nostoc punctiforme
gtagcagccctgcaaaattatgagcgtctacgtgaaagtcaagacagtctgcgtcaaagtgaagaacgttatcggctattagtagaaggagtaactaattacgcaatttttatgctagatccaaacggtaacgttaccacttggaacattggagcagaacgtattttaggttatcaggaagcagaaataattggtcaaccttttgaacgagttttttcacctgaagcaattaagcagggactacccaagcaagtattaagaaaagcagtagctgaaggtttttctagggagaatcgctggcatattcgtaaagatggtacatttttctgggcgcattgtctcatcacacctttactagatgacgatggaaatctgcgcggcttttctaaaattatgcaagatattactgaacgtaaacaggctgaagaagaaaaagagcaactattactgcgagaacaagctgcacgcgccgttagcgaagctgcccaaagtgcagcagaagccgcaaaccgttccaaagacgaatttttagcaatagtttctcacgaattacgtacccccatgactgcaattatcggttgggctggaatgttacaaacgggtgtgttagatgaagctaaagcaactctcgcgctggagataattgagcgcaatgctaatttgcaaatgcaacttattgaagacttacttgatatttcgcggattgttagaggagagctttcactgtccattgatttggtagatttagtagaagtaattacagccgcaattgaggttgtacaatcactggcaaatgctaaggatattcaacttgagactatacttgatacctcaatagaaaaaatttggggtgactcagatcgcttgcaacaagtagtattaaatctacttactaatgccatcaaatttacacccaacggtggacgagttgaagtgcgattgtctaaggaaatggggagtagggaagagttttcccaacccgcaattcctaattatctccaaattgaagtaactgataccggtaagggcatcagtccagatttcctacctcacgtatttgagcgcttttggcaagcagatagtactcatactcgttcaaataaaggactaggtttagggttagcgatcgcacttcatctggtagaactacacggtggtacaattgatgcccaaagccaaggaatagggcaaggagcgacatttacagtcaagttgccgattttagaagaaagcagaggggcagcacttcgactacgctcagtgaccgaggagcagggaagcagaggggcaggagacaataatttacacttcttttcccagtccccagcccccaatccccaatccccagtccccaatcctcttagtggcttgcgggtattggttgtagatgacgaggcagatgtgcggcagtggattaccgcagtactcgaagagtgtggagcagaagttagtgcttttagctctacaggacaggcacttgaggcactagaaaaattacatccagatgtgttaatcagcgacattgggatgccaggtgaggatggctacgcgctgatgcgtaaaatcagaaaacttgaaccagagctaggcgggcggattcctgctattgcactgacgggatacgccagggtagaagattataaagaagcattagcggcaggatttcagctacatgttgctaaaccagttagagcagctgagttaattgccgttgttgccagccta

SEQ ID NO: 43705 - DNA, 2085 bp, Nostoc punctiforme
gcttttggttcacctggcatcgatcctcaatggactcatgccaataaagatggagtaggaacagcttactctacctccagtcgcgtttggtttactgtctggaacggtgttgtgactgaaatctaccaccccacagtagacagaccccaagttcgggatttacagtatctcatttctgatggtaaaagctttttccacgaagagaaacgccatctcgaatcaaaagtagaaccgatgtggattcatggtttaggatatcgcatcactaattccgatccccaagggcgttatgctgtaatcaaagaagtgattgctgacccgcatttatcctgtattttacaacatacaaagttaacaggagatagcgattttatttcccaactccagctatacgctttatgtgcgccgcatctggaagtcggaggtagaggtaataatggttacgctgtacaagttgctggacatcggattctaacggccgagaaagcaggaacatggctagcgctgagtgcaacagttccctttactcgtctttcctgtggctacgttggacaaagtgatggttggacagatttagctgataattttcggatggattgggagtttgacagtgctgtagatggcaaccttgctttgactggaaaattaaatctcaatggcagtaaagagtttactttagggctggcatttgggacaactctgcacaatgcaatttccacactgtttcagtcactcaatattccttttgagaagcagaagcagcaatataacgaacagtggaagcgatcgcgcgacggcatccactcattagaaaatgcttcttatgatgatgggaagttgtatcacaacagcgttagtttgttgttggcacacgaagacaaaagctatcccggtgctttaattgcatctatggctatcccttggggtgaagccaaagacgaccaagaccaaggaggatatcaccttgtctggacgcgggatctggtcagtagtgtaacaggtttggtggctgctggggaaacagatacagcagtgcgatcgctaatttatcttgcaaccagccagcaagaagatggtggttttgcccaaaatttctgggttgatggtgaaccttactggaaaggtattcagctagatgaagtggcatttccaattttactggcatggatattgcaccaagaaaaagtaccactgcactttgatatttatcccatgattttacgagcggcaggttatttaattcgtcatggccctgctacccaacaagaacgctgggaagaaaacagtggctattcaccttctacactggcatctaatattgccgctttaatctgcgctgctcaatttgttcgtgaaagtggtgatgaagcaacagcacaatttattgaagaatacgccgattttttagaatctcacattgaagcttggacggttactaccgaaggaaccctggttcctggcatcaaacgccattacatccgaattactcctacaaatatcaataatcctcaacccaacgaaaatcctaatcagggaactcttcttattgccagtcagccacctggtgaaccagcagaatttccagcgaaggaaattgtcgatggcggattcttacaattagttcgctatggaattcgcaaaccagatgacccgattatcgttgattctgtcaaagtaattgatgcaatcttaaaagtagatacacccgttggcccttgttggcatcgttacaaccacgactgctacggtcaacaagaagatggaagtccttacattggttatggcaagggacacgcttggcctcttttgacaggagaacgaggacattatgaattagctgctggcggcgatgtcaaaacatatatcaaggtggtggaaggatttgcttcaaacacttgtttgttaccagaacaggtttgggatgaagcagatagaccggatatccatcagtatttgggaaaaccaacaggttctgcgatgcctttaatgtgggcgcacgcagagtatatcaagctgctacggtcaaaccatgatggtcaggtgtttgattttattccagaggtagcgaatcgttatttaggcgaa

SEQ ID NO: 43706 - DNA, 1023 bp, Nostoc punctiforme
agcagttaccgagaaaagaatatctgcaagttatcgcagcctcattcccagtattgcgatttgacagtagtgcggaagttaagtggagtagcagaagcgatcgccctttcttccgatgctcacaccttagtgggcggcggtggcaaaagctttaccgtctggcatctgccaagtcagcagccgcaattaaccctgaaaggacacgccaatgatatttatgaccttgcgctttctgctgatggtcagactttggtgagtgggagtttagacaagacgattaaggtgtggaatttagcgacgggaaaactcaaatttacgctcaaaggacattctgaagttgtaaatgcactggcgatcgcacccaatcagcaaacaattgtgagtgccagttctgacaagaccattaagatgtggaatttggcgactggacaattaacaagcacattggcacaaacaccggatgctgtaataactttggtgctgagttcggatggcaagactttggttagtggcgattcgagcaatcacatcactgtatgggatctggtaactggacgaaaacgcaccactttgactggacattatggtgtagtatctgctttagccattagtcgtgacggtcagctgctcgctagtggcagcgccaagcaggtaaaagtgtggaacctgacaacaggaaaattgttgcaggattttgggggcttctattttccgcagatcaccatcgcctttagtcccaatgggcaatctttaattgctggtggaggatataaaccataccgggtttggaatctggcaacaggaaatatggaagcaactctgcccgatgttagcaactggtcgggggcaatggtatttagtagggatggcaagactttgtttagtggaacacaggacggaattacggtgtggaaattttctgcaccaagccacccgtaaaagaatgtttgaaaagttatgagagtcttgcgcctgagctattcgtctggttttaaaacttcctctttctaaaaaacagaaatg

SEQ ID NO: 43707 - DNA, 648 bp, Nostoc punctiforme
aagcaacttgaaaataaggttgtaatagttacaggtgcagggaaaggtattggtcgggcaattgcgcttgccttcgctgttgagggcgcacatattgttatagctgataagtctgaggaattagccagcctgagtgctgatgcaattaaagcgattggtggaaaagcaattgctttgataactgatgtcactcaagaacagtcagttgctgatatggtagagcaaacacttgttagcttcggaaaaattgatattttggtggcaaatgcaggtattcaacgccgttattttgttgctgacttgccgcttgctgaattccaggcaatacttgatgtcaatttacttggtgtgttcctgacatccaaagcggtactaccgacgttctactcgcggcaggaagggaacatcatattgatagcttctgattcaggcaaacatggctattcatataacgctgcatattgtgctagtaaatttgcagtagttggttttatggaagcattagctgatgaagcaaagcactatcaagttagggtgaatgcactatgtctggctggagtaaaaaccgatatgggtaaggaattaaaggaaacagacggcaactgtgttaatgacacttactttatggaacctgaagaagttgcagat

SEQ ID NO: 43708 - DNA, 234 bp, Nostoc punctiforme
atgacaaccgagcaagagcttcaatctctttttaataccttagatagcgatcgagacggcaaagtatccattaacgatctttttttaagtcctggcttaagtgcaatcatttcatcagaaacaaatactactagtccccaggaattactagtaaattatgattcagacaaagacggcagtattacctttgaagagttaaagggagcagttgagaaggcaaataatttaaactag

SEQ ID NO: 43709 - DNA, 2934 bp, Nostoc punctiforme
atgacaaatacaaccgttgatattcaagaatttattgctgatttgtttcctttcaattatctgtcaccaaatgttttagaaaatttgctcaacaaagtgcaattttgtcgctatcgcatcgggcaagtaatagtagcacgggaagctatgcccgatcggattagtattatctaccagggacaagcgcgtttattagcctacaattcccaaggacaaaatccggcgacactgaagttgctctcatcaggtgaggttttgggttgggtaagtcatgtgcgggggattgcttgtgaaactgcgatcgcttctactgaagttatcacctttaatctggcgatcgctgattttctcgcattgattcaacaggagaaggcttttgccgaagcattacataatactgcttccctcatagaagtatatgaactgctgatggaagaactgaatcgtcgggcagatggtagcaggaatttagttaagcttgctcgcacagcaactcaagcagccgttattcaaacattcccaacacgtaaaatatctctccagcagttagattcagaattattgtggttagttagcagtagttcgagtgcttactttcctgtagggagtcgcttaaagttagatgatatcaaccccaagctgaaatttaacgcaagtatgcgtctggtgggcttacctaaatcaatacttggagaaaatcttgctcctcctacgtcaaaaacactgttacccgcagagattccctacgcttcagaaattactgtcacagaagaaccagcagctaagggtaaacaaaagaagtttccttatatcaaaggtagaggaccactagatggttcattagcttgcttccaaatgttgagccaatactttaacatctcctggcgcaaagatacactacgccgggtgttgacaaagcagcaagaacagaagggcactatatctctgcaattttgcgccgccgccgctgagttgatggggttgacaacacagatggttaaagttcccgctaccgcagtcggacgcttgcagttaccagtaatgatttcttggcaagatagttttgccatcatctacaaaaatagcgatcgagagttactcattgctgttccagagatgggactactgcgctacaaattacgagactttgcggaaaactggggggctgaaggagaagttctgctgctacaaaccaccaaaaatactcccaaggcgcggtttagtttaagttggtttgtaccttcactgcgacgctaccgcaaagtattaattgaagtactaattgcttccattgttatccaactgtttgggctggtaaatcctctggctacacaggtgattattgataaagtattggttggcaatagtcctgataccctggaagttttcggcatctttttgctggtagttgcagtcatcgaagcaatacttaccagcgttcgcactcatttatttacagataccaccaaccggattgacctcacccttggttctgaggtgattaatcacttgttgcgtttgcctttatcttactttgaacgccgccctgtgggggaattggcaacgcgaatccacgaattagaaaacatccgctcttttttaactggtaccgctttaactgtagtgatggatgctgtgttttcggtggtctacatcgtagtaatggcgatttacagcccagtgttgacattagttgctttggcaacagtaccgctatttggcttgctcaacttgatggtatcacctttgatgcggcgacaattgcaagagaaagctgagtgcaatgccgagacgcaatcttatttagtggaagtcatggggggaatgcagacaatcaaggcgcaaaatttagaaatgcgatcgcgttggcaatggcaagaacgctatgctcgttacatcagcgctggtttcaaaacagtctctacccaaactaccgccagttctattagcagttttctcaacaagttttccagcatgttagtactgtgggtgggagcttttctcgtcctaaatcagcaccttaccttgggacaactcatcgcctttcgcattcttgctggttatgtcaccagtcccttgttacgcctgatgcaactttggcagaacttccaagaaaccgctctatctctgcaacgccttgctgatattttagacactccccaagaaacagaaatcggcaactctcaaaatattctcatgcccagtattcaaggtagtgtccgctttgaaaatctcagcttcagtttctcggaaaacggaccgatgcaactgtgcaatattaacttagactttccggctggctcctttgtgggaattgttggtcaaagcggttccggtaaaagcactctgctaaaattgttgcctcggctttatgaaccaaagtccggcaaaatcttgattgatggctatgatatcagcaaagtagaactttattctttacgtcgtcaaattggtatggtgttacaagataccctcttgtttgatggcacaattcgcgaaaacatttccttgggatatcctgatgctagcgatgaagaaattattactgctgccaaggtagcattcgcccacgactttattatgtctttacccagtggctataacacccgcgtcggcgaacgaggttcgggactgtctgggggacaacgccaaagagtcgcgatcgctcgtactgttctgcaaaatccccaattactgattcttgatgaagcaaccagtgccttagattacaatgccgaagcccaagtttgcggtaacttagcgagaactttccaagataaaacagtatttttcattactcaccgcctcagcacaattcgcaatgccgatgtaattctcatgatggatcgaggcgctgtagtagaacagggaactcatgaagaattgatggcgctcaaaggttattactactgtctgtatcagcaacaggaagcg

SEQ ID NO: 43710 - DNA, 1923 bp, Nostoc punctiforme
atcaattttaccctgcaagcgatcgccgaatttatgggagctgaatgcagttgtatctttgaatatcacgagccacaacagcaatttcacatcgcccatgagtggtataatcccagcagcatattaaacaacaccacttcatctgagccgttgccctggttttataaccaaattctcaacggtaatcctattcaaggtttacaagcgtctcgcattgcaaatattttaccagaggcaaacgtcgagacagaattgacttacagagaaataattaaatctgtagtggctgtaccaatgatttatgccggcagagtcgttggactactggaattagatactgttaacaaatccaaaacttggaaccaagaggaaatcaacttactgcaactggtgagcgaactcatagccattgggcgatcgcggcataaggctgaagaggcactacgaattgccaaagaaaccgccgaaactgccaaccgttcaaaaagcgccttcttagccaacatgagccatgaactgcgaacgccactcaatgccattttgggttttgcccagctaatggaacgagacaccaccctcaacaaacgtcagcgagactctttagcaactatcaatcgtagtggagaacacctgctcaacttaattaacgatgtgctggaaatgtccaaaatcgaggctggacggattgttcttaacccgacatcctttgatttgcataggttattgcaagagatgcaacagatgtttcaggtacgagccaaggataaaaagttatcactctcatttgaacttgctccaaatttgcaccaatatatcctcacagacgaaagtaagctccgacaagtgctgatcaacctattgggaaatgccattaaatttaccaatactgggggagtaacgttgcgcgtaagcttggggattggggagcaggggagcaggggagaagttgcactaagtctttcccctctgcccctctgcccctctgctcctctgcctcttgtgcccaattcccaatccctgattagctttaaaattgaagatacaggattgggaattcctacagaggaattagataatttatttcagcctttcgttcagactgcaagtgccagacaagtaatggaagggacaggattaggattaacaatcagccgtcaatttgtgcagttaatgggtggcgatatccgagttcatagtgtggtaggcagtggctcaactttctactttgatatcaaaattgaactagcagactcattagatattgcaccaccaacactcaaacgtagagtaattgctttgacaccagggcaacctgtatacagaatcctgatagttgatgaccgcgaagacaattgtgatttattaacgcagttatttaatagtattggttttgaaactcaggcagcagctaacggacaagaagcgatcgctctttggcaaacttgggaaccccacctgattttcatggatatgcgaatgcccgtgatggatgggtatgaagccactaaacaaatcagagctactttaaaaggtcaagctacagtcattattgctctaactgctagtgcttttgatgaggaacggtttgtggttttatcggcaggctgcaacgattttgtgcgtaagccgttccgagaagaagtaatcttaaatatcatatctaaatatttaggagtgcgttatgtatatgaacaggaaccacttcaacaagaccaacttgcaaaaaatcccaaccttaaacttctatcattagaagaaattctagctcagatgcctactgagtgggtgacacagctacaccaagcggcactctgtactgatgaaaaactgattttcagcttacttgagcaaattcctgaagaatctgctcttttggcaaacactctgtctgattggattaataactttcggattgataaagtt

SEQ ID NO: 43711 - DNA, 1206 bp, Nostoc punctiforme
gcctatcaagcttccctaaagttagggatcacaaagggagcagaccgaagtcgtgcagtattggcgatggcacaagctcttgagcgctcatttgacgacattctagaagccaacacgttggatttagaagctagtcgagaaatggcagtgccagagttgatattagactggctgaagctgactcccacaaggctagagatgacagtagacgttttacaacggttaggggaattatcagatccgctaaggcgcgttagaacggctgattatcaactggaagattcccagagttacacccagttaatgcctttgggagtgattggatttatttatgaagcctttcccgatttaggggcgatcgcagcaggtttttgtattaaaactggcaatagtataattctcaaaggcagtactgaagctagccattccaacgctgccatcgctgaggcactgcaaaatgcgatcgcagaagttggtctacctttaggctgtgtagagctaatcacagccgaacatggtgcttcaattcgggatttagtcacccaagaccagtacgtgaatctagttattccctacggacgttctagcttggtacagcaggtagtacgacagtcaacttgcccagtcttaaagtccgcgatgggtaactgttatctctactggtcgctaaattccagcttagaaatggtgcgctggatgattcttgatagccatcaaagcgaacccgatcaagtcaatgcgattgaaaaggtactcattcatcgtcaagccttgccatcatccttagcagttctgtggaacagcttgatggaaaaaggctttgaaattagaggggatgcagaactagtacaagcttttccccagttgcagctggtgaaggagggggaatggggaaatccttatttaacaaagacggtagcttttaaactggtggatagcttagaaagtgcgatcgcttggattaatgaacacagtagtggtcatgccgactccatcgttactgaatcttaccaagaaagtcggcagtttgctttaggagttaacagcgcctctacctacatcaatacttccccgcgtttttcccgcaacccctcgcggggagattcagtgtttctcggtatgtctaaccaaaaaggccatcgtcgaggatttatcagcttagaaaccttgaccaccgttaagcacattgttcagggaaatggcagg

SEQ ID NO: 43712 - DNA, 861 bp, Nostoc punctiforme
tcagtagccattaccccagatggtcaaacagcagtttctgcttctagtgacaacaccctgaaactgtggactctaaagctttggactctgaaactatggaatgtggagacaagaagagaaacctttaccttgagaggtcatagaggtttagttaatgcagtagccattaccccagatggaaaaaaagctgtttctgtttctaataacctaaaactgtggaatttgaagacgggatggcaaatctctacacttacaggtcataaagactcgataaatgcagtagccattactccagatggtcaaaaagccgtttctgcttcaagtgacaccaacctaaaactgtgggatttggagacaggaaaagcaatctctaccctcagaggtcatactgactcggtaaatgcagtagctattattccagacagacaaacagctgtttctggttctgctgacaccaccttgaagttatgggatttgcaaacaggaaatgtaatctctaccctaagcggtcataaagactcggtaacagcagtagccataactccagatggaaaaaaagctgtttctggttctgctgacaccaccttgaaattatgggatttgcagacgggaaaggcaatttctaccctaagcggtcataaagattcggtaacagcagtagccataactccagatggaaaaaaagctgtttctggttctgctgacaccaccttgaaattatgggatttgcagacagaaaaggcaatctctaccctaagcggtcataaagattcggtaacagcagtagccatcaccccagatggtcaaaaagccgtttctagttctactgacaccaccctgaaactgtgggatttagagaca

SEQ ID NO: 43713 - DNA, 1668 bp, Nostoc punctiforme
atggcaaatttaactgactttaaattgtttgctcctcgcaacaaaggagcagctttaattgggtctttttcggattggaaagaaattccaatgtctaaaagtgaagatggttattttcgcactaaaatcaaactggaagacggcgtttatcaatataaatttcgcattcaaactaaaagtccaaattttgcacctgatgaatggatcgatgtcattgatcctaaagcaacagaagttaatgaaacagaaaaatatggcatagttcgtattcaagatgggcaacgcattgttgatagttacttttggcaacacgatgaaatgccgttgcctgataaccgggaattagtcatatatgaaatgcacgttgctgattttactggtgatgaagttgattctaacgagcgaggcaaatatctagggataattgctaagttagattatctttgcgaactgggaattaatgcaattgaattaatgccagttaatgagtaccctggtgattatagctggggctataaagttcgccacttctttgctacagaatctagttacggttcaacagaagatttaaagcgattgattgacgagtgtcatggtagaggtattcgcgtctttatggatggaatttataaccacacagatgaagaatgcccattaatactaattgaccgcaattactggtactacgaacataaacattatcctgaagacccagctaattactgggggccagagtttaactatgatttttacgacaaaaacttaaatattcaacctgcatgggaatacatcggcgatgtggtaaggttttggattcaggaatatcacattgatggaattcgctttgatgcagtacggcaattggctaactttgaatttctcaactggctgactaagcaagcgaaaaaccatgctgcacccaagcagttttacaacattgctgaacacattcccgatacaaacactgtagtcaagccagatgggccattagatgcttgttggcatgagagctttcgctactttttagttccatatatttgtggaaaatcatttgaattagaacaactcaagcaaattttagaccccaaacagcagggttatgcgatcgctaccaatgtgataaattatttggcaacccacgatcgcgaacgtctattacgagaattaggcaattgcggcatctttgacgcagccgcatttgaacgagccaagttagcagctgttttgttaatgacagcgatgggtataccgatgctgtggatggcagaagagtttggcgaataccagcaaaaaagtgaagatgtgactaagccgcagaaaattacttggtctttgttgttagacgaccaaaattatgatttatttgagtattatcaaaagctgattactctacgccagcaaactccagctttgcaaagtgacaatattaagtttttctacgaaaatgcagatgataaagtgttggcttacagccgttgggatgagcaaaattctcatgtcgtcgttgtggtaaatttttccgatcggagtctaaatcaatataaaatttccgacttcccaactactgaagattggcgagattgggttggtaatcgggaagtgaaatctggagaagatggtttagtcactgacttgccaagctatacagctaaaatatttgttttgcaa

SEQ ID NO: 43714 - DNA, 828 bp, Nostoc punctiforme
aaaattttagtgacaggtgcaactggaaacgtcggtcaagaagttcttcgcttactgcaatcccacgattgtaatgtctgcgccgcagttagaaatccaaacagcgctcaacacctcttaggcagcaatatccaaaccatccccttcgactttaccaatcctgacacctttgattatgctttttttcaagtcaataaactttttttagtgcgtccgcctgcccttgctaatattcgtaaacaaattgccccagccttaaatgctgcaaaacttgcaggcgttgagcatatcgtatttctttcaatactgggagccgaacgtaacccttttgtgccacactctcaaattgaacgttatataaaccaattgggtattaaagccacctttttacggtgcagcttttttatgcaaaatcttaataccacacacagagaagatatcaaagttcgtggtgaattgcttcttccagctggtaatgggaaaacaagtttcattgatgtacgagatattgctgccgttgcagttcgtactttacttgaagatgagcatcagggaagagcatattcacttacgggtgcagaagccttaacctattacgaagtagcaaacattttcacatcgattttaggtaaaccgatacgctataatccttctctgctaaagtttattcgacaaatgcgcttatcggggttgccaatagactttattttagtaatgctagtaatctacactacggctcggttaggattggcaggcaacattacatctgatactgagcaattgctcaatcgttcacctctaactatacggcagtatgtcgaagactat

SEQ ID NO: 43715 - DNA, 1677 bp, Nostoc punctiforme
tatttagtgcagcagtttatcaatggcgataatttgttaaaggagttgcagcagcgcaaggggtataacgctagggatattcaatctattttgctagatttattgcccatcctgaaatttatccacgatcgcaaagtcattcatcgggatatcaagccagaaaatattatccgccataaaagtgatgggcgattaagtctgattgattttggttcctcaaagcaattcaccgcaaaagttcagcacaagtctggcacatccattggttcacatggttattctcccttagaacaaattagagatggtaaagctttccctgccagtgacttgttcggtttaggcgctacctgctttcatctgctaacgggaacttccccctttcagttgtggatggaatcggggtacgcctgggtgagtaattggcgggaatatttgcggagtccattaaatactgagttggattttgtcatcgacaaacttttaaaaaaagatatccatgaacgttaccagtcagccgatgaagttctcaaagacttaactccaaaacaactccttgccctaccaccagctggtaagtcatctggaaaaatccccgcaactcaagccccatctttaccaaaaagttatcctttgctgagaactttaattttggtaagtgcttttattctgttgttcgggttccaagaatcttggtataaaaattttcggcggattcaaaccagtttagtttctaggctgagtcagcataataattctggcaaagatgacgtgcttttaggtcaaccaccaaagattactttgggtaaggtttccttagctaacaccctccaaggacatgaaaactcggttttatccgtcgccatcagccccgacggtaaaaccattgccagcagtgggggcgatggcataatcaaactttggaatctctcaattgggaaagaaatatcttcactcaatgcctattctcagcaggtgaatacggtagtaattagcccagatgggaaaactctggtaagtgccagtgatgacagcaccatcaaaatttggaatttagcaacaggaaaacaaattcgcactcttacagggcattctgactcagttcgtgccctagcgatcagcgctgatagcgagactctggtgagtggtagtgatgacaacaccatcaaaatctgggatttagccacaggagagcaaattcggacactggtagggcatacattctgggtgcgatcggtagccatcagtcccgatagcgtgattcttgctagtggcagttttgacaagacgatcaaaatctggaatctgacaaaagggtactcaatccgcacactagagggaaattatcaaacagtaacagctgtagctattagcccagatgggaaaattttagccagtgctagccgcgatcgcactattaaactttgggatctactgacgggaaaagaaattcgcacactggcaggccacgccaacacagtcacaaccgtagccttcagtgccgatggtaaaattattgccagtggtagccgcgatcgcgccatcaaactctggaattcggccacaggagaagaaattctcacattaacagggcataccaacaccgtgacatccgtagcctttagtcctgatagtaaaacccttgtcagtggtagtgaagacaacaccattaagatttgg

SEQ ID NO: 43716 - DNA, 1206 bp, Nostoc punctiforme
attaccagaaatattcgccggacattggatttagatattatttggcagcaaacagttgacagtttgggaaaagcactgcggctagagcgctgtattatttgtccttatcagccctctagctcaaaagtaaaagtgaaggctgagtatcgccagccagaacttagatcaatgctaggcttggaaatagatgtagcttctgagcctgcctttgctcaggctttgacaaccctagaaccagttgtgatggaagtgcctggatgcacagagtctgggcggcagaaaactttggtggttgcgacttgctatcaagaccaagccaatggattggttgccttaaattggcaagatgaatgctatacattaacagaatcggaattagagctagcaaaagaagcagcagatcaattgggaactgcgatcgcacatgctactttatatgaagaattagaagtagctcgtcaaaaagccgaagaagcttcccgtctcaaaagcgagtttctggctaatgtatcccatgaaattcgtactcccctcaatgggatgattggcttcttaaagctgattttggaagggatggcagatgacccagaagaacaaaaccaatttttggcagaagcgcacaacttatcgatacatctactaaatatcatcaacgacattttggacattgccaaaatcgaagctggtaaaatggagctaacttacgctccagtcaagctaaatgagctatttagtgatgtagaaagttttatgcgtccccaagcagaaatgagaaacctcagctttcggatgcaaatgcctgctacctcggatgaaatcattgtccaaagcaactaccaacgcttgctccaagtgatgctgaatttgctaggtaatgccatcaaatttacccatgaaggtggtgtcaccgtcagcgccgatttagtactcaaaaaatcgaagcttcaagaccaacaatttcctggcttggtaagagtccgtgtggcagacacaggcatcggtgtttccctagacaaacaagataaactgtttcaattattctctcaggtggatggctcacgcactcgccagtatggtggcacaggtttaggactggcaatatctcagaagctagttgaagcaatgggcggcgaggtacatttttatagtctgggtgaaggtcttggttcaacagtgacatttacagtgccactatatcaacaacca

SEQ ID NO: 43717 - DNA, 1194 bp, Nostoc punctiforme
gtctaacagatgaagatattggtattgagttgggagtttccgccaaggattgttgggggaattgcgcgacatgtagcggaattgtacccggaactggtaaagctaggacatgaagtccacctgattacggcggagtttggtcacgcatcgatgtatgaggtggttgaaggagtaaaggtacatcgggtgccagtggcacatagtaacgactttttccactgggtagtgaatctcaacttgagtatgggagatcacggtggtaagttgatcttggaggaagggccctttgatttaattcatgcccacgattggttagttggagatgctgcgatcgctctcaagcatagttttaaaataccactaattgccacaattcatgctacagaatacggacgctataacggtattcacacagagatccaaggctatataaatggcaaagaaaccttgctggcttataatgcttggcggattattgtttgtagcgactatatgcgccaagaggtagaacgagcattacacagcccttgggacaaaatcgatgttatctataacggtatcagagccgaaaagaaacagcatcacgtagattttcatgcgctagattttcgccgccaatttgctacagacaatgagaaaatcgtttactacctcggtcgcatgacatacgaaaaaggtgtacctgtattacttaatgctgcacccaaaatcctttcggaaatgggaggtaacgttaaatttgttatcgttggtggcggcaatactgaccatctcaagcgccaaacttgggatttgggaatttggcatcattgctattttacaggttttctctctgatgattacttagataaattccaaactgttgctgactgtgccgtttttcctagcctttacgaaccctttggaattgtagctttagaaagctttgcttctcgcgtgcctgtagtggtttctgatacaggtggttttcccgaagtggtgcagcatactaaaacaggtattgttacttgggtgaacaattccgattctttagcttggggaattttggaagtgttgaaaaatccaggttatcgacaatggctagtggataacgcttatgaggatttaaagcggcgctttagctggccgaaattagctaggcaaactcaagaagtatatcagcgagttgtgcaagagcgatcgcaaatttcctgg

SEQ ID NO: 43718 - DNA, 966 bp, Nostoc punctiforme
attactaaacctaagattttcattgatggcgaatcaggaaccacaggcttacaaatttattcacgtctcaatcaacgtgatgatatcgagttagttagcattgaggcatctaaacgtaaagatgcaagtgagcgagctaaactaattaataccgtcgatgttgttattctctgcctacctgatgatgcagcccgtgaagctgttagcttagtaagtagtactacggttaagatccttgatgctagtagtgcccatcggacagctaatggctgggtatatgggttccccgaactcaatccagggcagagagagaaaatcgccagcgcccagtatgtcagtaatccaggctgttatcccacaggatttttagcctgtatccgtccgttgattgctaagggactgttcaaaagtaattttcccatcaccgtgaatgcagtatcaggttactctggtggcggaaaaaatcttattaaacaataccataccttccatgaacagcaagccgggggtgagtcactatatccattcggaatctacggtttgcagtttggacataagcatgtcaaggaaatgcattattattcagggttagcatcgccgccactatttgtaccttcagtaggggattttgagcaagggatgctagttcaagtgcctttgccgttaggaactttggataatccaccatcaggtgaggtaatctatgaagcgatcgctgattactaccaaggtgaaaagtttgtgcaggttgctccattccaagattctactctgctgcgagacggaatatttttggatgcgattgcagtgaacggcactaatattgttcaggtttttgtattcgccaatgacaccaccaaagaagcattgctagttgctcgtctcgacaacttgggcaaaggcgcatcaggagccgcaatccaaaacctaaacatcatgctgggctttccagaagaattgggattg

SEQ ID NO: 43719 - DNA, 1359 bp, Nostoc punctiforme
acaactccatcatcgggttacatcttatcactggacttaggtacgacaggcaaccgcgcctttgtgtttaacgcagacggcaagattgttgggcaggcatacaaagaactaactcagtattatcctcaacctggatggttagaacacgatgctcaacaaatctggcaagatacgtgttgggtgatagaaaccgcaattgaaaatgcccgcattgctccatcaacgatcgcagcattgggactaactgtacagcgtgaaacctgcttgatttgggacaaaactactggtagaccactccatagagcgatcgtttggcaagatcgccgcactgctcccctttgtcaccagttacaagagcaaggctacgctgatgaaatttacgatcgcactggattaatcattgatgcctatttctctgctaccaaacttaggtggctattagataagtttacagacgttaacctaaacaatgtcttagctggcactattgatacctgggtgctgtggaatcttacaggtgggaaagtccatgctactgaccacagcaacgccagccgaacaatgttgatgaatctcaaaacctgtgagtgggatgataatttactaaatttgtttcaaattccggctcatattttgcccaagattcagcctagtttaggagtatttggagttactgatgctactttgttgggcgctgaaattccgattactgcgatcttgggagatcaacaagcagctttatttggtcatggttgcgatcgccccggtttgatgaaatgtacttacggaactggtagctttttggtagctcacacaggcaatcgaattgtgcgctcgcaccatcaacttatttctacggtggcatggacacaagcaaatccaaggggagcattggatgtaggttatgccttagaaggtagtatgtttaccagtggagcttgtattcaatggttgcgcgatcgcctcaagctgattaaaactgctgctgaaagtgaaacgatggcaaatcaggtgacagataatggcggagtctactttgtgcctgcatttagtggactgggggcaccctattgggatatgagtgctaggggagcctttttcggcattaccgccagtgtccaaccagagcatctagtacgcgccgtgttagaagcgatcgcgtatcaagttgtggaagtagtacaggcaattaattcatctagcagtactccagttggtcgattaaccgtagatggtggtgcttgcgaaaataattttttgatgcaattccaggctgatgtattaggtattccagttgaacgtccgataatgcgcgatacgaccgttcagggtgcagcatttgcagcaggtttagctata

SEQ ID NO: 43720 - DNA, 1761 bp, Nostoc punctiforme
tctagtagctctagtacctctctaaactatggtgagttgatcaagaaagcgaaggcgggagaagtccaaaaagtagagcttgacgaaaccgaacaggtagcaagagtttatctcaaagggcaaaaggaaaatacgccaccgcaacaagtgagacttttagcgcaaaacacagagttaattaacatactcaaagataaaaatgttgagtttggcgagatttcctctgctaacagtcgagctgctgttgggctgttgattaatcttatgtggattttgccactgttagctttaatgctattgttcctccgacgctctacaaatgcttctagccaagcgatgaatttcggcaaatccaaagctcgtttccaaatggaagccaaaaccggagtgaaatttgaagatgtcgccggggttgaagaagctaaagaagaccttgaagaagttgttactttcctgaaacaaccagaaagatttacggctgtaggtgcgcggattcccaaaggagtgctgttaattggtcctcctggtactggtaaaactttactagcaaaagcgatcgcaggcgaagcaggtgtaccatttttcagtatttccggttcggaattcgtggaaatgttcgttggtgtgggtgcatctcgcgtgcgcgacctcttcaagaaagctaaagaaaatgccccatgtctaatatttattgatgaaattgacgcagtaggtagacaacggggtgcaggaatcggtggcggtaatgatgagcgcgaacaaaccctcaatcaactgctcaccgaaatggatggttttgaaggcaacacaggtattattattattgctgccactaaccgcccggatgtcttagatgcagcgttgctcagaccaggacgctttgacagacaagtgatggtggatgcaccggatctcaaagggcgactggaaattttgaaagtccacgcgcggaataagaaaattgaccctagcgtatcattagaagcgatcgctcgtcgcactcctggatttactggcgcagacttagccaacttgctcaacgaagcggcaattctgactgctcggagacgcaaagaagctgtcaccattttagaaattgatgctgctgtggatagagttgttgcaggtatggaaggtactgcattagtagacagcaagagcaaacgcttgattgcctatcatgaagttggacacgctttagtaggcacattgctcaaagaccatgaccctgtgcagaaagttacattaattccacggggacaagcactcggattaacttggtttactcctaacgaagaacaggggttagtttcccgttcccaacttaaatcccggattactgctactttgggtggtcgcgccgccgaggaaatcgtttttggtaagccagaagttaccacaggtgcaagcaatgacttgcaacaggtgacagggatggcgcggcagatggtgacacgcttcgggatgtcagaattaggcccattgtctctggaaaatcagagtggagaggtatttttaggacgcgactggatgaataaatcagactattctgaagaaattgccgccaagattgattcacaggtgcgtgaaattgtaaacaactcttatatcaaggcaaaagaactgttggaagaaaaccgcatagttttggaacgtttagtagatttgttaatagaagaagaaacaattgaaggcgattcattccgccaaatcgttgctgataatgcccaaatagctgatgcacaattagctgtacctcat

SEQ ID NO: 43721 - DNA, 1815 bp, Nostoc punctiforme
gtcctgcccaaacgtgcatctggcggttttgctctacttgacagccttcatcgccacggcgttgattatatttttggttatcctggtggggcaattctaccaatttatgacgacctgtataaggtggaagcaactggtgctattaagcatattctcgtgagacacgaacaaggcgcagcccatgccgcagacggttacgcccgtgccactgggaaggtaggagtatgctttggcacttctggcccaggagcaactaacttggtgacagggatcgccaccgcctacatggattcaatcccaatgattgtggttacggggcaggtagcacgtccgtccattggtacagatgcctttcaggaaaccgatatttacggcattacgctacccatagtaaagcactcttatgtagtgcgtgaccctaaagacatggcgcgaattgtcgccgaagctttccacatcgctagcactgggcgaccagggccagttctgattgatgttcccaaggatgtagctttagaagaatttgactatgtacctgtaaaaccaggttcagtgaagttacgcggttatcgccccacggtgaagggaaatccccggcaaattaacgctgcaattcagttgattactgaaagtcgccgtcctctactgtatatcggtggtggtgcgatcgcagctggtgcccatgaagaaataaaagaactagctgaattattcaacatccctgtcaccaccaccttaatggggatcggtgcctttgacgaacatcaccccctagctttgggaatgttggggatgcacggcacggcttacgctaactttgctgtaagtgattgtgacttgctgatttgcgtcggcgctagatttgacgatcgcgttacaggcaagttagacgaattcgcctcccgcgccaaagtaattcacatcgacatcgatcccgcagaagtcggcaaaaaccgcattcctgaagtgcccatcgtcggcgatgtgcggaacgtgttagtagacttgttgcgtcgctgcaaagaaacaggcgttaaggctacccctaatcaaaaccaagaatggttaaatcttgttaaccgttggcgcgatgagtatcctctaatagtgccacagcaccccgacagcatttcaccccaagaagtgattgtagaagtcaatagccaagcacccaacgctttctacaccacagatgttggacaacatcaaatgtgggcagcacaattcctcaaaaacggcccaagacgctggatttctagcgctggtttgggaacgatgggttttggcttacctgcggcaatgggcgcgaaagtggcatttcctgatgaagaagtcatttgtattagcggtgatgccagtttccaaatgtgtttgcaggaacttggtacacttgcacagtatggaataaatgtcaagacaataattatcaataacggctggcaagggatggtgcgccagtggcaacaagccttctatggtgagcgttactcatgctccaacatggaagtaggaatgccagacgtagagttattggcaaaagcttatggcattaagggtatggtaattagcgatcgcagtcaattaaaagatgcgatcgccgaaatgctggcacacaaagggccagtaatcttaaatgtccacgtcaccagagacgaaaactgctatccaatggtagctccaggcaagagcaacgctcaaatggtcggcttgcagaagcaaccgcccaaagcagcagcagagccagtttattgtagtaactgcaatgccaaaaatgctcctaaccacaacttctgtgctgagtgtgggacgaagctg

SEQ ID NO: 43722 - DNA, 690 bp, Nostoc punctiforme
ttaaaggcagttctctttgatttcaatggtgtcatcattaacgatgagccaatccacctacaactgatcgatgagattctcattgaagaaaatctccaaccccaaaaggtgagtgagcgtcaagcttctcttggacgtagcgatcgcgcttgttttcagcaactactcgctaatcgtggtagagtcgctaacgaaaactacttaactcagttgttgtaccgcaaagcccaagcttatacggtggagttagagaaaatagagaaactgcctttatatccaggtgtagaagacttaatatatcaggtgcgatcgcggaatttgaaattaggattagtcagtggcgctcttcgccaagaaatagaattggtactccatcgtgccaaactagaccaacattttaaaattatcgttgcgggcgatgacataaccaccagtaaaccagaacctgatggttatttactggcagtaaaatgcctaaataaagaatatcctgaattaaaccttcaaccacaagagtgtctggcaattgaagatacccccgcaggtattgccgcagcgaagcgatcgcagatgcaggttgttggtgtagcgaatacttacccattccacatgcttcagcgctgctgtaattggactgttgattatctcagtgatttagaactggaacgcgtgcagaagatttattctcaa

SEQ ID NO: 43723 - DNA, 1272 bp, Nostoc punctiforme
cgttttgaaactctgcaagttcatgctggacaagagccggctcctggaaataatgcccgtgctgtaccaatttaccaaacgacttcctacgtttttgacgacaccgaacacggagcgcggttatttgctctccaggaatttggcaacatttacacccgaatcatgaacccgacgacggatgtatttgaaaagcggattgctgcactagaagggggtgtagcagcattagcaaccgctagtggtcaggcggcgcaattcttggcaatcagtaccatcgctcaggctggggataatatcgtttccactagttttttgtatgggggaacatataaccagtttaaagtctcactaccacgtttagggattaacgtcaagtttgtcgagggagacgatccagaaagtttccgtcaggcgatcgacgctcgcaccaaagcgttatacgttgaaaccattggcaatcctcagtataacattcctgactttgccgctttagctcacattgcccacgaaaacggcatacctttaattgtggataatacctttggtgctggtggatatttagctcgacccattgaacatggtgcagacattgtagttgaatctgcaactaaatggattggtgggcatggtacttccattggtggcgtaatagtcgattcgggtaaatttgactggggtaacggcaaatttccactatttactgagccagcacccggctatcatgggctgaatttccaagaagtgtttgggcctagcggttcctttggcaacattgcttttattatccgcgctagagtcgaggggttacgggattttggcccatctttgagtccatttaacgcctttcttttactgcaaggattagagactctctctttgcgtgtagatcgtcatgtcagcaatgccttagaattggctcggtggttagagcagcaagagcaagtattatgggttaattatcccggacttcctaatcactcatatcatgaacgagcgaaaaaatatctccggcatgggtttgggggagttttaaactttggcatcaaaggtggattggaggcaggtaaagcttttattaatcatgtgaaattggcaagtcatttagcaaatgttggtgatgctaaaaccctcgttattcatcccgcttccacaactcatcaacagctaagtgatgaagaacagctttcagcaggtgtaacgcccgatttagtgcgcgtatcagtgggaattgaacatatcgacgatattaaagaggattttcagcaagcattc

SEQ ID NO: 43724 - DNA, 747 bp, Nostoc punctiforme
gagtccattgagtttgaaaagcggtgcttgcacaaagccagagaaataggcgatcgcaatagtgaagtcatttgtttagcaagtttgggcaatgcttatcagtccattggggagtaccacctggcaattgagttttatcagcagtggttggatatagcgaaagaaataggcgatcgcttcggagaagccaaatctttatctggattgggcaacgcctaccaatcattggggaaataccagcgggcgattgaattttatcaccagtggttgagtatcacgaggaaaataggcgatcgcactggagaagccatttgtctaggaagcttgggcaatacttatgaatacctgggcaagtacgaccaagcgattgagttttatcagcagtggttgagtatcacgaggaaaacaggcgatcgcactggagaagccatttgtctcggaagtttgggcaatacttatgaatcattggggcagtaccaactggcagttgagttttaccaccaatggttagaactgacaagattaattagcgatcgcaatggggagggcatggccttaagtgggttgggaagtgcttataaggctttgggacagtaccaaagagcggttgagtttcatcaatattcattagagattagaaagaatcttgatgaccaaaatgcagaagcaaactcctggtttaatttgggtttagtgttagaaaaaatcaatcgcgaatcagaagcgatgaatgccttttgcaatgct

SEQ ID NO: 43725 - DNA, 1473 bp, Nostoc punctiforme
cgacgctctgagtcaacagtcaacagaccatacgtgaaatttcacaaatcatctaggattcctatatttatgaataaagcaggaaatcatttacaacagagatatttagaagcattcactacacgctacaacgagcggacaaaaaaatcaaaacaacttgctcaaacttatcgtccgattattactagtaatatgggacctgtaggttttagtttgtcctgtaaagaaatgtgctaccctattactgcaaagcgctctctgggttccaggatatgggatgttgatggcaatgaatatatagatttcatgatgggattgggagtcaatctttttggtcacaatccaccttttatccaagcagccctcaaagaacaacttgaaaaaggaatccaaattggtccgcaatcagaattaacaggtgaagtcggtgaattaatttgtgaactgacaggaatggagagggttgcctttagcaacacaggcacagaagcagtgatggcagcaatccgtttagcacgaacagcaacaggacgtaacaagattgtgctattttctggctcctatcacggtcattttgatggaacgttagttgaggtagaaacgatagatgggattccgcatactgtaccaataacttcaggaataccgcaaaatattgttgaagattatttagttttagattatggaaatcctcaatcactagatgcaattagagctaataagcacgaattggctgccgttttagttgaacctgtacaaagtcgccgaccagatttacagcctaaagattttcttttacagctgaggcaattgaccaaagaattagggatagcattaatttttgatgaagtaataactggctttcgtgttcatccaggtggtgcacaggcgtggtttggtgttgaagccgacatagctacttatggaaagattgttggtggcggaatgccgattggaattattgctggcaaagctacttacatggatagaattgatggcggaatgtggaattatggtgatgcatctcaacctcaagtcgaaacaacatattttgcaggtacatttcgtaggcatccactagctatggctgcggcactggctgtacttaaacatttaaaaatgcaaggatcgcagttacaacagcaattgaatcaacggatgtcgcaactagttgaaacattaaatgcttactttgaagaagaagaagttcccttacgtctgaggaattttagctcgtggtttagtcctgcttttttagagaacttttcgcttttagaatatgctactccatccgagttgcgagaacttttatattatcaccttctagataagggggttatgttgggaggccctggaggctacctttctacagctcatacagatgaagatattaattatataattcaggcttttaaagatagcgttagggaactacgcaaaggaggctttttacctcctattgctccacaaaat

SEQ ID NO: 43726 - DNA, 846 bp, Nostoc punctiforme
gaaattcagacagttggtgttgtcggagcaggtgttatgggaatcggggtttcgcaaaacctcgctcaaacaggtcatcaggtgattttagtagatgtttcagaagatattctgaaccatgctaaacaagaaattagaaataatgtccgttttcagggttttttccagaaaaacagtgaagcagagagtcctgacgacatactaaataaaatcaagttttcaactaactataaattccttgaagatgcagaatttgtggttgagaatgtcacagaaaagtgggatcttaaaaaagaggtctacgcacagcttgatgccatttgtccagagaagacagcatttgcagctaatacatcagctatctcaattacccgcattgcttctgttaccaagcgagcaacaagagtcgttggtatgcattttatgaaccccgtgccaatgaaaccgatggttgaaatgattcgcgggcatcacacatctgatgaaacaatcgagacagcaaaaaaaatgttggctcagatgggcaaagaatgcatcatagttaatgactcaccgggttttgtttctaaccgcgtattgatgttgactattaacgaagctatttttatcctgcaagatcaagttgcttcgatagaagaagtggataaaatctttaaaacctgctttggtcacaaaatggggccgttggaaacagccgatttgattggtctagatacgattttattttccatcgaagttttgtatgaaagtttcaatgacagtaaatacagaccatgtccactgcttaagaaaatggtagacgcggggttgcatggtcgcaaaagcggcaaagggttttatgcctat

SEQ ID NO: 43727 - DNA, 1107 bp, Nostoc punctiforme
atgaaactagaattaactcctcagcaaaaaaatgctcaggctgaatttagagaatttgtagatgcagaggttgtatctcaggcaaatcaatacgatcaacaagagtataccccctcagacctagttcaaaaattcgctcaaaaacgatatttgggtgctgttttacctaaagaatttggtggcgaagctatggatatgattacctatggcttgctgaacgaagaaattggacgcggatgttcttcgctgcggagtttgttgacagttcattgcatggtttctcatgctctttgcaagtggggcaataagtctcaaaaaaacgattggcttcccaaattagcctctggtgaaataattgctgctttcgctttgagcgaacctaatgtgggtagtgatgctaaaagtgtggaaactacggcaacactttctggggatgcttacatcttaaatggacacaagaaatggattacctatggacaaattgcagatgtctttttagtatttgctcaatgtgaaggaaaaccctctgctttcttagttgaaaagaatagccctggactctcgattaaaccaatttttggaatgctaggtgtcagggcttcgatgttagcagaattgcacctaaatgactgtcgtattccccaggaaaatcttgtgggtaggctgggttttggtttctcttatgtggcatcttctgcactggattatggcagatacagtgtagcatggggatctgtaggcattgcacaagcttgtttatcagcttgcattcgctatacaagcgatcgcaagcagtttggcgtttatttaaaagaacatcaattaattcgccaaatgattactaacatgattgccaatatcaaagcagcaagattgctatgttatcaagctggctatctcaaagaaattggcgatcctagctccattatcgagacttcaattgctaaatattttacatctacaattgcttctcaagtagcaagtgatgccgtacaaattcatggtggcaatggttgcagtagcgaatacccagttgaaagatatttgcgagatgcaaaaatcatggaaatcattgaaggtagcactcaaattcaacaagttactatc

SEQ ID NO: 43728 - DNA, 1089 bp, Nostoc punctiforme
ttgcgcggttatgcaggcgatcgcattaactcccgattaattgatgaacgccgttgtattccgccttatattgtccttgattttggcaatcgcggacttttggggatgcaaattcccgaagagtacggcggtttggctctcagttatcgagatactttccgcgttttcgagcaattggcggcgattgatttaaccctagcgtcctttgtggcggttcaccacgttttaggtactcgcccgattttgaattatgcaccagagaatgtgcgtcaggaaatactgccgttactggctggtgggcgcgagttggctggttttgccatcaccgaacagacagcaggttccaatccgagagcgatcgctacacgagcaattcctgatgctggcggttggagaatacgcggtgagaaaatctggattggtcatggttcatgggcgggggtaactaatgtcttcgctcaaacgctggatgcgaataatcaaccaactggaattagcagctttataattcgtcaaggaacaccaggattttctcaagggccggaagcgctgacgatgggtgtgcgcgggatggtgcaaaatactatttacctcaaagatgtcttggttactccagagaatcttttaggaacgctcaataacggcatggaagtcgcccaagatgcgatgatgcacggcagattaatcatcggcgtgatgagcctcggtggaatgaaacgctgcgcccagttgatgctgcgctacagttcccgtcgttctgtgtccacaggaaggttacttaataatcccatttctctggtttggctgagtgatttaacagcagcaattacatctttagaaaccctactgttcaaaattgccgatttattagaccaaggacgcgccattcctcaagaagccttcaccgcctgtaaaacagcggggccggaactagtttggcaagcagccgatcgcttagtacaaatgttaggtggtcgtggctacatcgaaaccaacattgcgccgcaaatcctccgcgatgccagattatttcgcatttttgaaggccccaccgaaaccctgaatatgttccttggttctcgtgcgatg

SEQ ID NO: 43729 - DNA, 1713 bp, Nostoc punctiforme
ttggttgaattgctgcttactagagcaaaggaacaaccgtcacgtattgcttatacttttctccttgatggggaagatgaatctcaatctatacagattagttatcaagagttagaccggcaagctagagcgatcgctattcatctccaatctataatgaatgctggcgatgtctacgacgggcaaagcccacgcgctttgatgctttatcccgccggattagattttattacggcgttttttggctgtttatatgctggaatcgttcccattccggcttatcctccccgacaaaatcacaagctttctcggttggaagctattgtcttggatgcggaagccaagattgtgctgactacatctggggttatggctaatttgaaggatataggcaagtacagttcagcgttagctgagatagagtggttaccaacaaacgatttaattcttggtgatggttctagttgggttcggccggaaatcaatggcgagacgttagcttttctgcaatatacttccggttcgacgggaacaccgaagggggtaatggttactcatgataaccttttacgtaattctgctgacttggatttaggttgggatcatgatgaaaatagcgtcattgtcacatggctaccaactttccacgatatgggactgatttatggaatgttgcaacctctatacaaaggttgtacttgctacatgatggctcctgtaagctttctccaaaagccgattcgttggctacaagcgatttctcgttatcgcggaactcacagtggcgctcccaactttgcttataaattgtgtgcggagaaaataacgccagaacaaagagctaagttagacctcagcagttggcggatggcgctgaatggtgcagaaccagtgagagcagatgttttagaagagtttgttgaggcgtttaaaccctctgggtttgatggacgagcattctgtccggggtatggtttggcggaagcaactttgaaagtctctgctgtgcggtcaaaagatttacctgtttatctccatgttgatgctgaggctctagagcaacatcgggttgtggaagtgagcgccaatcatcccagatgtcgccagtttgttggttgtggctggacagaaattgatactcaaattgttattgttaatccagaaaccttgacccagcgcggtgatgacgaggttggggagatttgggcatctggctctacgattcctctgggctattggaatcgaccagaagcgacggcggaaacttttcaagcttatttgaaagataccaaagcagggccatatctgcgtacaggtgatttaggatttgttcataacggtgagctttttgtcaccggacgcattaaagatgtaattattattcgtggtcgcaatcattacccacaagatattgaacttactgttgaaaagagccacccagcacttcgaccgacttgtaccgccgcttttacggtagagattgagggcgaggaacggttgattgtggctcaagaaatagaacggctacatttgcgaaagttagatgtagaagaggtggtaggagcaatccggcgtgcggtatcacaacaacatgaattgcaattatatgcagtaattttactaaaaacggcaactattcccaaaacttctagtggtaagattcagcgccgcacttgtcgagccaagtttgtggagaatgctttagaggtggtg

SEQ ID NO: 43730 - DNA, 888 bp, Nostoc punctiforme
atcgctgggctaggcacttttttaccaggtaaaccagttgaaaacaaacaacttgcagaaatattcaatataaataaagattggattgaggtctttattggtagtaaaagacggtattttgccgttgaccttgttacccaagaaacaacccatacattagcagaaatatgcgctcatgctgctaaagaggcaattcaaaattctggttattcaatccaagatattgaatttatagttatggcaacaggcactccagattttctcatgcctgctacagtgaacttggttgcagaaaaactaggaatcaacttagtcccaacatatcagctacaatctggatgcagtggcgcagttcagtgcttagatgtcgcccagcaatttttacttagtggtagctacaaagttggtttagtaattggcggtgatatttgctctagatttgcagattttaaccgtgactttaataatatgccgtcaggtgaactagtaaattatgttttgtttggtgatggtgctggtgcagcagttttgacaagcgaagagaacaaaacaggttttacaatcgaatacgtgctgaaccaactaacaggtttagacaaagaaccaggtcaaatactcaattggtttgctgtacctccagcaggtgatacaaaacttccacaagctgttaaagaagactataaagctatagaaaaggcagtcccggttttggcgaaagaaatattggaatctctcatggatgcagtggaatgggagttacatgatattgattttatattgcctcctcaactttcaggaaatatgagcaaacgcattgttgagttcatggatattcctgtagagaaagcagtacattgcgttacagaaaccggaaatgtagctaatgct

SEQ ID NO: 43731 - DNA, 837 bp, Nostoc punctiforme
caccgatgggtactagcaccagatgaatcctcactcatgctgcaagagcgtgcagctcgtgaagctctggacgcagcaaaactgactctcaaagaaatcgatctcatgctcgtcgcctcagtttggcctgaacaaattggatttggcgatgctgcttttctcgctggtaaacttggcttagaaggtgctgcgtggaatcttgatgcagcctgtggcgtaaccccagttgcactacaaactgcctttgccttagtccgagccggagagtatcgcaatgtactagtggtcatttcatgtgcatactctcgttttttcgatgaagacgataccctgtcatggttcatgagtgatggtgctggagcttgcgtagtcagttcactcgcaccaaatcaaggcatccttggcacaaagaccattcatactgctgctttatgtaatagcttttttgccaaactcaccgaggatgaccagggtaatccacacatacacatgcggatgggcaaaggcgcaaataaagccatccgcgaaacggctgtagggcaactgcgtacttgttgtgaaggcgcactggcggcagccaatgtcaaacttgaggaaattgacttttttattttcaatacatccactgcttggtcagcaagcttctgcacacgcgtactaggcattgacccagagcggacaatcaatctttactctgagtatgcaaacattggtccagtaatcaccatagccaatctgtactatgctgcacaactgggcaagattcacgaaaatgacttagttcttatttatggtttgggtgcagcaggtgccgcctctgcaagtgtcatgcgttgg

SEQ ID NO: 43732 - DNA, 759 bp, Nostoc punctiforme
atgcgcatgagtagccaattgtatggaaaagttgccttggtgactggcgcttcatcaggtataggtaaagctacggcgatcgcatttgcccgcgctggagccaaagttgtggctgctagccgccgcaccaccgagggagaagaaaccgcgcactacatccaagaaattggaggagaagctattttcatcaaaactgatgtgtcaaaggctgctgatgtagagacactaattgagaaaaccatagatatttatggtcgtttagactgtgcttgcaacaatgccggacttgggggtgcagccagcccgatcgcggatatgtcggaaaaagactgggatcaactggttgacgtaaatttgaaaggaacctggctttgtttgaagtaccaaatcagggcaatgctcaaacagggaagtggggcgatcgtcaatatcgcttccgccgctggtgtggtcggtttccctggttttactggctactgtgctactaaaggtggggtcatcgctttaagcagagccgcagctatggagtatgccaaagcaggtatccggattaatgttgtcagtcctggtgcgatcgccactgatatgctagctacgttacctacagatgtacttgctcaactcacagcaatgcatcccatcggacgcattgccaagcctgaagaggtggctgaaagtgtagtctggttatgttcggatggttcttcatttctcgtcgggcacaacatgatggttgatggaggatataccgctcagtaa

SEQ ID NO: 43733 - DNA, 1341 bp, Nostoc punctiforme
cagaaaactaacgaaaccttcctagtctttgacttaggtggtgggacgtttgacgtgtctatcctagaagtgggtgatggtgtgtttgaagtgaaagctaccagtggcgacacccacttgggcggtgatgactttgataagagaatcgtagactggctagcaaccgaattccagcgcaacgaaggcatcgatctgcgtaaagacaaacaagccctgcaacgcctcaccgaagcagcagaaaaagccaaaattgaactttcaagcgcaacacaaacgaacattaacttaccttttattaccgcaaccccggaaggcccgaaacatctagatatgaccttaacgcgggtacagttcgagcaaatgtgcgccgacttgttcgatcgcagccgcattcctgtcgaacaagccctgcgcgatgctaaactgagtcccgcagatattgacgaagtaatcctagtgggtggtgcaactcgaatgccggctgtccagcaactggtacggcagataataggcaaagatccacaccagggtgtcaacccggatgaagtcgtagcagtgggtgcagcgattcaggcgggtgtgcttgggggtgaggtaaaagacgtactgctcctagatgtcacgccgttgtcgctgggtgttgaaactctaggtggtgtgacgaccaagattattccgcgcaataccactgtcccagtgaagaaatctgaggtgttctcaacggcggctgacgcacaaacaaacgtagaaatccatgttctgcaaggtgaacgcgaaatggcatccgacaacaagagcctgggaaccttccgactagatgggattcctccagctcccagaggtatgccacagatcgaagttacctttgacattgatgctaacgggattctgtcagcaactgccagagaaaaagccacaggtaaagaacagtccattagcatcacaggtgcgtccaccctcgacaaatctgaagtcgagcggatggtgaaagaagccgagcgcaatgcggaagaagaccgtaggcggcgcgaacaaattgataccaaaaacatggcagattctgttgcctatcaagccgagaaacaacttcaggatttgggcgacaaagtgccaccagcagacaagtcccgcgtggaaagcttaattcgagacttgcgtcaggcaattgagcagaacaacattgatcgcatgaagtccctcaccaacgaaattcaacaaggcctaatgcaaatcggcactgcggtctactcacaagcaggtgcatctccaaacggtggtacttctacagaccgtcaaggcggcggtgaagatgtcatcgatgcagactttgtggaacaaaag

SEQ ID NO: 43734 - DNA, 2643 bp, Nostoc punctiforme
tctcagctaaggggcacgattatgcaaccaacaaatcccgagcaatttaccgaaaaagcctgggaagcccttgttcgtactcccgaaattgccaaacagtttcagcatcagcagattgagagcgaacatttgatgctagcgctactggaacaggaaggactcgccagttctattttcaacaaagccggggtaaatgttcaaaaactacacgagcgcactatcgacttcatcaaccgtcagcccaaagtatcgggggctagcagtggttcggtatacatcggacacagtttagagaggctgctcgatcgcgccgaacaataccgcaaagagtttggtgatgaatatatttctattgaacatttaatacttgcctttgccaaagacgatcgctttggtaaagggttgtttcaagaatttggactggatgaaaaaaaactccgcaacatcattcaacagattcgagggagtcaaaaagtgacagatcaaaacccggaagttaaatatgaagcgctagaaaaatacgggcgcgatttaacccaattggcacatgagggcatactcgacccagtgattggacgagatgaagaaattcgccgcacgattcaaatcctttctcgtcggactaaaaataaccccgtgctgattggtgaacccggtgtcggtaaaacggcaattgtagaaggattagcgcagcgcattgtcagtggtgatgtcccggaatcattgcgcgttggcatagccggccgtaggcatcgcaaactaatagctttagacatgggtgcgttaattgccggagccaaataccggggagaatttgaagaacgcctgaaagctgtcttaaaagaaatccaagaagcacagggacaaatcgtcttgttcattgacgaaattcacactgtagttggtgcgggtgcaacgcaaggatcgatggatgctagcaacttgctcaagccgatgctcgctcgcggcgaactgcgctgtattggtgccaccacgctagatgaataccgcaagtacattgaaaaagatgcggctttggaacgtcgttttcagcaggtatatgtcgatcagcccagtgtggaagataccatctcaattctgcgcggtttgaaagagcgctacgagttacaccacggcgtgaagatttctgatagtgcgttagttgcggcagctactctgtctgcgagatatattagcgatcgcttcctacccgacaaagctattgatttggtggatgaagctgcggctaaactaaaaatggaaattacttccaaaccagaagaattagacgaaatcgatcgcaaaattctgcaactggaaatggagcggctgtcactgcaaaaagaaacagacagtgcttccagagagcgtttagaacggctggagagagaacttgcagagttaaaagaacgccaagatgccctcaatgctcaatggcaagcagagaagcaaatcatcgatcgcattcgccaaattagacaagagattgagcgtgtcaatgtagaaattcagcaagccgaacgcgattacgacctcaaccgggcagcagaattgaaatacagcaaactcactgagctgcaacgacaactaaaagaagccgaagcgcgactagcccaaatccagactagcggtaaatctctgttgcgcgaagaagtcaccgaagctgacattgccgaaattatctccaagtggacgggtattccggtgagcagactggttgaatcggaaatgcaaaaactcttgcatctggaagaagagctacataaacgtgtgattggtcaggacgaagctgtaagagctgttgccgatgcaattcaacgttcccgtgctgggttggcagacccgaatcgtcccattgctagctttattttcttaggcccgaccggggtgggaaaaacagaactggcaaaagctttagcggaatatctgtttgataccgaagatgcactggtgcggatcgatatgtccgaatacatggagaaacacgctgttgcccgtctcatcggtgcgcctccaggttacgtgggctatgaagaaggcggacaactcaccgaagcgattcgccgccgaccttattctgtaattctgtttgacgaaattgagaaagctcatcctgatgtattcaacgtcctgctgcaaatcctggatgatggtcgcctaactgattctcagggacgcacagtagattttaaaaatacgatcgcgattatgaccagcaatattggttcaatatacattttggatgtggcaggagacgatagcaagtacgaacaaatgcgcgatcgcgtcatggaagcagtgcgagaaagtttccgccccgaattcctcaaccgcattgatgaaatcattattttccacagcttgcggaaggacgagttgcgcgaaattgtcaaactacaagtgcagcgtttagaggagcgactgcgcgagcgtaaactctcgctcaaaatctccgaccaggctctcgattggattgttcaggtcggttatgacccagtttacggtgctcgtcccctgaagcgggcgattcagcgagaactagaaactccgattgccaaagcgattctacgcggcgagttccacgaaggtgacacaatctacgtccatgtggaacacgaacgactggtgttgaagcgcttatca

SEQ ID NO: 43735 - DNA, 1482 bp, Nostoc punctiforme
gatatagttgttattggtagcggtattggcggtttgagttgtgctgctcttttggcacggtatggctttgatgtgatagtctgcgaaagccactctattgctggaggcgctgctcatggttttgagcgcaatggtttcaagttcgactctggcccgtctctctattctggactatcttacagcccctctgctaaccctttgcgacaagtgttagatgcaattggttctgaattgccatgcgtcacctacgatacttggggttgttgtctaccagaaggtgattttgacacggcggttggtgcagagcaattttgtgaagtgctaatgaaattctgtggtgatgatgctgttgctgaatggcaagaactccagcgcgttatggaaccatttgctagggctgcaacttccataccaccagccgcattacgctttgatttcggtgcagcgagaactgtgggcccgtttgtcccatctctgacaaaaaatgtggcgaatataattaagctgacgggtcccttcagccggattatggatggggttgttaaagactcttttacccgaaactggctaaatttgctgtgttttctcctttctggattgcccgcagatggtactagcgccgcagaagtagcatttatgtttgctgactggtatcgcccagatgcaatcctggaatatcccattggtggtagtagtgctttagttgacagccttgtacaaggattagagcgtcacggtgggaagctgatgctaggcgctcatgtagaagaagtgcttgtagaaggtaatcgtgcggtgggtgtgcgtctgcgcgatcgctccgaaattcgcgccaaactagcagtaatttctaatgcctcagtttgggacacattgaaattattaccagaaaaggcaatacccaaacagtaccgcagcaaaagacaagctacacctgagtgtgatagctttatgcacctgcatttaggcatcgatgctcaaggattacagtcaaatttgcggtgtcattacatcgtagttaataactgggaattgggcgtaacagcacctcaaaatgtggtggtgatctctatcccttcagttctcgatccatctttagcgccagcaggtaaacacgtgattcatgtgtatacacctggtaatgagccatactctttctggcagggaatggatagaaggagtcaagaatacgctgaacaaaagcgatcgcgtgcagaagtaatgtggcaagctttagagcggataattccagatattcgctctcgttgcgaagtcacacttgttggtacaccgttaacccacgagcgttatctccgtcgtcaccaaggttcttatggcccggcaattcaggcaggaagtggtatgtttcctagccccagcacacccctaccaggattgatgtgctgtggcgactcaacatttcccggtattggtttaccagcagtcgccgctagtgggctgattgctgccaatacccttgca

SEQ ID NO: 43736 - DNA, 1431 bp, Nostoc punctiforme
gaacctaacgtgagtcaaggatttgattacgatttagtcattatcggcgctggtgtaggcggacatggcgcagccttacacgccgtaagttgtggtttaaaaacagcgattattgaagctggtgatatgggaggaacctgtgttaatcggggttgtattccttctaaagcgctactggcggcatctggacgtgtgcgggagttacgcaatgcccaccacctcaaatcgctgggaattcaaattggtagcgtggaattcgatcgccaagcgatcgctaatcatgctaataatctcgtctcgaaaattcaaggggatttaaccaacagtctcaaacgtctaggagtcgatattatcaggggttggggaaaaatcgctggggcacaaaaagttgctgtaaccggagacggtgccgaaaaaattatcacagccaaagacatcatcctttcgcctggttcaattccttttgtacctccaggaattgaagtagacggcaaaactgtctttactagcgaccaaggtgtgaagttagagtctctaccagactgggtggcgattattggcagtggttacattggcttggaattttctgatgtttactcagctttgggttgtgaaatcaccttgattgaagccctagatcagttaatgccaggatttgaccgcgatattgccaaacttgccgaacgggtgctgattactccccgtgatattgaaacgaaagtggggatatacgccaaaaaagtcacccctggttcaccagtggtaattgaattagcaaatttcaaaaccaaagaagatgtagatgtcatcgaagtagatgcttgcttagtggctacaggacgcattccagcgaccaaaaatcttggtttagagtctgtgggtatagaactcgatcggcggaattttatcccagttgacgatcgcatggcagtgctatcagctggtgaagtagtaccaaatgtctgggcaattggcgatgctaatgggaagatgatgttagcacatgcggcttctgctcagggcatcatcgcggtagaaaatatagttgggagggaaagaatagtagactatcgcagcatccctgcagcagcttttacccacccagaagttagctatgtaggtttaacagaaaccgcagcgaaggaattgggacaaaccgaagggtttgaaatcgccacaagtcggagttacttcaaagggaattccaaagcgttggcagaaaatgaagccgacggtattgccaaagtgatatatcgcaaagacaccggagaagtcttaggcgttcacattttcgggctgcacgcctcagacttaattcatgaagcgtcagccgcgattgcaaaccgtcaatccgtccaaagcctcgcacatctagttcacgcccacccgacactctcggaagttctagacgaagcttataaacgagcgatc

SEQ ID NO: 43737 - DNA, 1230 bp, Nostoc punctiforme
tttgaccaagcctgtagctacttagaagcggcagctaaagaattaaatttaaatcaaggtttgctggaaatcctcagccatccgcgtaaggttgtcacagtttccattccagtgaaactagatgatggcgaaatacaagttcttgctggacaccgtgtacagcactccgatgttttaggcccctacaaaggtggaattcgttaccatccagctgtgacattgcgcgaagtatcggctttggcaatgctgatgacctggaaatgtgccttgttaggtattccttatggtggtgggaagggtggcattcctatagatccaaaacgctacagtgttggcgaattagagcgaattagccgccgttatatcagtgagttacttaaagatattgggccttctgtagatattcctgcgccagacatgggtacttctgctcgtgaaatggcttggatgatggacacttactctgtaaatgttggtcatgctgtaccaggggttgtgactggcaaaccgctttccattggtggttctctggggcgagaaatggcaactggacgtggcacaatgattattgtgcgtgaggcgctagcagatcgaggtaaatccttagtaggagtgcgagtagctattcagggttttggtaatgtcggtggtgccgcagctgaattactccatcaagcaggcgcgaaaattatcgctgtttcaacaggtgctgggggaatattttccgaagctggtcttgatattcccgcgttgaaaatctacgctgctgaaaatcgcaagagtattgtaggtttcccgcaatctgtaccaataagtaatgcagatttattaactttaccctgcgatgtcttaataccagcggctttagaaaaccagataactggagaaaatgtgaatcaggtgcaagcgcaaattgtcgcagaagcagctaacgggccggttactcttgaagctaacttggcattagaggcgcggggtgtaacagtgctaccagacatcttggcgaatgctggtggtgtggtagtcagttatttggagtgggtgcagggtctttcttacgtattttgggatgaggagcgcgttaaccgcgaaatggagcatttgatggtacaagcctaccgtaaggtgattcagcaatctaataagcggcaaatttctttaagattagcagcttacactttaggcgtgggtagagttgcccaggccctgactgacagaggtctttatcct

SEQ ID NO: 43738 - DNA, 1146 bp, Nostoc punctiforme
gttcttgtcactggtattggcctagtttccgccctgggtggaagtttagaggatagttggaaaaatctgatagcaggtaaatctggaattaggttacatcaaccatttccagaaataaaaccacttcctctaggtttgattgctcaacaaccatctgagttggcaatgttaactcaaatggttgttacttctgctttacaagatgctgggttagttccacctttagctgattgtgctgtcgtcattggatctagccgctcttatcaagcatcttgggagatgctggcgcggcaaatgtataaagatacaaaaaacttgcccgtttctaattttggaaattggttagatatattacctcatatcaatgcgatcgcaactgcaagacaaatcggtgcaacaggtatggttttggcaccgatggcagcttgtgcaactggaatttggtctatcgcccaagcagccttacttatacaaactgggcaatgtcaacaggcgatcgcaggcgcagtggaagcaccaattacacccctaactttagctgggtttcagcagatgggtgctttggcgaaaactggggcttatccctttgatttgcagcgagaaggcttagttttgggcgaaggtgcggctgtatttgtcttagaatccgcagagttggcaaaacagcgtcaagcaaaagtgtatggtgaaattctcggttttggcttaactaacgacgcatatcatagtaattcaccggaacctgaagggaaaagtgcgatcgcagctatcaaacaatgtctagaacgtagttgtctctcaccagccgatattgattacattcatgctcatggcacagcaacccagctaaatgaccagatggagagtatggtaatccagcgcttgtttccccaaggcgtggcagttagttctaccaaaggaagcacaggtcatacactaggagcatcgggagcattaggtgtagctttttctctcatggcattaaagcatcaaatattaccgccttgtgtaggattgcagcagccagaatttgatttagaaatcgttacagcagcacgtctaagcaaaattaggcaggttttatgcttgagttttggctttggtggacagaatgtcgcgatcgcgttagctaagtccccatagtac

SEQ ID NO: 43739 - DNA, 1206 bp, Nostoc punctiforme
cgcaagtccgcagaattaaagatattgcaggcaaaagaagcagcagaagttgctaaccatgccaagagcgaattcctcgccaacatgaatcacgaattgcgaacccccctgaatggtattctgggctatgctcagattctccagcgcgaccccgccaccacctctaagcagcagaagggattgagcgtaattcaccagtgtggttctcacctgctgaccttgatcaacgacattctggatctctcgaagttggaagtgcagaagatggatctctatccccaggatttccacttcgccaacttcctcaccaccacggtagagatttgccgcatcaaagccgaacaaaagggtattgccttccgctaccatcccgctaatttgccaactgccgttcatgctgatgacaaacgcctgcggcaggtgttactaaacttactcagcaatgcaattaagtttactgattttggcagtgtaaaatttacagttgaggcaatcagcaatgaagaaacagccgacactcgatcaactagaattcgcttcctagttgaagatacgggtattggcatcccaacggaaaagtggcaaactatttttttaccctttgaacaggctggaaaacgcgatcgcaacagtgaaggcacggggttggggttagcaatcagccagcaaattgtgcaaatgatgggtagttcgattcaggtcaatagcacacccggcaagggcagcaaattctggtttgaagtggacatactcgctgctgccgattggcttgcccagccagccagtagtaatctaaaggtgattggctaccagggcgaacggcgcaaaatcttagtaattgacgatcgccttgagaaccgcgctgttgtcatgggaatgctagcacctttaggcttcaaactggctcaagccgatgatggacagactggactagatttagcactccagatgcgcccagatttaatcattaccgatgtaatgatgtcaaagatgaatgggctggaaatgactcgccgtctgcgtcaactgtctgattttgcagtcacacccattattgcttctcctgccagcttgtctcaagtggatattcaagaagctcttgacgcgggttgcagtagcttttttccgaagccgctcgagttcatcggcttgctgggggaattgcaacgccacctagagttgcaatggatttacgaaacggcaccc

SEQ ID NO: 43740 - DNA, 1074 bp, Nostoc punctiforme
acacggattatgaaaaagctgatcaacaagccggaagactttgtgcgagaaagtctagaaggtatggcggcggctcattccgatttaattaaagtaaactacgatccagcttttgtctatcgagccaatgcacctattccgggtaaagtagcaattatttcaggtggtggcagtggacatgaaccaatgcacgctggcttcgtgggcaaaggaatgcttgatgcagcttgtcctggtgaggttttcacttcaccgactcctgaccaaatgctagaagcagcaaagcttgtagatggaggctctggtatcctttacatcgtcaaaaattacagtggcgatgtcatgaactttgagatggcaacagagttagcccgtagtgaaggcattcgatcgctaaatattttgattgatgatgatgtagcagtgaaggatagcctctatacccaaggacggcggggtgtaggaacaacaatactagcggaaaaaatttgtggcgcggcggctgaggcagggtatgatttgccacaaatagcaaatttatgtcgccgagttaatctgaatgggcggagtatgggaattgctttaacatcttgtacagtgccagctaatggaacaccgacatttgaattgagcgatcgcgaaatcgaattaggtatcggtatccacggtgaaccaggaatagaacgtacagctatcaaagcagtagatgagattaccgaaattttaacgcgatcgctccttgaagatgcagcatacagccgcacactgcgcgagtgggatgaagacaaaggagaatgggtagatgtagaactaacaaatcttccatttaccaaaggcgatcgcttattagctttcgtcaatagtatgggtggaactccggtttccgaactgtatattgtttaccgcaaactcgcccaaatctgcgaacagcaaggattgcaaattgtgcgaaacttaatcggcccttatattacatctctagaaatgcaaggttgctcaattaccctgctgaaattagatgatgaaacgatccggttatgggatgcaccagtcaaaacaccaagttggcggtgg

SEQ ID NO: 43741 - DNA, 780 bp, Nostoc punctiforme
atttctatgctgaatctgactggaaaaaatgctcttgttacaggtattgccaataaccgctcgatcgcctggggcatcgcccaacagctgcataaagccggagcaaacctgggtattacctacctaccggatgaacgcggcaaaatggagaaaaaagttgcggagttggtttaacccctcaacccaagcttatttcttccttgtaatgtccaagatgaggaacagattcaatttacctttgagacaattcgtgagcaatgggggaagctagacattctcatccattgtctggcctttgccagtaaagacgatttaagtggagactttagccaaacttctcgttctggcttcagcactgccttagaaatcagtacctactcgctggtgcagttaagtggtgcagcgaaacctttgatgactgagggaggtagtatcgtcacgctgacatatttaggcggtgtcagagcaattcctaactacaacgttatgggagttgcgaaagcagggttagaaatgagtgtgcgttacctagctgctgaactaggaccgcaaaatatccgcgtcaatgccatctccgcaggccccatccgcaccttagcatcttcagcagttggtggaattttggatatgatccatcatgtcgaagaagtagctcccctgcgccgtactgtcactcagctagaagtgggtaatactgccgctttcttatgtagtgatttgtccagtggtattaccggacaagttctatatgtagatgcaggatatgaaattatgggaatg

SEQ ID NO: 43742 - DNA, 585 bp, Nostoc punctiforme
cctcggattgccactgttcaccgtactactggtgaaactgatgtacaagttaccatcaatctcgatggtagaggaacttgcacggcagcaacaggcattccgtttttggatcacatgttgcatcaaattgcctcccacgggctgattgatatagatgtccaagccaagggagacttggaaattgatgaccatcacaccaacgaagatgtaggcattactttaggccaagctttcaaccaagcactaggcgacagaaaaggtattgtccgctttggtaattttcttgcaccattggatgaagctttagttcaagtagcgctagacttttctggacgacctcacctcagctacggcttgcaaattcctacccagcgtgtaggaacctatgacactcaacttgtgcgcgaattctttgtagcactggtgaaccatagccaaatgacactccacattcggcaactggatggcattaattcccaccacattatagaggcaacatttaaagcctttgcaagagcaacacggctagcagtggagattgacccccgtcgtgctggtctaattcccagttctaaaggcgttctc

SEQ ID NO: 43743 - DNA, 1299 bp, Nostoc punctiforme
atgaaaattagcatttttggtttgggatatgtcggtgctgtaacagcagcttgcttggcacgagatggacacgaagtaattggggtagatgtaaatcctgaaaaagtggatttgattgccaaaggagagtcacccattgtagagcctgggctaagtcagttgctggttgatggagtggcagctaatttaattacagctactacagatactgaagcggcagtgctagcatcagatgtttctctaattagtgttggtacacctccaatagagagaggagaaccggatcttacttacgtttggaatgtgtgcaagcagattgcgaaagcctccatccataagactgaaagccatgtcgttgttttgcgtagcactgtccccccaggaacattagaaaaatgtcagaatcttatagatagtattacaggtaataactctatccatttagcatttaacccagaatttttacgcgaaggttcagctatcaaagattacgatcaaccaccttacaccattattggtacagaatctcctgtggcagaagcagcagtacggcaaatgtatgccacagtagatgcaccgttcaccgtagtcaaaccatctgtggcagaaatggttaaatatgtggccaattgctggcacgctgccaaggtaggctttgctaatgaaatcggacgagttgcaaaagcttttggcgtagatgggcgggaagtaatgaatatcatcgtccaggatacgaagttaaatatttcccctgtttatatgcgtcctggatttgcctacggtggttcttgcctgcccaaggatttgagtgctttgctttactatgcaaggaatatggatgtaccagtacccctgctaaacgccctaccaactactaacagccttcaagttgatttggctgcccaacaagtgttacgccttggggcaaggaagattgcaattttaggattggcattcaagccaggtacagatgacttaagagaaagtccagcagtgctgctagttaagcggttgattggggaaggctgccagataaaaatttatgaccaggctgtttatgaagctcggttaatgggaaccaatctgacctatatccaaaataacctccctcattttgaggagctactagttgcagaagcagaacaagctctgaaagatgcagaattagtaatagttactcatgctaatccagagtttcgccaaatattacaggaagcgctcaaagaaatacaagttttggatttggcaagtgtatttactgaaccgattgaagagttaaattattgtggtattgcttgg

SEQ ID NO: 43744 - DNA, 351 bp, Nostoc punctiforme
ccagcacacacattcaatggtgactctagttggttcggtggtgtgcgctccctatccataaatccaagccgccaaattattggttgtggcagcgatgacaatacaattagattatgggatctcaataatggtcaacttttgagctatccatttgaacatacaaaatctgttcgctctattagctttactcccaaaggaaatggtttgattagcggtggcgatgatgccaccattagagtttgggatttaagaacatctcaggaattattaacttttaatgctcattctcaaccagtaacggcagttgctgtggttccaatttatgattttgttgtaagtggaagtgatgac

SEQ ID NO: 43745 - DNA, 1722 bp, Nostoc punctiforme
tttaaagggcatgagggtagcgttaacagtgcgagttttagtcctgacggtaagttaattgtgactgctggtgctgataatactgctcgtgtttgggattttgcgggaaagcaggtagcagaattaattgggcatcaaggcaatgttaaaagtgcgaattttagcccggatggtaagctgattgtcactgcatcttttgatgacactgcccgtatttgggatatttcaggcaaacagctagttgagctaaaaggacaccaaggtaatgtttacagtgcgaattttagcccggatggaaaggcgatcactacagcaggtgcagataaaaccgtgcggttgtgggatttatcgggcaaacagctaagagaatttaaagcccataatgctagtgtgtacagtgcgaagtttagtcccgatggcaagcacatagtgacagcatcggcggataaaacagcgcgtgtatgggatacgtctggtaagttgctagcagaattaaagggacacacgaacacagtttggagtgcaaattttagttgtgatgacaagcggatagttacagcatcagatgataaaactgcccgcatctgggatttatctggtaagcagttagcggttttgcaagggcatcaagatagtgtttatagtgcgaattttagtcctgatagtaagcagattgtgacagcatcgattgattttgctactttgctgtgggagtcatcagggacgttattagggaagttacaacagcatactggtggggttaatagtgcgaactttagcccagatggaaagtggattgtaactgcctcatctgacagtaccgctcgtgtttgggatttgtctggtaagatgctaactgaactgactagctttcaacgtgaggttggcagtgcaaggtttagttctgatggacaacatatcgttacaaaaagtggcaacatcgcccaagtgtgggatttgtcaaaccgacaattagttgaattcaaaggccatcaagctgacattagaagtgttagatttagccagaatggagagcttctcgtcactgcatctgatgacaaaacagctcggatatgggatttgtctggtaagcaactagctgaactaaaaggacatgaggattttatctatgatgctagattcagccctaatggaaaaagtattattactgcatctaatgacaaaacatctcggatatgggatttgtctggtaagcaactagctgaacttaagcatcaggactatgttagtagtgcaacttttagtcctgatggacagaaaattctcattgaatctggcagttttacattaagtatttgggatatttatggtaaattcctagccacaatcaaaggagataaatttgatatcaacagtggtacttttagtcctgatggacagcggattctgaccacttcacttgatgatactgcccgcgtttttgacatttacggaaagttattaaccgaattcagagggcatcaagagcaagtaataaatgctaattatagccctaatggacaacgaattgtgactgcatctctagatggtactattcgtgtatgggacacttctggcaagcagctaactctactcaaagggcataaaggtagcgtcaatagtgccagttttagtcctgatggaaaagttattgtcagtgcatatgacgacaaaactatccttgtttgggatacatctggcaaaatactagctcaaatagga

SEQ ID NO: 43746 - DNA, 2037 bp, Nostoc punctiforme
tggaatagttctggtaagttgttagcagaactcaaaaaacattggggaccaattagaagtgcaagttttagctctaatggacagcagatcgtcactgcatcctatgacggtactgcccgtatatgggatacttcaggcaaggagttagcactgcttaatcataattcttttgttaacagtgctagctttagtcctaatggaaagcaaattgttactgcatctgatgacaatactgctcgtgtttggaatagttcgggtaagttattaacggaacttaaaggtcatacacaaccagtcttaagtacaagttttagcttagatgccaagcacattgttactgcatctgctgacaaaactgcccgtgtttgggatttatctggcaaacagctagcagaacttcaacattctgcgatcgtcagcagtgctaattttagctcagatggaaaacagattattactacatctcatgacggtagtgctggtgtatgggatttgaataacaaaacagcagtacgtctgagtcatcagcatattgtcaatgaagctagatttagcccggatgaaaagctagttataacggcatccagagacggaactgctcgtgtatgggatttgtctggcaaacaaatagtgttgttcaaacatcaaagcagtgtcaatagtgctaattttagtcctgatggaaagcaaattattaccgcatctgatgataagactgctcgtgtttggaacttatctggaaaactgttacttgaattaaaaaaaagcgagactactcttaacagtgctagttttagcccggatggcaagcggattgttaccacatctgatgacggtactgctcgcttatggaacacttccggcaagttgttaatggttctcaaaggtcgtccagattggttactagatgccagttttagcccggacggcaagcagattgttaccgcatctgatgatggtactgctcgtttatggaatacttctggtaagatactagccgaactcaaagggcaagagaagactgttaaaagtgctagttttagcccagatgggcaaaaaatagtgaccgtatcctttgatgctgcatcctctagtggtgctgtacgtctatgggatttatctggtaaactgctagttgaacttcaagggcatcaaggacaagtcttgtgtgctaattttagcgccaatggacaaagaatagtgactgcctccgatgacaagactgcccgtgtatgggatttatccggtaagcagatagcaatccttagtcatcaaggtggagtcaacagagcaatttttagtccagatggacaaagaatagtgactgcctccgatgacggcactgctcatttatgggatttatcgggcaagttacttacccaattcaaagaacatcaagatgctatccagagtgtcagttttagccctaatggacaactggtagtaactgcatcttgggatggcactgcccgtgtatggaatttgtccggcaagcagatagtgcttttcaatcatcagcgtgaagttattgatacgagttttagtccaaatggacaatacattgttactgcatccattgacaacacagctcgtttatgggatttatcaggtacgttgcttgttgaatttgtaggataccaaggtggtataggcagtgctaattttagtcctgatggacaatggattattaacctagaatatgacaaaccttctctttggaatttgtccttgagatttccattaagatttcctaaagccagcatttatgcatatgaagatacttttccaaacacatctgtcgaaaagtctacagcacttcttaaagaatattgggtaaatattggcagtgcaaaatttagccctgatggacaacgcattatctctgtttttagtgacggtagcactcgtgtatgggatttatctggaagactgctagcttttattaaggggcatcaaggtagggttacaagttctaattttagccctgatggacaaagaattctcaccacatctaatgatggtactgcccgtatatgg

SEQ ID NO: 43747 - DNA, 1296 bp, Nostoc punctiforme
tcgcgccgggcgcaagttagctggcaaaagctgggtttagaggggagaatcgaagctttacagcagtggaaggcagcgatagtatcagagcgcgatcgcttaacggaagctctggtaaatgatacgggaagattatcaacctcaatattagaaatagactctttcctctctagcatcgatcggtggtgtaggttagcaccagaattgctgcaagactctgcaaaaaacacagcaattccatttatcgccttacaacaaacatccgttccttaccccctagttgggataattagcccgtggaattttccactgttgctctcaactattgataccattccggcattgttggcgggttgtgccgtcattgtcaaacccagtgaaatagctccccgcttcgttgcaccaatgacaacagcactcaatgccgtccctaaattgcgcgatgtcttaacttttattgaaggagcaggcgcaaccggatctattttgattgacaatgtagacttagtatgctttacaggtagtgtcgcaacagggcgaaaagtggcagaagcggctgctaaacggtttattccagcttttttggagttagggggaaaagatcctgcgatcgttttagaatcagccaatttagaattagcaacctcagcaatcttgtggggttccgtcgtcaacactggacagtcgtgcttatcaattgagcggatttatgttgctgaatccatatttgaaaagttttaccatcaactagtagccaaagcacatcgccttgggctagcctaccccactgttgaaagtggagaaattggccccatcatcgctgaaagacaagccgcaattattagcgatcatctcctagatgcagtagaaaagggagcagtcattcactgcggtggtgtaattgaagacttaggcgggggttggtggtgtcgtccaacagtgcttacccaggttaatcattccatgaaagtgatgacggaagagacttttggccccattatgccaataatgcctttttccacagttgaggaagcggtgtctttagcaaatgattcaatttatggattaagtgctgctgtttttgcctcggaagctgaagccttagaaattgcccagcagatagaagcaggtgctattagtatcaacgatgctgcactcactgccatcatgcacgagggagagaaaaacgctttcaaattctctgggatgggaggatcgcgcatgggtgcagcagcgctgaaacggttcatgcgaaaaaaagctattttaattaaaactaatgcgactaatgaccct

SEQ ID NO: 43748 - DNA, 1278 bp, Nostoc punctiforme
gtaattgtaattggggctgggttggcaggactgacggctggttatgaactcactcgtgctgggtttgatgtgcaagtatttgaagcccgcgaacgagttggaggacgagtcaaaacggtctttttggaagaagaacagcatggcgaattaggtgcagaatttgtcgatgataaccatacagcattgatatcctatgccactcaattcgacctcaagtttgagccggcctttgagcttccagatgacctctgttattacattgatggtaatttttctactccaaaaacgctcttgcctcaacagcaagcttctttaaatgatgcatatcagaagttagatcgattattgtcacaggttgccgatcctgcccaaacattagctcagtggttgacagcagaatcgatcgatccttttgcaagcaaagttattcgtcagcaatcctatggaatgtatactgccgatccagaagcaattggagttggtttctttgcttacagtggtacttccggcgatcgcagtttgcgaattcaaggtggtagtactcaaattgcaactgcatttgctcgctttttaggcgattgcatccatctaaacaccccagttgtgcggattcagcagcaagaacaaactgttgccgtgagcctaaaaactcttcaagggcaggttgaagtattttgcgattgggttgttgtcacgattccctggagtgtcttgcgccatttgtcgattgaagctccgcttacacagatacaacgagaggcgataacccacttgccttatgggacatcggttaagaccttacttcagtactccaatcgtttctggcagcaatccagtcttgggctgctcgtgggagacacaccttatcaaactatctgggaatctaccctaactcaagtaggtgaagcgggaattctggcttgtacgagcagtgggacacctagccgaaatatttctggacactccgttgagttcgcacaacaaacaatatctgcgctttacccaaatgctcccaaagcgatgtctacgacggtcactgagcgcagccgaagtgcgggctgcgcctacgcaactacaactcataactggagtgccgatccctggtcacaaggatcttactgctacttcgctcccagagatttgaaaagctggcgttctgatttaccgtactctgctggacaagtcatttttgcgggagaacataccgctcccattgaatattgtggctatatggagggagcgattcgcagtggacaacgagcagcagaggaaatttta

SEQ ID NO: 43749 - DNA, 1011 bp, Nostoc punctiforme
atggaacttgcaatgattggactcggaaggatgggcgcgaacatggcacagcgcttgatgcgtgctgggcatcatgtagttgggtatgtccgccggactgagaaattgtccgcaatggtgaacgaaggtgtaattgcagccggagccagctcaatcgccgatctagtcagcaagttatccaaaccccgtaccgtctggttgatggtgcctgctgcttccgtggatgaaacaattgaaacgctaattccactcctcgaaccagacgacattattatcgatggtggcaactcatactaccatgatgacattcgtcgagcagccacactcaaggatcgaggcattcactatgttgattgcggtacgagcgggggtgtttggggattggagcggggttattgcctaatgatcggcggcgaacaggtggcaatcaaacgccttgaccccatttttgcaactctagctccgggtgtaggagagatcgatcgcactcccggacgagagaaggcgggcggtactgctgaacaaggctatctccattgcgggcccatcggtgcaggacacttcgtgaaaatggtacacaacggtattgagtacggtgtcatggcagcgtatgcagaggggctgaatattcttcaccacgccaacataggcaacaatcagcgcgagatcgatgccgaaaccacaccattacgaaatccagaacattatcagtatgactttaatctgggagatattgccgaagtctggcggcggggtagtgtaattgcttcctggctattggatttgacagcgatcgctttattagaaagccccaatttagaaaggtttggtggtcgggtatcagattctggtgaagggcgctggagtgcgatcgcagcaattgacgaatctgtaccgactccagtgttaagcgcagcgctctttgctcgctttagctcgcgtggggaagcagactttgccgataaacttttgtcagccatgcgctatcagtttggcgggcattatgaaaaa

SEQ ID NO: 43750 - DNA, 1347 bp, Nostoc punctiforme
cctgattcagacgcactggtattttttggggcaacaggtgacttggcttacaagaaaatctttcccagccttcaggcaatggtacgacggggcaatctcaatgtcccagtaattggggttgccggacgaccttggacgacggatcaacttagggaaagggcacgtgatagcctagaacataatggtggtatagatcgagacgcatttgagaaactttctggtctactccagtacgttgctggtgactacaacaaaccagaaacttacgaaaaattacgtcaagcccttggtgataccactcatcccctctactatttggcaattccaccgagcctgtttgcacaagtagcgtcaggattgggtaaatcaggctgtgctaaaaatgcgcgggtggtaattgaaaaaccatttggacgggatttgaaatcggcacgtgagttaaatcaaattctggcatcggtttttcccgaatcatccatctatcgcattgaccattacctgggcaaggaaccactgctgaatttactctattttcggtttggcaactcttttctcgaacccatctggaatcgcaactatgttgaaagcatccaaattgtgatggcagaggactttggcattcaaggaaggggacgcttctatgaggagactggtgcaattcgggatgtggtggaaaaccacatgctgcaagtattggcttcagtgtgcatggatgctcccgctagtacggcggccgattccattcgagatgaaaaagcacgtattctcaaagctataccttcactgcaacccgatgatattattcgcggtcaattttctgattaccgcaacgaagaaggcgtttctcctgattctcaagtagaaacttttgttgccgtgcggttatttattaatacgtggcggtggtcaggagttcccatctacatccgggctggaaagaaattacctgttaaaactactgaggtgatggtcaagctcaagtgtccacctttagatgtgttccaggagggaggaaaagaaaacgctaattatgttcgttttttactagatccagaggtaattgtgggattgggcgctcgcactaaaatccctggagaagatatgagtggctctgcggttgaactcctggctttttacggaggtggcgacgagatggaaccctatgagcgtctattgggtgatgccatgcggggcgatcccaccttgtttgtacgagaagataccgtagaagaagaatggcggattgttcaaccaatccttgataacgtcacacccgtttacgagtatgagccaaatacatggggcccacctgagtcagataaactgctctcgccaatagatgattgg

SEQ ID NO: 43751 - DNA, 921 bp, Nostoc punctiforme
gggccagagggtgtgtcaggtgctggcgctggcttccaagatgtcggcgatatgggtggttttgccgatatttttgaaagcatttttagtggctttgctggcggtatgggtagtcccacgcaacaaagacggcgcagtgggcctgcgaggggcgatgatctgcgactagacttgaagttagactttcgagaagcggtatttggtggcgaaaaagaaattcgtatttcacatttagaaaattgtgaagtctgtagcggttctggtgctaaacctggaacccgcccccggacttgttcgacttgtagcggatcgggtcaagtccgtcgtgtcactagaacaccctttggcagtttcactcaagtctcgacttgtcccacctgtaatggaacagggatggtaattgaagacaagtgtgatgcctgtgatgggaagggcgcaaatcaagttaccaagaaactcaaaattaccattccagctggggtggataatggcactcgcttgcggatttctagtgaaggagatgctggtcaacgtggtggtccttctggggatttgtacgtttacttgttcgtaaatgaggacgaagaattccaacgagatggcattaatattctctcggaaatcaaaattagctacctgcaagcgattttaggttgtcggttagaggtagatacggtagatggccctgtagaactaattattccagccggaactcagccaaataccgtgatgaagctggaaaatcgcggcgtaccccgtttgggtaatcccgtcagtcgtggggatcacatgctgaacgtattaattgatattcccaacaaagtcaccccagaggagagggaactgttggagaagctggctaaaattaagggagatcggactggaaaaggcggtctagaaggatttttgggaaatttattt

SEQ ID NO: 43752 - DNA, 819 bp, Nostoc punctiforme
gtggtggttacgggagcatcaacaggaattggccaagcgtgtgctttgcttttagaccagttgggcttctctgtttttgctggcgtgcgtcaaaatattgatgctcaaacacttaagcagaaaggatcgccaagactcattcccatttttttagatgttactgatgctgaatcgatcgcagatgcggttgataaggtaacaaatgaagtcggtggtactggaattttaggtttagtgaataatgcaggaattgctatccctgggcctttagaattattagcgatcgcagaatttcaacaccagatgcaggttaatgtcaccggacaattagcggtgacacaagcatttcttggtcttttacgccaaagtcggggccgaattatcaatatgggttccattgctggtaggagtcctacgccgttcttaggagcttacaatgcttctaagtttgccttggaagcactcactgatgtcatgcggatggaattacgtccttggggaatctcggtttcaattattgaacctggttccatcgctaccccaatttgggaaaagtccctaagtcaatcggaagtagcacagtatgatttaccgcaatcggcacaaaatctctacggtcaagcaatgaatattgtccgcaagaaaatgcagattctcgcatctaagggaatttctgcggatattgtcgctcagactgttgttcatgcgctcactgcaaagcaacccaagacgcgctatctggttggctcagatgccaaactcggagcggtgctaaagcatattttgtctgataagctacatgaccagataattttatac

SEQ ID NO: 43753 - DNA, 1965 bp, Nostoc punctiforme
agtgaaattaaaacccttagtgcatccagtgaagccctctttgcctcacaaaaaggtattgattctttaaaagaaggtttaagagcgggaagaaaattacaacaaatagtttgggtagattcctacacaagagagcaagtacagacggcgctctatcaagctgtttctgggttaagagaatataaccgcttggaggggcatttatctggagtaaataatgctacattcagccctgaccgttctttaattgcttcagctagtgcggatactacaattaaactttggcttcctgatggtagcttgttcaaaaccctatctgggcatgaagatgtagtgaatagcgtcagtttcagccccgatggtcaaattattgcttccgctagtcaagacaaaacggtgaaactttggagtcgagagggtgtattacttgttactctattagggcatcagggtgtcgtgaatagtgtcagttttagcccagatggacagattattgcttctgcaagtacagacaagacagtaaaactgtggagtcgggatggtaaactgctcaaaaccttgccaggacatgatggtgcagttttgagtgtcgcttggtcaactgatggacaaaccattgcttcagggagtgcagacaagacagtaaaattgtggagtcgggatgggaagctgctcaaaaccttgcagggacatgaggatgcagttaaaagtgtagcttggtcaaccgatggacagactattgcttcagctagtttagaccagacaatcaaactgtggaatctagaggggaaattactgcgaaccctatcagggcatagtgctggagttaccagcgtcagttttagccgtgatggtaataccatcgcttctgcaagtaccgacgagacaatcaaactttggagttttgaaggtgtgctgctaggaaccctgaaaggacataataattgggttaacagtgtcagtttcagcccagatggtcgcaccctagcttctgcaagtcgggacaaaactattaaactctggcattgggacgatgtgttattgcgaaaacccaaagccgataatgatgactggataactagcatcagtttcagcccagacgatcgcaccttagcagcagggagtcgagacaaaactataaaactattcagccgcgaaggtaaattactccgaatacttacagggcatcaaggtcaagtttggggggttagtttcagtccagatggtcaagcgatcgcttcggctagtaaagatcaaacagtaaagctttggggtgctgacggtaaactgctcaataccttacagggtcataatagtaccgtcttgagtgtagcttggtcgcctaatagtcaaataattgcctcggctagtaaagatcaaacagtaaagctttggagtcgagatggtaaactgctcaacaccttgcaaggacataaagatgcagtgaattgggtaagttttagcccagatggtaaattgctagcctcagccagtgatgacaaaaccgtaaaaatctggagtttagatggtaaattgctatataccttaattggtcatagccgccgcgtaaatggggtttcttggtcgcctgatagtcaagtaattgcttcagttagtattgatagcacagtccaactttggagccgggacggtggtttactaaatactctcacaggggatggtgatagttttattagtgtgagttttagccccgatggtaagactttagcagctagcagtgatgacaaaataagaatttggaaccgagaagggacattactgatcgctttaaaaggctatgaagctgagttaaccagcgtcagtttcagtcctgacggtaagactttggctgcgggtagtggtaacggcacagtgattttccagaatttggcagatatccaactggaaaaattactggcacggggttgttatttgctctatgattatttgcagactaaccagaaa

SEQ ID NO: 43754 - DNA, 921 bp, Nostoc punctiforme
tgtgtacacaccctgactcatctcaactgggtttttacaactgcaatcagtccagatggtaaaactttagctagtggaagtagtgataatacgatcaaaatttggcatctcgacacagggaaattactacatactctcactagtcatacaaaatgggtaagatgcctagcctttagcccagatagccaaactctagttagtggcagtgatgatagcaccctaatgatttggcaagtgtctacaggtaaattactcaagacactcaaagtacattcaaccccagttttttctgtaatcattagtccagatggtcaaactatcctgagtggcggtacagacagtactatcaagatttcccatatagagatgggacaattactgcaagtcctcaaaggtcattctggcttagtttactcccttgctatttgcccaaaacaacagatttttgtaagtggcggtgcggataataccattaagctgtggaatttgaagagtaacaaactgctgcaaactctcaacggacattcaggctgggtgatgtgtgtcgccattagccctgatggaaaaattttagctagtagcagttatgaccaaactatcaagctatggaatatcaatacaggtaaggtaattaacactcttgccggacattgcagctatgtttgtgcgatcgcttttagtcccgttggtcagtatcttgctagtggtagtgcagatcacagtgtaaaactatgggatgttaacacaggacaagaactttacactttgaataaccattctgattgggttaactccgtcactttcagtcctgatagcaaaaccctagctagtggtagtcgggatatgacaattaagctttggcaatgcgatatctaaacacaaattaaaaatttagatgatttcagtaatttactagatttt

SEQ ID NO: 43755 - DNA, 462 bp, Nostoc punctiforme
caaaaagcgacatttggagcaggctgtttctggggagttgaagcagcatttcgtcaagtaaaaggagtaacttctacagcagttggttacagtggcggacaccttgataatccaacctacgaagatgtctgtagaggcaaaactggacatgctgaagcagtggaagtggaatacaatccagcaatagtatcttacgatcaactgctaaatgtgttttggaataagcacaatcccacagcatcaaaccacgaggagctaaatgttggttatcaatatcggtcggtgatatttttccacactccagagcaggaattattagtaagagcctccaaggagcagcttgaaaatagttctcgctatcacaaaaatccaattgtgacggagattttacctgcatcacaattctatagagcggaaaagtatcatcagcaatatctggagaagcatggacgagcgtcttac

SEQ ID NO: 43756 - DNA, 555 bp, Nostoc punctiforme
cccgccactgatatctcgaatgctgcaccgcagggaaagcaagtagcggttttcgctggtggctgctactggggaatggaagcggtttttgagcatctattaggtgtttctgatgttgtttctggcttttctgggggtgatgcaagaaccgcagactacacacttgtcagtgctggattaactaatcatgctgaatcagtgaaaatcacctacgatccatcaaaaatatcatataaccagcttctcaaggtctactttttggtagcccataacccaacagagttaaatcgacaagggcccgactcaggtaagcaatatcgttcggcgatcttttttgctaacgatgagcagaaacaggccgcacaagaatatattgctcaactcaacaaatcgcgagtcttcgacaagccgattgtgacagaattagatcctttgaaaggtttttatcaggctgcggcataccatcagaattatatagtgcatcatccgagcgatcgctatgtggtagtgaatgacttgccgaaactggctaaacttcaagcaaagttccctgat

SEQ ID NO: 43757 - DNA, 756 bp, Nostoc punctiforme
tggcaagattggcgaaattttgttgttgttcgtaaggtgaaagagagcgaagaaattacctctttctatttacaacctgaagataaaggggaaattaccaactttcaaccaggtcaatttttaaccatcaaacttgatatacctggacaggataagcctgtaattcgtacttactcgctttcagattatcctgaaaactgtgaatactatcgcctctcaattaagcgggaacctgcaccgaacggattagatgttatgcctggtatagcatctaattttatgcacgatcgcattcaagaaggttcagtaattttagcaaaaccaccaaacggtaaatttgttttagatgtgcagaaatctatccccgcagtgttgattagcaatggggtggggattacgccaatgattagtatggcgaaagcttgtagtcttcttaatcctactcgtcctatttggtttgtacatggtgctagagacggtaaattccatgcttttcgggatgaagtgagggaaatttctcgacaaaatcataatctgaatgtgcattttcgctatagtcgtcctacacctgaagatagaggtaaataccacagtgttggttatgttgatgctgctctgattcaagagttagtacgacaagaagctgagtattttctgtgtggttctccatcttttatgcagtccataatgcaaggattaaaagaatcgggagtacctgacagtagagtattctttgaatctttcggtaaaccgatg

SEQ ID NO: 43758 - DNA, 804 bp, Nostoc punctiforme
tttatgaaactagaaggaaaagttgccctagtaactgggagcagtcaaggaattggacagggaattgttctcggtctagctcaagcaggggcaaatgtggtaattaactatcgttctcacccagaaggagcagaggatactttagcaaaggtggaggcgattggtggtaattgtcacatagctcagtgtccaaaatctcatggttatacagttcaggcagatttgggcagtgtcgatgaagtacgccaactgattgcagaaagtattaaccatttcggcaagctagatattttggtaaataatgctggcattgaaaaacacgcaccattttgggatgtcacagaagcagattacgacgctgtaatgaatgtcaatttaaaaggtgttttctttgccactcaagcttttgtacaacacctgattgaaactaaaagaacgggaaaaattattaatattagttcggtgcatgaagaactaccatttcccaatttcacagcttactgtgctagcaaaggcggaatgaaaatgcttgctcgtaacttagctgttgagttgggtgctttgggaatcacgattaataatgttgcgccaggagcaatagaaactccgattaatactaagctgttgaatgacccagaaaagttgggtgcgctattaaaaaatattccacttggtcgcttgggtcaaccgcaagatgttgcttctttagtggcgtttctggcttctgatgatgctgactacattacaggtagcactttctttgtagatggtggactactttggaattatcaagaacagtaggga

SEQ ID NO: 43759 - DNA, 1887 bp, Nostoc punctiforme
atggcaaaagttgttggaattgatttagggacaactaactcttgtattgcagtcatcgaaggcggacaaccactcgtgattgcgaatgcagaaggacaacgcatcactccctctgtagttgcatatacaaaaacaggcgaacgtttggttggtcaaattgctcgacgacaggcggtaatgaatccagagaatacgttctactcagtcaaacggtttatcggacgcaaacacgatgaaatcacccacgaagcgagtgaagtttcttacaaagtcgttcgcgatcgcaacggtaacgtcaaactcgattgtccggcgctcaaaaaacaattcgcgcctgaagaaatttccgctcaagttttgcgaaaacttacagatgatgccagcaaatatctaggagaacccattacgcaagcagtcattactgtgcctgcttacttcaatgattcgcaacgacaagcgaccaaagatgcaggcaaaattgcagggctagaagtactccgcatcattaacgaacctacggctgcggcacttgcttatggtttagacaaaaagggcaacgaaacaatcttagtctttgacttaggaggcggcacgttcgacgtttcaattctagaagttggagaaggtgtgtttgaagtcaaagccacgagtggggatacgcatttaggcggcgatgactttgataaaaagattgtcgattatgttgcaaatgattttcagcgccacgaaggtattgatttacgcaaagataagcaagccctgcaacggttaactgaagccgcagaaaaagccaaaattgaactctctagcgctacccaaacaacgattaatctccccttcatcacggcaactcaagagggaccaaagcacctcgatataactttaactagggcggagtttgagaaactctgcgctgacttgctcgatcgctgccgcattccagttgagcaagctctcaacgatgccaatctgaacaatgccaatctcgatgaagttgttctagtaggcggttccacccgaattcccgccgtgcaacaactcgtcaaacgcatcacaggcaaagatccaaatcagggagtgaacccggatgaagtagttgctgtgggtgcagcaattcagggtggagtactggcgggagaagtgaaagatgtgctgctgctagatgtaacaccgctttctttaggggtggaaacaatgggcggggtaatgacaaaaattattccccgcaacacgacgattccggtgaagaaatccgagacgttttcaaccgccgctgatggccagtcgaatgtcgaaattcatgttctgcaaggagaacgggaacttgtggcagacaataagagtttaggtacgtttcggctcgatggcattcctccggctccgcgtggagtacctcaaattgaagtgacgttcgacctcgatgcaaatgggttactatcggtaactgctaaagatcgcgccactggtaaagaacaatcgattacaatctcaggcgcttcgacgctggataaacgcgatgtggaacgcatggtacgagatgcagaaactcatgcccaagaagatcgccaacgccgcgagcaaatcgacaccaaaaataatgcggactcgctggtttatcaggcagaaaaacaactgcaagacttgaatggtcgagtttctcaagcagataaaagtagggcgcaacaattgattgacgagttgcgatcggcaattgagcgagaaaactacgagcaaatgcgatcgctcactaccaatcttcaacaagcgctcatgcaaatcggtagcgccgtttacgcccaagctagcacagctactaacaatcctaatcccacaaatcagccaaccggacaaaacgacgatgtgattgatgctgattttgttggctaa

SEQ ID NO: 43760 - DNA, 966 bp, Nostoc punctiforme
atgccaactgcaaatgatttcaaagattattacaacattttgggagttagcaaaactgcaacttccgacgaaattaagcgagcttaccgcaaacttgcccgcaaatatcatcctgacgtgaatcctggcaatccagaagccgaggaaaaattcaaagacatcaatgaagccaacgaagttttatcaaacccagaaaagcgcgaaaaatatgactcttttgggcagtactggaagcaagcggaggctagcggtactcctcctggaggaactagcacgtatgcagagaattttgaccaatatagcaactttgatgactttatcaatgatttgctaggtggtttagggggcaggacaagagcaggacggacttattaccgtacctcggctaggcagcctgatgactttggctcatttggcagccaagcaccagcacccgatagtgaagctgcgatcgcactctccttctcggaagcgtttcatggcgttcaaaagcggttgcagttggatgatgaaactatcaacgttcgtattcccgcaggtgctaaaccgggtagtcgaattcgcattaaaggcaaaggtcgccccagccctttttctcaacagcgaggcgatttgtatctcacaattgagctgcttcctcatccgttttttcaattttcggatgacaatttaacttgcgaagttcccattcgtccagatgaagcagtcttaggcgctcaaattcaagtaccaacaccagagggccgcgtcacattgagcgttcctaaaggtgtgcgttccggtcaatcgctgcggctacgaggaaaaggctggacgcaaccaaaaggcgggcgaactgacctaattgtgaaacttcagatcgtgtctccgaaagagttaagcgaaattgagcgggattgctatgaaaagattcaggccaatagcagctttaacccgcgtactgcattagaaggagtgacgttatga

SEQ ID NO: 43761 - DNA, 1056 bp, Nostoc punctiforme
atgattgttaaggctggtgaagcaattttaaaattttggttagtagtcatggaagttatttttaaggtcatccgacagcaacaaaattcctcccctattgtgcaaacctatcttgtagaggcagaaccaggtaatacaatcctggattgtctcaatcatattaagtgggagcaagatggaacgttggcatttcgcaaaaattgccgtaataccatttgtggtagctgtgctatgcgaattaatgggcgttcggctttagcttgcaaggaaaatgttggcagtgaacttgctagattacaacaaataccatcatcccaaagtaaagtaaatgtcattcctgaaatcacgatcgcacctctcggtaatatgcccgtgattaaagatttggttgtagatatgagcagtttctggaataatttagaggcagttgctccttatgtgagtacggcagcacgacaagtaccagaaagagagtttttacaaacaccacaagagcgatcgcgcctcgatcaaactggcaactgtattatgtgtggtgcatgttactctgaatgcaacgcccgtgaagttgatccaaactttgttggtccccatgcccttgccaaagcttaccgaatggtagctgattcccgcgatagcgacactgaaaatcgtttagcaagctacaacgaaggtactaaaggcgtatggggttgcactcgttgtttatattgcgattcagtttgtccaatggaagttgcaccattagaacaaatcaccaaaattaaacaagaaattctcacccataaagaagccagcgatagtcgctcaattcgtcaccggaaagtattggtggatttagttaaagaaggtggttggattgatgaacgtcaatttggtttacaagttgttggtaactactttaaggatttaagaggattactcagtcttgcacccctcggtttgcggatgctcctgcgaggtaagtttcccctatcctttgaaccttcagaggggacagaacaagtgcgatcgctcattgaatctgtgcaacaagttgaagggaataggcaatag

SEQ ID NO: 43762 - DNA, 1284 bp, Nostoc punctiforme
atgaatatagcagtggtggggttaagccataaaacagcccctgtagaagtccgggaaaaactgagcattccagaaccacaaattgaaagtgcgatcgctcaactggccagctatcctcatattgatgaagttgcaattcttagcacttgtaatcgcctggaaatctacattgttaccagtgaagcagaccaaggtatccgagagataactcagtttcttgcagaatatagtaagttacccgtgctttctctgcgacagcacctatttatgctgctacatgatgatgcagtgatgcacgtcatgcgggtagcaggtggtttagatagtctggtactcggagaaggtcaaattctggctcaggtgaagactactcacaaactggggcagcaatataacggtataaaaaccattttgaatcgattatttaaacaagcgctgacagctggtaagcgggttcgcactgaaactagtattggtactggtgctgtctctatcagttcggcagctgtagagttagcgcagataaaagtggcaaatttagcagcttgccgagtggtaattttaggcgctggtaaaatgtcgcggctgctggtgcaacacctaatttctaaaggtgctgtagaaattagtattgtaaaccgctctcgcgatcgcgcccaagaattagcaaagctgttccctcaacaaccgatcaaaattcatccactctcggaaatgatgagcgtaattgccgatagcgatctagtatttacaagtacttcagcaacagagccaatacttgaccgggtcaaattagaaatggttttagaagttcagcgctctttaatgttatttgatatttctgtgccgcgtaatgttcatgcggatgtaaatgaattggaaaacgtgcaagcgtttaatgtggatgatttgaaggcagtagtagcgcaaaactacgaaagccgtcgcaagattgcacaggaagctgagaaacttttagaagaagaagtggaagcctttgatatttggtggcgcagtttagaaactgttaccactattagctgtctgcgaaataaagtcgaaaccatccgcgaacaagagttagaaaaagctttgtcgagattgggttcggaatttgcagaaaaacatcaagaggtgattgaagcattaacacggggaattgtcaataaaattttacatgacccgatggtacagttgcgatcgcagcaggatgtggaagctagaaggcgctgtatgcaaactctgcaaatgcttttcaacctcgatgccgaggaacagtttagt

SEQ ID NO: 43763 - DNA, 1575 bp, Nostoc punctiforme
atggatgctagggcactttggcaacgataccaaaactggttatatttccacgagggattgggactgtacttagacataagtcgaatgcggttcgatgatgccttcgtggaatcgttgcagccgaagtttgacaaggcgtttgcggatatggctgaactggagaagggcgcgatcgcaaatcccgacgagaaccgcatggttggacactactggctgcgaaatcctgatttagcaccaactccagaacttacacaagaaatagtccaaaccctagaacaaatcgaagcctttgcggaaaaagtccaaacaggtgctattcatcctcccagagcaagccgcttcacggatattatctccattggcattggtggttccgccctcggcccccaattcgtcgcagaagctctcgctcctgatttcccacctctgaaaattcactttatcgataacaacgatccggcaggtatagatcgcgttctgaatcatctgcgaaatagcctcgccagcactttggttttggtaatctccaaatctggaggaacaccggaacctcgtaacggcatgattgaagttaaaaaagcctacgccggacacaatttggaatttgctcaatatgcggtagcaattaccagcgttgacagcaacctcgataaactggccaaagacgaaggttggctggcgagatttcccatgtatgactgggtaggaggacgcacctccgaaatgtctgctgtggggctagtaccagccgcattgcagggcattgatgttcgtgccatgctagatggcgcaaaagaaatggatgacgctacccgcgtcccagatgtgaaaaataacccagcagccttgcttgctttgtcttggtactttgctggcaatggaaagggtgaaaaagatatggttgtcttaccttacaaagacagcttatttttattcagtcgctatttgcaacagctggtgatggaatccttgggcaaggaaaaagacttagacggtaatgttgtccatcaaggcatcgccgtttacggcaacaaaggctcaacagatcaacacgcttacgttcagcagttgcgtgagggtgtagcgaatttctttgctaccttcgttgaagtgttggaggatcgtcagggcccatcgactgaaatagatccgggagttacatcaggcgattatctttccggttttctccaaggaacccgacaagcgctttatgaaaatcaccgcgattcgattacagttaccattccccaagttaacccccgaactgtaggggcattaatagctttgtatgaacgtgctgttggtttatacgctagcttggttaacgtcaacgcctaccatcagccaggggtagaagctggcaaaaaagcagccgcctccattctcgatttgcaaacacgagtggtagcagtcctgcaaaaagaaaaaactcccatttctcttgacgaactcgcaaagaaagcaggcgcatcagaccaaattgaggcaatttacaaaattttgcgtcatatccatgccaatcagcgaggtgtggttttgcaaggcgatcttcacaaacccggcagtttaaccgtt

SEQ ID NO: 43764 - DNA, 978 bp, Nostoc punctiforme
ccaagcatgggctgcggaacttgggcctggggcaaccaactgctttggggatatgacgaaagtatggatgaccatttgcaagcggtgtttaacctttgtgtaaacaacggtgtgactttatttgatacgggtgattcttacggaactgggagattgaatggtcgaagtgagttactgctgggacgattcaaccgagaatatctaggttcaaacaaagaaaatatttgtattgcgactaagctggctgcttacccgtggagatggacacggcaatcaatggtaaaggcttgcaagtcatctgcccaacgcctgggaaaaaacgtagatttagtacagatgcattggtcaacagcgaattatgccccttggcaagaggtagggctgttagatggtcttgccgatttatatgagcaaggactagttaagggagtaggactgtccaattatgggcctaaacagcttaagcaagtgcagaaaaagtttgctgaacgaggtgttcctattactactctgcaagttcaatactctttgttgtctacatatcctgtcacccaattggggcttaaagacctttgtgatgagttgggaattaaactgattgcctatagccctctagctttgggactactgacaggaaaatactctgagcaaggccctttgccaaaaggcatccgaggtctgctgtttaggcagatattaccaggaatgcgtagacgcggagcggcttctgctggcagttcgcttttgggatgtttgcgagaggtagcacaagctagaaacaaaaccatgtcacaggtagcaattaattggtgcatctgtaaaggaaccattcccatccctggagcaaagagcgtagaacaggcaagagagaatattggtgctttaagttggcaattaaacgtcagcgagattgcagagttagataaggcggcggcgaatgtaggcaagaaaatggtacaaaatatatttcaaactaag

SEQ ID NO: 43765 - DNA, 3288 bp, Nostoc punctiforme
gtcggcatcctcttctaccgcgctcattatttagctggaaacaccaaggtaattgatgctttatgccaagccttggtacagaaaaatttacaaccagtgccagtgtttgtttcctcattgcgtgaacccgatgttcaagcggagttgagtgaatttttccaacccaaagaagccgaatcaatagctgtgctgctgaatactaccagtttttcactagcacgcttggaaagcgaaacaccccaaaccgaactgtgggaaaaattagatgtgcctgtgttgcaggtaatcctcagtggcggatcaattgagcagtgggagtcacagtttcaagggctttctccccgcgatattgggatgaatgtggcgctaccagaagtagatgggcggattattacgcgtgctgtgtcttttaaagccgtgcaaactcgtaatccccatttagagacagatgtggtaatttatgaaccagtcagcgatcgcattgagttcgttgctcaactagcagcaaattgggcgcgtctacgttccaaaccaccccaagaacggcgaattgccctaattttggcaaattaccccaaccgcaatggacggcttgctaatggtgtgggactcgataccccagctagttgtgtagaaatcctgcaagctttacatcaggctgggtatgaagtagaaaatccacctgctcaaggagatgagttgattcaacggctgacaaatggcgtaaccaacgatgcggaaggtagagaatggcttccggtacaccaaagtgtctcttgggaagaatatcaagaatatttcgcttcattaccgccagcagttcagcaaggtattactgaaaggtggaaaatggggcaaagtgcgggaggcaaaggtgaaagctcttctcccctgctccctgctccctgcccccctgcctctatccccgttcccggaatccaaatcggcaacatcttcgtgggaattcagccagcaagaggttatgataatgaccccagtttgaattatcatgcgccagatttagaaccaacccatgattatttagctttctactattgggttagagaaacttttggtgctgatgctgtagttcatgtagggaaacacggaaatctagaatggctacctggtaaaagcgtggctttatctaataattgttatccagaagtggctttcggctcacttccccacctgtacccgtttattgtcaacgatcctggtgaaggttcccaagccaaacgtcgcgctcaagcggtgattatagatcacttaacgccgccgatgactcgtgcggaactctacggttctttgcaacagttagaaaatttaattgatgagtattatgaagcggatagtttagatccttcacgtttgccagtaattcgcgatcgcatccacgaactggtgatcaaagaaaatctccatctagatttgggaatccaaaatgaaacagaaatttttaagtctgaatctctagttttgaattccatcggtggttatctttgtgaattgaaagaagcccaaatccgcgacgggttgcacatttttgggcaatgtccccaaggaaagcagctgcgagatttaatagtagcgatcgctcgcatacccaatcgccattcttcaggtattacccgcgccatagctcaagattggggtttagacttcgaccccctcacagcagatttgtcaatgcctagcggtgaatactcaatagtcaatggcacagagtgccgcaccattggcgatatagttgaagtcctagaagaacacgccgcccttttagtagaacaactaataaatcaggattcagaattcagaattcaggaatcttgtagagacgcgattcatcgcgtctctacctggatacgcgatcgcctgcttccagctttacaacaaaccgatcgagaaatcacccatttattacatgggcttgatggcggttacgtccccagtgccccatctggcgcacccacgcgcggccgcccagaagttctaccaacagggagaaacttttattctgtcgatattcgcgccattcccacagagacagcttgggatatcggcagaaaagccgccgaaaccctcgtagaatattacactcaagagaatggtgagtatcccagaacactaggcttatcattgtggggaacagccaccatgagaacaggcggtgatgacatagccgaagcgttagctttgctgggagtcaaacctgtatgggatggtgcagcgcggcgagtagtagattttgaaattttgcccctagcgattttgggacggccccgtgtagatgtcaccttgcgaatttcaggattcttccgcgatgcttttcccaacttaattgacttattcgatcaagcagtatcagcagtagcagatttggatgaaccaccagaacaaaatccccttgcagatgcagttcgccaagaaactgaattgtggacaagccaaggattaactttagaagaagccgtggtgcgatcgcactatcgcatctttggttctcgcccaggtgcttacggcgcaggactccaaggtttaatcgaatcgcaaaactggacagacgatgaagatttagcccgtgcttacattaactggagttcttacgcctattcttcgggaaatttggtaggggagcagggagcagggggagcaggggaggataaaattgccaatccccaatcctcagtccccagtccccagtccccagtccccaataccgaagccttcaagcaacgcttatcccagatgcaagttgtcctgcacaatcaagataaccgcgaacacgacctactcgattctgatgattattaccaatttcagggtggtttaacagcagccgtgcgttctctacagggaaaaaaccccaaaacatattttggtgataattccatacctgcccaaccacgagtccgccaactcaaagaagaaatttcacgggtgtatcgttctcgtgtagttaatcctaagtggattgcaggagttatgcgccacggttacaaaggtgcttttgaaatggcggcgacagtagattttttattcgcctacgacgctacagctaaatgtgtagaagattatatgtatcaaggcatagtagaggcttacttgctcgatccagttgtgtcagaatttattcaggaaaagaacccttatgctctgcgtgatattgctgaaaaattattagaagcacataagcgcaatttgtgggaggatgtaaatataggaacattagaagctttgaggaacctagtacatcaagctgaagcagttatcgaagaaaaatcaatg

SEQ ID NO: 43766 - DNA, 2323 bp, Nostoc punctiforme
atgacaacaaccatcgactttctcagtcaccttaaccctagtcaacgtcaagctgtcgaacactactgcggcccgttgctagttgtagctggcgcaggttccggtaaaacacgagcgctgacttatcgtattgccaatctgattctgaaacaccgtgtcgatccagagaatattctggcggttacttttaccaataaagccgcacgggaaatgaaagaacggattcaacggctgtttgctgaacaactggcaatgaaacaacacggtcagcgattggatttgttgacagaataccaacaaacgcagctgcgatcgcaagtttacaaaagcactattaaagacttatggtgtggcactttccacagtctattttctcgtatactccgctttgatattgaaaaatacgtagacgaaaaaggacgcaagtggaatcgtaatttttctatttttgatgaatcagatgtgatgactctgattaaagaactcgttaataaagagctaaatttagacgataagaagtttgacgctcgctctgttcgttacgctattagtaacgctaaaaaccaaggtttatcgccccaagaatttgagcaagaccaaccaaattatcgcggacgggtaattgcccaagtttacaatttatatcaagataagctagcacaaaacaacgctcttgactttgacgatcttattcttgtacctactagattatttcaacaaaacgagcaggtattgggttactggcatcgcaaatttcgtcatatccttgtagatgaatatcaggatactaaccgcactcagtatcaactgattaatttattagtgactaatggcgaaaccaaaaagaccgaatggcaatgggaaaatcgctcagttttcgttgtcggcgatgcagatcaatcaatttacagctttcggatggcagatttcaccatcttgctaggatttcaggaagactttggtgatggtttggtagatgatgacacccggacgatggttaagctggaagaaaactatcgttcttgtgaaaacattctgcaagcggctaatgaactgattgaaaataacacccaacggattgataaaattctgaaaccgacgcgggggggcgggtgaacagattacttgtcacaaggccgatgaagaacttgcagaagcggcatttgtgatcgatcaaattaacactttaaaaaaccaaaatccagagttagactggggtagttttgccatactttatcggacaaacgctcaatctcgtccctttgaagaattgttggtaaaatatcaaattccttacacagttgtggggggaatgagattttatgatcgcaaagaaattaaagatgtgattgcgtatttaagagcgatcgctaacccatctgatacagtaagtttattacgagtcatcaatactccccgccggggagttggcaaaactactattgatgctttgatgaatgcctcccagcaactaggcacaactttgtgggaaatactcagcgacgaaacatcagttaatacattagctggacgggcgacaaaagctgtaaataactttgccgcaatgattagccgttggcaagggcaaattgccacgcttccggtaactgaggttttgcaaggaatattagaagattctggttacgttcaagacttgatgaatcaaggcacagatgaagccacagatcgggtacaaaacgtccaggaactttataacgctgcgctgcaatttcaagaagaaaacgaagagatttccctgcgagattttttaagtagtgctgccctcagttccgatttggataacttaaaagaaggacagacagccgtttctttgatgactttacacgcttccaaaggtttggaatttcccgtagtgtttttggtgggattagaacaggggctatttcccggctaccgttccctaagcgatccggcatctttggaagaggaacgccgcttgtgttatgtggggattactcgcgcccaagaaaggttgtatttatcacacgcgcgggaacgccgtttgtatggttctcgtgaacctgcgatgcgatcgcaattcctcgacgaattgccagaagagttattagctacgaaacgcgcaagtcgtcaaagttataccaaaagtgcctctagttctaatggtaaacaagacacatcacagaattggcaagtaggcaatcgagtattacacaaaacttttggtcttggtgaaattactcatgtttttggaacaggtaataaaatgtctgtagcaattaaatttgccagcttgggacaaaaaattgttgacccaagagtagcacagttgcaaaaagtctga

SEQ ID NO: 43767 - DNA, 675 bp, Nostoc punctiforme
attcaaggtaaagttgctctgattacaggggcttcgcgtgggattggacgagcgatcgctctcgaactagcgcaagtcggcatcaagcgactgatattggtagcacgggatcgccaaaagttagtcgaggtagctaacgaaatagaggcgatgggaaccgaaactgcgatcgtgccattagatttgactcagactattgaagtaaatatcgctgttgcccaactgtggcgcaatttcgggcagattcacctgctggttaattgtgcgggagtcgcataccaaagttcgtttttgcaatctaagatgcctcaagttcaagaagaactctctgtgaacttgttagggatgtacaacctcacgagtctgatagctcgacgtatggtcagccaaaggcaagggacaatcgtcaatgtctcgagtctgatggggaaggtggctgcaccgacaatggcgacttactcagctaccaagtttgccatcttaggatttacccaagccttgcgccgcgaactagctgaacacaatatccgagtgattgcattactgccttccctcacagacacagacatggtgcgcgacttaaaattatttcgctgggtgatccccatgactccgcagcaagtagccaaagcactcgtcgccggaatgcagaatgattcaccagaaattttagtc

SEQ ID NO: 43768 - DNA, 819 bp, Nostoc punctiforme
ttacacaatttgtaattattaagtttcaaaaaattctgataactaatgaaaatcgctacttggaacgtcaactcaattcgcactcgcctcgaacaggttactgattggttaactaacaatcccgttgatgttctctgcttacaagaaaccaaagttgcggatgccgagtttccgcgatcgccttttgagcagttgggctataacctttatatatcaggacaaaaatcttataatggcgtagccctgattagccgccagccacttttaaacgtaagtagcgggtttagggcgattttgccagatttacatcacgaatgggatgagcaaaagcgtgtaataacaggtgtaattgatggtgttcggattgttaacttatatgttcccaatggtgcagcagtaggaactgagaaatatgaatacaaactgcgctggttaacagcgctacacgagtatttgcgagtgcttgcgctgtcggaacctgcaatttgtgtgtgcggtgacttcaacatcgccctagaagacaaggatattcacgaacaagtgagtacagaaaatcacattatggcaacagaaaccgagcgtcaagccttacgcgagattctgcaactagggtttgctgatgcttttcgcaaattcaccacagaaggcggaaattatagctggtgggattatcgcgccgccgcctttcgtcgcaacttaggttggcggattgaccatcactatctcacacccgtgctgtatgagcgtgctacaagttgtattattgatgccgaacccagaaaatcaacccaacccagcgaccatacgccggtaattgtg

SEQ ID NO: 43769 - DNA, 963 bp, Nostoc punctiforme
ggaggaatagaactggtggtgagtcgcttgactgatgaacttgttcgtcgcggtcatgaggtaacattatttgcctctggcgattctcaaactttggctaatttagaagcagtttatccacgtgcattacgcttagacccgaatgttaaagagtatgcagtgtacgaaatgctagaactgagcaaagtttaccaacgtgctaaagaattcgatcttatccattctcatgtagggatttcggcattacctttagcgagtttcataacagcaacttctacagtgcataccctgcacaataattttacaaacgacacccgtcacgcatttagctactaccagaagcaaccatacgtcagcattagtaactcgcagcgtcaagtcgatctaaattatgttggcactgtttataacggaattgagctagcagattatcctttcgtagcccaaccgtcagaacctctatatttagcatttttaggtcgtttttcgccagaaaaagggccacaccatgcgatcgctattgcaaagcagagtggttggcgcttgaagatggcaggaaaggttgatgtcggcgactctaagttttttgaacaagagattgccccccacattgatggtcagcaaattgaatatctcggcgaaattaaccacgccgaaaaaactgaacttctgggcaatgctgccataactctttttcccattaactggcaagaaccttttggtttagtgatgactgaatcaatggcaactggtacaccagtaattgccatgaatttcggctcagtacctgaagtaattgcccacggtaaaacaggttttatctgcaaaagctatgcagaaatgacggcaatgattcccctagctttggaactcaatcgtcaaacctgtcgaaaacatgtagaaagcaactttagtgttaaccaaatggttaacggatatgaagctatttacagacaaattatt

SEQ ID NO: 43770 - DNA, 909 bp, Nostoc punctiforme
aaaatgagcattatcgtctttggcagcataaatatagacttggtagcaacaacaccccgattgccagtcccaggagaaacgttgctaggagaagaattttttaaagtttcgggaggtaaaggagcgaatcaagctgtagcattagcaaaactgggaattcctacccaaatggtggggcgtgtcggtgcagacgattttggtgtggaacttgtcaacaatttgcaatcatctggtgtgcagattgataatatttttgtggatgaaactgttagttctggagttgctattatcgccgtaaatcatgctggggaaaatcaaattattgtaattcctggtgcaaatgggcgtgtcaatcaagaagatgtagaacgattgtcgcagttattaccagaagcgacagcactgcttttacaattagaaattccaattactaccgtgattgcagctgctacagcagcaagaaaaagcaaaatcagggtaattctcgatccagcacccgcacaatctaattttccagatgaactttatccattagtggacattattacacccaatgaagttgaagccgcgcagctagtgggttttcctgtggatggagaggaacaagcggcaaaggctgctgaagttttattacaacggggtgtgaaatgtgcgattgttaaacttggtgctaaaggtgttttttgtgccactgctgaggaaaagttttttgtccccgtctttccagttcatgcagttgacacagtagcagctggcgatgcttttaatggtggcttaacggcggcactttttgcaggattttctttacatcaagcagttgtttggggcgcagcagcaggtgctttagcgacgacaaaatcaggcgcacaaacttcactacccgataggtttacatttgatgcctttctt

SEQ ID NO: 43771 - DNA, 1557 bp, Nostoc punctiforme
ttaggggtacgcgatgtctttggacaatttttgattatttcttttctcactgtcatcatttggatactagaatctgtttttgaatacgcctacgctcgactttggcggaatttagctcagaatattcagcatgacttgcgtttagatgcctacaaacatttgcaagagttggaattggcttattttgaagaacgcagcactggcggcttaatgtctatcctcagtgatgatattaaccaattagagcgttttttggatggaggagcaaatgatattattcaagtttctgcaactgttctaattattggcgctgctttctttattttggctcctagtgtcgcgtggatggctttgtcaccgatgccatttatcctctggggttcttttgcttaccaacgactgcttgcgcctcgctacgccgatgtccgggaaaaggttggtttcctaaattcgcgtttgtcaaacaatattagtggaataactaccattaaaagtttcactgccgaaacttatgaagcctctcgtttggaattagatagtgaagcttatcgccgcagtaactccaaggcaattactctttctgctgcttttgtaccgttaattcggatgctgattttagtgggtttcacagcattactcttatatggtggcatggcagcagtttctggacaaatgtctgtaggtacttacagtgtattagtgtttttaatccagcgcttgctatggcctttaacaagattaggcgaaacttttgaccaatatcaacgagcaatggcttctactaatcgagtcatgaatttgttagatactcctatcgccattcatacaggaaatgtggcgttacctgtgaatgaagtgcgcggtgaagtgcaatttaaaaatgtttattttgcctataaagatagatttccagtaattaaaaatctgtctttggatattccggctggaaaaaccattgcaattgtcggttcaacaggttctggtaaaagcactttagtcaagcttttgttgcggttatacgaagtgcaaacaggaaacattactctcgatggtattgatttgcaaagtttaaatttgcaagatttacggcgctgtattggtttggtgagtcaagatgtttttctatttcatggcactgtagcagagaatattgcttacggtagctttgagactacagagcaagaaatcatcacggcggcgaagatagccgaggcgcacgaatttattgttgaattgcccgaaggttatgagacaattgtgggggaaagaggacaaaagttatctggtggacaaagacaacggattgcgatcgcccgtgcagtcttaaaaaatccacccattctgattttagacgaagctacctcggcagtggataatgagacagaagctgcaatccagcgatcgctcgaacggattacagtagatagaactacaattgcgatcgctcatcgtctatccaccatccgcaatgccgattgcatttatgtcatggaacatgggaaattagtagagtcaggaacccatgagcaattgctggagaaagacgggatttattcc

SEQ ID NO: 43772 - DNA, 1278 bp, Nostoc punctiforme
gtgaaattaggaatactcggattaggcactgtgggaacggggacagtgcagttgttgcaagataaggctggacggcacccgttgttacaagagatagaaatctatcgggtgggagtaaaatcgctcgataaaccccgtgcagtagaattatctacagaagtagtaacgacagatttagaatcaattgtcaacgatccggcggtagatatagttgtcgaggtgatgggcggactggagccggcgcgatcgctaattctcaaagctttgagtaatggcaaacacgtagtcaccgccaacaaagcagcgatcgctcggtttggggcggaaattttcacaactgccaatcaagctggcgtatacgtcatgctagaagctgccgtgggtggtggtattccggtaattcaacccctaaagcagtctttgagtgttaatcgcattcacactgtcacaggcatcgtgaacggtacaactaactacatcctgacgcggatgcaaacagaaggcagcaactttagcgatgtcttagctgatgcccaacgtttgggttatgctgaggctgaccctacagccgatgtcgatggcttagacgcagccgataaaattgccatcctggcatcattaggctttggtggacgcatcaacctacaagatgtttatactgaggggattcggcaagtcagcaaaacagatattgcctacgccgaaaaattaggatttgtgattaaattgttagcgatcgctaaacgtgatactccctcatcaccactttccgttagagttcatccgactttagtgccccaagctcaccctttggctagtatcaacggcgtttacaacgccattctcgtcgaaggagaaccaattgggcaagtaatgtttttcggccctggtgctggtgctggtgcaaccgccagtgctgtgacatcagatatcttaaatctagttgctgtcctcaaaaccaatacagcagttgcaaatccattaatagcttgtggacatcaagaatactgccaaattgcgccgatggcagaactgataactcggttttatgcccgtttccttaccaatgaccaaccgggagttatcgggaaattggggacttgctttggtaattatggcgttagcttagagtcaattgtccaaactggctttcaaggggaactagcagagattgtggttgttacccatgatgtgccagaaggcaattttaggcaagctttggcagaaattcagaatttggaagcgattgaaagcattcccagcttactgcgtgtactt

SEQ ID NO: 43773 - DNA, 1218 bp, Nostoc punctiforme
gtcaccgaaggtcatccagataaaatctgcgatcagatttctgataccattctggatgccctactgacacaagaccccagcagccgtgtcgctgctgaagtagtagttaacactggtttggtgctaatcactggtgaaataaccaccaaagcaaatgtgaatttcgtcaatctcgcccgcaaaaaaattgccgaaattggctataccaatgctgataatggcttttctgctaacagcaccagcgttctgctggctttagacgaacaatcacccgatattgcccaaggtgttaacaccgctcaagaaactcgccagcaagatagtgatgagctattcgacaaaattggtgcaggcgatcaaggtataatgttcggttttgccagtaacgaaacaccagaactgatgcccttacccatcagtctcgcccaccgtattgctcgccgattggcagcagttcgtaaaacaggtgaattgtcatacctgcgtcctgacggtaaaacccaagtaactgtggtctacgaagatgggcggccagtaggtattgatactattctaatttccacccagcatacagctacgattggggaaattacggatgaggcggctgtacaagccaaaatcaaacaagacctctggtcagcagtagtcgaacctgtttttggcgatattgacgttaaacctaacgatcagacgcgttttttagtcaaccccactggcaaatttgtcgttggtggtcctcaaggagactctggtctgacaggacggaaaataatcgttgatacctacggtggttattcacgacatggtggcggcgctttttctggcaaagaccccacgaaggtagaccgttctgcggcttatgcggctcgctatgtggcgaaaaacattgtcgctgctgggttagcagaaaaagttgaaatccagctatcttatgctattggtgtagcgcgaccaacaagcattttggtagatacctttggtactggcaaggtggatgaagaaaccttactcgaattaatcaaccaacactttgaactgcgtccagcagggattatccataccttcaacttacgcaacttaccaagtgaacgaggcggacgtttttatcaggacgtcgcggcttacggtcattttgggcgggctgatttagacttgccttgggaacagaccgataaagccgaattgttgaagcaagcagcaaacgagtcactttcggca

SEQ ID NO: 43774 - DNA, 1854 bp, Nostoc punctiforme
atggcgctcatagttcagaaatacggtggtacatctgtcggttcagtggaacgcattcaagctgtcgcacagcgtgtttataaaactgtccaagctggaaactctctggtagtagtggtttcagcaatgggcaaaaccaccgatggactcgtcaaactagctaatgaaatttctcccaatccaaaccgccgggaaatggatatgctgctttccactggcgaacaagtaaccatcgccttactcagcatggctttgcaggaactcggacaaccagcaatttctatgactggcgctcaggtaggaattgttaccgaagctgaacacagccgcgctcggattttgcatattgacactactcgcctctgtcgccacataaatgcaggtaaagtagttgttgtagcagggttccaaggcacatccagcaccggggaaatggaaattacaactttggggcgcggtggttctgacacttctgcggtagcgatcgcagccgcattaagagctaacttttgtgaaatttatacagatgttccagggattctaactacagacccccgtttagttgccgaagcccagttgatggatgacatcacctgcgatgaaatgttggaactagctagcttgggcgcaaaagtgttgcatccccgtgctgtagaaattgctcgtaactatggtgttcccctggtagttaggtctagctggacggatcaaccaggtacttgggtgacatcagccaaaccccaagggcgatcgctaatcaatctagaaattgcccgtccggtggatgctgtagaatttgacactgaccaagcaaaggtggctttgttgcgcgtacccgataaaccaggtgtagcagccaggttatttggcgaaatttcccgacaaaaagtagatgtagatttgattattcagtcaattcatgaaggtaacagtaatgacattgcttttactgtcaccaccccaatcttaaaacgggcagaagcagtagccgcagcgatcgctccagcactgagaaatccatctaaccccaaatctgatgaagccgaggtaatgctggaacataacattgccaaagtcagcatcgcaggcgcaggaatgattggccgtcccggtgtggctgcaaaaatgtttgccactttagcagaagctggcgtgaatattcaaatgatttccaccagcgaagtcaaagtaagttgcgtagtcgatgctgccgaatgcgatcacgccgttttagcactccgcactgcctttgaaatagaagcaggggagcaggggagcaggggagcaggggagagtgcatgtatagattcccctccgcccctttgcccctccgcccccctgcccaattgtcctcccgttcgcggtgttgctttagatttgaatcaagcgcgtctcgctattcgccaattaccagatcgtccggggatggcggcgaagttatttggattattagcgcagcataatatcagcgttgacatgattattcaatctcagcgctgtcgggtgattgatggcgttcctaggcgagatattgcttttacagtctcgcggatagacgcggaaagcgcaaaaaaaatgcttactcaagtagcggcagagttaggatggggtgaagttgttttagatagtgcgatcgctaaagtgagtattgttggtgcaggtatggtaggacaaccaggtgttgctgccaaaatgtttgaagcgctagcccagcaccaaattaatattcaaatgattgccacctcagaaataaaaattagttgtgtcgtagcacaagagcaaggtgttaaagctttgcaagccattcatgccgcttttggactagctggtagtgagaaagtagtcgtgccagca

SEQ ID NO: 43775 - DNA, 987 bp, Nostoc punctiforme
gggttagataaatatgatgcaggaaattatgaaggagcagttaaagatttcaatcacgttattgaattagatccaaaaaatgctttagcttataataagcgaggcgatacttattatcgattaggagactatgagcaagcacaagcagactctagtcaggccattttactcaatcctcaagatgggaatgcctattttgaccgaggatttgctttttcggaattaggcaaatacaaagaagcgatcgcagactatactcaagcgattaagttaaactctgatgatgcttatgcttactatggacgagggttagcccgtgttcaattgaaagataataaaggggcaattggagattttagtaaagcgatcgccctcaagcctcaatataccgaagcctacttacagcgtgggattatccgccgtcgcctcagactcaagcaaggggcaatcgaagattttgatacagtaattaaaattaatcctagtgatgccaaagcttattatcagagggctttaactcaatctattaataaacaaaaatatgcagcccttaaagattacacagatgcaattaacattaatcccaaatatatagaagcatatctcaatcgaggtgatgttttcagcgatctgggaaataaaatcgaagctactgaagattacaatactattttacagattgaccctaaatttattgccgcttatattcacagaggtattcaccgcttttctttcggagattataaaggcgctattgaagattacagcgaagctctgaaactagatcctaataatatagcagcttacaacaatcgtggtaacgcttatcttgaactgggaaataaaaaatctgccaatcaagattattcacaagcgatcgcaattaatgctaacaatgccttagcctactataatcggggtgtgattcgcaccaagcagaaaaataaacagggagcgatcgcagatttcaaaaaagctgcaaaacta

SEQ ID NO: 43776 - DNA, 1374 bp, Nostoc punctiforme
gatttgctctacacttccagtcaaatagcaacaagtcttcttcagaatgcaaaagatttacaagagaagcgagttgccttcctcatcccacctggatttgagtatgtagctactcaatggggaatttggcgtgctggtggcatagctgtacctctgtgtgtttcccatccccgcccagaattggagtatgtaattactaattctggagcatcgattattgttgctcatcctaattttgaaagtatactgcgctcgctcgccgaagaacacaatttgcgatttatcctcacctcagaaaccctcccatctaatgttgctcctctcccagaagtagatatcactagacgcgccttaattctctacactagcggtacaacaggtaaacccaagggtgtagttacaacccatcaaaatattcaagcgcaagtgactagcttaaataccgcttgggaatggacatctagcgatcgcattttacatatattgccactacatcatattcatggaattattaacgtcctgacatgtgctttatgggctggcgcggagtgtcatctgttgagcaagtttgatactgaaaccgtttggaggcgaatctgtgatggtgacttaaccctatttatggcagtaccaacgatttatgtaaagctgattactgcttgggaaaatgcctctaaagaacgtcaaaaaaccatgtcagaaggctgtgctaaaatgcgtctgatggtttccggctcggcagcgttaccagttcaagttttagaaaagtggcagagtattagtggtcattttctgcttgagcgatatggaatgacggaaattggtatggcgctatcgaaccctttacacggtgaacggttggctggatatgtcggcaagcctctgcctaaagttgaagtgagattagtagatgagaagggattagtctcagccggaacaccaggagagatccaagttaaagggcccggagtgtttcttgaatattggcaaaaccctgaagcaaccgccaaagccttccaagatggctggttttgtactggagataccgccgtagttgagaacgagaattaccgcattctgggacggatgagtgtagatatcatcaaaaccggaggctataaagtttcagctttggaaattgaagaagtattgcgatcgcatccagatattcaagaatgtgcagtagtcggggttgcagatatagagtggggcgaacgggtttgtgctgcattagtattattgcaaggatcaaaacctttaacattagaatctttcagaagttgggcaaaagagcgattggctgtttataaagtgccaacccaaattttgatagttgaagaattaccgcgcaacgctatggggaaagttactaag

SEQ ID NO: 43777 - DNA, 1197 bp, Nostoc punctiforme
cgtatcgccttgatttccgtccacggagacccggcgattgaaatagggaaagaagaagctgggggacaaaatgtttatgtgcgccaagtgggtgaagcactagcgcagctgggatggcaagttgatatgtttacccgcaaggctagtctggagcaagattcgattgttgaacatagcgacaattgccgaactattcgtttaaaagctgggccccttgagtttgtgccgcgagatgaaatttttgaatatttgccagaatttgtggagaatttcctcaaatttcaggtaaaaaatgagattcaatatgagttagttcacactaattattggctctctagttgggtggggatgcagttaaagaaaatccaagggagtaaacaggttcacacctatcactcattaggagcagtcaaatacaacactatagaaaatattcctctgattgctagtcagcgattggcagtagaaaaacaggtgttagaaacagcagagcgaattgtagcgaccagtccgcaagaacagcaacacatgcgatcgctagtttccactgaaggcaatatcgatattatcccctgtggtacagatattcagcgttttggttccattgggcgagaagcagccagggctgaactggaaattgccaaagatgccaaagttgtattatatgtagggcgttttgaccaacgcaaaggtatagaaaccctagtgcgtgcagtcaacgagtctgaactacgcgactcgaagaatctcaagctaattattggcggtggtagtactccaggtaacagcgacggcatagaacgcgatcgcattgagcaaatcgtccacgaattaggaatcactgacttgaccatcttctctggtcgtctcagtcaagatattttaccaacttattacgctgctgccgatgtctgcgttgttcctagtcactacgaaccatttggactggttgcgatcgaagcgatggcaagcggtacgccggttgtggctagtgatgtcggtggacttcaatttactgtagttaatgaacaaactggtttattagcaccaccacaagatgtaggtgcttttgcgtctgctattgaccgaattctctttaatccagagtggcgagacgaattgggtaaagctggcagaaagcgtactgaaagccaatttagttggcatggtgtcgcaactcagttgagtgaactttac

SEQ ID NO: 43778 - DNA, 1983 bp, Nostoc punctiforme
  unsure (1)..(1983): unsure at all n locations
atgtcaactctcgtcatcgtcgaatctccaaccaaagctcgtaccattcgcaactacttgccagcaggctatcgggtggaagcgtctatgggtcatgtgcgtgacttaccccagtcggctagtgaaattcctgctgccgtcaagggggaaacatgggcgcagctaggggtaaatgtggacgccgactttgaaccggtatatgttgtcccgaaagacaaaaagaaaattgtcacccagcttaaagaagcccttaaagatgtagatgaactgattctggcaacggacgaagaccgggaaggtgaaagcattagttggcatttataccaattgctgaagccgaaagttccaactaagcggatggtgtttcacgaaattacccaagaggcgatcaaaaaagctctgaaggactgccgccaaatcgatgagcagttggttcgcgcccaagaaacgcggcggattttagatcgacttgtgggatatacgctgtctccactgctatggaaaaaaatcgcctggggattatctgctgggcgggtacaatctgtagccgtgaggcttttagtcacaagagaacgccaacgccgcgctttccatgagggcacttactgggatttgaaagccagtctgtcaaaggaaaaaaccccctttgctgctcagttggtaacattggcaggaaccaaaattgctaacggtagcgattttgacgcaacaaccggacaaattaccgcaggtcgcaatgtcttgttgctcaacgaagaccaagcggtagccctcaaggaacgcctaactgggaaaacctggagtgttaccgagatggaagaacgtccagtgacgcgcaagccgtcgccaccgtttaccacctcgacactgcaacaagaatctaaccggaaactgcgcctctcagcccgcgatacgatgcgcgttgcccagaatttgtacgaacaagggtatattacctatatgcggacagattcggtgcatttgtcagatcaagcgatcgcagctgctcggagttctgtagaaaagctttacggtcaacaatacctcagtccccaaccccggcaatacaccactaaatccaaaggcgcacaagaggcgcacgaagcaattcgtccagccggtagcacctttcgcaccccccaagaaactggtttgggcggtcgagaacttgccgtttacgatttgatttggaagcggactgtcgcctgtcaaatggctgattcctgccaaactcaaattagcgtgcaattacaagttgaggatgctggattccgttcctctggcaaacggattgaatttcctggatatttacgtgcttacgtcgaaggttcagatgacccagaagcagcactggaagaccaggaagtaattttgccgaatttgaaagtgggagatcatccgaattgtacagatttagaagcagttgggcatgaaactcaaccgccagctagatacaccgaagcttctttggtgaaaaccttagagagtgaaggtatcggtcgtcccagtacctacgccagcattattggtacgatcatcgacaaaggttatgcccatttggtgagtaacgctctcattcctaccttcaccgctttcgccgtcaccgacttgctggaaaaacatttcccagacatcgttgatcctagttttacctcgaagatggagcaaacccttgatgacattgccacaggtgaagcgaaatggctaccctacttgcagaaattctatctgggagagaaagggttggaaaccctggtaaaagaacgggaaagtcaaattgatgccaccacagctaggactgtagaactggagaatctagatgccaaagtccgcattggtaaatatggcccctacattgaagttacaaatggtgagggggtaatcaccgcctcaattcccaaagacttgacaccagcagacctcgaccccaaacaggtagaagttttgctgcgacaaaaaatcacaggccctgnccaggtaggg

SEQ ID NO: 43779 - DNA, 1056 bp, Nostoc punctiforme
atgattatagtaatgaaaactggttccccagaagcggaaataaaccgcattgatgaggaactaactagctgggggctaactccagaaaaaattgttggtcaacataaagtagttattggtcttgtaggtgaaactgctagcttagatccattacaaattcaggaacttagcccctggattgagcaggtgttacgggtagagcagccttacaaacgagccagtcgccaataccgtcacggtgaggcttcggaagtagtagttaatactcctaatggagcagtggtatttggtgaacatcagcctttggtagtcgttgccggtccttgctcagtagaaaatgaagaaatgattgtagagacggcacggcgcgtcaagacagctggagcaaaatttttgcgcggaggggcatataaaccccgaacttcaccttacgccttccaaggacacggcgagagtgctttggatttattagcaagggcgcgggaagttagtgggctaggtattattacagaagtgatggatgcggctgacctggataaaattgtcgaagttgctgacgtgattcaggtaggagcaagaaatatgcagaatttctccttgctcaaaaaagtgggagcgcagccgaaaccagttctcttgaagcggggaatggcggctactattgaagattggttgatggcagccgagtatgttttggcatctggcaattccaatgtaattttgtgtgaaaggggaatacgcacctttgaccgccaatatacgcgaaatacgctggatttatcggtagtgccagtgttgcggaaactgactcacctgccaattatgattgaccccagccacggcgtaggttggtctgagtttgtgccttcaatggcaatggctgcgatcgcagctggcacagattccctgatgatagaggttcaccccaatcctgccaaagccttatccgacgggccccaatctctcacaccagaccgtttcgataacttgatgcaagaattagcagtaattggtaaggcagtgggacgttggcagcaaccagctgtggctctggct

SEQ ID NO: 43780 - DNA, 741 bp, Nostoc punctiforme
agtaccaaaaaacttacaggtaaggtggcattggtaacaggcggctcacgcggtctgggagcagcgatcgccaaacgtctcgcaaacgatggtgcaatcgtcgctctcacatacactagctcgccgcaaaaagccgacgaggtagtgcttgccatcgaagcggctgctggaaaagccctggctcttcgcgccgacagtgccaatgtcgaagccgtgaaaaacgctgttgccgagacagtgaaagcctttggtcgtcttgacattctcgtgaacaatgcgggggtcgccactttagccccaatcgatcaattctcaatggatgattttgatcggctgattgcggttaacatcaagggtgtctttgtggcaactcaggaggctgttcgccacatgggtgagggcggacggatcgttatgattggcagtgtcaacagtgacataatgccttttgctggcggctctgtttacgctttgaccaagggtgcgattgcaagcttcacacgcggtcttgcccgcgatctcggccctcgtggcatcacggtgaacaatattcaacccggcccgatagacactgacatgaatccggcggaaggtccctttgccgacaccatgaaaagtatgattgccctccaacggtatggtcgaacagaagaagtcgccgagatggtttcctatctcgccagtgcagaagctggtttcatcaccggtgcaagcctgaagattgatggcggctttgcagcc

SEQ ID NO: 43781 - DNA, 1323 bp, Nostoc punctiforme
agatcgcaattgatgtccaggtctgccaactactgtacaacagctttggtacaactgagacacatcctatcttggcagcaacaatatcaacagttaagtaactccaatcaagaattggagcgcaccaatcaactgaaaaaccagtttctggcaaacaccagtcacgaaattcgcacgccgcttagttctattattggctttaccaatctgcttttagctccagggtacgaaccaactatagaacgtcaacgggagtatttaaatatcattcagtctagcggtaagcacttgctagctctgattaatgatattttggatctttcaaaaattgaagcgaaccagctagaggtgcagtgggaatgtgtagatgtgccactgctatgtagcaatgttttagcactggtgaaagagaaagccgctaataaggatttaagactttgcctagaaattgaccccgatatcacaaccctagtagccgactctttgcgactcaagcaaatgctgttgaatttactcttcaatgccttaaagttcaccagcaaaggaagtgttggcttacaggttgttgccaaaggtatatctgtacattttacagtttgggataccggaagtggcatttctcaagaagaccagactcaattatttgaaccttatttccaaattgctaaggctgtcgctggtggtgctgaggggactggtttgggtttagcagtgactcggaaactcgcccaaattcacggtggttctgtgaaagtggaatctgaagtagatagcggctcccgttttacccttgtacttccccttcagcaagaggcgggagcgggaatcgataagagagatgagggagatgaggaagcaaaatattcctcatctcttctgcctttcatccctagttcttctgtagatgttttgctggtagaaaatgacttacccaacgctgatttgatgcaaatttatctacggaaattaggatatcaggtgacttgggttaagaatgctgccgagatgtgggaagctctaacacagctagacccagcagtgattttaatggatgtttatctgccagatggaaatggtctgaacttggtgcgacaactgcgagaacacgagcaatatcagacgattccggtaattgttcaaacagcaatggcgatgaaaggcgatcgcgaaacctgtctaacagccggagtaaatgactatatttctaaaccgattgatttaccacttttagccagtctggtagccaagtacagcaaaccgccaatatagagagcagggggcaggaggacaaggggacaaggggacaataagtgagaacttgaa

SEQ ID NO: 43782 - DNA, 630 bp, Nostoc punctiforme
gagggtactaaagggaacacaatccaaaccggaaacggtgaagacacggtactagccggcagcgactcttcagtatccacaggagacggtaacgatcagatatttattggtcaaaatggcccggctcaaaataccagtgctgatggtggcaatggtaatgatgttattaccgtagtagaagccagtggtagtaataatttacttggcggtacaggtgatgatagcctcactgtaattgaaggttctcgtcaatcattatttggtggctcaggtaatgacaccctcagaagtggcggtagcaataaccgtctctacggtggttctggcgatgacaaactcttctccaatttcaatgattccttgtctggtggcgatggtgatgatgtgctatttgctggtcaacagggtggtaatcgcttaactggtggtactggtgctgaccaattctggattgctaacgccaatctgccaactagcaagaacattgtgactgattttgtagttggcattgataaaatcgggctgggcggtattggtgttactcaatttagtgccttaactctattacaacaaggtagcgatactttggtgaaagccggaaatacagagttggcttcattagttggagtt

SEQ ID NO: 43783 - DNA, 825 bp, Nostoc punctiforme
caaggttatgtggactatgcgcccgtcagtaatgccgatgtcacgcctacacttgctcgtattttagggttagatattccaagtaatggcgatttgaaaggtcgtgccattacagaagcactggtgggaggcccggatgtagttccctctactaaagaagtattgatttcagaaaaaactactaatggtcaagcaacagttctggattctcaaagtgtaggcaatactcagtacttcacagccgcagggtttgatggtcgcactgttggactaacaacactagaccttcaatttggttctactaatagtgatgatgtcaccctcaagccaaatcaaaccttatttgcaggtgacggcgcagactttgtagaaggtactaaaggtaacacaatcgtgactggtaacggtgaagatacggtactagtcggcagtggctcttcagtgtccacaggagatggtaacgatcaagtttttattggcgtaaatagccctgctagtaacactagtgctgatggtggcaatggtaatgacgaagttaccgtagtggaagccaatggtagtaataatttgttcggaggcgcaggtgctgatactctcacagtagttgaaggttcgcgtcaactgtctttcggtggctcaggtaacgataccctcaagagtaacggtagcaataaccgcctctacggtggttctggagatgacaaactcttctccagtgtgaatgattcgctgtttggtggcgatggtgatgatgtgctatttgctggtcaacagggcggtaatcgcttaactggtggtactggtgctgaccaattctggattgct

SEQ ID NO: 43784 - DNA, 729 bp, Nostoc punctiforme
ttatcggggaaagttgcaattatcactggtgcatcgcggggaattggacgagcgatcgcactaaaattagctggtaacggcgcatctattgtcgtcaactatgcgggtaatgcagtcaaagcagaggaagttgttgcagaaattgaaaagttgggagtagaagcgatcgctattcaagccgatattagcaaagtacccgacatccaacgcctgtttgagcaaacacttgagcattttggtaaagttgatattttggtcaacaatgccggaattgccttctataaaccaattactcaggtgagtgaagaagatttcgatgcgatttttgctattaatgtcaaaggtactttttttgcttgccaacaagccgcgcaacatctatcagaaggcggacggattatcaacttttcgtcatcaactacggtgatgatgctgccaacttatagcgcctatgtaggaaccaaaggtgctgttgaacaaatcacgcgagtattagctaaagaattgggtgcaaaagcgatcgcagttaatgttatttctcctggccctaccgatacagaactattccgagaaggcaaaacccaagaacagatagatcgtttggcccaaatggctgcttttggcaaactgggagatgtgcaagaaatcgccgatgtagtagcgtttctcgctagcgatgaagccagatggatcacagggcaaaatatccgtgtaaacggtggaattgcc

SEQ ID NO: 43785 - DNA, 1116 bp, Nostoc punctiforme
gaatcagcaaaccgcatcaaagatgaatttttagccgtgctatcccatgaactgagaaccccgcttaacccgattctcggttggacaaagctgatgcggagtcgtaaacttgaccaagcaacaagcgatcgcgccctcgaaaccattgagcgcaatgccaaattacaaacccaattaattgaagatttgcttgatgtctcccgcatccttcagggtaaacttaacctcaacttcggccccattaatttggtatcagtcattgaagctgcgatcgagacagtgcgtttatcagcacaggctaagtccatcgagattcagacaatttttgaatttggtgtcggctcagttttaggtgatgccaatcgattgcaacaagtcatttggaatatcctttccaatgccattaagtttactcctagtgagggacaggtaaaaattaaattagagcaggttggctcacaggtacaaatctgcgtaactgacacaggtaaagggattgcacctgagtttttaccttatgtctttgattatttccgtcaagcagatggagccacaacccgacaattcggtggtttaggtttaggattagcgatcgtccgccatcttgtagaactccacgggggaactgtgcaagcagaaagcctgggtgaagaacaaggagcaactttcactgttagacttccatgtttacagaatgaaagtaaaggaattaaagataaaataaatactttctcactgctgccagaacagtctttacccttatttggcttagagattctagtagtggatgatgacgcagatatgagagagtttttgccatttatgctggaggagtatggtgcatctgttaccgttgtagcctcagccattgcagctttaactgcactgagtcaatcccagccagatttgattattagcgatattgggatgccagaaatggatggttatatgttgatgcgacagattaggagtctaaaaccagagcaaggtgggacaattcccgcgatcgctttaactgcctatgctggagagatggattatcagcaagcgatcgctgtcggatttcaacagcatatttccaaacctgtagatccagaagaattggtaaaggcgatc

SEQ ID NO: 43786 - DNA, 1041 bp, Nostoc punctiforme
atcacgttcaacaatcctcttggctctgaaaagtctgaggatacgactaaattacctttcaatcttcaggatttaaaagctgcaattcctgctgaatgctttcagcccaatgtgaaaaaatcacttttttacttctttcgtgatatcctgattatcggtctgctttatgcagttgcttcttacctggattcttggcttttctttccgattttctggctaatgcaaggaacgatgttttgggctttgtttgtagtcggccatgactgcggacaccaatctttttctaagcataaatggctcaatgatttgattggacatctttctcacacaccaatacttgttccttatcatggttggcgaattagccacagaacccatcacaaaaatactggcaatatcgataacgatgaaagctggtatccagtaagcgaatcacaatataaggagatgcctttagcacaaaagataggcagatattatgtttttctattggcctatcctgtgtatctgtttaagcgttctcctaataaagaaggctcccactttttacccggtagttcgcttttcaaaccttcggaaaaatgggatgttattactagcactgtccttttgattggcatggtaggtttgttgggttttctcacttaccaatggggttggatgtggttgctgaaatattacgctgtcccctaccttgtgtttatagtttggctagatttggtgacatttttgcaccacactgagcccgaacttccttggtatcgtggagaagattggactttcctgaaaggtgcaatttctagtattgaccgtgattatggtttggttaatcatatccatcacgatatcggtactcatgttgctcatcatatattccttaacatccctcactacaatttgttgaaggcaactgaggcaatcaaaccagtgatgggtgagtatttccacaaatcggaagaaccaatttggaagtcattatggaattcatgtatcagctgtcattttgtacctgatactggtagtagggtttactacacatct

SEQ ID NO: 43787 - DNA, 1041 bp, Nostoc punctiforme
atgactacatcaataattaatagccagaaactaagtgacgagcctggtaattccaacttccggctcaaagatattatcaaaacagttccacgggaatgttttcagcagaaccgtcgcaaagcttggacacaagtactgctcagtgtcttggcagttgccttgggctattacagcctgatcgttactccttggtttcttttgcccctagcttggattttcacgggcactgctttaacaggtttttttgtaattggccatgattgtggacacaggtcttttgccaaacgtcgttgggtaaatgatttggtagggcacttcttcatgatgccgttaatttacccctttcacagttggcgcattaagcataattatcaccatgctcataccaataaactggatgaggacaacgcttggcatccaatcagaccagaagtgtttgaaaattgggatacaactaggcagtctgcttttaagctattcatgcgtaaacgcttatggtgggtaggttccattggacattgggctgtagtgcattttgattggcggaacttcaaaactaaagaccaatccagtattaagctttctgtggctgtagtagttgtgtttgctgcgatctctttcccgcttctggtcgccacaactggtatctggggatttgtcaagttctggctagtaccctggatgatttaccatttttggatgagtacttttactattgttcaccatactgccgcagatgttccttttgcgacagcgaacaagtggaacgaagctctagcacaactagctggaactattcattgcgattatccgcgttgggtagaaatcctgtgccacgatatcaatgttcatgtccctcatcatatttccactgcgatcccttcttataatttgcggctagcttacagcagcatcaaagaaaattgggggccttatctccatgatgagtgtcagttttcttggcctttaatgaagcagattacagacgagtgtcaactgtacacaactgacgttggttataagactttcaacgaacattac

SEQ ID NO: 43788 - DNA, 813 bp, Nostoc punctiforme
atgacaattgctacctcaaccaaacctcaaattaactgggttaataccctgtttttcattggactgcacatcggcgctttatttgcttttgttcctggtaactttagctggacagcagttggtgtgggtttcttgctgtactgggtgactggcggtttaggcgttactctaggatttcaccgccttgtcacccaccgcagttttcaaactcccaagtggctagagtatctcctggtttttttcgggacactctcctgtcaaggaggcccaattgagtggatcgggacacatcgcattcatcatttaaactctgatactgacaccgatccccatgattctaataaaggcttctggtggagccacatgggttggctgactcattattgtccagctcacgctgatgttcctcgcttcaccaaagatattgcagaagacccagtttatcagtttttagaaaaatatttcattttgatccaggttgctctaggtgtattacttttgctcctaggtggctggcctttcgttatctggggaatttttgttcgcattgtctgggtttaccactgcacttggttggtgaacagcgctactcataagtttggctatcaaagctatgattctggtgataaatcgactaattgctggtgggtagccgtactagttttcggtgaaggctggcataataaccatcatgcctttcaatactcagctcgtcatgggctggaatggtgggaaatcgatttaacctggatgactgttcaattgctacaggcggttggtctggctactaatgtaaagttggccccagcaaaa

SEQ ID NO: 43789 - DNA, 1167 bp, Nostoc punctiforme
atgaaagcagtttgctggcatggagcaaacgatgtgcgggtagaaacagttcccgaccccaaaattctcaatccacgcgatgccattgttaaaattacttccacagccatttgtggttcggatttgcatatttacgacggctacattcctaccatgcaaaagggcgatatccttggtcatgaattcatgggggaagtcgtagaacttggaagtgcagtgaaaaatgtgaacgtaggcgatcgcgtcgttgtccctttcactatatcttgcggtagctgctttttctgtaatcgggatttatggtcactgtgcgataactctaaccccaatgcttggttggtaaaaaagcaaatgggtcattcgccagcaggtctatttggctactcccatttattcggtggttatgctggtggtcaagcagagtatgcaagagtaccttttgccgatgtaggcttgttcaaaatccccgatggtttaacggatgagcaagtgctatttttaacagatattttccccactggatatatggcagccgagaactgcaacatcaaacccggtgatattgtcgccgtttggggttgtggcccagtcggacaatttgccatcaaaagcgcatatatgctaggtgcggaacgtgtcatcgcctttgaccgcattcccgaacgtctgcaaatggctaaagaatacggcaaagctgaagttctcaactacgaagaagtgaatataggcgaagcacttaaagaaatgactggcggtcgtggtcccgatgcttgtattgatgcagtgggaatggaggcacacggcacagactttatggcgttctacgaccaggtaaagcaagcagtacgtctcgaaacagaccgtccgacggcattacggcaagtaatagtgtctgctgctaaaggtggtcacgtatcacttgtgggtgtctacggtggctttttagataaaatcccaatgggtgctgctatgaacaagggattaaccttcaaaatgggacaaacgaatgtccacaagtatctaaaacctttgctagaacacatccaaaacggtgaaatcgatccaacgtttatcatcacacatactttacctctagaacaagcgccccacggctacgaaatctttaagcacaagaaagataactgcatcaaagttgtacttaaaccg

SEQ ID NO: 43790 - DNA, 1191 bp, Nostoc punctiforme
atgaaagcagtctgctggaacggcgctaatgatgtccgggtacagtcggtaccagacccgacaattctcaacccgcgtgatgcaattattaaaattacttccacggcgatttgtggctccgatctacatatttatggcggctatatccccacagtgcaacagggtgatattatcggtcacgaatttatgggagaagtcgtggaagttggcagaggagtcaacaatttaaaaataggcgatcgcgtagttgttccttctaccattggctgtggtaattgccattattgccaacatgatatgtggtcattgtgtgataattccaatcctaaaggttggattgaagaaaaattatttggcaatatcacctcagccatttatgggtactcccacatgttaggtggttatgcaggcgcacaagcagaatatatccgtgtaccctttgctgatgtaggtgtcgtcaaagttccgccagacttaccggatgagatgttgttattcatctccgatgctattcccaccggttatatgggtgcagagttatgcgatatccaaccgggtgatactgtagcggtttggggttgcggtgctgttggacagtttgccatgattagcgcctacatgatgggagccgaaaaagtgatcgcaatcgatcgctttcccgaacgcctggaaatggcgaaaaagtttgccaaagcagaagtgattaactacgaagaagttaatgctggcgaagcgttgaaagagatgactggtggtcgtggccccgatgcttgcatcgatgctgttggtttagaagcacacggcgttggtttagaagacttctacgaccagacaaaacaaaagctcagattggaaaccgaccgtccccacgttctgcgggaaatgatggttgcctgtcgtaaaggcgggactctttcaatcatgggtgtttatggtggttttgtagacaaaatcccatttggtgctgccttcaacaagggtctaacttttaggatgggacaaatgcatggacaaaaatatatgcatttgttattgcagatgattttggatggaaaactcgatccatccttcgttgtcacccatcaattacctctagaacaagcaccccacgcctaccacatttttcaacaaaaaaaggacaactgcatcaaagttgttcttaaaccctgaatggtgaatagtcattcagcg

SEQ ID NO: 43791 - DNA, 1863 bp, Nostoc punctiforme
caagttgcagaagcgatcgcagccagccaacaatatttactttcgattcaaaatccagcaggctactggtgggcagagttagaatctaatgtcacgattactgctgaaacagtccttttgcataagatttggggaacagaccaaaccagacctttacacaaagttgaagcatatctgcgtcaagagcaacgacagcatggcggctgggaacttttctacggtgatggcggagaacttagcacttcagttgaagcttacatggcgctgagactgctaggtgtaccagcaaccgatccggcgatgattcgggcgcaagcttttattctccaacggggtggtatcagcaaaactcggatttttaccaagttgcacttagccttgattggctgctacaactggcgcggtattccctcgctaccgccttggataatgttattgccaaaagcttttccagttaatatctacgaaatgtctagctgggcacgttccagtacagtaccattactggttgtatgcgatcgcaaacctgtttttatcactgacccaactatcaacctagatgagctatacgctgaaggtatcgatcgagtccggtgggaattaccccaaagtggcgattggactgatttattcctcaccctcgaccaaggattcaaatgggcagaaagcctaaatttagtccccttccgtgaagaaggtatcaaagccgccgaaaaatggattttagaacggcaagaagcgacaggcgactggggcggcattattccggcgatgctgaattcaatgctagctttgcgctgtctggattatgaccgcagcgacccgattgtggaacgaggtttgcaagcaattgataactttgccattgaaacagataatagctaccgggttcagccctgtgtttcaccggtttgggatacagcttgggtgatgcgtgccttagtagaatcaggctttgtaccagatcatcccgccgtggtaaaggctggagaatggttgttgcaaaaacaaattttagattatggagattgggctgtaaaaaatcgccaaggaaaaccaggggcttgggcttttgagtttgaaaatcggttttatcccgatgtagacgactcggcggtggtggtgatggctttacatttggcgaaacttcccaatgaaaaaatcaagcaggctgcgatcgcacgggcggtaaactggattgcatctatgcaatgtaaacctggtgggtgggctgcttttgatttggacaacgatcaagattggcttaactccatcccttatggcgacttgaaagccatgatcgatccaaataccgcagatgttacggctagagtcgtagaaatgcttggtgcttgtgatttgtcaattgatagtgataatttagagcgatcgctaacttatcttttacgcgaacaagaaaccgaaggctgttggtttggtcgttggggtgtaaattatatctacggcaccagtggcgttttgtcagccttggcattaattgatcctcaaaggcacaaactcagtatagaacggggagcagcttggttactgggatgccaaaacctagatgggggttggggtgagacttgccgcagctatgatgaccccagtctcaaaggaaaaggagatagtactgcatctcaaactgcttgggctttaattggcctcttggcagcaggtgaagcaactggtaaattagctgttaaggctattgagcaaggaattggctatttaatggcaactcaacagcctgatggtacttggtttgaggcaaactttacagggactggcttcccttgctatttctatcttaaatatcatctgtatcaacaatactttcctttaattgcactaggtcgctat

SEQ ID NO: 43792 - DNA, 789 bp, Nostoc punctiforme
atggacttgaaattgcatggtaaatccgcgctagtgagcggctcaaccgcaggtattggtttagcgatcgcccaagcgctagctcaagaaggtgcatcagtaattgtcaatggtcggtctgaagaaagagtaacccaagcgatcgctaaaattcaacaaagtacacctgaagcgaaagtttctggcgttgttgctgacacaagtactgcatcaggggtagaggaactctttcaaaaagttcctcacgttgatatcctcattaataatctgggtatttatgagccaaaaaccttttttgatattaccgatgaagattggttaaacatatttcaggttaacgttctcagtggagtccgtttgagtcggcaatatctgcaaaagcagctagagcaaaactggggacggataatttttatctccagcgaatctgcgattcaaattccggtggaaatgattcactatggcacaactaagacagcgcaactagccattgcacgaggtctagcagaaatgactatcgggactggagtcactgtaaactccgtcctccccgggccaacccgttcagaaggagttgaagagtttatcaccaacctggcgcaggaacgtggtatcaatcgtgctgaagtcgaggctgagttttttcaaaatgtgcgtccaagttccttaatcaaacgctttgcaactaatgaagaagtagctgcgatcgtagtttacctttctagtcctgtagcttcagcaactaatggtgcagctttgcgggtagatggtggcgttattcggtcaatt

SEQ ID NO: 43793 - DNA, 1209 bp, Nostoc punctiforme
cgttcgttccactatggttggctcgttgcaggtttaacattcctcgccttactcgttgcagccggaattcgctctgctcccggagtttttatagtgcctctcgaacaggagtttggctggagtagagcaactatatctttagcaatctctattaacttagtactttatggactgattggcccttttgccgccacagttatggagcgaatcggcattcgccaaatgatggtgttttcacttgctgtcattgctctcggtgtcggtttaactactttgatgtcagcatcttggcagctagttttgctgtggggtgtagttgtcggttctggtagcggagttatcgccctggttttgggcgctattgttgtcaatcgctggttttttgagaagcggggtttagttctcggcatcctaaccgccagtacagccacggggcaactggtatttttgcctatgctggcctcagtagccgatcgctttgggtggcgaactgcggctttggctctgactggtgcagcacttttaattattccagcgatcgcagcctttatgcgcgatcgtccggcagatgttggtttgcgaccctttggcgacaacagcgagactgtagaaatatcacagcctagagcaaattccatcagctctaccctcaacgccctctggctgggaatgcgtaagcgcgatttttggctgttatttggtagcttttttatctgtggcgccagcacaaatgggttaattggaactcatctgattcccgcttgtattgatcacggtattcctgaagtcaaagctgcgggtcttttggcaatcatggggctattcgatttttttggaactactatgtctggttggctctctgacagatggaataatcgctacttattgtgctggtactacgggctgcggggtttgtctttgattttcttgcccttcagtttcaacttttctttctatggactttctattttcgccgtcttctatggacttgattggattgctaccgtaccaccgacagtccgtcttgttgccaatgcctttggtaaagaaaatgtcggcgtgatgttcggttggattgtcgcaggacaccagcttggtgcagccacagcagctttcggagccggagtgttaagaacttggacgggtagctatttacaagcgtttattttatcaggtattctctgtctgattgccgcagttggtgtattg

SEQ ID NO: 43794 - DNA, 681 bp, Nostoc punctiforme
atggcaacaacagctttaattgtcggcgcaggtagtggactgagtgcatctttagcccgcctatttgccaaagaaggattcaccgtagctttagcggctcgtcaaattgaaaaacttactcaattgactagagaaattgacgcagttagtttcgctgctgatgtctcaaagccaaatgaagtagaacaattatttattgatattgatcgtaaaattggttcccccaatgttgttatttacaatcccagttttcgggtgcgggggcctcttattgatttagaccctggtgaggtggcaaaaaccttagatgtaactgcttatggtggctttctcgtggcccaagctgctaccaaaaggtttttgcaacttggcggtggtgctatattttttacgggagcctcagcgagtgttaaaggttatcctctgtctgctccctttgcaatgggtaaatttgcactgcgcggtttggctcagagtattgctagagaattagcaccaaagaatattcatgtggcgcatttcgtgattgatggggcaatccgttcagcagttcgccaagatccagtagataatcctgatagtactcttgacccagatgcgatcgctcaaacttatctcagtattctccgccagccccgcagtgcttggacttatgaagtagaactacgtccttgggtagag

SEQ ID NO: 43795 - DNA, 618 bp, Nostoc punctiforme
atgatcgatctttattattggacaaccccaaacggtcataaaattacgattttcctggaagaagtcggcttgcaatataccataaatcctgtgaatattggagctggagatcaatttaagcccgaatttttgaagatttctcctaacaatcgtatccccgcgatcgttgaccacgaaccagtagatggaggtgcgccgatttcggtatttgagtctggggcaatcttgctatatttggcagaaaaaaccgggaaattaatcccgcaagatttacgccaacgcactcaagttttagaatggttgttctggcaaatgggcggtctggggccaatggcaggacaaaatcatcactttagcgcctatgctcccgaaaagattgaatatgccattaaccgctacgtgaatgagacaggacgcttatatggagtgctaaataagcaactagcagatagagaatttgtggctggggattattccatcgccgatattgctgcttatccctggattgtgccctatgaacgccaaagtcagaatctagaggattttcctcacctcaagcgctggtttgagacaataaaagctcgtccggcaacaattcgcgcctacgagaaagcagaa

SEQ ID NO: 43796 - DNA, 1953 bp, Nostoc punctiforme
atcgaatcaatcctccaagagaaccgccttttccatcctcctagtgaattctcgcagaacgcccacattaaaagcttggacgactacaagcgtctctatgaaaaagccaaagccgatccagagcaattttgggcagatttggctggaacagaattagaatggttccaaaaatgggacacggtgctagattggcaaccgccttttgcgaagtggttcgttggcggtaagatgaatatttcttacaactgccttgacagacacctcactacttggcgcaaaaataaagcagccttgatttgggaaggagagccaggtgattcgcgtaccctaacttacgcccaactacaccgggaagtctgccaattcgccaatgtattgaagcaactgggtgtacaaaaaggcgatcgcgttggaatctatatgccgatgattcctgaagctgcgatcgcaatgttagcctgtgccagaatcggcgcaccacacggcgtagtatttggtggttttagtgccgaagctttgcgcgatcgcttaattgatgccacagctaaattagtaatcacggctgatggtggttggcgcaaagatgcgatcgttcctctcaaagaacaagtagataaagccttagctgatggtgctgttcccagcgtcgaaaatgtcctagttgttaagcgcaccggacaagaaacttatatgcaattggggggacgcgatcattggtggcatgatttacaaaaaagtgcatcagcagattgtcccgccgaaccgatggatagtgaagatatgctatttgtcctctacacttctggtagcaccggcaaaccgaagggcgtagtgcatacaactgctggttataatctgtatacccacatcaccactaagtggatattcgacctgcaagacacagatgtatattggtgtaccgcagatgtaggctggattacgggacacagttacattgtctacggtcccctttccaacggtgcaacgactgtgatgtatgaaggtgcgccccgtgcttctaatcctggctgtttctgggatgtaattgaaaaatacggcgttaatattttttatactgcacctacggcaattcgggcatttattaagatgggtgaacaacatcctaatgcgcgaaacttgtcttcgttgcgtttgctgggaaccgtcggcgaacccattaacccagaagcttggatgtggtatcagaaagtaattggtggcgatcgctgtccaattgttgatacttggtggcaaacggaaactggcggtatcatgattacaccgctaccaggagcaatccctactaaaccaggttctgcaactcttcccttcccaggaattattgcagatgtcgtggatttagaaggaaacaccgtacccaataacgaaggcggttatctggcggtgcgccatccgtggccaggaatgatgcggacagtttacggcgatccagaacgcttccgccgcacttattgggaacacattccgccccaagatggtaaatatacttactttgctggtgatggcgctagacaagatgaagacggctacttttgggtaatgggtcgtgtggatgacgtactgaatgtatcaggacatcgccttggtacaatggaagtagaatcagctttagtttcgcatccagccgttgcagaagcggcggtagtaggtaagccggatgaactcaaaggtgaagaagtagttgcttttgtgactttagaaggcacttatcagggaagtgaggaactgagtaaagaactcaagcagcacgtcgtcaaagaaattggtgcgatcgcacgtccaggagaaattcgctttactgatgctttgcccaaaacgcgatcgggtaagattatgcggcgcttattgcggaatctagctgctgggcaagaggtatctggtgatacttcgacgttagaagatagaagcgtgttggataaattgcgggaaggt

SEQ ID NO: 43797 - DNA, 765 bp, Nostoc punctiforme
attatgttatctaaaagaatcttaccgtgcttagatgtgaaggcgggacgggttgtaaaaggagttaactttgtaaatctccaagatgcaggcgatccagtagagttggccaaggtttacaacgaagccggtgctgatgagttagtatttctggatattacagctactcatgaagaccgagctacaattttagatgtggtctaccggactgccgaacaggtctttattccattgactgtgggtggtggcattcaatccttagaaaatgttaaagctttgttacgagctggcgcagataaggttagtattaattctgcggcggtacgcgatccagacttgattaatcgggcaagcgatcgctttggtaatcagtgcatagttgttgctattgatgccagacgcagaaataacccggaaaatccaggttgggatgtgtatgtgcggggtggcagggaaaatacaggcttagatgccctattgtgggcgcaggaagttgagaaacgcggtgctggagaacttctaataacaagtatggatgctgatggaacccaagctggatatgacatcgagattacacgggctattgcaaacgctgtagaaattccagtcattgcttctggtggtgcaggtaattgtgaacatatttatacagctctaactgaaggcaaagcggaagcagcactactggcatcgctattacattacggacaattaagcgtagcagaaatcaaaaattatttacgcgatcgcaatgtgccagtaaga

SEQ ID NO: 43798 - DNA, 1344 bp, Nostoc punctiforme
ttacttaaactgcctaacggccctcaaactcacccttggatacagatgtatcagtggcttactaatcccttagaatacatggaagcctgcactaaacgttatggtgatatcttcactctcaaactcggacaaaattttgctcatcaagtcttcattagcaatccccaggcaattcagcagatttttactacagatccaaaacagttagactctggtgaatcagcaggtattaaagcgcctttattaggacagcaatcattactggcgctagatggaaagcctcatcagcgacaacgaaagctcttgacaccccccttccacggggaacgaatgctggcttatggtgagttaattcgtgaaatcacagagcaagtgagtagccagtggcaggttggagaaacctttgcagttttgccatctatgcaagcaatctctttccaagtgattttgaaggctgtatttggtctagaagatggaccacgttacaagaaactcaacgaactcctaattaaaatcctaaatcccaaaatccctctactaagaacagttctgcttatttttccatcaatgcgacaggatttaggagcgtggagtccttggggaaaatatttacgtttacggcagcaaatcgatcaactcatctacgcccagattcaagaacgcaaagcacaacccaatctatctgggactgatattttatctttgatgatggctgctcgtgatgaagcgggagagccaatgacagacttggaattacgtgatgaactgatgaccctattagtggcaggtcatgaaactactgcaacttccttatcatgggcgctgtactggattcatcatcgaccacaggtgcgggaaaaactgttgcaagaactagataatttgggtgaaaaaccagatccaaacgctattttccgattgccttatttaaatgctgtctgttctgaaacactacgtctttacccagtggcaatgtcagcactaaatcgattagtcaaatcaccgctacaaattggggagtacaactttgagcctggaactatactaattccctctatttatttgacccatcatcgagaagatttatatcctgagtcgaagcaatttaagccagagcgttttctggaacgacaattttctccctacgagtatctaccctttggtggcgggaaccgtcgctgtattggaatggcatttgccttgtttgaaatgaaactggtgttggcaacagtgttgtctcgctggcaaatggaactggctgatagtaaaccagtccgaccagtacgtaagggtttgctatttagcccagcaggtggtgtgcagatggtggttaaggggaagcgt

SEQ ID NO: 43799 - DNA, 1443 bp, Nostoc punctiforme
atggtcacaaccgcagaaaaaacaaacattggctacattacccaaatcattggcccagttgtagacgttaaatttcccggcgggaaattgccacaaatctacaacgctttgaaaatcgttggcaccaacgaaagtggacaggaaatcaacatcaccgttgaagtacagcaactgctgggcgacaaccaagtgcggactgttgcgatgagttccaccgaaggcttagtgcgcggttttgaagtcaccgatacaggcgctcccattaccgtgccagttggtaaagccactttgggccggattttcaacgtccttggcgaacctgtggacaacaggggacctgtaaatgctgaggcaagtttacccatccaccgctctgctcctaaattcactgacctggaaaccaaaccttcggtgtttgagactgggattaaagttgttgaccttctgactccctatcgacgcggcggtaagattggtctgttcggcggtgctggtgttggtaaaaccgtgatcatgatggagttgattaacaacatcgctacccagcatggtggagtatccgtatttgctggcgtgggtgagcgcacccgtgaaggcaatgacctctacaacgaaatgattgagtctggggttatcaataacgagaacctcaacgaatcaaaaattgctctagtttacggtcaaatgaacgaaccacccggagctagaatgcgggttggtctttcgggattgacagtagcagagtacttccgggatgtgaacaagcaggatgtgctgctgtttattgacaacatcttccgatttgtgcaagcaggttcggaagtatccgcgctattgggtcggatgccttctgcggtaggatatcagcccacattgggaaccgacgtaggtgaactgcaagagcggattacctcgactacagagggttccattacctccattcaagcagtatacgtacctgcggatgacctcacagaccccgcacctgctactaccttcgcccacttggacggaaccacagtactgtctcgcggtttggctgctaagggaatttatcccgcagttgacccccttggttcaacttccaccatgctccaaccaaatattgtaggtgacgaacactacaatactgcgcgggcggtgcaatcaactctgcaacgttacaaagaactccaagacattatcgccattctcggtttagatgaattgtctgaagaagaccgtctaatcgtggcacgggcgcggaaagttgagcgcttcttgtctcagccgttctttgttgcagaagtattcaccggttctcctggtaagtatgtgaagttggaagataccatcaaaggcttccaaaaaattctgtctggtgagttggatgctctgccagaacaggctttctacttggttggcgatatcaacgaagcgatcgctaaagctgaaaaaatcaaa

SEQ ID NO: 43800 - DNA, 1401 bp, Nostoc punctiforme
atgactgtcgctcaacaaccagaagctttaagctttgaatgtgaaaccgggaattaccataccttttgcccaattagctgcgtggcgtggttataccaaaaaattgaagatagcttctttttggtgattgggacaaaaacttgtggctacttcttgcaaaacgcgatgggggtgatgatttttgctgaaccccgctatgcaatggcagagttggaagaaggcgatatttccgcacaactgagtgattatgaagagttaaagcggttgtgcttgcagattaaacgtgatcgcaatcctagtgtaattgtctggattggcacttgcaccacggaaattatcaaaacagatttggaaggcttggcaccgaagctggaatctgaaattgggattcccatcgttgttgcgcgtgcaaatggtctagattacgccttcacccaaggggaagacacggtattagcagcaatggctaaccgttgccctgataaggctccggtggcggaaacagagaagagcgaacgcaatgcgatcgctaaattgctaaacttcggtaagaagaaggaagatgtcgcccaagatgaatctgagtatgtagatcatccgcctttagttctctttggctcccttcccgaccctgtggtgactcagttaaccttggaactgaagaaacaaggcatcaaagtttccggctggctacccgcgaagcggttcaccgaactgccagtactggaagaagggtattatgtcgctggtgtcaaccccttcctcagccgcacagctaccactttaatgcgtcgccgtaagtgtaaactcattggcgcacccttccccattggccccgatggaacccgcgcttggattgagaaaatctgctcggtgttcggtattactcccaagggtttggatgaacgggaagcacaaatttgggcaggcttggaagattacgtgaaactgattcgcggtaagtctgtattcttcatgggtgataacttgttggaaatttcccaagcaagattcttaatccgttgtgggatgacagttcacgaaatcggcattccctacatggataagcgctatcaagctgctgagttggcgctgttggagaaaacttgccaagaaatgaattcacccctgccaaggattgtggagaaaccggataactacaatcaacttcagcgaatttatgagttgaaaccagatttggtaattactggtatggctcacgctaatccgttggaagcacgcggtattaatactaagtggtcggtagagttcacttttgctcaaattcacggctttacgaatgcgcgtgacatattagagttagtgactcgtccgctacgtcggaataataatttgaaagatttgggttgggataagttggtgagagaagaagcaaagatt

SEQ ID NO: 43801 - DNA, 1326 bp, Nostoc punctiforme
cgcctgcgacggcaaaaattagcaaacctcattaagtttcccgtaattctgtggtcaggtaccaacagtccccgcaactttccagcaaatccttttccgtttcgcgctaacagtcatttcctctattttgccggactaccattaccaaatgcggcaattcgtttagaagggggcaagctagaactattcatggacgatccatcacctagcagcactctttggcatggagaaatgccaacgcgcaatgaaatagcccagaagattggggcagatgtggctcgaccaatgacagaattagagtcttggatagaagatgctgtcacacttgctgtacaagatgcagccacatggacgcaacaatcgcagctattaaatagatgggttttaccccaaagtcctccccaaggaattgacttagatttagctaaagcgatcgcttctatccgcctcactcacgatgaagctgcattaaccgagttgcgaaaagctgctgctgtcactgttgaagcacacaaagttgggatggcagcaacacctcaagccaaactagaagcagaagttcgcgcagcgatggaaggggtaattattgcccacaatatgaccacctcttacaacagtattgtcaccgttcacggcgaagttttgcataacgaacactatcaccaccccttgcaaccaggtgatttactacttgccgatgttggcgctgaaactgagatgggttgggcaggtgatgtcactcgcacatggccagtttccggcaagttttcatctacccagcgagatatttataatgtggtattggcggctcatgatgcttgcattgccaaaatacagcctggtgtagagtatgaggatattcatctattagctgccacggttatagctgaaggtttagtagagttaggcattttccaaggaaatccccaatatttggtagagatggatgcccacgcgctgtttttccctcatggtatcggtcatctactgggtttagatgtccatgatatggaagatttgggagatttagcagggtatgaagaaggacggaaaaggagcgatcgctttggcttaagctacctccgcttaaatcgtcccctacgtccaggaatgttggtaacaattgaacctggtttttatcaagtaccagcaattttaaatgatgccaatgttcgctcaaaatatcagaatgtggtgaactggcaacgtttatctgaatttgccgatgtgcgcggaatccgcctagaagatgatgttctagttaccgcagaaggtagcgaagttttaacagccgcattaccgaatgatgccgatactatagaaaat

SEQ ID NO: 43802 - DNA, 1554 bp, Nostoc punctiforme
ttattacggcggttgtttgtcactttgttggctttgatcgttttctggtggggattgctaccagaaattgctctggctcaaactcaagttgcacctcctcaagaaaccaaaactcaaactccaccagttcaaaattcgatccaaccttatctggatcgagttattaaacagttaacggagtttcgcctcgacaatggtctaaaattccttgtcttagaacggcatcaagcgcctgtggtttccttcctgacttatgcaaatgttggaggtgtggatgagccagatggtaaaaccggtgtagctcactttctagaacatttggcgtttaaaggtacaacgcgcattggtacgcaagactacaaagcagaaaaacctctactagagagattgcagcagttagatactcaaattaaagcagcgaaagccgatggcaaaaaagacgaggttgctcaattagaaactgagttcaagcaagtagaatcacaagcaggtaagcttgtcaagcaaaacgaattgggacaaattgtggaacaagcgggaggtgtgggtttaaatgccaatacttcaaccgaagctacccgttatttttacagttttcctgccaataagctggaactgtggatgtcgctggagtcggaacggtttctcgatccggtaattcgtcgtgagttttataaagagaaagatgtcattttagaagaacgacggctgcgggtagagaattcaccgattggacaaatggtggaaaagtttatcgatactgcttataaagtccatccttacaagcgtccggtaattggttatgaccaagatatccgcaatctgacaccagatgatgtccaaaatttctttgatactcactacgtaccaagtaatttagcgatcgctattgttggagatgttaacccggctgaagtgaaaaaactggcgcaaacttattttggccgctataaagcaaaaaccaaagctgttgaacaaatccccgtggaaccgccacaaaaacaaacacaagaagttactttacaactaccttctcaaccctggtatttagaaggttatcatcgcccagcagttacccatccagataatgcaacctatgaaatcattggtagtttattaagtgatgggcgcacgtcgcgcttgtataagtctttggtagaaaaacagcgtttggcgctaaatgcccaaggttttagcggttttcctggagataagtacccaaacctgatgttattctatgctctcacggctcctggtcatacagttgatgagttggcggtggctttgcgccaagaaattgacaaattaaaaactgagcctgtcgcggcgattgatttggaacgggtgaaaacccaagcacgggcgggtttgttacgtactctcgattcaaatatggggatggctcaacaattgttggaatatgaggtgaaaactggctcttggcggaatttgtttaagcagttggatgatatttcggcggtaacgacggctgatattcagcgagtggcgaaggagacgtttacgccaggaaatcgcacgattggtaagttgttg

SEQ ID NO: 43803 - DNA, 771 bp, Nostoc punctiforme
atgcaggtaatccgtctggaagcactctcagacaactacatattcttgttatatgacgacaaacgtaatatcgcggctgttgtcgatccagcagaggctcaaccagtattaaagaaactggcagagttaaaagctgatttagtagcaatttttaacacgcaccaccataacgatcatgtaggtggtaataagcaattaatcgaaaaatttccccaactgatagtttatggaggagccgaggatcgtggtagaattccgggacaaaaggtatttttgcaacaaggcgatcgcgtcgagttcgcagaccgcatagctgaagttatcttcgttcctggacatacccgtgctcacatcgcttactactttccacctcaagaagctagtgagacaggcgatttgttttgtggtgataccctattttccggcggttgcggtcgtttatttgaaggaacaccgacccaaatggtagattctttaagcaaactgcgttctctacctgataatacacgcatctggtgtgcccacgaatacacattaaaaaatctgcaatttgccttaactgtagatggcgacaacgctgacttacaaagacgcttcaacgaagtaaaagcttaccgtagtcgaggagaagctaccattccctcactgctaggagtggagaagcacaccaatccctttttacgttgggatcaggcatcattacaatcaactgttaagagtagtgatggagtgcaaacctttgcgcggataagagaaatgaaaaataacttt

SEQ ID NO: 43804 - DNA, 2625 bp, Nostoc punctiforme
atgtcgaagtcttattttgatacagataataacggacacaaaccttttgagttaccgggagcaagaccacactacaatcccgatcgcccaggacaggtggagcatatttttctcgatctcagcttagatattcctaagaaaagctatcagggcatttgtagcattcgcctcttgccaatccgtaatggcattgaccgtttgactttggatgctgtcaacctgaatatcgagtctgtgcaagtggacgatgtgccacaaaattttgactacgacggggaacagctttctatcaaactttctgaggtaactcagattggtaaacgcttgctgattgcgatcgcctattcggtggcaaaaccgcaacgcggtatttattttatccaaccagacaagcattatccaaataagcccactcaagtttggactcagggagaagacgaagactctcgcttttggttcccctgctttgactatccaggacaattgtctacttcagaaattcgcgttcgtgtccccaaccccctcgtggcgatttccaacggcgaactgattgacaccacagaagatggtgattataaaatctaccattggttacagcaacaagttcatcctacctacttgatgactttggcagtaggtgactttgccgaaattcaggatgaatggaagggtaaaccagtcacctactacgtagaaaagggacgggaggaagatgctaaacgcagcatgggcaaaactccccggatgatcgaatttttgagccaaaagtatggttatccatatcctttcccgaaatatgcccaggtttgtgtcgatgatttcatctttggcgggatggaaaacacctccacaaccttgttaacagatagatgtttgcttgatgaacgcgccgctttagataaccgcaacaccgaaagtttagtcgtccacgaactcgcccaccagtggtttggtgatttggtggtgattaagcattggtctcatgcttggattaaggaaggaatggcttcctattctgaggtaatgtggacagagcaagaatatagtctagaagaagcagcttactatcgttttttagaagctcgtcgttacattagtgaagatagcagccgctaccgtcgcccgatggtaacacatgtttaccgcgaagctattgaactttacgatcgccacatctacgaaaaagggtcttgtgtttatcacatgattcgggcccaattaggagatgaattattttggcaggctattcaaacatttgtccaagataatgcccacaaaactgtagaaactatagatttactcagggcgattgaaaaggctactggacataatcttttgtttctctttgatcaatatgtttatcgtggcggccatcccgattttaaggtagcttactcttgggatggagatgctaagttggcaaaaattacggtaactcaaactcaagctgctgaagataaaaatggcagtaaagatttgtttgatttaaaaatacctattggttttggctatacccaacaagaagggaaaagtgaggagttaggagttaaaaataattccaaactcacaactcctaactcacaactcaagacttttgtcgtgcgtgtaaatgaacgagaacaaagcttctactttcccctagaaaataagcctcaatatatcagctttgatgttgagaataattacctaaaaacagtagctttagagtatccaatagcagagttaaaagcacaattagaatctgaccccaacccaatttcgcgcatctatgcagcagaagctttaacgaaaaaaggcgggttagaagcaacaaaagcactgtctgcgtccctcaaaaatgacccattgtggggtgtgcgggtggaagtggcaaaacaactagccaaaattaatttagaccaagcttttgatggcttagttctgggattaaaagataaaaatgcttacgtgcgacgatctgtagtggaagcacttgctcaaatcaaaactgctgaaagctataaagttgtaagagggttgttgcaaaaaggcgatcccagctactatgtggaggcaacagcctctcgtgtgattggcgcgatcgcatctgcaaacttggaagaaaaacccaaggaagataaggtaataaagcaactcaagggcattttagaagaaaaggcgggttggaatgaagtagtgcggagtggtgcgatcgctggtttagctgaattcaaaacctcggaagcagctttaaatctactactcgaatacaccaaaatcggtgtaccacaacctctacgtttagccacaattcgcgctttaggaaagatttctgtaggtcaaagtccggttaatttggaacggattttagaaaaactggcagaactagctaaagaaaccttctttttaacgcaagtggcggtagcagcagcattgggacaaatggaaacacccaaagcagtcggaattttgcgatcgctagctgaacaaacagccgatgggcgtgtccgtcgcaatgctgaagaagaaatttccagggtgcaaaagaacatcggttcagaaaaaaccctccgtcaattgcgtgaagatttcgaccaactcaagcaacaaaaccaggaattgagaagccgtttagaaaacttggag

SEQ ID NO: 43805 - DNA, 405 bp, Nostoc punctiforme
ataggaaacgcaatggaagcataccttactatcagtactcactttagcgccgcccatcggctagctcatcctcatctcagtaacgaagaaaacactgagatttatggtaagtgcgcccgtccccacggtcatggacacaactatcatctagaagtcaccgtcaaaggagaaattgacccacgcaccggcatgattgtcgatttagggggtttgaatcaagtgatagaagattatgtggttgaaccattcgatcacacttttttaaataaagacattccttattttgccgaaattgtgcccactgctgagaatatcgcactttacattagtaatttattgcgatcgcccattcaagaattgggagctaaacttcacaaagtgaaacttattgaaagtcccaataac

SEQ ID NO: 43806 - DNA, 360 bp, Nostoc punctiforme
gtgaatcgccgcgcccagttttcggcaagtcatcgctattggttgccagaactgagtgaagccgagaatattgaaaaatttggtgcttgctctaaatttcctggacacggacataactatgtcttatttatctcccttgcgggggaattggataagtatggtatggtgctgaacttgtctgatgtcaaacacgtaatcaaacgagaagttaccagtcaattggatttctcttatatcaacgatgcgtggacagaatttcaacaaactttacccaccactgagaatattgcccggattatctggcagagattagcaccgcatttgcctttagtccgtgtgcagttatttgaacatcctgaa

SEQ ID NO: 43807 - DNA, 933 bp, Nostoc punctiforme
gcaatttgcacccgtggactaactaagcaatttgacagacacgttgctgtcaatgatgtggatttagaaatccaggcaggggaagtatatggactgattgggcccaatggcgcaggtaaaacaactctcatccgcatgttggcaactgctgaggaaccaactacaggtgagatttatattaatggcgatcgcctactccgtgacaaaagtaatcccaaactgaagcgtcgtctaggctacttacccgatgactacccactatatgaggatttgacagtctgggattacctagattattttgcgcgtctctatcgtttacgagaaccacgtcgcactcaacgtctacatgaagttttagaacttattcaacttggaaataaacgccacagccagatttctaccctgtcgcgggggatgaaacagcgcttaagtttagcgcgaaccattatccacgaaccgattttactactactagatgagcctgtctctgggcttgatcccatcgccagaatgcacttccgcgaaatcatcaaagctttgcaagaagctgggatgactgtaatcatttcttcccatgttctcagtgatttagcagaactgtgtacatctgtgggaattatggaacttggcttcttggtagaaagtacctctttacaacaactgtacgaacgtctttcccaccagcaaattgtgatatcaactctggggaacctagagacacttttaagggagttaaaacatcatcatttagtagaagagtgggaggtgatatcaggaaaaaatagcgtgcgggtgaatttttcgggtaaagatgaagatagtgctgagttgttgcgatcgctgattaaagcaggtattcctttgactgattttcactgcacccaagaagacttagaaactattttcttaaaattaggtcacaaacaagcatct

SEQ ID NO: 43808 - DNA, 1221 bp, Nostoc punctiforme
tcacaaaagttagaaattcatcgcttggctttgttggggaaggatgaagaaattgtggggaaaatagctagttcattggcgaaccacttgttgcatcaaagccgttttcgggaagcaatacatctgtgcaaatcaacattagaaattactaaaaatcatagtgttctcaaagaaatggcttattctaaacaccaaatgggtgaggttgatcaagcattaagctattaccaacaagctttaaatttttgtcccgcagaagacgaaagagaattagcatcaatttatcaacatttatgtatgcttaaagacgacaaaggggatgtggatgaagcgctcgcactctgcaatcagtctttagaaatatttgaacgcattggaaatgtccaatgcaaagcggaagcgttgggctgtctgggaaatatctacgccggcaaaggggaagtggatgaagcgctcgcactctacaatcagtctttggaaataagtgaacgcattggagatgtccaaagcaaagcggtgacgttgagctgtctgggaaatatctacgccggcaaaggggaagtggatgaagcgatcgcacttttcaatcagtctttggaaataaatgaacgcattggtaatgtccaaagcaaagcagcgacgttgatccaactgggaaatatctacgccgacaaaggggaagtggatgaagcgctcgcactctataatcagtctttggaaatatttgaacgcattggaaatgtctgaggcaaagcggtaaccttgcaagaactgggatctatctacgcgaacaaaggggaagtggagcaagcgatcgcacttttcaatcagtctttggaaataaatgaacgcattggtaatgtccaaggcaaagcagcgacgttgcactgtctgggactgatctacgtcaacaaaggggaagtggatgaagcgatcgcactctacaatcagtctttagaaatagaagaacgcattggggatgtccaaggcaaagcggcgacgttgaacaatctggcaggtatctacgcgaacaaaggggaagtggagcaagcgatcgcacttttcaatcagtctttggaaataaatgaacgcattggtgatgtccaaggtaaagcaataactctgtggtgcttaggagatttggcagaacagcagggtgaatatactaaagcgatatcctatttgcaaccagctttaaagattttgcagcgattgaagtca

SEQ ID NO: 43809 - DNA, 3648 bp, Nostoc punctiforme
atggttcatatcaagcgcgtggaacttaccaacttcaaatccttcggcggtactacttcagtccctttgctgccggggtgtactgtcatatctgggccaaatggttcgggtaaatctaatattctcgatgcactgctattttgcctcggactctccagttctaagggaatgcgagccgatcgcttaccagatttggtaaataacacccaaacgtctaaaggacgcgcttctattgaagctagcgtcactgtgacgtttgatttgtcagatgaaatctcacacaaagacacaaaggcgcaaaaggaggaagtagaggaggcaggggatgcaggggatgcaggggaagcggaggaagaaccaaaatccaaaatcgttcgactgagcgaagccgaagtccaaaagccaaaatcggcagagtggagtgttactagaaggctgcgagtcactcaccaaggaagttacacgtcgaattactatataaatggtgaagcttgcacgctgacggagttgcatcagcaactaagtaatctgcgggtttatcctgaaggctacaacgtggtgctgcaaggggatgtcaccagcattatctcgatgaatgcgcgggaacggcgggaaattattgatgaattggctggggtggcggcgttcgatcgcaaaatcattcaagccaaatcaactttagatgaggtgaaggagaaggaagatagctgtcggattattgaaacggaattaactgcacaacgcgatcgcctttctcaagatcgtgctaaagctgagagatatcaaaaacttcgcacggaatttctggctaaacaatcctgggaagcggttttatcatggcgatcgctacaagcacaacaagaaaagttagttcacgaaattcaaacaggcgatcgcaattctagtgaactctcaactcaactcacaaatctaaattccgaaatcgtccaaaaaactgctgaacttgaacaactcaatgcccatgtcaaagcattgggagaagatgaacttttggcggtacaatctaccctcgccacccaagaagcagaacgtaaacaactccagcgtcagctaacggaattacaaacagcttcccaagaaactgctaaacgtctcactcaaactcagcaagaaattcaaaaacatcgtcattccctagaagaaattgacgaaacccaaattgtagagacgcgattcatcgcgtcttcccaacaccaaaggaatgaagcccaccaatctctagaaacctcccgcgaagcagccgcagaaatcgcctcagcttcggaagcatgggtacagcaacaaacggcattcaatcgtcaaattgaaactctgttgcaaactctagaaccgcaacgcacagaaaaagcacaactcacagaacggaataatcaattacagcaattaatttcagaacaaacccagttaattgaacgcgacgaaccgctattagcccaaaaacaaactgactgtaatcaagttgaaacggaatttaacgcctctagcgaacccatccagaatttagcccaaaatctctcagctacagaacaagaactgcaaatccaacaggaaacccaaaagcggttactttttgaacaacgggaaaaacaacgccagttggataaaatagaggcgcaaacgcaagcacagcaagaagtccaaggaacccaagcgagtaaagttattttacaatcgggaatgcctggactttgtggcttggttgtgcagttgggaaaggtggaaccccgccatcagctagctttggaaatggctgccggtggacgattgggacatattgtggtggaagatgatggtgtagccgcagccgggattgaattgctcaaacagaaacgtgccgggagagcgacttttttaccactaaataaaattcatgctcctaaatttactcaagatgcaacgctgcgtttcgctagcggcttcgttaactatgctgttaacttagtcgattgcgatcgccgttacaaagatgtatttagctacgtttttggtaacacagtagtatttgccaacctggaggcggcgcggaaaaatttaggtttatatcgcatcgtcaccttagacggggagttgttagaaactagcggtgcaatgactggtggtagtaacagcaatcgttcagcgttgcggtttggtacgggtgaagcggcagaatctgatgaagcgatcgctttaaaaactcgtttggtggatattgagcgagttttagagcgttgtacagaagcgatcgcaactttgtcagccagaagtaaaaaactcacccaagaactcacagaaacgcgtcaggcgcggcgcgaacagcagttgcaattggaacagttgcaaaaagacattaagaatttaacagcgcaattagaggggacgcgatcgcaactagcccaaaacagcgaaaagttagccactgctcaatcccgattagaaattttggagcgggaattacctgggaaagaaaatgaattgcaacaattgcgacacgctttagcagagttggaagcatctcaaacccccagtgaatggcagcaaatccaggcgacaattaaaattcaagagcaacacttgcaacaacgagagacagcattacgcgaagctgaacaaagattaaaaaatttagaaaatcagcaacaacgtttgcaagaaaaaatccaagaagcagaaacgcgaatcaccgaatacgaaacccaacaaatctcttgtaaagacgcgattcatcacgtcttttcacaaatcacaacgataaacgagcaaattacccaaacccgtttatcgttggctcaaatggagcaaaatttgggagaagagaaacaaaaacgcgacgctacagaattggaagtgcgatcgcaccttttgcgccaacaacaattgcaatgggaaatcgaaaaactcaaagaaactcaagagaagcggcgggaggaactaattgcactgcaaagccagttgcgagatatgggagcagaattaccaaatcccttgccggaagttccagataaggtagatttggaggaattacagaaagaattgcgatcgctcaccaaacgcttacaagcaatggaacctgttaatatgctggcgttggaagaatacgaacgcacccaaaaccgtctccaagaactgacgcaaaaattagagacactagaaggggaacgcaccgagctacttttgcggatcgaaaactttaccacattgcggcaacttgcctttaaagaagcgtttgatgctgtcaacgaaaactttcaatcaatttttgccattctttcagacggtgacggctacctacaactcgaaaatcccgaagatccctttagcagtggacttaatttagttgcacatcccaaaggtaaacccgtacagcgcctagcttccatgtctgggggagaaaaatcacttacagctttgagctttatctttgccctgcaacgctaccgtccatcgccattttacgcctttgacgaagtagatatgttcctagatggagcaaacgtagaacgattagctaaaatgattaagcaacagtcacaacaagcgcaatttatagttgtgagtttgcgtcgtccgatgatagaatcagccgaacgcacaatcggcgttactcaagcacggggagcttacactcaagttttggggattaaatta

SEQ ID NO: 43810 - DNA, 1080 bp, Nostoc punctiforme
atgacttctttaattaatgtaaatttaccagagcagtcttatgagattgcgatcgcaccatcaaatttagatcaactgggtcaacagatggccaatctgaagctaggcaagaaggtattgctagtttctaatccgacgatttttaagcattatggggaaagagcaattacatccctgaaatctgcgggatttgaagttgctagctgcaccttaccacctggtgaacgctacaaaaaccttaattccatccaaaaactctacgatgtcgccttagaaaaccgcttagaacgttctgctactatggtggctttgggcggaggtgtaattggcgatatgactggctttgccgccgcaacctggctgcgcggcattaatgttgtccaagtacctacaactctcttggcgatggtagattcggcaattggtggcaaaactggcgtaaatcatccccacggtaaaaacttgattggggcattccatcagccgcgcttggttttgattgacccagatgttttaaaaacccttccgatgcgcgaatttcgggcaggaatggcagaagttattaagtacggtgtaatttgggatgctgaattgtttgcccagttggaagcaagtaaacggctcgaccaactccgctatgtaaaacctgagctaatagacagcatcttaacgcgctcttgtcaagccaaagctgacgttgttggcaaagatgagaaagaaggcggattacgcgcaattctcaactatggacataccatcggtcatgcagtggaaagcttgactggttatcgtttagtgaatcacggtgaagccgtagccattggtatggtagcagccggccaaattgctgtggaattgggaatgtggcaaaaagaagatacagaacgtcaaaatgctttaattcaaaaaacgggtttaccgactcagttaccatctggggtagatattgaagcaattattgatgcgttgcaactagataaaaaagtcaaagcaggaaaagtacggtttgttttaccaacagagattggtgtagttacagttaccgatgaagtgccatcagatatcattcggcaagtcttg

SEQ ID NO: 43811 - DNA, 999 bp, Nostoc punctiforme
cgcctggatacaaatgaaagcccctacgatttaccacctgagttaaaagaaaaactagcctggacatatcagcaagtaattgaaacaaatcgttatcctgatggtggacatgaaacccttaaggatgcgatcgcagaatacgtcaatgaatcagccgctttcccgctatccaatactgctgccaatatttctgttggaaatggttccgatgaactaatccgctctttattaatcgccacttgtttaggaagagaaggttcaattctcgttgccaatcctactttctctatgtacggaattttggcacaaactttgggaattcctgtcgtaacggtgggtagagacgaaacaaattttgaaattgacttaaaagccgcacagtctgcgatcgaacaaactcaaaatccacccattcgcgtagttttcgtagtacatccaaattcgccgactgccaatagcttaacgacggcagagttggcatggttaagaagtctgagcgaacatattttggtagtaattgatgaagcttactttgaatttagtcaaactaccctagtaggtgaattagcgcagcgccccaactgggtaatattacgcactttttctaaagctttccgattggcatctctccgtgttggttattgcgttgctcatcccgaagcgatcgccattttagaaaaagttcgcttaccttacaatcttcccagcttttccatagcagcagcattagttgctttacaaaaccgtaccctcttactggagtcaattccccaaaccttgagtgaacgatccaaactcatcgaaattttatcccagcaaccagaactacaaattaccgcaagtgctgctaattttatttacctacgccttaaacctaatggcttaaattcacaagatgctgtgctaaaaactttccaccagaaacttagaaaactcggcactcttgtacgacacattagcggaggattgcgaattactgttggaacaatagaggaaaac

SEQ ID NO: 43812 - DNA, 789 bp, Nostoc punctiforme
tcaccagcttggctatttgaacatctagaagatccgcaagttgttattgttgattgtcgcttttctttagccgatccacaactaggacaacaacagtaccaaacaagccatattaaagggtcatattacctagatttaaatcaggatctttccagtccagtgggtaagcatggcgggagacatcctttacctgaacccaatgatatcgctaacaaatttgcagcaattggggtaaattaccaaaaaactctggtggtagcttatgatgattcgcgttttgcttttgcatctcgtttatggtggctgttacgctatctcggacatgaacaagttgcggtactagatggaggctttactggatggcaaaaagctggttatccggttacggatgtcgttcctcaacctcagatcggtacgtttgtagctgaattgcaaccagaaaaagtggtggatattaatgtggtgaaaacccggaaagataaccacgaggtagtattggtagattcgagagaaagcgatcgctatcgaggtgaacgagagccaattgataaaattgccggacatattcctggtgcagtcaactatccttggcaagaagttacagactcttccggctacctactccctcaagaggaacaacgctgtcggtgggaacagctagaaacagccgaagaaatcttggtttattgcggttctggtgttactgcttgcgtcaatttactttctttagaattagctggcattaacaaaggtaaactttatgctggtagctggagtgattggatttct

SEQ ID NO: 43813 - DNA, 873 bp, Nostoc punctiforme
atttggtctaatctgggttttggctttgcagaactaggaactgtaacttttcacgcacaaccaggaaatccgcgtccccgtttgtttcgcttaccgttggataaagccgctctcaatcgtatgggctttaacaatctcggtgcagcagcaatggcaacccgtttggtacaggaaaaacaggagtctaccaacttaatacccatagggataaatttgggtaaatctaaggtaactcctctagaagaagccgcacaagattatctcgatagttttcgcctactcaaggatttgggagattattttgttgttaatgtctcttcccctaatacgccggggttgcgatcgctccaagatgcttctatgctcagtgccatcttgaatttattacaacaagaaaacactacacataaaccaatttttgtcaagatagcgccagatttagattgggttgcgatcgctgaaattatttctttggctaaaacctacaatttggcgggaattatcgccaccaataccaccatccgccgtgatggactgaaaacccaggtaattaaccaaactggcaaatcacctcaagaagaagctggcggaattagcggtgaaccattgcgcgatcgctccactgaggtaattcgttttatttggcagcaaacccaaggagaaattccaattattggcgttggtggcattttttccccagaggatgcttgggaaaaaattactgctggtgctagtttaatccaggtttatactggctggatttacgaaggcccactgatggtacgccggattctagaaggtttactttccaagctagaacaaaacggattcaattccatcagagaagctgtgggcttagaaataaaaagtaaa

SEQ ID NO: 43814 - DNA, 825 bp, Nostoc punctiforme
gctcaacaacaaaaaattattattttggagaagttagaaagattagaaactgagtttgtctctcaactctctgagttacaattggatgccgaagaaagaaaggatcttattcttcaagaactaactgaaattacacctgaatctatcttagaagcggtgaattatgaagttaaggaagaaaaagaagtagaggaaccgccacaacaaccagaattgactgctgaggagtatgtaaaagagggagatgagctgttttctaaaaggcgctatgaagatgcgatcgcagcttacaaccaagcggttaaaatccaacctgatgaacctgtggcttggttaaaacgaggtctaactctcggaaggttgaaacgctacaaagatgcgatcgcatcctacgagcgagctattcagattcaaccagattaccatcaagcttggtgcgatcgcggcgttgcttttgggaaattacaacagcatcagcaagcctttgcttcattcgagaaagctacacaaatcaagcctgatgatgctgttgcttggttaaattgcggtctttctctcgtagcattggaaaaatatgaagaggcaatagtgtcttttgataaagcgctagaatttcaacccaattctcccaaaatctgggataaacgcggttataccttggtaagattgggacgcgatgatgaagcgatcgctagttttaacaaaactttagaaattaagccagattatgccagtgcctattacaacaaagcagcctgttacgcactgcaaagacaagttgaactatctttggcaactctgaaacaggcaattgaactcgatccc

SEQ ID NO: 43815 - DNA, 1155 bp, Nostoc punctiforme
ccacgttgcattgtctgcaagacaacttttttacagggtcatggcttttacactggactctgtgttgaatgtggaaatcttaacttcagcaagcgtcagcaaagtgctgatttacggggtatgattgccgttgtcacaggagccagggtaaagattggtcatggggtagcgttgagactgttgcgagatggtgcgactgtgattgtaacaagccgttttccccatgacgcggcaaaaaggtacgcagcagagccagattttcgagaatggcaacatcgattgcaaatttacggactcgatttgcgccatctccacagtgttgagcaatttacccaacacatttgtaagttttaccagcgactcgacattattatcaataatgcggcacaaacagtgcgtcgtccgccagcgttttatcatcatttaattgagtttgaatcactacctttcggggaactaccgccagaaatacaggtgttagtaggccataatcatgcggtgaacactgagaattctgcactattagctagtacagaagaaaaagaagccacatttaccaaaaattctgctttcctgtcccaaattcctttgattcccgaagacataggcgataattcggcttatttccctctagaagggtataccgatgatgagcaacaacttgacttgcgtccctttaatagctggctgatgaaggatgatgaagtcagtattttagaattattggaagtgcatataattaatgcgatcgctccatttgtcattaacagtagactcaagcgattaatgagcaactacaaagaaactaataaatacatcattaatgtttcttcaatggaagggcgatttaacgatgttgacaaaccttggcgacatccccacaccaatatggccaaggctgctctcaatcaaatgacccgtacctgtgccaaagaatacgccaaacatcgtatttttatgaatgcagtagaccctggatggattagcttccaacacccctatcatcaagcaaaatccatgcaagaacgtggcgtttatcctccctttgatgtcaatgatgctgctgcacgcatttgtgacccaatttatctaggaattaaccaaggtaaaacaccctttgctagattatttaaagactatacagaaatagactgg

SEQ ID NO: 43816 - DNA, 756 bp, Nostoc punctiforme
gttgtggtacgttaccaagggggtgtcaatgctggacacacgattgtagttaaaggtcagacctttaaactacacttgattccctctggtattttgtatccaaataccgattgcattatcggctgtggaacagtaatcgatccacagattttgatcgcagaaatcgaccaactaaaagaactaaatatttccactgaccacctgctgatatctgagacagcccacgtaacaatgccttatcatcggttgattgaccaggcatctgaagaacgacggggaagctataagatcggcacaacaggtcggggcattgggccgacttatgctgacaaatctgaacgtactggcatccgggttttagacttgatggaccccgatgggctacgtgagcagttagagtggacgattaattataaaaacgtcattttagaaaagctttacaacttgccgcctctagatccacaagaggtgattgaacagtatttggggtatgcagaacgtttgcgacctcacgttgttgatacatcgttaaaaatatccgatgcaattcagcgacggcgcaatattttgtttgaaggcgcacaaggcacccttcttgacttagatcatggaacttatccttatgtcacctcttcaaaccctgtagctggaggggcttgcgttggtacaggggtaggcccgacaatgattgaccgggtaattggcgtgtcgaaagcctacacaacgcgggtgggagaggggccatataccacagaa

SEQ ID NO: 43817 - DNA, 1989 bp, Nostoc punctiforme
tttcccttgacagccgtagtcggtcaagaagcaattaaattagccttgctgttagccgcagttgatcctggtttgggaggagtagcgatcgcaggtcgtcgtggtacggcaaaatctgtaatggctcgtgctatccacgctctactaccgcccattgaagttgttaaaggttcaattagtaattgtgaccccaaccaccccgaagaatgggacgatcaactattggcggagtacgcagacaaagacattcaggatgttcccgttgaaattatccccgcgccttttttacaaattcctttaggtatcaccgaagaccgactattaggttcagtagatgttgaaaagtcggtaaaacaaggtgataccatttttcagcctggattactcgctacagcaaatcgaggtgtactgtacgtagatgaaattaatttattagatgaccaaatatcaaatcagcttctaacagtattatctgagggacgcaaccagattgaacgggaagggattagttttcagcatccgtgcaaatccctatttattgccacctacaacccagaagaaggcggattacgggagcatttattagatagaattgcgatcgcactctctgctgacggtgtactcggcttagatcaaagagtagcagcagttgaacaagcgatcgcttattctaaatctccccaagactttctcaaacagtacaacgaagatttagactccctcaaaacccaaatcatcttggcacgggaatggttgaaagaagtaatcatcacccatgaacaaattgcttacttagtagatgagtctattcgcggaggagttcagggacatcgcgccgagttattcgccacgcgggttgccaaagctgcggcggctttggagggacgaacaacagttaatgccgaagatttgcgccgtgctgtagaactggtaattgtaccacgtgccacagttgtgcagacaccgccacccgatcaagcaccaccaccgcctccaccgccgccacaacagaaccaagaagaaccccaggacgaatcagaagaggaacaagaagaacaagaagaacaagaaaatcaagagcaagaaccccccagcatcccggaagaatttatctttgatccggaaggggtaatccttgatgacaacgtgctgtactttacccaaatggcgaagcggcaaggtaaatctggtagtcgcagtgtcatcttttccgatgacaggggacgctacattaagccaatgttacccaagggaaaagcgcgacgcattgcagtagatgctaccctcagagcagctgctccttatcaaaaagcacgcagagaaaggcaaccagatagaaaagttattgtcgaacaatctgatattcgctcgaaacgcctggtacgcaaagccggggcgttggtagtatttgtggtagatgcttctggctcaatggccctgaatcgaatgcaatcggctaaaggtgcagtgatgcaactattaacagaagcttatcaaaaccgcgatcaaatagcattaattcctttccggggagaacaggcagaggtattattgcctccaacacgttctattgctttggcgcgtaaccgtttggaaaggttgccctgtggtgggggttcgcccttagcgcatggtttaactcaagctgtacgcgtcggcttaaatgcccagatgagtggagatattgggcaagttgtccttgtagcaatcaccgatgggcggggtaatattcccttagcgcgttctttaggtgaacagattgaaccaggagaaaagccagatatcaaaggagaattattagaaattgctgctagaattcgtgctttggggatgcaactattagtaattgatacggaaagtaaatttgtgtctactggctttgctaaagaattatcgcaaacagcaggcggtaaatattatcatttgccaaaagcgacagatcaagctattgctgctatgaccaaaggtgcgatcgctgatttaaaatct

SEQ ID NO: 43818 - DNA, 1233 bp, Nostoc punctiforme
gtggatgccacggtagaaattcccggttctaaaagtcttaccaatcgggcgttgcttgtggctgctttggcacaaggtgactccattttagaaaatgccttatttagtgaagatagcgagtattttgctaaatgtttagagcaattaggcattcccattacactgaatcctcatctagcacagatccaactagcgggaagaggaggtgagattccagctaaacaggcagatttatttgtgggtttatcaggtactacagcacggtttatttcggcgctggtggcgctgggtaacggtgaatatcgtctagatggcgttcccagaatgcgagaacgaccgatgggtgacatgctgacggtgctggaaacgggtggagcaactgttaactttgagggaaactctgggtttatgccctacaccgtctatagccagggattcgctggcggaaatttttgcttaaaagcgaaccaaacaagtcagcaactttcggcattgttgatgattgcgccttacgctcaacaggatacgatttttgaggttgagggtacactggtttctctgtcttacatcaaaatgacctgtcgtctgatggcagattttggcgtagaggtaattcaaattggcgataatcaatttcagatcaaagcgggtcaacgttaccaagctcaacattatacagtagaacccgatgcgtcaaatgcttcttacttttttgccgccgccgctgtcacggggggacgggtgcgcgtcaaacatttgactaaacaatcgtgtcagggtgatattctgtggctgaatgttttagaacagatgggttgccaaattaaggattcggatgattacaccgaagtgacggggccgaagcaattgcaaggcatcgacattgatatgaatgatatctcggatttggtgcaaacattagctgcgatcgcaccctttgccagttcaccgattaccattcgtaacgtggaacatattcgctataaggaaactgaccgaattaaagctgttgtcacagagttgcgtcggctaggggttcaggttgaagaatttccagatagactaaaaattgagcctggccccattaccccggcggagattgaaacctatcacgatcatcgaatggcgatggcttttgctgtcactggcttgaaggttccaggaattgtaattaaagatcctggttgtacagcaaaaacttttccagattactttaccagattctttcaaatg

SEQ ID NO: 43819 - DNA, 732 bp, Nostoc punctiforme
atgttaaacgtagaaaataaagtcattgcgatcgctggagccagtagcggtattggtgaagccacagctaagttactcgctaaaaatggtgcaaaagtcgttttaggggcacggcgcacccaaaagctagaaaagattatcgaggagatccgtaaccagggttatatagcggaattcaaagcggtggatgttacgaatcgtgaggatatgaaagcgttcattcacttcgccaaagataagtttggtcgtgtcgatgtcatctttaacaatgcaggcgtgatgcccctatcgccgatgaatgccctgaaagtcgaggaatgggacaacatgattaatgtgaatatccacggcgtattgaatggtattgctgctggtttaccaatcatggaagcgcaaggcagtggacagtttatcaataccgcgtccatcgccgcgcacatggtagggcctaccagcgcggtctattccgcgacaaaatttgctgtttgggccatatccgatggattacgtcaagaatcgaaaaatattcgcgtgacaataatatcccctggcgtggttgagactgaactcggctctgatatcacagatgaatcagcaacaggcttcttgaaagaacttcggaaaatcgcactgaccccagatgcgatcgctagagccgtcttatatgccgtatcccaaccggatgatgttgatatcaatgaagtgattgtccgtccgacggcaagcgcattc

SEQ ID NO: 43820 - DNA, 760 bp, Nostoc punctiforme
gtcacagtgtaagtattcccctctattgacatagaacaatcactcagcacaaaaacaatgtaaactatgtaaattaagttaacaattatttacattttaccaaaaaatcatgctagctgcaattctctttgacctcgacggcactattgtcaataccgaccccatacactaccgagcttggcgggaaatgctgttaaattacagcctagaaattgacgaaacattttataaatccagaattagcgggcggctaaatccagaaattgttaaggatattttgccacaattatcaaccacagaagggcagaaatttgcagacgaaaaagaggcgcttttccgcaaactcgcctcgaatcttaaaccattgaatggattttctgaactactagcatggacagagacacatgagttaaagcgagcattagtaactaatgctcctagattaaatgcagaatttatgctagaggtattgggaataaaagaagctttccatacagttgttgtagcggatgattgtgtagcagggaaacctgaccctgcgccctaccaagtcgctctgaataagttggcgatttcagcagaggaagcgatcgcattagaagactctccctctggtattcgggcggcggtgagcgcagatatccgcactattggtatcgcttctacccacgatccgcaatttttacaagaagttggcgcatttatggcaattccagattttactgatttgcagttgtggacattgctcaactcactcatt

SEQ ID NO: 43821 - DNA, 984 bp, Nostoc punctiforme
aaaacacttcggaatcgctttgaaattatcaagcacttaggaagcggaggctctggtgatacatacttagccgtagacctagatttaccaggacaaccccattgtgtggtcaaacatttccaaccaaaagattccaatcctgctgttctacccatcgctaaaaagttatttgatcgagaagcagaagttttataccagctaggcaacgatcacgatcaaattcctagactgtttgcccattttgatgaagatggagatttctatttagtccaagagtttattgatggtcatgcgttaacccaagaaattgtctcaggtcagcgtctgagcgagagtgtagtcttaagtttattaaaagacattttggaagtgctggcattcgtccatcaaaataacattattcatcgggatattaagccccaaaatttaatgcggcggcgctccgatcggaagattgtgctaattgactttgggagtattaagaaaattggtgctttgggagcaggtttaactattgctgttgggactcctggttatatgccaagcgaacaggctaaaggaaaaccaaaactttgcagcgatatctatgcagtagggatgataggcattcaagctttgacaggtttaatccctgagcaaataaaagaagatcccaatactggagaagttctctggcgcgatcaggtacaggtaagtgatgctcttgcaaatattttagatacaatggttcgcgatcgctacaaccagcgttatcagtctgctacagaagctttgcaagcacttaattctgctctgctgttgccacagtcatcagaatctgctggcatcaaccaaaattctgatgatacctatttgctaaattatagaaactttgttttgcttctaggaatagggcttggtgctaccactagttttatagtactaattttaatctatacatttattaatacaagtgcatcgtctccaaacaaacctactcaatta

SEQ ID NO: 43822 - DNA, 1197 bp, Nostoc punctiforme
atgggtcgcgccaaaaaggttgtcctggcatattctggtggagtggatacttccgtttgcatcccttacctcaaacaggagtggggtgtggaagaggtgattaccctagcagcagatttaggtcagggagatgaattagagccaattcgagaaaaagctctgaaatcgggtgcaagtgaatcactcgtggcggatgtcaaagacagcttcgttaaagattacgcttttggagcgattcaagccaacgcactttatgaaaatcgttatcctctaggaactgctcttgcccgtccactgatcgctaagatattagtagaaacggctgaaaaatatggtgctgatgcgatcgctcacggttgcactggcaaaggtaacgatcaggttcgctttgatgtctctgtgactgccctcaaccccaacctaaaaatcctcgcaccagccagagaatggggtatgagccgtgaggaaaccatcgcttatggtgagaagtttggtatcccctcaccagtcaaaaaatcttctccctacagcattgacaaaaatttgctcggtcgtagcattgaagctggtttactcgaagatccatcatttgagccaccagaagaaatttatgagatgactaaagcgatcgctgacactcccaacgagccagagtacatcaaaattggtttccacggtggtattcccacaaccctcaacggtatagctaaacagccagttgaactaattgaagaactcaatcagcttgtaggaaatcacggtgttggacggatagatatgattgaaaaccgtctggttggcatcaaatcgcgggaaatctacgaatcacccgcgatgttagtgctaattcaggcacatcgggatttagaaagcttgactttgacggcagatgtcacccattacaaacgtggcattgaagaaacttatagccaaatcgtttacaacggtttgtggtacagtccactcaaagttgcactagatgcctttattcaaaagacacaagagcgagtctctggaactgtgcgagtgaagctattcaagggtaactccacgatagttgggcgttcgagcgatagttccctctatactcctgatttggcaacctacggagccgatgaccaatttgaccataaagctgctgaaggttttatctatgtttggggactaccaactcgcatttggtcgcggcaaataaaa

SEQ ID NO: 43823 - DNA, 1026 bp, Nostoc punctiforme
atggttcaagagcgtactttacccacatttaatcctgctactacgcaaattactaaagaagaagggttatggttgtatgaggatatggttttagggcgcttgtttgaagacaagtgcgctgaaatgtactacaggggcaaaatgtttggttttgttcatttgtacaacggtcaagaagctgtttgtacgggtgttgtacagtcaatgcgaccgggtgaagattacgtttgtagtacttaccgcgaccacgttcatgctctgagtgcgggagtaccagcaagagaggtaatggcagaattatttggcaaagccacaggttgcagcaaagggcgcggtggttccatgcacatgttttctgcggaacatcgtttgctgggtggctatgcttttgtggctgagggaattcctgtagcagctggagcagcttttcaaagcaaataccgccgcgaagtgctgggagataaaaatgctgaccaagtgacagcttgcttttttggcgacggtgcagctaacaacggtcagttttttgagacactaaatatggcagccctatggaaactgccaattctttttgtagtcgaaaataataagtgggccattgggatgtctcacgaacgagccacttcccagccagagatttataaaaaagccagtgcatttaacatggtgggcgtggaagtagatggtatggatgttctagcagtccgagccgtcgctcaagaagccgtcgctcgtgcccgtgcaggtgaaggcccaacattaattgaggcgcttacctaccgcttccgtggtcactccttggctgacccagatgaaatgcggagcaaagctgagaaagaattttggtttgcccgtgacccaattaagaagctggctgcttatttgctagagcaaaacctggcgaatgagggagaaatcaaagcaattgaccgtaaaattcaggatgtaatcgacgaggcagttaaattcgccgaaagcagccccgaaccagaccccagcgagttatatcgttttgtgtttgcagaa

SEQ ID NO: 43824 - DNA, 915 bp, Nostoc punctiforme
ttaggagtaaataaaatgaaaaatgaaaaatggaacacggaaaatattctgagtcaaaaaggaagagtagcaattgtaacgggttcgagcagcggtatcggttatgaaacggcgcgggttttagcaaataaacaagcgtctgtaatcattgcggttcgcaatttggacaaaggaaacaaggcattggcaaaaattcttcaacagaataaagatgccgacgtaaaggtaatggaacttgatttggcgaatttagcatcagttaaaaattttgctgaaaactttcagaaaaattatgtgcgtctggatttactaattaataatgcaggtgtgatgattccgccatattcaaaaacgacggacggttttgaattgcagttcggcactaatcatcttggacattttgctttgacgggacagcttttggaacgtttgatcgacaccgaagactcacgaattgtcaatgtttcgagcggcgcacatagtataggcaaaatagatttcgatgatttgaattgggaaaagagaagttatgccaaatggaaagcctacggcgatagcaaacttgccaacctctatttcacctacgaactcgaccgaaaactaaaagataagggtatcgatacacttgtaaccgcctcgcatcctggctggacagcaaccgaattgcagagaactgcgggtggcgttgtgaaatatctcaacggcatccttgctcaagacatcacgatgggcgcattaccgactctgcgggcagcaaccgaagcaggcttaaaaggcgcagaatatttcggccccaatgggtttatggagatgcgcggctatccaataaaagtcgaatcaaacgaattatctaaagaccaagcgatcgctaaaaaactatgggaagtatcagaaaaactcaccaatgtgaaattt

SEQ ID NO: 43825 - DNA, 1077 bp, Nostoc punctiforme
atggcgcttgtaccactgcggctgctgttggatcacgcagctgaaaacggttacggcatcccagctttcaacgttaacaatttggagcagattcaggcaatcctgaaggctgctgtagagacagatagccccgtaattttacaagcttcacgcggcgctcgtaattatgcaggagaaaacttcctccgccacctgattttggcagcggtagaaacctatcctcacattcccattgtcatgcaccaagatcatggtaatgcgcctgctacctgctactcagcaattaagaacaacttcaccagcgtgatgatggatggttctttagaagctgatgcgaaaactcctgctagcttcgagtacaacgtcaatgttacccgcgaagttgtaaatgtagctcatgctttgggtgtcagcgttgaaggtgaactcggttgtttgggttctctagaaactggtgctggtgaagctgaagatggtcacggatttgaaggtacactcgaccactcacaactgctaaccgaccccgatgaagctgttgacttcgtagaagcaacccaagtagatgcattggctgttgccattggcacaagccacggtgcttacaagtttacccgcaagccgactggtgaaattttggccatcagccgcattgaagaaattcaccgccgtctgcctaacacccacttggtaatgcacggttcatcctctgtacctgaagatttacttgcactgattaaccagtatggtggtgcaattcctgaaacctacggtgtacctgtagaagaaatccaaaaaggtattaagagtggtgtacgtaaagtaaacatcgacaccgacaaccgtttggcaatcactgctgctgtacgtgaagctttggctaaaaagccagaggagtttgacccccgtcacttcctcaagccttctattacatacatgcaaaaagtttgtgctgaacgctatcagcaatttggcactgctggcaacgcaagcaagattaagcaaatttctttggaagattttgctgctaagtatgctaaaggtgaactcaacgttgttacaaagtctgctgctaaagtt

SEQ ID NO: 43826 - DNA, 675 bp, Nostoc punctiforme
ttagaaaaattaaatgagcaatttgaaactgccactcctaaagagatactggcatggtctatagagaatatcccaacgggattggtgcaaaccagcgcctttaacgtggatgacatgataattacccatattctttacagtgaactgaagcatcccgttcctgtgatctttctcgacactttacatcacttccctgagagcctagaattagtagccaaagccaaagaaatctacaatctggacttgcaaactttcaaaactccagacgtagaaacccgtgaagcctttgaagccaaatacggcgacaaactttgggatacggatattgccaaattccaccacattacaaaaattgaaccactgttacggggtctagacgaactcaacagcgtggcttggattaccggtcgccgccgtgaccaagcagtaacccgtgcgaatatgcccatatttgaatttgatggtaaaggtcggttgaaagtaaatcccattgctacctggacacgtcaagatacctgggtttacgtagctgaacacggagtcatctacaacccactccatgacaaaggctatcccagcataggcgaccaacccatcaccaccaaagtaggcgaaggtgaagacgaacgcgccggacgttggcggggaagtgataaaacagaatgcggaattcat

SEQ ID NO: 43827 - DNA, 1530 bp, Nostoc punctiforme
atttttggcagtctataccctgacattcctatccctaaacagccactgacagaatttgtcttgcaacgagcaataaatttagccgacaaaccagcccttattgaaggactaactaacaggataataacatataaacaactagtcgagtcaattcgtaaaattgcttgtagcttggcagcgcgtggcttctccaagggagatgttttagctatttacagccctaatattccggaatatgcgatcgcttttcatgccgtagcaactttaggtgggattatcaccacagtcaacccatcctacaccgcagaagaactggcatatcaactcaatgatgctggagcaaaacatctcatcaccatcccagaccttgtagggcaagcattagaagcgattggtcactcaaaagtagaggaagtattcgtatttggtgaagcagctggagctacccgattttctgtacttttagaaggtgaaggagaaataccaaaagtacaaatcaatccacaagaagatttagtagccttgctctactctagtggtactactggtatgcctaaaggtgtaatgcacacccaccattcatttgtggccaactttcaccaattccaaaactgcgagccagtcagcaaggctgatgcaattatcggagttttacctttttttcacgcctatggcctggtcatgctgaattacagcctggcttgcggtgctactgttgtgacgatgccgcgctttgatttagaagcctttgtgagcctgattgaaaagcataaaatcacccgtattcacatcgttccgccaattttgctggcattagcaaagcagccaatagtagataaatacgatctttcgagcttgcgagtgctgacttctggagcagcaccacttagccatcaattgatcgaagagtgcgaacagcgtctgactaattgcgttgttaagcaagcatacggaacgacagaaacctttgtgaccacctacactccagatgaacgtgacaaaatcaagcctggttcagtaggtcaatgtctccctcatgttgaatgtcaaatcgtaaatgtcgatacccaacaaccattaggttttaatcaatcaggagagttgtgggtacgcgggccgcagatcatgaaaggctatttgaataatcccgacgcaactgccagcacaatcaatcgagatggttggtatcacactggtgatattgtctatattgacgaagacgactacttttacatagtcgatcgcatcaaagaattgattaagtgtaatggctactccatagcaccggcagaattagaagcagtattgttgagtcatccggctgtcgctgatgcttgtgtagtcaagagtcctcatcctagtagtggggaagttcccaaagcttttgtcgtactaaaagccgctgccactgcacaggaaattatggagtttgtcgctggtcaagttgcaccgcataaaatgatccgcagacttgaatttgtggacaaaattcccaaatcgccttctggcaaaattttgcgccgcatattg

SEQ ID NO: 43828 - DNA, 840 bp, Nostoc punctiforme
aaattactacaagggcgttaccaaattgtccaaagccttggtgcaggggtatttggacaaacatacatagctgtagacgtagattttccccagaatcctaaatgtgttattaagcagataaaagttagcagttccgaacctggctacttggagatgctgaggttaatgtttctaactgaaactgaaaccctcaagcttctgggaagccatcaacaaattcctgaatttatcgcctgctttgaagaaaacagccagttttatttagtacaagagctaattgaaggacatgcgctgactgcggaattgcccattgctcaacagtgggggtgtctgtggaatgaaagggaagttgtacaattcctgatagatgttttaagtattctagaatttgttcactctcaaggcgtgatccattgtgacatcaaaccagaaaacttaattagacgtaatagcgatggcaagttagttttgattgactttggctcaatccagtctatcgattttggcataggtgcggaattgccgatttataggattcccgtcacctcattgggatatataccaccagagcaatttattggtcaaacacagcccaacagcgatatttatgctttggggatgattgctatccaggctttaactgggttagaaccactacaattaaaagttgatcctcatactaatgaaattttttggcgttctcaaaacacgccagttaacgattatctagctgctgttctcagccaaatgatccgttacgattctcaaaatcgcttccagtcagcgactgaggtactgcgggtactcaaacaaataacatgggatcagccaccagaaata

SEQ ID NO: 43829 - DNA, 1399 bp, Nostoc punctiforme
caagcatttgaacaacgtgaactgaaaaaatctaaagctgcggctgatacagccaaccatgctaaaagcgaatttttagctaacatgagtcatgaactgcgaacacctttaaatggcattctcggttgtgcccaaattttgctgcgttccccagctttacctaagcaagagctatatcacgtcaatattattgaacaatgtggctctcatctgctgactttaattaatgacattttagatctctccaaaattgaagcgaaaaagctagaactttatccagatgatgtgcatttcccctcatttctccaaggaattgtcgaaatatgccacattcgggcaaaacaaaagggcattttgtttgtctataaacctgggataaatttgcctacagggattcatgtcgatgtcaaaagattacgtcaggtactattgaatctgctgggaaatgccatcaaatttacagatgaaggtcaggttactttcaatattgaagtcatcgatcgagctcccaatgatgtgcagataataaaacatcgccttcgctttactgtagaagacacaggaattggtataactcccgtagaattgagccagattttcttgccatttgaacaagtaggtgagaaaaagcgccaagctgaaggtacagggctgggtttagctattactcggcagttagtacagatgatgggtagcgatatccatgttcatagtcagattggtcagggaagtagctttttgtttgagttagagatacccgaagcgactgactgggtacaatctgcgatcgctacctcagagaaacaaatcattggctttgagggtggtccctacactatcctaatggttgacgatcgctgggagaatcgcacagtgattacaaacttactgcaaccactgggttttaatgtggttgaagccagcaacggtaaagaaggtttagaaaaagcgatcgccctcaaaccaaacttaatcgttacagatttgctgatgccagaaatggatgggtttgaattaattaaacacctgcgtcacactccagaaattcaggatgtattgattatcgtttcttccgctagtgtctttgaagccgaccgaaatcgcagtctgcaagctggaggtaacgcctttttgagcaaacccatacaagtagatgaattattgcatcaactagaacaatacttaaatttggtatggatttacaagcaatctcagcctgatggagaaaaagccaaagatggaacgacagcaactgctcaattaatccttccttcccctcaggtgttgcaagaactagtcattttagccagtagaggtaactttaatggcattatcaagtgggccgatcaactggaagaaacagatacaacttttgcaccatttgctaacgaactacggc

SEQ ID NO: 43830 - DNA, 795 bp, Nostoc punctiforme
cttgttggaagataccaaattattagtaacttgggaggagggggttttggtgaaacctttgttgcttatgatactcaattacccggttcacctcaatgtgtggtcaagaaactcaaaccccaagcaaacgatccggtaactttagagacggctaggcgcttatttgatacagaagcacaagttctgtataaattaggaactcacgatcgcattccccaacttttagcttattttgaggagaatgccgaattttatctcgtacaggaattgatcgaaggtcatgacctaagtcaagaattaataccaggtaaaacccttagtcaagagcaagtaatttcacttttacaagaacttttgacaattctagaatttgtccatcaacagaatgtaattcaccgtgatgtcaacccccgaaatatcctcagacgacacccggatggcaaattaatcttaattgattttggtgcggttaaacaaattactacccaagtaattactcccgaaggttcaactaaaggtactgttgctataggtacgcctggatatattcctggagaacaagctcatggtacgccaaaattaagcagtgatatttatgctgcgggaatcattgctattcaagctctcactggattattaccagaggaaatagtaaaagatgctgagactaatgaaattatgtggcgcgataaagccacagtaacgccagaatttgctcaattcttagacaaaatggtgtgctacgactttcgacaacgctattcttcggctacggtagcattaaaagcgctgaaa

SEQ ID NO: 43831 - DNA, 2952 bp, Nostoc punctiforme
agcttttaagaatttaatggatggaatatgcttactaatgagaagagtcagggcaacaagattcaattaccatatcaaggactaactttggaggaagttaagctcaatcgccaaaaatatggtgccaacgttcttactcctccagaacgagagccattatggaaattgttcttagagaaatttgaagatccagtaattcggattctgatgattgctgctgcgatcgctattagtgtcggaatttttgagggtgaatatgctgaaggtttagggattgtagctgctatcttgttagcgacaactctcgctttttttaacgaatataaagccagtcaagaatttgacattctcaatcaagtttatgacgaagtatttatcaaagtcatccgagatagcagctttaccactgttaagcgtaaagatttagtttttggtgatgttgtatatgtagaacaaggtgaagaaatcccaactgatggacaaattttagaagaaatatctttagaaattgaccagtcaaaaatcactggagaagcggaaccagttaaaaagcttactcaagctgacgcagagaatcaaggtattgaagaaggaacttacccagcttacaaaatttatcgcagtacgattgttgaacaaggacaaggttattttgaagttactgccgttggtgataatacagaaattggtaaattggcaacagcaattgccagcatcgaaaacacagaagacacaccgcttaatcatcaactagaaaaacttagtaaactcattggtgtagttggtcttggatttgctggtttcactttcatatctttgctggtgcgcggttttgtcactaaagaattaagcctgagttctcaacagtggtatgttgtcggactgtcaattattagtgtgctagtaacacttagccgagtatggctacctgtaatttatgatggtctggagctagctggtagcaaacttatagcaccaaaatggctggaaaataatagtcttcctagttggctaaaaacagttggtataggattagtatttttcactattggacttgctttaggctatcctctaggactaattcctggctctataaataactgggtacctagtactgttgccaaagcattactgcactactttatggtagctgtgacaattattgtggtagctgtgccagaaggtttagcaatgagtgttaccctcagtcttgcctacagtatgaaaaagatggcagcttccaataatttggtgcgtcggatgcacgcttgtgaaactattggttcagctacagtaatttgctctgataaaactggcactcttacccaaaatcaaatgcgggtatatgaagtcaattttcctagtttgaattctcaactgttgccagcacttaaagatgtgaaaggtttaatagcggaggcgatcgcagttaatagtactgctgatttagagaaaaaacctttgcagactcctcgtcctattggcaatgctacagaaggagctttacttttatggctagatagccaggatactgattacatatcttaccggggtaattttcaaataaaatcccgaatgcctttttgcggtcagaaaaaatacatgggcacaattggcatttcctctgtaactgggaaggatgtgctttatgtgaaaggagcgccagaggtaattttggaacgttgttcgcaaattcttacacagcaaggactagaatcactcaagaataaagccgcgatcgcatctgcaattaaagaatatcaaagacgaggaatgcgggcactagggtttgcttaccatgaagtctcacagcattcgagtgagacgaacttggacgaaattgctcacgacatgacttggctggggtttgtggcaattttagaccccttgcgtccagaagtacctgatgccatccaagcctgcttaaatgcaggaatacaagtcaaagttgtaacaggcgataactcggagacggctaaggaaattgctcgtcaaattggactttggcaagaagaagatgactttaatagcggttatttacatttgactggtcagcaatttgatcaactgagtgacgaagaagcaagtcaggcagtgctgcaattaaaggtactttccagagcgcgaccacttgataagctgcggctggtgaaactattacaggagaatggtgaggtagtaggtgtcaccggagatggtacaaacgatgcagctgctctcaagcaagctcaggtaggtttggcaatgggaagtggtacagcgatcgctaaagaggccagcgacattattttgcttgacgattctttccgcagtattgtaaatgcagttgtttgggggcgatcgctttaccaaaatatccaacgatttattctatttcagttaacaatcaacgttgtagcgttagggattgctttagtagggccatttatcggtgtagcgctacctctaactgtcacccaaatgctctgggtaaacttaattatggatacctttgctgctttggctttggcgacggaaccccctcatcggagcgtcatgcagcactctccccgtaacccagaagcccttattgtcaccaaagcaatggcacagaatatttttactgttgggttagcatttttgctttttctggttggtttcttacgctatatccgtcgagatggagaaatcactccttatgagctttccgtgttcttcggcgtgttcgtaatgttacagttttggaatttgttcaatgctcgatgcttggggttaaagcagtctgcgttcaaaggtttgtctaagaataaaggatttgtagcgatcgctattaccatttttgtaggacagatattgattattcagtttggtggtagcgtttttagaacagtacctttgtctttggtggactggataagtgtaattgttgtaacatcgacagtgctttggattggtgaactatggcgcttcata

SEQ ID NO: 43832 - DNA, 1209 bp, Nostoc punctiforme
ctcacccaaactgttccccgtcaacgagaaattcttgaagtattccttcgcaatggttgggactatatgcgaaggttactcactggtggcaaagctgatgaaccacagttacctacacctgcggttttaaaaaatatcctggtagacttggggccagtttacgttaaacttggacagctaatgtctacacgtccagatttactgaacgctgcctacattgaggaactatctaccttacaagacgaagtaccaccagttccttggtcagaaatagaaataatccttcgcaaagaattaaaacgtccactagcagaaaccttcaagacagttaacccgatccccgtagcggcgggatcaattgcccagacacatcgcgctacattagcagacggtcgagaagttgctctaaaagtacaacgtccgggaatcgatctgactattgcccaagatattgctttaattcaaggtattgccgatttagtggcgcggactgaatttggacaaacctacgaaatcaaatccatcgctgaagaattcaccaaagccctagaagccgagttagattttacacgggaagcgggttttacagaccaactacggcgcaacttatctaaaagtcgctggtttgatcccacgcaaatagtggttgcagagattaactgggaattgaccacagaaaaattactggtgatggaatggttagatggagtaccattcttgtcggcagatttaaacaataacaataatggtaaagaccctgccgtagagcgtaaagaaataactactttgttatttcgggtattttttcagcaactatatattgatggcttttttcacgccgatccccatccgggaaacttgttttatctcacagatgggcgtgttgctcttttagactgtggtatggtgggaagacttgatccccgcacacagcagatattaacagagatgttgttagcgatcgttgatttagatgctcaaaggtgcgctcagttaactttgcagctatcagattctgctcaaccagttattttgtcgcggttagaaaatgattatgatcgcatgttgcgaaagtatcacaatgtcagcttaacgcaaatcaacttcagtcagataatttatgaagttttacaagttgcccgtaacaataaaattagattacctagcaatatgggtttgtatgccaaaactctagcaaatttagagggt

SEQ ID NO: 43833 - DNA, 1410 bp, Nostoc punctiforme
attaagtttggtacagacggctggcggggcgttatcggtgacgagttcacctttgaacgtctagccctggtcgcgccagttgccgcaaaagtattatatgatacgtatttttctacggtgggtagccggacaataattgtcggttacgatcgccgattcatggctgaagactttgctcgtgctgtcgccgatactgtcagtgctgtgggatttgatgtgctattgagcgaggactatgctccaaccccagcttatagttgggcagcaaaagaactcaatgctttaggggcgctggtaattacggccagccacaaccctggtaaatatttgggtttaaaagtcaagggttattttggtggatcggtaccgtcagaagtcacaaaaaagatagaagagcagttgtcagtgggagtacctctagcagctaccccaggtaagcaagagaaattcgatccttggcccagttatacccaagcactagaacgtaaagttgatatcgccaaacttcgagaagcgatcgcatctggcaaattgacgttatttgcagatgtcatgcatggcgctgcggctggcggattggcgagactactaggcaatcaagtcaaagaaatcaactcacaacgcgaccccctttttggtggcggtgcgccggaacccttacctaaatacctttcaaagctatttgaagtcatcaagactcaccgagaaaccgataaatcaggtttaacagtggggttggtatttgatggagactgcgatcgcattgcagcagtagatggggaagcaaacttcctaagttcccaagtattaataccgatattaatcgaccacctaactctgcggcgcaactttagtggtgaaatagtcaaaactgtcagtggttccgacttgatgccccttgtagcagcactgcataacctgtcagtctttgagacagcagttggttataaatacatcgctgacagaatgttagtagcaaaagtgttgctaggtggcgaagaatcgggaggaattggctatggcagtcatattcccgaacgcgatgccctgctgtcagctttatacgtcctagaggcgatcgtagaatctggtttggatttaggcgagtataatcgctacttgcaaaaacaaacagggtttacctcagcttacgatcgcattgatttacccttagcaagtatggaagtgcgatcgcgtcttttgcaacagctgcaaaccaaacccttaacagaaattgcagggttagcagtaattgattgccaaacaattgacggctacaaatatcgcctcgccgatcaaagctggttaatgattcggtttagcgggactgagccagttttacggctctactgcgaagcctcgacaattgagcaagtgcatcaaactcttgcttgggcgaaacagtgggcg

SEQ ID NO: 43834 - DNA, 918 bp, Nostoc punctiforme
atggcagcattgctcggacgagatttattaagtctagcggatatcagttctactgaacttcaagaactcctgcaattggcaactcaacttaaatcacaacagttgaagttgcagtgtaataaggttttagggttgttgttctccaaagcttcaactcgcacgcgggtaagttttactgtggcgatgtaccaattgggtggacaggtaatcgatctgaacccgaatgtcactcaagttagccgtggggaacctttacaggatacggcgcgggtgttagaccgatatctggatattttggcaattcgcacttttgcacagcaggatttagaaacttttgctcactatgcaaagattccagtaattaatgcgcttactgatgcagaacatccttgtcaggtattagctgatttattgacgattcaagaaagctttaacacccttgctgggttaactttaacctacgtaggtgatgggaataatatggctaattctctgatgttgggctgtgctttggtagggatgaacgtcagaattgctactcctgacggatatgaaccagattctcagattgtagaacaagcaagagcgatcgctaataacaaaactgaagtccttctcactcacgatccagaattagctgctaagggttctactgtactttatactgatgtttgggcaagtatgggtcaagaaacagaagcagacaatcggatgccaattttccagccttaccaaatttcggagcaactattgagccttgctgctccagaggcaattgttttacactgcttaccagctcatcgtggtgaagaaattactgaggcagttattgaaggttctcaatcacgagtttgggaacaggcagaaaatcgcctacacgctcaaaaagctttgcttgcaagtatcttaggggcggaa

SEQ ID NO: 43835 - DNA, 2073 bp, Nostoc punctiforme
atgaagctgacttcaatcaagctctgcaactttcgctccttttatggtacgacaccagaaatgattatcgctgggggagatgctcagaacacgacaatcattcatgggaataatggctctggaaaaactagcttgctgaatgcctttacgtgggtattgtatgataaatttagtgcggcatttgcatcgatagagcagttagtgaataagcgtgcgatcgcagaaacccaaaaaggtcaagctgtagaatgttgggtagagattggctgggaacacgaaggtaaacgctatcgagttaaacgcgcctgtcggggttataaaaacgaaggtgattttgacgctggaaaaactcaattaaccatgtgggttggtggagatgatggcaaatggaatataccaattcagcaaccagacgatataattaatcaaattttacccgcaactttacatcaatattttttctttgacggcgaacgaattgaagaaatcgttcgttctgataaaaaagctgaaattgctgaagctacaaaaattttcttgggtgtggaagtaatcaaccgttccatcagacatttaggagatgctaaaaaaactctagaaaatgatttaaaagctattggtgattctgaaattaaacagttattacgacagcaagaaaaaatagagcgagaacgcgaacgcattaccaaacggcaaactgaaattaaagaagagttagaatatcaacaaactttcaaaaaagagacaagtaaccgtttgcgagaattgagtgctgctaaagaattgcaagaaagatggcaggatttagaatcgcaaaaagcagcaaatcaagaagaatataaaaaaaccaaggaagcgctgaaaaaagttatttctgcgcggggttatacagttttgctttcagaaactacatcgcagtttcgagggattatcaatgatttgaagcagcgcggtgaattaacatcaggaatttcgcgggaatttgtgaatgatttactcaattctcaacgctgtatatgtggtgcagaattacatgagggtaatcattctcatactcatgtgagtacttggttaaataaagccggttcttcggcggtagaagaaactgcaattcggatgctagcacaagtagatgaaattgataagcaagcgataggattttgggaagaagttgatagagaacaaactaggattaatcaattaaggcaaagtatatctcaaattgaaggcgatttagacaatattcaagaacggttgcgaaaagatgctaatgaagaaattagcagtttgcaaaaacgattagatgaaattgaaagtaaaattgatgaattaaatcgagaacagggtgcaaatcagcagcaaattgctcaactcacaactgaaattgaaggtttaaacaaacaaatcgccaaacaaaagctgaatgaagacaagcaaactttagcacagcgacgaattaacgccactcaagatgcaatcgaacggttaacggaagttagaaatcgtcaagaacaacaatttcgtctgcaactagaaaagcgagtgcaggagatattcacagagatttctgttactccatacattcctaaaattagtgataaatatgaactgacattagtagaaaatactacaggtgtggaagcaccagttgcagcatctactggggaaaatcagattctcagcttatcctttattgccagcatcattgacaaagtgcgggaatggagtgagaagcgaaaaatgatgatgattcccgatagtagtacttttccaattgtgatggattcgccgtttggtagtttagatgagaattcgcggcgacatatagcaaagacaattccccaattagcgaatcagttgatagttttagttactaagactcagtggcgcggtgaagtggaagcagaaataacagacagaattgggagagaatatgtgcttacgtattattcttctaaaccggattgtgaacaagattatattgagttgagtggagaaagatatcctttggtgaaacaaagtccgaatgagtttgagtatacagaaattatggaagttgaacgagataggtaa

SEQ ID NO: 43836 - DNA, 1986 bp, Nostoc punctiforme
atgatatttcttgaactcgttctacaaaactttggcccgtatagcggaaaacaagtaatcaaccttaacccaaaaattgatgaggaaacctcacacccaattattctcttaggtgggatgaatggcggcggaaaaactacccttatggatgccattcgtctcgctctttatggcgctcgtgcccaatgttctacccgtggtaatttaagttatagcgattttctcaaccaatgtgttaacaacaaaattgatccagttgcagacacccggattgaattactttttgaacatattgaaaacgataaaccaataaaataccgtgttgtgcgtagttggacaaaaaatcctaaagatggtaaagatacattaggtattttaggtgacagtgatacatggcccgatgctttagttaatatctgggatgaatatattgaaaatctcctgccattaggaatttctaacttatttctctttgatggtgaacaagttaaagaactcgcagaacaggaaacaccaccaccagttgtagtagacgcaattcgcggacttttaggtttagagttagcagatcgtttagcagttgatttagatatcttagttaaccgtaaactgaaagaagttggtaatagtaaagatttagcaaacctagaagaaattgaaactaggttaacccaacagcaagaagattatcaaacaacaggagaaaaattagaaactctcaaaaatcaggtagaagagttagaacaaaagcagcaagaagcctttgataaattcatttctgaaggtgggaagattgctgcagaacgcaatcagctagaactacaacaggatacaaaaactgcggaaattgaacaagtacgtcagtcaatgtgtgaattggcggctgatgttttacctttggcattaattcccaatttgcttaatcaggtgcagacacagggcgaaaaagaatttcgccatcaacaggtacaaatctccaaggatttgttacttaaacgagatcagcgcttactcgcttggctaaatcaagtagaaatttctccgatacaagttgaaaaaatccaatcatttttaatccaagatgtagatagtttatatgcaaagactatccagatagaagcagcttggctattagccgatgatgaaagtttaagtcagctagataaccttatatatcatttacaaaattctaaaatttctgcaaaagagaaattagctattctcaaaaataaaggagaagaaattcatactttagaaagacaagtgcaaacagcagcagcaccagaagattatacaaagctgcgtcaagcattagaaacggcacaaaatcaagttgttgaagctaaagcaaattatgaaacaatccgccgccgtttagctgaattagaaactgttattgctaagtcaaagagagaattaagtgattataccgtagaaaatattaaacataaaaatagcgaacatattattacctcagcagcgaaagttcaagaaacactcaagacttttcgggaaaaattaactctgcgaaaactcaataaattagaggaggaagttaaaaattgcttcctttatctcctgcacaaatcagatttagtgcatcgtatcactattgataccaagacctttagccttttgctttatgatttaaatggtaaacctgtacctaaacatcgcctctctgctggggaaaaacaactacttgcgatcgcattcctttggggtttagccaaagtctctggacaccgcctaccagtagcaatcgatacgccactaggtagactagactcctctcaccgcagtaatttagttgaacgttactttccatccgccagtcaccaagtaattttgctatctacggatacggagattggcaagaaagaagtggaaacactgcgagaaaatgaagcgatcgcccgtgaatatctgctcaaatatgactctaccacccgccaaactaccatacaaccaggatatttttggtaa

SEQ ID NO: 43837 - DNA, 867 bp, Nostoc punctiforme
gcagttgcgattagctcttcggggcaaaccctgattagtgcaggtagagatgatacaattaaattctggaatttacgtactgggaaattgttgcgtagtttagacgctcactcagatggtgttacttcaattgcgattagtccagatggcaagcgaattgtaactggtgggataagcaccccaacaatgaaggtttgggatttacgcagtttccttatgcttaagggcgacagtgggcatacccaaccagtagaaactgttgcgattagttcagatggtaaattgattgctagtggtagtgacgattatacaatcaagctttgggatttacacacgcttaagctgcttgataccattactacacactcaggatttgtgagtaaagttgcatttagccctgatatgcaaacccttgtaagtgctgggggtggcgatgataatacaattaggctgattgatttacaaaccaaaaaaacacgccatattctcaaaggacacaaaactggagttgatgctattgccattactccagatagcaaaaagcttgttactggtagttttggtcagctagtttctcgaaatcgtgcaattagtaccctgaagttatggaatcttcaaactggaaaactgctgcatgagtttgctgataattttagttcagttgaatctcttgtgattagccccaatggaaaaattctgatctgcggcaattatgatggcactattaaaatgtggagcttagagactttaaaactattgcacacatcgagggatggttccagttcggttttagggcttgctttgagtttggatggtaaaaccctcgttagtagcaatgaggatagcattatacatatttggcaaatt

SEQ ID NO: 43838 - DNA, 9755 bp, Nostoc punctiforme
ttactacaagccttggcacaagtagaattaccagcagtcaaactatggctagtaacccaaggcgcacagcctgtaggggaaattagcaaagaattggcgattgccgctgcaccgctttggggtataagtcgagtcatagcaatggagtgtgctgaaatctggggaggcattatagatatagacccagcaagcactctagaggaagcggctaacttactagccgccgaactatctcaatcaaagagccaagaaaatcaactagcttttcgccaacagcaacgttatgtggctcgtctaacgcggacagttgcaattgtatcaacctcacctttgagcctccgaaccgatagcacgtacttaattacaggtggattgggtgctttgggattacgggtagcccattggttggtagaaagaggcgcgcgtcatctgttattactcagccgtcgtcctcctggagaacaagcgcaagcagctattcaggagatggaacaggagggcgcacatattcaggttgccttagcagatgtcaccaatcaagctgaacttagcaccatattacacaacctgaattatcccctacgtggcattatccatgcagcaggagtattagacgatggcatactactgcgacaaacttgggaacggttcgccaaagtcttagctcccaaaatcgatggagcttggaatttgcatcttctcagccgcgactgtgccctagatttcttcgtcatgttttcgtcagtggcttctttaataggctccccaggtcaagggaactacgccgctgccaatatgtatttagatatacttgctcattatcgacgacatcaaggcttacccgctttgagtatcaattggggaccttggtcagatgtaggtatggcagctgatttaaatcatcgcaacctttggagtactgagaacggagttagttacattactccagaacagggattgcgcgccttagaagaactgctcaaacaagggaaaactcaagccggagtcgtaccgatcgcctgggataaattctctacagccgtgcaactaccattgttgcagcaacttactaccaaggtaagtcaatcaccatctcagcccttcttactacggcaattggaatctacaccagtgagcgatcgccgggaattgctgatgtcagccgtacaagaccaagtggtaagagtgctgaggttagataatagccgccccatcgacccggaacgccccttgcaagaaatgggtatggattccctgatggcggtagaattgcgaaatactctcggaaagttggtagataaaactttacccgcagctttgatttttgactatccgagcatctcaaatttgacagagtatttaggtaaagaattggggatatttgcgacaactgcattaccgccgactgtggagagtcgggaactatcacctacagaagcgattgctgttgtggggatgagttgtagattccctggggcagatgatttagagagtttctggcaactcttatgtaatggtacagatgcaattcgagaagtaccgggcgatcgctgggatgtagatgaattttacgatccagacttgtcttttcctgggacgatgaatactcgctggggcggcttcatcaataatatagaccactttgacccccaattttttggtatctctgccagcgaagcccgcagcatggatccccagcaacgcctactcttagaagtttcctgggaagctttggaacacgcaggctatagttccgagcatctggcaggtagtcaaacaggagtattcacaggtatcagcacttgggattacttcacactacaactagacccacctccacggggcggtacagggatggctttgagtattgcagctaaccgtctttcctatctcttagatttgcgcgggccaagcatggcagttgatacggcttgttcttcttccttggtagcggttgatttagcctgtcaaagcttgcggaacggtaaatgcgatctggcattagcagggggtgtaaatatcatcctctcaccattaactaccgttgcctgctcccaagcggggatgatggctgctgatggacactgcaaaacatttgaccagcgagctgatggttatgtccggggagaaggctgtggcgtagtcgtactcaaacgtttatccgatgctctcagagatgacgaccatattctggctctggtgcgtggttctgctgtcaatcaagatggacgcagcaatggtttaactgcccctaatggtttagcccaacaagctgtaattcgccaagccttacaaaatgctgccgtcactcccgacggcatcagttacgttgaagcccacggtacaggcacagctttgggtgatgccattgaagtagaatccctgtggacagtactcaaggaaggtcgcactgacaatcagccttgccggatcagttctgtgaaaactaatattggtcacttagaagcagctgcagggatagctggtttcattaaactagtgctgttgttgcatcgagaacagattcctcctcacctcaacttgcaaactatcaatcccgtgttgaatttggagcaaacccagctacaaattcccacctccttgcaactgtggaaacgaggtgagcagccgcgattagcggggattagttcttttggctttggtgggactaacgttcatgcaattgtggaagaagcacccttggagaaagcagggggagcagaggagcagaggagcaggggagaagaaattataattgagcgtcctttgcatctacttacgctgtcagcaaaaagtgaatcagctttgcaaaacttgattgggcgttaccaccactatttacaggaaaatacaggcgatcgcttggctgatatctgctataccgctaatatgggacgtagccattttgctcatcgtctagcatttgtggtcaattctcaggcgcagttacgagatacccttgccgctttcaatgtaagagaaaaaagtcctgatgtactgtacggcaagcttgatactcaacgccagccaaaagttgcttttatttttgctggtgaaggttcgcagtatgttggtatgggtaagcagctttacaaaacccagccgcagtttcgctcaattttagaagattgcgatcgcctcctacaacatcatcttcaacaatccctacttgcaatcctcgaagatgaatcactgttaacacaaccccgttacgctagtcctgctgtattcgccttgggatacgccttagcccaactttggcgcagttggggcgtacaacctagtgtagtcatgggtggcggagttggtgagtatatcgccgcttgtgtggctggcgtgttcagtttggaagatggtttgcggttaattactcagcaggaatcatgggcagaattcgagccaattgccaagcaggtgaaatttcaagtgccccaaattccgatggtgtcaaccttctatgggcaactgttagctgctgactatatcccagatattgactactggagacgatgctggcaagcaccagcgttatttaaaggagcaatgttagcccttacacaaaaagggtgcaatttattcttagagattggctctgatccccaattatccgagatccaacagcaaggtacttggttacaatcaattgacgattggacagtattattacatagcatgattgcattttatatcaatggtgtagcaattgattggcaaaagtttgaacaaggatatcagcgttgtcgtgtggtcttgccgacttatccctttgaacgaaagcggtactggctcgatccggcagttatcagatcctttagcaaaaaggaggaaaatttatgcaacgagtaggaattgagaaaattaatttatacgctggtcgtttctgtgctgatgccctggaattagctaatttacaaggtaaagatttggattacgtgtctaaacaagtaaaagtaaagacacgttctgtaattcctgcctacgaagatacagttaccttatcggtgaatgcagccaagcgcctcctttccccagaagatgcgcgggatatcgaattgttgattgtggcaacggaatcggctgtggattttggcaaacctgtatctacttgggtacatcggtattgtaatttacctccccattgccgtagctttgaactcaaacacgcctgctacgggttgacagcagccgtcaaaacagcagcaatgtggctgcaaggaggacttacccctggtaaaaaggcattagttatcggctgtgactatagccgtcctcaccttgatgaccgtgataattttattggcggtggtgcagctattgctatgctgattagtaccgatcccaaggtatttgaaattgacttgcatcccgcaggcttttggactaatgaaatttctgataccttccgtccgactgcgagagttgaaattggcgacaatcaaaccagtctttactcttacttagatgctttggaagcctcttacacccactacgaaaaacttgtggggggagtagattatgacaaggatttccaaaaacatatttatcacacaccctttccgggaatgcccttacaagcgcatcggactttgctgagtttattagaagttaacgactcgaaaatctatgaggagaattatcaaaaaaaggtacaagaaggcatttacttcgcccagcaggtaggtagtacttatggctcatctacattcttatgtttgctaagtttgttacactatgcccaggatttacacgcaggtgatcgcatttcgatttttgcctatggttctggttgtcaaggtgaattttatcgcggcactgtcagtccgggtgcaattgaatacatccgttctttggatattgaccgtcatttgcaagaacgtttgccattatctctgatggaatacgaacttttggaatacgcacgagaaaaatatattgatgcgcctgattatcaacccaaaagagacagtttccaaaacgcttatgacaaactctatgccggacaggaactgttggtattaaaacaggtaaaaaattactacaggcaatacgaatggagctaaagttaaaagcaattgagtatcaaatagattcaggagtcgctcacatcacattatcagcaccagaaactggtaatgctttgaacggcgagatgttgggacagttttatcaagctttgcaaaatgcgatcgctaacccaacttgtcgagttattgtaatttctagtataggcgctgacttttgtacagggatggactttaacgccatctttgccaatggttcccgtcctgatttagcgccactgcatgcctttcgtgattgtctgttactaatttatagttctcctagaccagtcataacctgtgtgacaggtaatgttacaggtggtggcgtgggtatagtcgctgcatccgacatcgtactcgccgaggaaaatgttctattcatgctgtcagaagtgctggtggggatgattcctgctgtaattacgccctttttattgtgtcgtctttcctcctcccaggtgaaatatctcactcttagttctagaggtattgatggaaacgaagccaaaaattggggactggtggacgaaattgctagtgatgggatgaacgatacactcaaccgccagattcaacgtttattctattcttcaccggaagcgatcgccgaaagcaaacaatattttgacacatttatcggtcaagatttgcgacaccaaaccgaattcgccatgcaacgcctacagaaatggttagaacaaccccaaattaccacagccatccatcagtttagtgaaggctattcaccaccctggtttcaaaaatataggaggaatagcactaattatccaaaataagcctacaaatataaaactagattctgactctcttaattacgaactccgaattacaaattagtattatgtccgaaattgtaactctttcatgtttagaagatgggatttatcaaatcaatttaaatgatctacaaaacgataatcaactcacagatgagttagttgatatttttttaaaaaaaatagcagaatgcgctaaaaatcctcatttaaaggtattgttaataacaggtcttcctaagattttttgtggtggtgctagcttagatgtactgcaaaaattgctgcgtggtgacacagaagttaaagacctcttactaccaacagaactattacggtttcccgttcccgtaatcgcagcaatggaaggacatgccgtaggaggcggattattaattgccttatgttgcgatgtaattatagccgcacaagaaagtcgttatggcgtgaattttgctggattaggatttacccctggcatgggaacaacatctttacttccatcattagtcggtccattattcgcccatgaaatgatcctcactgccaaactttacaaaggtagagaactacagggaagaggactatttaatgatgtcgtccccaaacaacaagtcatagaagtagcgatggatatcgcccgcaacattgccgaaaaacccaagcacgtattggaaatggtcaaggatactttggcacttccccgccaacgtgctttacaagaggctatgtctcgcgaacatctaatgcatactgtatgttttaatcatccagatactcaatctattgtcaaagatatgtatatttcctaataataacagtagattttatcagcgtttaattattctttttggagattaggagaaaaatcatggtgcaacaaacagttgagcaacaagtcctgaatgtagttaccaaacacatgcgcttgaacattgaaggtttagaaaatgcaaacatcgatccaacaaagtcaatgcgcgatttgggtgctaccagtttagatgcagtagagattgcctcagcttcgatgagagagttaaaagtgaaagttcctagaaccaaactcggcagtgttaagaacattcaagaacttgtagacttacttgctgaaatcaaaatacagcaagggtgaaaagtgctaagacgcgattaatcgcgtctgtacaagaaagagtgctaagtcaaaatactagtccccagtccccaatccccggttccccctgttatgaagaacactaaacaacaatacaacaaggaagcgatcgctgttattggtatgggatgccgatttcctggggcaaaaaatcctgctgctttctggcaaatgttgcgggatgggatgaatgctattacacaagttcccgccaatcgttggtcaatggatgacctctacgacccagatttggcgacccctggaacgatgaatagccgttggggagggtttctgcaaaatgtagaccagtttgatgctaaattcttcggcatttctcccggtgaagccgcaagtacagacccgcagcagcgtttgttactagaggtagcttgggagactttagaaaatgctggtttaaatccgcaacaagtttcaggaagtcaaacaggagtatacataggcattggtagcaacgattatgccaatgtttgctttgaggatttgactcaactaaatgcttattttgtgacaggcaatgccctctgtacaacagtgaatcgcctgtcttacttctttggttggcaagggccgagtctggcattagacactggctgttcttcatccctggttgccatccatcttgcctgccaaagtttgcgaacaagagaaattgaccaagctttggtaggggctgttaacctgattttgtcacccaaagctaacatcggattatcccaagcttggatgatgacatcagataattgttgcaaaagttttgatgcggcggctgatggttacgtgcggggtgaaggttgcggtttagttttgctcaagcgtctagaagatgccattagggacaaagaccggattttagggattatccggggttcagccgttaatcaaaatggctttgggaaaaacttgactgcacccaatcaactagcacagcagtcagttatcagtcaggcgttggcaaatgctggagttgaaccacaacaaattagctatattgaagcccacggagtcggcacacccttggctgatgtgacggaagccagcgcccttaaagcagtcttgcggccagagggggatactctaccgtgttttctcagttccgtcaaaaccaacattggacatttagaaccggctgcgggaattgctgctttaattaaagttttactgtgtttccaacaccaagaaattccaccacaccttcattttcaaaccctaaatccagatattggcgatgattttccctttatcattcccaccacagcaagtccttgggaattgaacaatacacctcgtttggctggaattaattcctttggtttggggggaactaatgcccatcttgttttagaagaaccaccattggagagagcagaggagcaggggagcagggggacagaggagcagaggagcagaggaggagaaaatacaattgagcgtccgttacatttgttgacgctatcagctaacagtgaaaaggcattacgagaattagctaatctttataatacacatattgctaaatctgtcaatatttatttgccagatatttgctactcagcaaatataggtagagcagctttgaaacaccgcttggctatactggtggatacatttgaaagcttgcaacaagaattatcagccttcgccagtgaacaagaggcgggagaatggttttatggtcaacagaactctattaaagttggattcttgtttacaggacaaggaacacaatacattgatatgggtcgtgaactctacgatacacaacctgtatttcgtgaggtactggaacgttgcgatcgcctactcacccctcatttaaataagtcgttattatcaatactttatcctgaatctggtagcaaactattactacacgaaaccgcttacacccaacctgctttgtttggcctagagttcgccttagcagaaatgtggcgttcctggggaatcaagccgtattgtgttatgggctacagcttaggtgaatatgtcgctgcttgtgttgcgggcgttctcagcttggaagatgccttaattttagtagcaaagcgggggcaactgatgcagcagttaccgcaaactggggctatggcttgggtatatacctcaatagacaaagtaataacagtactcttgccatatcagcatcaggttggtatcgctgccatccacggccaagaagaaatcttgattgctggtaaaagtcaagctgtgcagcaaattctccaacagttgaaaagtgagggcatagcttttctcaagctgaagataaatcaagcctttcactctccagccgtcgagccaatattggatgcaatggaggaacttgctgccacattcacctacaacccaccgcagataaattgggtttctagtgtgactggaaaattagtggaggcgatcgcaccccaacattggcgtaatcatctccgagatacattacaattttcaacggcagttgataccctaattgctcaaggttgtaacctgttcctggaattagggccgagttcgaccttagcggaagcaggtaagcgatatcgaccccaaagtgaggaaatttggttatcttctctgaaagaaggatttgaggattggcagcaggtattatcaacactgagtgccttgtatgtacagggagcaaatgttaactgggcaggatttgaccacaattaccaacaccaacgcctagaactaccaacttaccctttccaaagaaag

SEQ ID NO: 43839 - DNA, 8357 bp, Nostoc punctiforme
actaaactagcgctcttggtacaacaaatgcgtgccaaaactgatggaatcgaactgttaaacgccgaacctattgcaattattggtatgggttgccgatttcctggtggaagtgataaccctgaagcattttggcagaatcttcgtaatggtgttgacgctattagcgaaattccgccagaccgttgggatgcagacgcatattatgaccctaatcctgatgcaccaggcaaaatgtattcccgatatggtggttttattggtcaaatcgacaaattcgagccagaatttttcggtatctcgccacgggaagcgcagagtctcgatccccagcaacggttaatgttggaagtcagctgggaagcgctggaaaatgccgggattcctctgaatcaattgcagagaagtaaaacaggcgtttttgttggtattaccaccacagattacctgcaattgcagactggtcttgcagatgatgaactgataaatgcttatacaaattctggcggagcaattaattttgcggctggtagattatcttattttttaggattacaagggccgagtttagctgtagaaaccgcctgttcgtcatctttagtagcagttcatttagcttgtcaaagtctgcgtaatcaagaaagtgatttggcgatcgcagctggtgttaacctaattgtcataccggagatgaacgtcaggctgtgtaaagccaagatgattgccactgacggacgttgcaaaacctttgatagcagtgcggatggttttggacgttctgaaggttgcggtgttttggtactgaaacgcctttcccaagcattagccgacggtaacaacatcgtagctttgattcgcggttcggcagtcaatcaagatggttctagcagtggtctcaccgtacccaacggattagcacaacaagcagtagtacggcaagcattagccaacgccggactagaaccccatcaagttagctatatcgaaacccacggtactggcacatctttgggagatccgattgaggtaaatgccttgggtgcagtgtttggtaaagaaaaaacagctaatcaacccttaatgttagggtctgtcaaaaccaatattggtcatacagaggcagcagcaggcgtagctggcatcattaaagtagctttagcgctacagcatcaagaaattccaccacatctgcattttcaaacacccaaccctcacattgcttggcaggatttaccagttgcagttccgactaagctgacaccttggctaccacacgaacaacgccgcattgctggggtaagttcttttggtgcaagtgggacaaatgctcatatagtattggaagaagcacctgtgaagaaagtagggggagcaggggagcaggggagtagaggagaagaaattacagagcgtcctttacatctattaacactgtcagccaaacatccccaagctctgagtgaaattgcacaacgctacatcaaatacttttcatctcacccagatatacttcttggcaacatcacccacgcctcacaagttggcagaacccatttctcacatcgccttgcaatcatcgccgcagacaacgcacatatccaacaacagttgcaagcctacctcgacaccaccgaagtcatcggtatctatcacggacaggctagccagcaaactaaaaaaattgcttttctctttactggacaagggtcacagtatcgccacatgggtcgccaactttaccaaactcagcctagtttccgtcaaacactcgacgaatgcgataccttactgcaacctttgttaggcgaatcaattttacaggtgatattctctgacaatttagaagatactcgcctcgatcaaactgcctacactcaagttgcattatttgttatagaatacgctcttgctcaactttggttgtcttggggtatccgtcctcatgctgtactcggtcacagtgtcggtgagtatgtcgctgcttgcattgctggtattttttccctagaagacgcactgaaattaattgtgcaacgtgctgctttaatgcaaggactacctcaaggtggaggaatggcagcagtattcaccacggtagagcaagttacaccgttaattgctgactatccacaacagttgagtcttgccgctatcaatggcgaacacagcattgtcttatctggggaattagagatactcacaacagtgctgcaaaaattagaaagtgagggtattgaaaccagaagattgcaagtatcccatgcttttcactcgcccttaatgcagccaatgctgacagagtttgccaaagtagcagcatcagtaaaatatcaacagccgcaattagatattatctccaatgtcacaggtaagattgtcagacatgaggaaatgtcaaatgcgacttactgggtagagcatatcctcgcaagtgtgcaatttgctgccagtatgcagacattgtatcaagcacgatatgaggtatttatagaagtcggttcccatccgacattgttgggaatggcacggcgcgagtgtcccgaacacttggatatggaaggattatggctggcttcgctgcgtaaaggtagagaagattggcagcagttgttagattccgtggcacagttgtatgtggcgggagtagaggttgattggcggcgttttgaggctgattatccgcgctctcaggtaattttgccgaattatccttggcaaatacagcgttattgggtgagtgatggcaagaaaaagcgatcgcccctgcaaaaactattacatcccttactcggtcaaagattgcgatcgcccttagctgacacaattatctttgagagacaactcagcacagccgatgtgcccttcattgacgatcaccgtatctacggtatggtagtagttcccacagttgcctacttagagatggcttgggcagctgctacggaagtcattggtaagggtgtttgtgttttagaacaagttgctatccgcgaggcattcgtactggcagagggtgaaacccgcactacacaattacttctcacaccagacgacaaaggatatactttccaaatcttcagcttggcatccccggaaaaagaagacggaaccgcttggaatctccacgcatctggtaagctgcgagttgagcctataccagaacaccaaatcattgcagatttctcacccacagcactacaagaacgcagtctgcaagaactatccggtggagtgttctatccttgcttacacaaacgcggactagaatttggctctagctttttgggtatagaaacactctggaaactccagaacgaagtgttagcaaaaattcaaatgccagtatccatcatggcagaggcgggtaattataatatgcacccagcccaatttgatgcttgcttgcagttgtttttggctgacttacccagtgaagatgatgtgttcatccccattggtttagataagttgtgcttttacgggcaacccacgactgagttgtggtcatatatgcgtctgcacattggtaatacacccaacccagaaacctttgatgtggatgtctgtattgtaaatccggctggtgaggtggtagcccaagttgagaaaatgcacctcaaacgtgcgcccagaaaagctttacagcgcattgcccagaagagtttacatgattggctgtatgaaattaaatggcaaccaaaagtcctacagtcgcctatccaagctactgtaacggggcattggctgatcctagctgaccacagtgcgatcgcagtagaattagccgagttcatagaaaaatctgggcaaacttgcaagttagtctttgccagtcaggaataccatcgtcaagactttgaacaactgttcgagaattgtgcaaaagatcaagaattgcgtggtgtaatttatctgtggggaatagattcgactttaacagataaaacttctgccagtttccccgctttgcttcaagctttagtcgccgcaaaattatctcagcaacccaagttatggttagttacacggggttgtgtacctgtggagttaaaaccaggagaattgagtattgcccaaactcctctctggggattgggaagaaccctagctgtagaacacccggatttgtggggaggattaatcgatttagatccaggaacaagcttagtcgagcaagcatcaagtttgcggactgaaattaaccatccaactgaagaacaagtcgcttttcgggctggacaacgctatgtacctcggttgttgcgctatcaaccgtcattctcggtagaacctctaaaaattaaatctaacgctacgtatttaattacgggttgttttgatgatattcacgtgaatcttgccagttggctaattgaaaaaggcgctgaacatctcgtgttgatgggagaaggagaacctgcaccagaaatttgcgatcgcctcaagcaaatgcacgcaattaatccaactgtagtattatttaacttcagtagctccaagtcagaacaagtcgcaaatgtttttcaatatattgaagacaaactgccaagtctatctggtatcatccataccgaaggtatacacgaagacagcatacttttacatcaaacacgagatgggtttggtagagtcctcgcagccaaggtaacaggagcctggaatctgcatattctcactcaggaaatccccttagacttctttgtaatgttttcctcagcgttatgcctactaggttcgcctggacaaggtaattacgctgcggctaacgcttttgttgatgctttagcccactatcgtcaatctctgggtttacctgctctgagtgttaactgggcaccttgggggcatcaagataatcctattgtccgacgctgggcaacttggggcgtagatacaattgattggcaacaaagtttgaaaattttagaacaactactgactgataatgtcgcgcaagttgccgtcatgccagtgcagtggagcaagtttactcaagcctttcctagaggaaaaaaagaggcagaggggcagaggggatggggagcagaggggaaagaagatggacttttgcccacaagggaaggggcttataacgaaaatattttttctgctctgctcgtctatccaggatctctgctttcttctcaaccgaaatcttcgccagcatcccagttatacgaacgtttagaaaacgctcctcccagcagacgcaaagacttaatatttgaagccgtacaaggggaggttgccaaagtcttgcggatgaaatcagcccaggtagatgggaaaaagccttttaacacaatgggtatggattctctgacagcagtggaactgcgaaacgccctcatggaattgttgaaagtaacattacctgcaacccttgtctttgaatatcccagcctagaaagcttgtctgagtatttagctgagttggtgattctcaaaatcccatcgtccgcaacaaaggaactacctactgctcccagcaagattaacttggctgtagagcaaatggaacagttttccgaagatgagctagaagccctactagctcaagaactggcaactcttaatgagtcatgaagatgaacaccccagaacgtactgaccagctacggcgggcattagtcgccctaaaggaactccgcaccaagcttgatgccattgaacaggatcggcaagaagcgatcgccattgtcggtatgggatgccgatttcccggaggagttaacaacctcgaaacctattggcaattattgagccaaggtattgatgctagccgggaaattcccagcgatcgctggtcggtcgatagcttctatacgcctcatcctgacacccctggtaaaatgtacacccgtcggggtagctttatcgaccaagttgatggctttgatgccgatttctttgggattgcgccgcgagaagcagtcagtatagacccgcaacagcgattgttgctggaagttgcctgggaagctttagaaaatgccggacaaagcacagagaaattagaaggtagtgccactggtgtatttattggcatttccaccaacgactacgcccgcttccacatcaatagcggcgaccccaatcgcattgatgcttactcatttattggttgcactcccagcgtagtttctggtcgtttgtcttacgtttttgggttacaggggccaagtctcaccatagatacagcttgttcatcttccctcacagccattcacctagcttgtgaaagcttacgcaaatgcgagtgtaacttggctttggctggtggtgtcaacttgatgctggctccagaaaccacgatttatttttgtcaggtgaaagccttagcagcagacggtcgctgcaaaacctttgatgctgctgccgatggctacggacgaggagaaggctgtggtgtcgtcgtactcaagcgtttgccggatgctttagcagatggcgatcgcatctttggtttgattcgcggttccgccgtcaatcaagacggacgcagcaacggtatgactgcccccaacggctcggctcaacaagcagtgattcgccaagcattagcggcggcggcagtacaaccccaggagattggttatgtggaagctcacggtacgggaaccgtcttaggcgacccaatagagattcgcgccttagcatcggtactttgtgctgacaggagtcaagataatgcattaattgttggttctgtcaagactaatatcggacatttagaagctgcggctgggattgctggaattatgaaagtagttctggctttacagcatcgacaaattccaccacatttacatttcaaacaagcaaatccgcatatcgattggcaggaattaccgttagttattcctactcagcttactccctggatttcagaccgactgctggctggggttagctcctttgggatgagtgggactaatgctcatgtggttttggaagcagcaccggttgaagaggacaaggggacaagaggacaaggggacaagaggaatgatgaaagcgatcgcgtttatcttttacctttgtctgctagaagcccggaggctctcaaagaaatagctaaagcataccgagaattgttatcaggttcgctaaagcttgaagatatttgttatacagctagtttacggcgggttcattacgaatatcgtttggggttagtgggaaattcggcggaagaattagcgaatcaacttcaagatttcctagaagatattcccaattctgatgttaattggggatatcaaggttctagccgtcgccagcaaattgcctttgtgttttctggacagggttctcaatggctgggtatggggcaagaactcttgacgcaggagcctgtattccgggaggctttagaagagtgcgatcgcattatccaatctcatacgtattggtcgctaattgccgaactgtccgcaccgccagagaaatcccgtctggatgaaacggaaatcgctcaacctgcgattttatctctgcaagtagcactagtggcgctgtggcgggcttggggtgtggaaccaagtgcagttgtaggtcatagcgttggggaaattacggctgcttacgtggcgggtgtgttgactttggcagatgctttgtggattgtgatacaacgtgccaaactgatgcagcaagcaacaggccacggcaaaatggcaatgctgcatttaccagagaaagctgtggcagaactgattgcaccttatgaagacaaaatagcgatcgcagcgataaacagtcctttttcaacagtcatctctggtgcaatcgaggcaattgaaattatcctagaaaaagtcgaacagcaaggagtattctgtcgccgcttaccagtgaattacgcttttcactgcccgcagatggacggctatagtcgagaattagagagaattctcgaagatattcagccaaaatcgccatatttgcagattttctccaccgttagcggtcaaccagaagattcgcctctgcccctttgcgcctctgcccctctgcctctttttgacgctgcctattgggggcggaatatgcggcaatctgtacgatttgccgaggcaatggatagtctgatccaagctggatacaacctgtttgtagaggttgcccctcattctgtcctcgccaaagatatgctggagtgcctcagtcagactcagcagcagggaacagttttaccaaccatgcggcgaggagattccacagtcagcttaaggtcattagccaaactttacactttaggacataaagttaactgggataatttctatcccaatggtggcaaatttgtacagttaccgacttatccttggcaacgcaaacgctactggattgag

SEQ ID NO: 43840 - DNA, 993 bp, Nostoc punctiforme
agaaccgagcgagttgttgagaacttaaatcgtgccctacatcatatatttgctgtagatcctcaagtttttttaattggtgaagatatcctcgacccctatggaggagcattcaaagttggtaaaggattatcttctaattacccagatagagttttaactacaccaattagcgaagaagcaattgtggggataggtggtggtttagctttgtgtggcaataaacctattatcgaaatcatgtttggtgatttcattgccttgggattcgatcagattttaaattttgcttccaaatctgtatcaatgtatggcacaaaattagacttaaatatgattgttcgctgtgcagtgggtggtaacagaggatatggcccgactcatagccaaagtttgcaaaagcattttgttggtattcccaatttatatttatttgaattatcgccattgcatgataatattgcagtgtttgaaaagttggttaatttaacttttccctgcatcttttttgaagataaggtactctatactcaaagaatttatgctgatggattgattgacgatctgtttagttatgaatttttagattctgccaagaatttcgctagaatttatgccgatagttttgaagaaaataactgcttgctaatttcaccaggaggattagtaccaagatgtttagctgcggcgcgggaattatttattgattgggaaattgaaactcagattattgttcccagtcaactatatccttttgaattagaaaccatcatcgatttattagcagatagcactcatatctttattgtggaagatagtgtagctggcggtacatgggggagtgaagttgctcatcaaatctacagtaggctttggggtaagttaaaaaatcctgtcaaattgattcactcaaaaaatagtattattccttcttctgctcatttagagaagcaggtgattgtgcagaaagaagatatttgcaattctgtcaag

SEQ ID NO: 43841 - DNA, 690 bp, Nostoc punctiforme
atcatactgatgattcgccactttgaattatcacttttagagctattttctagtggtaaattaaacggtacaacccatacttgcctcggtcaagaatacatccctgtagcactcaaggcagttttaactgatagtgactttatcctcagcaatcatcgcggacacggccattacctcgcaagatttgaagatcctgaaggcttgttagcagaaattatgggtaaagaaggtgcagtttgtcatggtgtgggtggaagtcagcacatctacagaaaaaattatttatctacaggaattcaaggcgaaagtttgcctgtagctgctgggatagccttgcatttacgccgccaaggtaactttgggatggctgtagttcacattggcgatggtacttggggtgaaggaggagtttacgaagccttaaacattgcccaattgtggggtttacctgttttagtaattgtagaaaataacaaaatagctcagtctactcctactcaactgcaaatggcaggcacaattgcaggtcgtgttcaaggttttggaattaattatttaaaagtagactcaatagatattaacgagattaggacactgattagctctcacattcaatctgctagaactaaatctttgcccttagtaattgaatttgatactaatcgagtcggcccccatagtaaaggtgac

SEQ ID NO: 43842 - DNA, 1275 bp, Nostoc punctiforme
atgaccgcaacttctccccgattaaagcacgaggttaaagacctcggcctagctgccttgggtagacagcgcattgaatgggctggacgcgaaatgccagttttgaagcaaattcgcgatcgctttgcgatcgaaaagcctttcgctggtttacgccttgtagcttgcgcccacattacaacagaaacagcacatttggcgatcgctctgaaagccggtggtgcagatgcgctattaattgctagcaatcccttatcaacccaagatgacgtagccgctagcctcgtcgtcgatcatgaaattcccgtctttgctcaaaaaggcgaagataacgcaacatataaccgccacgtccaaatagctttagatcatcgccccaacattattgttgatgacggtagcgatgtggttgcaactttggtacaagaacgccaacaccaaatcgctgatttgattggtagcaccgaagaaaccaccactggtattgtgcggttacgcgccatgtttagagaaggcgttctcaccttccccgccgtcaacgtcaacgatgctgacaccaagcacttctttgataatcgctatggtactgggcaatcaaccctagatggcattatccgcgccacaaatattttgttggctggtaaaaacattgtcgtcgtcggttatggctggtgtggtaaaggtacagccctccgcgcccgtgggatgggtgctaacgtcatcgtcaccgaaatcgaccccatcaaggcaattgaagccgtaatggatggcttccgcgtcctgccaatggctgaagctgcaccccaaggtgatatttttatcactgtgactggtaacaagcacgtcgttcgcggtgaacacttcgatgtgatgaaagatggtgcgatcgtttgtaactccggtcactttgacttggaacttgatttgaaatacttggctgcacaagctaaggaaatcaaagaagttcgtcctttcaccgaagagtacaagttgaaaaatggtaaatcagttgtcgttctcggacaaggacgcttgattaacctagctgcggctgaaggacaccccagcgcagtaatggatatgagttttgcaaaccaagctttggcttgtgaattcctggtgaagaataagggtaagttgcaacctggtttgcactcaatccctgttgaagtcgatcaagaaattgctcggttgaagttgcaggctattggtatcacgattgatagcctaacagcagatcaaattgagtacatcaactcttggacaagtggaact

SEQ ID NO: 43843 - DNA, 777 bp, Nostoc punctiforme
aaacttgccgcacaatctcatccgaatcaccagacaatcgttaaaatctcagaaaaagtcgctttcggaggcgaagaactggtaattatcggcggcccctgtaccgttgaaagcttagaacaaatggagattgtcgcccaaaagctatctactgcatcgatacaggggttgcgtggcggtgtctacaaacctcgcacatctccctacgctttccagggtatgggtgaggaaggattgaggattttggcaagggtgcgatcgcattacaatatgccagttgtcactgaggtgatgtcaatttctcaaattgaagtagtcgccgcccatgctgatatgcttcaagttggcagtcgtaatatgcaaaacttcgacttgctcaaagctttgggacaagctggtaaaccaatattactcaaacgtggtttagcagcgactattgaagaatttgtcatggctgctgaatatattcttagccacgggaatcctgatgtggtgttgtgcgaaagaggtatccgcagcttcgatgattacacccgcaatgtcctagatttagcagcagtggcagcactcaagcaaataactcacctgcctgtgattgtagatccttcccatgctgtcggtaaacgggaactggtagcacctgtggctagggctgcgatcgcttgcggtgctgatggattaattattgaatgtcacccacaaccagaaaaatctgtttctgatgcccgtcaagcactctctttagaagatatggtgcgtttagttgatagtttaaag

SEQ ID NO: 43844 - DNA, 852 bp, Nostoc punctiforme
ttaaacgtaattcaatggtatccaggtcacattgcgaaagcggaaaagaagctcaaagaacagctgaagcgcgtagatgtggtatttgaggtacgagatgcccgaattcccttagcgactcatcatccccaaataggtgagtgggtagagggtaagacacgggtattgatacttaaccgagtagatatgattacgccgcaaatgcgatcgctgtggatagattggtttaaacgtcaaggggaagtcccttattttaccaacgctcaacatggtaaaggtatagcagaagtggcgcgagcagcgcaagcggccggagtagaactcaatcaaagaagaagcgatcgcggaatgttacctcgtccagtccgggctgtggtaattggttttcccaatgttggtaaatcagctttgattaaccgccttttaggacggcgagtagtggaaagtgcagcccgtcctggggtaactcgccaattgcgctgggtgcgaatttctgaacatttggaattgttagatgctcctggtgtcatccctctaaggttggaagaccaagacgcagcattgaaattagccatttgtgatgatatcggcgaagcatcttacgataatcagctagtagcagcagccttagtggatttattcaactacttggaagctgtaactacagatttgttaccgaagaaaccattacagtcccgctaccaactcgattcgacctcagacaccggggatacttatctacatgctttagcagagcatcgttacaaaggtgatgtagagcgtgctgcaaggcaacttttaacagattttcgtaaggggttattaggtgaaatgagtttagaattaccgccc

SEQ ID NO: 43845 - DNA, 777 bp, Nostoc punctiforme
  unsure (1)..(777): unsure at all n locations
atggcgatcgctactatcaatcccgccactggggagacgctcaagacctttgaggcgctcaatgatacagaaattctcgctaaactcgatttggctaatcaggcttttgaaaagtatcgccagactgatttttctgagcgatcgcaatggctacaaaaggctgctgatattttagagcaagacaaagcagaatttgctaagttaatgactctggaaatgggtaagccatttaaagctgcgatcgcagaagtcgaaaaatgcgccgttgtctgtcgctactatgccgaacatgcccctagttttttggctgatgtcagtgtaaaaactgatgccagccagagttttgtacgttatcaaccaatgggtgcaattcttgcggtgatgccgtggaattttcccttttggcaagtgttccgctttgctgcaccagcactaatggcgggaaatgtcggcttactcaaacacgcttccaatgtgccgcagtgcgccttggcaattgaagatattatccgacgcgcgggttttcctgaaggtgcgtttcaaactctattaataggcgctgccaaagtcgctgatttaatggctgatgaccgcgtaaaagctgccaccttaactggaagcgaaccagcaggcatatccctcgctgtcgccgccggcaaacaaatcaaaaaaacagttttggaattgggaggaagcgacccatttattgtgttagaaagtgctgccttagagacagcagttgtcacagctacacacaaaaggntgttgcntnngggg

SEQ ID NO: 43846 - DNA, 828 bp, Nostoc punctiforme
atcgatctctctggcaaacgggcgatcgtcacgggagcagcatcgggtatcggtgtagaaacggcgcgggcgttggctcacgctggagccgaagttacgttggctgtgcataacgtcgatgctggggcaaagacggcggctgacatcactgctatcactgggaatcaaaatattcacgtcgccaaacttgacctgaccgaccgaggagcgatcgctaaattcattgccgcgtggaatgaaccactacatatcctcgtcaacaacgcaggggtaatggcattgcctgaacagcacacacccgaaggttgggagatgcagtttgccaccaaccacctcggacacttcgctctaacactcggactccacgatgctctggcggcggacggtgctgcgcgcatcgtgtctgtcagttctagcgcccacatgctctcgccgattgtattcgatgatatccacttcgcgttccgtccctatgatccgtggttggcatacgggcagtccaaaacagcgaacgtactcttcgctgtcgctggtactgggcgctggttcagggatggcattactgccaatgctttgatgcctggggcgatcgccaccaatctccaacgccacgttggtggtatccagaccccggcagaattgcaaaaaacaccagagcagggtgctgccacttcaattctgctggcaacctcccccttagtggaaggcattggtggtcgctacttcgaggactgcaacgaagctacgatcgttacccagcaaaccaaagactacagtggtgttgctccctacgccctcaacacgaacaacgccgatcgcctttgggag

SEQ ID NO: 43847 - DNA, 747 bp, Nostoc punctiforme
atgaaaaaactagaaggaaaaatcgcccttgtcacgggtggcaacagtggtatcggtcttgccacagctaaacagtttgttgctgaaggttcctatgtctacatcacgggtcgtcgccaagtcgaactggatgctgctgtagaagccattggtaaaaatgttacggctgtacagagcgatgtttctaatctggcagacctcgatcgtctgtttgccactattaagcaagagcaaggacacctcgatatcatcttcgctaatgctggaggtggacaaattgccccacttggagcaatcactgaggaacactttgacaaaacattcaacgtaaacgtcaaaggtttgctgttcaccgtacaaaaggcgctgccactcttaccagagggcgcttctattatcctgaatgcttcgattacttctataaaaggtacgccagctttcagtgtttacagcgccaccaaagccgccgtgagatcgtttgctcggaattggatactcgacctcagagaacgcaagatccgagtgaatgccattagccctggtgtggttccgactcctggttacgattatttgggactaaatgaccagcagttgcaagaattcgtggacagccaagccagcgccattccactgggacgagtcggcacacccgatgagattgccaaagccgttgtctttcttgcttcagatgacagtagcttcgtgaacggcattgagttgtttgttgatggcggtatggcacagatt

SEQ ID NO: 43848 - DNA, 1380 bp, Nostoc punctiforme
tatgatgatattattatcggcggcggcaaggcgggtaaaacactggcaccagcgctggttgctgacggacgtaaaaccgctctagttgaacgcagcttaaacatgattggtggcgggtgcattaatattgcctgcattcctactaaaactatggtggcgagtgctaatgtagcaaacacagtgcgaaacagtgccgcttatggtgttaaagctaatacacccatcgttgatctagcagaagtgatccaacgaaaacgagcggttgtgcaatctgcgcgtgaaatgaacttgcacaatctagaaacggctctagataaaaacttgattattggcgaagcaaggtttgttgctcccaaaacaattgaagtaacgacgactgaggggaaaaatcgcttacttaccgccgaacgcttatttattaatacaggcacacgaccgttaattccatccattcccggactcacagaagttgagtttttaacgagtgagtcgattatggagctagaatacctgcctgaacacctgatcgttctcggtagtggctatattggtttagagtttgcccagatgtttcggcgctttggctgtggcgttactgtcattgggcaaagtgagcaaatcctgtcacagcaagatccagatatagcgatcgcagttcaaacactgctggaacgaaacggtattgaattcttgctgaaggcaaaggtgttgagggttgttcgcaaagcgtctcctttggagaatcgcactggtaatgaaaccatcctgcaaatccaagttggcgatcgtgaaatcaccctccaggggtcgcatttgctcgtcgctgttggtcgtgcgcccaataccgatagcttaaatttagctgctgctggtgtggcaaccgatacacgcggatttattcaagttaacgatcgcttagagacgaacattccgggaatttgggcgttaggcgacatcaacggcggcccgcaatacacccatatatcgctcgatgattatcgcattatcaaagctaatttaattgatgggggcgatcgcagtacaggcgatcgcttagtgccatcgtgtctgttcatcgctccagaactggctcatgtgggtttgactgaaactgaagcacagcaacaaggatatgctatccgcgtggcgaaaatcgatgcctcagccgttcccagagcaagaacactcggtcaaaccgatggacttctgaaggcgatcatggatactgagacaggtcgtattctagggtgttctctgttgtgtcatgaagcaggtgaagtgatttcaacagtgcagatggtgatgcaagctcagatgccctacaccattctgcgcgatggtattttgactcatcccacgatgaccgaagggttaaatata

SEQ ID NO: 43849 - DNA, 930 bp, Nostoc punctiforme
aaaacatctaaagtcggtattattggtgcaggtaatgtaggtgcagacgttgcaaatgctttagttttactcggtagatgtgtaagggttgtcctttttgaccgaaccttatcaaaagctgaagggcaagtatgggatatcgaagatagcattcccctacttaaagagatggaaatcataccatcaaatcagtatgaagatttagctgattcagatattattattattgtgactgctggggtgcagccaaaacttggacagacccgattagatacattgagcgacaatgcagagattatacgttcgacaatcaaagaattggatcgagttgcaccaaattcaatcgtaattatcattagcaatccagtggatgtactcacgcggattgctcaggctacttccaccagagcagaaaatctaattttcggttcgggaactgttcttgatactgctagactgagatatcaacttggaaagcaactgaatgttgcaaaacaagacattcatgcttatgtgattggagagcatggagacagtcaatttgtggtttggtctagtgcatttattgggggaattctgttaactgaatttcccataccacaaggagcaacgctagaacaaattcagcaagagtacgcacagttaactcgtaaacgaggctataacatttttgaacgcaaaggatatactagctatggcatatcaacagtagtttgtcagttagttgataccattctgcgagatgaaaagcagatatttccagtatcgactagagcagattctaactatggagttggcagtgaagttgttcttggacttccatgtatcattggctcaacaggtattgagcgccaactgctgttatcaagaaatgctcttgaacaacgcttattagaagaatcagccaacaaactcaatgaagcctataat

SEQ ID NO: 43850 - DNA, 708 bp, Nostoc punctiforme
aaggtcgtgctagttacaggagcatcatctggatttgggcagttaactgctaaaaagcttgctgctgtaggttattgggtcttcggtaccagtcgcaagtcatatccagcatcaggtgatgtagaaatgttgaagctcgatgttacctctgattcctcagttcaattatgtattaaacagttgctcacacggactaatcgcattgatttactgattaataatgctggacaaattcatgccagtatgttggaagaaacttctttacaacaagccaaggaaatctttgaaacaaacttttggggggttgtccgcctcactaacgccgttttaccagttatgagacagcagcgtagtggacatattatcaatatcagttcagtcgcgggattgattggcgcaccaggtcaaggtttttacagtgcaagtaaattcgccctcgaaggttatagtgaagcactgagcgtggaactagacccattcaatatcaaagtgtctttaattgagcctggttactttaaaactaacttcaaccatgccatgttaccacctaccttcaattatgctgattacgacaatgtacgtgatgtgattcgctcaactgtcactcaagcaattgcacagggcgatgatccaacaaaagttgcacagacaattgtctttgctgcttgtagccgttccccacgattacggtatcgtgttggtaatgag

SEQ ID NO: 43851 - DNA, 1158 bp, Nostoc punctiforme
atgaagctggcagcaagagtaagtcaggtaacaccttcattgaccttagcgatcgcagccaaggctaaggcactgaaggcagaaggaatagatgtttgtagttttagcgctggagaaccagattttgataccccagcgcatattaaagccgcagcagtcaaagctttggatgaaggcaaaaccaagtatggtgcagcagccggagaaccaaagttaagggaagcgatcgcccataagctcaaaaatgataacggtcttgattacaagtcggagaatgtcatcgtcactaatggcggtaagcattctctgtacaacttgatagtggcgttaatcgatctaggcgatgaggtaattatccctgcaccctactggctaagttatcccgaaatggtgactttagtcggtggagttgcagtaattgtacccacagatgccacgacgggttataaaattactcccgaacaactccgtaaagcaatcacccccaaaacaaagttatttatcctcaactctccatctaatcccacagggatggtttacacgccagacgaaatcaaagcactggcgcaggtagtagttgatgcagatatctttgtcgtctctgatgagatttacgaaaagatcctctacgacggtgcagaacatatcagcatcggttctcttggaaaggaaatttttgatcgcactttgatcagtaatgggtttgcgaaggcttattctatgactggttggagaatcggctatttagcggggccagtggaaattattaaagcagcaagtaccatccaagggcatagtacatctaacgtgtgtacctttgctcaatatggtgcgatcgcagcgctacaaagttctcaagattgcgtcgaagaaatgcgccaagccttcgccaaacgccgacaggtaatgctagacagactcaatgccattcccggattgagtaccgcaaaaccagatggcgcgttttatctgttccctgatatcagcaaaaccggtctaaaatccctagaattttgtgacgctttgttggaaaaacatcaagttgcagtcattcctggaattgcttttggcgctgatgacaacattcgcctttcctacgctacagatatggcaaccattgaaaagggaatggataggttagagaaatttgtcaagtca

SEQ ID NO: 43852 - DNA, 1017 bp, Nostoc punctiforme
atggaaacgcgatttttaggaaagtccggtctcaagatttcggttctcagtttcggtacaatgacctttggtggtagtgacttcttccaagaaattggggcgactcaggtagacgaggcgcaacatctgattgatatttgccttgatgcaggtgtcaacatctttgatacagcagatgtttactcgaatggactttctgaagaaattcttggtaaagctctcggaaagcgtcgttctgatgtaattattgcaactaaggcttatggtcgtatgggacaaggagtaaatgataccggactatcacgttatcatctgattcgagcctgtgaggacagcctaagacgattagacacagattacatcgacctctaccaagttcatggtttcgatgctttgactccactagaagaaacacttcgcgctttagattcacttgtacatagtggcaaagttcgctacattggctgctctaattattcagcttggcatttaatgaaagcgctgtccgtatcagagcgtttgaacttggagcattatgtgtcacaacaggtttattactcgcttgtggcgcgagagttggaatttgaactaattcctctttctttagatcaaggtgtgggtatcttagtgtggagtccgcttgcttttggttttctctcaggtaagtatcgtcgtggtcagtcccaaccggaggggacgcgacgagcaaagatcggtgatattggcactgttagtgacttggaaaagggatacgacattgtggaagttctgcacgaagtagctaataaccgtggtgtcagtgttgctcaagttgcgctcaactggctgttacgtcagtctggtattacatccgttattgtcggagcgcggaatgaacaacaacttcgagacaaccttggtgctgctcagtgggagctaacattagaggaagtcaatcgactcaatgaggctagcgcgatcacgccaatctatccttactggcatcagcgcaagttcggggctgaacgcattccacaa

SEQ ID NO: 43853 - DNA, 3051 bp, Nostoc punctiforme
agatttcggtgaaattttgtgtttgaaaacaaggaaaactgtaaattcacaactgaaagttactgaaaaaatcaatttaggtagaaaattatggcgaatatcattggaaccaacggtaacgatactctagtaggcagttacgaagcggacacgattaatggagaagcaggtaacgataccatcacaggtaacgaaggtgatgacaccctaactggtggtggtggcaaagatcagtttgtttacaactattacaccggaattgatatcatcacggattttggcggtataggcaaaggcgtaaatccctcggcaggagtcatcgccgaagtggatacactacaattccaaggtgctgccttgactgaccgaaatatgctgctgacgcagaatggaaagaatctggaaatcacatttgaaaatgtgcttgattccaaagtcatcctggaaaactttgccctggaaaacctggaaaacctgagcaaatctaccggagccagtgtagacttgggcaatatagagtttgatgggcaaactagcatcaccgacagctttgatgttttcaatgccaactccacccaaagcactatcttcaacaagaacactgttaccttccttaacgacctctccaataatgttagtggctttgacaactcagatgatgtgatcaatggtcaaggtggaaatgaccgcattgacggcttgagtggcgacgacatactgaggggtggtgcagggaatgatactcttattggtggtgcagggaatgatactctcattggttatcaaggcaataatgcactcattggtgacattggtgaagactatttgaatgttgatacttcaacaggcgataacactctcaatggtggcattggtgacgatactttaaatgctaggggaacaacaggcaataattccctttctgggggcgatggcaatgattatctttccacctcttcttttcctatttacagcggatacagctatattgcctcttcaagcaataacacccttgacggtggtgctggtaacgatacattgaatgctgagtctccatccggcgataacttactctctggaggcgatggcaatgattatctctctacctctggtactaaaagtgataatgggcagcttaattttacctcagagggtaataacaccctcgatggtggtgctggtgacgatcgcttgtatgctgatatttcaacgggtaataacttactgtctggaggcgatggcaatgatactctctctacctctggcacttacacaagaaactcttttatcgtaccatcctctggcaataacacgctcaatggcggcgctggtgacgattacttgtatgctagcgcttcaacgggcagtaactttttctctgggggcgatggcaatgattctttctctctaagcaccatatcttcagatggttccccctctaactcttatttagtgactcaaacggtagacggaggtaagggtgacgatttgttatctttcaatttgttaccttttcatgacagcgacagcaatgttgctggagggatcataacgacattcaatccaactacaaacaagggaacaattactgctggtacgtatggggttaattacaagaatatcgaaaaattaaatatctcaggtacagccgacgatgacttgattttggggagcaatggaaacgatacactctccacaggcaatggtggcaaagatacgatagatgggggtaagggtgacgatgtaatatctattgattacagtaatgctacaagcaaaatcataacaacattcaatgccactactaatactggcttaattaccgcaggtacttatcagattagttacaagaatattgaacgattaaatatcacaggtacagcctacgatgacaacattttgggcaacaatggcaatgatacgctctctacaggcagtggtggcaatgatacgatcaatggcggtcaaggcgacgatatactgtcagttgattactacactaatacaacaggtattacaacgacatacaataccactactaatgctggagtaattacagcaggcagtaatcgggttagttacaagaatatcgaacgattagatatctctggcacagtctccgatgactatattataggcaacaatggcaacgatacgctttccgggggctatgacggtaatgatacgattattggcggtgcaggaaatgatgtcgtgataggtgggaagggtaatgacattttaactggtggtgtcggcaatgataaatttgtttacgatcttttagagagcaactatgatactggtactgatataatcacagatttcggtggcattggtaaagattcaaatccctcacaagcggtaattgcctccctagacactttggaatttatagacaacagtggcttccgtctatttagcgctcaaaatctgcaattaactcaaaatggtaacaatttagaaattacctttgaagatttatttaatagcagtaatagcaaagtcattctccaaaatttccaactagaaaacctcgatggtgagaatattctatttcctggacaaaccaccatcaccaacagtattgatgtgtttgatgctaattccactcaaactagcctgttgaacaaaaacactgttaccttcctcaatgacctcaacaacaacattacgggttttgacaattccaatgatgtggtgaatggtcaagggggtgacgatatcatcaacggcttaagtggtaacgatcttttgagaggtaatgcgggaaatgatactctcattggtggtgcgggaaatgataccctttacggtggtgctggcaatgatctcctctatggtggcgctggcagtgatattctcacgggtgacaacggtaacgatatctttgcttttgctgctggggaaggtactgatacgattactgatttcactaaaaataatgatttgattggactgtatggtggtttgagctttgggcaattaagtttctcaggtaacaatatcctggtgacttctacgaatgagattttggcaacgctgactggc

SEQ ID NO: 43854 - DNA, 708 bp, Nostoc punctiforme
attagcaagtcttatggttctcaccaagccgtgaacaatcttagcttgcagattacagaaggttcattttatgctcttttaggccccaacggtgcaggaaaaaccactactctacgaatgattgcagggttactacgaccagataagggcgatgttatgattctaggtcatagtatcaggcgagcgcctcaaaaagccaagcaaactttagcatatctacctgatgaaccgctaatttacaataaactgcgccctatggagtatttagagtttattgctggactttggggaattaatcctcctaaagctcaaatcttagcccaagaaattctcaaacaattaaacttgtggaatcacagaggagatttgagcgaaactttttcgcgagggatgaaacaaaaacttgctttagcaggggcattaattcatcaaccgagaattcttatcttagatgaaccgttaacaggattagatgcagccgcagcccgcttagtcaagaatatgcttgctgaatatgtaaatcaaggtaacacggtaattttaactacccatatcatggaaattgccgagcgtatggcgcagcgaattgggattattaatcatggacgcttgatcgccgaaggaactttagacgaacttagaactcaaagtggtgaagcaggcgctagtttggagacagtttttttagaattgactcaaaatcatgat

SEQ ID NO: 43855 - DNA, 1005 bp, Nostoc punctiforme
tacgactgcatcatcgtcggcgctgggccagctggtgggacagctgcatatcatttagccaaacagggtcgctcagtattagtcttagaaaaagaatccctaccaagatataaaccttgtggtggtggtgtatctccagcgatcgctcaatggtttgactttgattttagcccagcaatttctgtaaaagctgactcctttcgctttacctggaaattaggcgacccagtggaagcaaaaatagccacagaagaaccagtctggatggtgcgacgagatatttttgaccatttcctagtgcagcaagcgcagaagcaaggggctgaagtacgagataatactgaagtaacgggtattgaatttaaagctgaccattggcaagttaacacagccaatgggccaattacaggtcgctacttaatcgcggctgatggtgctaaagggctaatggcaaaatggctaggcttcaaagaacgtaaacgccgtttagcagcagctttggaagcagaggtttccaccactgtaaaagacaaatccacaattcacattgagttgggcttggtgaaaaatggctacatttggaacttcccgaaagcggatggttattccattggtgtcggtacgtttggcggtggcgaaccccaggattttaagaagattttagatgaatacgcgcgatcgtttaatctagatatcacaaccagcaagaagtatggttatcctctttgcttgtgggatggaaagcaaaagttgcatacccaaaatgctgttttggctggcgaagctgcttgtgtagtttatcctatgacagcagaaggcattcgtccttcaatttttagtggcttgattgcagcaggagccattaatgaggccctttctggtgacatcaatgctttagaaaaatatagtgaagctattaatgaagaatgggggactgagatggcttgggcacaaaaactagctggagcattctatcgctttcctggtattggctacaaagttggt

SEQ ID NO: 43856 - DNA, 636 bp, Nostoc punctiforme
atggctctccgtctaggtgacacagtacccaactttacgcaagcctcaacacacggcgacatcgatttttaccaatgggcaggtgacagctgggttgtgctgttctctcaccctgctgattttacacctgtttgcacaacagaactcggcacagttgccaagctaaaaccagaatttgacaagcgcaatgtcaaagcgatcgcactcagcgttgatgacgtagaatctcacaaaggctgggtgggagacatcgaagaaactcaaagcaccacccttaactacccaattttggcggatgcggatcgcaaggttgctgacctgtacgacatgatccaccccaatgctaatgcggctgtgacagtgcgatcggttttcgtgattgatcccaataagaaactccgtctctctttcacctatcctcccagcacgggacgcaactttgatgaacttttacgagtgattgattctctgcaattgactgataactacagcgtggcgacaccagctgactggaaagatggagaggatgttgtaattgtcccctcactgaaagatccagaagtactcaaagagaaattccccaaaggttacgaggaaattaaaccctatctgcggatgactcctcagcctaacaag

SEQ ID NO: 43857 - DNA, 1077 bp, Nostoc punctiforme
agattgtcagagcaaattgatcgaactcgtacaggaaatatggttatccaggttgttaattctcagcagcagccagtctccggtgtcgaagttaaacttgagcaggttgctcatgaatttgagtttggtacagcgctcagtactcaaatgtttgctcaaggcgctaatcctaacgatcaagctcagtattttaatctttctaggcaacttttcaatggcactgtgcatgaaaatgctctcaagtggtatgcaactgaagaacaacagggacacgtcaattatgtagatgcggatcgaattttaagctggagtgaaacccattctctaccattacgcggacatgcacttttttgggaggtggagaaatggaaccagccttggttgaaatctctttccaagcaagaactgcgacttgctgttgaacggcgagcaacagaaatttgcgatcgctatcgagggcgaattcgtgaatatgatgttttaaatgagatgctacatggtgatttttttaggcagcgcttaggtgaagatattgtcaaaacaatgttcgagcgatgccatgctgccgatccgaatgcagtactatatgttaatgattacgacatcctgaatggtagaagattggatgactatgttcaacagattcgttcattactggcgcaaggagtcccaattggagggattgggattcaggcacacattttaagagaaaaaatcacaccagcacagatccaacacagtctagatacgttagcacaattcaatttaccaattaagatcacagaattttctacacttgcaaatactgagcaggaacaagcaaaaattctgcttaatctgtatcaaatcgcttttgcccacccaatggttaagggaattctcatgtggggattctgccagaaggcccattgggtacctcaagcagctatttttgacagaaacttccaaccaaaactggctgcaaaagtctatgaagagctagttttccagcaatggtggactcgagcgagtgggatcaccaatcagaatggtcaattctcaacccgtgctttctttggacagtaccaggtaacggta

SEQ ID NO: 43858 - DNA, 573 bp, Nostoc punctiforme
cctgataattcctggatcgcagagctaggtagaacaattgtattgagtattgttctagctctgggaattcgtacctttgttgctgaagcacgctggatcccttctgggtcaatggaaccaactctgcatggtacgccaaaccagtgggaagcagacaaaatcattgtcgataagttgaaatataaatttgctgacccgcagcgtggagatatcgtagtattttcacccactaaagagttacaaaaagaacaatatcaggatgcttttattaaaagagtaattggcttacctggagaaaaagtacaactcaaagatggcaaggtctatattaacaacaaacccctgccagaaggtaattatctcgctcctagccaaagcacagttattaatgtttgccaatcagggccacagccaccttttttggaaaaaccccaaactataccagatgattcatacttagtattaggtgacaatcgtaataatagttatgatggacgctgttggggtgttgtccctcgccagaatattattggacgggctgtagttcgcttttggcctctaaatcatattgga

SEQ ID NO: 43859 - DNA, 1848 bp, Nostoc punctiforme
cggagtgtgacgacggtaatgcaagtagttccaaaggagctacgctatgtggcaattttgacattactgggtggtgcaggcccagcgatcgccatttggctcaataagataattattgatgaaattacccgtttattgagtacgggaacaacgcagaatgcgatcgctctgattctttctcaacctgtgctactctccagtattgcaggttcattgctggtgaatttggtaagtgatgcgatcgctaacatcaatagttttgtatatacttccctgcgcgatcggattacaggctttatccaagggcaagtaattgagaaggttgccacttttgaagatattgccctgtttgaaacacctgacttactcaatttgttgcagttgaccgaaaagggaatgcaacgacttccagagctttgtatcaggttggtaacgatgttagagggaatttttatcttcattccagccatactgctttcggtgtcccttgcttggtggataccactaattttgtttagctgcgttactcctgctatgtatgtagaaaggaaatatcgtaagcaagtttggagggtagaaaaaacccaagccagtcttcttcgagaaatgaacttatataaaacggttttaactggagagacatacgccaaagaaatacgcttgtttagtttgcagcctttactactagaacgttggtatggactttatcgcaccatttttagagcaatggaacagatccgtcgtcgggggacaacggcggttattagttggtctttactcagtggcttaggctttgcgttgccatatttatacgtagttcagggagtgctagatagaacccatactttaggggatttggcgctttacactggggtaattttagaagtgcgtcgaagtttggataatttgatgtctggcgggtcagagttgtatgatattgcactggcaacaacgcccattttccaacttttggaattagagccgcaattatccagttctcaatcaaagtcatggggaaaaatcagggaatcggctgctaacaatcagaactttcaaagaaatggaaatcgggaaagtttatcgggtgaagcattacagacaggtattgacatcaaaaatctatcctttacctatccaaatagcgagcgccccatcctgaaaaatatcaacctgaaaattcaccccaacgagatgattgtattggtgggtgaaaatggtgctggtaagacgactttaacaaagctattgtgtcggctctatgaccctagccagggtgcgattatttggaatggggaggatttgcgatcgctcccgttagaagatttgcgatcacggattgatgtagttatgcaagattatgcacgttttccgactaccgtgcgcgaaaatgttgcctttggcaatttacctaaaatgcaggatgacgaagcgattaaggaagcgatcgctgaggctggtttggcgaaagtaattgagaagctagatggtggtttggaaaccctcttaggcaaacagctagagggtggtattgatttatcagggggacaatggcagagattagcgatcgctcgtgctttgttgcgactgtctccagccgaattactcatacttgatgagccaacagcaaatcttgaccccaaaacagaacatgagatttacaacattttgcgtactctagcgaaggggagaatagccgttgtagttagccatcgcctcgccttagcaaaactagcagaccgagtagtagtactagaacacggtcaaattatcgaagtaggcactcatgatgaactcatcgcactcggcggacagtatcatttgatgtttactcgtcaagctagtagttac

SEQ ID NO: 43860 - DNA, 3355 bp, Nostoc punctiforme
ggtttatttaactttggacaaagctatttagcagaagcagcctctcaaggtgtagcttatgacctgcgaaacaagattttcagcaaaattcaaaatctcagtttcagctatcacgatcaggcgcagacttcccaactcttaacccgtgtcaccagcgatattgagcagatccgtacctttgttggtactagcttaattcaggtcattggtggagttgtcacactggtaactattgcagtaattttgctggtgatgaactgggaactagcactgattaccctaacagcagtacccatatcagcatggttgatggcaagatttgtcggtcggaataacaaactttttcggcaagtacaagagcaattaagcgacctgaatgctgtattgcaagagaacttgttaggaatacgggtagtgaaagcctttgtccgagaatcagccgaaaggtcgcgttacacaaccctaaatgatggtctagttagggcaaacatgaagaccattagcgctatccataatactttcccctttatctttttgctgagtaactttgtcacactggcggttttcggctacggaggagcgcaggtaattgggcgtagattttccattggcgaactggtggcgtttaactcctatctggcgttgattctccaaccaattttgttgattggatttgctgcacctgcgatcgctcaatcagccgcttctgctgaacgagtctatgaagttgtcgatgcagaagtagaaattcgcgatcgccccggtgctgttccattcgacacctgcgttggtagaatcacctttgaaaatgtttcctttcgctatccgggagccacgactgaaaccctcaaagaagtttcctttgaaacaaggcccaaagagctaatcgccgttctcggaatgactggttccgggaaaagcacaattatgaacctacttgcccgtttttatgatgtcacagggggagcagttcgcattgacggacgagatgtcaaagatttcacactcaaaagcctgcgatcgcggattggcattgtatttcaggaaactacccttttctctggcacaatccgcgaaaatattgcctacgctaaacccgatgcaaccctagagcaagtgattgaggttgcaaaaaccgcccaaatgcacgattttattatcagtttacccgatggctacgagacgattgtgggtgaacggggcgtaggtttatctggtggacaaaaacaaagaattgcgatcgctcgaaccttactaaccgattacagcattctgattttggacgatagtacctcagccgtagatgccaaaactgctgctcatattcaagccgaactagatggcttaatgcgccaaaaagcttgtacaacttttgtagtagctcaacgcattagcaccgttaagaatgccgatcggatttttctgatggataaaggtcgattagtcgcccaaggtactcacgaagaattgatggaaaccagccccctctacggtgtgattttggaatctcaggtaaaggcgaaagaaaaaaatgatacaaaactaagataaatagtgttgcttgagatttttataacaacctagtaatccaaaatttaaaattgctatgagaggcactattcctgttgttgcatctgagcaagcgagtaagcaactttctaccctgcggcgttttttgcaatacctgctactttatcgcaaagaaattcccatcgccttgacattagtatttattggtgctgtaacccaggcaattggaccatttttcctcggttggtcaatcgatcgcctaattgaaaaaggtaatttacaaggactcctactgttattagggctactagcgctgaactacggacttggcattatagcaatccggggtcaaattattcgagtcggctggattatgcagcgattgttggctcaactgaggcaagatatttttctcaaaatccaaagtctccccctcagctttttcgatcgcagcgaagcgggcgatttaatgagccgtctgctgaatgatgtcaatactgtgaatcaggcatttggactgacgatcgcccaaatgctaggcaacattttcagtttggttggtatcatcattgccatgctctcaatcaacctgcaacttggcttattgagcaacctggttgtgccactgatgatttttaccacaagtttgtttgcacgttgggcaagagccaggtttcgcgttacccgacaaaccattggggagctttccgccaagttggaagaagatattggcagtgtcagagaagcacaggcatttaatcgggtacagacaaacatcgcccaatttgacgttcttaacgctgcaaatcgtgatgccaacgtcgaagctgtagcaattacttcggcctttttgccctccattgattttctcaatacactcgcaaccgcaggtgtgctggcttatggtggctatcttgcggtcactggggctgtaacagtgggcgtggtgacatcctttttactttacgtccagcagttcttccgccctatccagattctcagccagttttacacccaagctcaatctgccttcgccggattagagcgaatctttctattactagatgaaccgtcagagctcaaagatgcacccgatgcgacagaaatgccgccgattcagggggaagtgagatttgagaatgtcaagtttggctataacccagatcaattggttctcaaaggggtgaatttgcacgcctatccagggcagatgattgcactagtcgggccgactggttcgggaaaaagtacaattattaacttgattttgcgcttctacgatgtatttgctggtgcagtaaaaattgatgatattgatgtgcgtagtgttacccaagccagtctgcgccgtcaaattggcatcgttttacaagataatattctgttcagtggtactgtcgccgaaaacattgcctttggcgctcctcatactacccaagctgacatcgaagcggctgcacaactggcaaatgtacatgagttcattacctcattaccacaaggctatacaacccaattgggcgaacgaggagcgcccttgagccagggacaacgacaactgattagtattgctcgtgcggtgttgattaacccacgaattctgattcttgatgaagccaccagcagcattgacacgcgcacagaagcgctagtacaaagtgcgatcgctcgtttgctgcaaggtcgtaccagtttcgtaattgcccaccgcctcagcacagttactcaggcagatcaggtattagtaattcagcagggacaaattgtagagcaaggtactcacgccgaactcatcgagcggcaaggtgtatacgccaacctctat

SEQ ID NO: 43861 - DNA, 1656 bp, Nostoc punctiforme
aatatgagtgaagccttattctgtatcgaaaatctgcgagttgcctatcctcaacggagtggagaagaggcaagctgggcggttgatgatgtatctttcaccttgcaaccaggtgaaagaatgggattggtgggagagtcaggttgtggtaagtcaactatcgggcgggcagtaatgcgtttactaccagcctctagttgtgttgagggaaaggtgacatttcaaggacagtcggtgcttgacttgatgcctaaccagttgcggaaatttcgaggagaggcgatcgccttaatttttcaagatcccatgacacgcctcgatccgttgatgacgattggtaagcattgtatcgaaactcttcaggcgcactcaccacaattatcaacgcgggaagccaaagaaaaagcacttgctactttggcgaaggtaaatattcccgctagtcgctggaatcagtatccccacgaatttagcggtggaatgcgccaacgggttgcgatcgctttagctttactcctcaaccccaagttaattgttgccgatgaacccaccaccagtttagatgtcaccgtctccgcgcagatattgcaagaattaactcgcctgtgcggtgaagaaaacatgggattgttgctgatttctcacgatttagcaatggtggctgagtattgcgatcgcattggcgtgatgtaccagggcaaaatggtcgaaatgggttctacagaaaccgtctttagacaacctcaacatgaatacacgcgatcgctcttaaaagcagctttacacattcaagcagtaaacgatgatggagaattgataattgccaacgactcagaaaagcaattaccgattattaataagcaatctccaattttgagtattacagaactcaagcaatactacaccatagaacctaactttatcgaacgactgtttaacacacaagcgcagacaattaaagcagtagatggtatcaacctggatatttatccaagagaaattctcggcttagtcggtgaatcaggttgcggtaaaagcacactatcacgaacaatcctgcaactaattcgtcccaccagtggcaaagttaaatttttaggacaagatttaactacactgtcgcctcaagaaattcgctcctcacggcgacaaatccaaatggtttttcaagatcctcatgcttgtctcaatccagcgatgactgtgggacaaagtatagccgatcctttatttatccacaatttagccgatcttgttaaggcaaaagaacaggttttgtggatgctagagaaagttgggttaacaccctcagaagtatattatgagcgttatccatcagatttatctggggggcaacagcaaagagttgcgatcgctcgtgctttgattactcaccctaaacttttgatttgcgatgaacctgtgagtatgttagacgcaagcgtgcagtcgcaagtactagatttgatgttgcaattaaaagaagaatttgagttaacttatctgttcatcactcacgatctctggttagctagatttttgtgcgatcgtattgccgtgatgaatggtggcaaaattgtcgaactcggtctaacaaaaactatttttgccaatcctcagcacccttataccaaaacactactagctgctgccccc

SEQ ID NO: 43862 - DNA, 1497 bp, Nostoc punctiforme
gattttctttatggtggtaatgagaatgataccgtcataggatttgcgggagacgacaacctctatggaggtttaggtaatgactatctttatggtgatgaggataatgacaaactctatggaggtttaggtgatgactatctttatggtggcttaggtaatgactatttaaacggagaagagggtaataatagtctatatggtgaagcaggtaatgattccttctatgccgccaactcctctgggaacaaccttttagatggtggggcgggaaatgatgaactttacgtttatagctcgactggaaataacacccttaagggtggaagtggaaacgataccttagatatttccttctcttatggaaaaaatattttagatggtggctctgaggatgatcgtctttctgctcgctacgccgtaggaaacaatacccttcggggtggaaccggaaatgattatattgcagctgatttgtctgctggtaataatgttctcgacggaggtgatggaaatgatacccttgacattaattatcaatggaaaggcaagaatacagtttcaggtggaaacggagcagacactttttatgcctatggagttcagggtgctaacactctcaatggtgatagtggtgatgactctttctatattagtagcccagaaactgttctctattccttggtaactcaaacagttgatggaggaacaggtaatgattacttgtacattgactatagtaatgcgatcgctagcattacctcaacatacaaccctaccactaaccaaggtttaattactgctgacacaaatcaagtccgctacaaaaatatcgaacgattagaggttaagggtacagcctatgacgacaatattgtaggcagcaatggcgacgatacactcaacggcggtaatggtggaaatgacaccctcaaaggcggtgcaggcaatgacatcttacgtattaacgacaattcacgtaatactaatactgcctatggtggtacaggtaacgactttttatatgcagaagctacaggtggaacgagcctactagatggtggcgatggcaatgattatttatccattgctaatagctactctagtgtctttggcaggagtaataccctgaatggtggtgtaggtaatgacaccttaaatgctaaagctacctatggtggtaacttcttgaatggtggtgtaggtaacgatttcatttatgcagactattcatctggtacgaatatactagatggtggcgatagagatgattatctatctgctgctggcgctagcttccatttcgataacaccttttttactttgaagggtggtacgggtaatgacaccttaaatgctaactcttcatttagtaccaataatctcgatggtggtacaggtaacgatcgcttgactgttgaaaattcgtataagaataacttgctaaatggtggcgatggtaatgattatctgaaggggggacaagcacccgaaagc

SEQ ID NO: 43863 - DNA, 957 bp, Nostoc punctiforme
atgatgcaagcagtatgcgaccaaatagcgatcgcaatggaacgggctagtttaattgcctttttgcaaaaacaaactgagcagttacaagaggcgaaccgtatgaaagacgaatttctggggatattgtctcacgaattgcgatcgcccctcaatgcaattttgggctgggcgcaactcctgcaacgaagcaagctgagtgaaagccaaatggctaaggctacggagacaattgagcgcaatgctaaggcgcaaacccagctaattgaagacttactcgatatatcgcggatgattagaggcaagttacacctcaatgtcagtacttgtaatttggttccgatgattgagtcgaccctagagactgttagcctagccgctcaatccaaggaaatcgatttaagattttccatcatttcctcaaaagaaacgcgaaatacgccactggggatactccccgtggtaacaatcgcgccaaattcagatttgggattagaaattaatcacgaaaatgttgaatcaagagaagcggaatcccaaagcaatcaacgttcaaaggacagcagcgaaaattcccaattcctagtttccggtgattttgagcgtttgcagcaaattatctggaatctgttatctaatgccatcaaatttacaccgacaggtggacaggtagagttgcaattgtcagtggtaactggcgaagaaaaacaacatataacagagaaatatgcccaaattcaggtgattgatacaggtattggtattagccctgattttctcccctacgtcttcgatcgctttcgtcaagctgatagttctaacactagatcttacggtggattaggactaggattagcgatcgtgcttcatttagtagaattacatggtggtactgttcaggtagatagtccaggaaaagatcaaggagcaacatttacagtcaagttgccacttttg

SEQ ID NO: 43864 - DNA, 678 bp, Nostoc punctiforme
aaaaggattgctgtggtaacaggcagcaatcgagggctaggatatgctatttcccgtcaattatccaaaattggcaaccgcgtaattctgacgagtcgtaatgaaacagatggtcttgctgctaaaggtcagcttaccaataaagggtttgatgttgattatcacactctggatgtcaccaatgatggaagtgtgcaacagtttaccgagtggctacgtgaaacttacggcaaagtagatattctggtcaataatgcaggcgtaaatcccacaactaagccggaagagtccagcttactgactgtgcaactggaaacaatgcgatcgacctttgaaactaatgttctagcggtactcagaatttctcaagccttaattccgttgatgaaggtgcaaaattacggccgcattgtcaatatctcaacggaaatggcatctctaacatcagttcccactgactactaccctttagcgccatcctatcgactctcgaaggtgggagtaaatggactaactgtgcttctcgccaaggaactccagggtactaatattctcgtaaatgcttattctccaggttggatgaagacagatatggggggagatgatgcgccgttcacggcagaagaaggagccgaaactgctgtctatttagcaacgcttcccgatggaggagcgcaa

SEQ ID NO: 43865 - DNA, 2349 bp, Nostoc punctiforme
attattcttgatgttgggggcatgaagtgtgctgggtgtgtgaacgcggtagaacgacagctaacccaacatccaggagtcaagagtgcctgtgtgaacctggcgacagaggtagcagttgtagagtcagaaactggtgcggtagatgcagatgcactggcacagcgattaacagccgttggatttccaactcaaccccgaaaagctagggccacagtagcaggcgaaatatctaccttaccagatccagcagaacgacaacgccgagaaatgcggtcttctgttaggcagttggcgatcgctgcaatgttgctgttattgtcgggaagtggacattttggtaatcttggtagctcggtgctgccactgttaaataacatctggtttcactgtggattggctacagtggcgttattaattcccggtcgcccgattttagtagatggctggctaggctggcggcgaaatgcgcctaacatgaacaccctgataggattgggaacgctgacagcctacattgctagtttagtagcgctgctctttccccaaatgggttgggagtgcttctttgacgaaccagtaatgatgctgggctttattcttttaggaagaacattagagcaacaagctagaggtcgcgctgctgctgcatttaggaaattgctagcacttcagccacaggtagcgcgattgattgccaacccagaaaaaggaggagtgggatcttctagtgtagagattcctgccgaacaggtgcgggttggtgaatggttacaggtgctgccaggcgataaaattcctgtagatggtgaagtggtgcttggtcaaacaacagtcgatgaatccatgttgactggggaagccgtgccagtaattaagcaaccgggagattcggtgacaggcggtacactaaaccagtcaggagcgatcgctattcagacaacccggactggaagtgatacaactctagctcaaattgttgctttagtagaagccgcccaaactcggaaagccccagtacaaaagttagccgatacagtagctggttacttcacatacggggtgttaacagcatctttattaacatttgtcttttggtactttttcgacactcatctttggactgatatcgccatgtctggtgagatggagatgatgagccacgctatacatcaagctccccgctcccctttattaattagtttaaaactagcgatcgcagttatggtagttgcctgtccctgtgctttaggacttgctaccccaacagctattcttgttgggactgctatgggcgcagaacggggtttgttaatcaaaggcggcgacgttttagaaaaagtacaccagttagacactgtagtatttgataaaactggtactctgaccacgggtcatcccatcgtgaccgattgcttgttaatttcagaaacgggaagtgggaatccctactctctaatccaactagcaacagccgtagaaagtggtactcaccaccctctagcaaaagcgattcagcaagaagcacagagacaaaagttatctattccagaagctgtggactttcacacggaaccaggattaggagtgtctgctgtggtagaggacacagttgtactgttgggtaactgggattggttgagttggcacggtatttcaattagtgaaactgcacaacaggtagcacaggatttggcaacagatggtaaaacagtcgtttgtgtagcagttgggggaactctagccggattaattgctgtttctgatacccttagaccagatgcccaatccactgtagacaaattgcgtcagatgggattacgggtaatgttgctcagtggcgatcgcctagaagcagctagcgccatagccaaacaactaggattagatagtgctgatgtcatagcaggtgttcccccagcgaaaaaagcagctgcaatcaagaatttacaacaagcagggacaaaaggaactcctaactcctcactcctcactcagcactcagtagtcgcaatggtaggagatggaatcaatgatgctccagctttatctcaagcagatgtaggaattgctttgcactccgggacagatgtggcaatggaaactgctgaaattgtcttaatgcgtgatcgcttaaacgatgtagtcgaatctattcagcttagtcgcgccaccttcaacaaaatccgccaaaatttattctgggcttttgcatataatacagttggcattcctttagcagcaggtgttttgttccctagtctgggttttgtccttaacccatctggcgctgctgcattaatggcttttagctctgttagcgtcgtcacaaactcaatattattaaga

SEQ ID NO: 43866 - DNA, 978 bp, Nostoc punctiforme
atgtgagaagatgtaaataatcagttagaatgatttcgcatgtctgtaatattttttccacctcccatacaacaaatcaacagcgaaatcatccgtagcgctggtgttgatctgtatgtactacgcctggatctcatgcacccgtgggttaacggcaataagtggttcaagctgaaatacaatcttttggaggccaaggagaaaaatttcacaacgctgcttacttttggcggcgcttattccaatcacatctatgcaactgcggcggctggtaatcttttcggttttcgtaccatcggcgtaattcgtggggaggagagactaccattaaacccgacgctgaattttgctgtacaacagggtatgcagcttgtgtatacgaaccgcgaaatgtatcgacagcgcaacacaccagtggtagaggaatatctgcaacaacgcttcggtgaagtgtttatcattcccgaaggcgggagtaatttaaatggtgtgcgcggctgtatggagatcattggtgatgcgatgtctacggcggtcactgaacgcagtcgaagtgctggctacgcctacgcatttgatcgtatatgcgtagcctgcggtacagctaccacacttactgggattgcgctttcattgcatcaaggacaaagagcgatcgcttttcccgttctgaaaaatggctcatttcttgcacaagaaatcgaaagtctgctgacaaattacctcgcctctgatttacccacaccatctaactcccctgctttttgggaattggtatgtgattaccactttggcggctatgcaaaggtgaacaaggagttattattgttcagccaacagttcagggaggaacatggcatacctcttgattacgtatataccgccaaaatgttttacggtgtgatggatttactaaaacagggattttttagtaaaggcgattcgttgctgctggtacacacaggaggcttacagggc

SEQ ID NO: 43867 - DNA, 963 bp, Nostoc punctiforme
gtagttgcagtaatagacgcaggaatattaaagtatcaaccggaattagtgaagcaattagttgcgtataccaagttttatggagaggtactagcgatcgcagctgaacccatgataatttcgggaggagaagctgccaaaaacgatcgcactttagtagagcaaatccagcaactcattgaaacagccggattatgtcgccattcttatgtgttagcgatcgggggcggagctgtattggatttggtaggatatgctgctgcaactgctcaccggggaattcgcctgattcgggttccgacaacggtgttagcacaaaatgattctggggttggagtgaaaaacggcattaatgcctttggtaaaaagaactttctcggcacatttgcgccaccttatgcagttataaatgactctgcgttcttgacaaccctagacgatcgcgattggcgttctgggattgcagaagccgtgaaagtggcgctgattaaggatgctaacttttttgattttatccactctcacagcaaagcccttgggcggcgagacatggatgctatgcaacaggttatctatcgttgcgcccagttgcacctagaacatattgccaatagcggcgatccttttgaaatgggttcgtctcgtcccctagattttggacattgggcggctcataaactggagcatttgacaaattatcgcttgcgtcatggcgaagctgttgcgatcggtattgctttggatagcacttattcttatttagcaggattgcttgattgctcagaatggcaacgaatattaaatactttatcagcgttgggtttcacgctgtatgtgccagaactggcccagaaattatcacaacaggaacatcctgattgtttgtttcgaggtttaactgagttccgcgaacacttgggtggagaattgactttaacattgctaaaaaatattggaaaagca

SEQ ID NO: 43868 - DNA, 1009 bp, Nostoc punctiforme
gaaattactcgcatcagccaatactaatgaaacttggaaagtcaccgtagaaaaaagcattggcactcataaagttgtgctagggctaattggtgataccactagcatcgataaattacagattcaagagtacagcccttggattgagcaagtattacgagtgcaacaacctttcaaacgggtaagccgagaattccgacatggagaagccagcgaggttgttgtacctacacccaacggtgatgtctatttcggcgaacatcatccgattgtggtggtagctgggccttgttccgttgaaaatgaagcaatgattgtcgaaactgcaaagcgcgtcaaggcagcaggagcgaagtttctgcgcggcggagcctacaaaccccgcacttcaccttatgcctttcaaggttatggggaaagcgctttagatttattagcagcagcacgggaagctactggtttgggtatcgtcacagaattgatggatgctgccgatttatcagcagtggcgagaacagctgacataatccaaatcggagctaggaatatgcacaacttctcgctgctgaaaaaggtaggcgctcaagataaacctgtgctgctgaagcgggggatgtctgccacaattgacgagtggctgatggcagcagaatatattttggcatcaggaaacccaaatgtgattctttgtgagcggggaattagaacctttgatggtaaatatgcccggaatactttagatttatctgtgcttccggtattgcgatcgctgacccatttaccgattatgatcgatcctagtcatggtactggtaggtctgaatatgttccatcgatggcaatcgctgcgatcgcagctggtacagattccttaatgattgaagttcaccccaatcccgcaaaagctttatctgacgggccgcaatctctcacccctgataaatttgaccgcttagttcaagaaatgtcaattattggcaaagtagtcgatcgctggtctacacctaca

SEQ ID NO: 43869 - DNA, 774 bp, Nostoc punctiforme
aaaaaaactgctctaattacaggagcggctagtgggataggctatcaattaacccagatttttgcccgtcatggttataatctggtgttagtggataagaatgagcagaaacttacagaaatcataaatgaatttccgcaaaagtttggtatttttgtgaaaattttggctaaggatttatctatcccaacatctccagaagaaatttttagagaactccagcaagaatccatcaaaattgatgtgctggttaacaatgctggctttggcacttatggagcattcagcgaaacagacctcagtattgaactgcaaatgcttcaggtaaacatggtgacattgactcatttaacaaagttatttctcaaagatatggtcgagcaagactatggaaaaatattaaatgtggcctcagcagcagcttttcaaccagggcctctaatggcagtttattttgctactaaagcctatgtcttatccttttcagaagcgatcgctaatgaattagagggtactggtgttagcgtgactgttctttgccccgggccaacagcatcagaattccaacaaactgctgcaatggaagattcaaagattgctagcgttaacagaatgatggatacggcaaccgttgctaaaattggttatcagggtttaatgaaaaacaaaactgttgttgttcctgggatgagaaataaaatattgaccgaaagcgtcagatttacacccagaaatctagtaacaaaggttgtgagaagtatgcacgaacttaaa

SEQ ID NO: 43870 - DNA, 1131 bp, Nostoc punctiforme
cgcttttgtacccattgtggtgaaccattacctcttgctgtgggacaggttgtggataatcgctatcaaattatccgtcatttagggcagggcggctttggacgcacctatttggcggaggatataagtcaatcccatcgaacctgtgtgctgaaggaatttgcgccccaagtacaagaacatcaagatttacaaaaagctaaagagttatttgagcgagaagccaatgttctgaaaaaactccagcatccacagattccgcgttttcacgcctcgctacaagtgaaaataggtactaaagattttttctttttagtacaagattatgtggatggtgacaattactaccaattattagaacaacgcgagaacgaaggcaaaactttcagtgaagaggaagtaatcaccctactgcaacagattttacctgtattagcttacatccactcacaagatgttgttcaccgtgatatctctcctgataatttaatttggcggcgttctgataatctacccgtgctgattgattttggtggtgtcaagcaattgccagcttctcaaggtttttggcagacgaagttggtgggaaataatactttgctgggtaaaaaaggctacgctccagaagagcagttacggcaagggaaagcattttttagtagtgatttatactctttagcggttacgtcactggtgttgcttacagggcaagaaccgcaaaaattatacgacagctaccagggaatttggggttggggaaaacaaatccgagttagttccaaactggaagcggtgttaaaaaagatggtggcttataaaccgagcgatcgctatcaacgagccgagcaaatcctcaaagatttaccatcatcaagtgcggctaaatcaactggcaattcgattaccaccaagattaaaacgatggtagttgctccgggaagacaacgcgccagcgctattgtgagtagatttcagaacagaacgcaagcgattgccaaaccgatatctttccctctttggattcgtccttttatgatgagtttagggggaacagctttagttgttttaaccggcgcaggtgcttggggggtagtaaatgcagttattcgcagcgtatcttcaattaccatc

SEQ ID NO: 43871 - DNA, 1653 bp, Nostoc punctiforme
atggcgaaaattattgcatttgacgaggaatcgcggcgagctctagaaaggggtgttaacgcccttgctgatgccgtaaaaatcaccttggggccgaaaggtcgtaatgtccttttagagaaaaaatttggcgcacctcaaattgtcaacgatggtatcactgttgccaaggaaattgaattagaagatcctttggaaaatactggtgcaagactcatccaggaagtggcctcaaaaactaaagatgttgctggggatggtacaaccaccgccacagttttagcacaagccttgattcgggaaggtttgaagaacgtcgcggcgggtagtaacccagttagcttgagacgcgggatcgacaaaactattgaggcattggtactggaaattgccaagatagccaagccagtagaaggaagtgcgatcgctcaagttgccactgtttctgctggtaacgatgaagaagttggtcaaatgttagctcaagcaatggaaaaagtcaccaaagatggtgtaattaccgttgaagaatctaaatccctgacaactgaactagaagtagttgaagggatgcagattgacaggggttacatttcaccctactttgtcaccaacaacgagcggcaaatcgtggaatttgaaaacgcccggatcttggtgacagataaaaaaatcagcagcatccaagatttagtgccgattttggaaaaagtcgcccgttctggtcagcccttgctgattattgctgaggatgtcgaaggtgatgccttggcaactttggtagtgaacaaagcgcggggtgtacttgctgtagctgcaatcaaagcgcctggatttggcgatcgccgcaaagctttgttagaagatattgctattctcaccgatggacagttgatttctgaagaaatcggcttgagcctagataccgctgctctagaagcactgggaactgctcgcaaaatcaccattgacaaagaaagcaccaccattgtagctggcagtgtcaccaagccagaagtgcaaaagcggattggtcaaattcgcaggcagttggaagaaaccgattctgaatacgatcaagaaaaactgcaagaacgcatcgccaagctcgctggtggtgtggcagtgattaaagtgggtgcggcaaccgaaaccgaactcaaagaccgtaaactgcggattgaagacgcgctgaacgctactaaagccgctgtggaagaaggtattgttcctggtggtggaacaactctaattcacttagctaaggcagtagaagcgattaaaaagaccttacaaaatgacgaagaaagaattggggctgatattgtcgaacgagcgctagaagcgcccttgcgccaaatagcagacaacgctggtgcagaaggttctgtgatcgtttctaaagtccgagacagcgagttcaacattggctacaacgccgctactggcgaatttgaagacttgatcgctgctggtattatcgaccctgccaaagtcgtgcgttcagctttgcaaaatgctggttccattgctggtttggtcttaaccactgaagcgatcgttgttgaaaagccagagaagaaatctgctgctgctgcccctgacatgggcggcatgggtggtatgggcggcatgggcggcatgggtggtatg

SEQ ID NO: 43872 - DNA, 1830 bp, Nostoc punctiforme
accttgggaggacacgcaaaggaggttcagggcatcagcttcagtcccgatggcaagatgctagcttctgccagtgatgacaacacggtgaaactgtgggataccaccactggcaaagaaatcaaaaccctaactgggcatacaaactcggttttgggcatcagcttcagtcccgatggcaagatgctagcttctgccagtagtgacaacacggtgaaactgtgggataccaccactggcaaagaaatcaaaaccctaactgggcatacaaactcggttttgggcatcagcttcagtcccgatggcaagatgctagcttctgccagtgctgacaacacggtgaaactgtgggataccaccactggcaaagaaattaaaaccctaactgggcatagaaactcggtttttggcatcagcttcagtcccgatggcaagatgctagcttctgccagtgctgacaacacggtgaaactgtgggataccaccactggcaaagaaatcaaaaccctaactgggcatagaaactcggtttttggcatcagcttcagtcccgatggcaagatgctagcttctgccagttttgacaacacggtgaaactgtgggataccaccactggcaaagaaatcaaaaccctaactgggcatagaaactcggttaatgacatcagcttcagtcccgatggcaagatgctagcttctgccagtgatgacaacacggtgaaactgtgggataccaccactggcaaagaaatcaaaaccctaactgggcatagaaactcggttaatgacatcagcttcagtccgaatggcaagatgctagcttctgccagttttgacaacacggtgaaactgtgggataccaccactggcaaagaaatcaaaaccctaactgggcatacaaactcggttaatgacatcagcttcagtcccgatggcaagatgctagcttctgccagtggtgacaacacagtgaaactgtgggataccaccactggcaaagaaatcaaaaccctaactgggcatagaaactcggttaatgacatcagcttcagtcccgatggcaagatgttagcttctgccagtggtgacaacacggtgaaactgtgggataccaccactggcaaagaaatcaaaaccctaactgggcatacaaactcggttaatggcatcagtttcagtcccgatggcaagatgttagcttctgccagtggtgacaagacggtgaaactgtgggataccaccactggcaaagaaatcaaaaccctaactgggcatacaaactcggttaatggcatcagtttcagtcccgatggcaagatgttagcttctgccagtggtgacaagacggtgaaactgtgggataccaccactggcaaagaaatcaaaaccctaactgggcatacaaactcggttaatggcatcagtttcagtcccgatggcaagatgctagcttctgccagtagtgacaacacggtgaaactgtgggatactaccaccactggcaaaaaaatcaaaaccctaactgggcatacaaactcggttaatggcatcagcttcagtcccgatggcaagatgctagcttctgccagtagtgacaacacggtgaaactgtgggataccaccactggcaaagaaatcaaaaccctaactgggcatacaaactgggtttatggcatcagcttcagtcccgatggcaaaatgctagcttctgccagtactgacaacacggtgaaactgtggaggctggattttgattatttactccagaaagggtgcagttttatgcgcgagtattataaaactaatccccctgataatgagagtgacaag

SEQ ID NO: 43873 - DNA, 471 bp, Nostoc punctiforme
aaactcttgctcatcggacaaggcagcgtcggcaaaacatctctcatcaagcgactaatccgcaatgaatatgatgagaaacaaccccaaaccgacggactcaatgtagaaacttggaacgtgcaggtcaatagcaaagacatccgcctgaatgtttgggactttggcggacaggaaatttatcatgccactcatcagttttttctaactaagcgcagcctctatctcttagtctgtaattgtcgcaccagcgaagaagaaaaccgcatcgaatattggctgaaactaatcgaaagcttcggcggagagtcccccgtgattatcgttggcaacaaaaaagacgaacaacccttggacataaaccgcaaggcattacgcgaaaaatatcctaacatccaagagattatcgaaacctcctgccaagataatatcggcattgatgaacttcgcaccgccattttccagcaagtc

SEQ ID NO: 43874 - DNA, 1464 bp, Nostoc punctiforme
cagaaagagttattgcaactgatagatcgtgccgtggctgagggttggcgagagttagacttgtcggggcaagagttgactgagttacctgtggaaattggtaagttgcagcagcttgagtctttgattttgggaaagaaggttgaaggttatgaacgagtaggagaccactttctcgaaaaggtttcgggcaacaatttaaaaacgcttccactggaactattgggtttgcctaatttgcgtaagttggatattagtggcaatcctttagagagcattcccgatgtggtaacgcaaatactgcatttagaggaacttatcttaattcgagtagagctaactgaaatacctgatgcgatcgctaatttaaccaatctgacgcagcttatcctcagttacaaccaaataacccagattccagaggcgatcgctaaattaagcaatctgactgtgcttatcttcagtgacaacaaaataacccagattccagaggcgatcgctaatttaaccaatctgacgcgacttaacctcagttccaaccaaataacccagattccagaggtgatcgctaaattaaccaatctgacgctgctttacctcagtggcaatcaaattactgagataccagaggcgatcgcgcaattaaccaatctgacgctgcttgacctcagtgacaacaaaataaccgagattccagaggcgatcacgcaatcaaccaatctgacggtgcttgacctcagtagcaaccaaattactaagataccagaggcgatcgcacaattaaccaatctgaagctgctttacctcagtgacaaccaaattactgagataccagaggcgctcgctaatttaaccaatctgatgcagcttcacctcagtagcaaccaaattactgagataccagaggcgctcgctaatttaaccaatctgacgcagctttacctcagtggcaaccaaattaccgagattccagaggcgctcgctaatttacccaatctgacgcggctttacctctatagcaaccaaattactgagataccagaggcgctcgctaatttaaccaatctgatccaacttgtcctcttttccaaccaaattgccgagattccagagacgctcgctaatttaaccaatctgatccaacttgtcctcttttccaaccaaattgccgagattccagagacgctcgctaaattaaccaatctgacgcggcttgacctcagattcaaccaaataacccagattccaaaggtgatcgctaatttaaccaatctgacagaacttcacctcagtagtaaccaaataacccagattccagaggcgctcgctaatttaaccaatctgacacagctttacttcagttccaaccaaataacccagattccaggggcgatcgctaagttaaccaatttgacgcagcttgacctcagtggcaaccaaattaccgagattccagaggcgatt

SEQ ID NO: 43875 - DNA, 1487 bp, Nostoc punctiforme
ctgatccttttaccagtaattcgctcgattcaaaagctacaacagggagcagcaaaaattggagatggaaatctagaataccgcctgaatattcaaaccgaagacgaaattcaagaactcgcagaagcttttaaccgaatggcaggcactctagctgagtcctatcgctctctagagttaaaaaaagagcttgctgatacagcaaatcgtgccaaaagtgagttcttagctaacatgagccatgagttacgaactcctcttaacggtatcctgggttatgctcaaattctccaacgagataaaactttaactgataaacagcaagacggcttaagaattattcaccagtgcggttcacacctattaacattaattaacgacattctagatttatccaaaatagaagcccagagaatggaactttacaaaagcgactttcattttccggcttttctccagagtgtagtagaaatttgtcgcattcgtgctgaccaaaaaggcatttcattcatttaccaaccaacttcagaattacctattggcgtttgggcagatgaaaagcgattgcggcaggtcttaattaatctactaggtaatgccattaaatttaccgaaaaaggaggagtgagatttactattagctctgtagaccaattgttaaccaatgaaagtaaccaaaaaccaattcataaaattcggtttcaaatcatcgatacaggaattggcatgagtcaagaacaggtagcgaaaatattcttaccatttgagcaagtcggagaagttaaaaagcaatcagaaggtactggattaggtttagctattagtcagcgaattgtgcaactaatggatagtacaatccaagtaaaaagtgaaataggtcagggcagcactttttggattgacttggatttgcaagaatcagtggattggatgcaatcagctagagtcatttctgctggcaaaattgtcggaatcgccactggtaagcgcagaattttgattgtagatgataggtgggaaaaccgttctgttgtgatgaatctattagatgaaattggatttgaaattatagaggccagtgacggtcaagaaggcttagataaagctatgcaatttctaccggacttaatcattacagatttaacaatgcccgtaatggatggctttgaattaacgcgtcgcctccgccagcaacaagagtttcaggatttgaccatcatagtttcatctgccagcgtatttgaatctgaccaacacaaaagtttaggagttggtgcagacgattttctaccgaaacctgtacacgctgatgatttacttcagaagttagaaaaatatttacaacttgaatgggtttatgaaactgtaccggagaaatctgtaaatgaaacacaaaatactatccatagcccaagtagctctgtcgtaactgctgaaagtacaattgttgggattactggcaataagcgaaaaatcttgattgtaga

SEQ ID NO: 43876 - DNA, 1332 bp, Nostoc punctiforme
aaacccaaaatgactaacgaagaactgctgcaaattattgaacaagctgtcaaagacgaggtaacagaattagacctttcttacaaagggttaacaatactgccaccggaaattggccaactcaccaacctgcaaactctccacctcgacagtaatcaactgagcagtctgccaccgaaaattggccaactcaccaacctgcaaactctccacctccgcagtaatcaactgagcagtctgccaccggaaattggccaactcaccaacctgcaaactctccacctcggcaataatcaactgagcagtctgccaccggaaattggccaactcaccaacctgcaatccctccacctctggattaatcaactgagcagtctgccaccggaaattggccaactcaccaacctgcaatccctcgacctcgacagtaatcaactgagcagtctgccaccggaatttggccaactcaccaacctgcaatccctcgaccttggcagtaatcaactgagcagtctgccaccggaaattggccaactcaccaagctgcaatccctcgacctcagcaggaatcaactgagcagtctgccaccggaaattgtccaactcaccaagctgcaatccctcgacctccgcagtaatcaactgagcagtctgccaccggaatttggccaactcaccaagctgcaatccctcgaccttggcagtaatcaactgagcagtctgccaccggaaattgtccaactcaccaagctgcaatccctcgaccttggcagtaatcaactgagcagtctgccaccggaaattgtccaactcaccaacctgcaatccctcgacctcagcagtaatcaactgagcagtctgccaccggaaattgtccaactcaccaagctgcaatccctctacctcagcagtaatcaactgagcagtctgccaccggaaattgtccaactcaccaagctgcaatccctcgaccttggcagtaatcaactgagcagtctgccaccggaaattgtccaactcaccaagctgcaatccctcgaccttggcagtaatcaactgagcagtctgccaccggaaattgtccaactcaccaacctgcaatccctcgacctcagcagtaatcaactgagcagtctgccaccggaaattgtccaactcaccaagctgcaatccctctacctcagcagtaatcaactgagcagtctgccaccggaaattgtccaactcaccaagctgcaatccctcgaccttggcagtaatcaactgagcagtctgccaagggaaatcaggcaactgtcaaacctgaaaaagctggatcttcgtagaaatcca

SEQ ID NO: 43877 - DNA, 777 bp, Nostoc punctiforme
ttagaactaaaactattaggtaaaaccgctattgttacaggaggaagtgcaggaattggattagctaccgccaaagcactttatagtgaaggtgtaaatgttgcgatcgcagcccgcaatcaagaaagactagaaaatgcagtagctgccatccagtccctaccaacttctggtgctaaagttattgccatcagcgccgatctgactaaagcagaggatgttgaaaaagttgtctccacaacattagcccaatttaatcagattgatatcttgattaacaatgcaggttcagcccgtgctgggtctttcctcgaatccactgatgatttatttttggatgcttggaacttaaaattattgggctatatccgcttggttagagccgttgtcccccatcaaaaaagtcgcggtgatggacggattgtcaatatagttggcggtgcaggacgtacacctcgccctaacttcctagctggtggtacaagcaatgctgctttgttgaacttcacaaagggcatttctaaagagctagccgagtacaagattcgcattaatgccatatcgcctggtgctacagctactgagcgtgccgagactttagctctacaaaacgcccaagcgcaaggcattaccgtcgagcaagtgaaggcacaaaacatccaaagtattcctttaaaaagaatcgcccaaccagaagaaattgccgcgctggcgctatttttggtgtcggatctagctgcatcgattacaggtacagagattatcgttgatggcggt

SEQ ID NO: 43878 - DNA, 579 bp, Nostoc punctiforme
cctcccggaacttctcaacccgccacagggttaattgttactttgcatggttggggagctaatgctgaggatgtcgcatctttgctacccttgctcaacttacctgattaccagtttatattacccaatgcaccttatccttatccctattcccctatagggagggcatggtatgacctgcgggtggaaaatatgtatgaaggcttggtagaaagtcggaaactgctaatagattttttgcaatctttagaaagtaccactggcatacctttgtcacgcactattttaagtggattttctcaaggcggagcaatgactttagatgtaggctcaaaattgccactagcaggcttagttgtgatgagcgggtatttacatcctgatgcactaacggcaggtcaaagagatattccgccaactttaatcagccacgggaaatatgatgaagttgttccactgcaagctgctttaaaggcacgagacactttaaaatctctaggagtggcggcagaatatcatgaatttgacatggggcatgaaataaatccacaaacgttaaaggtgctgcgggatttcgtt

SEQ ID NO: 43879 - DNA, 807 bp, Nostoc punctiforme
aatgctcaagttgaaaaaattgctaaaaatttcaaatttacagagggaccgctttggcatccagatggttttctactctttagtgatattcctgccaatacaatttataaatggcaacctaatcgaaaattgcagattttccgtcgccattctggtaatgctaatggcaatgcctttgaccaacaagggcgtttagttactgctgaacacggtaatcgtcgtgtatctcgtacagaagaaaatggcaaattagtcacacttgttagccattaccaaggaaaacgacttaatagcccaaatgatttagtagtgaaatcagatggaagtatctacttcacagatccaccctatggtattaaaccacaacaagaagaattaggtttttatggtgtttatcgtctgacatcggatagaaaattaactctattagttaaagattttgtacgtcccaatggcatcgccttttctcctgatgaaaccaaactatatgtcaatgattctgaaacaggtcatatccgtgtctttgatgttaattccaatggacttttgaaaaatggacatatttttgcccaacaaaaatatcctggtaaggaaggagttccagatggaatgaaagtagatatcaaagggaatgtttacagtacgggacctggaggagtgtgggttttctcacccgcaggcaatctactaggtattattgaagtcccagaagttccagctaatctagcgtggggagacaatgattataaaactttgtacatcacggcaagaaatagcttgtatcgtatacgccttaaaaacccaggt

SEQ ID NO: 43880 - DNA, 1185 bp, Nostoc punctiforme
tatcatacccacgattattatcaagttgacccgatgttagggggcaacgaggcttttaaagaattgcttgatgcagcccatcaacggaatatcaaagtcgttctggatggggtgtttaaccattccagccgtggctttttctttttccacgacgttttagaaaatggcccccattcaccttgggtaaattggttcaaaatagaaggctggcccctttcaccttataacggtgaattccctgcaaactacgtgggttgggcgggaaatcgcgccttgccagaatttaaccacgataatccagaagtacgagaatatattatggaaattgccgaatattggcttaaattcggcatcgacggttggcgattagatgtcccatttgaaataaaaactccgggtttttggcaggaattccgcgatcgcactaaagccatcaatcccgaagcatatattgtgggcgaagtgtggggagattcccgccagtggttggatggaacgcaatttgacggcgtaatgaattatttatttgctgggccgacaattgcttttgcagctggcgatcgcgtagtcttagaacaagtccaaagccgcgactatcaaccctacccacccttatttgctgccgagtacgccaccaaaatccaagaagtactgcaactttacccttgggaaattcagctaactcaactcaatttgttagcaagtcacgatacagcccgattgatgaccattgcaggcggtgatatagcgagtgtagaattatcgactttactgttactcacctttcccggtgcccccagcatttactatggtgatgaagtcggtttacctggtggcatagatcccgactcaaggcgtggctttcctttagaggctaactggaatcaagaaattttcaatactcatcgtcaattaattaccatccgccaaacatacccagccttgcgtacaggtgattaccaagtcctctatgctcaagggcaactttatctctttgcacgaactttaggcacagaagaattgataattgctataaacgctggcacaagttcggcaaccgcaaatgtagatgtggctagtttgcatactcaacccaacaagctgttatatggtactgctgaagctgagtggaatggtgaagaaggaactcagcaattgtcattaactcttcccgcacgcagtggc

SEQ ID NO: 43881 - DNA, 963 bp, Nostoc punctiforme
ctgctaattacgggaattgatgaatttgtcggtttgcgtacagccgagttagccatcgcacaaggaatgaaggttcgtggacttaaaagttctacagaacaaaacaaacaattacagaatttaggtgttgagataattattggtagtatcacagattctactattgctcaaaaggcttgtcagggagtagatatcgttttacatacagatcaacttgccgaagaagctggcgcaattaagaatttccgtgatgtcaatgttggtggtactgtcaacatggctaaagccgctaaacaggctggtgtcaaaacatttgtgcatctttccagcgtaatggtttacggtttcaactatcctaatggtgttacagaatctgggccactttctggcgaaaataatccttactgtgaaacgaaaatagaagccgaaacagcagttttagaactgaataatcctccagattttggcatcattgttattcgagctggagatgtttacggcccaggaagtataccctggatagtcagaccagttctgatgatgcgtcaaaaattatttgcctgtgctaacgatggcaaaggagttattaatcatgtatacatagataatctgattgatggcatctttctagcgatagaaaaagaaacctatggtgaaatatttaatatcaccgacggacaagaaacttcgtggaaagagtattttatgcgtttagcagcaatggaaggtttatcagcacccctttcattaccgaaagatgaaatcaagttgtttctaaagctacgtgttcaaggacaaaaactttttcgaaaaaaagttgatatcctaccagagtctatagattttatgactcgtccttatgcttgttctattgtcaaagcacaaagcatgttaaattataaaccaacaattcacctagaagaaggaatgcagcgaacacatgaatggctgcaaaaaacagat

SEQ ID NO: 43882 - DNA, 1080 bp, Nostoc punctiforme
atgggagaacccaaacgcattggaattcttaccagtggaggtgattgttctggcttaaatgctgtgattagggctgtagtaaattgtgcagtggatacttacggctgggaagttttgggaattcgtcaagcgactctaggattaatggcacgtcccccacaattcacaaaactggaaatcgatcaagttgactcgttattaactgcgggtggcacaatgttggggacaaccaataaaggcgacccctttgcttttccaatgacggatgggagtttatgcgatcgctctgaagaaattattgcaggttatcatgagctaggtttagacgctttgattggtattggcggtgatggtagtttggcaattcttcgccgtctcgcccaacaaggtggcattaatctagtaggtattcccaaaaccattgataacgatattggtgttactgaacatgccatcgggtttgatacagcagtcaatattgccacagaagcattagataggttgcattttactgctgcaagtcatagccgagtcatgattttagaagtgatggggcgtgatgctggacacatagcaatagctgcgggaattgcggggggagcaaatgtaattttaattcccgaaattccttacacagttgagcatatttgccacaaaattaaagaacgccaagagaaaggcaaaaactattgtttgataattgtttctgaagcggttcgtacccacgatggagaaaatgtgacgattacaaatcgcttaggtcaatctcgatacggtggaattggtgagtatttagcagataaaattattgaacacatcggtgtagaaacgcgagttactgttttaggacacattcaacgaggtggaactgcttcaccactggatagattagttgcaacagcctttggcgtagcggcggttaatctaattgccgaggataaatatgatcgcatggtgacttggcaaaatcgccaagtattaagtgtaccaattacagaagcgatcgctcaatatagcgccgtcgatcccaatggtactttagttaaaaccgctcatggtatgggtatttatttaggagac

SEQ ID NO: 43883 - DNA, 702 bp, Nostoc punctiforme
atgagaccttatcatcaaatcccaattttcgagtgtggtgaaccgctaattgagattcctttagaattgtttgcggtggaatctcctcatccttatgaaaaattaggtgcgccctatggcgaacagtctccttattatctccgtcaaagcgttattaaaaatttgagccaagcgcaaaattatcttaaattgctgcatcctaactggcatatccaaatttttgatgcttatcgcccgatcgcagttcagcagtttatggtagattacagcttcactcaagcagtgcaggataggggattaactaacgtggagttatccccaaaccaacgtcaagaagtttgggaagcggtttatgcaatttgggctgcaccaagtttggatgaaaaaactccgcctcctcacagtacaggtgcagcggtggatgtgactctagtagatgatattgggcaaatagtaaatatgggttcgccgattgatgaaatgtcagagcgatcgcatcccgattattatgccaataatgacgacccagaagcacaaaagtatcatgctcaccgccagctattacaagatgtaatgttaaaagaagggtttcaacgcaatcccagagagtggtggcatttttctgttggcgatcaaatgtgggcttggctgaataatcaatccaatccagccaatcctgtcacagcgcgttatggccgtatt

SEQ ID NO: 43884 - DNA, 1488 bp, Nostoc punctiforme
acaccattattagatgcgttaaaagccaatgcagcaagacctcatgcacctttttacaccccaggacataaacaaggtgagggaattcctcaacctttggctgacttacttggtaaagctgtatttcgcgctgatttaaccgaattagcagatttagataatctctttgcaccccaaggcgtgattcaagaagcacaacaactggcggctgaagcgtttggcgcttcgcaaacatggtttcttgtcaacggttctacctgtgggattgaagcggctattcttgctacctgtggcacaggtgataaaatcattttgcctcgcaatgtccattcttctgcgatcgctggtttaattctctctggtgcaataccaatttttctcaatcctgaatacgatccagttttagatattgcccacagcatcacgcccaatgctttagaatctgcactccaacaacatcccgacgctaaagcagtgttgacagtttatccaacatattacggcgtttgtggagatttgagtgcgatcgccaatattacccatcaatacaatatccctttactcgtagatgaggcacacggcgcacactttgcttttcatcccgaattacccactccagccttagccgcaggtgcagatttaactgtacaatccatccacaaagtacttggtgcaatgacacaggcatcaatgctgcatatccaaggagataggatagattgcgatcgcatcagtaaagctttgcaactagtacaatctaccagtcctagttatttacttttagcttctttagatgcagcgcgtcagcaaatggtactccacggaaaaatgctgatgtctcgcacattgcaacttgccaatgaagctagaacaataatcagccaaattcctggattatctgttttacagattcttagccccccttatcaaggggggttggggggatcttcttctctaggtggtttggtgggatctcccggctttgtggctttagacaaaacgcggctaactgtcactgtttctggtttaggcttaaccggatttgaagcagatgaaattctggatgaaaaatttgctgtcactgctgaattcgcctcactgcaacacctcacctttatcattagtttagggaacaccccagccgatattaagcaattagtgcaaggttttaccattcttgccaaagaatatcgcgcaactaacttgaatgttacaaatcctaatttgcagaatcttttaactacacagggtcatactttacatttttctccccgtgaagccttttttgctctcagcgaaacattgcctttagcacaaacaagcgatcgcatttgcgctgaaatcatctgtccctatcccccaggaattcctgtgttaatgccgggagaaatcatcactaaacctgtccttgattacttgcaacaaattcaaggaatggggggatttatcagtggttgcaatgattccagcctcaaaactttgaaagtt

SEQ ID NO: 43885 - DNA, 948 bp, Nostoc punctiforme
gccgttttaattcagaatctgcaaaaacgttacggtacagtggttgccgtccaggatgtttcctttcaggtagagccgggagaaatctttggtttacttggccccaacggtgctgggaaaactactaccttgcgtgccttgtgtacgctgaccacaccggatgctggcaaaatcgaagtatctggcatctctgtgttagataatccgagagtggcaagacaacgactaggctatgttgctcaggaagtagctatagataaggtgctaactggaaaagaactgctgcaattgcaagcagcactttatcaccttccacgcgcagtagccaaacagcgcattgagacggtattagatttactcggtttgcaagaatacgccaataaaaagacaggaacctattctggtggtttacgcaagcgcctagacttggctgctgggttgctccatgcaccagatgttctggtattggatgagccaactgtaggacttgatatagaaacccgttttgtggtatgggatttcctacgaaaattacgcgcctctgggacaacggtagtaattaccagccattacctagaagaaattgacgctttagccgatcgcgtcgcaattatagatcggggcgtggtaattgcttctgggacaccttcacaattaaaagataaagtagggggcgatcgcatcaccttgcgaatccgcgagttttcccccatcgaggaagcagaaattgccaaaaacctcttgcaacctttgccctttgtgcaagaagtcattatcaacagcgctcaaggtaattccctcaacttagtggtgacacctcaaaacgatgttctcattaacatacagcaagcgctgaatactgctggtttgcccatatttggcattgcccaatctcgccccagcctcgatgacgtttacctcgccgctacaggacgcaccctgatggat

SEQ ID NO: 43886 - DNA, 1135 bp, Nostoc punctiforme
atacctgctttacttgtcctggcagatggaaccacttatcgcggttggtctttcggtgctacaggaaccgcgatcggagaagtggtgttcaacactggcatgaccggatatcaagaagtactgactgaccctagttactgtggtcagattgtcatttttacctatcctgaattaggcaatactggtattaatcttgaagatgaggaatcagatggccctcaagtgcggggtgcgatcaaaaaaaaatatttgtcaacgaccaagtaactggcgatcgacacaatccttaccagactacctgaaacaaaaccaagtaccagggatctacggcatagatacccgcgccctcacccgcaaaattcggatgtttggagccatgaacggtggcatttccacaactattctcgatgaggcggaattgctagaacaggtacaggcggctcccaacatggcgggattgaatctggttcgcgaagtcaccacatcaacggcttatgaatggtcagatcccacaattccagcttgggaattcaactgtgaggctgcggaaaatcttggagaagcctttaccgttgtcgcccttgactttggcgtaaaacgcaacattttgcgtcgcttagtaagttacggttgtcgggtaattgttgtgcctgctgatacgccaccagaagaaatcctcaattacaatccagatggtgtgtttctttctaatgggccgggcgacccagctgccgtcactggagggattgcaactgccaaagcgcttttgttaagtcaaaaacccatttttggtatttgtatggggcatcaaattttaggtcatgcattaggtgcagaaacctataaattaaaatttggtcatcgtggtttaaatcagcctgcgggtttacaacaacgggtagaaattaccagccaaaaccatagttttgctattgatccagattctttacctacggcagttgtggaaatcagccatctaaacttaaacgatcgcaccattgccggggtacgtcacaaatctctacctgtattctctgtacagtatcacccagaagccagtcctggcccacacgatgccgattacttgtttgagcaatttgttcaagccatgcaagcagcacgtcaagccgcaaca

SEQ ID NO: 43887 - DNA, 2259 bp, Nostoc punctiforme
atccatatacctggctctattcaacctcatggcattctcctggcactcagtactcagctagagatcgtacaagttagcaataatacccaagtgtatttgtgcaaagctccagaagatttgctcggtcggcctttgagctatttacttgagcctcagccagtggaaattgtcaagcagtgcttagtaaaaaaggttggcagcgccaatgcgtttaaagtattaataaatactttgtatggagaaatatactttgatgctattgctcatcgtacagaagaagctgtgattctggagctagaaccaactgactcggaatttgaggtgagtttcttaaactttcatagttttgcgagtgaagcgatcgctaaaatgcaaaggacatccaatctaggagaatttttgcatttagtcgcacaagaagtccaaaaaatcatcagtttcgatcgggtgatggtctatcaatttgacgagtcagaagcgggttctgttgttgcagaagttaaacgggaagatttatcaccttatttaggactccactatcccgctacagatattccagcgcaggctagggagttatacacgcgctgctttctccgatttctccccgatttgactgccgaacctgtcaaactagttccaacggaaaatccgacaacacaccaacatcttgacttaagctactgtctgctacggagttttgattggtgttgtgctgaatatcatcaaaatatgggagtgaaggctcttttggtgatttcactgattcaagagcagaaactttggggattaatatcttgccatcatcaaacaccaaagtatatttcctacgaagtacgcaagatgtgcgaatttttgggacaaatcgtatcttcagagttagcgcacaaaattagttcttcggaatgggactataaggtaaaactcaaatcgctacagtctgagttccttgagtccatttcccaagcagacaactttatcgatgccttaatcaaaccggaaatccgtttgctggattttgtcagtgcctctggagcggcggtttgtctagataatgaaattaaccttgtgggaaccacaccaaatattgatgaagtgcgggcgttaattgaatgggcagatactcaagttactgataacctgttttctaccgattctctgccgaagctttatccagaagcgctcatatttaaagatactgctagtggtttgctgctactgcgaatttctaaagtccggcgttattatattctttggttccgccctgaagttatccaaacagtacactgggcaggaaatccacaagaatcgattaaagccgagggagatggtagctacaccctgtctccccgaaaatcctttgaacaatggcaagaaacggttagattaacttctttaccttggaaagggtgtgaacttgaaagtgcgatcgctctgagtaatgcgatcgttggtattgttctctcaaaggcggatgaattagcgaaaatcaacttggagttagaacgcagtaaccaagaattagcatcctttgcctacgctgcttctcacgatctcaaagaacctttgcggggaatttataacttttcgactgtgctgctagaagactatgcccaagtattagatgatgacggaattgagtgcttgcaaacagtagtgtccttatctgtacgcatggaaactctgattaatgctttgctacgactatcgcagttaggacaagcacatctccgagagcaagcaaccgatctcaacgaattactcaaccaagtaattgatgtctttcgtgctagtcgccaagactctgggcttgtggatattcgcattcctcgccctttaccaacaattcagtgcgatcgagttctcgttaatgaagtcttcagtaaccttcttggtaatgccttcaaatacaacgataaagcagagcaatgggttgagattggctacctttctcaagaagaggggcagggagtagggagcagggggcagggagcagggggagcaggggaagcgattattcaccaatccccaatccccaatgccccatgcccaatcttttatatccgagataacggtattggcattccacagcatcacctagaaactatctttagattattcaagcggctgcattctcaggaaaagtacggtggaggagcaggtgcgggattagctattgttaagaagattgttgagcttcataacggccaaatttgggttgaatctaccctaggcgttggctcgattttctatttcacgctg

SEQ ID NO: 43888 - DNA, 1695 bp, Nostoc punctiforme
ctttcgggaattgccgcttctgcgggagtagcgatcgcacctgtggttaattatcaacccactcacattacgattacggaatatcatgtagacaatcctgaatcagagtggcaaagagtacaagcagcaattcacaccgccaaacaagaaattcaagcagttttttcccaagcatctctgcaaattggtgacactgaagccgccatctttgatgctcaattactatttttagaagatccagtattgttggaagcagctcatcagcgtattttagatcactatataaatgctgaagcagcttggcaagccgtcgtagatgaagtagcgacttcttaccgaacacttgaagatgcttatctgcaagagcgagttgaggatgttgtagacgtaggacaaagggtactgcgattactagctgggaatgcccctgctaacttgcatctttcggaaccggcaattttagtggcaactgatttaaccccctcagataccgctagactagatccgagaatggtgttgggtatttgtacaacttctggtagcgccacctcccacagcgccatcatcgcccgaacattgggtattcccgcagttttgggagtggattcccaggtgttgcatttggcagatggtacactcatggcgcttgatggtgaaagtggcaaagcttgggtagaaccagaatcacatatcctggatttactggaggcaaagcgagaggcttggcaaactgcccaggaggaagcacgagctacagcacatcagccagcaattactcttgatggtcggcaagttagcgttttcgcaaatattggtagtataaatgatgtccaagttgctgtggctagcggtgcagaaggagtgggattactccgcacagagtttctctatctcgatcggacaagtgcccctacagaagaagaacaacttgaagtgtatcaggcgatcgcccaagttttagataatcgtccgctaattattcgtactttagatgtcggtggtgataagccacttccttatctgagagtcgggtttccagaagcaaaccctttcttaggttggcggggaattcgtttctgtttagatcatttggatttatttaaaactcagttacgggcaattttaagagccagtgtaggacaccaaattaaaattatgttgccgatgattgccactgtgacggaggtacgtgcagctaaggtaattttgggtgaagtgcaggctgaattaaatcaagctggtatcccctttgatgccgcgatgaaagtagggattatggtggaggttccgtcagcagttgcgatcgcagatcaattagcagctgaagtagacttctttagtatagggactaacgatctgagtcagtacgtcatggctagcgatcgcactaatccccgcgtggcaaatttagttgatgcgctacatccagccgtgttgcgaatggtgcagcaaactatccaagctgctcatgctgccggaatttcggtaggattatgtggagaattggcagcagatactttagcaacaccaattttattaggtttagggctggatgagttgagcgtcaaccctcaaagtatacctggagtgaaacaagcgatcgctcgattaagtatagttgagagtgaagcgatcgcggcatcagcattacaacaagattccgcagttcatgtcagagaaataatctcaacttca

SEQ ID NO: 43889 - DNA, 864 bp, Nostoc punctiforme
caagttagaaaagctgtaattccggtagctggttttgggactcggttgtttccagcaactaaggttgtgaaaaaagaacttttcccaattatcgatcgagatgggagggcaaaacctgtcattctcgcaattattgaagaggcaattagtgctggaattgcagaagtcgggattgtggtacagccggacgatcgagaaatatttgaagatttattgaaaaacccacctaaaaaagaacttttcaagaaactttcaccgcaaaatcaagaatatagccgatatctcgaagatttaggtagcaaaattacgtttttattgcaagaggaacaattaggttatggtcatgcagtattttgtgccaaagattgggtacaagatgagccatttttgctaatgttgggcgatcatgtttatgcatctgatattcaaaaatcttgtgcaagtcaacttttagatgtttatgaacaagttaatcaaagtgtcgttagcttaactacaacaccagcagaaattcttcatacagccgggtgtgtaacaggagtttggcaagagttaaactcgattttagaagttacacaactctatgaaaaaccaaccattgaatatgcacaacaacatttgcatgtagagggaatggcagaaaacgaatttttatgtatatttggtttgtatttacttagtccgaaaatttttgactttttagcagaacacataaaccaaaatttacgagaacgaggcgaatttcagttaacatcttctcttgatagattgcgtcaggaagagggaattacaggatatgttgttaaagggaagtgttttgatacaggtttgccagatacttatcgtcagacgatgattgatttt

SEQ ID NO: 43890 - DNA, 828 bp, Nostoc punctiforme
ctaaacaatcgctacaaaattactcaaggcttgggttctggaggatttagcaatacttatttagctgatgatatccagcgtcctggtaatccgcagtgtgtggttaaacagttgcgtcccccccgccaagatgcagaatatttaaatgtcgtcagacgattatttgacgctgaagcacaaattttagaaaccttgggtaagcatccacaaatccctcaactgctagctttttttgaagaaaatcggcaattttctctagtgcaagaatttgttcgagggcacgctatggacaaagaagtaacctcaggaaagcgactaaaacaagctgaagttgtggaaatgcttaaagaagttttacacgtacttgtttttgttcacagctatggtgtaatccatcgagatatcaaacctagtaacttgattagacgagaatcagatcaacacattgttttaattgactttggcgctgttaagcaaattcatcctcagcagcaagaagctcagactatttcaattggtacgcctggttatgcaccttctgagcaaatgagcggtttgccaaaactcaacagcgatatttatgcgttgggaattatgggaattcaaggtttaactggggtagatcctagagaatttcgcagagatataaatactggtgaaataattattcaaggtgaagctgatggcaatcaacagacttggcaacattggcgcgaactaactgacgctacaaacgagttagttattattttaaatagaatggcgcatttcgattttactcaacgatatcagtcagcagcagaggttctcaaagctctcgaaagtcct

SEQ ID NO: 43891 - DNA, 774 bp, Nostoc punctiforme
cctctatatggcaagagaattttagtaacagcaccgagaaattatgcttataggttatctgaacaaattatcaaacaaggtggtttacctgttttcatgcctactatcgaaacctgctatttatcaaactacgctaagttagatgctgctctcaaccatatagctgaatttgattggattgtcttcacaagtagaaatggcatcactgcattttttcaccggatgaatgatttaaatattcctgtatctgtggtagaaaaatgccaattatgtgctttgggaaaagatgcagaaagcctattgtctttttgtggcaaggtagatttaattccaacagaatctagtccagccggaattgtggcggaattagcgaaaattccgcaaattcataacaaaaaagtgctgatacctgcaccagaagttgttggtttgcctgagcctgatgttgtacccaatttaattacggatttgcagcaattgggcacagaagtaattcgcgtacccacatatattacacagggcttaaacacaagtatctatagtattgaattaaacctgatacatcaaggaatgattgatgtcattgcctttagtagcacggcggaagtagaaagctttttgacaatggtcaactcgcaaagtgactatgaaggttgcattgttgcatgttttggcccttatacaactgccaatgcgcgaaagttgggtgtgaatgtctccatcgtgtctagggactatagttcatttgagggatttgctgaagcgatcgcagaa

SEQ ID NO: 43892 - DNA, 759 bp, Nostoc punctiforme
tttctacccaaagccttcaaggggcattccagcgatgtgaattctgtagctttcagtcctgatggcacaacccttggtagtgccagtgatgataagacaatcaagctatggaatctggcccgtggagaggaaatccacactttagaaggacattccaattggatttggactgtagccttcagtcctgatagtaaaaccctcgccagtggtagtgcagacaagacaatcaaactgtggaatgtggagacaggaaagttagtccgcaccttagagggaaatactgacggagttacttctgtagctttcagtcctgatggcaaaactcttgccagtggtactgctagtaaggatataagaatcaaactgtggaatgtgaagacaggaaagttaatccgcactttagagggacatactgatggtgttccatctgtggcttttagtcctgatggcaaaactctggctagtggtagctgggataagacaattaaattgtggaatttaaatacaggcaaggaaatccgcactttaaaaggaaatgcagagtcgattctttcagtcgcttttgcgcctgatggtgtcacccttgccagtggcagtaaagacaaaacaattaaattgtggaatctaaatacaggtaaggaaatccgcactttaaagggacataaggataaggttaattctgttgcctttttgcccagtggaactcaaaatggccttacccttgtcagtggtagcagtgacaagacaattaaactgtgg

SEQ ID NO: 43893 - DNA, 1185 bp, Nostoc punctiforme
cgcaagcgtattgagaaagaactacgtcaagcagaagaagttgctcaaaactctagccaagccaagagtgaatttctggccaatatgagtcatgaactacgcacacctcttaacggtatcctgggctatacacaaattctccaacgcacagaatctttaagtgaaaaaggacgcaaaggactcagcgttatttatcaatgtggttctcatcttttaaccttaattaatgatgtcctggatctctccaagatcgaagcccggaagttggaattgtatcctgttgatttctacttgcctgcctttatagatagcgtgactgaaatttgccgcatcagggcagaacaaaaagtcatcgcatttaacattgaaatcgatcctaatttaccaacgggtattcatggtgatgaaaaacgcttgcggcaagtactgattaacttgcttagtaatgccatgaagtttactcatcaaggcagtgttactttcaaaactcaggtcatcaatcaagaatcaaatgctaatggaaaaactaactacaaaattcgctttgaggtagtagatactggcactggcataacccctgaacaagccgaaaaaatattccagccctttgaacaagtgggaagtcagaaacgacaatctgaaggtacaggcttaggattagcaatcagtcaaaaaattgttttgttgatgggtggtcaaattaaagtgcaaagtgaatttggcaaaggtagcactttctggtttgaggcaaacttgtcagaatctaaagactgggcaaaggtttctagagtagttgagcagggaactattattgcttatcaaggaaaaaggcgcaccattttgattgcagatgataaatgggaaaaccgatcggtaattgtaaatttactagagccagttgggtttactgttgtagaagctagtaatggtcaggaagcatgggtacagtccctagcccacaaaccagatatgattatcactgatttagtgatgccgatattggatggatttgagttaattaggcgtttgcgtcagtctggggcatttaaagaaattccgatcgtcgcttcgtcagcaagtgtgtttgcagtcgaccagcacaaaagtattgatgtaggtgcagatgcctttttaccaaagcctgtagaagctgaaaatctactggaaatgctacgacagtttttg

SEQ ID NO: 43894 - DNA, 600 bp, Nostoc punctiforme
atgaaactctatgaatttgctcccacacgatcaattcgggttcgctgggttcttcaggaacttggggtggaatttgaagcaatctccatcaacatgcaggcaggtgaacaccgtacacccgattttctcaccatcaatcccactggcaagctccctgtactcattgatggcgaacatatcatcactgaatccgtagccattgctttgtacctcggtgagaagtacccagaatctaacctggtacccacagacttgcttctgcgagcacagctttatcgttggcttctctttactgccaccgaattggaacagccgctatggcgtatcgctcgccacacgtttatatacccagaagagttgagattgcctgctgaaatacctctcgctcggcaagacttcaccagtatggctgtcgttttagagaaccatctgttggatcggcagtttgtactgggtgaacacgtcacagtggctgattttgtgcttgcttacacacttgattgagcgaacgaagttcagctactcgccacttttcccacgctggtagactacatggaacaaatgtacaaacgaccaaaggcatctgggcgaatcgcagct

SEQ ID NO: 43895 - DNA, 1200 bp, Nostoc punctiforme
cgcagcgttagcgagtctgcaagtgtcattttgaattttgaattcggagcgaagcgacgtgatccttatgcctggctagaacagtccttagcaacaattcatcgggcagactggtatcgttcggtacaacctatcaacggtcgtccgggtgcaacggtggttttagctgggcaagaggtaattaattttgccagcaatgactatttgggattggctggggataagcggttgatggcagccgcaactgctgcgatcgcagaatttggcactggtagtactggttctagattactcagtgggcatagagaattgcatagggagttagaaaaggcgatcgcatctaccaaacaaacagaagatgccttggtatttagttcagggtatctagctaatttgggtgcaattaccgcccttgtgggcaagcgggatttaatattatccgaccagtacaatcattcaagtctgaaaaatggagccattcttagcggtgcagcagttgtggaatatccgcactgtgatgtggcagtactcaaaactcagttgagtcaacaacgacaaaattaccgacgctgtttgattcttactgatactgtcttcagcatggacggcgatttatgtcccttgcctgcactcttcgatctggctgatgaatttagctgtatgctgctagtcgatgaagctcatgccactggggtactaggaaaaactggcgctgggtgcgtcgaatatttcgggtgtacaggaaagcaattaattcaaattgggactttgagtaaagctttgggtagtttaggcggttatgtggcaggaagtagcgccttaattgactttttgcggaaccgcgcacccagttggatttataccactgggctttcacctgctgatacagcagcagccttagcagcaatcaagatagtgcaacaagaaccgcaacatcttgcccaattgtggaggaatatacattacttgaaaactttgctacaacagttgcctaacttaaaattgctgccttctgaatcacccatattatgctttcaattgcctaatgctacagatgccctcaaagctggaaaacagctaagagatgctggcatttttgccccagcaattcgtcctcctacagtgcccacaagtcgaatcagaatatctgtgatggcgactcataaagtagcacatattgaaaaattggtggcagcgctg

SEQ ID NO: 43896 - DNA, 1521 bp, Nostoc punctiforme
agtgaagaacgctatcgctgcttggcagaattaatcccacaattagtctggacagccaaccccgaaggaaggttattggatgtcaatcaacgttggttagaattcacaggattaaccctggaacaagctcacaccagcggctggagagaggttgtccatccagaagatgtactgatattggttaaagaatggagcaaggcagtacaacagggtacttcttatcaagccgaaggtcggatgcggcgggcagatggtgtgtatcgctggcatctgcaccaagcaattccacaaaaagatcggcaaggtgaaattgtcaaatggtttggcagtgcaacagatatcgaagcgcaaaaacaactagaggttgaacgcgatcgcctattccaactagagcaagccgcacgggccgaagccgaacgtgcaaatcggatcaaagatgaatttcttgccattctctcccatgaattgcgatcgcctcttaaccccattcttggctggacaaagatgctgcaaagccgcaaatttaatgaaaccaaaacagctcaagctttggctagcatcgaacgcaacgttaaactgcaaactcaactaattgatgacttgctcgatattgccaagattctgcgcggcaaactcagcctggatgtcactcctgtaaatctgttatttgtgattgaatctgcgatcgacacggtaaatacagcagccattgccaaatcaattcagttgcatccggtactgccgaatattgggcaagtctctggagattccaaccgcctccaacagatcgtttggaatttactttccaacgctatcaaatttactcccaaggggggacgggtagaaatccgattagagcgagttgacgagcaggcacacattattgtgagtgacactggcaaaggcattaaccctgaatttctcccacacatttttgagtcattccgtcaagaagatgtctcaattactcgcaagtatggcgggttaggattgggattagcgatcgttcgtcagttagttgaggctcacggcggcaccatcacggctgacagtcctggtgaaggtttaggagccacctttacagtccagttgccactgctgaatcttcaaccagaaatcaagcagacggatgatttgctacaaccaggacttgaactcacgggaattcgagtcctgacagtggatgatgaccccgatgcccgtgagctattaacagtattgcttgctgaatacggagcccaagtcttgactgttccttctgccacagaagtgttggcaaacctagagtcctttcaacccgatgtgttagtcagtgatattgggatgcctgaagttgatggctataacctgattcaacagatccgagctttaacccccgaaaaaggcggacaaatcccagcgatcgctttaactgcttatgccagagttgatgattcccagcgagctataaccagtggctatcaacggcacgttaccaagcccctcgatccagaagagttagttcaagctgtggtggcactc

SEQ ID NO: 43897 - DNA, 1086 bp, Nostoc punctiforme
atgggcaatatttttggtcatttatttcgcattagtacttttggcgagtctcacggcggcggtgtgggggttgtgattgatggttgtcctccacaactagaaatttcggcagaagaaattcaggtagaactagatagaaggcggccgggacaaagtaaaattacgactccccgcaaagaagctgatacctgcgagattatctcaggagtatttgaaggcaaaacgctgggaacccctataacgattttggtacgtaatcaagatactcgtccccaagattatgacgagatggcacagaagtatcggccttctcacgcggatgcaacctatgatgcaaaatatggcattcgcaattggcaaggtgggggtaggtcgtcagcacgtgagacaatcgggagagtagcagcaggtgcgatcgctaaaaaaattctccgtcaagttgccaatgtcgaaattattgcttacgttaagcggattaaagacttggaaggtgtagtcgatcctaatactgtaaccttagaacaagtagaaagcaatatcgttcgctgtcccgatgctgaatgtggcgatcgcatgattgaattgattgagcaaataggtagacaaggcgattctatcggcggtgtcgtagaatgtgtggcgcgaaatgtaccgaaaggtttgggcgaaccagtatttgataaattagaagctgatatcgctaagggtgtcatgtctctgcctgctagcaaaggctttgaaattggttccggttttgcgggaacgctactaacgggaattgagcataacgacgaattttatatcgatcaaaatgatgaaatccgtacagtaacaaaccgttctggcggtattcaaggcgggatttctaacggcgaaaatatcattttgcgagttgcatttaagccgacagcaacaattagaaaagaacagaagactgtaactcgtgagggcgaagaaacactattagcagcaaaaggacgacacgatccttgtgtattaccgcgtgcagtgccaatggttgaggcaatggtggcgttggtactatgtgaccatttgttacggcatcatggtcagtgcaaagtcttg

SEQ ID NO: 43898 - DNA, 2448 bp, Nostoc punctiforme
atgtttgaacacttcacttccgaagccattagagtaattatgctagctcaggaagaagcacgtcgcctgggacacaatttcgtaggaactgaacaaattctcctgggtttgatgggagaaggaactggggttgctgctaaagtgctggccgaattaggcgttaccctcaaagacgcacgtcgtgaggtagaaaaaattattggtaggggttctggctttgtaccaccagaaattcctttcactcccaaggtgaaaagcctcttcgagcaatcttttaaagaagctcatagtctgggacagaattacatcaacacagaacacttactcttaggattaactgaggctggtgaaggtgtcgccgccaaagtcctgcaaaatctaggagttgacttcaagagtgtccgtagtgccatagttcgccgtttgggtgaaaatgcaccagctttcgctggtagtggtagtcaaaagcgcacccaaccgctaacgatggaagaatatggcagaaatttgaccaaattagcgcaagaaggcagactcgaccccgtagttggtcgtgagaaggaaattgagcgggcgatccaaattctcggtcgccggactaagaataatcccgtgttgattggagaaccaggagttggtaaaactgcgatcgcagaaggtctagctcaaagaattatcaaccaagatgttcccgaaaccttgcaagacaagcaagttatcagcctcgatatggggtcattggtagctgggactcgcttccgtggcgattttgaagaacgcatcaaaaaagttgtggaagaagttcgcactgtcggtaacataattttggtaattgacgaaattcacaccttggttggcgctggtggtacagaaggtggtttggatgcagccaacatcctcaaacctgccttagcacggggtgaactccagtgcatcggcgcaacaacccttgatgagtatcggaagcacatcgagcgcgatgccgcactagaacgtcgtttccaaccaattatggttggtgaaccctcagtagaagaaaccgtacaaattctttacggcttgcgcggcgcttacgaacagcaccacaaagtcacaattttggattcggcacttgtagcagccgcagaattatcagaccgctacattagcgatcgcttcttgccagataaggcaatagacttgattgatgaagctggttctcgcgttcgtctgcggaattctcaaagttctcccaataaagaactcaagcgtgaactcgctggcgttaccaaagaaaaagaagcagcagtcagagtccaagattttgacaaagctgtaaccctacgcgaccaagagttaaaactcgcagaacaactgcaagcaacgtttacaccaaacgagcaacctgtcaactctactgtagttgacgaagaagacattgctcaaatcgttgcctcttggactggcgtaccagtcaacaaactgactgaatctgaatcagagttgcttctgcacctagaagacactctgcatcaacgcctcatcggtcaagagcaagctgtctcggctgtatctcgcggtatccgtcgcgcccgcgtcggcttgaaaaatcccaatcgtcccattgctagctttatcttctccgggcctaccggagtcggtaaaacagaattggccaaggcattagcttcctacttcttcggtgcggaagactcaatgattcggctagatatgtccgaatacatggaaagtcatactgtcgccaagctaattggttcgcctccgggttacgtcggatacgacgaaggcggacaacttacagaagccgtgcgccggaaaccttacacagtgttgctattcgacgaaatcgaaaaagcacaccccgatgtattcaatatgctgctgcaaatcttggatgacggtcatcttaccgatgccaaaggtcggaaggtggacttcaagaatacgctgatcattttgacatctaacatcggttccaaggtgattgaaaaaggtggtagtggtttaggctttgacttcgacactcaagccaacgctagttataaccgcatccgcaccttggtaaacgaggaattgaaagcttacttccgtcctgagttcctgaaccgtcttgatgaaattatcgtcttcacccagctttctagggatgaagtgaagcaaattgctgaaattatgcttcgtgaagtttctaaacgcttgacagaaaagggaattactcttgaagttagcgatcgcttcaaagaacttgtagtgcaagaaggctataaccctagttatggtgctagaccattacgtcgggcaattatgcgccttttagaagattctctcgctgaagcaatgctgtctggtgaaattacagatggagacacagcgcttatcgatgttgatgatgactctcaggtgagagtacaaaaattagaaaaacgagaattgctcttggcaaatgtt

SEQ ID NO: 43899 - DNA, 1309 bp, Nostoc punctiforme
  unsure (1)..(1309): unsure at all n locations
atgaatttttctactctcggcttgtccaatgaaattatccgtgcggttacagagcgaggctacaccgaacctacgccaattcagagacaggcgattcctgccgtcttatcgggtagcgatttactagctggggcacaaactggcactggaaaaaccgctagttttaccttaccgcttctacatcggttatcgtccgagaagaacgtcaaagttacatctaatggataccgcccgatccgggcactgattctcaccccgactcgtgaactcgcagcccaagtggaagaaagcgtgcgcgagtacggcaaatacttgcagctcaactcaatggtgatgtttgggggagtcggtattaatctgcaaaaacagcgtttgaagaaccgagtggatatcttggttgctactccagggcgattgctggatcacgtacagcagggcacgctgaacctgtcacatattgaggttttagttctagatgaagcagatcggatgctggacatgggctttctccatgatatccgccgcatccttgcaattntgcccaaacagcgacaaaatttgctattcttcgctactttttcagacaaaattaaagcgctagccgccggactactcaataacccgaagatgattgaggtagcacgccgcaacgtcaccgccgagacgatcgcccaaaaaatttaccaagttgaccgtgacaagaaacgccaattacttgctcacctgattcggcgcgataattggtatcaagtgctagtgtttactcgtactaagtatggcgctgaccgtttagtcaagcagttgggtgaagaccgcattcaagcacttgcaatccacgggaataagagtcagccggtgcgtaccaatgctctggcaaagttcaagaatggtagcttacaggtattggtggcgacagacattgctgctagaggtcttgacatcagcgaactaccccatgtagtcaacttcgatttacctaatgtaccggaagattatgttcatcgcattgggcgaactggtcgtgctggtgcgtcaggtgaagccgtatcgctggtgtgcgtcgatgaatacagtttattgacagatatcgaaaaactgattgagcagcgtttgctcaagggaagtagttgctggctttggccctaaccccgatacaacggccgaaccaatccctaatggacggcaacacagacccaaatctggaggtgaaaagcgatcgcctcggactcctaaaccgttaccacggacatcggctaaacgtaaagcagcaccacccgcgactaatggcgagaagcctggggctcgttcg

SEQ ID NO: 43900 - DNA, 504 bp, Nostoc punctiforme
ttagatcaatttatggttatccagaagaaaatttgtatgataggtgcatttgctacaggtaaaactagtttagtagcaatgtttgtccacagcattttttctgagaaatatcatactactgtgggtgtaaaaattgataaaaaagctatagagattcaagataaaaaaataaaccttatcctttgggatatctatggagaagatgagtttcaagaattacaaatgtcttatttacgaggttctgctggttatttattagttgtagatggtaccagacataatactttacaaaaagcttttgacttacaaataaaaatagaagatgctattggtcaagttccctttattttagtcataaataaattggatataacggatgaatgggaaattgaatctgctgagatagatgatgttacacaaaatggttggactgtgattaaaacaagtgccaaacatagtattggtgtagaagaagcttttcaaactctcgctaaaaaaatattg

SEQ ID NO: 43901 - DNA, 714 bp, Nostoc punctiforme
tcaactcctaaaccactgcaattatctaatcactcaaccactactattaaagttagtaatttacataaacattatggacaactaatcgctgtccggggaattgattttactgtcaatcagggtgagatgtttgggttaattggccctgatggtgctggtaaaactactacctttcacatcttaggcggggtgatggaggcgacggcgggagaagtgcaagtatttggtcagccggcaagggacgcacgtttaaggacgggatatctcacacaacagttttccttgtacttggatctcagcattgatgaaaacttgcgttatgcggcgggattgcgccaagtgagtgatgatttattacgagaacgccgccagaaatacttaaaattaatgagtttggaacaatttggcgatcgcttggcgggtcaactttccggcgggatgaaacaaaagctggcgctgtgttgtgccttggtttcccagcccgacgtactgttactagatgaacctactacaggggttgatccagtttcgcgccgggaattttgggatgtattagcagaactttctgccgatgggatgacaattgttgtcgccacaccttatctagatgaagccgaacgctgtgatcgcgtcgcactgatgtatagtggtcaaattcacgaaattggtacacccgcagcattacgcgccaatttaggcttacatcgcctagaa

SEQ ID NO: 43902 - DNA, 615 bp, Nostoc punctiforme
gcagtcaaaaacgttaatgtcgaagtacgctatggcgaaatatttgggcttttaggtgccaatggagccggaaaaacaactaccatcaaaatgctgtgtggattactagcagctagtggcggtgatatttccctcggtggtgaaacaggaaatctgcgtagtcgtgacttacggcgacgtatcggttatatgagccagaaattcactctttacgacgatctgacaattctgcaaaacttagagttttatagcgggatttacagcgtaccccgcaaactgaggcgagaaaagattgattgggtaattgctacctgtggcttagagggacaagaacagatgcttaccggacaattacccggtggttggaagcagcgagtagcttttggcgcttctgtcatgcacgaaccagatattttatttctcgatgaaccgacatccggggtagatcctttagcccgtcgtcagttttggaagctgattaatgactttgcccgcaatggtacagctattttagtgacaacgcactacttagaagaagctgaacagtgtaaccgcatgagttttatggtagccggggaaatcgccgccgaaggttcacctagttctatcaaagct

SEQ ID NO: 43903 - DNA, 1977 bp, Nostoc punctiforme
atgctagaacaaggcactatcagtattcatactgagaatattttcccgatcattaagaagtctctttactcagatcaccaaatctttttgcgggaactggtatccaatgctgtagacgctatccaaaagctgaaaatggtatcccgcgccggagattacgctggagacatcggcgaaccggaaattgaaattgccattgacaaagataagaaaactctctccatatccgataacggtatcgggatgaccgcagatgaagttaagaaatatatcaatcaggttgccttctctagtgctgaagaatttattcataaatacgaaggcaaatcagatcaacccataattggccacttcggtcttggtttctactcttccttcatggtggcgcaaaaggtagaaattgataccctctcctaccaagaaggggcgcaggcggttcactggacttgcgatggttccccagcttttaccttagaagattcgtcccgcacaactcgcggcactactattaccctcagtctgcaaggcgaagaggaggaatttctagaatctgcacggattaagaatcttgtcaagacctactgcgatttcttgccagtaccaataaaactagagggtgaagtattaaataagcaaaaagcaccgtggcgagagtctccaagtaatctgactcaagaagattatttagagttttaccgttacctgtatccttttcaggaagaacctttgttgtgggtacatttaaatactgactatccttttatcatcaacgggattctgtattttcccaaaatgaggccggatgtagatgttaccaaagggcaaatcaagctattttgtaatcaagtttttgtcagcgacaactgcgaagaaattatcccgcaatttctgatgccgatgcggggtgtgattgatagcaccgatattccgctaaacgtatcgcggagtgccttgcaaggcgatcgcaccgtgaagcgaattggtgactacattgctaaaaaagtaggcgatcgcctcaaagaacttttccgcgataatcgcgaacaatacatcagtgcttggaaagatctcggaacctttgtaaaattcggcgttctcaacgacgataaattcaaaaaacaaattgaagacatcatcgtcttccgcaccaccgccaagctgacagaaaaagttgctgctgaaactccagtggttgaagtccagtcttcagacggcgatgcttggcaagatgtgactccttcacccagtgctgagaactcaacccccagcgctccctatactacgctgaaagaatatctagaacgcaacaaagaacgcaacgaaaaccgggttttctacagtactgatgaagcaacccaatctacatacatagaactgcacaaaaatcaaggattggaagtcctatttatggactccttcattgatactcactttatcaacttcctagagcgggaatatcaggatgtcaagtttacgcgggtagactcagatttagacaatactctgctggaacaagataaagataaggaaattgtcgatcctaagacgaacaaaacccgcagtgagacgattaaagagttatttgagaaatctctcaacaaacccaaactcaacatccgtaccgaagcgttgaagtcagacgatcctcaaggtacaccacctgcgatggtgcttttaccagagattcttcgccgcctgcgagaaatgaatgccatgatgcagcagggaacagcagagtttcctgaagatcacattttgctcgtgaatactgctcacccgcttattcaaaatctggcaaatctgaaccaaggtactattattcaaggtgacggtcaatcatctacagatcagttagtgaacttaatttgtcaacacgtttatgatttagcgctgatgtctcaaaaaggatttgacgctgaaggaatgaaatctttcgtcgagcgatcgaatgaggtactcaccaaactgactgaacaa

SEQ ID NO: 43904 - DNA, 2577 bp, Nostoc punctiforme
atgcaacctacagatccgaataaatttactgataaagcctgggaagcaattgttaaatctcaggatatagtccgtgcttatcaacaacagcaactagatgttgaacatttaattattgccctgttagaagaacccactagtctagcaatacgtatcctggctcgatctgaggtcgatccaatccgctttcaacagcagctagaagcctttatccaacgtcagcccaaagttggtaaaagcgatcagctttatcttagccgtagtttagatgttttactagataaagctgaggaagctagagtcaggatgaaagactcctacatttccgtagaacatatacttttggcttttgctgaagacgatcgcattggacgaaagatcctcaaaagctttagtgcggacgcagctaaactagaagctactatcaaagccgttcgcggtagccaaaaagtaacagatcaaagcccagaatcgcgctatgaagctttacaaaaatttggcagagatttgacagaacaggcaaaagctggaaaactcgacccggtaattgggcgagatgacgaaattcggcgggtaattcaagtattgtctcgtcggagcaaaaataaccccgtcttgattggtgaacctggggtaggtaaaactgcgatcgcagaagctttggcacaacggatggtaaacggtgacgttcccgaatctctgaaaaaccgccaactgatctctttagacatcggtagtttaattgctggggcaaaattgcgaggagaatttgaagaacgtttgaaagctgtcctcaaagaagttatggactctaacgggcaaattgtcctgtttatcgacgaactacataccgtagtcggtacgggttccagccaacaaggggcaatggatgccggaaatttgctcaaaccaatgctggcgcggggagaactgcgttgtattggtgcaactaccctcgacgagttccgcaaacacattgagaaagacgctgccctagaacgccgctttcagcaagtatttgtcgatcagccaagtgtggaaaatactatttccattctgcgggggttgaaagaacgctatgaagtgcatcacaacgtcaaaatttctgattcggctttggtagcagcagcaaccctgtcagcacgttatattagcgatcgcttcttaccagataaagcaatagatttggtggatgaagccgcagcacagttgaaaatggagattacctccaaaccagcagaattggaaaccatcgatcgccgcctcatgcagttagaaatggaaaagctgtcattagctggcgaagaaaagggtactccccaaacaaaagagcgtttggagcgcattgagcaagaaatcgccaatttaactgaaaaacagcaaatatttaatgagcaatggcaaggtgaaaagcagatattggaggcgataagcgccttaaagaaagaagaagatgcgctgcgagtgcaaattgaacaggcggaacgcgcttatgacctaaataaagctgcccaactgaaatatggcaaattggaaggagtacagcacgagcgcgaagctaaagaagccagccttttagaaattcaaaaccaaggttccacgttgctgcgagaacaagtcactgaagctgatattgcggaaatcgtcgccaaatggacaggaattcccgttaatcgcctgttggaatcggaacggcaaaaattactgcaactagaaagtcatttgcatcaacgagtcattgggcaagaagaggctgtagaagcggtagcagcagccattcgccgcgcccgtgcggggatgaaagacccctcccgtcccattggttcatttttgttcatgggccccacaggtgtgggcaaaaccgaactcgcccgtgctttagctcagtttctctttgattctgatgatgccttggtgcgcttagatatgtctgagtatatggaaaaacactcagtttctcggttagtgggagcgcctccaggatacgtaggctatgaagaaggcggtcaactttccgaggcggttcgccgccgtccctactcagtggtgctgctggatgaagtggaaaaagcgcaccccgatgtgttcaatattttgttgcaggtgttagatgatgggagaattactgactctcaggggagaacggtagattttcgtaacagcgttattgtaatgaccagtaacataggtagcgaacacattttagatgtgtctggtgattctcagtatgaaacgatgcggaagcgggtaatggaaggtttgcgatcgcatttccgcccagaatttctcaaccgcgttgatgatattattctcttccataccctaaatcgcacggaaatgcggcaaatcatccgtattcaactcaagcgagtagaaaatctcctacgagagcaaaaaatcttctttgagatatcccaagcagcctgcgatcaccttgtcgaatcaggctatgacccagtttatggtgcgcgtccactcaaacgcgcaattcagcgagaagtagaaaaccccctcgccaccaagttattggaaaatacttttatctctggagacacgattctcattgacaaaaatgaa

SEQ ID NO: 43905 - DNA, 1263 bp, Nostoc punctiforme
attgaagcgatcgcagcccgtgaaattcttgattcacgcggtagaccaacaattgaagccgaagtgcatttagccaatggtgttgtcggactagcgcaggttcctagtggtgcttccacaggctcttttgaggctcacgaactgcgtgatggtgataaaagccgttatgggggcaaaggcgtactcaaggcagtaaaaaacgtcaaagaagcacttgcaccaaaattactaggcttggatgccctcaaccaagaattgctagaccggacaatgatcgccatagatggttctcctaacaaatctagtttgggcgcgaatgcgattttaggggtttccttagcagcagccaaagcaggcgctgaatctctagatattcctctatatcgctatttgggtggccctttagcgaatttgctcccagtgccattgatgaacgtaattaacggtggcgcacacgcatcaaacaacgtggactttcaagagtttatgattgtcccaattggcgcaacttcttttcgggaagcattgcgctggggtgcagaggtatttgctacccttagccaggtattagatgagaagggtttgcttactggtgtaggcgatgaaggcggctttgcccctaacctagaatctaatcaagtagctttggaattgctggttgctgcaattaaaaaagctggttacaagccaggtgaagaagtagctttggctttggatgtggccgctagcgaattttacaagaatgggcagtatgtttacgatggtaaacctcatgccccggctgaatttattgattatttaggacaactagttgaccaatacccaattgtgtcaattgaggatggtttgcatgaagaagactggcaaagttggcaattgctgacccagaagttaggttcgcaggtgcaattggtaggggatgatttgtttgtaacgaacgctactcgcttgcaaagaggtatcgaggaaaaagccgctaacgccattttgattaaactcaatcaaattggttctctcaccgaaaccttggaaacaattgatttggcaactcgtaacagcatccgttcagtaattagccatcgttctggtgaaaccgaagacacaacgatcgctgatttagctgtagcaacccgtgccggtcaaatcaaaacaggttccctctgtcgcagcgaacgcgtagctaaatataatcgcttgctgcgaattgaagatgaactaggcgatcgcgccgtttatgctggtgctgtaggtttagggccgaag

SEQ ID NO: 43906 - DNA, 1056 bp, Nostoc punctiforme
atgggcaaatttagacgcgtacccgttgggattattggcgcgtcgggctatggcgaagtacagttagtacggctactgatggatcatccagaagtcgaactggtttatttaggcggtgagagtagtattggtaaatcctttggggatttgtacccacatctggctcatacagctaatctaccaatagaagcggtagaaccagaaataattgctcatcgctgtgaagtagttttcctgtctttaccaaatggtctggcttgccaaatcgcgcccaaactattagaaaaaggatgtaaagtgctggatctgagcgcagactatcggttcagtgatttgacaacttatacaaattggtatggcattgagagaagcgatcgcaccattgcagctacagcagtttatggattaccagaactttatcgcgatcgcattgccgaagctcaacttattggctgtcctggttcctatccgactgcgagtctccttgcactttcgccactcttaaagcaaggcttaatcttaccagaaacagctattatcgatgccaaggctggcacatctagcggtggacggcaacctcaaaccaacttattactatctgaagcagataattccatcgcagctttcaatatcggccgtcaccgtcataccccagaaattgagcaaatttgcagtgacttagctggtcacgaactgatgatccaatttacaccccatcttgtcccaatggtacgcgggattttggcaacggtatatgccaaaatgagcgatcctggtctagtgcgagatgacttaatcacaattttctcagccttctaccgcaactctccttgggtaaaagtttgcggtagcggcatttacccccaaaccaagtgggctaatggcagcaacctttgttacatcggcgtagaagttgactcgcgcacaggtagggtgattgtcatatcggcaattgacaatctaattaaagggcaggcgggtcaagcgattcaatgtctaaacctgatgatgggctgggatgaaactttggggttgcccaagttggggttttatcca

SEQ ID NO: 43907 - DNA, 1077 bp, Nostoc punctiforme
atgacgcaacagaagcgagcgttgattactggtattactggtcaagatggttcatatctaagtgagtttttactagaacaaggttatgaggttcatggcatcattcgccggacttctaccttcaacacagaccgcatcgatcacatttacgaagacccccacaaacagggagtacggttgtttcttcactatggtgacttgacagatggtacgacgttgcgacgtattttagaagaagtcaaaccagtagagatttacaacctcggcgctcaatcccatgtcagagtaagctttgattcaccagaatatacggtggatgctgtaggaatggggacgctgcgtctgttggaagcaattcgagactaccaacaccggactggaattcaggtgcgattttaccaggcgggttcttcagaaatgtatggtttagtacaagcaataccgcaaagtgagacaacgcccttttatccccgcagtccttacgcctgtgcaaaagtttacgcccactggcaaactgtaaattatcgtgagtcctacgatttgtttgcttgtaacggcatactttttaaccatgagtcaccaagacgtggtgaaacctttgtaacccgcaaaattactagagcagttgctggtatagttgctggtaagcaaaaaaagatttacatgggtaatctagactcaaagcgagattggggctatgcgaaggattacgtaaaagcaatgtggttgatgttgcagcaagaccagccagacgattatgtaattgctactggtgaaacccattcagtgcgagaatttttggaactagcatttagttacgtaaatctcaattggcaagattatgtagagtttgatgagcgttacctccgtccatctgaggtagatttattgattggcgatgctaccaaagcacgtcagaatttgggctggaaaacatcagtaacctttaaagaattagtttccttaatggtagaagcagacttacaagcattgggtcacacttcacccaatggaaatggttcgcaatttccattagatattgccactgttcgtcaagaactcggcgctttgcacttc

SEQ ID NO: 43908 - DNA, 852 bp, Nostoc punctiforme
ctccacaatgttctagaagcccgtgcccgtttgggtgaaggccccatctgggattctacccaaaacgtaatttactgggttgatatctacaaccatcgtgtacatcagttcaatcctgctacagggaaagacttgttttttgatgtgggagatgtagtaggtgcgatcgcaacagcaggtgcagatagattaattatcgcgctgcgtcatcacctggcatttctcaacacccggacaggtgtaattacccccattttagaaattgagggaaatctgccagataaccgcctcaatgatggtaaatgtgaccctcaaggacgtttttggttcggttcaatgtgttctttggaaaaaccccaggctagcctctatcgctatgacaatgatggttcattgcatgtaatggaaacgggattgactatttctaatggtctgggatggagtcccgatcgaaaaatattttacttaacagattctcatcaacaaaaaatatatgcttacgactttaattcaataacaggaaatattactaatcgtcggatttttgttgatttaactcatgaatctttctacccagatgggttgacaatagacagtgaaggacatatttggtcagctatgtggaatggatggtgtgtgattcgtttcaaccccaagggtgaagagatattgcggataaagctacctgtgcaagtgccaagtagctgtacttttgggggcgaggatttgcaaacactctacattaccactgcttcagttggactaagccaagcagagatcgaaaaaagtttctactctggtgatttgtttgctctccaaactgatgttactggattacctacttatgctttt

SEQ ID NO: 43909 - DNA, 837 bp, Nostoc punctiforme
caaacattgcaaccaccacagcagcaagaagttccaggtgttgaatcagaaatgacaccaaaaccgaaagcagatgatgcccagtatcggggtagtggtaagttgcaagataaagtagcattgattacgggtgcagatagtggtattggtcgtgctgtagcgatcgcatttgctaaagaaggtgcagatgttgctatcctttacctaaatgaacacgacgatgccaaagaaacaaaacatctggtagaaaaacaaggtcgtcgtgcagtaactatcgcaggcgatattggcgatgaaactttttgtcagcaagctatccaacaaacagttggtgagtttggcaaactcgatattctcatcaacaacgctgccgaacaacatcctaaacaaagtattgaagaaatcactaaagaacaattagagcgaactttccgcactaatatcttctcaatgttttttatgactaaagctgcactcaagcatttgcaaacaggcagtgctatcatcaataccacatcggtaacagcttataaaggtagcccacaactgctagattattcttctacaaaaggtgcgatcgttgcttttacccgctccttatcacaaaatttggtttcaaaaggaattcgcgttaatgctgtcgcaccaggaccaatttggacacctttaattccctcaacgttcccagaagagaaagttgagagttttgggaaacaagtaccaatgcaacgagccggacagccagaagaagttgctcctagctatgtatttctagcatctgatgatgcttcttatgtctctggacaagtgctgcacgtaaatggtggcgaagtagtc

SEQ ID NO: 43910 - DNA, 1692 bp, Nostoc punctiforme
acagtcgtcgatattctgcgcgatcgcagttcgacacagccgcacacacaagcattcaccttcctcgaagatggagaaactcaggaatcaacgctaacttactatgagctggatcgtcgcagtcgggctatagcatctcaactccaagcccttggtttaagtggggaacgtgctatattgctctatcctccgggattggattacttaacagcatttttcggttgcttatatgctggagtcgtggcagttccggcttacccgccgcgcaatcaacgtaatacgcccagaattcaggcaattatcgcagatgcacaagcagcaattattttaacgacaacaacgctcctccctaacgtcaagtctttactgacaaaacacacagaccagggaagtttatgttggctgacaactgacaacctggcacaaggcatagaagattcttggcaacaacctgaaattgacgcgcagatattagcgtttctgcaatatacatctggttctacaggcactcctaaaggtgtcatgcttagtcatggcaacctactacataatgctgccgtgacttaccaaatcatggaacattcgcctgagagtcagtttgtctcttggctacccgtttaccatgacatgggattgattggtggaatactgcaaccattatatggagggtttccttgcgtcttaatgtctcccacctcatttttacaacgtccatatcgatggttgcaggcaatttctcaatatcgtggtacaactagtggtggtcccaactttgcctacgagttgtgtattcagaggattactcctgagcaaaagtctactcttgacttaagtagttggagcgtcgccttcaacggcgctgaacccatcagatcggagactctagagcgattttcagccacttttgctgagtgtggttttcgtccagaagggttctatccttgttatggtatggcggaagcaactctgatggtttcgggtgggatcaagaaagctttacctccttgcaaaacagttgcaaaatctgcattggaaaggcatcaagtcattgaagcagccactagtgaagatatccagacctttgtcagttgcggtcaaagtgtaccacaacagcaaattgtcattgcacacccagagactcttaagccttgtcaacccgacgaagtaggcgaaatctgggtatcagggcccagtattggtcaaggttattggaaccgtcctgatgagacaaagcaaacattccacgcctccctcaaaggcccagattctaggctatttttacgcacaggtgacttaggttttttggacaagggagaactatttatcacaggtcgagccaaagatttaatcattatccgtggtcgcaacctttatccgcaagacttagagttgactgtggaacgtagtcattcatcattgcgttcaggcagtggtgcagctttctcagttgaggcagagaatgaagaacgcttagttgtagtgcaagagttggagtttcgcgccaaaccaaatattgaagaagtcattgcagcaattcgtcaagctgtggctgaggagtatgagatacaagtatacgcagtggtgctgattaaaccaggcactattcccaaaacctctagtggcaagattcaacgccgtgccacaaaagccgattttctggcgaacaagctggaagtcgttggtagcagtatt

SEQ ID NO: 43911 - DNA, 1824 bp, Nostoc punctiforme
gtaaatttgcataatgttaactttgaatcttctgatttgagccagtgtgtttttgctgaaacctttggtatggtttttgctggcattgcttttagtccagatggaacattattagctacaggagatgcagaaggtgagcttcgtctttgggaagttgcaactgggaaacttgttgtcaattttgccggacatttaggttgggtttggtcacttgcttttagtccagatgggcaattattagcaagttgtagtagtgataaaacgattcgcctgtgggatgtcaacactggtaaatgtctgagaacattgtcaggacatacaagttcaatttggtcagttgcctttagtgctgatggtcaaatgcttgcgagtggaggcgatgaaccaacaataagattatggaatgtcaacactggggattgtcataaaattttctcgggtcacacagatcgaattctctcgctttcctttagttcagatggccaaaccctagcaagtggcagtgccgatttcacgattcgactttggaaaattagtggagaatgcgatcgcattttagaaggacatagcgatcgcatctggtcaatttcctttagtccagatgggcaaaccctagtcagtggcagtgccgatttcacgattcgcctctgggaagttagtactggcaactgcttcaatatattacaagaacatagcgatcgcgtccgatcgttagcctttagtcccaatgcccaaatgctggtcagcgccagcgacgataaaacagtcagaatttgggaagctagtacaggagaatgcctgaatattttaccaggacacaccaattctatattttcagttgcttttaacgtagatggtcgaaccattgccagtggtagcacagaccaaactgtaaagctatgggatgtcaacacaggtagatgctttaaaaccttaaaaggctatagtaattcggtattttcagttgcttttaatctagatggtcaaactctggccagtggcagcacagaccaaaccgtaagattatgggatgtcaatacagggacttgtctgaaaaaattcgccggacatagtggctgggtaacttccgtagcatttcacccagatggagatttgctagccagtagcagtgcggatcgcaccatccgcttatggtcagttagcactgggcaatgtctgcaaattttgaaagatcatgtaaattgggtgcaatcagttgcctttagtcccgatcgacaaatcttagcaagcggcagtgacgaccaaaccattcgcttatggtctgtcagtacaggaaaatgcctcaatatattgcaaggtcattccagttggatttggtgtgttacctttagccccaatggtgaaatagtcgctagcagtagtgaagaccaaaccattcgtctgtggtctcgttccactggtgaatgtctccaaattttagaaggacacactagtagagtgcaagcgatcgcttttagtccagatgggcaaattctcagtagcgctgaagatgaaacagttcgcctgtggtcggttgatacaggtgaatgtctgaatatatttcagggacacagtaatagtgtttggtcagtcgcctttagtccagaaggtgatattttggcaagtagtagcttagatcaaacagtgagaatttgggataggcatacaggggtttgcctgaaagtgctgcctgtcctgcctcatgcaatgcgatcggcgatcgcatttggtaaatctacagaacattatgcgatcgctagcggtagccaaaacggaactattcagatttgggatgcccaaacgggtgaatgcttgaaaatactg

SEQ ID NO: 43912 - DNA, 2687 bp, Nostoc punctiforme
atgaaaagcacccaaggcaaaatcaacgagctgctgactgagacaggatgcgaacataatcagcacaaacaagcggaaaagaaaaacaaatcatgcgctcaacaggcacaacctggcgcggctcaagggggctgtgcctttgatggtgcaatgattgctctagtgccgatcgcagatgctgctcatttagtccacgggccgatagcctgtgctggtaattcctggggcagtcgtggtagtctgtcgtctggccctcaactctacaaaatgggctttaccacagacttgggtgaaaatgatgtcatcttcggtggcgaaaagaagctctacaaagcgattctggaactcaaagagcgctaccaaccagcagcagtatttgtctatgccacttgcgttacagccttaattggcgatgatatggatgctgtctgcaaagctgcggctgagaaaattggtattcctgttgttcctgtcattgccccaggattcattggcagtaaaaatctcggcaaccgtttcggtggtgaagctttgttagaatatgttgtcggaacagcagaaccggaacatacaacgccctatgatattaacttaatcggtgaatacaatatcgccggggaaatgtggggagtaacaccactgctagaaaaattaggcatccgtattttgtctaaaattacgggcgatgctcgctacaatgaaattcgctacgcccaccgcgccaagctcaacgtcatgatctgctcacgagcgctgctgaatatggcgagaaagatggaggagcgttacaacatcccttacattgaagagtctttctacggcatcgatgatatgaatcgctgtctgcgaaacatcgccgctaaattaggcgatcctgatttacaagagcggacagaaaagctaattgcagaagaaacggctgctttagatttggcattggctccttatcgcgctcgactcaaaggtaagcgggttgttttatatactggtggtgttaagagttggtcgattatctcggctgctagagacttgggtattgaagttgtcgctaccagtactcgaaaaagtactgaagaagataaagccaaaatcaagaagttgattggcaacgatggcatcatgctggagaaaggcaatgctcaagaattgctacaactggttaaagacactcgcgcagatatgctgattgctggtggacgtaaccaatacacagctttgaaagctcgaattcctttccttgatatcaaccaagaacgccaccatccttatgcaggttatgtgggaatgattgagatggcgcgggaactgtacgaagctttgtatagcccgatttgggaacaaatacgcaaacccgctccttgggaagaagaggaggaagtttaatggcgatcgttaccgcttctaacaaagcactgacagttaatcccctcaagcaaagtcaagctttgggcgcaaccttagcctttttgggattgaaagggacaatgcccttattccacggttctcaaggttgtactgctttcgccaaagttgtcctagtgcggcatttccgggaagcgattcccctagctaccacagcgatgacggaagtcactactatcttgggtggtgaagagaatgtggagcaagcaattctcactctggtagaaaaagctaatccagaaattattggtttatgtagtactgggttaacggaaactagaggcgatgacattgaaggttttctgaaggaaatccgcgatcgccatcccgaattgaatgatttagcgatcgtttttgcacctaccccagattttaaaggtgcgttacaagatggctttgctgttgctgtcgaaagcatagttaaggaaattcctcgcgcgggtggactcagaactgaacaagtcacgattttggcgggttctgctttcacacctggggatgtacaggaaatcaaagagatagtcacgtcttttggattagtgccgatctttgtacctgaccttggcgcttctctagatggacatttagaggataattatagtgcggttacagtcagtggaactaccttaaaacagctacgagaagtaggtagttctgcctttaccctggcattgggtgaaagtatgcgcggtgctgcaaagattctagaagaacgctttggcacaccttacgaagtgtttggcgaactgacgggattagaaccagtagatgagtttatccaagcattggcgattctgagcggtaacagcgtacccgaaaaataccgccgccaacgtcgtcagttgcaagatgcaatgttggacactcatttttacttcggtgcaaaacgagtttccttagcgctggaaccagacttgttgtggtcaacagtgcatttcttgcaatcgatgggtagtcaaattcatgctgtggtaacaaccacgcgatcgcacctcttagaaaaactcccggttaaaagcatcaccatcggcgacttggaagactttgagagtctagcaggcggttctgatttgctaattggtaactcgaatgtcggtgcgatcgcaaaacgcctctcgattcctctttatcgtttaggattgcccatttatgaccgcttaggtaatggtcaatttaccaaagttggctatcgaggcacgatggaacttttgtttggcatcggcaacctgtttttagaggcagaagaagcgagagttaagcagttc

SEQ ID NO: 43913 - DNA, 1533 bp, Nostoc punctiforme
atgcctcagaatccagaaaaaattcaagatcacgtcgagttattccaccagcctgagtaccaacagctatttgaaaacaaaaagcagtttgaaaacggtcacgatcccgaagaagtaaaacgggtttcagagtggacaaagggttgggattatcgtgaaaagaacttcgctcgtgaagctttaaccgttaaccctgctaaaggctgccaaccactaggagcaatctttgctgctgttggttttgaaggtactctacctttcgttcaaggttctcaaggttgcgttgcttactttcgcacccacttaacccgtcactacaaagaaccattctctggtgtatcttcttcaatgactgaagatgcagccgtgtttggtggtctgcaaaacatgattgacggcttggcgaactcttaccaactgtacaaacctaagatgatcgctgtctgcaccacctgtatggcagaagtaattggtgatgacttacaagccttcatcaacaactctaagcaagctggttcagttcctcaagatttcccagtaccttacgctcacacccctagctttgtcggttcccatatcactggttacgacaacatgatgaagggaattctttctaacttgaccgcaggtcataagaaagaaaccagcaatggtaaaatcaactttatcccaggttttgacacctacgtaggcaataaccgcgaaatcaagcggattgcttctttgttcggctttgactacacaattctagccgacaacagcgactacctagattcacctaacacaggtgagttcgatatgtacccaggtggaacaaagctagaagatgcagcagattcaatcaatgcgaaagctacgatcgctctgcaagcacactctacacccaaaacccgcgagtacatcgaaaaagaatggaagcaaccaacctcagtttcccgtccttggggtattaagggtactgatgagttcttgatgaaactcagcgaattgagcggtatccccattcctgaagaattggaaatcgaacgcggtcgtgcagttgatgccatgactgattctcactcatggattcacggcaagcgcttcgccatctacggcgaaccagatttagtatacagcgtagttggctttatgctagaaatgggtgctgaacctgtgcatatcttggttcacaacagcaacgaagtatttgaagcagaaatgaaagaactgcttgcttctagccccttcggtcaacatgcaactgtttggcctggtaaggacttgtggcacatgcgttcattgttgttcaccgaaccagtagacttcctggttggtaacacctacggtaagtacctgtggcgcgacaccaagattcccctcgtgagaatcggctaccccatcatggatcgccaccacctacaccgctatgccaccattggttatcaaggtgtgatcaacctcctcaactggactgtaaacaccctgtttgaagaaatcgatcgcaacaccaacattccttctaagacagatatttcctacgacttgattcgt

SEQ ID NO: 43914 - DNA, 408 bp, Nostoc punctiforme
gaaacctacgatcgcggggcggcagattatgatgcgattatgaagcgttactggcacattgagcgcgaaccgttaattgcttccttgcagcttcagccaggacaaatcgtgctagatgctgcggtaggaacaggtcttaatctttcagcttacccggaaggggtaaatgttgtgggtatcgatttttctgaaaagatgctgaatgaagcacgtaaaaagcacgtatccgcagacatcactttcaatatctcggatctctgcaatcttgattttcctgataatagctttgatgcagcagcatcaggatttaccctctgtgtcgttgaagatccagttcttgctcttaaagaaatcctacgagttactaaacctggtgcattgattgccattctcgattactgcaaatcg

SEQ ID NO: 43915 - DNA, 2400 bp, Nostoc punctiforme
atgtatgaactagttcaagctgtcttcaacggtgatgaaaaaactgctctacatcagttgatttatacgttgagtgcttcaggtaagcgttacttactaagaaatgagattttacaagcttttgccgattactgtcatgaatcccaaaagccagcctatttttatcactcttcttcgattggcaaactgatacagtacactcacgaaataattatcgaagaggaaagtacctggttcgtgattcggcccaagattgctaaccaggaagtttggcgattgacagccaatttggatagcttcgagcagatgacgcaacaagcgctgttagatgtaagagatcgcttagtcaaccgctaccaacccggtatcctcgaaatcgaccttcaccctttttacgaggattctccaagaatcgacgacccgagaaatattggtcaaggtttagcctaccttaaccgttacctgtgcaatcaattgttgactgaccctgaatattgggtagaaatgttgtttcaagcattacaggggctacaacacgatgggattcgcctgctgttgagcgatcgcattccctctggtattcatttagccaaacaaattaagctagcgctcaaattggtgaatgagcgatcgcctcatgaaccttacgaaaaattctccttagacctccaagaactcggctttgagccaggttggggtaacactgcggcgcgagtctccgaaaccctagaactcctcgaccgactcatttattctccagaaccgggcatattagaagcatttgtcgcccgcgtccccgccgtttttcgtgtcgtcctcatttccatccacggttgggttggacaggaagatgttgtcggaagagatgaaacacttagtcaagttatttatgtcctcgaacaagctcgcagcttagaaaacgaactgcgcgaacaaatcaaactcgctggactagaccagctaggtatcaaaccccatgtaattattctcacccgactaatccctaactgtgaagggacattttgctacctgcctctagaaaaagtccaagatactgaaaatgcttggatattgcgcgttccttttggtgaattcaatccagaaattactaacaattggatttctaaatttgagatttggccttatttagaacaatttgctatcgatgcagaaaaagaattattaactcaattcaaaggtaaacctaatcttcttgttggcaattacagcgacggtaacttagtggcttctcttttatctcgccggatgaaagttacccagtgcaatattgcccattctttagaaaagcctaaatatctatttagtaatttatattggcaagatttagaaaatcaataccacttttcagcacaattcactgctgatttaattagcatgaatgcagccgacttcatcattacatcctcctatcaagaaattgtcggcacaccagacaccataggtcaatacgaatcgtataaatgctttactatgccgcagttgtatcacgtagttgatgggattgatttgtttagtcccaaattcaacttagtaccaccgggagtaaatgaaagtattttctttccctatagccaaaaagaaaaccgagattctaacctttgtacagaaattcacaacctactattcagccgcgaagatccccaaatattgggtcatttagatcgccctaataagcgaccaatcttttccgttagttccatcagttccatcaaaaatcttgcgggattagctgagtgctttggtcaaagtcagaggttgcaagagcattgcaacttgatcctcttgagtagtaaactgcatcctgatgaagctacaaacccagaagaagcagaagaaatccaaaaactccacaatattattgatcgatatcatctccatagtaagattcgctggctggggatgcgtattcctagcagcagccttggcgaagcctaccgagtagttgcagattgtcagggaatttctgtccactttgcccgctttgaatcctttgggcggagcattttggaagcaatgatttctggcttgccaactttcgcaactcaatttggtggttctttagaaattatcgaaaaccaagaggaagaatttaatgttaatcctacagatttggtagaaacagcaaagaaaattttagatttttttgaaaaatgcaatactcatcctgaacattggcaggaagtctcagaatggatgagtcagcgagttcataaccgatacaattggcatttatatagtaatcaattactactacttgcaaaaatgtttactttttggaactttgttgcgccagaaaataatgaagccagagatcgctatatggaaacattattccatctcatttataaacctagagccgaaaagattttagaaaagcac

SEQ ID NO: 43916 - DNA, 591 bp, Nostoc punctiforme
atccaaggattcattttcgatttagatggtgtgctgacagatacagcagaacttcattatctagcttggaagaagttagcagatgaagagggtataccgtttaatagccaggataacgaagcgctgcggggtgtatctcgtcgtgcttccctgatgctgattgttggtgatagaccatatacggaagcacaaatccaagagatgatggagcggaagaatagctactatatggaattgattcaaaatatgacatccaaggatttgttgccaggtgcgatcgcctttttggatgaactgcgacaagctgggattaaaatcggcattggttcagccagcaaaaatgcccgtacagtaatcaagcgattgggcattgctgataaagtagatgcgatcgcagacggttatagtgtacagcaacccaaaccagcacccgatctatttttgtactcagccaagcagctaggacttgaaccagcgcaatctatagttgtagaagatgccgcagcaggcattgaggcggctctagctgctgggatgtgggcagtagggcttggcccggttgaacgagttggagccgctcatgttgtctta

SEQ ID NO: 43917 - DNA, 1269 bp, Nostoc punctiforme
gtgagcctacaaactctcgttgaacaagccaccatccccccagattcagggtctgtagcatctagtccctttgatgcagatagctttaatgaagctgtcatgtctacctatggtcggtttcctttagccctagaacggggtgctggatgccgggtttgggatacacagggacgagaatatctggactttgtagcgggaattgccacttgtactttggggcacgcccatccagttatggtagaagcggtaacacgccaaatccagaagctgcaccatgtctctaatttgtactacattcctgagcaaggtgaattggcaaagtggcttgttgaacattcttgtgccgatcgcgtatttttctgcaactctggagctgaagctaacgaagctgcaattaaactggcgcggaaatatgcccacacagtattagacattgaaaaacccattattttaaccgccaatgccagtttccacggacggactttggcgacaattaccgccacagcacaaccgaagtatcaaaagtacttcgatcctttagttccggggttccactacgtaaattacaacgatattaacgctgtggaagtagcgattagcgagttggatgaaggtgattaccgggtagcagcaattctgattgagccattgcagggagaaggcggtgtgcgtccgggagatgttgcctatttcaaaaagctgcggcagatttgcgatgaaactggcattttattgatttttgatgaagtgcaagttggtatggggcgcagtggcaaattatgggcttacgaacatcttggcgttgagccggatatcttcaccagtgccaaaggcttaggtggtggtatccccatcggtgcaatgatgagtaagaaattctgcgatgtttttcaaccaggggaacacgccagcacttttggcggtaatccttttgtgtgtggtgtagcactcagtgtttgccagacattggaacgggaaaatattttacagaatgtgcaagacaggggtgaacagttgcgatctgggttgagagcgatcgcagcgaaatatcctcaacagattggcgaagttcggggttggggtttaatcaacggtttggagttgcgagccgatatccaattaaccgcagcagatattgtcaatgctgccattaacgagggtgtattactggtaccagccgggccaaaagtagtccgatttgtgccaccgctaattgtcacagaggcggaagtcaacactgccttagaagctgtagacaaggcgatgtct

SEQ ID NO: 43918 - DNA, 1281 bp, Nostoc punctiforme
ctgcgaatcattactcagcaggcagacgttagagcagaactgcaacggatctgcgatcgcacccatgacgaacaggtgcttcacaaagaagcaacggtgcgggaagttttgcaagcagtgaagcgccaaggcgataaagctgtattgcattacacagccgaatttgacaaacaaaccctgaaagcagaagaactccgagttacaggctcggaactagatgcagcctatcagcaggtgtcaaaggagttgttgggcgcagttcggctagcttgccgccaaattgaagcgtttcatcgtcagcgagtaccaaaaagctgggtacactttggcgacgatgaagtagtactgggcaaacgctacacccctgtagaccgagcggggctgtatgtacctggtggtcgcgccgcctatcctagtacagtgctgatgaatgcaattcccgctcatgttgctgctgtacctcatatagtgatggtgacaccaccaggtccagggggtgtaattaacccagcagtcttagtagctgcccaagaagcaggagtgcaagaaatttatcgcattgggggcgcacaagcgatcgctgctttagcctatggcacagaaacaattccgaaagtcaatgtgattactggccctggtaacatttatgtcacccttgcgaaaaaacttgtatatggcaccgtcggtattgattctttggcaggccccagtgaagtgctggtgattgccgatgaaagcgcaaatgcggtgcatgtagctgctgacttgctagcccaagccgaacacgatccaatggcggcagcaatcttgctgacaacagatgcggctttggcgaaaaacgtgcaagtagccttggaaagacagctagtggatcatccacggcgaatagacacagaaaaagcgatcgctcattatgggttgattgtccttgtggaatcgctccaagcagcagcagaactctcaaatgaatttgcccctgaacacctggaattagaagtaaaagacccttgggcactcctaccagagattcgccacgctggggcaatctttttgggttactccacaccagaagctgtaggagactatttggcagggcctaaccacaccttgccaacttctggcgctgcccgctatgcttcggcgttaggggtagaaactttcctcaaacattccagtattattcaatactcccaaactgcgctgcaaaatgtggctggtgctattgatgtgctagcaacagcagaaggtttaccttctcatgctgattcagtccgccgccga

SEQ ID NO: 43919 - DNA, 2856 bp, Nostoc punctiforme
aaatactccttgccgttattaattttaagcttatggctagtagcggtttttttgttgagcgatcaacctgcgaatagccaacatacagccatatctaacaaagaaaaatcccagtcaaccttgctagtaaaaagaataatgccctcaacactgacagaaaacgtccgtaagacagtgctggagaatggtctaactgtcctaacaaaggaagtgcatactgcgccagtggtgacggtgcaggtgtggtacaaggttggctcacgcaacgaagaaccaggggtgaatggcattgcccaccaattggaacacctgatgtttaaaggcacgaaaaatcgtccgattcaatttgggcgtttgtttagtgctttaggtagtgattccaatgctttcaccagctatgaccaaactgcatattacggtactgtggagcgcaacaagctaaaagcgctcttagtgctggaagcagatagaatgcaaaattctcagattgagccagaacaactagcgagtgaaaaaagagtagtaatttctgagttacaaggttacgaaaatagtccagaatatcgcctcaaccgcgccgttatgcaggcagtgtttcctaatcatgcttatggtttgcctgtaggtggtaccaaagctgatgtcgaaaaatttgaagttgagcaagtacagaaatattaccgtaatttttacagtcccgataatgctgtcttagtgattgttggagattttcaaaccgcgaataccctcgaaataattaaagaggtgtttggcaaattaccaaaaaggcagggggcagggggcaggaggcaggaggtagaaggcagaaggcaggatagcgaagcggtagcgagtccgcgagcgtcggcagaaggtaggaggcagggggcagaaggcagggggcaggaggtaggagttatttcttcgtcatcttcttcatctcctatagtgttgcgagaaccgggagcagggcgactattacaagttgtttatccgctaccagatgcaaatcaaccagatgtgccggcgttggatgtgatggattacatttttacagaaggacggaattctagactttatcaagcattggtggaatcaggtttagctagtgaagttacagcatctgttaccagtttgcgagaatctggctggtatgagattttggtgacggctggatctaaaaaagatttgaaaaaaattgactcagtgttgagtcgcgcgatcgcaaatgtagcagaaaaaggcgtgacaactgaggaagtagaacgagccaaaacccaattaacagcagatgtgattttgagtaaccgtgatatcacctctcaagcaatgcgattgggcaatgatgagacaactgttggtgattatcgctatactgaccgctatttggctgctgttcgtctggtgaagccgacggatgttgtcgctgtgattaacaaatacctcacaaaaaaagcccgaagagtaggcttttttgaaccaactcaaaagcagatagcaggggttggcgataaaccagactcagcccaaactacagaaaatttctctcctggcgtgcctgtgcttccttctgaggtagtgaaatacttaccacctgtggatttggctacagatgcgattgctcaagttttaccacaaaaatttaaacttaccaacggactgcggatattactgttacccgataatagtactcccaccgttactctaagcggctacattcaagccggtacagaatttgatccagacgatcgagccggattggctgcttttgtggcagataatttgctaaatggtactaagagcaaagatgtcttaaatattgccaaaatattggcagaacgaggggcgagtctaaactttgaagtacatcgtgaaggtgtacatatcgagggtgatagtttagcaggggatttgccaataattttggagatattggcagatgttcttaaaaatagtacctttcccgcacaagaattggaattacatcgccaacaaattttaaccgatctgcaactggaattagatgagccagcagaagtagccagaagaatatttgtgcagtcaatttacccgaaaaaacatcctctacatacttttcccacagaggagagtttacagcagattcaacgccaggatgcgatcgatttcaaagctaaacattatcgtccagacacgacagtattggcgctggtgggagattttgatctagacaaagtgcgatcgctcattcaaaatgagtttggtaactgggaagttagcggccaagcacccacattaaaatatcctccagtatcaatgccggagagaatagtgagtgtcaacacagttttaccaggtaaagcccaagctgtgacatatatgggttacacaggtattaagcgttacgatcctcggtttcacgcagccttagtattaaaccagattttgggaggcgatactttatctagtagactgggtgcagaagtacgcgatcgccaaggtttgagctatggaatttatagctacttccaagctgggaagagtacaggcacatttttgatagaaatgcaaactagtccagaagatactagtcaagcgatcgctagtactcgccaaatactacagcaaatccatcaacaaggtgtcaccgcactagaagtagaaacagctaaacgcaccctcatcagcaactacaacgtttccctggcaaacccagaagaattaacagacagaattctgatgaatgaggtgtatggactagataaagtagaattgcacacctttactgacaaactccagaaagtcacctttgagcaagttaatcaagcggctcgtgaattactccacccagatcaaatcgtagtcgttactgctggg

SEQ ID NO: 43920 - DNA, 1269 bp, Nostoc punctiforme
ttggatattgattctgtaatacaaccctttcaacgctttggtgtccatctgggactcgatcgcattatcaacctattggcaaatctcggcaatcctcatcaccaagtcccggtaattcatgttgctggcactaatggtaaaggttccgtctgtgcctatctttcctcgatacttactgaggctggttatcgcacaggacgctacacttcaccgcatttagtcgattggacggaacgtatttgtctgaatgaacagccaatttcttctgaggaattgagccaattattagaaaaagtccaaggagtgattcgccctgaagacgaatcggcaactcagtttgaagtaattacggcggctgcttggttatattttgcccagcagcaagtagatgtggctgtggtagaagtcggactaggagggcgcttagacgctaccaatgtctgcttggaacccatagttactatcatcacttccatcagccgggaacattggcagcaacttggccccaccgtcgcggatattgctagagaaaaagcaggtattctcaaacctggatgtcccgttgtagttgggcaattgccactggatgcagaagaggttgtgcgatcgcgtgctttagaattaaaatgtccaatttttacgcctcaacctgcccgtcaaatcgctacaggatgggcagaatatcaaacacttcaaaattctcaattaattaaatatcctttgccattagcgggacaaattcaattagcaaattcagctttggcaatagcagctttagaaattctccaagaacagggttggcatatttctgaagaagccataattaagggtatggcaaaaactcaatggccaggaaggatgcaatggactacctggaacaaccataaaatattacttgatggcgctcataatactgccgccgcccaagttcttcgccagtatgttgatagcttagacgcagttaatcccaagcccatcacttgggttatgggaatgttttccgataaggatcatgctgatatttttgccgccctactgcgccctggcgatcgcctttttttagtaccaataccagtagaatcctggacaggtagaacctctgccgatctagactccttagcaaacctagcttataggctctgtccccaattaagcgatcgccaaatccatccagatttatttacagcactagaagtcgcaatctcaaccactagcacagacgatttaatcgttttatgtggttccctttatctagtaggcgatttttta

SEQ ID NO: 43921 - DNA, 1017 bp, Nostoc punctiforme
ctggctggctgtccccctgatgctattctggatttttctgctagcatcagcccgttggggcctccaaacagcgcgatcgctgctatactgtcccaacttggtaatcttaagcactatccagatccaaactatagtgaactgagactagctctcagtcacttccatcaactgcctcctgagtggattctgccgggtaacggctccgcagaattactcactttaataggtagggaattggctcaattagccgcgacaactttaatcactccagcctttggtgactattaccgaaccttggcagcgtataacgctaatgtgctggagtgtcctttgtcattagtcactggtcattggtcattattccttgacaaagggcagaagacaaaggacaaaggactattgttgaataatccccacaacccaaccggaaagatattttcacgggactctattttgccctacctagagcaatttgctttggttgtggtggatgaagcatttatggattttgtaccgcctaatgaggaacaaagcctaattccggtggtgcaggaatatacaaatttagtaatattgcgatcgctaaccaaattttacagtctcccaggattgcgattaggatatgcgatcgcacaccccgactgcctagccaaatggcagctatggcgtgacccttggcccgtaaacaccctagcggcggcagcggcaattgcagccctccaggatgcagagtttcagcagcaaacctgggcatggctaccacctgcacgaaaccaactctttcaaagtttggctgaaataccgggattgcaaccccaagtaagtgctgctaactttttactggttgagtctcaagagtcgacttcgcagttacagcaccaattactcaagtatcaccagattttaatccgtgattgccttagttttaaagaattaggcgatcgctttttccgggttgctgtacgtgaagagtccgataaccaacgcttactaacagcgctaaactcagtgttgagt

SEQ ID NO: 43922 - DNA, 1383 bp, Nostoc punctiforme
tacgatgttgtaattattggcggcagtcttgctggatactacgctgctcttgctgcaacccaactacgtgctacggttgccttggtggaacctaaagtagactatgggtttactcatcaccatgctcttaccgaaatcggtaaactggcgcagaagttgaatgatgccgctagttttggtattcatgccacaaagactgatatttcagaagactgccacatatctatggcatggcaagaagcgatgctgtatgctcaatgcgtcgccgcaaatctcaaagaacagcattctcccgccatcctagccgcgctgggggtagatgtgattgttggcagtggtcaatttcaatcttcgccccaactggcttttgccgttaacaatcgcctactacacgcccgtacttatttactagccagtggttcgcgtccagaaattccagagattgagggattgcaaagcactggctatctaactctttctaatatttggcaatctttacagggagaaacattacccaaaaattgggtaattatcggtggaattcctcaaagcatcgaaatcgctcaaactttagcgcggtttggttgcagtgtgacgctagtagtcaagcatccttatgctctctcccatattgaccatgaaatagccatattgcttcaagcacagttggaagtcgaaggtgtgcgcgtcctcaccgataaacaggtaactcaggtgaggctaattgaggctaaaaagtggattcaagcaggagataaagccattgaaactgatgaaattttagtggcgactggacaacagccgaatattgaatccctaaatttggcaatggtaggcgtgaaatggcatcggcgtagtttagtagttaatgataaactacaaaccactaaccaccgcatttacgcttgtggtgatgtaattggtggttacgactttgccaatatcgctaattatgaagcaaaaattgccttaaacaatgcactctttttccctagattacgagtaaattatcgctccattccttgggcaatgttttctgtgccgatggtggcgcaagtgggtttgacagaggcacaggcaaaacgtctatttagtcgagatgaagttttagttttgcgtcaatattttaaaacagtggcagcagcgcaacttcgggacgaaaccactggtatgtgtaaattaattgtgctacataatggcgaaattttgggagcttcgatattaggggcagaagctggagaattgattaatttgattgccttagcaatgtcccaaaaaattaaagtcaaagatttagcaaatctatctcctgtctatcccagtttctcagaaattttggaacaagctgcaagagaatggagtaaacagaagttaaatagcgat

SEQ ID NO: 43923 - DNA, 720 bp, Nostoc punctiforme
gtttttagttctcatgaaacaatccttgctagtgctggtgcagatgggacaattcgcctttgggatacgattacaggtaaatgcttaagaactttacaggtaaacgggtggatactctcacttgctatgagtcctcaaggaaatgctttagccactgctaatacagatactatggctaagatttgggatatcaaaactggggaatgtatcaagactttagagggacatactggttgggtattttctgttgcctggagtccaaatggacaatttctggctactagcagcgatcgctgcattaagttatgggatgtcaaaacatggcaatgtatcaagactttagaggcacattccggttgggtatattcactagattggagtccagacggtcaaacgttactcagcggcagttttgacctcagcttgaaattatgggatatcaatacaggaaactgtcagcaaactttgcacggacacacaaaaatagtgttaggtgcaaagtttcatccccaaggcaacattattgccagtacaggtcaagatggaacgataaaactttggaacagcaatacaggagaatgcctgagaacactcataggacatgcagattggatttgggctattgcctttcaccccaacgggcaaacccttgctagtggcagtcaagatgagacaattaagctgtgggatgtcgaaacaggggagtgtttgcaaactttg

SEQ ID NO: 43924 - DNA, 828 bp, Nostoc punctiforme
tttagtccgaatggtaaagtcttagcaacttgtagtgatgatggtgtcattaaaatatggaatattaatactgggaaatgtcatcatactttacaagatgattccaagcgtagttggtcgataagcttcagtccagatggaaaaatactagcaagcggtagtggagaccacactgttaaactttgggatatcaatactgggcaattgttgaaagtattaaagggacatataaatattgtccgtccagttatttttagttcagatggaaaaattattgctagtggaagtgaagaccaaactatcaagatttgggatgttgatagtggtgaatatttgcagactttagaaggacacttggcacaagtttggtcagtttctttgagtgaagatgggaagatactagcaagtgggagtgctgataaaacagtaaaactttgggatgtgagtacgggggaatgtcgaacaactttacaaggaaatcaaattgatggtgtttggtcagttagctttagtcctagtggtgagagtgttgtagttgcaggtgaagtacctgtaatcagtttgtgggatatcaaaactggcgaatgtattcaaacctttttaggacatataggccgtgtttggtcagttgctttcagccccaatggtaaaactttagcaagtgcaagtgaagatcagagcgttaagttatgggatgtgactacaggaagatgtttaaaaaccttacaaggatactcaagtcgtgtttggtgtgtagctgttaacgccaatggtcagttattagctgcaaatacaaacaaaacactaagaatatgggatatttccaca

SEQ ID NO: 43925 - DNA, 1269 bp, Nostoc punctiforme
aaatcacaagaggtcttcgccgctgctcaaaacctcatgcccggaggagtcagttctccagttcgtgcctttaaatctgtaggtggacaacccatcgtttttgatcgtgttaaaggcgcatatatttgggatgtagatggcaaccaatatatagactatgtaggtacttggggcccagctatttgcggtcatgctcatccagaagtcattgcagcgttgcatgaagctttagaaaaaggcaccagtttcggcgctccttcaaccctagaaaatgttttggcagaaatggtcattgatgccgttcccagcatcgaaatggtcagatttgttaactctggaactgaagcctgtatgggagttttgcggctgatgcgggctttcaccaaccgagacaaaatcatcaagtttgaaggctgttaccacggacacgccgatacctttctcgtgaaggcaggttctggtgttgccacacttggcttaccagactcaccaggagttccgaaagcggcaactagcactactctaaccgcaccttacaatgacctagaatctgtcaaagccttgtttgaagaaaaccgcgacgagattgctggcgttattcttgaaccagttgttggtaatgctggatttattgcacccgacgcaggtttcttagaaggattacgggaactcactcacgagtatggagccttattggtatttgacgaagtgatgacaggcttccgcattgcttacggtggcgctcaagaaaaatttggcgttacccccgatttaacaaccttgggcaaagttattggtggtggtttgccagtaggagcttatggcggtcgccgagatattatgtcaatggttgcccctgctggccccgtatatcaagctggaactctttctggtaatcccttggcgatgactgctggtattaagactttagaattgctgcaaaaaccaggtacttacgattatcttgagcggatcactaaaaagctagcagatggtttgctgcaaattgctaaagaaactggtcatacagcttgcggcggtcaaatcagcgcgatgtttggtttattctttacctctggcccagttcataactacgaagatgcgaaaaagtctgatacagccaaattcggacgcttccatcggggtatgttagaacgtggtgtttacctagcaccttctcaatttgaagctgggtttacgtcttttgctcacactgaagaagacattgatcaaactttagcaatagcacgggatgtaatgtctagtctg

SEQ ID NO: 43926 - DNA, 648 bp, Nostoc punctiforme
atgtcttctaacgatttgcgatcgctacattacgccatccctgttgaaaaaattcgctacgatgaacggggtttagtgcctgcaattgtccaagattatttggatggtactgtcctaatgatggcgtggatgaatcaggagtcgttacaaaaaactttagaaactgaagaaacttggttttggagccgttcccggcaagaattatggcacaagggtgcgacttctggacatattcaaaaagtgcaaagtattcgttatgactgtgatagtgatgccttgctcataggtgtagagcaattaggagacattgcttgccatactggagaacgcagttgctttcaccaaatagaagggaatattgtttcaccaccaggggatgcgttgtcgcaattatttcaaataatatgcgatcgccgcgacaatcctactgaaagttcttatacctgtaagttattcgcaggtggcgataacaaaattttgaaaaagatcggtgaggaaaccgccgaggtggtaatggcttttaaggatgatgaagcagatgcgatcgcaggtgaagtggctgatttgctatatcataccttggttgccttagctcatcatcaagttgatttgaaatctgtgtatcgtaagttgcaagaacgtcgtcaa

SEQ ID NO: 43927 - DNA, 1056 bp, Nostoc punctiforme
atgaaaattgatcgcgttcatttctatgtagaagatgccaaaatttggcgggattggtttgtacaccatcttggttttcaatcagtagccgatcgcaacagttcgtttcacacttgtacagaagtggtgaaaagtggtgctgtctgcttttttctatcttcaccactgttacccacaagtccagtagcagagtttttgcgtaaatatccacctggtgtggcagatgtcgcttttgctgtggaagatgtagaagctgcgatcgcacaagctcaaaaacatggtgctacaatcttacaacccattcaggaacgccagataggtacggcatttctcaagtgtggcaaaattgccgcctggggtggacttactcatacattaatagaaaggtcatcagtgatttgtccgtcgtcatctgtaactaacacaaatgacaaaggacaaatgacaaatgacaacacttttaccgccatcgatcacattgtgttaaacgtggcagttggtgaattggatcgtgctgtcgcttggtacgaaaatatcttagattttcaaccccagcaagcatttaaaattaaaaccaatcgttctgctttacacagccaggtgatggtttcgcataacggcagcgtccaactgccaattaatgaaccagcttccaaaaattcccaaattcaggaatttttagatgtcaatcgggggccaggtattcaacatattgccttacggacaactaatctggtgagtgcgatcgctaaatttcgtgccagtggtttacctttgctctcagttccccaaacctactattcacagctaaaacagcgttcaggactcacgctatcacctctagaactagaagcaatcgctcaacaggaaattcttgtggactggcaagaatatactcccgtagggacacaacaaactgcacccctactactgcaaattttcacccagcctatttttgaacagccgacatttttctttgagtttattgaacgccgtttccaagctcaaggttttggtgaaggtaactttcgtgccttatttgaagccattgaaagc

SEQ ID NO: 43928 - DNA, 627 bp, Nostoc punctiforme
caaggcgtaattttggatgtagatgggacacttgttctcagtaatgatgcccatgctcaagcttgggtagaagcattttctgcctttggctatgaggtgaagttcgaacaagtccgaccattgattggtatgggaggcgaccagattattcctaagttcgcgccaggactttccgatcgacaaggaaaaggtaaggaaatcgccgagaaacgtaaagaactgattatcaacaagtttgcaacaaatctgagtcccgccactggtgcgcggcaactaatattgaagatgttgtctgttgggttacgtctaatcattgccagttcagcaacgagtcaagaactgtcggtattgttgaaagctgcacaagttgatgacctgctgagtcaggatgaggcgacaacatctagtgatgccgaagcttctaaaccagatccagatattgtcgaagctgctttgagcaagttgaatatagaaccagcctctgttgtaatgctgggcgatacaccctacgatgttgagtctgcaaataaggctggtgttggcgtgattgcatttcgttgtggtggttttgatgatagtcaattaaaggatgcgatcgctatttacgatgacccatctgatttgtta

SEQ ID NO: 43929 - DNA, 3015 bp, Nostoc punctiforme
cgcacggtgttaattttcgatcaatttgaggaatttttctttgtttacaccgaacctgcacaaaggaagcaattctttgagtttttgggagagtgtctgaatgttctatcggtgaaagttatcttatcgctgcgggtagattacatccattacttgctggagtgcaatgatttgtccagtctcaagattattggcaatgacattctcagtaataatgtgctttacaagttggggaatttctcaccgacagataccaagtcaattattcagcgtttaactgaaaatactagtttttatttagaacctgccttagttgaacaactggtgctagatttagccggagaattgggcgaagttcgtcccattgagttgcaagttgtgggggcgcaactgcaaacggagaacattacaactctggcagaatatcggcagcgtggcactaaggacgaattggttaagcgttatttggatgaagttgttaatgattgcggcgtagaaaatcagcaagcagcagacatattactgtatttgctgactgatgaaaaaggaactcgccctttaaaaactcgcgctgagttggaacgcgatttgcagggttacttctcggagatccccccaaccccccttaaaaaggggggctttattctttcaaccccctttttaagggggtcgccgcaggcggggggatcggaagctagggcgaaacaagcttctgaaatcaataaattagatttgattttagagatttttgtccaatccggcttagtggttttgctaccagaaaaccccgccgaccgttatcaactggtacatgactacatcgctgcctttatccgccagcaacaggaaccgaagttaaagcaggtaatggcggaactggaaaaggaacgaaaagaaagaaaactgagtgaggcgaaactgaatagctttctcaaacgcgccctttttagtaccgtggccgcaggtttaggatttgctgggttagcagcagcaacattccagtgggcagtagaggcaaatgttaatcaaattagcgccatcaataattcttcggaagcctttgctctctctgaaaaatatccagatgctttaatagcagccttaaaagcaggtagcaaactcaagcatacactttgggcacagcacagaagcgatatcttaatgcaaactgtggtaactttacagcaagcggtttacttaaagccaaaggagaagaaagaaaatcgtgccatagaagtgaatactttagaaggtcatagcgattgggtcagtagcgtcgcttatagccccaatggataccagttagcttctgctagtgctgataagaccatcaaaatctgggatgttagcagtggtcaactcctcaaaaccctgactggtcatagcgataggatcagaagcatcgcctatagccctaatggacaacagttagtttctgctagtgctgataagaccatcaaaatctgggatgtcagtagtggtaaactcctcaaaaccctgactggtcatactagtgcggtcagtagcgtcgcctacaaccctaatggacaacagttagcttctgctagtgatgacaacaccatcaaaatctgggatatcagtagtggtaaactcctcaaaaccctgcctggtcatagcagtgtagtcaatagcgtcgcctacaaccctaatggacaacagttagcttctgctagtaatgataagaccatcaaaatctgggatatcaatagtggtaaactcctcaaatccctgactggtcatagcagtgaggtcaatagcgtcgcctacagccccaatggacaacagttagcttccgctagttttgacaacaccatcaaaatctgggatatcagtagtggtaaactccttaaaacccttactggtcatagcaatgtagtctttagcgtcgcttacagccccaatggacaacacttagcttctgctagtgctgataagacaatcaaaatctgggatgtcagcagtggtaaacccctcaaatctctggctggtcatagcaatgtagtctttagcgtcgcttacagccccaatggacaacagttagcttccgctagtgatgacaaaaccatcaaagtctgggatatcagcaatggtaaacccctcgaatccatgactgatcatagcgatagggtcaatagcgtcgtctacagccctaatggacaacacttagcttcccctagttatgacaagaccatcaaaatctggaatgtcagtagtggtaaactcctcaaaaccctaactggtcatagcagtgaggtcaatagcgtcgcctacagtcccaatggacaacaattagcttccgctagttgggacaaaaccatcaaagtctgggatgtcaatagtggtaaacccctcaagaccctaattggtcatagcagtgtggtcaatagcgtcgcctacagtcccaatggacaacagttagcttccgctagttttgacaacaccatcaaagtctgggatgtcagtagtggtaaactcctcaaaaccctaactggtcatagcaatgcggtcagtagcgttgcctacagtcccaatggacaacagttagcttccgctagtcttgacaacaccattaaaatctgggatgtcagtagtgctaaactcctcaaaactttgactggtcatagcgatgcggtcagtagcgtcgcctacagtcccaatggacaacagttagcttccgctagtgatgacaacaccatcaaaatctgggatgtcagcagtggtaaactcctcaaatccctctctggtcatagcaatgcggtctatagcatcgcctacagccccaatggacaacagttagcttctgctagtgctgacaataccatcaaaatctgggatgttagcagtggtaaactcctcaaatccctctctggtcatagcgattgggtcatgcgcgtcacctacaaccctaatggacaacagttagcttctgctagtgttgacaaaacaataattttatgggatttggatttcgataatttattacacagtggttgc

SEQ ID NO: 43930 - DNA, 798 bp, Nostoc punctiforme
ttacaaattgcctttatcggcggtggcacgatgggcgaaatgataattagtagattgttattaacgaaaattgttccaaaagccgatctaattatagtcagcgatccagtttctgcgcgatgccttcatttagaaagggaatatggagtacgtactacaacctccaatatagaagcggttcttggcgcatctattgtgatattagcggtgaagccgcaggttttagcagaggttctaggtatgcttaaggataaaattccacctaatgctttagtaattagtattgtgagtggagcgaatatttcatctctgtgccaagggttgaatcatcctgctgttgtccgtacaatgcccaatattgcagtacaagttggtcatgggactacagtgtggagtgcatcatcaagtgtgacagagatacagcgatcgcatacccaagtcattttacaagcattaggtaaggaatttactacccaaaatgaacattaccttgatatggcaacggcgttgagtagcgcggggactggatttgtgtttctctacatcgaagcgatgattgatgctggcgttcagatgggtttaactcggacacaagcccaagaactaacattgcatacgattgctggtagtgtagaactgatgtttcagactcatgaacatccagcagttttacgaaacaaggtaacaagcccagggggagtcactgctgctggtctttacgagttagaaaaaggtggtatgagaactgttatttctaatgcagtacttgccgctttgagccgcaatcaacaattaggt

SEQ ID NO: 43931 - DNA, 1382 bp, Nostoc punctiforme
tcagacacgaatggcactaacgttcccattgctattgtttctatgggttgcttgctacctggagctgatagtccacaagcatactggcgaaatattcaagatggagtcaccggcattgttgatttaggcctcatcgatccttccttagtaccagattttatgtctgatggatctgtaattcctgagaaaacctacactttactcagtggcagaatcaatcaggtggaatatgaaaaaggtataccgtacagtctcgaagaattcaacaacttaacaagaggtcagcaactacttgctaaagcattagctcagtgtctcaatcccattcatcagcaagtatctgctaccaaaaaagtgcattgtctccttggctccacagctgacggcatcaaagagtacgatgaagctctgtttgctgaaagcttaaagtatttcgttgagaaactagacgaaccagagcagttgcgtaccacttttagcaattccctacaaaccttgctaggacgaaaaagtggagaacacgaatttctcgcacctgacctatgttacaagcgcgtagtccagaaattcttagcgatggtgtaaaaaccttactcttagatgctgcctgtgcttcttccctttacaccgttgacatcggcatcaaactactacaaaaccatgaaagcgacctagtactttcggggggtgtattcgcaccgggagtagcgatgaactgtctatttgctcagttcaaaggtctttctgccacaggtagccgccccttcgatgctaccgcagatggagtagttttcagcgaaggagcagctattctagcactcaaacgcttacctgatgcgatcgctgctggagatcgcatccacggcatcatccggggtgttgggacatcaagtgatggtaagagtgctgctgtgaatgtacctactaaagttggtcaagtattagcatgtcagcgagcttgtgagaacgcccagataaatccgaatacgattcagtacattgaagcccatgcaaccgctacaccagttggcgatggtacagagtttaagtcgctgtctgaagtgttcgacaaacgagaagcaaatttaccgccaatttatttgggtagtgtcaaagctttgattggtcatactggctgggtagccggaacagcttctattattaaagtttgccaagctttaaaagcccaaactattccacgtcagtataactacaaatcacccaataaagatattgaacttcaaggttcttgtttatccattccgacaacaccattgccttggccgaataacatagccggacaaccccgccgtgcagcagtaaatggctttggttttggaggtactaacgccaacttaattattgaagcttacgatcctagt

SEQ ID NO: 43932 - DNA, 735 bp, Nostoc punctiforme
cacaaaattgccttaatcacaggatctggaagaggtttaggtaaagttattgcccagcatttagcagagttgggtgcgactgttattgttaattcttttcattccactgctagcggagaagaaactgcggctgagattatagccaatggtggtaaggctattcatatttggggatctgtggctaatgaaacacagcttcatcaactttttgacaaaattgaggctgaatttggcaggcttgacttttttattagcaatgcttctaatggaatgcttgctcccttagaagagattaaagtagaacatttagataaagcatttcacacgaatgtaattggacttcaccagggagcgttacgtgctgccaaattgatgaagaagcaaggaggtggaaaaattattactctttctacaaatgcggctcatcgttacattccttattttggctgtatggctactgttaaagctgcggtagaggcattaacgcgatatcttgctatggaattcgagccgtataatatccaagttaactgtattagttctggccccgtgtacggtgaactaatcaataaatggcctgatagcgagaagctaattccttattgggaatctatttcactcggtaacaaactttgtatgcccgaagatgtcgctgacatggtttcctatcttctgcgagaagaagttaaacgcatcaatggcagtattctccttatcgacgctgggcaatctatc

SEQ ID NO: 43933 - DNA, 1467 bp, Nostoc punctiforme
tggcaaggtatcggcggcttggctgatgttctccaagaaatcagagagttagttgaaattccacttaaacgtccagatttattggtgaaattagggttagagcctccgcgtggggttttgctcgttggcccgcctggtacgggaaaaactttaacagcccgtgttttggcagaagagttagagttaaactacattgccatcaatggcccagaggtgatgagcaagtattacggggaagcagaagctcgtttgcgaagtatttttgagaaagcaactcgttctgctccctgcctgatatttattgacgaaattgacagccttgccccagatcgcagccaagtggaaggtgaagttgaaaaaagactagtggcgcagttgcttgggttaatggatgggtttgccaaaaccgagggcgtacttgtattagcggcaacaaatcgtcccgattatctcgatccggcgctgcgtcgtccgggacgcttcgatcgcgaagttcagtttcgggttcccgatcgcgatggacgattggaaattctcacgattttaacaagtgccatgcccttggagacttcggttaatttaggagcgatcgctgatttggctgtcggttttgttggtgccgatatcaaagctctttgccaaaaagcagcttacattgcccttcgtcgtcaagtcccctcactcaacagccccgttcctgagaacatgactatcgtacagcaggattttctcgaagcaattaaggagataaaaccctcagttctcagggatgtagcaattgaagtaccgagcgtcagttgggatgacattggtggtttggatgatgtgaaacaaaaacttcaagaatctgtagagggcgcactcctctatcccgaactatacgagcaaacaaaagccaagcctccccgtgggattctgttgtgggggtcgcctggaacgggaaaaaccttacttgcaaaagcgatcgcttctcaggctagagccaactttattgctgtgaatggcccggaattactcagccgatgggtaggtgcagcagaacaggcagtcagagaactttttcgcaaagctcggcaagcagctccttgcgttgtgtttatagatgaaattgataccctggcaccagcacggggacgattcactggtgattctggagttagcgatcgcgttgttggtcaactgctcaccgaactggatgggttgcatgaatgcccgaaagtactgttagtaggagcaaccaatcgtccagaagcgctcgatcctgccttgctcagagcaggaagattggacttacaaataaaaatcgatctaccagatcgagccagccgattagcgattttacgagttcacaatctagatcgtcccctggttgatgtcgatttagaaacctgggcgacagttaccgagggttggaatggagcagacttggctttgttgagcaatcaagctgctttaagcgccattcgt

SEQ ID NO: 43934 - DNA, 1878 bp, Nostoc punctiforme
ctggcaattcaaacaatgggtgagaatctagagaaatacccaaaccagcttctagctcctgttttgggaagcttaaaggaagcaatgaacacacccacagaggcaaatagcttgcgtggacacgagcaagaagtgaattgtgtagcctttagtcctgatggcaagtttattgctagtgggagtagcgattctacgctgtgcttgtggaatatcattggcaatcctactgctcaatttttgtgtggacacgagcaagaggttaattgtatagcctttagtcctgatggcaagtttattgctagtggcagtattgacggaattttgtgtttatgggatctacaaggtaatctcattactcaaccgtggcagggacatgaggaaggagttatttccgtcgcctttagcccaaatagcgatggctgcgccaacccctctggggtaagcattgtcagtgttggttttgacggaacggtgtgtttgtgggatttacaaggtaacgccattactcaaccttggcgcggacacaaggaaggagttatttccgtcgcctttagcccaaatggcgattgcattatcagtgttggttttgacggaacggtatgtttgtgggatttagaaggtaacaccatcactcaaccctggcacaaacatgaggcaaaaattatttgcgccacctttagccccgatcgcaagtttattgtcagtggtggtagtgattctacagtgcggttgtgggacatacaaggtaatcccatcggtcaaccttggcacgggcatgaaggacatgtaaattctgtagcgtttagccctgatggcaagtttattattagtggtagctgcgatcggacaatacgcttgtggaatatcaatggcaactctatcactcaaacttggcgcggacatgaaggagaggttaattccctagcctttagccccgatggcaagctgattatcagtggtggcgatcgcactgtgcgtttgtgggagctacatcaaatactacaagatcgggtcatcgggcgatcgcagcgcaaatatgagaattgggtcaattctgtagcctttagccctgatggtcagtggattgtcagtgccagcaatgattcgacaatccgcttgtgggatagcaatggcaaccccactggtcaaccttggcagggacatgaaaaagaagttaattctgtcgcctttagccctgatggtcagtggattgtcagtgccagtaatgattcgacaatccgcttgtgggatagcaatggcaaccccattggtcaaccttggcagggacatgaaaaagaagttaattctgtcgcctttagccctgatggtcagtggattgtcagtgccagtaatgattcgacaatccgcttgtgggatagcaatggcaaccccattggtcaaccttggcagggacatgaaaaagaagttaattctgtcgcctttagccctgatggtcagtggattgtcagtgccagtaatgattcgacagtgcgcttgtgggatagcaatggcaaccccactggtcaaccttggcagggacatgaaaaagaagttaattctgtcgcctttagccctgatggtcagtggattatcagtgccagcaatgattcgacaatccgcttgtgggatagcaatggcaaccccattggtcaaccttggcagggacatgaaaaagaagttaattctgtcgcctttagccctgatggtcagtggattatcagtgccagcaatgattcgacaatccgcttgtgggatagcaatggcaaccccattggtcaaccttggcgcggacatgagtattgggtaaattccgcagcttttagccctgatggtcagtggattgccagtggtagtcttgatggaacagtccgcttgtgg

SEQ ID NO: 43935 - DNA, 1620 bp, Nostoc punctiforme
ctgctccgctttagagcattttcgcaacccgacgaaatagcttatacatttttactagagggtgaaaaagatacagttaacttaacttatgcacaattagataaacaagctcaaactattgccgcttatttgcaattcaaagagcaagttctgctgttgtatccaccgggcttagagtatattgcagctttcttcggatgtctgtatgctggtgcgatcgcagttccagcttatccacctcgtccaaatcgctctttacaacgacttcagtcaattgttgctgatgcagaggctagtatagtactgacgaatacggctgttctctcaaatttagagcgacagttagcggaattacctgatttaagagcattaaattggctaactactgatagtactgataataatttagccaacaaatggcagcagccagaaatagatagcgattccctagcatttttgcaatacacatcaggttctacgggtacacccaagggagtaatggttagtcatggaaatttactccacaatcaaaagatgattcaggcaggttttcaaaatacagagaaaaccattattgttggctggttgcccttatatcatgatatgggtttaattggtaatgtactgcaacctttgtacttgggtgttcgctgtattctcatgtctccagttgcttttctgcaacgtccaattcgctggctagaagcaatttcccgctaccagggtactaccagtggtggccctaattttgcttttgacttgtgtatgcgaaaagtgactcctcaacaactatctgctctcgatttaagcagttggaatgtagcttttaatggagcagaacctgtacgtgtagaaacgattgaaaagttttcatccacctttgcatcctgtggtttccgaaaagaagctttttatccttgttatgggatggcagaaacaactttatttgtttctggtggaataaaaacagatgcacccgtttacatcacagttcgagaagatgaattagcgcaaaaccgcatcgttttagcacaaggaaccgaaggaactcgaactttggtcggttgtgggcagacttacattaatcaagaaattgcgatcgcaaatcctgaaactttaattcgctgtgctgctgatgaagttggcgaaatctgggttgcgggttcgagtattactcaaggttactggaatcgtctcgaactaaccgagcaagtatttcgggctaatcttgctgactcgaaaaaacagtttttccgcacgggagacttggggttcctgcataatggtgaattatttattactggtcgtctaaaggatttaattattattcacggtcgcaaccattatcctcaagacattgagatgactgtagccgatagtcacgaggcattaatactcggagccggggcagcttttacaattgatagcaaaggggaagaaagattagcgattgtacaagaaatagaccgtcattacagaaacttagataatgatgctgttaccgaagtgattaggactgcgatcgcacagcagcatgaattacaagtccatgcgatcgcactgataaaaatgggtagtatttgcaaaacgtcgagtggcaaaattcagcgtcatgcctgc

SEQ ID NO: 43936 - DNA, 1317 bp, Nostoc punctiforme
ataaacccagaagtggaagtaatgttagataaagctttactagctcaaaaagaaattcaaacttggtctgaagaacgtatagatgccttattactggtaattgcttcatcgattgcacaacatgccgaatcattagcaacagcaacagtaaaggctactcgtgttggggatattttggataaagttactaagaataaaattgctagcttaggtatttaccgctcgctggttggcaaatctggatgcgggtttatctcgaataataaaattaataatgtttgtgaaatagcaagtccaatgggaattatttttggaatgattcccatgactaacccagttgcaacagcggtttttaaagctttaatttgtataaaaagtcgtaatgcactgattttaagtttcccactttctactaagaatgttggcacgttagtttgtgaaattattcaggaagctttaattcggcaagatgcacctgtagagctgattcagtggttaaaacatcgcagttcccgcgaacaaacagaaatattaatgaagcacaaaaacgtctctttaatcttagcaacaggaggtgcgagcatggtgaaagctgcctatagttcaggaactccggcaattggtgtaggtcctgctaatactcctaccttaatttgtgcggatgcaaatattcaacatgctgcccgcactattattgtaagtaaatcatttgataatggattaatttgtggttctgaacataatttgatagttgatgcacgcgttaggaagaactttattaaagtattagagcaagaaggcgcggcaatacttacgcatgaagaaaaaagctactttagcacagttgcttttgaagataaatcgaatcgattgcaagcaaaaattattggtcagtcagcggctaaaattgccgttatggcaaatattaaacgcgattatcacattaaattaattatagtcccgaatgaatttctaagtttagataatccctatgcttatgaaaagatggcaccgatattgagtttatttacagttcaaaatgagattgaaggtatagacctttgtcggtcgatactacagatagaagggaaaggacatacagcaattatacacacgaaaaataaggcagtggtgagaagatttggtttagaaatgccagccagtagaatattagtaaattcgccgggggtacatggaatcataggtcttacaagtgctttagacccatccttcacattagggtgcggcacatttgggggaaattcaactactgataatgttacttatagcaatcttttgaatttaaaacgggttgca

SEQ ID NO: 43937 - DNA, 1011 bp, Nostoc punctiforme
atggaactgggaatgataggactaggacgaatgggagctaacatggcacaccgtctaacccaggctggacataccgtcattggctacactcgtcagccacaaaaagcagaggtgctggttcaggaaggagcgatcgcccgtggtgtaacatcattcgttgaactcatcgaagcactcacgccaccccgcgccgtctggctgatgctacccgcagcgacagtagatgctaccctacacactctcatgccgtttctagacgctgacgacattatcattgatggtggcaattctcactacattgatgacattcgtcgtgcagatcaattaaaagtcaaaggaattgaatacattgattgtggaactagcggtggcatttggggggcagaacgcggctactgtctcatgattggtggtgcattggcggtggtgaaatatcttgaccccatctttgcagcgctggctcctggtgtatcagctgcaccgcgcacccctggtcgtgagttaatggggggaacagctgaacagggctatttgcattgtggctctcacggtgcagggcactttgtcaaaatggttcacaacggcattgaatacggcatcatggcagcttatgccgaagggttgaacattcttcaccatgctaatattgggaaacaattgcatcaaatcgatgctgaaactgctcccttacgaaatcctgaattttaccaatacgactttaatcttgcagatatagcagaggtatggcaaaggggcagcgtaattagctcttggttactcgatttaatcgcgatcgcccttctcaaagaccccgacttagccaacttcgaggggcgcgtatctgactctggagaaggtcgatggacactaatggcagccattgaagaaggagttcctgttcccgtccttagtacagctctctacacacgatttagctctcgcggtcaatcagactttgccaataaactcatttctgcgttgcgctacgagttcggtgggcatttggaaaaa

SEQ ID NO: 43938 - DNA, 1350 bp, Nostoc punctiforme
tccgatgccctggtattttttgggatcacaagtgatttagcctacaaaaaaatctttcctgccttacaggcgatgattcaacgcggtcattttgacattccaattattggagtgggtaggcgagattggagcatcgaacaattacaatcttatgtgcgtaagagcctggaggaacaggccagcgttgatgaggcagctttccagaaactgtgttcattactttactatatttttggtgattatagcgatcgcgctacctatgataaattatgccaggtactccaaatagctgaagctcctctgtattacttagccattcctcccagtttgtttgcgacggttgtcgaagggttaggtcaatcaagttgtgtaaagaatggtcgcgttatggtagaaaaaccctttggacgcgatctagaatcggctagaatgctgaactgcattctgcactctatctttcccgaaagtcatatttttcggattgaccattacttgggaaaagaaccagtccaaaatcttctctacactcgcttcgccaattcattacttgaaccgatttggcatcgcgtcagtattgccagtatccaaatcacgatggctgaaaaatttggcatcgatgcacggggacagttttatgaagagacaggcgctattcgggatgtggtgcaaaatcatctacttcaagtgacggcgtgtttaatgatggatccgcccatcaacgagcagcatgaagccatccgagatgaaagagcgcgattgctcaaatccatagatccaatcgaaccctcaaatgtagtgcgtggacagtacaagggctatgcctcagaacctggtgtagctcctgattccaaagtcgaaaccttcgcggcggtcaagctcaacattgatacttggcgctgggctagcgttccgatttacattcgtgcaggcaaatgtttaccgagtacaactactgaagttgtggtcaggctcaagcgtccgccgcaggatgtttttggcgagcgtgcctttggattagcaaattatttctactttcgtcttagtccaaatgtgctgactgcgatcggcattcgctctaaaaccccaggcgacggaatggtgggtagcgaagtcggactagtcgctcaagttgagcatggcaatgagatgaatccctacgagcggctttttgaagatgccatgaaaggcgactccatgttatttgctcgccaggatgaagtagaagcacagtggcaaattgtcgctcctatcctagatcgagcaacccctgtttacgaatacgcacctcatacctgggggcctcctttagcggatcacatgattcccccagatggcggttggcataatcct

SEQ ID NO: 43939 - DNA, 1293 bp, Nostoc punctiforme
cctcgtataccccatttaataacttccttacctggacctcttgctcaagcaattgtacagcgcgatcgcgccgtaacttccccttcttacacccgtgattatccgttagttgtatctcgcggacaaggctgtatggtagaagatgtggatggcaatgtatttctggatatgaccgcaggtattgctgttaccgccaccggacacgcccacccggaagtcgtcaaagcaattcaagaacaatccgaacgtctgctgcacatgtcagggacagatttttattatgaaccgatggtggaactggcggaacaactagcgattcgcgccccttttcctcaaccacagggtaacagtgcattcccggcaaaagtatttttcaccaattctggggcagagtcaaatgaaggagcgctaaaactagctaaatattacaccaagcgatcgctaattgtggctttcttaggcgcatttcacggacgcacttatggggcaatgtctctcacgggttctaaagcagtgcagcgagcgaattttgggcctttagttcctggggtaactcatatcccttatgggactcacgccagcttagattacctggaacaacagctatttgggacaattttaccaccgcaagaagtagccgcgattgtagttgagccgattcaaggagagggtggttatatcgtaccagaggatggttttttaaaacggattcgggatatttgcgatcgccacggtattctgatggtagtggatgaagtgcaagcgggaatggggcggacaggtcgcttatttgcgatcgagcattggggagtgatgcctgatattattactactgctaaaggtatcgccagtggtttgccattaggagcgatacttgcaaaacctgagttaatgacttggcctcctggttctcacgctactacatttggcggaaatcccgttgcttgtgctgccggtattgctacactgcgattgttagaaagtggtttgatggcaaacgctacccaaatgggagaacttttacaagctagccttagtgagttgcaccaaagatttccgagagtatcgccgccacgaggtaaaggtttgatggttgcagtggatttattggatgaacaaggtaatctagatcgtgaattgcgcgatcgcattattcaagaagcttttttacgcggtttattattactaggttgcggtaaagcagcaattcgtttctgtccccctctagttatcgacagcgaccaaattcaaatagcccttcagattatcagcaacattctaacttcttaaaag

SEQ ID NO: 43940 - DNA, 1107 bp, Nostoc punctiforme
ttgcaagttaaagcagcagtggcttacagcgcaggtaagccgttaacgattgaaaccgttcaattatcgggaccacaagctggcgaagtgttggttgaggtgaaagccagcgggatttgccatactgacgcttttaccctatctggtgacgatcccgaaggtttgtttccggctattttggggcatgaaggtgctggtgtagtagtggaagtaggcgctggtgtcaccagtctgaaaccaggagatcgtgtgattcccctatatactcccgaatgccgccagtgcgaatattgtctgagcttcaaaactaatctttgtcaagccattcgcttaactcaaggacggggtgtcatgcccgatggcaccagtcgctttagcattgatgggcagatgattcatcattatatgggtacatccacttttgccaactacacggtgctgccggaaatcgccgtggcaaaaattcgggaagatgccccatttgaaaaggtttgttacattggctgtggtgttactactggtattggtgcagttatcaatactgcaaaggtggaaccgggagcaaatgtagtagtttttggcttgggtggtattggtttaaatgtcatccaggcggcgcggatggtaggggcaaatatgattgtcggggtggatattaatcccagcaaacgcgccttggcagaaaagtttgggatgacgcactttgtcaatccccaagaagtagaaggtgatttagttccctatctggttgacttaacaaaaggcggtgctgattacagttttgaatgtatcggtaatgtcaaaattatgcgtcaagcattagaatgttgccacaaaggttggggtgtcagcgtgattattggggttgctggtgctggacaagaaatcagcactcgtccttttcaattagtaactgggcgcgtttggaaaggttcagcatttggaggtgcgagagggcgtacagatgtgccgaaaattgttgattggtatatgcaaggcaaaataaatattgatgatttaattactcatgtgatgccgattgaacaaattaatgatgcttttgaattaatgcacaaaggtgaatcaattcggagtgtggtgactttt

SEQ ID NO: 43941 - DNA, 1248 bp, Nostoc punctiforme
ctaactcaaattggcgctcaaatgtccaaactgactggcgtaagagcaatcatgaaggatattatcgagacattacgagcgggtgcagggcagcagtttattaatttgagtgctggtaatccgttgattttgccagaagtagagcaattatggcgggattgtactgcacagcttttggctagtccagaatatggtgaagtagtttgtcgctacggctcaagtcagggctatacaccattagttgaagcgatcgctaacgactttaacaaacgctacgggttaaacttaagcgaacgcaatatcctcatcacccccggtagtcaaaccctctacttctacgctgtgaatagcttcggtggctacacccctagcggcgagttaaaacaaatcgttttgcccctcagccctgactacaccggttacggcggtatctgcttagttccaaaagccttaattgcttacaaaccgactctcgatattgatgaagccgcccaccgatttaaatatcgccccgacttcagccaactgtcgattacagaagatacgggttgtgtcctcttctctcgcccttgtaatcccactggtaatgtcctcactgatgatgaggtgaaaaagattgctgccctagctgcgccttacaatctgcccgtattaattgactccgcttatgcgcctcccttcccggcattgaattttaccgaaatgacaccagtgtttggtgataatattttacactgcatgagtttatcaaaagctggattaccaggagaaagggttggtattgccattggggatgaaaagtggattgaagtgctggagtgtttccaagcaaatattggtctccattcttcacgttacggccaagcgatcgcagctcttgcaatcaattctggcgctttagtagaaatttctcacactgtcatccgtcccttttaccaaaataagtttagcgttttagaaaccagcttagaacaagcgatgcccaaggatttaccttggttcctccatcgcggtgaaggagcaatttttgcttggttgtggttagaggatttacccatcagtgattgggaattttaccagcaattaaagcaagtaggtgtgattattgtccctggaagcaccttcttccccggtttagaggaagagtgggcgcacaagcaccaatgtttccgcatcagcctcacaggtacagatgaagagatagccactgctatgcaacgtttagcaaaagtggctgaagaagcttat

SEQ ID NO: 43942 - DNA, 840 bp, Nostoc punctiforme
attccaataattgatttatcacagttccaaattagcaaccaagtaaggcgacaaaatgtagttaaaaatatttatcaagcctgtcatgaaattggatttatgtacatccaaaattccggcatatcaccggatttattagagcaagttttttctgcaagtaaatctttttttgactcaccattggcagtcaaggaacagttagcctggaacaatgaatttattaatacaggttatgttggcttggaaagagaacacctcaatcctaatcaaccaggagatttaaaagaggcttttaatataaaaaatgacataataattaataatttttcatctcctatcttacttacaaacaatcctgtcatatctactttttacaatgcttgtacagaattagctaatactgtactgcaagcttttgctttggcattagaattgcctgaatatttttttacgactagacataatcaaaaaaatcataccttgcgactattacattacccgccactacagacatcgcccaaacctggacaagtacgtgctggtgaacattccgattatggcagtcttactttactgttccaacatgcagtaggaggtttggaagtgcagacaactaggaaagagtggattgccgcaccattgattcctgggatggtactagtaaatactggtgatttaatgcagagatggacgaatcatatattttgctcgactaagcatcgggttatgattcccaatgatgagagagtaaagaagtcaaggtattctattgcttttttctgtcatcctaatgatgatacagaaattgcttgtctagaaagttgctcccagaggcaatca

SEQ ID NO: 43943 - DNA, 1248 bp, Nostoc punctiforme
atgattgaagatggtgaagcgaatgaaattaagcgagattatctagatattttagaatctctcctgaaactcatccatgcgaaagctaaagaaaaaggattagatcccaccaaggatgttcatatttactctagctctagcaaagtttatcaaggaacattgggagaatccccctctaaaaacttattaacaccaacgatagtagagaacttaaaaaaagctctgtctgacccgaaaaattctcaaggggcaatttctattaaaattggtaatgaaaaagtattccatattaaaaatggagaagtactgactgacaaattaggtttagctccggcatcacagaaaaataaagttgtaagtaatgagcgaatctacagtgtagaagctttaggaaaacaagtgcaagtattgcagaaaaaactaagcgaacaacaaaaacttgtagatagtatcaaatcagaacagctttcacccgaatctttatcacaactagctgctcaagttgccgaaatgagtaaatccttggagaagcagcaacagttgattgaaaacacccaaaaagcattgtcacaggtaaatgaacggtttttaccacaagttcaaaatacggttcttcaaaattgggtgggtacggttgagaacaaggtaaaacaaactgctaagaatgtttttgagcggattaaagatgtgctgacacccgaagtaacgaagctcagaaaggaaattgcttcacttaaatctcaaattaatgaacaaattactagcttccaggatgaagttaaatatcagactgacagtgtaagaaatcaactcaatcaacaagttggtaacttaactcaagagatacgtacacaggtagatagtgttaaaaacacggttgatcaaagccttatgggtgttcagtcagccattgataatactcgaactgaactacgggctgctgttgaggatgccaaatcccaagctattgagcaaagtgttaaagccctgcttaatattttgggcaaagataaccctgatggttctaagagttttaaaagtagaagttttgattttgaacgccttggtgataatgtaatcgttcgtgccaaaaacggcgagcctgttctcactgatggagttttatcacctaacgtaagtgaccaacagttacaggcacttgataaggttcaatcttttgttgatatgcatcatcaaattcagcaggattctcaacaagaatcacaatttagaaatatgcacaggtaa

SEQ ID NO: 43944 - DNA, 756 bp, Nostoc punctiforme
aaattgctcaaaactcttactgaatccaagggcgaagtttccgaggtttcattcagtggcgatgataatttaatcgcgcttttcacttccgatgatacggtaaaaatcaagaagcgagatggtactttaattgctagttacaaatctcatcacagcaaactgacatcaggggtgtttagtcctgacgggcaaacaattgcaatggcaggtgttgataaaaatgttcagatatcgaggcgcgatcgcctctggccgggcgtagcccatcgcgccgcaactttgcagattctcaaaggacatcaggcggaagtttggcacgtcgtatttagcccagatggtaagcttgttgcctcagccagcggtgataatactgataagttgtggacgcttgacggcaatttatttagaacccttgtaggacactcagcagcagtatggagagttgtttttagccaagatagtaaaatgctagctactggaagtggcgacaacacggttaagctgtggacgttagacggcaagttattgaataccttcaaaggtcacaaagctgggatttggggaattgcctttactcctgatggaaaaattgttgcttctggcagcgtcgatgccagcattaaactttggaagctagatggtacggaagtaacaacccttactggacataccgcagcgattagggtggttgcaatcagccctgatggaactttgcttgtttcagggggtgatgacaacacgctcattctgtggaat

SEQ ID NO: 43945 - DNA, 594 bp, Nostoc punctiforme
acggtgctaattacaggtgcttctgaaggcattggcaaagcaacggctcttttatttgcgcggcaaggatatgacttggtacttgcagctcgtcatgctgaccgcttggaagccttagcgcaggaagtgcaaagcattggctgccctgcaccattaacgattacttgcgatgtcactgactcatctcaggtaaacgcgttagtgcaaaaggcattaggaaattatggctatatcgacgtgctgataaacaatgccggcatctttgcatcggggccagtagagcagttttctcttagtgattggcatcaaattatagacactaatttatggggatatatccacactattaatgcccttctgcctcatttcctccagcgtcgaagtggaactatagttaatttaagttccatcggtggtaaggtgccaagtgcttacttggttccctattgtactagtaagtttggtgtgacagggttgacggaatcgctgcaagtagaactacagccaaaaggtattcatgtttgtgggatttatccgaatttaattaagagtactttaatggaacgggcagtttttcgaggccaggatgagcaa

SEQ ID NO: 43946 - DNA, 500 bp, Nostoc punctiforme
tcctccctgtctgggggtatgaaacgacgtttgcagattgccagagccttattgcatcaaccgcaaattctgtttttggatgaaccaacggtagaattggacccccaaaccaggcgaagtctctgggaaattattcgggatttaaataaacaagggagacgatgctactgacgacccattatatggatgaggttgaatttttgtgcgatgctttttgctttaccaagctaggatgcatcggtattatggatggcgataggctgatttgtttcggaactttaccacagctccattctgtttacgaaaaaggtttagtgatgaagcaattgagtgtgtctgaagtgggaaatgatagcgtccgtagttggaaatatttgtttttccaatctttggaagcagtaaatgtctacttaaatgaacagcccgataaaaccggaatggtggtgcgtccctctaatctggaagatatttttgtggaattaacgggacgctagttagat

SEQ ID NO: 43947 - DNA, 552 bp, Nostoc punctiforme
atgacaagtcaggtagcggcagccgaagtagcccagccttatgcacaggcgcttttgtcaatagcgcaatcgaaaaatttgacagaagagttcggagaagatgcgcggactttcctgggactgctcagagcagacaaacagctacacaacttcttcagcaacccgtttattcaggctgagaacaaaaaagctctcatcaaacaaatactcggtgaaggctctaacccctacttacgcaactttttgttgatactagtagacaaacgccgcattgcattcttggaatcgatttttcaacaatatctggcgctgttgcggcagctgaatcaaaccgtattagcggaagtaatttcagccgttcccctcacagaagctcaacagcaggcaatcatccaaaaggtcattgccatcagtaatgctcgccaggtagaactagaaaccaaggtagacagtgagttaattggtggtgtgattattaaagtaggttcgcaggtaattgatgccagtatccggggtcagctgcgtcgcctttcattgcgcttaactaatagc

SEQ ID NO: 43948 - DNA, 1509 bp, Nostoc punctiforme
atatcaattagacctgacgaaattagcagcattatccaacaacaaatcgagcaatacgatcaagaggtcaaagttgctaacgttggtactgtcctacaagtaggtgacggtattgcccggatctatggtctggaaaaggctatggctggggaactcttagaatttgaagatggcacaattggcatcgcccaaaacttagaagaagacaacgtgggcgcggtgttgatgggtgaagggctggaaattcaagaaggtagttctgtaaccgctactggtagaattgctcagattccagtcggagaagccttaattggaagagttgtagacgctttaggtcgtcccattgatggtaagggagacatcaaatcctcagaaagccgtttgattgaatctccagcgcctggtatcattgctcgtcgatctgtacacgaacccatgcaaacggggattacagctattgactcaatgattcccatcggtcgcggtcaacgggaattgattattggcgatcgccaaaccggtaaaactgcgatcgcgatcgacacaatcatcaaccaaaaagaagaagatgtaatttgtgtatacgttgcgatcggtcaaaaagcttctaccgtagctaacgtggtgcagacattgcaagaaaaaggcgcaatggattacaccatcgttgtcgcagctagtgccagtgaaccagcaacactacaatacctagctccttacacaggcgcaactattgctgagtactttatgtacaaaggcaaagctaccctggtaatttacgacgatctctccaagcaagcccaagcttatcgccaaatgtccctgttgctgcgtcgtccacccggacgcgaagcttaccccggagatgtattctacattcactctcgcttgttagaaagagccgcaaagctaagtgatgaattaggtaaaggcagtatgaccgccctaccaatcatcgaaacccaagctggtgacgtttcggcatacatccccaccaacgtaatttccattaccgatggtcaaatattcctatcttctgacttgttcaacgctggtatccgtccggctgtgaaccccggtatttcagtatcccgcgtgggttctgcggcacaaaccaaggcaatgaaaaaagttgccggtaagattaaattggaactagcccaatttgacgacttgcaagccttcgctcaatttgcttctgacttagataaagccactcaagaccagttggcacgtggtcaacggttgcgcgaacttctcaagcagccacaaaattcgccactctcggtatacgagcaagtagcaattttatacgctggtattaatggttacttagatgacgttcctgtagataaagtcaccagctttacccaaggtctgcgggagtacttaaagactggtaaaacacagtatgccgaaggagtaagaacctccaaagcactaggtgatgcagaagaagctgctttgaaggaagcacttaccgaatacaagaagaccttcaaagcagca

SEQ ID NO: 43949 - DNA, 945 bp, Nostoc punctiforme
atggccaatctaaaagcaatacgcgatcgcattcagtcggtcaaaaacaccaaaaaaatcacagaagccatgcgtctcgtagctgcggctagagtgcgtcgggcgcaagaacaagtactagcgactcgcccctttgccgatcgcttggcacaagtattatatggtttacaaagccgtctgcgctttgaagaagcaaacctgccactgctgagaaaaagagaagttaagtcagtcgggctattggtaatttcaggcgatcgcggtctatgcggcggctacaataataacgttatccgtcgtgcagaaaatcgcgccaaggaaatcaaagcagaaggtttaaactatcaatttgtactcgtcggacgcaaatctacgcagtactttcaacgccgcgatcagcccattgatgctacctacagtggcttagagcaaattcctaccgcagcagaagctaatcagattgctgatcaactactttccttgttcctttcggaagaagtagaccgcatcgaattaatctacaccagattcctttccttggttagctcccgtcctgtggtgcaaaccttactgcccctcgatccgcaaggtctagaagcagccgatgatgaaatcttccgcttgacaacccgtggcggtaaatttgaagtcgaacgggagaaagtggctagccaagtccgcccgttggctcctgacatgattttcgagcaagatccagtacagattctcgattctttgttgcccctgtatctgagtaaccagctattgcgggcgctgcaagaatctgcggctagtgaactagcagcgcggatgacagctatgagtaatgccagtgaaaatgcgggtgaattgattaataccctcacgctgtcttacaacaaagctcgacaagctgcaattactcaagaactccttgaggttgtaggtggtgctgaagcactaact

SEQ ID NO: 43950 - DNA, 1218 bp, Nostoc punctiforme
tggcagcgtatccctctcacattgcaaattctcatcgccttagtagccgcagtcagcgttggaattgcccttggtgcgggaaatcccaatcccagcaatgccactttaattaacaatttagcaattccggctgagttggtgctaaaggctctccgcgccctagctacgcctctaattctggtagcggtgctgcataccttaatgactaccaatatccccggtacagccggacggcggctggcggtgctacttttgactaacactacagtagctattttagtaggacttttcgtagcaaatgtgctgcgtccaggaacttggggcaatgtagctacctcaacaactacacaaataactactcagagtcttgacccttggggaatactcaaagatgctgtaccggaagctgtcctcaagccattagttgataataatgttattcaactaattgttattgccctaagttttggcatcgtcctgcggggattaaaatctgaacaaattgcccaagggaaaaaaggataccaaccaatagaagatgtcatcgggattttattcgaagcggtagtccgcgtcctcaactgggtaatagccttagtgcctttcgccgtttttgggattgttgctaaaacagttgctatgcagggatttacaccgtttaaatctttgggtgcatttattctggcggtgctgttagcattggcattgcaggcgtgctattaccttactagagtaaaatttggttcttgggtacccccgctaaaattcctagctggcggatctgatgcctttttaacagctttttcaacttcttcctctgcggcggcaatgcccgtaacttttgaggttttgcaaacaaaagttggtttaagagaatcttctgctgctttgggggcattagtcggggcaaattttaataatgatggcactgccctttatgaagcaatgtctgcgttgtatatttcccaactaattgggcaacatctgactctaggacagcagttaattgtcattctgacctcgatttttgcatctgtaggtgcggcgaatattcctaatgctggactagtaacaatgacactagtgttcacttctgtaggcttacctacccagtacattgctttgctggttaccatagactggtttttggatcgctgccgcaccgcgattaatgttatgggagatatgactgtcagtgctttacttgacggcaaaaag

SEQ ID NO: 43951 - DNA, 1827 bp, Nostoc punctiforme
aataaaagatggagaaatgcagggctgtacgcgctgctgtttattgtcgtaattgcgctgggaacagcattttttgacaaacaaccccaaagcagagagacatggcgatacagtcgctttattcaagaagttcaacaaggcagagtagaaaaagtcagtttgagtgcagaccgttctacagcactggttacacccaaatatgacccagctaaacggattgttaccttagtcaacgatccagacctaatcaatactttgacttctaaaggcgttgatatttctgtattgccccaaaccgatgaaggattttggtttaaggcactgagcagcttatttttccctgtattgcttttggttggcttattcttcttgttacgtcgcgctcaaagtggcccaggcagccaagcgatgaactttggcaaatccaaagccagagtccaaatggaaccacaaactcaggtgacatttggcgatgtcgctggtattgaccaagccaagttggaattaaacgaagttgtagactttctgaaaaacgccgatcgctttaccgccgttggtgcaaaaattcctaaaggtgtactgttagttggtcctcctggtacaggtaaaaccctcctagctcgtgccgtagctggtgaagcaggtgtacccttcttctcaatctccggttcagaatttgtcgaaatgttcgtcggtgtgggtgcatctcgcgtccgcgatttgtttgaacaagctaagaccaacgctccttgtatcgtcttcattgatgaaattgacgcagtaggtcgtcaacggggtgctggtttaggtggtggtaacgatgagcgggaacaaaccctcaaccagttgctcaccgaaatggacggctttgaaggtaatacaggcatcatcattattgccgctaccaaccgccctgatgtcctagatgcagccctgttgcgtcctggtcgctttgaccgtcaagttgtggtagaccgtcctgactacgccggacgcagcgaaatcctcaaggtacacgcccgtggcaaaaccttggcgaaagatgtggatttggataaaattgcccgtcgtacccctggatttactggcgctgatttatccaacctgttgaatgaagctgcaattttagcagcacgtcggaatttgactgaaatttcaatggatgaaatcaacgacgcgatcgatcgcgtattagctggtccagagaagaaagaccgggtaatgagcgaaaagcgcaaaaccttggtggcatatcacgaagctggtcacgccttagttggtgctttgatgccagactatgacccagtacaaaagattagcatcatccctcgtggtcgtgcaggtggtttaacttggtttacccccagcgaagaccggatggacacaggtttatacagccgcgcttatctggaaaatcagatggctgtagctttgggtggtcgaattgctgaagaattaatctttggtgaagaagaagttactactggtgcttctaatgacttgcagcaagtagcacgggttgcgcgtcaaatgattaccagatttgggatgagcgatcgcttaggcccagtcgcccttggtcgccagcaaggtaacatgttcctaggacgggatatcatgtcagagcgtgatttctctgaagaaactgccgccgccattgatgaagaagtccgcaagcttgtggatgtagcctatacacgcgctaaagaagtgttagtaggcaaccgccacattttagatcaaatcgcccaaatgttggttgagaaagaaacggtagatgccgaagagttgcaagaaattctatcgaataacgatgtaacaactgct

SEQ ID NO: 43952 - DNA, 948 bp, Nostoc punctiforme
atgcgttcctacagcttaattgcccctgctaaaatcaacttgtatctggaaatcattggcgatcgccccgatggttatcatgagttagccatgatacttcaaagtatcggactttcagatcaaattgatgtgcgttccatcagcactgacagcattcgtgttcactgtaaccacccacaagtaccgacagataaaagtaatctggcataccgggcagcagaattaatggtcaggcaatttcccgaagcctttgctaaatatggcggtgtggagattaccgtcaataagcagattcctgtagcggctgggttggctgggggttcgacgaatgcagcagctgtgttagtgggcatagatttactgtggaagttgggattaactcagtctgaattagaagagttaggaggtacactcggttctgatgtcccattttgtgtagcaggtggaactgcgatcgcaacaggtaggggtgagcaactttctcccctgccgagtttagataacatatatatagtattggggaaataccgcagtctggaagtttccacaccttgggcatacaaaacctatcgacagcagtttggccattcttatattatagataccgataatttggcagcccgtgctagtgcagttcattcaggagcaatagtcaaagctattttgcataaagatacgagggaaattgcccaaaaattgcacaatgatttagagcgtgtggtattgccagcctatccccaagttttgcatttgcgagaagtgtttgcaaatcaggaaggcgttttaggaacaatgatgtccggttctggcccaacagtatttgctctttttgaatctcaacagcaagcagaactagttttgcagcaagtaagggaagcaattattgatgaggacttagaattgtttgtaactcggacaattacgcatggtattaaagtgacatcatct

SEQ ID NO: 43953 - DNA, 1707 bp, Nostoc punctiforme
acgttagttgatgtactcatttatcgagcaaagcaccagccagaacaaaaagcttatacatttttaaaaaatggagaacaagaagcagatagtttgacttatcaagaacttcatctgcggtctagagcgatcgctggttctctgcaagctcttaatcttgttggagaacgggcgctactcttttatcaacctggattagattttattgctgccttctttggatgtttatatgctggagtagtagccgttcccgcctatccaccaagaaaaaatcaaaatctgagtagactacaggcaattacagctgatgcccaagctcaaatagtactcactacaaccacattactgaataaccgtgagctttttgctgaacaggagttagaactaggacagttgcaatggttaacaaccgatgtgttaactaatgaactcacacaatcatggcagcaactaaaacttgaagagaattccttagctttcttacaatacacttctggttctactgggaatcccaaaggtgtaatggtcagtcatggcaaccttttacataattctcgcgcgatcgcccaatgttttggtcattcatccaacagcaaaggtttgatttggttacctccttaccatgatatgggattgattggtggtattttacaacctctttacgctgggtttcccgtggtattgatgtcaccagtagactttttgcaaaaacccatacgttggttacaagcaatttctcgctacaaagctactactagtggtggtccgaactttgcatatgagctatgcctgcgtaaggccacacctgaacatttagaaagtctagacttaagtagttgggatcttgcttttacgggtgccgaacccattcgtgctcaaacgttggagcaattcaccaaaacttttgcaccctgcggttttaatcaaaaagcattctatccatgctatggtatggcggaaacaactctgattgtttctggaggagaaaaaacagaattaccaatcctttgtaaagttgatcctgcagcactagaacaaaatcgagtagtcaacgttatagatgaacagattgatgctagaaccttggtcgggtgtgggcaaagctgtcaagatatgagcattgttattgtcaatcccgagtctttaagtgtttgttcggagaaacaaattggcgaaatctggatatcaggttcaagtgtgactcaaggctactggaatcaagctgaactcacagagaaaaacttctatgcttatgcagatatgggagaaggtccatttttgcgtacaggagatttgggatttttacaagatgatgaactgtttgtcacaggtcggattaaagatatcatcattattcgtgggcaaaaccattatcctcaagatattgaactcactgtagagaagagtcatcctgctttgagagtaggttgtttagctgccttcgcggtagaatccaaaggttctgaaagattggttgttgttgctgaagttgaaagaacttacttaaagaaattaaacattcaagaagtcgtcaataagattagacaaacagtagtaacagaacatgggttagatgtatttgctgtggtattggtgaagactggaagtattccaaaaacttctagtggtaaaattcgccgttacgtctgtcgaaccgcatttttgtcaggcagcttggatgttgtccaagactggagtgaaagtcca

SEQ ID NO: 43954 - DNA, 663 bp, Nostoc punctiforme
gcgattgtcacaggtgcttcttccggaattggtagagcatttgctcatgatttagcccaacgagggatgaatctgattctcgtagcccgccaacttgcagggctggaagaagtagccgcagaatgtaactcttgggaaacaaaaacttacttgtgtgccgttgatttgaccgagcctaatgggatacataagctgatatctttagttggcgatagagaagttggcattttagttaataatgtaggtattgttgctagaggtttatttactaaaattgaacttcaaagacaactagatatggtaacgctacactgtactgttcctgtagcccttacgcaccattatttagctcagatgctcaaaagaaatcaaggagctattattaatatttcttcggtggctgcttatcattttcaacccttgttgacaacctatgctgcaacgaaagagttcgattggaagtttagtaagtctctagcttgggaactgaaagatacagacattgatatattaactgtagtaccaggattcactaaaacagcagcctatgaggctgccgactggaaaattgattttgattctattcctgctttatttaagccgcaaaatccacgagaagtatcgaaaaaatctcttgatatccttggtaagcaacgctcaatt

SEQ ID NO: 43955 - DNA, 1017 bp, Nostoc punctiforme
caaatgagcaatttacaaaaagttattgtttttggcgcaagtggttttctcggcgagcatattatcaaatccttaatcagtgaaaattgggatgtctatgctgctgtgagaactaaacccgagtcttctaccgatggctttaaccagactcaagtaacctactatgaaggagacttagaagaccaaaagtacatccaggatgctatcgccgggatggatgcaattattttttccgcaggatgtacttggaagagtgatttggagatttccgaatactatcgacgcaatgtccaaattaccaagaattttttcactgctcttggcgatcgccccaatgttcggattgtctacacatcctctatgtctgtcatcgcaggcagtaaatctgattatatcttctttgaggatagcgatcgctctcaagtcagccaaaatcaattaagtccttacgatttagccaaaatcgaatgcgaacagatagcactggactatgctcaaagaggtaataatcttgtaatactaaatcctggtaatatgttgggaccaggagtttttaaccattccaaaattactacatcgattctcgtcttatggttttgtcaaaaacaatttccattctacataaatgggggacactcctattgcgatgttcgagatgttgctaaagctcatgttgcagcactaacccgtggacgcagtggtgaacgctacatcgtggctggagacaacttagatatggcaagtatctctagtttactggtgaaaatgactggctttaagatgcctcaacagttacctgctagcggcgtatatttgttatcgttactactggaaagtttatctttattaagcttcagattattcaaaaatccctatcatccagatttcgtcaaatcttttgccctgcattattatgctaattctcaaaaagcaattaaggaacttgcttacaatattactcccatcgaaaccactcttatagatactattaaatattttggtaaacgggaactgcta

SEQ ID NO: 43956 - DNA, 2097 bp, Nostoc punctiforme
gattgtggtgcagcttgtttagtgatggtgtctcggtattgggggaaaaactttagtgtaaatcgcttgcgggatatcgccaatgttgaccgtaatggctcatcgttgcgggggttatcggcggcggcagaaagtattgggtttgctacgcgaccagtgaaagcgagtcttgaccaattggccaagcaaaaattgcctgcgatcgcccactgggaaggcaagcattacattgtagtctacgaaattacccctaaacaggtaattgtggcagatcctggtattggtcaacgcaccctcagccaccaagaatttaaagccaactggactggctatacactgctactgcaacccacagcctggttgaaggatgccaaagaaactataactcccttttggcaattctttgaattgatgaagcctcacgctttagtgatgctagaagtgtttatcgcttccttatttatccagatttttggacttgttactcctttatttacccagctaattttagaccgtgtagtagtacagcgttctgaactaaccttaacggcggtgggattaggcttactgatttttagtttattccgtgtggcgatgacaggattgcggcaatacctgttagaccacacagcgaataaggtagatttagccctgattgtcggatttattcgccataccctgcggctacctttgagttactttgagtcccgttatgtgggggatattatctctcgcgtacaggaaaaccgcaaaattcaacgcttcctctcaggtgaggcattatcgatcctgctagatttagtcactgtttttatttatttaggattgatgttttggtacagttggaaaatggcgttattagtattagtaattataccgccttttttccttttggcattgattgccacaccttttttacaaaagatttctagggaaatctttaatgctgttgccaaagaaagtagctatctaattgaaactctttctggtatacgaacggttaaatccacagcagtagaacaaacggtgcggtggcattgggaagagttattaagtaaggaagtaaaaactaacttttccgggcaaattatcagcaatcggttgcaaatattcagcaacacaattgaagcagtgctaactaccgtcttactgtggtttggggcgtaccaagttattcataacgagttaaccattgggcaattggtggcatttaatatgctgctaggaaatattattacacccttccaacgattaacagttttgtggaatcaattacaagaagtggtgattgcagtagaacgcattaatgatgtcttggatgcggaaccagaagaggatttgcagcatcaggtacgacaatctttaccatcaattcaaggtaatattcgctttgataacgtgacatttcgctatcaccccgaaagcgatgttaatgttttggaaaatctcagttttgaagtccaaagcgggcaaatggttgctctggtcggacggagtggttcggggaaaaccacaatttctaagctggttttggggttatatcctcccacagatggcaaagtgttgattgatggacaggatattaccagtctttcgttgcgttctctacgcgaacaggttggggtagttgaccaagatacctttttgtttggtggaacgattcgggaaaatattagcttggcacatcctggggcaactttggtagagattattgaagcggcgcgattggcgggtgccgatcagtttattaaaaacttacctatgggttatgaaacccagattggggaaggaggggggatgttatctggaggacagcgacaaagaattgcgatcgcaaaagcattgttaggcaatcccaagctgttgattttggatgaggccacttcccatctagatgcagagtcagaaaggattatccagacgaatttaaacacaattcttcaagacagaaccaccttagtcatcgcccatcgcctttcaactgtgcggaatgcagatttgattttagtgttagatcgcggcgtgttgattgaaagtgggactcacaaagagttgatggcgaagcgaggacattatttttatctcaatcatcagcag

SEQ ID NO: 43957 - DNA, 1920 bp, Nostoc punctiforme
gtctcgcagttacaaaagcaaaaaagtgcccaattacgagacttgggaagacttcctttcccgatgatgcgtcaacgaggggaaaaaggctttcgccgtattagttgggatgaagctttagggataattagcgatcgcattcgcgccactacaccagatcgccttagtttttatattaccagtcgtggaactgtcaacgaaacttattatgccacccaaaaagctgtacgggcaatgggaagcaataatattgataacgctgcccgcatctgtcattctcccagtacggcgggactaaaagctgctctgggggcaggggccaccacctgttcttataaagactggattggtactgatttattaatcttcattggttccaacgttgccaataatcagccagtcaccgttaagtatctccattacgccaaaaaagctggcacgaaaattgtagtcattaacacttaccgcgagccaggaatggagcgctactgggtgccctcaattgtagaaagtgccgttttcggtacaaagtttgccgaagacttcttcttaatcaacatgggcggggatatagcatttttgaatggcacaattaaacatataattgctaacaattgggtagaccagtcatttatagatatacacacagttggctttgctgaactcaaaacatctttagaaagccaatcttgggaagaattagagcggctttccggtacatgccgtgagcaaatgtacgcctttgccaaaatggtcaaagaagccaacaaagccgtatttgtttggagtatgggcattacccagcatgaatgcggcgaagataatgtgcgaagtattatcaacttagctctcacgaaaggttttgtcggtcgggaaggctgcggtttaatgccaattcgcggccactctggggtacagggtggggcagaaatggggtgttacgccaccgtgtttcccggtggtaaacccattaccccagaaaatgctgcccaattgagtcagcattggggctttgatgtgccagcaagtaaaggtttaattgctccagaaatgattaatgccgcatatcaggcggaattagatgtgttgttttccgtgggagggaattttttagaagtgctgccagaaccggattatgtggaagcggcgctgaagaaaataccgttgcgggtacatacggatattgttctctccagccaaatgttggtggaacctgctgatattgtggtgcttttacctgcgacgactcgctacgaaataccagggggagtaacagaaactaacactgaacgtcgggtaattttcagtccagaaattccaggaccgcgcattggagaagcgcgtccagagtgggaagtttttctagaattagcaaggcgcgtgcaaccagatttggcagataagctggcttttgctgacacatctgctatccgtcaagagattgctcaagttgtcccccaatatgctgggattcaacacttacagcagcctggcgatcaatttcagtatggcgggtcacatttgtgctttggttggaacttccctacatcggatgggaaggcgcactttggcgtattattgccacgccaaagggaattaccagaaggttatttcttagtagcaacgcgccgaggcaagcaatttaatagtatggtacaggaacgtaaggatgcaattactggggcggtgcgagaggcagtgctaataaatgctgctgatgcggcactattggatttaaaagatggggataaggtaattcttaagaatgagttaggtgagttgttctgtgaagtgtatattgcaccaattcagtcaggaaacttgcaggtccattggcccgaagggaatgtgctactagataaaagtaagcgatcgctagaaggagctcctgattataatgcgatcgcacggttggaaaaa

SEQ ID NO: 43958 - DNA, 1221 bp, Nostoc punctiforme
aaagttgttggttattttgaaaactggtctcaataccggcaaggaggcggaaagtttttgccagcacagattgatccatcactgtatacacacataaactttgcttttggcattttcggctatatcaccaaaggcattgcgccaaataacccgcgccttactggtgactatagaatccaacccatagagtggaacgatcagacggtactgtacccagaaatccaaaaactgaagctaaagaaccctaatcttaagactttattatcaattggtggatggggctttaatgacccccaagatccgattcaaataggcacttatacttataatcttttcagccaaatggcagcttcggcagcaggcaggcaacagtttatttattctgcgctcgaatatgctcaaaaatataaattcgatggaattgacctagattgggaatatcctggttatcaaggtagaggaggtagaccagaagatttcgcaaatttccttgctctagtccgagagttccgtactgccatctctggaagaaactttcttttaacgatcgcctcatctgccatagtcccatcaggcgtaccagatcaatatcgctccaatccaggatcttactttcaatggctggctcagtgtgcccaatatttggattggctcaacgtcatgtcctacgactatcatggtgcatttcctgacgataaagtaacagggatgaacgcacccctaccccaagactctacgcccaaagggccattcagcgtcaaaaatactatcgaagcctacttagcagcagggattcccaatagcaaaatcgttatgggtataccaacttacggtcggacgttcaaggtatccagcccactgagtttaaccgataatggcccaggaaagtcttatagtagtgtcggccctgcgggaatatcaactgtgactccaggagttctctcatactacgagattcaaaaccggatctcaagcggttctctaacacgacggtggcatgaaccaactctgactccctacgcctacaatagccaaactagtgagtgggtgagctatgacgatactgagtcaatcggttataaaaccagttacttgattgagaaaaaactgggtggcgcgatgatttgggcgatcggtctagaccaatttcaaagcggttttcctctgattaaaagggtaaaatctattttagataatcctgcattaaggccaaagttgccg

SEQ ID NO: 43959 - DNA, 1713 bp, Nostoc punctiforme
ggactggaagttgctaactttattgaaattattcgctttagatccttaagccaagctggtaaaacagcttttttatttctgcaagacggagagacagaagcagcgaaaattacatatcgagaattagaccagaaggcgcaagcgatcgccgctcaacttcaaactttaacaactcctggagatcgtgttctattgctctacccttctggttttgagtttattgctgcctttgttggctgcttatatgctggggttgtcgcagttcctgcttacccaccccgacggaatcagaagatgcttagattgcaggcgatcgccatagatgctcaagcaaccctggtggtgagcaccacatcagtattaggcaatataaatagtcaggctgagaatccaggtttccttgggctgaagtgcgtcgcgactgataatcttattccgattgaggactttattccttatcgagcaaccccagacaccttggcttttctccaatacacttcaggttctacaggaacgccaaagggggtgatgttgaatcatggcaatctgttgcacaaccaacgactgatccagacggcattcgagcatacagaacaaacgatctttgtcggctggttgcctcttttccatgacatgggcttgatcgggaatacacttcagcccctgtacttaggcatcccgtgcatcttcatgtctccaacagcctttctgatgcgccccctgcaatggctgatggctatttccaagtacaaagctactactagtggcggtcctaattttgcctacgacctatgtgcaagcaaaataacttccgaagagcggtcaactctcgacctaagtacctggcaagtggcttttaatggagctgaacccatccgagcggaaactatagagcggtttgcaagcacatttgctgattgcggctttcgccgggaagcattttacccctgttacggtatggcagaaacaactctcattgtttctgggggtctagtggcgcccccaccagtattgcaaaccttccaaaaagcggcgctagagcaacatctggtagttccagctagtaattcagatgatgccacccaaacactggtggggtgcggtcaaccgttgcaggatatgcgggtggtcattgtccatccagagcgaatgactcgctgcaattccgatgagataggtgaaatttgggtatcaagtgcaagtgtaactcaaggctactggaaccagatcgactcaacccaacgtactttccaagcctacctccaagatacaggagcaggtccatttttgaggacgggggacttgggatttttaaaagatggcgagttgttcgtcacgggtcggctgaaggatttaattattattcgaggtcgcaattattatccccaggatattgaatctacggtgcaaaaaagtcatttgtctctgcgagcgaactgtggagcggctttttcagtagaaatagacggagaagagcggttagtcgttattcaagaggtcgagcgtgcttactaccggaatttagaggtggaagaggtagttggagctattcgttctgctgtgtcagaagaacatgaattacaagtttatgctgtggtattgctcaaacctggaggtattctgaagacttctagcggtaaagttcagcattatgcctgtaaggcagggttcttggcaaatactctggatgcgatcggcagtagtattctggaa

SEQ ID NO: 43960 - DNA, 828 bp, Nostoc punctiforme
gcctttgaaaatgttgatatagtactagctagtgcgggtggttccacatctaagacttgggcagcagttgccgtggcaaagggtgcagtggtaattgacaactccagtgcctttcggatgaacccagaagttcccctaatagtaccagaggttaatccacaagccgcagctaatcaccaaggcattattgctaaccccaactgcacaacaattttgatgactgtggcagtatggccattgcataaagttaaaccagtgcaacgcattgtggcttcaacctaccaatctgctagtggtgctggtgccagagcaatcgcagaagtcaaaacccaaacaagcgctatactacaaggacagccgccagttgctgaggtattaccttacccattggcatttaatttattcccgcataactcgccattaaatgatttgggttattgtgaggaagagatgaaaatggtcaacgaaacccgaaaaatatttggcacgcagcaaatcagaatcactgcgacctgtatacgggttcccgtactccgcgcccattcagaagccattaatttagaatttgagactacctttagtgccgaggaagccagagaaattttaaattcctcccctggagtgaaattggtagaagattgggaaactaatcattttccgatgccaattgaagcaacaggtagagatgaagttttagtgggaagaatccgtcaggatatttctcattcttgtggcttggaattatggttatgcggcgaccaaatccgcaaaggcgcagcattgaatgcaatacaaatcgccgagttattggtagaaaaaaatctactc

SEQ ID NO: 43961 - DNA, 873 bp, Nostoc punctiforme
tttggtaatgttttaaccgctatgattacaccgtttaaagcagacggtagtgtagattatggtgtagcggcagaactggcagtgcatctagctaacaacggtacagatacattggtgatgtgcggcacaacaggagaatcccctaccttgagttgggatgaggaataccagttgtttgtcgaggtattgcagtccgtggcaggaaaagccaaggtgatcgcaggttgtggttcaaattccaccaaagaagcgatcgctgccacccaaaaagcgtctaagataggagtacatggttccttacaagttgttccttattacaacaaaccgccgcaagcgggattggaagctcactttcaggcaatagcacaagcctgtcccgacttaccattgttgttatacaatgtcccaggtcgtaccggacaaaaccttcagccagaaacagttgcccggttagctgaggttagcaatattgtcgggattaaagaatccactggtagcatagatcaggcaagcgaaattcgtcgcttgacaccaaaagaattccacatctattctggtgatgattacatgactttgcccttgttagcgatcggggcaaagggtgtggtaagtgtggcttctcatctggtaggaaaccaactacagcagatgatccaagcttttagtgcgggaaaaattgaagtagcaagggacattcatctccaactcttcccgttgtttaaagctttatttctcacttcaaatcccattccagtgaaaaaagcgctgaaactccaaggttgggaggttggttcaactcgtccaccgctatgtgaagctgatttagaagtaagtcaaaagttagaaggggttctgaaagaacttagtttaatc

SEQ ID NO: 43962 - DNA, 1305 bp, Nostoc punctiforme
atccagaatcagcgagagttttttgaaactggtaaaactaaagatgtcacttttcgcattgaacaacttaaaaatctcaagcaagccataattgagcatgaacaagcaatagtcgaggcattaaaagcggatttacataaaccagaattggagatttacattacagaaataggcgtaattaaggaaattgattatgctataaaacatatcaatgcctggactaagcccaaaaaagcagcagtttcctttgattttttttcttactcagcaaaaatttatccagaacctttaggggttgttttaatcattggcccttggaactatccatttcagttaattatctcaccgttagtaggtgcgatcgcagccgggaattgtgcaattatcaagccttcagaaattgcttctcatacctctggtgtcattgctaagattattgccaaacatttcgacccagcttatattgcagtcttagaaggagatgtggaagcaagtcaaaaactacttgtagaaaagttcgatcatatcttttttactggtggcacagctatcggcaaaattatcatggcagcagcagccaaatatctcacaccagtgactttagaattgggtggtaaaagtccttgtatagtagatactgatattaatcttgaacacactgttagacgaataacttggggcaaatttattaatgctgggcaaacttgtatcgcccctgactatcttttagttaataaaaaaatcaaaaaagatttaatagatgggctgaaaaagtgcctaaaagaattttatggtgataatcctataagtagtcctgattatgctagaatcatcagtcaaaaacactttgatagattggtgaattttctcaaagatggtgaagttatcatcggtggagaaaatcaatcttcagagcgttatatcgctcccacagtgattgataatgtctcttcggaagattctgtaatgcaggaagagatttttgggccaattttaccaattattgaatatactgacgttgccgaagcgatcgcgttgattaactctagacctaaacccctggcgttatacttattttctcaaaacaaaaacttgcaaaagcgagttttgcaggaaacttcatctggtggggtctgcatcaatgacacagtaatacaggttggtgtctcgtctttaccatttggtggggtaggagatagcggcattggcaactatcacggcaaagctagttttgacactttttcccacaacaaaagtgtattgcaaaactctttctggctcgatttaaaatggcgatacgctcct

SEQ ID NO: 43963 - DNA, 1632 bp, Nostoc punctiforme
atggcaaagcgcattatctacaacgaaaacgcccgtcgcgccttagaacgaggcattgacatcttggctgaggctgtagctgttacccttggccccaaaggtcgtaacgtagtcctagaaaagaaatttggcgcaccgcaaattgttaatgacggtgtaacgatcgctaaagaaatcgaattagaagaccacattgaaaacactggtgtagctttgattcgtcaggctgcttctaaaaccaacgatgctgctggcgatggcaccacaactgctaccgttttagctcatgcgatcgtcaaagaaggcttgcggaacgttgcagctggtgctaacgcaatttccctgaagcgtggtattgataaagctactgcctttttggtagacaaaatcaaagaacacgcccgtccagtggaagattccaaagccattgcccaagttggtgcaatctcggctggtaatgacgaagaagtcggtcagatgattgcccaagcaatggacaaggtgggtaaggaaggcgtaatttccctagaagaagggaaatctatgttcaccgagttggaaatcactgaagggatgcgctttgacaaaggctacatctctccttatttcgctactgaccctgagcggatggaagcagtttttgatgagcctttcatactgctgaccgataagaaaatcgctttggtacaagacctcgtaccagtgttagagcaagtagctcgtgctggtcgtcctttggtaattatcgccgaagatatcgaaaaagaagctttagcaaccttggtagtaaaccgtttacgcggtgtactcaacgtggctgctgttaaggctcctggttttggcgatcgccgcaaagcactactagaagacatcgctgttttaactggtggtcaactaattaccgaagatgctggtttgaagctagataacaccaagctggatagcctgggtaaagctcgccggatcaccatcaccaaggacagcaccacaattgttgccgaaggtaacgaagctgctgttaaagctcgtgtcgaacagattcgtcgtcaaatcgatgaaaccgaatcttcttacgacaaagagaaattacaagagcgtcttgctaaactctctggtggtgtcgctgtcgtgaaagttggtgcagcgactgaaaccgaaatgaaagacaagaaactgcgcctagaagacgctatcaacgccaccaaagctgctgtggaagaaggtatcgttcctggcggtggtacaactctggctcaccttgctcctgaattggaagtttgggcaaagagcaatcttaaagatgaagagttgattggtgctttgattgttgttcgcgccttacctgcacctctgaagcggattgctgaaaacgctggtcagaatggtgctgtgatcgctgaacgcgtcaaagagaaagaattcaacgttggctacaatgctgcaacgaacgaatttgtcgatttgttagctgctggtattgttgaccctgctaaagtgactcgttctgctctgcaaaacgctgcatccatcgctggtatggtgttgacaaccgaatgtattatcgttgacaagcctgaaccaaaagacggcgctcctgctggcgctggtgctggtggtggcgacttcgattac

SEQ ID NO: 43964 - DNA, 1464 bp, Nostoc punctiforme
gtcattgttatcggtgccggaataggtggacttacagctggagcattattagctcatagaggttacagcgtcttagttttggatcaggcccttgtaccaggaggctgtgcttcgacgtttaaacggcagggatttacctttgatgtgggagcaactcaggtggcggggttggaaccagggggaattcaccaccgcattttctcagaattgtcaatagatttaccgcaagcaacgccttgcgatcctgcttgtgcagtgtatttacctggggaaagcacaccaattaatgtctggcgcgaccaagagaaatggcaagaggaacgacaaagacagttccccggtagcgaaccgttttggcaattgatggcaactttatttgatgccagttgggaatttcaaggacgcgatccggtgctaccaccacgtaatttatgggatttgtggcaactagcgcaagcggtgcgtcccagtacattaattaccgtacccttcactttgtttacggtgggagatgctttacggttatgtggattgggaaatgaccaacgactgagaacttttttagatttgcaactaaagctatactcccaggtagatgcagaacaaacagcattactttacgccgccacagcgttgagtgtatcccaactgccccaaggattgtttcacctccaaggaagtatgcaggtattaagcgatcgcttggtacaatccttagaaagagatggcggcaaattgttgatgcgccacactgtagaagaaatcaaagtagaaagcggcaaagctactgctgtagtcattagaaatcagaaaactggcgaagtctggacagaagccgccaaccacatagttagcaacgtcaccgtgcaaaacttggtgcagttattaggagaacaagcaccatctggatataaaaaccgggtggaaaaactaccccaagcatcgggtgcgtttgtggtgtatttaggtgtagatgctagcgcgattccgcctgggtgtcctccccacctacaatttttgtacgatgtcaatggtcccattggcgagaataattccctgtttgtttctgtcagtcatcctggagacggtcgcgcaccagaagggaaagcgacaattattgcttcttcatttgtcgatcctgcacagtggtgggagactgaagattatgaaggactaaaagaaaagtttacccaagaagcgatcgctcgtcttgcccaatacttctatctcaaaccagaaacgattattcatcaagaagcggcaacaccacgcacttttgcccattttacagcccgcgatcgcggtatagttggtggcatcggtcaaagaatacccacctttggcccctttgggtttgccaatcgtacaccaatccagcatctgtggttagtaggtgactccacccatccaggcgaaggtactgctggggtgagttattcagcgctgacagtagtcaggcaaatc

SEQ ID NO: 43965 - DNA, 1041 bp, Nostoc punctiforme
atgggtgtttcttcaacgactcctcatctcttacgggctgctcgtggtgaagtagtagatcgtccccctgtatggatgatgcgacaagcgggacgatatatgaaagcatatcgagacttaagagagaagtatccttcgtttcgcgatcgctcggaaattccagatgtagcaattgaagtttccttgcaaccgtggaaagccttccaaccagatggagtaattttattttctgatattgtcaccccattacctggtttgggcattgacatggatattgcggaaggtaaaggaccaatcattcactcccccctccgcactcaagaacaaattgatcgtctgcatcccttagaaccagaagctgctctaccatttatcaagacaattttacaagcgttgcgttctgaagtaggcgataaatcaacagtgttaggctttgtgggtgcgccgtggacattagcagcttatgcagttgaaggaaaaggttctaaaacctactccatcatcaaaaacatggcattctcagatccgacgatactgcatcaactgttaactaaattagcagatgcgatcgccatctatgcccgctaccaaattgactctggcgctcaagttgtgcaaatgttcgattcttgggcgggtcaattgagtcctcaagattatgacacctttgctctcccctatcagcagagagttttccagcaggttaagcaaacccaccccgatacacctttgattctgctagttagcggtagtgcgggtgtgttggaaagaatggcacaatctggcgctgatatagtcagtgtagactgggcagtggatatggcagacgcacgagcaagattgggcaagcaagttaaagttcaaggaaatcttgacccaggcgtgctattcggctctaaacagtttatccgcgatcgcattctcgataccgttcgtaaagctggtaattggggtcacattctcaatctcggtcacggtgtcttaccagaaactcccgaagaaaatgtcgctttcttctttgaaaccgcaaaggaactgaat

SEQ ID NO: 43966 - DNA, 1374 bp, Nostoc punctiforme
caattccgcatcgaacgcgattcgatgggcgatcgccaaattgctagtagcttttattacggcattcaaacgctacgggcgatcgaaaactttcctattagtggcattaagcctttagctacttacgtagatgctggattaatcattaaaaaagctacagcaattgtcaatggagaactgaattgtattcccgaagatattagtcaggcgattgtccaagcaactgatgaaatcctggctgggaagttccgggatcagtttgtcgtggatgtttatcaggcaggtgctggaacatcccaccacatgaatgtcaacgaagttctggcaaatcgcgccttagaaattctgggtgaagaaaagggcaattacaaacgtgttagtcctaacgatcacgttaactatgggcagtctaccaatgatgtgattcctactgccattcggattggtggtttattggcattatccaagacattacacccagcaatagaaggtgcgatcgcatccttagaaaacaaagctgtagaatttcaagatattgtcaaatctggcagaacccacttacaagacgctgtacccgtgcgtttgggtgaaaattttcgcgcttgggcgcacattcttacagaacaccaaaaccggatttacaccgcctctggagatttgatggtgctgggtttgggaggtagtgcagcaggaaccggtttaaatactcatcctctatatcgcgcccgtgtagtagaagttctttcagaattgattgatacacctttagaacctgcgccccatctcatggcagctatgcagagtatggctccatttgtaaatgtttccggtgctttacgcaatttagcgcaggatttagtcaaaatatctcatgacttgcggctgatggattcgggaccaaaaactggtttgaaagaaatccaacttcccccagtgcaacccggttcctcgattatgccagggaaatataacccagtcatggcagagatgacatcaatggtgtgttttcaggtgatgggttatgacagtgcgatcacattagccgcacaagccggacaattagaattaaatgtgatgatgccgctaattgcctataacttgattcacagtatcgaaattctcggcaataccatcgctgcactcaccgaacgctgcatcgagggaattactgcaaatcaagaacgttgtttagcttatgccgaaggcagtttagctttagtaaccgcactaaacacccacattggttatttaaacgctgctgctgtcgccaaagaatctttagaaactggtaaatccctgcggcaaattgttctagaacggggattaatgagtgaaacagacttagccacagtgttaaatctagaacacatgagt

SEQ ID NO: 43967 - DNA, 1389 bp, Pyrococcus horikoshii
atggagatgagggttggtatcgtaggaggtggtctcgctggattgactgctgcgatagctctagctgaaaagggattcgatgtttcaataattggacctaggtcaactgattcaaactcctacttagctcaggccggaatagcacttcccctattagagggagattcaataaggatccacgtccttgacacgataaaggctgggaagtacataaacgatgaggagatcgtttggaatgtaatctccaaatccagcgaggctcatgacttcttaacatctcatggtgtaactttcactggaaacgaacttgaaggtggtcattcttaccccaggatattcacgattaaaagcgaaacaggaaagcatatcattcctattctggaaaagcatgccagggaactcgacgttaacttcataaggggttttgttgaggaaatagggataaacaatgggaagcttgctggagttttccttcagggagagttgcttaaatttgacgctgttgtaatagctgccggcggattttcaggtctctataggtttaccgcaggggttaagaataacattggcctgctaattggggatgtagcacttaaaggtgttccattgagggatatggagtttgttcagtttcatccaactggatttatagggaaaaggacttacctaattaccgaggccgttaggggggctggagcaaagcttgtcactggagacggtgagaggttcgttaatgaactggaaactagggatatagttgccagagcaatctacatgaagatgctcgagggtaaaggagtcttccttgacgctagagggatagaaaacttcaaggatagatttccctacatttactcggttcttaggggagaagggataaatcctgagaaggatttaattccgataactccagtagcccactacactataggcgggataagtgtagacgctttctatagaacgaggattaagggtttatacgctattggagaatctgcttgcaatggtttccatggggcaaataggttggccagtaactctctcctagagtgcgtagtttccggcctggaggttgcgagaactatatcaagggaaaaacccaagagggaggtgaacgatgctccttactcttttaatgaacttggagacgttgattcgataagggaggtactctggaaccatgctgggatagttagggatgaatggtcacttagagaagggctgagaaagcttaaagagatagaagtagatgagagacttaagttagttgctaaggccgttataatttcagccctcaagagggaagaaagcaggggggcccactataggaaggactaccccttcatgagaaaagagtttgagcattctagcttcttctaccctaacgtt

SEQ ID NO: 43968 - DNA, 1647 bp, Pyrococcus horikoshii
atggcacagttagcaggtcaaccaattctgattttacctgaaggaacccaaaggtatgttggtagagatgctcagagaatgaacattctcgcagctagaataatagctgaaaccgtaagaacaacactcggtccgaagggaatggataagatgctcgttgacagccttggtgacattgtaattacaaatgacggtgctacaattctcgatgagatggatatccagcacccagcagctaagatgatggtcgaggttgcaaagacccaggacaaggaggccggtgatggaacaactacagcagtagttattgctggtgagctcttaaagaaggctgaagaattacttgaccagaacattcacccaagcataatcatcaagggatacaccttagcatctcaaaaggcccaggagatacttgacagcatagccaaggaagtcaagcctgacgatgaggaggttctccttaaagcggcaatgacagcaataaccggtaaagcggccgaggaggagagggagtacttagctaagctcgcagtcgaggccgttaagctagtcgcagaggagaaggatggtaagcttaaggttgacattgacaacatcaagctcgagaagaaggaaggtggggctgtcagagacacaaggttaattagaggtgtagtcattgacaaggaggtagttcacccaggaatgccaaagagaattgagaacgctaagattgcactcattaacgatgcccttgaagtcaaggagaccgagacagatgctgagataagaattaccagcccagagcagctccaggccttcctagagcaagaggagaagatgctcaaagagatggtcgacaagatcaaggaggtcggagctaacgtagtgttcgtccagaagggaattgacgacctagcccagcactacctagctaagtacggaatattggccgtaagaagggttaagaagagtgacatggagaagcttgctaaggccactggagctaagatcgtaaccaacatcagggatctcacaccagaggacctcggtgaagcagaactcgtagaagagagaaaggttgctggagagaacatgatcttcgtcgagggctgcaagaaccccaaggccgtgacgatactcatcaggggtggaactgagcacgtagttgacgaagtcgagagggcccttgaggatgccattaaggtagtcaaggacatacttgaggatggaaagataatcgcaggtggaggtgctagtgaaatagagctcagcatcaagctcgacgagtacgcaaaggaagtcggtggcaaggagcagttagctatcgaagccttcgcagaggccctcaaggttattccaaggacactagctgagaatgctggtctcgatccaattgagacactagttaaggtcatcgctgcccacaaggagaagggacaaaccataggtatcgacgtctatgagggtgagccagctgatatgatggagaggggagtcatcgagcctgtgagagtcaagaagcaggctattaagagtgccagtgaagctgctataatgatactcagaatcgacgatgtcatcgcagccagcaagctcgagaaggagaaggaaggagagaagggaggaggaagcgaggaattcagcggtagtagcgacctagac

SEQ ID NO: 43969 - DNA, 807 bp, Pyrococcus horikoshii
atgagggatgtaaagctaataggctcggatgaggttacggccataggtatgggaacttggggcattggggggtatgaagtcccggattattccagggatagagagagcattgaggttctaaggtacggtttggagcttgggattaacttaatagataccgctgaattttacggtgctggccactccgaggagctcgttgggaaggctatagagggtttcaatagggaggagatatttataataagcaaggtctggccgagtcactttggctatgaaaaagcaaagaaagcagctaaggctagtgcaaagaggctcggcacctatatagatctctacctcctccattggcctggggatagctgggggaagatagaggaaaccctccatgctcttgaggatttggttgatgaagggttgataaggtacataggggttagcaactttgatttggaattgctaaaacgctctcaggaggcgatgaggaggtacgagatagtggccaacgaggtcaagtattcaatccgcgataggtggccggaaacatctggtctgctcgattacatgaaaagggagaaaattgccctcatagcttacacgccgcttgaaaagggaacccttgctagggatccgtgcctcaccgagatcggtagggcttatggaaagacagcagctcaagtggcccttaactatttaatttgggaggataacgttatagctattccaaaggctggaagaaaggatcatgtggatgaaaactttggtgctatgggatggaggctttcgagagaggatagggaaaaggctagg

SEQ ID NO: 43970 - DNA, 984 bp, Pyrococcus horikoshii
gtggtgaatatgcatccgaagatctttgctcttcttgctaaatttccaagggttgagttaatcccctgggagacacccatacagtaccttcctaacataagtagagaaataggagccgacgtatatatcaaaagggatgatctaactggtctcggaattggggggaataaaataaggaagctcgaatatctcctgggtgacgctctctctaaaggagcagacgtcgtaataactgtgggagcagtgcattccaatcatgcattcgttactggactagccgccaagaaacttgggcttgatgcaatcctagttttaagggggaaggaagagctgaaaggaaactaccttctagataagatcatgggcatcgaaacaagggtgtatgatgcaaaggactcctttgagctcatgaagtatgctgaggagatcgcggaggaattgaaaagagagggtaggaagccctatgttattccaccgggaggagcatccccaatagggacgcttggttacgttagggccgttggagagattgcaacgcagagcgaagttaaattcgatagcatagttgtagcagctggaagtggaggtacgcttgcaggattatccctgggcttgtcgatccttaatgaagatattagacccgtaggaatcgcagttggtagattcggtgaagtaatgactagtaagctggacaacttaattaaagaagctgcggagttacttggagtaaaggttgaggtaaggccggagttatacgactacagctttggagagtacggtaagataaccggtgaagttgctcaaattataaggaaagttggaacgagggaaggaataatactggatcccgtatatacggggaaggcattctatgggctcgttgatctagctaggaaaggggagttgggggagaagattctctttatccatactggagggatatcgggaacgttccactatggtgacaaacttttgtcactactt

SEQ ID NO: 43971 - DNA, 1368 bp, Pyrococcus horikoshii
gtgaggatgaactctcaatggggttttaaaatgaagatactcatcatggggtttgaatatctccctgtaaaagtgggaggcttggctgaagctttaacttccattgcagaagccctcgcctctttaggacatgaagtcctagtcttcacgccttcccatggaaggtttcagggttcagaaattgggattataaaagcttttggggggaaagttgccatcaaagttcacttggaggagaatggaaatttgaggatctatagaattggcggggggttgttagatcatcaagacgtatacggcccaggatgggagggtttgataaggaaaaccgttatatttgggaaagctagcgttctcttgctgaatgaactcttaaagagtgaagaccttcccgatgttctccacttccatgactggcacaccgtatttgctggagctttaattaaaaagtactttaggattccagcggtattcacaatccataggcttaacaagtcgaagatcccagcattttatttccatgaagcgggattacctgagctcgctccttatccggatctagaccctgagcacactggaggttacatagctgacatagtgacaacggttagtagggggtacctcctggatgagtgggacttctttaggaacttcaatggaaaggtaacctacgttttcaatggaatagattgtagtttttggaatgagaattatctaaagggttccaggaaggaaagaaggagctccatacttgcgaaatttggaatgagtgatgggataactttcatgttcataggaaggtttgatagaaggcagaagggagttgatactttgctcagggccatagagcttctatccgagagacctgagtttaaggaaatgagatttatcatcattggaatgggggatccagagttggaaaactgggccagggaattagaaaagaggtatgacaacgttagggtattaacggaaatgctcagcagagaattcgtgagagaactctatggttcggtagacttcgtaataatcccttcatattttgaaccatttggactagtttccctagaggcgatgtgtctcggggccattcccatagcttcatcagttggtggacttagggatgtcattgtgagtatagatgaagatcacgttgatggtaccggattactagtaaaacctggagacccatgggatctagctaatgcaattcttaggatgcacagtatcgcaatggataatgagtttgtggagaaattaagggataactgcaagaaaagagcaaagtcattttcctgggagaattcggcaaaaaggtatttaagggcatataaagggaatatcgacaggatttttgactttgcaatg

SEQ ID NO: 43972 - DNA, 849 bp, Pyrococcus horikoshii
atgctactttacacgtatcgctcattcgacatggaactcccaacggtggatatcaaagatgctgactacataatcctgggattaccatttgatggtaccacaagctataaaccaggagcaagattcgggccagtactaattaggcaggctaccctaaatcttgaaagttacatcttagattatgatattgacattgcagaattgaaaattgccgatgcgggggatgtagcactaccggtgagcatagaagatgcgataaaggtagcagttgaaaccattaaagaagttagaagtattaaccctagagcactaccaatcttcctgggaggagagcattcaatgacttacccaccagttaaagtcctcgaacctaaaagctacgttgttttcgatgctcatctagacttaagggattcctatcaagggtcgaggtttaatcatgcatgcgttgcgaggagaatacacgaaatgggggtaaaggttgcaatatttggggttaggagtggaactagagaagaggtcatgtttgcaagtcagagtggaatagaatgggttcacgctagggattacaattttgacgcattcgttgatttagtttcatctcttcccgaaccggtttacgtttccatagatgtggatgtctttgatcttcccttagttccagaaactggaacgccggaacctggagggcttggattctgggaggtcatagaggccctagaatggctcaccaaaagaaagaaggtagcaggtttcgatataatggaagtatctggagatagattgggaaactcaacctcgataaccgcggctaagctcctcttctatgtaataggtatgagtgctagg

SEQ ID NO: 43973 - DNA, 2463 bp, Pyrococcus horikoshii
gtggacaaaatggcatataagttcattaagtggtttgaagaacttagaaaagatgacgttccccttgttggtggtaaaggggcaaaccttggcgaaatgacaaatgctgggatccctgtcccaccaggattctgtgttaccgcagaagcgtacaagtacttcgttgaaaatgttaaggtttctaaggaagatgtcaagaagattctcggcgaaaaggcaaataagggaacgatagctgaggttcttgcaagcgctccagacgaacctaggacacttcaagagtggataatggatataattaacaggacaaacgttgacgacagcaagcaactccaggagaacaccgcaataattagggagctaattgaatcccttgaaatgccaaacgagattgcagatgaaattaaacaagcttacaaggagctcagccagaggttcggaaaggatgaaatctacgttgcagttagatcatccgctacagcagaagacctaccagaggcttcattcgcgggtcagcaggagacttatcttgacgttcttggtgctgacgatgttatagacaaggtgaagaagtgctgggcctcactctggactgcaagggctaccttctacagggctaagcagggattcgatcacagcaaggtttaccttagcgcggtagtccagaagatggttaacagcgagaagagcggtgtcatgttcacggctaacccagttacgaacaacaggaacgagataatgatcaacgcctcctggggcctaggtgaagcggtagttagcggtgcggttaccccagacgagtacatcgtcgagaagggaacatggaagatcaaggagaaggtcatagcaaagaaggaggttatggtaatcaggaacccagaaacaggaaagggaaccgtccaagttaaggttgcagagtacctcggtcctgagtgggttgagaagcaagtcttaaccgatgagcagataattgaagttgcaaagatgggacagaagattgaggagcactacggatggccacaggatatcgaatgggcttacgacaaggatgatggaaagctctacatcgtccagagcagaccgataacaacgctcaaggaaacgacaactgaggaagttgaggaggttgaggaagccgaagtcatcctcaagggtctcggtgcttccccaggaataggcgcaggtagggtagtagtaatcttcgatgcaagcgagatcgacaaggtcaaggagggagatgttctagtaacaacaatgaccaacccagatatggttccagctatgaagagggcctcagccatcatcaccgatgagggtggaagaacgagccacgctgcaatcgtttcaagagagctcggaattccagcagtagttggtaccaaggaggctaccaagaagctcaagactggagactacgtaacagtcgatggtacaagaggtctagtctacaagggaattgtcaagagcttagttgaaaagaagaagaaagaggaagctgcagcagctcctggagctgcagtagcagcagctccgttagttacgggaacccttgttaaggttaacgtatcaatgccagaagtagctgagagggcagcggccactggagcagatggtgttggactgctaagggctgagcacatgatcctaagtatcggacagcacccagtcaagttcatcaaggaaggaaaggaggatgagctggtagagagattagcagaaggtatcgagaaggttgcagcagcgttctatccaaggccggtatggtacagaaccctcgacgctccaaccaacgagttcagagagatgcctggaggagaggacgaaccagaagagaggaacccaatgctcggatggagaggaattaggagaggtctcgatcaaccagagctactaagagctgagtttaaggccatcaagaaggtagtagagaagggatacaacaacatcggtgtgatgttaccactagtcagccatccagagcagataagaaaggctaaagaaatagcgagagaggttggccttgaaccgcacaaggatgttgcatggggtatcatgattgaggttccagcagcagctatcatcatcgaggatctaatcaaggaaggaattgacttcgtcagctttggaacaaacgacctaacccaatacacgctagcaattgatagggataacgaaagggttgctaagctctacgatgagacccacccagcagtccttaagttgatcaagcacgtcatcaaggtatgtaagaagtatggagtcgagaccagcatctgtggacaggccggaagtgatccaaagatggctagaatcctcgttaggcttggaatcgacagcatctcagctaacccagatgcagtacagctaatcagacaagtagtagcccaggaagagaggaagcttatgcttgaagccgctaggaagaaactcctcgaagaggaagaggaagaagaggacctcttc

SEQ ID NO: 43974 - DNA, 2565 bp, Pyrococcus horikoshii
gtgcataatatggaagaggttagagaggtaaaggttcttgaaaaaccatgggttgaaaagtataggcctcagagattagatgagatagtgggtcaagagcatatagttaagaggcttaaacactacgttaaaactgggtcaatgccccatttactatttgcaggtcctcctggtgttggaaagtgcctcaccggagatactaaagttatagctaacggtcaactcttcgaacttagggagcttgtcgaaaaaatctccggaggaaaattcggcccaactcccgttaaggggttaaaagttattgggatagatgaagatggaaagcttagagagttcgaagttcaatatgtttacaaagataaaactgagaggctaataaggataaggactcgccttggaagggagcttaaggtaaccccataccatcccctcctcgtgaatagaaggaacggagagataaagtgggttaaagccgaagaactcaaacctggtgacaaacttgcggtaccgcgtttcttacccattgtaaccggagaagatcctctggcagagtggcttggctacttcctcggaggcggttatgctgactcaaaggagaacttaatcatgtttaccaatgaagatcccctcctaagacaacgcttcatggagctaacggaaaagcttttctcagatgcaaggataagggagataacccacgagaatggaacttcaaaagtttatgtaaactccaagaaagccttaaagctagtaaactccctaggaaatgctcacatacccaaagaatgctggagaggaattcggtctttcctcagggcttacttcgactgcaatggtggcgtcaaggggaacgctatagtcctagcaacagctagcaaggagatgtcccaggaaatagcatatgctctagccggctttggaataatctcaaggatacaagaataccgcgttattatatcaggctcagataacgtaaagaagttcctaaatgagatcggctttattaatcggaataaacttgaaaaggccctaaagcttgttaaaaaagatgatccaggtcatgatggcttggagatcaactatgagctaatatcctacgttaaagataggcttaggttaagtttctttaacgataagagaagttggagctacagagaagcgaaggaaatttcctgggagctgatgaaagagatctactaccgccttgatgagcttgagaagctgaaagagtctttgtcaaggggtatcctaatcgactggaacgaagtagcaaagaggatagaagaggtagcagaagaaactggaattagagcagatgaactccttgagtacatagaaggaaaaagaaagctgagtttcaaggattacataaagatagcaaaggttcttggaattgacgttgaacataccatcgaagctatgagagtttttgcaagaaagtattcaagctacgctgagattggaaggagactcggtacctggaattctagcgtgaagacaattctcgagagcaacgccgtgaacgttgaaatcctagagaggataaggaaaattgaacttgaactcatagaggaaatactctccgatgaaaagctcaaggaagggatagcgtacttaatcttcctctcgcaaaatgagctttattgggatgagataactaaagtagaagagcttaggggagagttcataatctacgatcttcacgttcctgggtaccacaacttcatagctggaaacatgccaacggtagttcacaatactacagcagctttagccctctcaagagagcttttcggcgagaactggaggcataatttccttgaattgaatgcttcagatgagagaggtataaacgtgattagagagaaagttaaggagtttgcaaggacaaaacccataggaggagcgagcttcaagataatcttccttgacgaggccgacgctttaactcaagatgcccagcaagcattaaggagaaccatggagatgttctcgagcaacgttcgctttatcttaagctgtaactactcctcaaagatcattgagcccatacagtctagatgtgcgatattccgcttcagacccctccgtgatgaggacatagcaaagagattaaggtacattgccgaaaatgaaggtttagagctaactgaagaaggtctccaagcaatactttacatagccgaaggagacatgagaagggccataaacattctgcaagctgcagcggccctggacaagaaaattaccgatgaaaatgtattcatggtagcgagtagggctagaccagaggatataagggagatgatgctcttagcccttaagggtaacttcctgaaggctagagaaaagctcagggaaatactcctcaagcaggggcttagtggagaggatgtcttaattcagatgcacaaagaggtatttaacttaccgatagatgagcccactaaagtttacctagcggataagataggagagtacaacttcaggctcgttgaaggagctaacgagatgatacagcttgaagccctcttagctcaatttaccttagttggaaagaagaag

SEQ ID NO: 43975 - DNA, 684 bp, Pyrococcus horikoshii
atgaagggttcgaagtctgaggttcagggtatggtgcttaccactggagttaagggattagatgaattattgggtggaggagttgctaggagggtaatactacaggtttatgggcccttcgctactggtaaaacaacctttgcaatgcaggtaggccttttaaatgagggtaaggttgcctatgtggatactgagggtggattctcccctgaaaggctagcccaaatggctagatctaggggtttagatccagagaaggctctatcaaagttcataatctttgagcctatggatctgaatgagcagaggagggtaatctccaaattgaaaacaatagttgatgaaaaattctccctagtcgtcgttgattcgttgacggcccactatcgagcggaaggaagtaaaaattatggtgaactagcaaaacagcttcaagttctccaatggctggctagaaggaaaaacgttgctgtaatagttattaatcaagtttatcacgactctaattcaaactctctaaggcctatagctgaacataccctgggttataggacaaaggatatattaagattcgagaagcttagggttggagttaggctggcggttctagaaaggcataggtttagacctgaaggtggaatagtttactttaaaattacggataagggattagaagatagtaaa

SEQ ID NO: 43976 - DNA, 1305 bp, Pyrococcus horikoshii
aaaaatttagagatagttaagctggatgaaaaatatattccaagggcttctggctttaagtattacccgatggtcatagaaaggtctagcggttctaggatatgggataaagatggaaatgaatacatagacttcctaacgagtgcggccgtattcaatgttggacatacacaccctggggtcgtgaaggccgtggaggagcagattaagaagttcttcaattacacgatggggtacttgtatgtggagcctcccgtaaggctggctgaactgttggttgagataactcctggtaattttgagaagaaagttacctatgggttctctggatcagatgcagttgattcctccataaaagctgctagagcatacacgaagagggttaacataataagttttctgcactcttatcacggaatgacatatggagctctttcagctacggggatacttgatcctaagctgaagaagcttttacatccgatgggcaactttcaccacgttgaatttccggatccttataggaacagctggggaatagatggctacgaggatccaagtgagctcgccaacagagccttagatgaaattgaaaggaaaattaaggagcttaacgaagacgttgcggggataataatcgagccaattcagggagacgctggggttgttataccgccagaagaatttgtaagagaccttaagaagctaactgaggagtacggaatagttttcatagatgaggaagttcagacgggaatggggaggactggaaggtggtggggaattgagcactttggcgtaactcccgatcttatagtttcagctaaagccctgggagggggtatgccaatttccgcagtagttggaaaagctgagataatggatagcgttccagtacccttcttcgtgttcactcacattgggcatgccgtaaatgcctcggccgcaatagcaactattaacgttataaaggaagaaaagctcgttgaaagatccgagaagcttggagaatacatgctaaagaggcttagggaacttcaagagacttatccaataattggagatgttaggggtaaaggattgctaataggggttgacatagtgaaggaaggaacgagggagcctgataggagtctagcacagaaaatatcctggagggcttgggagaagggattaataatgataacgtttggaaaacatggtaacgttcttagaatagctccaccactcaacataccccaggaagacttggataagggggtagagataattgaggagtcaataaaagatgcagttgaagggaag

SEQ ID NO: 43977 - DNA, 1179 bp, Pyrococcus horikoshii
atgaggtacgacgtcgtcgttgttggttctggagttgctgggcccatagttgcgaggaacgtagctaaggccggattctcagttttgctagttgataaaaagcccgctataggggcccctaagcagtgtgctgaggggttaactattaacgcctttaagcaattcgatataccctatgataagaggttcataaacagggagatttatggggccaagatatactcgcctagtggttatacagctgagctcaggtataaggaggtcagcggggttatcctggagaggaaggtttttgataaaatgctagcttactatgcagctaaagcgggtgctgaagttttagctagaaccgaggtcgttgatgtaataaggagggaaggaaagatagttggcgtgaaggctaagcatgagggcgagcctatggagatagaagcaaaggttatagttgctgctgatggtgtggaaagtactatagctaggaaggccggcatagatacctacgcccctccccacgagtttgactctggctacgagtacgagatgataatagagggctttgatccggacttgatccacctattcttcggaaatgaggtagcacctaggggttacgtttgggtcttcccaaaggatgaagacagggctaacgttggtatcgggataaattccgacaatgagaagacggccaagtattacttagacaagtggcttaaggagaataatataccgaggaacaagatcctcgaggttaacgttggtttaatcccagttgggggcttcgtaaaagagctcgtgaaggagaacgtccttgtggttggagatgctgcaaggcaagtaaatcctatacacggcggtggaatggccgaagctatgaaagcttcaacgatagcctctaagtggataatcaaggcccttgaagaggagaaccttgagctactcaagaactacaaggaggagtggtggaagactgagggtcctaggatggaaaagctactgaggctaaggagggccatggagaagcttacggatgaggatcttgacgttttcgttcagctggtaagtggaacagaccttgagaagatcgctggcggtaactacatcgaggtagtcaaagctttgatgaagcatccaaaagttttgatgagcaggagaaggctcgagatacttaaggccctacta

SEQ ID NO: 43978 - DNA, 1197 bp, Pyrococcus horikoshii
gtgagtgtaatgagtggtgacgaagttcaatttcaaggggattacgatgattatataacgtacctcaagagaaggataagacaacttgaacttcaggtgaggatgcttgaagctgacaaagagagactagagagggagttatctaggctaagaagtgagatgtcaagactaagacaacctccagcttttgcaggaacggtcatagaggtcctagatgaggatagggccatagtccaaaactacaatggcccaaggttcgtagttagaatagccccctggatagacaggaaaaagctgagaccaggaactagggttgcacttgatcaaaggacaatggccgtggtggagatactccccacatctaaagatcccacagtactgggatttgaggtcatagaaagaccaaatgtaacgtacaacgatattggaggcttgaaaaagcaactacaggagttaagggaagccatagagctgcccctcaaacatccagagctctttgaagaagttggtattgatcctccaaagggtgttcttttatacggccccccaggttgcggaaaaacgttaatggcaaaggccctcgcccatgaggttaacgcaacgttcattagagttgtgggaagcgagctcgttagaaagtacattggagagggtgcaaggctcgttcatgagttattcgaacttgcaaaggagaaggccccaacaataatattcatagatgagattgatgcaataggagcaaagagaatggatgaaaccacaggaggagaaagggaggttaacaggacactcatgcaactactcgctgaaatggatggattcgatccaagaggaaacgtaaaggttatagccgcaactaataggccagatatactagatccagccctactaaggccgggaagattcgatagactaattgaggttccacttccagacttcgagggaaggcttgaaatcttaaaagttcacacgagaagaatgaaactcaaaggcgttgacttaagagccatagcagaaatgacagagggagcaagcggagcagatttaaaagccatagctactgaagctggaatgtttgcaattagggagagaaggacatacgtaactcaggaggatttccttaaagcagtagataaggttctaggaaatgaaagaaagctattacaacagataacgtcccatgaagttatctacggc

SEQ ID NO: 43979 - DNA, 1221 bp, Pyrococcus horikoshii
atggaagagaacattaaaagcatgcttggggatgttgaaaggttcttctcgaaaaaagctctagaaatgagggcttcagaggttagagagctattaaaacttgtagaaactagtgatataataagcctagcaggagggctgcctaaccccaaaacattcccaaaggagattattagagatatcctagtggagatcatggagaaatacgctgacaaagctttacaatatggaactacaaaaggattcacgcctctaagggaaactctaatgaaatggctaggaaagaggtatggaatatcccaggataatgatataatgataacaagtggttctcagcaagcgttagacttgattggtagggtgtttttgaacccaggggacatagttgttgtagaagccccaacgtatttagcggcactccaagcttttaacttctatgagccccaatacatccaaattcccctagatgatgagggtatgaaggttgagatacttgaagaaaagctcaaggaacttaaatcccaaggaaagaaagtgaaagtagtatacacagttccaacgtttcagaatccagccggagttacaatgaacgaagataggaggaaatatctcctggagctcgcgagtgagtatgatttcatagtcgttgaagatgatccttacggagagctaagatactcaggaaatccagaaaagaagataaaggccttggataacgagggtagagtaatttatctaggaacgttctcaaaaatattagctccagggtttagaattggatggatggttggagatcctggaattataaggaagatggaaattgcaaagcaaagcaccgatttatgcacaaatgtcttcggtcaagtagttgcctggaggtatgttgatggtggatacctcgaaaagcatatcccagagataaggaaattctacaagccaagaagggatgcaatgctcgaggccttagaggagttcatgcctgaaggcgttaagtggacaaagcctgaaggaggaatgttcatctgggtaacgcttccagatggaatagactcaaagaaaatgcttgaaagggctataaagaagggagtagcctacgtccctggggaagcattttatgcgcatagggatgttaagaacacaatgagactcaactttacgtacgtggatgaagacaaaataatggagggaataaagagacttgcagaaactataaaagaggag

SEQ ID NO: 43980 - DNA, 1803 bp, Pyrococcus horikoshii
gtggaaaatgtgtgcggtataataggatacatagggcctaggaaggcctctgatgtcatcgttgaaggtctcaaaagacttgaatacagaggatatgactcagcggggatagcaacctgttatgaaggtaaaatattcataaagaaaggagctggaaaaattgatgaacttgtaaagaagttaaacttcttggaattacccgggaatataggaataggacatacaaggtgggcgactcatggaattccaaatgacactaacgctcatccccataccgattgcacgggaaagatagtcgtcgttcacaatggaataatagagaacttccaagaactcaagagagaactgctaaaaagagggcatgtatttaggagcgatacggacactgaggtaattgctcaccttattgaggaaaacctcaggataactggaaattttgaagatgcttttagaatgtcacttcttaggcttaggggatcttacgctctcgtagttctcttcgcagatgaccctgaaagattgtacatagctagaaaggacagcccccttataataggcattgggaagggagagatgttcatggctagtgatatcccggcatttctagcttatactcgcagggccgtgttcttagatgatggagaatacggtatagtttccaaggattggtttacgataaaagacattataacgggagctgtcaaaacaaaggaaattcacgagatccaatggaccctagagatggccgaaaaaggtggatatgagcacttcatgttaaaggaaatctttgaacaaccaaaggctataaaagatgcaatttatggtaacgttaaggaagctccaaaagttgcagaattgctaatgaaatatgacagaataatcattacaggaatgggaacatcgtaccacgcggccctcgttggaaagtatctaattcaaagatttgggaaggttcccgtaattgtggaggaagctagcgagttaaggtatgaatatgaggatatcctagataacagatcccttctgatagcaataacccagagtggggaaactgcagataccgtagcggctatgaagcttgctaaatcaaagggagtagaagtcgtagggatcgttaacgtcgttggtagtttagcaactagaattgcagatgaaaccctctatactcatgctggaccagagataggagttgcagcaacgaaaacttatacgacccaactagtggttcttacattactagctaaggagctcgggaagctagttggaatagatgtttctcaaattgaaggaacaatcccgaggctaccagaactagtggattcatcccttaagattaacgacaagataagggaaattgcggtcaaactaaatgataagagggatttcttctacattggaaggggaataaattatccaacggccctggagggagccttaaaaataaaggagatagcgtacgttcatgcggaggggttatcagcaggagagttaaaacatgggccactagccctaattgaagatgggatcccagtcgtcgggatagcaccgacaggtaagacattcgaaaagatgctatcaaacattgaagaagccaaagccaggggaggatttataatctccctaggggatgatgtaaggttgcatcaggttagtgatatcttcattagattacctaaagttcccgaagaattagctcccataacttatatagtaccgcttcagctattagcgtatcatttagccgtccttaagggtcataaccccgacagacccaggaaccttgcaaagtctgtaactgtggag

SEQ ID NO: 43981 - DNA, 501 bp, Pyrococcus horikoshii
atggtggaaacactgaacataagaaagataatcccaataactgatagaatagcgataacaactgctggaagcgttggagatgtccaaatgatagccagaatcttggaagcggaagcaagatactactatttcgcctggggtagaccaatgactacgaaggccatggcaaacctcttgagtaatatactgaacgagaacaaatggttcccatatttagttcagataattatcggaggatacgttgatgaaccaacgatagcaaatttggatccatatggagggttgatatttgacaattatacagcgacaggctccggaacaccctttgctattgccatattggaggaaggttataaggaaaacttgggaatagaggaagctaaagagttagccataaaagcaataaaagcggccggctccagggatgtctacacgggaagcaagaaggttcaggtagtcacgataacgaaggagggcatgcaagaagagtttataaagctc

SEQ ID NO: 43982 - DNA, 1587 bp, Pyrococcus horikoshii
gtgatgatcatggttaagaaagggagcgatcctgaggttgttgagatagatgagattgagggacttggattggaacttgaagaggagtcaactacctctaaaaagaaaaagaaggagaaagagataaagagtattgaggatcttccaggagtgggtcctgctactgctgaaaagcttagggaggcgggatttgatactctagaggctatagcggttgcatcccctatagaacttaaagaggttgcgggaatcagtgaaggggcagcccttaagataattcaagcggcgaggaaggctgctaatctcgggacgttcatgagagctgacgagtacctaaagaagagggaaagcattggaaggatctcaactggaagcaaaagtttagataaattacttggtggaggtatagagacccaggcgataacggaagtctttggggagttcggtagtgggaagtgctttgctagggataccgaagtttattatgaaaacgatacggtaccacacatggaatcaattgaggagatgtatagtaaatacgcctcgatgaatggggaattaccattcgataatggttacgcagttccattagataatgtctttgtgtacacgttggacatcgctagtggtgaaattaagaaaacgagggcttcatacatctatcgcgagaaggttgagaagctcattgagataaaactatccagtggatactcccttaaggttactccctctcacccagttctcctctttagagatggcctgcaatgggtccccgctgctgaagttaaacctggagatgttgttgttggtgttagggaagaggtactgagaagaagaataatatccaaaggagaacttgaattccatgaggtttcctcggtaaggataatagattacaataactgggtctacgaccttgtaattccggaaacccacaacttcatagctcccaatggacttgttctccataatactcagctagcccatacccttgcggtaatggtccaattacccccagaagaaggaggattaaatggctcggtaatttggattgacactgaaaacaccttcagacctgagaggattagagagattgcgaagaataggggattagatcctgacgaagtattaaagcacatctacgttgctagggcatttaatagcaatcatcaaatgctgctagttcagcaggccgaggataagataaaagagttactgaacacggataagcccgtcaagttgctaatagtggattccctcacgagccactttagaagtgaatatataggtagaggggcattagctgagagacagcagaagttggctaagcatttagccgatctacataggttggcgaacctttatgagatagctgtctttgtaacgaaccaagttcaggccaggcctgatgctttctttggagatccaacgagacccataggtgggcatatcttggcgcatagtgcaaccttgagggtctacttaaggaagggtaagggaggaaagagggtagctaggttaatagatgcaccacaccttcctgagggagaggccgttttcaggataacggagaagggaattgaagat

SEQ ID NO: 43983 - DNA, 1194 bp, Pyrococcus horikoshii
gtggttcttatggggaagcttgattggattaaggaggagcttgaggaactaaagaaaaaaggcctttacgtgacgataagggttctccagagcgctcaggggccatggatcgttgtgaacggtaagagagtccttaacatgtgttcaaataactatctcggcttagcggcccatcccaagattaaagaagctgctataagagctatactcgactatggagttggtgccggtgcagttagaacgatagctggaacaatggagcttcacgttgaacttgaagaaaagttagccaagttcaagaagagggaagctgcgatactcttccagagcggttacaacgctaaccttggagcaattagtgcactcttaaggaagggagaagatggagtattcttaagcgaagaacttaatcatgcaagcattatagatggaatgagacttagcggtgctcccaaggttatctacaagcaccttgacgtggatgacttaaagaagaagcttgaagagaataaggataagaagaagaaaatcattgttaccgatggagtattctcaatggatggcgacttagctccactgccagagatagttgaggttgctgagcagtacgatgcaatagtttacgttgacgacgctcacggtgagggtgtcctgggaagccacggaaggggaatcgtggatcacttcaacctacatgacaaggttgactttgagatgggaacgttaagcaaggcctttggagttataggaggttacgtagctgggccggaggaagctattgaatacctcaagcagagggctagaccattcctcttctcaagtgcaatgaatccgccagatgttgctgcagcaatagctgcagttgaaatacttcagaagagtgatgatttggtcaagaagctgtgggataacactcacttcctccagaagggtcttagagatctcggctatgacttaggaaataccaagcacccgattacccctgtaatgctttacgacgagaagcttgcccaggagttctcgagaaggttgtacgaggagtacaacatctttgcccaggcgatagtttatccgaccgttccactaggaactgctaggataaggcttgaaccctcagcagctcacacaaaggaggatctcaagcttgttattgatgcttttgaagatctcggaaagaagacgggattcttgaag

SEQ ID NO: 43984 - DNA, 1458 bp, Pyrococcus horikoshii
atgggaaaattcgtggaaaaactagaaaaagctattaagggttacacgtttgatgatgtactcttgatcccgcaagcgacggaagtagagccaaaggatgttgacgtttctacccggataactccgaacgttaagctaaacatcccaattctaagtgcagcaatggatacagtcacagagtgggagatggccgtggccatggccagggaagggggcctcggagtgatccatagaaacatgggtatagaggagcaggttgagcaggttaagagggttaaaagggccgagaggttaatagttgaggatgtaataacgatagcccctgatgaaactgttgatttcgcactcttcttaatggaaaagcatggaatagacggtttacctgttgtggaggatgagaaggtagttggaataataactaagaaggacatagctgccagggaagggaagcttgtaaaagagttgatgacgaaggaagtaataacagttcctgagagtatcgaggtggaagaggccttaaagataatgatagagaacagaatcgacaggctccccgtagttgatgagaggggtaaattagtgggtttaattacaatgagcgacctcgtggccaggaaaaagtacaagaacgctgtgagagatgagaatggagaattgctcgtagctgctgcagttagtccctttgacattaaaagggcaatagaacttgacaaggccggtgttgatgtaattgtcgtcgatacggcccatgctcacaaccttaaggcgataaaatccatgaaggagatgagacagaaggttgatgctgacttcatagttggtaacatagccaaccctaaggccgttgatgaccttacctttgcagatgccgtaaaggtgggaataggacctggaagtatatgtacaacgagaatagttgcaggagttggagttccccagataacggccgtagcaatggtggccgatagggcccaagaatacgggctttacgtcattgctgatggagggataagatattccggggacatagttaaagcaatagctgctggggcagatgctgtaatgcttgggaatcttcttgctggaactaaagaagctccagggaaagaggtgataataaacggaaggaagtacaagcagtacagagggatggggagcttaggtgctatgatgaaagggggtgcggagaggtattaccaaggcggctacatgaaaacgaggaagttcgttcccgaaggagttgagggtgttgttccttatagaggaaccgtgagcgaggtactctatcagttagttggtggattaaaggctggaatgggatatgtaggagctagaaacataagggagcttaaggagaagggagagttcgtgataataactcatgctggaattaaggagagccacccccatgacataataataactaatgaggcccccaattatcctttggagaagttt

SEQ ID NO: 43985 - DNA, 1863 bp, Pyrococcus horikoshii
atggaaaagctaagggagctacttccaaaggatcaatatgagaagatcgctgcaataaacaatccctacctccatgaatttctcgctgaatggatagaatggctagagcctagcaaagttttcgtttgtacggattccccagaggatgaagagtacgtaaggtggaaggccctttactatggtgaagaaaagatgctagagattcctaaacacaccgttcattacgataactactatgatcaagctagagataaaactaatacaaagctactggttcccaaaggcgttgaacttccgtttttaaacactatgaacagggaagaagggcttaaggagatcagagaaatcatgaaaggtataatgcgtggaaaggagcttttcatatgcttctttgttcttggtcccacaaattcgatatttacaattcccgcggttcagcttacagattcagcttacgtagctcactccgagtttctactctacagaaagggatacgaggagtttaagagacttggcccaactaagaacttctttaagttcgttcattcagctggcgagttggatgagaggaagacaagtaagaatctggacaaaaggaggatatacatagatttgctagatgaaaccgtttattcagcgaacacccagtacggtggaaacacaattggattgaaaaagctagcctttaggctgaccatccagagggccgtgaaggaaggttggctaagcgagcacatgttcctaatgagggttaacggtccgaacggaaggaaaacttacttcacaggagcttacccaagcatgtgtggaaagacttctactgctatgattccctgggagaacatagttggcgatgaccttgttttcataaagaacgtggatggaattgcgagagctgtaaacgttgaaataggggtctttggaataatagagggggtaaaccaaaaggatgacccaataatatggaaggttctccactctccggtcgagatcatattctcaaacgttctagttaaggatggtaagccctattggaacggaatggggatagaaattccagatgaaggggagaaccacagcggaaagtggtggagaggtaagagggatgctgaagggaaagaaattccaccgagccataagaacgctcgctttaccgttaggctcgaagccttcccgaaccttgatagggaggcccttaacaatccatgtggggttgaagttggagggatgatattcggtggaagggatcccgacacttggccaccggttagggaagcctttgactgggagcatggggttataactatgggagcatccctcgaaagtgaaacgactgctgcaaccctgggaaaggagggtgtcagggcttttaacccaatgtcgatcctcgacttcttgagcgttcacataggggattacataaggaactacttggagtttggaaggaagctaaagaaaactcccaaaatattcgctgtaaactacttcctcagggagaacggccggtggcttaatgaaaagcttgataaagcagtttggctcaagtggatggagctaagggttcacaatgatgtcgatgctatagaaactccaataggatacattccaagatatgaggatctcaaggttttgtttaagcaggttctcaacaaggattattcgagggaggattacgagaagcagttcaagataagggttccagagcttttagcgaaaatagagaggatatggaagatatacgagccaattgacaacatcccggaggagctatttaaacaactcaaggatgagagggagagattgctaaaagcaaaagcggagttcggtgattatataagcccatttacacttgaaaaaaggatc

SEQ ID NO: 43986 - DNA, 1299 bp, Pyrococcus horikoshii
gtggtggttatgataaagcttagagatgaacttggaactgcaactacggattcagcccaaaagatcctccttttagggagtggtgagcttggaaaggagatagcgattgaagcccaaagactaggcgttgaggttgtagccgttgaccgctacgctaacgctccagctatgcaagttgcccacaggagttacgtcgggaacatgatggataaggatttcctttggagcgtcgttgaaagggaaaagcccgatgcaattatccccgagatagaggcgataaatctagatgccctcttcgaattcgagaaggatggttattttgtagttccaaatgcaagagctacctggatagctatgcacagggagaggcttagggaaacccttgtgaaggaagcaaaggttcctacttccaggtatatgtacgctacaacccttgatgaactctatgaggcctgtgaaaagatcggttatccatgccacacaaaggctataatgagctcctcgggaaagggatcgtacttcgtcaaggggcccgaggacattccgaaagcctgggaagaagcaaagactaaagcgagaggtagtgcagagaagataatagttgaggaacatatagactttgacgtggaggttacggaattagccgttagacattttgatgagaatggggagatcgtgactactttcccaaagcccgttggccattaccagatagatggtgattaccacgcaagctggcaaccggccgagattagtgagaaagctgaaagggaggtctacaggatagcgaagaggattacagatgttcttggaggcttagggattttcggtgttgagatgtttgttaagggggataaagtctgggcgaatgaagtttctccaaggcctcatgatactggaatggtaactttggcttctcatcctccaggattctctgagtttgcccttcacttaagggcagttcttgggcttccaatcccaggggagtgggtagatggctataggcttttcccgatgcttatacctgctgcaactcacgttataaaggcaaaggtttcagggtattcacctagattcagaggattagtcaaagctctaagcgttccaaacgcaacggtgaggcttttcggtaagcctgaagcttacgttggaagaagactgggtatcgctctagcctgggataaggatgttgaggttgcgaaaaggaaagctgaaatggtagctcacatgattgagctgagaacgaggagtagcgactggcacgatcaaaattatgaaaaaaggaagcacttactccga

SEQ ID NO: 43987 - DNA, 1110 bp, Pyrococcus horikoshii
atgagatatgatgtgctcattattggaggaggacccgtaggaaattatcttgcgagcttacttgctggaaaagttaacgttggtgtcattgagaagaaaggagcatttgggggaaaagcctgcacagggatcgtaggagctgaaaactatgaaagcctaggtcttcctgaaaaggccatattgaacgccttcaatggggccttcttcatttccagggagaaggtttttgagattcatagatctcttccccaagcatacctcatagataggaaagtgcttgaaagggaacttgctaaaagggccatgaggaaaggggcagaatactatctctcaactaatttcctgggattcaagaatggaaaagcgatccttcagcatttagattctaggctcgaaatagaggcaaaatactacgtgggagcggatggagtaaacagtagcgttgccaaggaaatacaggcaagaactgaaggggaagtcctaaaaggatgggaaattgaagttctcggaaatttcaagagggatcacgttgaagtttgggtaaacaaaaatattaatccagagttcttcttttgggtagcccctataaacgaggaagaagcaagggttggcacttttggggaaatagattccctcgcaaaatttttgaaaattaggagattaaatccatttaaaaccgttgaaataaaatctggggccgtgatccttggctggaggaaaccctgggtaaagggtaacgtagctctagttggcgatgcagcacttcagataaagccaacgaccgctgggggaatagtttttggcgcttactgtgcaaaaagccttgccaaagctatactaaacgataacttggagatatatgaaagggaatgctcctgggttagagagcaagttagctttggattaaaaataaggaaggttttcaagaacttgacgcaggaaaaaatagaggaaatattcgaagttcttagctccgaagaagttagaaagataatcgttgagagggccgatttcgacgaccacgtcaagacggtcaaagcactactaaagaatccaagggtgttagccaagttaattagaatatcacccataatcttgagggcccttctc

SEQ ID NO: 43988 - DNA, 3873 bp, Pyrococcus horikoshii
atgaaatgtcggggtgttattatggtagttgaaaaagtgatgaaacgcgatggtaggattgttcccttcgatgagtcacgtataagatgggccgtacaaagggcaatgtgggaagtgggcgtcagggatgagaagaagctcgacgaagtagtcaaggctatagtgcagaggataaacgagctatacgatggaaagataccgcacattgagaacattcaagacatagtagaattggaacttatgagggctggactctttgaagttgctaaagcttatatcctctatagaaagaagaaagctgaaatcagagaagagaagaagagaatactgaacaaaaaagagctcgacgagatcgacaagaggttctcaataaatgcattaagggtactcgcatcgagataccttaagagggatgaaaacggtaatatcatagaaagcccaagggaattgtttgaaagagtagcaatactagctgtcatccctgatctgctttatgatgagagggtttttgacaaagatggtaactattctcaagatctaaagcgggttgaatactatctagagcactttgaagaattcgacgggaagtactctatagggaaatacaagcttaacaagtaccacttcgagagaatggtcaacctctacaaggaacttgcagaaaagggaaagatgaaagtaagtattgacgaattcctggggatgcttgaaaggggagaattcaacaagtacgagaaggaaattgatgagtacttcaggttaatgacgaaccaaatcttcatgccaaacactccagcgttgatcaactctggaaggcccctgggaatgctctcagcttgcttcgtcgtcccaatagaggatgacatggagagcattatgaaagcagcccatgatgtagccttaatacagaaagctggcggtggtactggaattaatttctcaaaacttcgtcctgagggagatatagtgggaacaacaaccggggcagcctcaggtcccgtctcgttcatgcacctcatagatgccgttagtgatgtaataaagcaaggtggtgtgagaagaggagcaaatatgggaatactggagatatggcatccagacattgagaagttcatccatgcaaaggagaagaacattggaactaacgtcttgagcaacttcaacatcagcgttgggatatgggaggacttcttggaggcccttaaggaaggaaagaagtatccattgataaatccaagaactggggaggttgttagggaggttgatcctaagtcactatttgaggaactcgcctatatggcttgggcaaaggccgacccaggagttatcttctttgacataataaacagaagaaacgtgctaaaagaagcaaaaggaggtcccattagggcaactaacccatgtgtcgttggagacacgagaatcctaacgcctgagggctatctcaagattgaagatctctttagaatggcaaaggaaagaaacaatggagaaaaagttgtcgcagtagaaggaatagctgagggaggagaagagttcgcctacccagtggcaatcttacttccaaatgaagaagaaaaagaagttatctatgaaactgtacatggaaagcaacttgccatagcagatcccattgaagtcaaagcatacgtttggaaggttggtaagaagaaagtagcaagaataaagacaaaagagggttacgaaataattgcaactcttgatcacaaaataatgacaaaagatggctggaaagcagttgaagatcttaaagaaggagatctaatagttttaccaagatttgaagtggaggataactttggaagcgaaagcataggtgaggatctagcttttgtcctagggtggcttattggagatggatatattaacacagacgataagagggtttggttctacttcaacgctgaaaaagaagaggagatagctcagaaaatctctgaaatactcaagaaacgctttaactccaaagcagagcctcacagatatggaagtgaaattaaactaggagtaagaggggaagcatacaaattctttgagaagatagtcaaaacaaatgataagagagttccagaaattgtctaccatttaaagccaaacgagatcagagcattcttgagaggtctattcacagctgatggttatgttgacaatgatggtgcaataaggctaacttcaaagagcagagagcttctgagagacgtccaagatttactactactctttggcataatatcgaagatctacgaaagaccatacaaaggaacatttgaatacacgactaaagagggcgaaaagaaagtctatacagctcaaggttactatgaactcgtgatagcaaactatagcagaaaattgtttgcagaaaagattggtttcgaaggagaaaaacagaagaaaattaagctcaataaaacaaaaatcgatgaaccctatgcaagagttgagagcgtggagataattggagaagaaattgtttatgacttaacagtcccaggaatccacagttatatctctaatggatttataagccacaactgtggagaagagcctctctacgaatacgaatcctgtaacttagcctcaattaacttagctaaattcgttaagtacgacgagaatgggaagccctatttcgattgggatgaatatgcatacgtgattcagaaggttacaaagtacttggacaacgctatagacgtcaacaagtttccgttaccggagatagaccacaacaccaagctaaccagaaggataggagtgggaatgatggggttagcagatgcgctgttcaagcttggaatcccgtataacagcgaagaaggcttcaagttcatgaggaaggtaaccgagtacctaacgttctacgcatataagtactcggttgaagcagctaagaggagaggaacgttcccgctctacgagaagacagaatatccaaagggtaagcttccggttgaaggattctaccacccggagatatggaacttaccatgggataagctggtcgaggaaataaagaagtatggattaaggaatgcaatggtaaccacgtgtccaccaaccggaagtgtctcgatgatagcggatacttcaagcggaatagaaccaatctacgctctagtttacaagaagagcgttaccgttggggaattctactacgtagatccagtgtttgaggccgagctcaagaagagggggctctacagtgaagaattactgaagaagataagtgacaactacggaagcattcaaggattagaagagattccagaggatatgaagagggtatttgtaaccgctctagacattcactggcttgatcacttgttagctcaagcaagcattcagatgtggctaacggattcagcaagcaagacgataaacatgatcaatgaagccacggtagaagatgtaaaggccgcatacctaatagcccacttcctgggttgcaaaggtgtcacggtttacagagatggttccctaagcgtccaggtttatagcgttgagggagagaaaaagaagaggaagtacaagccaaagccaagtgaatacgctaagaaggtattcctagagatagttgagaaggaaccatggattaagaatttcataaatgtggatgagatcttaaacggtaagagggaaagcaacttaaccttttcgctgagcattaaaaaggaacatcaagaaaaacctcaggaaaataaaggaattcccgaggagaaaataaaagagctactgggagtggtctactgtccagtatgttacgagagggaaggtaagctcgtggagcttaggatggagagtggatgtgcaacgtgcccagtttgcggatggagcaagtgcgtaataagc

SEQ ID NO: 43989 - DNA, 981 bp, Pyrococcus horikoshii
atgagagaacttcgatataaccctctcacagggcagtggatcatggtatctgcagtcaggaaaaatagaccatggagacctagaaatttttgtccattttgtccaggaagcgaagagacaggatatggatgggaagtccttttacttccgaacagattcccaatgctatcattcgacgcaccaaaacctaaaaatgaggatttctataaaaaggccagggctatgggtcaatgtagtgttattgtcgagactcccaagcatgagctcagagatttggatgagcttcccagggaacaaatggtaaagatagtgaggatgtggataaaaattacggaaacgttaaaggaaaatcgcaacgttgcataccttgctatttttagaaataagggagaggaaattggggtaagcttaaagcatcctcacggccaactttacgcccttccatatattcctctcaaggttagacttaaaatagagaactctagaaggtactataagagaactggggaatgcatattctgcaggataattaaagaagaggaaaagaacggggagaggactatctatgaaaatgataacttcatagtttttatgccattctttgcaagctggccctttgaagttcatatataccctaaaaggcacattcagtacctaaccgaccttaaggtgaatgaaattgaagacctagcggaagttatccaagtaactaccgcaacgctaaacgccgttctagataggcaaatgccatatgctatgatgatattccaagccccttttaaggggaattatcccttctatcacctccacatagagttctacccaattctaagagataatgggaaggttaagtatacagcgggaattgaactcgggacttgggaattcacatacgatggaattccagaagaaaacgccagaaaacttaaagaagcatgcaaaaaagtttcacagagaatgagtcttaagggaaaatgtatt

SEQ ID NO: 43990 - DNA, 1269 bp, Pyrococcus horikoshii
atgcctcttaagttccccgaaatgtttctctttggtaccgcaacatcatcccatcagatagagggaaataatagatggaatgattggtggtactatgagcagattggaaagctcccctacagatctggtaaggcttgcaatcactgggaactttacagggatgatattcagctaatgaccagcttgggctataatgcttataggttctccatagagtggagcaggctattcccagaggaaaataaatttaatgaagatgctttcatgaaataccgggagattatagacttgttattgacgagaggtataactcccctggtgaccctacaccactttactagccctctctggttcatgaagaaaggtggcttccttagggaggagaacctaaaacattgggaaaagtacatagaaaaggttgctgagcttttagaaaaagttaaactagtagctaccttcaatgagccgatggtatacgtaatgatgggatatctaacggcttattggcccccattcattaggagtccatttaaggcctttaaggtagctgcaaacctgcttaaagctcacgcaattgcctatgaacttcttcatgggaaattcaaagttggaatcgtaaagaatattcccataatactcccagcgagtgacaaggagagggatagaaaagccgctgagaaagctgataatttatttaactggcactttttggatgcgatatggagtgggaaatacagaggggtatttaaaacatataggattccccaaagtgacgcagatttcattggggttaactattacacggccagcgaagtaaggcatacttggaatcctttaaaattcttctttgaggtgaaattagcggatattagcgagaggaagactcaaatgggatggagcgtttatccaaaaggaatatacatggcccttaaaaaagcttccaggtatggaaggcctctttatattacggaaaacggaatagcgacgcttgatgatgaatggagagtggaattcataattcaacacctccaatacgttcataaggctatcgaagacggcctggatgtaagaggttacttctattggtcatttatggataactacgagtggaaagaggggtttgggcctagatttggcctagtggaagttgattatcaaaccttcgagagaaggcccaggaagagtgcttacgtatacggagaaattgcaagaagtaaggaaataaaggatgagctattaaagagatatggcctaccagaacttcaactt

SEQ ID NO: 43991 - DNA, 1047 bp, Pyrococcus horikoshii
atgataaaggtaaagagcccaggaagggtaaacctaataggtgagcacaccgattatacttatggctacgtcatgccaatggccataaacctctacacaaaaatagaggcagaaaagcatggagaagtaatactgtactcggagcattttggagaagagaggaagttttccctcaacgacttaagaaaggaaaactcatggatagactacgtaaagggaattttctgggttttaaaggagagtgactatgaagttggaggaataaaaggtagagtatcaggtaatcttccacttggagccggtttgagttcttcagcaagctttgaagtgggcatcctagagaccttagataaattatacaacttaaagctcgattcccttagtaaagtactgctagcgaagaaagccgaaaatgagtttgtaggtgtcccgtgtggaattttggatcagtttgccgttgtattcgggagggaagggaacgtaatattcttagacacacatacacttgactatgaatatatcccattccctaaggatgtctcgatacttgtgttctacactggagttagaagggagctagcatcatcagaatacgctgaaaggaaacatatagccgaagaaagcttgaagattcttggtaaaggatcttcaaaagaggtaagggagggggaattaagcaaactacccccattacacaggaaatttttcgggtatatagttagggagaatgcgagagtcctcgaggttagagatgcgcttaaagaaggcaacgttgaggaggttggaaagatcctcaccacggcacattgggatttggcaaaaaattatgaagtgagctgtaaggaattagacttctttgttgagagggctttgaagctaggagcatatggagcaagattaacaggtgcaggatttggaggttccgcgatagccttggtagacaaagaagatgctgaaacgataggggaggaaatactcagggaataccttaaaagatttccatggaaagctagacatttcatcgtagaaccttcagatggtgttggg

SEQ ID NO: 43992 - DNA, 984 bp, Pyrococcus horikoshii
gtggatattattgttgctcttgggggtgatcttatgagacccctcaactttaaagttatccacggtggtgctaggaaagagggcttaatagacttctcggcttcagtgaacccttatcctccagagtggttaagcgaggtttttgagagggctaaggatcttagttcaaggtacatctactacgaagagcttgaagaagagttcgaaagcctaattggtgagccaatcactataaccgctggaattactgaagccctctaccttcttggtatcttaacccttagaaacaaaagggtaataatccctaaccatacttacggcgagtacgagaggatcgccaggatgtttggtgctaaggtcataaaggggccaaacgatccttcaaagctggctgagctcgttgaaagggaaagcgtcgtgctcttctgcaacccgaataatcccgatggaaagtactacactcctaaggaacttaagtccttgattgatgcagttaccgatacaaactctctgctaatcctggatgaagcctttatagacttcgtgaagaaagctaaaagtcccagtggagagaacttgattaagctaaggactttcacaaagagctacggcgttcccgggataaggattggttacgttattggcttcagtgaagcctttagaagcgtaaggatgccctggaacataggtgcagttggagttgctttcctggaaaaggtaattgaggatgaatttgcacaccttcgtaggacactacctttgatatggagagaaaaggagaggatcgaaaggaggctcggtgttaaaagcgatgctaactttttcataatgaacgttggagatgctagagctgtcgttgagaagcttaagaagaagggaatacttgttagggattgctctagctttgggcttccgaattacattaggttctcagttagaaaacccgaggaaaatgataagcttatcgaggctttaacgtctctt

SEQ ID NO: 43993 - DNA, 981 bp, Pyrococcus horikoshii
gtgaaggtcctcataatggccggaggctatgcgacgaggctttggccgataaccaaggataatcccaaggccctcctacccttaggtaataagacgatactagagtacatcctcgagaaggttagggagctggatgttgacgtttacatctcaacaaataggttctttgctgagaagttcaggaagtacgatgtagagcttatagtcgaggataccgttcatgaggaggaaaagctaggaactatagccgctatgaggaatgcccttaacatcctgggcgaggatgattacctaatagttgccggcgataacgtgttctccttctcccttaaggacttcgttgataacttctctgggaaaacccttatagcggtttacgacgttggtgattttgagctagcaaagaggtatggagttgtagtccttgagaaggatagggttatagacttcgaggagaagcccgctaatcccaagagtacactgataagcaccggggtttacctcttccctagggatgtcatgaagctccttaatgaatacctcgaggatgggaacaaggattcccccggctacttcctccagtggctccttaagagaggggaggagataagggcttacaggttcgatggctactggtacgacataggttccgcggatagttaccttgaagcaatgaagaccctgcttaaggagagctacatagaggagatccagataagcccctacgcaaagataatacctccggtggttataaagaaggggactaagataatggggagatcgataataggcccctacgcctacataggcgaggaatgcataatagagaattctgatataagcgattccataatattcccgaggactgtgataaggaactccactatatggcgctctattatagatgaaaagtgcgagataaggaacctcgagctgaggaagagcctagttggaggccacgcaaagatccagaggggagat

SEQ ID NO: 43994 - DNA, 1068 bp, Pyrococcus horikoshii
atggtggatacaatgaaagccctcatcctctcaggcggctatgggactcgattaaggcccttaacttactctcagcagaaacagttaattccggtagccaataagcctgtattgttttatgcaattgaagatgtaattgaagctggtattcacgagattggaatagttgtcggacccaatgctgatctagtgaagaagacagttatgagcgttgactgggatgccaatattgaattcatctaccagggtgagccaaaggggttagcccatgcaatcctcgttgctagggattacttaggagatgaagacttcgtcatgtacctaggggataacatcctaagagaaggaatagttaggcataaagagcactttgaaaagagtgattacgacgctagcattctcctctgtgaggttcctaatccccagcagtttggagttgccgagctcagcgaggatggaaagactataaagagactggtagagaagccgaaacacccgccgagtaacttggccttggtaggtatctacttcttcagaccaataatccatgaagcggtgaggcacataaagccctcatggaggaacgagctggagatcacggatgctattcaatggctaatcgataacgggtacaaggtggggtggacaaaggtaacgggctggtggaaggatactggaaagcctgaagatttgctcgaggctaataggctagtcttagatgagatagagaaagaggttaaagtggagacaagggcgaagataattggtagggttaaaattgaagagggagcccaaatagacgagaattcagtaataaaaggcccggccgtgataggtaagaatgccgtgataaggaacgcctatatcgggccttacacgagtgtaggaaacaatgtcgtgattgaagatactgaggttgaggactcaatagtaatggatgacagtattatcgtaggagcagggagaattgtggaaagcataatagggagaggagtaaagataataaaagggaacagccacccgatgggaagaaggctaattattggtgataactcgcaaatagtgctg

SEQ ID NO: 43995 - DNA, 1008 bp, Pyrococcus horikoshii
atgaggatcctgatgataggacactatcccccccacaggggaggcgtcgcaaggcacgtcaaggatctggtagactacctctccagggagcacgaagtccacgtaataacctacggaactgtaaagggtaaaggggaaaacgtcagctacgttaaggtacccaacatcttcgggctaagggggacttccttcactctcttagcatctaagctaggggtaaagctacacaaaaaacttaacttcgatctgatccacgcccactacgtgggtacaacgagctacgctggcgtcctaataaaggaaagaactggtttacctttggttgtgacagctcacgggagcgaccttgacttcacctcaaagctacccctcggtagctactacgttaaaaaatctctcattaaagctaatgcagtaatagccgtgagccactacttaggagttaaagctaaaatgctaggtgctgaaaacgtcaaggtaattccgaactgggttaccaaaactgggaaatcaaggggggaatacatagcgttcataggtaggttaaccgagtacaagggggttgaggatttcatagagcttgctaagttattcccccaggaaaagttcgtcgtggctggagaaggtcccctcttaaagaaactaatgaaggaaagtcccaagaacgtaaaattcttagggtacaaacccagcgaggatgttttgagtaaagcaaaggttttgatcctaccctctaagagagagggcttcggtttggttatccttgaagctaactcctttaaggttccatcccttgggaggagggtaggtgggataagggagataataagggatgggaagaacggttatacgttctcagcccttgatgaggcgtacgaatatttaaaagagctcctgaaccctaagaaggggaggaaagctggggcgatctcttacaggatttcaaggttctacagcatggaggagtcatgcaagaggatccttaaggtctacgaggaggtggtggga

SEQ ID NO: 43996 - DNA, 1017 bp, Pyrococcus horikoshii
atgccgagcgttatagttgtaggcggtcagtggggagatgaagggaagggctcaatagtggcttacctttctctccatgacgagcctgagataatagctaggggcggcgttggaacgaacgctggtcacagcgtggtcataaacgggaagaagtatgcggtaagacagatcccgactggcttcatgcagacgaaagcgaggcttttgattggggccggagttctagtcgatcctgaggtcttcttccacgagctcgagcagttgaaagactttaatgttaaggatagggttgggatagattatcgctgcgcaataatagaggagaagcacaagcaactggacaggaccaacggttacctacatggaaagatcggaaccaccgggagcggttgcggacctgctaatgctgacagggttatgaggaaggccaagcaagcaaaggatgttaaggagcttgaaccttatttaaccgacgtagcccaggagataaacgatgccctggatgagggttccctagtcctagttgagggaacgcagggctttgggctcagcctctactatggaacgtatccttacgtaacttcaaaggatgttacagcttcatctgttgcagctgacgttgggataggcccaactagggttgacgaagttatagttgtcttcaagagctttcccactagggtgggtgcgggacccttccccacggagatgccaatggaggaagctgacaggcttggcctcgttgagtacggaacggtaaccgggaggagaaggagggttggctggttcgactttgagatggccagatattcagctagaataaacggggccacgatgcttgccgtcacgatgctcgacaagtacgacaaggaagcctttggagttacggattacgacaagctacccaggaaggctaaggaatttattgaagaaatagaggagagggttggagttccagtgggattgataaagacgggccctgagcttgagcacataatagatagaagggataccatc

SEQ ID NO: 43997 - DNA, 1479 bp, Pyrococcus horikoshii
aagttttactggggcgtcgttcagtctgcatttcaatttgaaatgggggatccctacaggaggaacatagatcccagaagcgattggtggtattgggtcagagatccatataacataaagaatgacctcgtcagtggagacctaccagaagagggaataaataactatgaactttatgaaatagatcataggttagcaaaagagcttggattgaatgcttatcaattaacgatagagtggagcagaatattcccttgccccaccttcaatgtagaggttgaatttgaaagagacgggtacgggctcataaaaaaggtgaaaatagaaaaggaacacttagaggagctcgataagcttgcaaatcaaaaggaagttaggcattacctgaatgttttaaggaatttgaaaaaacttggatttacaacattcgtcactttgaaccaccagacaaatcccatatggatccatgaccccatagaaactagggggaacttccaaaaggctagagcaagaggatgggttgacgaaaggacaatcatagaattcgcgaagtatgcagcctatgtagcctggaagttcgacaactatgtagattactggtcaacatttgatgaaccaatggttacagcggagctcggttatttagccccttacgtcggctggcctcctgggattctaaacccatcagcggccaaaaaagtgataattaatcaaatagtagctcacgccagggcctacgattcgataaagaaattctcgtctaagcctgtaggagtgatactaaatataattcctgcttatcctctagatccaaacgattctaagagcgtaagagcagccgagaattatgatctcttccacaataggctgtttctagaggccgtaaataggggaaacgttgacttggatatcacaggagaatacaccaaaataccacacataaagagaaacgactggatcggaaacaactactatacaagagaggtcgtcaagtacgttgaaccaaaatacgaggaattacccctcatcacattcgtcggtgttgaaggttatggatactctggaaatcccaatagcttatccccagataacaatccaacgagtgactttggctgggaggtattcccccagggtctctatgactccacgttagaagctgcggagtacaacaaagaggtgttcataacggagaatggaatagctgactccaaggatatactaagacctaggtacatcattgatcacgtcaatgaagtcaagaagttgatagaaaatggaataaaagtaggtggatacttccactgggcacttacagataattatgagtgggctatgggatttaagattagattcgggttatacgaagtggatttgataacaaaggagagaatacccaggagaagaagcgttgagatctataaaaaaattgtaatggaggggatcgaatgaagacgatagcagttgatgaaactacctgga

SEQ ID NO: 43998 - DNA, 969 bp, Pyrococcus horikoshii
atgaaaacgctaattgagattaagcaaacgcctgatgggataattaaagctgataaggtatttaataaggtaaaagataagataagcctaccgaatagaatcctgtacttagggtgtggctcttcacacttcctttccaagctcttggcaatggttactaacatgcacggaggcctagggatagcgttaccatgttccgagtttctttactctaaggaaacttatccgataggagaggtagagcttgcggtaggaatatcgaggtcaggggaaaccacagagatcttattggccttagagaaaattaacgtcaagaaacttggaattactacacgtgaaagctccttgacgagaatgtgtgattattctctggtagttccagccattgaagagagcgttgtgatgacgcactcatttacatccttctactttgcatacctccagttgttaagatactcctatggacttccacctttaaatgctggagagatctcaaaagcaacggagaaaagcctggaatacgaaagatacataagggagatagttgagagctttgacttccaaaacattatctttctgggctcaggattgttatatcccgtagctctagaggcaagtctgaaaatgaaggagatgtcaatattctggagtgaggcttacccaacctttgaggtgaggcacggctttaaggccatagctgatgaaaaaactctagttgtgctaatggttgaggagccttttgagtggcatgaaaagcttgtaaaggagttcaagaaccagggggcaaaggtgctagtaatctcaaattctccccaggatcttggacaggactattctatagaacttcccagactcagtaaagatgcgaatccaattccctacctccctatagttcagcttctctcctactataaagcggtaagccgtggattaaatcccgataatcccaggtttttggacaaggttgta

SEQ ID NO: 43999 - DNA, 1275 bp, Pyrococcus horikoshii
atggtgaactccatggattgtggaagggattactgcgtgaaagatctatccctcgctgacgaagggtggaagaaaattgattgggtttctcgcttcatgcccgttcttcagcacataaggagggaatttgaggagaaaaagcccttcaagggtgtaaggatagcggccaccctccacctggagatgaaaaccgctttccttctgcttactttaaaggccggaggcgctgaagtctctgcagcggcaagcaatcctttaagcacccaggatgatgttgtagccgctctggcaaaagctggagttaaggtttacgcaataaggggcgagagcaaggaacaatactacgagttcatgcacaaggccctcgacataaggccgaacataataattgatgatggagcggatatgataagcctagttcacaaggagaggcaagaattactagatgagatctggggaggtagtgaggaaactacaactggggttataaggcttagggccatggaaagggatggtgtccttaggttctcggttatagccgtgaacgactcctacatgaagtacctcttcgacaaccgctatggaacgggtcaatcaacctgggatggggtcatgagggctacaaacctcttaatcgctgggaagaacgtggtagttgtaggctatggctggtgcggaagagggatagccatgcgcgcccgtgggctgggtgcaacggtaatagtcgttgaggttgatcccataaaagctcttgaagccaggatggatggcttcctggtcatgaacatgaaggaagctgctaagataggggatatattcataaccgcaaccggggatataaagtgcatccgcagggagcacttcgagctcatgaaggatggtgcgataatggccaacgctgggcacttcgacgttgagatatggaagcccgatctcgaggagctcgccgtcgagatcagcaatccaaggccgaacgtaaccgagtataagcttaaagatggtaggaggctgtacctattagctgacggaaggttggtgaacctggttgctgctgacggtcatcctgctgagataatggatatgagctttgcccttcaagctaaagcagctgagtacataaaggataaccatggaaagctggaacctagagtttacattctaccgagagagatagatgagatggtggccaggataaagctagcatcaatgggaattgaaattgaagaactcacggaggagcagaagaagtacctagaaagctgggagcacggaact

SEQ ID NO: 44000 - DNA, 1434 bp, Pyrococcus horikoshii
gtgagaaggatgaagcttccctcccataaaacaaagattgtcgcaacgatagggccggcaactaactcgaaaaaaatgatcaaaaaattaattgaagctggcatgaacgttgcaagaataaacttttctcatggcacattcgaagagcatgcaaagatcatagagatggtgagggaacagtcacagaagttagataggagagttgcaatattagccgaccttcccggactgaagattagggttggggagataaaggggggatatgtggaacttgaaagaggggagaaagttactttgacaacaaaagatattgagggagatgaaacaacgatccccgtagaatataaggatttcccaaagcttgtatctaagggagatgtgatatacctaagcgatggctatatagtgttaagagtcgaagatgtaaaggagaatgaagttgaagcagtagttatttctggtggaaaactcttctcgaggaaagggataaacattccaaaggcctatcttcccgttgaagctataactccaagagatatagagataatgaagttcgcaatcgaacatggcgtcgatgcaataggactcagctttgttggaaacgtttacgatgtactaaaagcgaagagctttttggagagaaatggcgcaggtgacaccttcgttatagctaagatcgaaagacccgatgctgttagaaacttcaatgaaattctaaatgccgctgacgggattatgatagccaggggtgatctaggggttgagatgccaatagaacaacttccaattctccagaagaggttaattaggaaagccaacatggaaggaaagcctgtaattacggcaacccagatgctcgtttccatgacaatggaaaaagtcccaacaagagctgaagttacagacgttgccaatgcaatactagatggaaccgatgccgttatgttgtctgaagaaacagcagttggaaaattcccgattgaggccgtcgagatgatggcaaggatagcgaaagtaactgaggaatatagggaaagctttgggataaccagaatgcgagagttcctggaaggaacgaagaggggaacgataaaggaggcgataaccaggagtatcattgatgccatctgcactataggtataaagttcatattgacgccaactaaaacgggtagaacggcaagattgatctccagatttaagccaaagcagtggatacttgcattctctacgagggagaaagtttgcaataacctaatgttcagctatggagtgtatccattctgtatggaggaagggttcaatgagaatgacattgttaggttaataaagggactaggattggttggaagcgatgacatagttttgatgacggaaggtaagccgatagagaaaaccgttgggactaattcaataaagatattccaaatagcg

SEQ ID NO: 44001 - DNA, 3324 bp, Pyrococcus horikoshii
atggagagggaagagataattgagaggttcctcaaattctttagggagtatgcagaagagggtgaagaacccctctacatgggtaaaataaaggatctgctaacgataacgccaaagagatcaatagtgataaattggatgcatctaaactcatacgatccggagcttgctgaggaggttatagaaaacccagaggagtgcatacttgcagctgaggatgcaatccagataatactgaaggaggacttcctaagggaagatgtgccaaagatacacgcaaggttccacaacctcccaaagaccctaatggttaaggaagttggtgctgagcacataaacaaactcattcaggttgaaggggtagttacaagggttactgagataaaacccttcgtctcagtcgcggtcttcgtttgtaaggattgcgggcatgaaatggttgtgcctcagaagccctatgagggctttgttgcagtaaagaaatgcgagcaatgcggaagtaaaaacgtccagcttgatgtggagaagagcaaattcgtgaacttccagatgttcagaatacaggataggccagagagcttgagaggagggcagatgcctaggttcatagatgggatactcctggatgatatagtggatacagcaatgccaggtgatagggtaatagtcgtggggatcctcagagtgatccaggaaaagagagagaaagttccaacgttcaagaaggtgatagaggtcaaccacatagagcccataagcaaggagctcgaagagcttgagatatctccagaagatgagcagaagatcagggaactcgcaaagaggaaggatatagtttcagccatagttgactcaatagcgccagcgatctacggatacaaggaagttaagaagggaatagccctagccctcttcggaggagtctcaaggacgctacccgatgggacgaggcttagaggggatatccacgtcctcctcgttggagatcctggcgtcgctaagtgcgttgactacgatacagaagtcctacttggagatgggagaaagaggaagataggagagatcgttgaggaagcgataaagaaagcagaaaaagagggaaaacttggaagggttgacgatggcttctacgctccaataaacctggagctgtacgctttagatgtgagaacccttaaggtcaggaaggtcaaagctgacatagcgtggaagagaacaaccccggagaagatgttgaggattagaactaagaggggtagggaaattagggtaaccccaacgcacccattcttcacgttagaggagggaaggataaagacgaagaaagcttatgagctaaaggttggggagaagatagccacccccagggaggaagcacccgaagctgagatattttgggatgaagttgttgagattgaggagtacaagcccaataactcttgggtttacgatctccaagttccagagcaccacaacttcatagcgaacggaatattcgtgcacaatagccaactcttgcgttacgttgcaaacttagcccctagggctatatacacctcgggaaagagttcctcagcagctggactctgcgtggccccggataccttgataaataccgacaacggaagggtagagatcgggaagttcgtggaggagtggatgaaggaagttggagagataagcgaggaagggatcagctatgcaccatgcttcaggaaggtcgagacgttcaaagacgggaagatagttgaatcaccaattagaagggtttggaaactgagagctccgaagaagctcgtgaggataaaaacggagaatggaaggagcatagccctaaccagggagaccaagttactaacgataaatgatggagaattatcctgggttgaggccggggaggttaaggtaggaacatacgtgggaacggtaaaaagtgaaaaagacgtgattccaggggctggaaagacaataagggatgtttcaaaactctacaatatggaaatggaagttaaggattacttaaccagggaagaagtgagaaaagccattgaaaagcttgaagaaattatgaatccaatgaatatcaagattcctggggtgcaagaaagttacgaagagctgttaaggaagcttgaaactaccaacgacgagagggttaggaacgagacattgatcctcctaagtgacgttagcgatgcccacgagctcgccaaggaaaaaatcgagaagatcaaagagatcgtgaactcggaagttcactgggagaaagtcactgaagtaggggaagtagatggggttgaatacgtctatgaccttaccgtagagggaagccacaactttgtagccaacggattcatagtccacaacacagctgctgtagttagggatgagttcacgggaggatgggttctagaagctggggctttagttcttgcagatgggggctacgcattgatagatgagctcgacaagatgagcgatagggatagaagtgtaatccacgaagccctggagcagcaaacgataagcctatcgaaggccggcataacggcaacgctaaacgctagaacgacggttatagctgctgcaaatccgaagcacggaaggtttaacagaatgaagagggtgtcagagcaaatagatcttcctccaacgttgctgagcaggttcgacttaatcttcgtcctcatggatgagccggacgaaaaggtagacagcgagatcgctaggcatatattaaaggttagaaggggagagagcgaggtcgtaactccaaagataccgcacgagttgcttaggaagtacatagcttatgccaggaagaacattcatccagttataagcgaagaagccatggaagaaattgagaagtactatgtgaagatgaggaggagcgcgaagaaaagtagtggggatgagataaagccaattccgataactgctaggcaactagaggccctgataaggctaagcgaagcccacgctaggatgaggctcagcccgatagttacgagggaagatgcaagggaagccataaagctcatggagtacacgctcaagcaaatagccgtcgatgaagccggtcagctcgacgttacgatacttgaagttgggcagagcgcgaggaagcttagcaaagtagagagaatacttgatatagtagaaaagctagagaggacaagcgagaagggtgcaaagattgatgatatcctcgaggaagctgcaaagtttggaatagagaagagtgaagcgagggaaatactcgaaaagctactggagaagggccagatttatatgcccgagaacggctactacaaaaccgtc

SEQ ID NO: 44002 - DNA, 2058 bp, Pyrococcus horikoshii
atgatcttaataatagcggaaaaaccaaatgttgcaaggaagatagctggggcactttcagagaggaggccaataaagaagtctctcttcggcgttccctactatgaaattttcagggaggggaaaaagctaatagtagcttccgcagttggtcacctctatggtttagcccccaagcgggatgtatttggttatccaatattcgacattgagtgggttccagtttacatagccgaaaagggtaaggagtacgcaagggagtatattaaagccctctcggttcttgctaagagggtgagagagttcatagttgcatgtgactacgatactgagggagaagttataggttacacggccctgaaatacgcttgtggcgttgatcctagggttgctaagaggatgaagttttcagcattgaccaagagagatctattgaatgcttggcgaaatctcgagccaacgataaactttgggatggcaaatgctggaatcgcgagacatatcctagactggtactggggggtgaacctctcaagggccttaacgcatgctataaagaaggcttcgggtaagtgggtggtgctaagcaccggtagggttcaggggccaactctaaagttcctagttgaaagggaaagagaaatacagagttttgttccaaggccttactgggttatcaaactgatatttgagaaaaacggtcaaaaatttactgccaactatgaaaaagacaagatatgggaagaggaagagggaaagagaatagttttagaggttaaaaagagcatcccaagagtttctaatgtagagataaaaagacagaagagaactccccctcatccctttgatctcggtacacttcaaagagaagcctactcagcttttggctttagccctaagaaaactcttgacatagctcagagcctatatgaaaaaggattctcgagctatccgagaaccgaaagccagaagttacccaggaacatcaactttaggatgataattcaaaatcttgcaaagatgcctcagtataggccttatgctcatatcctactgggattaccagaacttaaaccagttgaggggaaaaaggaagatcccgctcatcccgctatttatccaacgggagaaattcctaggccgggggatctaacgaaagatgaagaaaaattatatgatatgatagtcagaaggttcctagctgtatttatggaaccagcgattagggaaagtgtaaaggttaccataagggccggcccccataaatttttcttgtcgggtgggagaacggttaaaaaaggttggctaagtgtctatgggaaatatgtgaaattcgaggaagttacgctccctgaattctttattggtgagaggataaaggtaattcaagttaaaagagaaaagaagaaaactaaacctcctgccaggtattctcccgctgccgtgataaagaagatggaagatcttggccttgggactaaagctaccagagctcaaatccttgaaaccctttatcagaggggttacattgaaggtaagaagagcattaaagttacacctctcgggatgaaagttatagaaacgttggagaagtacgttcccgagatcataagtgttgaattaactagggaattcgagaagaagatggagttgataatggaagggaggctcactaaggaggaggtaatagaggaagccaaagagaggcttaccaagatcctggaggagtttaaaaagagagaactggagataggtatagaactcgctaaaatcgtcgttggtgaggatgaagttaagccccttgtagttggtaagtgtccaaagtgtggcggggatttaatagttaagtacaacaagaagacaggaaagaggttcgttggatgctcaaattggccgaagtgcgatgtaacttatccgatccttcagaggggagaaataatacctaccaataagacgtgctgtaatggtgctccggtagttataatcagggaagaggatgggagagaattcgaaatatgcctcgacattaactgcaaggactggaaagctaaatctcat

SEQ ID NO: 44003 - DNA, 1044 bp, Pyrococcus horikoshii
atgtcagaaaagatggtagctatcatgaagacaaagcctgggtatggtgctgagcttgttgaggtggacgttccaaagcctggacctggagaagttctcattaaggttcttgcaaccagcatatgtggaactgatcttcatatatacgagtggaatgagtgggcacagagcaggattaagccacctcagataatggggcatgaagttgcgggagaagtcgttgaaatcgggccaggtgtggaaggaattgaagttggtgactacgtttccgttgaaacgcacatagtttgtggcaagtgttacgcctgcagaaggggccagtaccacgtctgccagaataccaagatatttggcgtcgatacagatggcgtattcgcagagtatgccgttgttccagcccaaaatatctggaagaatcctaaatcaattccaccagaatatgcaaccctccaggagcccttgggtaatgctgttgataccgttttggcaggaccaatttctggtaagagcgttttaataaccggagcggggccccttggattattgggaattgcagtggcaaaagcgtctggcgcataccctgtgatagtctcagaacctagtgacttcagaagggagttggccaagaaggtaggtgctgattacgttatcaatccattcgaagaggatgtcgttaaggaggtaatggatatcacagatggaaatggtgttgacgtatttctggaattcagtggagctcctaaggctctagagcagggtcttcaagcagttacacctgctggaagggtatctctcctgggtctatacccaggaaaggttaccattgactttaacaatctaataatcttcaaggcgctaacaatctatggaataactggaaggcacctctgggaaacttggtatacagtttcaaggctccttcagagcggaaagctcaacttagatcctattataactcataaatataagggattcgacaagtacgaggaagcctttgagctaatgagggccggcaaaacgggtaaagttgtttttatgcttaaa

SEQ ID NO: 44004 - DNA, 330 bp, Pyrococcus horikoshii
atggtaaagttctgccctaggtgcgggagtataatgattccggataagaagagaggagttttcgtgtgtaggaagtgtggttacgaggaacccattaatcctgaggatgctaaagcctatagaagaactgaggagattaagcataagcccgatgagggagttatagtgatagaacaagacttttcaacgttaccaactgcaaaagttacctgtccgaaatgcggctatcatgaagcctggtattgggaggttcagactagggccggggatgaaccctcaacgatattctataagtgcaaaaggtgtggctacgtatggaggagctacgag

SEQ ID NO: 44005 - DNA, 747 bp, Pyrococcus horikoshii
atgccattcgaaatagtctttgagggtgcaaaggaatttgcccagctcatagagacggccagcaggcttatagatgaagcggcctttaaggtaacagaagaaggaatatcaatgagggctatggatccgagtagagtagttttaattgaccttaacttaccttcgagcatattcagtaagtatgaggtggatggggaagagacgataggtgtcaatatggatcacctaaagaaagttcttaagagaggtaaggccaaggatacgcttatcttgagaaaaggagaagagaacttcctagaaataagcctccaagggactgctactagaacctttagattacccctaatcgacgttgaagagatcgaagtggaattacctgatctcccgtatacagcaaaggttgtcgttctgggcgaagtgcttaaggaagcagttaaagatgcttccttagtaagcgatagcataaagttcatggctaaggaaaatgagtttatcatgagagcggaaggagaaacccaggaagttgaagttaagttaaccctggaggatgaggggttacttgatatagaagttcaagaggagacaaagagcgcttatggggttagttatctagcggatatggtaaagggaataggaaaggccgatgaagtgacaatgagattcgggaatgaaatgccgatgcagatggagtactatattagggatgaaggtaggttaacgttcctgctagccccaagggttgaggag

SEQ ID NO: 44006 - DNA, 1167 bp, Pyrococcus horikoshii
atgaataataaggtaataatagttggcgttggcatgactcccgtaggggagcactggaggacgtcacttagagatctggccgttgaagcaattttaaaggccatggatgatgccggaatagacaaagttgactctctgtatgtaggaaacatggcatcaggctcattcatagagcaggaaaatcttggagccctcatagcggactgggcaggtttaggaaacattcccgctgttaaaattgaagcagcttgtgcctcaggtggagctgcggttcaggagggagttaaagcagtactaagcggattagaggatgtcgtcctagtagtcggcgtagagaagatgaccgatgcctggccaagcgatgccacaaggtatttagcttacgcaagtgacgcagagtgggagcttttccatggggtcagcttcgtcgcacttaatgcattagtaatgaggtattacatgaatacttatggatatacagaggaagatttagccctatttgcagttaatgctcacgctaatggggctaagaatccatatgcaatgtttaagaagccgataactgttgaaacagtcatgaaaagcccctatattgcagatccactaaagctatttgatgcatctccagtttgcgatggggcagcggcggtaataataacaactccagagaaggcgaaagaactgggagttccaaaggataagtgggtagaagttgcaggaatgggaagggctatagatacaataaacctagcaaacagggaggatctgttaacgctaaaagccgcaaaaattgcagctgagaaggcctataaaatggcccacgtcgagccgaaggatatagacttctttgaagtccacgatgcatttacaattatggccgcccttagcttagaagcccttggagttgccgaaaagggaaagggagctatgcttgctaaagagggacaaatagccatagatggcgattatccaatacaaacgatgggaggattaaaagctagaggacacccagttggagcaacgggagtttaccaagcagttgaagctaccttacagctcagaggagaagctccaaatggtattcaggttcctgacgctgaagtaggattaacccaaaacataggtggaacgggttcaaatataaccgtcacaatcttcaggagggtt

SEQ ID NO: 44007 - DNA, 2520 bp, Pyrococcus horikoshii
atgatactcgggaggagtgagcctcaaaaggaggagatcaagcttagggtagctgaggcccttaagcgtgacgttggtagggggattgttagatttgatagacgctatcagaagatgataggcgttgagccgggggatatagttgagatagagggagagagggtaacagcagctatcgttgcgaactcccatccggatgataaagggctcgacataataaggatggatggttatataagaaaaaacgctggagttagcattggagattacgttaccattaggagagctcaagttaaagaggccaaaaaggttgtccttgctcctgcgcagaagggagttatagtccagattcctggagatattataaagaataaccttctcgggaggcctgtagttaagggtgacatcgtagttgctagtggtcgtggggatttatactattctagcggaactccattcgatgagatcttcaggggattctttgaggccatgtcggtcggctttggagagcttaaattcatggttgtaaataccattccaaaagggatagtccagataacatataacaccgaagtcgaggttcttcctcaggccgttgaggtcagggaagagaagatcccggaagttacctatgaggatattggtggccttaaggaggcaatacagaagataagggaaatggtcgagctacccctaaagcatcctgagctctttgaaagactgggtattgagcctcctaagggtgttcttctttatggtcctcctgggactggtaagactctcttagctaaggccgttgctaatgaggctaacgcttactttatcgcaataaacgggccagagataatgagcaaatactacggagaaagcgaagaaagattaagggagatatttaaggaagctgaggaaaatgctcctgcaataatcttcattgacgagattgatgcaatagctccgaagagggaggaggttgttggtgaggtagaaaagagggttgtctctcaattgttaactttgatggatggtttgaagggtaggggtaaggttattgttattggggctactaataggcctgatgctttggatcctgctttgaggaggcctgggcgttttgatagggagattgaggttggagtgccagacaagcaaggaagaaaagaaatactacaaatccacacaagaggaatgccaatagaaccagacttcgagaaggatgcagtaataaaagtcctcaaagatttggagaaggatgagaggtttgagaaggagaagattgagaagataatcgagaaggtttcaaaggccaacagcgaggatgaaataaaggagatactcaaggaggacgggaacgtatatgtagaggttagaaacaggctaatagataagttgcttgaggaattggctgaggttactcatggtttcgttggcgctgacctagcagcactagccagagaagcagcaatggtcgtgcttagaaggctcataaatgagggtaagataaatccagaggccgaaagtattccaagggaggttctcgaagagttgaaggttacaaagagagatttctatgaggctttgaagatggttgagccttctgctttgagggaggtcctcatcgaagtcccaaacgtccactgggatgacataggcggattagaagaagtaaaacaagaactaagagaagcagtagaatggccactaaaataccccaaggcgtttaagaaactcggtataactcctcctaagggtgttttgttgtatggtcctcctgggactggtaagactctcttagctaaggccgttgctactgagagtgaagccaacttcatagccgttagaggcccagaagtattaagcaagtgggttggcgaaagcgagaagagaattagggaaatctttaggaaagcaaggcaagctgcacccgcaataatctttattgatgagattgatgcaatagctccggctaggggaacttctgagggtgaaaaggttactgataggatcattaatcagttgcttacggaaatggatggactagttgagaacagtggtgtcgtcgttattgctgctactaataggcctgatattttggatcctgctttgttgaggcctgggcgttttgataggcttattttagttcctgctcctgatgaggaggctaggtttgagattttcaaggttcacactagaagcatgccattagccgatgacgttgatttaagagaattagcaaggagaacagaaggatacacaggagcagacatagcagcagtatgcagagaagcagccctaaacgcgctgaggagggttgttaagagcgtgccaaaggagaaattggaggaggaaagtgaagagttcctcaataaattggtagtcacaagaaaggattttgaagaagcgttgaagaaagtcaaaccgagtgttagcaagtatatgatggaatactatagacaatttgaagaggcaagaaagagggttagtggagagtccgtaggaagggaaccagattactttactgga

SEQ ID NO: 44008 - DNA, 1923 bp, Pyrococcus horikoshii
atggaggagcttcagtacttcccatatgaaaagttcaggccgaatcagagggaatttatcgaaatagttaaggaagccgtaaaaagaggagagaaccttattgttgaggctccaactggatttggaaagacaataagcgttttagctggggtgcttccctatgctatctcgctgggctataaagtagtgtatttagctagaactcataagcagatggatagggtgatagaggagctcagaaagatcggggagaaaagcgaagttagtggaatagagtttaggagtagaaaagatttatgccttcacgcctatattcagacctttgcccaggatgcttacactagtatgatagtgtgtaagagtctaagaaagcttggaaagtgcaagtattatgaaaacttaaaggagaagagggatagggttgatgaaattgtaaaattcttcttaagctttcccccctttcctcgtgaagttattgagtatagcgaattacttgagctctgtccttatgagattacaaagaaggttggtgagaaagccaacgtcgttgtggctagttacttatacatgataagccccccaataaggcaggcattcttggaaaacctaggtgttgattattcagatttgatagtgatattcgatgaagctcacaacttgcccgatcaggctatttctgcacttagcgatagattaagcgtgagaagtatagaaagggccattaaagaagccgaagagtacggggaaaaagatatcgaaaacttcctctcgatattactaaggggtctagaaatcttatataaagaaaagttagagaactatgaaagtgaagagatccccataaggccagaggaggtgtttcttcacccagcttccatcctggggtggaggggaagagatattggaatgatgctagaggatatgatcgaggttggtgatgccattagggaggatagaatagaaaggaatcttcctcctaggagttacgttggaagagttggagagtttctgtggaattggctttcccttcgagatagggaagactacttacacctattcacaaaagaaaaaggcttagccttggagttagtggccctcgatccttccgttgcccttgacttccttgaggaggttcactctgcaatatttatgtccggaactctcagccccctagaggcatttagggatataattggtgttaatgctagactaaagaagtttcccagaattgtaaagagggaaaatgctatcgtccttgtggcgagagatgtatcaaccagagggatagagagaagtcctcctctgtataaaaggatcgcggaatacatatttgaagccgtcaaaaatactccaaaaaatgttggagtatttacggcttcctatgaggttcttgagggagttctaagtactaatgttcacataaagattgaggaagaagtcggaaagaaagtcttcatagagaaaaaagatgctccttccagggaaaacgatgagatgattagggaattcaaggaagaatctaaaggaaaaggtgcggtactatttggtgttatgggagggaggaacagtgaaggtcaggactattcgggggatgaaatgaatggagtcatcttggttgggatcccttatgcaaggccaactcccagggttcaagctcagacaaggtactttgaaaagaaatttcctgggaaagggaggtattatggatatatcctaccagcccatagaaagctagctcaagctgcaggtagggttcataggtctgaaaatgaaaagggtagtatagtgatcttagactacagagtcctatggaaaaacgttaagaaagacctccccgactggatggtagaaaccatgattcccgtaacattacccaccctaaggattaagcttaggagattttggagggagaggttaaatgag

SEQ ID NO: 44009 - DNA, 480 bp, Pyrococcus horikoshii
gtgtttcagatgagtgaaactgaaagaaccctggtaattataaagcctgatgccgtcgttaggggccttataggtgaaataataagtagatttgagaaaaaaggcctcaagattgtaggaatgaagatgatatggatcgacagggagctagctgagaaacattatgaagagcacagggagaagcccttcttcaaggccttaatcgattacataacaaaaacccctgttgtagttatggtactcgagggaaggtatgccgtggaagttgtgagaaaaatggccggagcaacggatccaaaggatgctgcacctggaacgataagaggggattttggtcttgaggtcagcgatgctatatgtaacgttatacatgccagtgactccaaggagagcgctgagagggaaataagtctattcttcaaacctgaggaattatttgaatatcctagggcggccgattggttctataagaaaggtatt

SEQ ID NO: 44010 - DNA, 924 bp, Pyrococcus horikoshii
atggagtggaaaggtagggatgttataagcattagggacttttctaaggaagatatagaggttgttctttccacggccgagaggttggaaaaggagatgaaggaaaaggggcaattagaatatgctaagggaaaaatattggcaacattattctttgaaccatcaactagaactagattaagctttgagagtgcaatgcaccgtttaggtggttcggtaataggatttgccgaagcttcaacaagtagtgtcaagaagggagagagcctgagggataccataaaaacagttgagcagtattccgatgttatagtaataagacacccaaaggaaggagctgcaaggttagctgctgaggttgcagatattcctgtgataaatgccggagatggaagcaatcagcatcccacgcagacgttactggatttgtatacaattaaaaaagagttcggtaccattgatggacttaagatagggttacttggggatcttaagtacggaaggacggtacacagcttggccgaggccctagcattttatgatgttgagctctatttaatctctccagagctattgagaatgccaaagcatatagtggaagagctaagggagaggggaatgaaaatagtcgaaaccactaagctcgaagaagttataggtgaactagatgttctttatgtaacgagaatccagaaggaaaggttcccggatgaacaggagtatttgaaggtcaagggaagctaccaggttaatctaaaaatcctggaaaatgttaaggatagccttagaataatgcatcccctaccaagggttgatgagatacatcctgaagttgataaaacgaagcacgctatatactttaagcaggtgtttaatggagttcccgtgaggatggccctcttggccctagtcttgggggtgatt

SEQ ID NO: 44011 - DNA, 450 bp, Pyrococcus horikoshii
atgcctgagcttaaggtttccgcaattaaggagggaaccgttatagatcacatcccagctggaaagggacttaaggtaatagaaatacttggactaagtaagctttccaatgggggttctgttttattagcgatgaacgttccaagcaaaaagctggggagaaaggatatagtcaaagtcgagggaaagttccttagtgaagaggaggttaataagatagcactcgtagctcctacagctacggtgaacataatcaggaattacaaagtcgttgagaagtttaaggttgaagttcccgaagtcattgaggggatattgaagtgtggaaatcccaactgcataaccaactatgaatacgttacgacaaaattctacgtgataagcaaaaacccattgaaggttcggtgtcactattgtgaaagaacgatggaagaagaggagatcttggct

SEQ ID NO: 44012 - DNA, 951 bp, Pyrococcus horikoshii
atggtagttagcttaaagggtagggatcttctctgcctccaggattatactcctgaagaaatatggacaatcctcgagacggctaagatgttcaagatctggcagaagataggaaagccccacagacttcttgaagggaagactttagccatgatattccaaaagccctcaactagaacaagggttagctttgaggttgcaatggcccacttgggcggtcacgctctctacctaaacgcccaagaccttcagcttaggaggggagagacaatagctgataccgctagagttctcagcaggtacgtcgacgctataatggctagggtttatgcccataaggatgttgaagatttagctaagtatgcaagcgtcccggttataaatggtttgagtgacttctctcatccatgccaggctttagctgattacatgacaatttgggagaagaagggaacgataaagggagttaaagtcgtatacgttggcgatggaaacaacgtctgccactccctaatgatagctgggacaaagcttggtgctgatgttgtagtggcaactccagagggttatgagccagataaaaaagtgattaaatgggccgagcagaatgcagctgaaagcggaggaagctttgagcttcttcacgatccagttaaagccgtcaaagatgccgatgtgatatacactgatgtgtgggcttcaatgggccaagaagctgaggcagaagagagaagaaagattttcagaccgttccaggttaacaaggatcttgtcaagcacgctaagtctgactacatgttcatgcactgcttaccagcccataggggagaagaagttactgacgatgtcatagactcaccaaacagcgtcgtttgggatgaagcagaaaataggttgcatgcacagaaagcagtcttagccttattgttgggaggagttaagactggcttc

SEQ ID NO: 44013 - DNA, 1125 bp, Pyrococcus horikoshii
atgacattcttcctaaagactaccatattaatgggtaggggatcccttgaaaatataaaaaagcttgtatctgaaggtgagagggtactcgtcttttcttcaaagtctatggataggcttggctttttaaaagaggtaattgactatttagacgaagcaggtgcaacctatgaaagtattacgggattaccttccgagccaagcattgaaaacgttgaggaattgctcccaaaggtcaaggatttctctccggaaaccttcatagcactcggtggagggagcgtgatagatatctcaaaagccctgaaagttttctatgatgctcctgaacttgattttgacagtgttgcaatatttagcagatttaaaaaagctcaacctcttccaaagcttaaaacaaagcttatagccgttccttctacgagtggtgcagggagtgaagtatccgctgcgaccgtgataaagaagggggatatcaagtacacgatagtgagtccagagctttgtccaaattatgcaatcttggatccgagactccccgagaacatgcccagggaagtagctaggaactctggattagatgtattagttcatgccatagaagcttacgtttcaaaggcatcaacaccttttagtgatgctatggccgtaaaagcagcaaggacaattcttgaaaagcttgaagatagcgttaatggcgatcctaccgctagagaagaagttcattatgccgccactatggccggaatagccttcctaaatggtagacttggactcgtccatgcaatgagtcataaagcagcgtggattggccctcatggattgattaatgcgatactactcccatatgtaatggagttcaatatggaaaaagctagagaaaagtacgatgcaatggccaaggaacttgggctttccaatgctgaagaacttcttcagaaggttaaagagctcaatgaaagattaaacgttccaaagttatcggaaatagttagcgaggaagatttcacttcaaggcttgatgagatgagcagaaaggcttacgaagatcccctggttaacttcaatccagtggaaccaagcgttgatgatataaagaacatctatctgagggccttccatgat

SEQ ID NO: 44014 - DNA, 1161 bp, Pyrococcus horikoshii
atgagagaaaagaggaagtattttatcgctgagagggtcctccttatcaaaagatcgaaaataagagaattattcgaaagagcttctaaaatggaggatgtaatatctttaggaatcggagaaccagactttgatactcctaaaaacataaaagaagccgctaaaagagctctagatgaaggatggactcattacactccaaatgcaggaattccagagctaagagaagccgtcgttgaatactataagaaattctatggaattgatatagaggtagaaaatgtgataataacagctggagcgtatgagggtacttacttagcctttgaatcattattggagagaggagatgaagttataataccagatccagcttttgtttcatatgctgaagatgcgaaagtcgcagaagcaaagccagttaggattcctttaagagaggaaaacaatttcttacccgatcctaacgagttgttagagaagatatcaaagaatactaggatgatagtgataaactatccaaataatccgactggggcaacgctagataaggagttggcaaagacaattgcagacatagcggaagattacaacatttacatactaagtgatgaaccctatgaacatttcatatacgaggatgcaaagcattatccaatgataaaattcgcaccagagaatacaatacttgcaaattcattctcaaagacgtttgcaatgacgggctggaggttgggatttgtagttgctccttcccaggtaattaaagaaatgacaaagttacatgcatacgtaatagggaatgtagcttcgtttgttcaaattgctggaattgaggcattaaggagcgaagagagctggaaggccgttgaggaaatgaaaaaagaatacaatgaaaggaggaaaattgttgtaaaacggctcaagaatatgccaggaataaaggttaaagaaccaaagggggcattttacgtattcccaaatatatccggaactggaatgtctagtgaaaaattcagtgaatggttattggagaaggctagagtggtcgtgatcccaggaacagcgttcggtaggatgggtgaaggttacgttagaataagctacgcgactagtaaggagaaactcatagaagctatgaatagaattgaaaaagccttg

SEQ ID NO: 44015 - DNA, 1422 bp, Pyrococcus horikoshii
atgccttttctacccttttcttattaccctttttctttggaggtgattctaatggagtacccaaagatagttgttaaacctcctgggccaagggctaaagagttgattgagagggaaaagaaagtattatctacgggaattggagtgaagctatttccattggttccaaagagaggctttgggccttttatagaagatgtagatggcaacgttttcatagacttcctagctggggccgccgctgcatccacaggatatgctcatccaaaacttgttaaggccgttaaagagcaggtggaacttatccagcattcaatgataggttatactcatagtgaaagagcgataagggttgctgaaaaactcgtggaaatctctccaatcgaaaattctaaggtgatttttggattgagcggtagcgatgctgttgatatggctataaaggtttcaaagttctcaactaggagaccttggatactcgccttcataggggcctatcatggacaaactctaggggccacttcagtagcatcattccaagtttcccaaaagaggggctactccccattgatgccgaacgttttctggataccttatccaaatccgtttagaaacatctggggcataaacggttacgaggagccagatgaattgataaatagggttctagattacctagagtattacgtcttttctcacgttgttcctccagatgaagtcgcggcattatttgctgaaccaatccagggagatgcagggatcgttgtccctccagagaacttctttaaagagctaaagaagctacttgaggaatatgggatactacttgtaatggatgaagttcaaacggggatagggagaactggaaagtggttcgcaagcgaatggttcaatgtaaagccagacatgataatatttgggaagggagtagcgagtggaatgggactgagcggagttatagggagaaaagagatcatggatataacgagtggttcagctctgttaactccagctgcaaatccggtaatttcagctgcagcagaagctaccctcgagataatcgaggaggaaaatcttctcaagaatgcccttgaggttggagaatttataatggggaggctaaaggaaatcaaagagcggtttgagataattggagatgtaagaggcaagggtttgatgataggagttgagatagtcaaggagaatggaaggccggatcccgagatgactggtaagatatgctggagggcattcgagcttggcttgatacttccgagttatggaatgttcgggaacgtgatcagaataacgcccccactagttcttacaaaagaggtcgcggagaaagctcttgaaattatagagagggcaatcaaggataccttaactgggaaggtagagaggaaagtagtaacttggcac

SEQ ID NO: 44016 - DNA, 1713 bp, Pyrococcus horikoshii
atggttgaaattatagacacgacgtttagggatgctcaccaatctcttatagccacgagaatgagtacgaaggatatgcttccaattgctgagaagatggataaaataggcttctattctatggaagtttggggaggggcaacttttgatgtttcactaaggtttctgagagaagatccatgggagagattaaaactcctaagggaacatataaggaagacaaagcttcaaatgttgctaaggggtcaaaatctagtaggatataggcactaccctgatgatgtcgtggaaaaatttgtagaacttgcttataaaaatggtattgacatttttagggtatttgatgccttgaatgatgttaggaacatgaagacagcaattaagaaagccaaggaaatcggtgctgaagttcagggggcgatatgctataccaccggtccaatattcacaatagactactacttacagaaggttgacgagcttatcgagcttgacgtggattacataacaattaaagatatggccggattggccgaccctcaaacagcttacgagctcgtgaaggaaattaaagagcgttatggaatcaaggtaaactttcatacacatgcaacgagtggtttagcggtggctacttatcttaaagcagttgaagctggagtcgattacattgatacttcaatttatccactagctgggggaactgctcagcccgcggttcaaacgatgtactatgcacttccaaaagggaaaaggccgaaacttaatataaagctaattcacgagatttccaagtacctgacaaaccttctagagaagaagtacgatcacttgctgaccaaaaaggccatacatggagatccaaatgtcctaatccaccaaatcccaggaggaatgtattctaatttaataaagcagttaagcgagctcaaagccttagataagttagaggaagttctagaggaggtaccaagggttagggaagatctaggctatccaccgttagtgaccccaacttctcaaatagtcggggttcaagcggttctcaatgttctctttggaaggtataaacaggtcaccaaggagacgaaggattacgttaggggactttatggaagacctcctgggaagataaaggaggaaattaaaaagcttatccttggtgatgaggaacccataaacgttaggcctgctgatctacttgaaccaatgcttgagaaagctaagaaagagcttaaggagaagggttaccttgaaaaagaggaagatgttgtaacttattgcctctttcctcaagtagctttggaattctttgagctcagaagacagggaagacttagaccagttgaagagaagccgaaaggaaagccaataaagatttacatcaacgggaaggaattcgaggttttcgtcgaaggaatagaatttgagcctcctaagcccaagccccaagttcaagctatcccttcacaacctcccaagcgggaggtagtagcccctagcgggagcgttgtttctgctcctatgcctggtaaggttttgagggttcttgttcgggttggggatagggttagggttggtcagggtttgcttgttcttgaagccatgaagatggagaatgagattccatcaccaagggatggtgttgtcaagagaatactagtcaaggaaggagaagcagtcgacacaggacaaccactaatagagttagaa

SEQ ID NO: 44017 - DNA, 2568 bp, Pyrococcus horikoshii
atgactaacccctggaaaattttccttgtgagttacgctcacatagacagtgaatggctctggaaagtcgatgagactgttaatatttgcaagctcaccttcgaaaatactctcaaacttatggaaaagtataacttccttacctttgctcacgggccagttttctattatgaacttatggaaagtcattatccaaacatctttaggaagataaaggaaatggtagataggaagcagtggaagatcatagatggatcctacgtagagttcgatgccaacatcccctctggagagtctctgatcaggcagtttctatatggaattaagtaccttgaggaaaaatttggagtaaagcctagaaccctttaccttccggactccttcggcttccctccaaccttacctaaaatactgtgtgaggttggaatagaaaacttcgcaacgagtaagcttaattggaacgatacaaacccctttccataccatatatttaggtggaaaagcagaagtggagaggaagttctagcttacagcactccaggaagttatagcgactatctttcggatattaaaaggatactctggaacgtggagcaacagagggaaaagcaggagatcccagttattatgcaagtctttggtaggggagatcatgggggaggaccggaagaaatcgaggttcagaacgttaaaaagtggatggaggaatataagggtaggctggaacttattgcatcggggatggatgagttcttcgattatgtgagggagcactacctgaaagatcttcccatcttcgaggatgagctctaccttgagtttcatcgaggcatctttactacgggggcatggataaaaaggttcaacaggctaaatgagcacctgatccttcaagtggaaaagctgtactctcttctgaagattctctatggtattgaatatccctgggaaggaatccttaattcctggaaggcgatcctccttacccaagggcacgatgccttacctgcttctataactaaggaagtttacgatgacgtaatgaggaggagctccaacgtgtacaagggtcttttatccttcctcagaaatgggttaaaggttatagctgagaaggaaaaagcccgctacatcgtctttaatccaaactcgttccctgtttccccctatataaggacatgggaaagcgttaatggcttctatcaaaggcttaaaaatgggagtaagctggtttacctttcagaactacccccgattggatttaaaggctatgaagaggtgggggaaaggccggaggacttcgtgaacattgtggaaagggagaaggattttatacttgagaactcctatcttagggttactgtgtctaagagaacaggttggataacgagcatctatgataagaagaacaagcgagaaatcctcaaagaaccaatacgacctaggattatgttagattatccaatgccttttagaggtcgctttgtgccagcttcaatgtttgatgcatgggaggtttattacagggaggggataaataagtactttcaccgtgacctcagggctaaagaagtttttatctcagagagaggtccgctttacgcttctatctcagctaaattccattataagcagttcctaggaaaggcctcaactatggaatttgaaattggcctctatgcagataaaccttacgttgaggtgaggtttagagctcactggaatacccaccatcgcttcttgaagcttttagttccagtagccattgattcagacaaagcggtatttgaagtcccctatgggatcgttgagagagctgatgcctgcagatctgaaaatcctagggagagggcgaaatacgaggttttggggcataagtgggttgacatctccgatggaagttatggtgttgcagtaataaacgattctaaatacgggttcagttggtgcaatggggttctgagaattagcttgttaaggtctccctcccagccattagctgacttcataatgaagttcattcgcatgaataagaaggcccaggagaagttccaggatattaagctccaaaagtccggaaaattaaagagggaaattataaatataataatttggctcatggttctcttcaatgagcttaggaacaaaaagaaagtaactccgatagatagaggttatcacatagccacagtgtgggtgtatcctcatgagggaaattacgtgaagggtaacgttccaatgcttgctacggagttaaacacgctttacatccttcaaaagggatcaggaagtagctctaccatctggaactttataaacgtggaacctcaggaaaaacttcaagttgtaaccgtgaagccatgcgaaaatggggattgctttgttttaagactcttcaatccaacagatgaacgccttaaagcgattctaagatttaacgttaaggttaagagtgctgccgaggctacccacgatgaaaggtttctcagggggctccctgtgagggacaactccgtggaggtatctctaggttcttatgaagtgagaaccttactcatcaccgtgttg

SEQ ID NO: 44018 - DNA, 861 bp, Pyrococcus horikoshii
atggaaggcgtaatagttcccctaataacaccgtttaaagaggatcattccatagactttgaagccctcgaatggctcataaaattcctagaggaaaagggagttcatggaatattcatcaactctaccactggagagtttacaagcttaagcctagaagaaaggaagatactagctgaaaagggaagggaagtcacctctagaacttacctagttggtactggttcaactagcacgtttgaagtaatagagttgacgaagcatgcgaaggagataggggccgatggtgttgtgatagtttcaccatattactgcagacttaaggaagatgccatatttaagcacttttcaatggttgctgagaaggttgacatcccaataatcctttatgcgatcccctcctgtgcaaatccaataagcttagaagttgtaaggaagctagctcttgaatattctaatgtaattggggtaaaggccagcgttgatagcttgacgtaccttagtgggttaattgagataaaagaagagagaaaggacttcaaagtctttactggattagaccagtacttcctccccaatttaatcctgggaggcgatggagggataatggcgtgtgcgaactttgtcccagagatccacttggaagtttggaacgcatttaagaagggtaacctcgagaaagctatgaattctgcaagaaagcttgtcaagataactaaaatctacagcatagcatcctcctttgcctcagcggtaaagcttgcaatggttgctaggggatttcctataaaacccatcttaaggcctccttacatgatggatggggaagaggttttcaaaaagattaaggaaatcgttagc

SEQ ID NO: 44019 - DNA, 1350 bp, Pyrococcus horikoshii
atggcggttcacccaatagattaccgctacggtagtgaggagatgaggaagatatgggatgaaaagaacaagttgcaaaagctacttgacgttgaagctgccctagcaagggctcatgctaaggtaggaaacattccggaagagagcgctaaggttatttcggaaagggctaatacaaagtgggttaagcttgagagggttaaggagatagaggccgagatccatcatgatataatggccgtcgttaaagcgttaagcgaggtttgcggagaacatggaaagtacgttcatcttggggcaacttctaatgatataatagatacggccaatgcattgttaatcaaggaaagccttgagatagttgaaagggatcttaaagagcttagatccattttgaagcagcttgcggaaaagcatataggtacggtatgcatagggaggacccatggccaacatgcagttccgacgacttatggaatgaagttcgccctgtggcttgatgagatccagaggcatatagagaggttataccagcttaaggagagggttctcgttggtaagatgagaggggccgtgggaactgcggcctcatttggagaaaaagcctttgaaattgagagattggtgatggaagatcttggtctcaagcctgcaaggataacgaatcaaatagtgcaaagggatgtctacgctgaactacttttcttcctggctttagtggcttcaactctggataagatggggttggagataaggaacctgcagaggactgaaatacttgaggtaagcgaacccttcggggagaagcaagtaggttcatctacgatgccccacaagaggaaccccataagaactgaaaaggtctgtggacttgcgagggttttgtactccaacgttattccggcgttgctaaataacccactctggcatgagagggatttgacgaattcttccgttgagagggttatccttccagagagctttgtattgcttgatgagatgctcaagaccatgaagaaggttttaactggactggagttcttccccgagaacataaggaggaacttgtatttaacaaagaacttgatcatggccgagccccttatgttaaagcttgccgagaaaggaatgggaagacaggaagctcatgaagtagtaaggcaacttgcaatgaaagctttccgtgaaaacagagacctcctggaagttgcaaaggaaagtagagaaataactaagtatctaaccgagagagatcttgaggagctaaaaccagaaaattacattggcaaagcaagggaaatagtcaaaaaagtcattgaatatgttgaggagatggaaagaaggggatta

SEQ ID NO: 44020 - DNA, 1077 bp, Pyrococcus horikoshii
gtggtggagaaacctgtcgttataaagtttggaggaacttcagtaaggtatgcctttgaagaagcactagagctagttgcgaagttacatgaaaacatgaaaatcattgtcgtcgtttctgcacttgcaggagttacagattgcttgttaaggctcgcaaagggggataaatccgctcttctggaaattgatgaaattcacgaagaactatcccaggaactcaacgttcagcttgagcatttaatacatcaacttaaaaagacgataaattctaaatcaagtttcccctcagaaaaggcatttatagacgaaatagcatcttttggagagagattttctgccaaactattctcagagggtcttaaaatactcggaattaccgccaggcctgttgactctaaggatgttctctttgttaaaggggagtttggaaatgcagaagtggagtttaagaagagtgctcagggagtagatgttctctatcgcatgcttaggagaggaatcgttcctgttgttactggatactatggaaatctgaacgggttccgagcaacttttggaagaggaggaagtgattattcggcaacatctatagcgagtctagtaaatgctaaagccgttctaataatgagcgacgttgagggaatttatactgcagatccaaagctagtgcctcctgcaagactaattcattacatttcctacaaagaagcaaaaacagctgcaaaattgggtatgaaggttcttcatccaagagccatcgatccagtagaaggaaagatcccagtcattcttggaaaaactagggatctaaaatttggaacgctaatttctcatgaatcccagggaattccaattgttacccacaagttactagaaaatcatgccgaaatatctgttgtatcagttaaaacaaatattcccttaccttacgaagtttatgaggaaggagatctatactttaagataaaaacttccaaggatcagtttctggaagttttaagggacgtgcacaggagagttgttgaaaatgagaatctgcactccagccacgatggtgaactttggacttgggtt

SEQ ID NO: 44021 - DNA, 1944 bp, Pyrococcus horikoshii
atgaacataaagagcttcataaacaggcttaaggagttagttgaaatcgagaaggaagctgaaatagaggctatgaggttagagatgaaaaggctcagcggagtggagagggaaaggctaggtagagcaattctcaacttgaacggtaaaatcgctggagaggagctcggctacttcttggttaagtacgggaggaatagggagataaagaccgagatcagcgttggggatttggtggttataagcaagagagatccgttgaagagcgatctcctgggaaccgttgttgagaaggggaagaggttcatcgttgttgccttagaaacagtcccagagtgggcccttagggatgtgagaattgatctttacgccaacgacataaccttcaggagatggctcgaaaacctcgacagggttaagaaggctgggaaaagggctttggagttttaccttggtttagatgagccttcccaaggggaggaagttagctttgaaccatttgacaagagcctaaactcctctcaaaggaaagcgatagctaagggtttaggtagtgaagacttcttcctaatccatggcccgtttggaaccgggaagacaaggactttagttgagctaattaggcaggaagtgaagagggggaacaaagttctagctacagccgagagcaacgtggccgtggataacctagttgaaagattagctaaagatggagtcaagatagtcagggtggggcacccaagtagggtttcgaggcatttacacgagacaaccttagcttacctcattacccagcacgagctctacggcgagcttagggagctaagggtgatagggcagagcttggccgagaagagggatacttatacaaagccgaccccaaagttcaggagaggattaagtgatgctgagataattaagctagcggagaggaggagagggatcagaggactctcggccaggctaataaaggagatggccgagtggataaaactaaacaggcaggttcagaaggcctttgaggatgctaggaagcttgaggagagaattgcgagggatataattagggaagctgatgtaattttaacaactaactcttccgcggcccttgaagtcgttgatgctaccgattacgatgttgcgataatagatgaggcaactcaggcaacgataccgagcatattaattcccttgaataaggttgataggtttatacttgctggagatcacaagcaacttccccctactatcttaagcttggaagcccaggagctctctcacacgcttttcgaaggtttaattgagaggtatccgtggaagagcgaaatgctaacaattcaatataggatgaacgagaggataatggagtttccgagcaaggagttttacgatggaaggatagttgccgatgaaagggtgaaaaacataaccctgggagacctcggaattaaagttaacgccaccggaatatggagggatatcctagatccaagcaacgtcctcgtattcatagatacttgcatgctcgacaataggtttgaaaggcagaggaggggaagcgaaagcagggagaatccattagaggctaagatagtgagtaaaatcgtagaaaagctcttagaaagtggagttaaagcggaaatgataggagtaattaccccttacgatgaccagagggacttgataagcttgaacgttcccgaggaggttgaagtcaagacagtagatggctaccagggaagggaaaaggaagtgataattctatcatttgttcgctctaacaaggtgggagagatcggctttctcaaggacttgaggaggctaaacgtgtccttaaccagggctaagaggaagcttatcatgattggtgattcctcaacgctttcatctcacgaaacttacaagaggttgatagagcacgtgagggagaaggggttatatgtt

SEQ ID NO: 44022 - DNA, 972 bp, Pyrococcus horikoshii
gtgaataaggtggaggctataatagtggagaacctcgttaaaaagtatggagactttgaagctgtaagggggatatcctttaaggtaagacggggtgaaatattcgctttcctgggaccaaatggagctggaaaaacgacgacagttcatatgttaaccacgctactgaagcccacttcgggaagagcaatagtagctgggcacgatgttgttaaagaatccagggaagttagaaagaagataggagttgtttttcaagatccaagcgttgaccgagaactaacggcctgggaaaatatgtacattcatgggaggatctacgggcttaaaggacaagaactgaaaaagaagattgaagagttgttaaaattcgttgaactctgggagtttaaggataggcaggtaaaatacttctctggaggtatgcaaaggaggctggagatagcgagggctttaatccatgagccggaagtcctctttttggatgaacctacaatagggctcgatccccagacaagggcccatatttgggagtacatcaagacgatgaaggaagagcatgacatgacgatattcctaaccactcactacatggatgaagctgagcaacttgcagacaggatagcaatcatagaccatggaaagataattgctgagggtacggctgaggagctgaagaagttggtaggtaatgatataatctacgttaagtttgagaaaccgacgtgcatacaagccgagttcataaggggatgtaaggttctcaacaacggaagggttgccctagaagttaagaacgcagcagaagctttacccctggtctttgaaaaagctagggagatggaactcaagattttagaagttacttatcaccgtccaacgttaaacgatgtgttcttgcacttaactggtagagaaataagggatgaagcttctgaaaagccaacaatgccaataaggaggtggaggaga

SEQ ID NO: 44023 - DNA, 1365 bp, Pyrococcus horikoshii
atgggaaagctctttggtacctttggcgttagagggatagccaacgagaagataacgccggaatttgcaatgaagataggaatggcctttggaaccctactcaaaagggagggaaggaaaaagccacttgtagttgtcgggagggatacaagggttagtggagaaatgctgaaagaggctttaataagcggcctcctaagcgttggctgtgacgtgatagatgtaggcatagcaccaaccccagcggtgcagtgggcgaccaagcacttcaatgccgatggtggtgcggtaataaccgcaagccacaacccaccggagtacaatggaataaagctcttggagcccaatggaatgggtcttaagaaagagagggaggctattgttgaggaactattctttaaggaagatttcgacagggccaagtggtacgagataggtgaggttagaagggaggatataataaagccctacatagaagcgataaagagcaaggttgacgttgaagctataaagaagagaaaacccttcgtagttgtagacacttccaatggggccggatcactaaccctaccttacctgctaagggaactcggatgtaaggtaattaccgtaaacgctcagcccgatggatacttccctgcaagaaatccggaacctaacgaagagaacctcaaggaatttatggagatagtcaaggccttaggtgcggatttcggagttgcccaggatggggatgcagatagggcagtattcatagatgaaaacggaagattcatccagggagataagacgtttgcacttgttgcggatgcggtacttaaggagaagggtggagggctactagtcacaaccgtggcaacttctaacctgttggatgacattgcaaagaagcatggggccaaggtcatgagaactaaagttggcgatttaattgtagctagggccctctatgagaacaacggaacaataggtggggaggagaacgggggagtaatatttccagagcatgtgctgggaagagatggagcgatgaccgtagctaaggttgttgaaatattcgctaagagcggtaagaagttcagcgagcttatagatgagctacctaagtactaccaaataaagaccaagaggcacgttgagggagatagacatgcgatagtcaataaagtggcagaaatggcaagagagaggggatacacggttgacacaacggatggagctaagataatatttgaggatggatgggttctggttagggcgagtggaacggaacctataataaggatatttagcgaagcaaagagcaaagagaaagcccaggagtatttaaacctgggaattgagctgcttgagaaagcactttca

SEQ ID NO: 44024 - DNA, 2637 bp, Pyrococcus horikoshii
atgaaaatcgagagagttatcgttcagaattttagatcgcataagaatagcgagatcgagtttaaaccgggcattaacttaataataggtcaaaatggagcagggaaaagttcccttttggatgcaatcttagttggtctttactggtcaaagagaatgaggttaagaggattaaaaaaagatgagttcacaagaaccggaacgagaggagctataattgaaataacgttcgaagaggatggaactaaatacaaggtacttagggattttgctcgaaatgtgtcttatttaaagagacttgacgggagggaatggaggcacgttaccgaaactagtatggagagcgtctcatccttcatagataggattattccatacaacgtattcctaaacgctatatatgtaaggcaggggcagatagatgcaatattggaaagtgacgagaccagggataaaatagtcaaagagatccttaacctcgacaagctagagaaagcctacgacaatcttgggaagatcaggaagtacatcaaatattccatagaggagaaggaaaagttcatcatgaaaacagaaaacatcgaggatctcataaggacccaggaaaagagctttacagaagtgcttaatgaaattcgaaatatatcttcaaaccttcccaggttaagaagggagctggaagggatcaaagaggaagttaaaacgttggaagcaactttcaatagtataaccgaactgaaactaaggttgggagagctaaacggaaaaaaaggtaggcttgaagaaagaataaggcagcttgagtcaggaattgaagaaaagagaaagaaaagcaaagagcttgaagaagttgtaaaggaacttccagaacttgaaaaaaaggagactgaatacagaagattaattgaatttaaggatgagtacctcgtcaagaaaaatgagctagagaagaggcttggtattttaagtaaccgtctacaagaggttaaaagaaaaattaaggatgcggagtctaaagttgctaggattaggtggatagaggaaagattaaaagagatacaggaaaaaattatgaagcttgagccaagggttagggaattcgaagatgctatgcgcctcaaagctcagatggaatccttaaaatccaagttgggtggattggagcctgagaaaataaatgagaaactcctatacttagagaataggaaaaaggagcttgaagaagaaatagacaagataacaaggaagataggcgagttaaaccagaggagtaaagataggagattggcaataattgagctgaagaaggcccgggggaaatgtccagtttgtgggagggagctcaccgaagaacataaggcggatctactgagaaagtactccttggagctttcatcgatagagaaggaaatccaagaggcaaaagcccttgaaaggcaattaagagctgaatttcggaaagttgagaacgaactgagtaggctttccagcttaaaaacgatagctgatcagatcattgagattagagaaagattaagcaagataaatctggaagatttgaagagggataaggaagagtacgagttactaaaaagtgagagcaataaattaaagggtgaagtggagagcctaaaaaaggaagtaaatgagcttaatgattataaaaatgaatctaccaagcttgaaatcgaaatagataaggccaaaaaggaattatctgagatcgaagataggttactaaggttgggatttaaaacaatagatgagctttctgggaggataagggaacttgaaaagtttcacaacaaatacatagaagcaaaaaacgctgagaaggagttaagggacatccttgaaagtcttaaagacgagagggaggaacttgataaggccttcgaagaactagcaaaaattgaaacggatatagaaaaagtcacttcacagcttaacgaacttcaaaggaaatttgaccaaaagaagtacgaagaaaaaagggagaagatgatgaagcttagtatggagataaagggattggaaactaagttagaggaacttgagagaagaagggatgaaattaaatctacaatagaaaagcttaaggaggagagaaaagagagagaatcagctaagatggaacttgaaaagctaaatattgctataaagaggattgaagagcttagaggtaaaataaaagagtataaagccctaataaaagaggaagctctaaacaagataggagaaattgccagtgaaattttctctgaatttacggatggtaaatattctgggatagcgataagggccgaagacaataaggttaaactattcgttatttacgacggcgttgagaggccgctaaccttccttagtggaggtgaaagaatagcccttggtttagcctttaggcttgcgatgtctatgtacttaataggtaaggtagatttgctgatcctcgatgaacccacaccgttcctagatgaggagaggaggaggaaattgatagagataatggagaggcacttgaggaagatatctcaagtgatcatagtttcccatgatgaggaactcaaggatgcagcggatcacgtgataaggataaggctcgagggtggggcctcaaaggtggaggtggtatct

SEQ ID NO: 44025 - DNA, 825 bp, Pyrococcus horikoshii
atgccaagaaaggccagggaatatccggaggagggtgagtttgtagtcgctactgtcaagaggattcataattatggagcattcctcgagcttgatgagtatcctgggaaggaagcgttcatgcacataagcgaagtggcctcgacgtgggttaggaacattagagactacctcaaagagggacagaaagttgttgccaaggttatcagggttgatccaaggaagggtcatatagatctaagtctcagaagagttacacagcaacagaggaaggcaaagctacaggagtttaagagagctcagaaagctgagaacttactaagactcgcagcggagaagcttggaaaagattttgaagctgcgtggagggaggtttgggttccgctggaagaagaatggggagaggtctatgcagcgtttgaagatgctgcaaaggatggaattgaagttttaaaaggtcatgttcctgatgaatggttacccgttcttaaggagatagtggagaactacgttgaggttccaactgtaactatagatgcagaatttgagataaccgttccaaagccaaacggagttgagataataaaggaagctttgataagggccagggatagagctaacaaggagaaagatattgaagttaagttcacatatcaaggagcaccgaggtataggatagacatcacggccccagactactacaaggccgaagaagttctcgaggatatagcggaggagatacttagggttataaagcaagcaggtggagaggcaactttgttgaggaaggagaagagaataaggaaggttaagaagagaaagaag

SEQ ID NO: 44026 - DNA, 573 bp, Pyrococcus horikoshii
atggtggatacaagcaatgtcaagctaaggatcgagaatatagtggcttccgtagatctttttgctcagctcgatctcgagaaggttctggatatatgcccaaattctaaatataatccagaagagtttcccggtatcatctgtcgttttgatgatccgaaagttgctttgctgatatttagctccggtaaactcgtcgttacgggggcaaagagtatccaggacatagaaagagcagttgcaaagctgatccaaaagcttaagggaattggagtaaagttcaagagggctcccctaatagatgtacaaaacatggtctttagtggggatataggaagggagttcaatctcgataacgttgcattgacccttcccaactgtgaatatgaacctgaacagttccctggagttatatacagagttaaggaaccaagggctgtaatactactgttctcttctggtaagatagtttgctctggagctaaaagcgaagctgacgcttgggaagcagttaggaagttgttaagagagcttgagaaatatggcctaatagaggaagaagaggaggagctc

SEQ ID NO: 44027 - DNA, 1248 bp, Pyrococcus horikoshii
gtgaataagatgaaggctgtaattcttgctgggggatttgggactagattaaggccaatttcttcaacgaggccaaagccaatggttcccgtgttaggaaagccgaacctacagtatattttagaggccctggaaaaggttaaggaaattgatgaaataatactttcagttcactacatgaggggcgagattagggaatttattcaggaaaaaatgagagactatcctaaggatataaggttcgtaaatgatccaatgccgctcgaaactggtggggcactgaaaaacgtcgaggaatacgtttcagatgatttcctggtgatctatggagacgtcttcacgaactttgattattctgaactaatagaggcccacaagaagaacgatggtttgataactgtagccctcacgaaggtttatgatcctgagaggttcggagtcgtaattaccgatgaggaaggaaagatcgtggagttcgaagagaaacccaggaaaccaaagacaaatttggtagatgctggaatttacatggttaacaaggatgtcctaaaagagataccaaagaacaaagagatctactttgagagggaaattcttccaaagttcgtaaatcaaggattggtttatgggtacaagatgccaaagcagtattactgggttgacttgggaaccccagaggacttcttctatgcccatcaaatagcacttgatgagctatccaaggaaaatggatacatgatcctaggggaaaacgttgaaattccagatgatgtcgaggttcaaggacccgtgtacatagatgacaacgcaaagatagggcatggggttaagataaaggcctacacttacatagggcctaatacaataattgaggataaagcctactttaagcgctcaatactcctggggaacgacataataaaggagagggccgagctaaaggatgcgatattaggcgaaggagtcgtcgtaggaaaggatgtcataataaaggagaacgccgtaataggggattacgctaagatatatgacaatctggttatctatggggccaaggttcttccatggaagaaagttgaggagtacgaggcatacataaagataaagctcgatccaacgaaagttagaccaggacaatatcccgatcactgtcctctcggccttccagagtgtatatacaaaaagtttaaggccattgcaggagagaagccaccttgcgatgagtgtatagagaaccagtggctcttc

SEQ ID NO: 44028 - DNA, 960 bp, Pyrococcus horikoshii
gtgaaatcactaagtaaggagtggggtgaaaaaatgatattcgatgctcactcagacttgccaacttacgtatatgaggaaagggagaagggaaggactagagtcctcgaaagcaatttcgaaaagttctttactgggatctcggctagggttatgagcgtctggagcaggccggagaagaaaccgataatacttaggtacgccttggaggcatataacaggctgttcaaggatgttagtgaaagcgaaaaactcgtgatagttggtaccgttaaagagatggaagatgcaataaaagacggtaaagtagccctttggcttgggatggaaggaggggaacccatagagagtctagacatactggagatattccactcgattggattgagagtcttaaccttaacttggagcttaaggaatcaaataggggatggtgtctttgaaagaactagaggagggttaaccaactttggagctgaagtcgttggaaagtgcgaagagcttgggataatcatagatctaagccacataaatgagcaggggttctgggatgttctagacattacgggcttccccgtgatagcttcccattcgaatgctaaatccctttgcgataaccccaggaatttaacagatgagcagataaaagctattgctgagagagatggggtgataggggctgtggctattccagccttcgtcgacaaagataatccaacccttgaaaagtacgttaagcatatagagtacatggtggatcttgtcggttacaagcacgtgggaataggcttcgacttcgtctactacctcccaggatggagtggaaagagcgttgaaggacttgaggatgaatctaagataccggatctaataaaggccctagaggagaatttcagtgagaaggaggtaaaaggtataacatttgaaaacttcaagagggtattcgagagggtagttggg

SEQ ID NO: 44029 - DNA, 1026 bp, Pyrococcus horikoshii
atggagaaatatgaagaactatttgcaagaataaaagagaaggctaaactcatcgatgagaagatcttcgagctcatcccggaaaaggatcccagagtcctctatgaggccgcaagacactatcctttagcaggtggaaagagggttagacccttcgttgttctaacgtcaactgaagctgttggcggggatcctctaagggccatctatccagcggtggccattgagctaattcataattactccctggttcacgatgatataatggatatggatgaaaccagaaggggaaagccaactgtgcatagaatttggggtgtaaacatggctattttagcaggagatctgctcttcagtaaagcctttgaagctgtggcaagggcggaaattcctccagaaaagaaagctagagtattagaagttattgtaaaggcgtcaaatgagctctgtgaaggccaagctagagatctagagttcgaaaagaagagcacggtaactatagaagaatacatggaaatgataagcggaaagacgggggcattatttgaagcttcagcaaaagtcggaggcataatcggaacggacaacgaggagtatataaaagccctttcaagttgggggagaaacgttggaattgcattccaaatttgggatgatgttcttgaccttattgccgatgagaaaaagctcggaaagcctgtgggtagtgacatcagaaaggggaagaaaaccctgatagttgcccacttctttgagaacgcagatgaaaaggataagcagaggttcctaaagattttcggaaagtatgctggtgatgttaaggggaggggaattattgaggaagacatcaagtccgatgttatggaagctatcgatctacttaagaagtatgggagcatagattatgcagcggaaattgctaaggatatgattaaaaaggcaaacgaagccctaagaatccttccgaaaagtaaggccagaatggatctagagttgcttgctaaattcattgtagaaagagaatac

SEQ ID NO: 44030 - DNA, 957 bp, Pyrococcus horikoshii
atgaaagttaacatctcaattttcggatttggaaccgttggtagagctctagctgaaattatagctgaaaaaagtagaatttttggggttgaactgaacgtcatctcaataaccgacagaagcgggactatatggggtgattttgaccttttggaagctaaggaagttaaggaatccacgggaaagctgagcaacatcggggattatgaagtttacaacttttcccctcaggagctagtcgaggaagttaaaccaaacattctagttgatgtcagtagctgggatgaagctcatgaaatgtacaaagttgctcttggtgaggggataagcgtcgtgacaagcaataagccgcccatagctaattattatgacgaactaatgaatttagccaaggaaaataatgcaggaatattctttgaatcaacggtaatggccggaacgccgataataggtgtattaagggaaaatctgcttggagagaatattaagagaattgacgctgttgtaaatgctagtaccaccttcattcttactaagatgagtgaaggaaaaacgcttgatgatgccatagaggaagccaagagcctaggtattctagaagaggatccctcaaaggacatagatggaatagacgcttattacaaggcgaagatccttcactgggtttcctatggggaacctccagaagaggaagagaggttaggaattagggaggttagagatgccaggaatgttagactcgtagctcaggtatctaagggaaagataagcgtaaagccgaggaaactttcaagtgataatccgttgctcgttgaaggagtgcaaaatgcagctgttataaggacgaacaatttaggggaagttatacttaagggcccagggggaggaggaagagttaccgctagcggagttttcaccgatataataaaggcaactctaaaattcccaaacctccgc

SEQ ID NO: 44031 - DNA, 1002 bp, Pyrococcus horikoshii
atgaaagtcgccgttcttggggccacgggagttgttggaagaactttcgtaaagcttcttgaaaatcatccttggtttaaagttgaaaagctagtagcttctgaaagatcggccggcaaacgatatggagaaatcgttgaagattccccggaagaattcaaggattacacgataataggtcttaaggaattccttgaggatcctggggttgatctcgtatttaatgccctccctgcatcgatatcaaaggaggtagaagagaaacttgcacaggaaattccagttttcacaaacgcaaggagtcaccgctatgatgaagatgttccaattttagtcccagaagtgaatagtgatcatttaaagcttgtagaagtccagagaaagcggaggaagtggagggggttcatagtaactaatcctaactgctcgacagcaatacttactgtttcactagcacccctcagggcctttggcataaagaaggttagggtagctacgatgcaagctattagcggagctgggttctctgggctttcagcctatgcaattcacgacaacgttataccttttataaatggagaagagtggaaaatagagaacgaaagcagaaaaatactcggtaaatttactggagataaagtagaaccagccgagatagaggtagctgcaatagctacgagggttccagttctacacgggcatactgaagcggtcttcgttgagcttgaaaaatttgatatcgaagagataagggaggcatttgaaaactttgatccccttagaagccttgagcttccatcgtatgaaaagcccatagtatatacagagattccccagccgagattgcatagagatagaggaaaagggttaacagttacagtgggtagacttcaagaaatatcaggaggtataaaatatgttgttttaggccataatttagttagaggagctgcagggggttccatccttaatgctgagcttgcttataaactgggaataata

SEQ ID NO: 44032 - DNA, 3132 bp, Pyrococcus horikoshii
gtgagttatgtgaagagaattagacagcctattatagcggttctcggtcatgtcgaccatggtaagtgtttattgccagaggagagggtaatacttccagattatggtccaataacgctcgaagagctatttaacatgacaaaggagaccgtctttaaggatgaggagaaggaggtaagaaaactcggaattaggatgccagttgcaggggttgatggtagggtaaggctcctcgaaggaccttacgtttggaaagttaggtataagggtaaaatgcttagggttaaactaaaagattggcattccgttgcagttactccggagcatccatttttaacgacgaggggatgggttagggccgatcagcttaaacctggagattacgttgcggtacccaagatccttcctgggaaggatgataaggaaaagtttttgcaatacgtgcacgaaaaacttaaggggaaagtccacataaagctaccgagctcagatgaggaatgggaaacctttttctactttgcgggaactatatttggtagagaaaacagtgttaatcctgaaggactgactcatgaagtaaaagctttgcttgagttatttaaagtactatttgagtatcccagggaagtcctaagggtacttttcatggccccagtcagatacgttgctaactttctaaggggattctttgatattaatggttatgtaaatggcgaagaattgagggttgaggtaaggggagcacctcacgaggtactggaggagctctccctcatccttctccggttagggatagtctcaaagatctatcctacaagtcttgcaatatctggaagaaggaaccttgagctctttaggaggtacattggcttctcagaaaagcagaaagcaaaagaactagaggggatcattagaagaagcgaaaatagtgagagttacccgatctttgaagagttaagacgtataagactgctcttcgggttcacaagagcagaacttagctcaacgatccccctctatagtaaatacgagtccaaggaggcgccaagctatgaaatcctgatgaagatccttaataccattgaaaagggatcaaaagacctgaacaaaaagattaccatccttgagggtagggtcagagaccatgagtatatagaggaatttaaaagggaggggttaataaaggatgggaagcttaccgaacttggaaaggagctcctcgaagtttggcgcaacagagaattcgactctagggatgtgaactacctcaggaatattattgaaaacttcgtttttctcccagttgagaaaatagaagagttcgaatatgatggctacgtttatgatgtaaccacggagactcacaacttcattgcaaacggaattttagttcacaacaccaccctgctggacaaaatcagaaagacgaacgtcgcggccaaggaagccggtgggataacgcaacacattggagctacggaagttccaatagatgtagtcaagaagatagctggaccccttattaagctctggaaggccgagataagacttccaggtttacttttcatagatactcccggacacgaggctttcactagcctaagggctagaggaggaagcttagccgatttagcagttctggttatagatgtaaacgaaggtttccagccacaaactatagagagcattgaaatattgaggaggtatagaacgccgttcgtagttgcggccaacaagatagacaggataaggggttgggtgattgaggaggatgaaccattcctaatgaacataaagaggcaagatcagagggctattcaagagcttgagacgaagctctgggaacttataggaaaattctacgaattcggcttccaagcgaatcgctttgatagagtccagaactttacgagggaattagcaatagtcccaatctcggcaaaatacggaattggaatagcggaactcctagttctcatagcgggactctctcaaaagtaccttgaggagaagctaaagattgaagtggaaggtccggcccggggaaccatacttgaagttagggaagaaccaggtttggggcataccatagacgtgataatatacgatggaaccctgcacaaggatgacacgatcgtcgttggaggaaaagataaagcgatagtcacgaaggttagggctttacttaagcctaaaccactggatgaaataagagatccaaggttcagattcgactacgtggatgaagttacggccgcagcaggtgtaaagatagctgctcctgggctcgaggaagcccttgcaggttctcccgttatagctgcccccacgcccgaagatgttgagagggcgaaggaggagataatgaggcaaatagaaagcgtcgtcataagcactgataaagttggggttatagtgaaggccgataccctgggaagcctggaagcattaagcaaagagctccaggagaaggaaatacctataaggaaagctgacgtaggaaacataagtaaaacagacgttatggaggctctcagcgtaaaagaggagaacccaaagtatggggtaatcctaggttttaacgtgaaagttaacgaagatgcaaaagaagttgcaaaggccaaggaagtcccgatattcgtcgggaatataatatataagctcatagaggattatgaagcttggataaaagaggaagaggagaagaggaagagagagttacttgcaaaggtgacgttccctggtgtaataaaattgtatccggatgagaggtacgttttcagaagaagtaatccagcaatagttggaattgaagttttggagggaagaataaagccaggtgttacgctgataaagcagaacggccaaaaggttggaactataaggtcaataaagagcagagatgaatttctccaggaagctagaaagggacaagcagttgcaatagcaatagagggggctatagttggaaggcatattcatccaggagaaactctgtacgttgacttaagcagggatgatgcaataatactattgaagcatcttagggatgtcctggaggatacagatattaaggccttgaagatgatagcccaagtaaaggcaaaggaagatccgttctggagggccgtt

SEQ ID NO: 44033 - DNA, 558 bp, Pyrococcus horikoshii
atgaaaatgaaagatgagctgatcaatctaataataaatgagggatgcataaaatttggccattttgttttgacatctggaaaagagagtaactactatatcgatataaaaagtctgataacaaaccctaaagccctaagaataatagcaaaactaatcaaagaaaaagctgaggaacttaacctaaactatgataaaatcgctggccccgagttgggagcagttccaatagcaacggccctttcgcttgaaactaacaagcctctcttaatagttagaaaaaagaaaaaggaacatggaaccgggaaagtaatagagggaaatgttcaaaaaggagataaagtgctattagttgaggatgttacgactactgggggaagcgtgataagagctgccaaaatcctaagagagcatggagcagatgtcgtcgggatttttgtcgtggtcgatagagaggagggtgcaaaggaaaatatcgaaaaggaaggcttcaagttctacccccttgtcttagtcagcgaactcttcaaggctgctgggatttctaaggatcaaagc

SEQ ID NO: 44034 - DNA, 1374 bp, Pyrococcus horikoshii
atggaggggaatactattcttaaaatcgtactaatttgcactattttagcaggcctattcgggcaagtcgtgccagtatatgcagaaaatacaacatatcaaacaccgactggaatttactacgaagtgagaggagatacgatatacatgattaatgtcaccagtggagaggaaactcccattcatctctttggtgtaaactggtttggctttgaaacacctaatcatgtagtgcacggactttggaagagaaactgggaagacatgcttcttcagatcaaaagcttaggcttcaatgcaataagacttcctttctgtactgagtctgtaaaaccaggaacacaaccaattggaatagattacagtaaaaatccagatcttcgtggactagatagcctacagattatggaaaagatcataaagaaggccggagatcttggtatctttgtcttactcgactatcataggataggatgcactcacatagaacccctctggtacacggaagacttctcagaggaagactttattaacacatggatagaggttgccaaaaggttcggtaagtactggaacgtaataggggctgatctaaagaatgagcctcatagtgttacctcacccccagctgcttatacagatggtaccggggctacatggggtatgggaaaccctgcaaccgattggaacttggcggctgagaggataggaaaagcgattctgaaggttgcccctcattggttgatattcgtggaggggacacaatttactaatccgaagactgacagtagttacaaatggggctacaacgcttggtggggaggaaatctaatggccgtaaaggattatccagttaacttacctaggaataagctagtatacagccctcacgtatatgggccagatgtctataatcaaccgtactttggtcccgctaagggttttccggataatcttccagatatctggtatcaccactttggatacgtaaaattagaactaggatattcagttgtaataggagagtttggaggaaaatatgggcatggaggcgatccaagggatgttatatggcaaaataagctagttgattggatgatagagaataaattttgtgatttcttttactggagctggaatccagatagtggagataccggagggattctacaggatgattggacaacaatatgggaagataagtataataacctgaagagattgatggatagttgttccaaaagttcttcaagtactcaatccgttattcggagtaccacccctacaaagtcaaatacaagtaagaagatttgtggaccagcaattcttatcatcctagcagtattctctcttctcttaagaagggctcccagg

SEQ ID NO: 44035 - DNA, 1359 bp, Pyrococcus horikoshii
gtgagaatggggagatactttggaaccagtggaattagggaggtagttaatgaaaagttaacccctgagttagctctaaaggttggtctagctttgggaacatacctccaggagggaaaggtcgttatagggtgcgacactaggacgagtagcgtgatgcttaagaatgccgttataagtggactactagccacgggaatcgatgttatagatataggcctcgcacctaccccacttacgggatttgctataagattgtacaacgcagaggctggcgttacgataacagcatctcacaatcctccacaatacaatgggatcaaagtttgggatagagatggaatggcatatactccggacaaggagcacgaactcgagaagattatagaatccggaaactttagaagagtaccctggaacgaggtaggaacattgaagacagcaaatcccaggaaagaatatattgaggctattttaagagaaataaatcttaagggatcctataccgttgttatagatgctgggaatggtgcaggttcgatagtaagtccataccttcacagggaacttggaaacagggtgataacgcttaactccgatcctagtggatttttcgttagagagcttgaaccaaataaggagagcctaagcatgcttgaaaaaaccgttaaagtccttaacgcagatatcgggattgcacacgacggagatgcagacagggttggggtcgtcgatgagaacggagaattcgtagaatatgaggtcatgctctcgctaattgcaggttacatgctaaaaaagtatggaaaggggaagatcgtgacaacggtagacgctggatttgctttagacgattacatccgagaactaggaggagaagtcgttagaactagagttggagacgttgccgtcgctgaagagctagttaagcatggaggggttttcggtggggaaccttctggaacttggataatgcctcaatggaatctaaccccagatgggatattcgcaagcgctttggttttggagatgatcgatagattaggcccaattggagagttagcaaaggatgttccaaagtacgtaaccctaagaaagaagatcccctgctcaaacgaactaaagaacaaggtcatgaataagatagccgatttaattccaagggagttctcctatgagaggataataacaattgatggtataaggatagagaatgacgactggtggattttgtttagacccagtggaacggagccgatcatgaggatcacgcttgaggcccacacggaagagatggcagagaggctaatgaaaaaagctgaaaatttagttaaaagcgtgataaaagatttatcttct

SEQ ID NO: 44036 - DNA, 648 bp, Pyrococcus horikoshii
atggtagtgattggagaaaagtttccagaagttgaggtaaagactacccatggagttattaagttgccagactactttacaaagcaaggaaagtggttcatactctttagccatccagcagactttacaccagtttgtacaacggagttttatggcatgcagaagagggtagaagagtttaggaagcttggggttgaacctataggattgagtgttgatcaggtcttcagccacataaagtggatagagtggattaaggacaaccttagcgtcgagatcgacttcccggtaatagctgacgacagaggagaactagctgagaagctcggcatgattccaagtggagcaacgataacagctagagctgtgtttgttgtcgatgataaaggaataataagggctatcgtttactatccagcggaagttggaagagattgggatgagatcctaaggctcgttaaggcccttaagataagcacagagaagggagtggctctaccacacaagtggcccaacaacgagctaattggagacaaagtgatagttcctccagcatcaaccatcgaagaaaagaagcagagagaagaggccaaggctaaaggagaaatcgagtgctacgactggtggttctgctataagaagcttgaa

SEQ ID NO: 44037 - DNA, 1227 bp, Pyrococcus horikoshii
atgttcaggttggaggattttaactttcacaataaaacggtattcttaagggtagacttaaactcacccatgaaggatggaaagataataagcgatgccaggtttaaagccgttttaccaactataagatacctcatcgagagtggagcaaaagttgtcattggaacgcatcaagggaaaccctacagtgaagattacactaccacagaggagcatgcgagggttctttcagagttattggatcaacacgttgaatatatcgaagacatatttggtaggtatgccagggaaaagataaaagagcttaaatcaggtgaagttgcaattttagagaatcttagattttccgccgaagaagttaagaacaaacccattgaggagtgtgaaaagactttcctcgttaaaaaactatcgaaagttattgattatgtcgttaacgatgcctttgcaactgcacacagaagtcaaccttctttagtaggtttcgcaaggataaagccaatgataatggggttcttgatggaaaaggagatagaggctttaatgagggcttattacagcaaagacagccctaaaatttatgtacttggaggcgccaaggttgaggattcgcttaaagtagttgaaaacgttctaagaagagagagagctgatctagtgctaaccggaggcttggtggccaatgtatttacgcttgctaagggatttgacttgggaaggaaaaacgtagagttcatgaagaaaaaaggcttgctagattatgtaaagcatgcagaggagatattagatgaattttatccctatataagaactcccgtagacttcgcagtagattacaaaggggaaagagtcgaaatagatctgctaagtgaaaataggggattacttcatcaatatcaaattatggatatcggtaagagaaccgcggagaagtacagggaaatattaatgaaagcaaggattatagttgctaacggaccaatgggagtctttgagagggaagaattcgcgatagggacagtagaggtgttcaaggccatagccgatagcccagcgtttagcgttttgggaggagggcattcgatagctagcatacagaaatacggtataactggaataactcatatctccacaggcggtggagcaatgctctctttcttcgctggagaggagttgcctgtcctgagagctcttcagattagttacgaaaaattcaaggaggtggtg

SEQ ID NO: 44038 - DNA, 747 bp, Pyrococcus horikoshii
atgataatagttgaaaacctcagaaagaaattcggatcaaaagaggtactaaaggggatcaatttcacggttaatgatggggagatatacggacttctagggccgaatggaagtggaaagtcaactactatgaggatactttccgggataattaccgattttgaaggtaaagtaatggtggctggagtggacgtctcaagagatccaatgaaggttaaggagatcgtgggttatgttccggaaacccccgcactttatgagagcttaaccccagcagagtttttcagtttcataggaggagtgaggaggattcctcaagatattctcgaggagagagttaaaaggctcgtagatgcgtttgggataggtaagtacatgaaccagttaataggaaccttgagctttgggacgaagcaaaaaatttccctaatctcggctttgttacacgatcctcaagttttgatactagatgaagccatgaatggccttgaccctaaaagtgctagaatattcagggagttactttttgagtttaaggaggaaggtaagagtatagtattttcaactcacatcttagccctagctgaggttatgtgcgataggataggtataatatacgaagggaggatagtagccgaaggaactatagatgaattaagggagatcgcaagggaagagaagcttgaagatatattcctaaagctaactcaagcgaaggaagaggtttctcagatagtttcagcacta

SEQ ID NO: 44039 - DNA, 534 bp, Pyrococcus horikoshii
atgctcatagctataaccggcactcctggcgttggaaagactaccgtggccaagcttctagccaagaagcttaactatgagtacgtgagccttaaagacttcgcccttgagaagggttgcgggaggagggtaaacgatgaagttgaggttgagatcgatgagctagcttactttatcgagagggaacttaaggggaagaatgcagttttagatggacatctaagccatttaatgccggttgaccttgtcgtagtcctcagagcccatccaaaactaataggagaaaggctcagagagaggggttatgacagagagaagataggggaaaatgttgaagctgaactcgtagatgctgtacttatagaagccatcgaggaacacgaaaatgttatagaggttgatactactaataaatctccggaagatgttgttgaggagatagtaagcctaatcaattcaggcattaaaaagagggtaggtatagtggattggagtgaggtgtatgacgagataataccctatctaaggcttgga

SEQ ID NO: 44040 - DNA, 576 bp, Pyrococcus horikoshii
atgccaaaggacaagctagtgataaccgttagcggattagcaggctccggaactacaacactttcaaagaaaatagctgaacattatggccttaagcatgtctacgctgggctgatattcagacagatggccaaagaaaagggaatgagccttgaggagtttcagaagtacgctgaacttcatccagagatagacagagaagtagacaggagacaaatagaagcagcgaaagaagggaacgtggttatagaaggaagattagccggatggatggttaagaatgctgacctcaaaatctggcttgatgctccaataagggttagggctgaaagggttgccaagagggaaggtataagcgtcgaggaagcttttatgaaaatagctgagagggaaatgcaaaacaggaaaagatatttaaacctttatggtatcgacatcaacgatttgtccatatatgatttaataataaacacgtcgaaatggtctcctgaaggtgtattcgctatagttaaagccgctatagaccacctcgaccccgtcggcgacgcggggtcgaaaaaagagaaggaggtggga

SEQ ID NO: 44041 - DNA, 1077 bp, Pyrococcus horikoshii
atgtttgaaaagggttatgtcgatgagaactacatcagagttcccaaggatagacttttctctttcatagtcagggtactaactaaactaggagttccagaggaggatgctaagatagttgcagataacttggtgatggcagatctgagaggggtggagagtcatggagttcagagattaaagaggtacgtggatgggataattagcggtggggtaaaccttcatcctaaaataagggttatccgagaaggcccttcctatgcccttatagatggggatgaaggccttggccaagtagttggatataggtctatgaaactcgcaattaagaaggctaaggatactgggattgggatcgtcattgctaggaacagtaaccactatgggatagctggatactacgccttgatggccgctgaagaggggatgatcggaattagcatgacgaactctaggccactagttgctccaacaggaggaattgaaaggatccttggcacgaatccaatagctttagcagcgcccacgaaggataagccctttttacttgacatggcaaccagcgtagttccgataggtaaactcgaagtctacagaagaaaaggaaaggatatccctgagggatgggccataaatagagaagggaatataactactaaggtcgaagaggtgttcaatggaggggcccttctaccccttggagggtttggagagctacttggaggacataaaggttatgggttaagtttaatggtcgatatactttccggaatactctctggtggaacatggagtaagtacgttaagaataccagtgagaagggaagtaatgtttgtcacttcttcatggtcatagacatagagcatttcatacctctagaagaatttaaggagaagataagtcagatgattgaggaaataaagagttcgagaaagcatcctgaatttgagaggatatggatccatggggagaagggatttttaaccatggagactaggcttaagctcggtattccgatctataggaaggttctcgaagagcttaacgagatagcaaaaagagttggagttgaaggt

SEQ ID NO: 44042 - DNA, 1089 bp, Pyrococcus horikoshii
atgcacaggctccaaatccttcaagtgcagaaatgccacgaggaattcgagaaagccatggccctaggtcagtatgataaggctaggttaatagcacttagatgctccgaattgttaaggaatctagcctctgaaaatttagatctctctcatatactcctcgaagaggcaaagaagtgggaagataaagccagaaatatcagaaaaaagaaagaagccaggaatgaatattttgatagattaaaggttctaataaagaagagcactgtaacttggaatgacattggagggttaaaagaagctaaaaagttaattgcacaagccgttggattaagcattgcaaaatctcctatagatccaccccagggaatacttctatttggccctccaggaactggaaagagcttacttgcaagtgctactgcaaacagtttgaatgcaacattctttagcgtgaaggcaagtgaccttctcagcaagtactttggggaatcttcaaagttggtttcagccctcttctccttggccagacaactaagtccaagtgttatatttatagatgaagttgattccctaaccatgaaaaggtcaagcctggatgatgccgctagaagaatgattgggacgttattagctgaaattgatggattcaaagataaaaggagaaaggtgattgtacttacagctacaaataccccctgggatcttgacgaggccatgctttctaggttgccaattagaatttacgtcccccttccggatataccctctgctgttgagatctttagaatccatctaaggggaattccccatgaggtatcgctgaacaagctagctaaagaagccgttaaaaagttgtactctggaagggaaatcgcaaatgttgtaaagctagcaactatgaagatgctcgaggaaatgaatcccgagctcgtagatcccctaagagtggctacgctaaagggaaaggatctgacgactagacctctaacgatggatgactttaggtacgcaatggccaagataaagagtcccataacgaagagtgatgttaaaaaatatgagaagtgggccaaggaatttggaatt

SEQ ID NO: 44043 - DNA, 942 bp, Pyrococcus horikoshii
gtgcccgagagagttgttatcgccctgggaggaaacgcactccagcagagagggcaaaaagggacttatgatgagatgatggagaacgtaaggaaaacggctaaacagatagctgagataattgcgaggggttacgaagtcgttataactcacggtaacggacctcaggttgggacgattctccttcatatggatgcgggacaatcccttcatggaataccagcccaacccatggatgttgccggggcgatgagccaaggatggataggttacatgattcaacaagcgttgaggaatgaactcaggaaaagagggatagaaaaggaagttgtcactataataactcaaacgatagttgacaaaaaagatccagcatttcaaaatccaacgaagcctgtaggcccattctatgatgaaaaaactgcaaagaaacttgcaaaggagaaaggatgggttgtcaaggaagatgcaggaaggggatggagaagggttgtcccaagcccagatcccaagggacacgtcgaggctgaaacgataagaagactcgtcgaaagtgggattatagttatagcaagtgggggaggaggagtccccgtaattgaagagaatggagaaataaaaggcgttgaagccgtgatagacaaagatctagctggcgaaaaattggccgaggaggttaatgcagatatacttatgatactaacggatgtcaacggggccgccctatactatggaacggagaaggaaacttggcttagaaacgttaaggtggaagaactggagaagtactaccaagaggggcactttaaggctggaagcatgggtcctaaagttcttgcagcaataaggttcattaaaaatggaggaaaaagagcaataatagctcaccttgagaaagctgttgaagcccttgaaggaaagacaggaacccaggtgactccc

SEQ ID NO: 44044 - DNA, 1275 bp, Pyrococcus horikoshii
atggggttgtatagaaaatacattgagtaccctgttcttcagaagatcttgattggccttatcttgggtgcaattgttggtttaatattaggtcactacggttacgcagatgccgtaaagacatatgtaaaaccctttggtgacctctttgttagactattgaaaatgctagtaatgccaatagtctttgcatcgcttgtggtcggtgcagcaagcataagcccagcaagactcggaagggtgggtgtaaagatagtcgtatattaccttctaacatccgccttcgcagttacccttggaataataatggctaggctgttcaacccaggagctggaatacacctcgcagttggcggtcagcaattccagccaaagcaagcacctccactagtcaaaatcttactcgatatagttccaactaatccctttggtgcactagccaatggacaagtactacccacgatattctttgcaataatccttggaatagcaataacctacctaatgaacagcgagaacgagaaggtgaggaagagcgctgaaaccctgcttgatgcaataaatggattagctgaagcgatgtacaagatagtcaatggagtcatgcagtacgctccgataggtgtatttgcccttatagcttacgtaatggcagagcagggggttaaggtcgttggagagttagcaaaggttaccgctgcagtctacgtagggctgacgctacagatactccttgtgtacttcgtactcctaaagatatatggcatcgatccgataagcttcatcaaaaaagcaaaggatgcaatgctaacagcgttcgttacaaggagctcaagtggtacattaccagttacaatgcgcgttgcaaaagagatgggaatatccgagggtatttattcctttaccctaccattaggagcaacgataaacatggatggaactgcactataccagggtgtatgtaccttcttcatagcgaatgccctaggtagtcatttaacggtaggacaacagctaacaatagtccttactgctgttctagcttcaataggaactgctggagtcccaggagcaggtgcaattatgcttgcaatggttcttgaaagcgttggacttccattaaccgatccaaacgttgccgcggcttatgctatgatccttggaatagacgcaatcttagacatgggaagaacgatggtcaacgtcactggagacctgacaggaactgccatagttgcaaagactgagggagagcttgaaaaaggagtaatagcc

SEQ ID NO: 44045 - DNA, 1158 bp, Pyrococcus horikoshii
gtggagattatggagttcgaagaggcatttaaagaagtttatgagatggtaaagccaaaatacaagctttttacagcggggccagttgcatgtttcccagaagttttagaaataatgaaagttcagatgttcagccacagatctaaggaatacaggaaagttcacatggacaccgttgagaggttgagggagttccttgaagttgagaaaggggaagtactgcttgtaccaagctcaggaaccggaataatggaagccagcataaggaatggagttagtaaaggaggaaaggttcttgtaaccataataggagcatttggaaagagatacaaagaggttgtcgaatccaacggtaggaaagctgttgtactggagtatgaaccaggaaaggctgttaaacccgaggacctagatgatgcattgagaaagaatcctgatgttgaggccgtgacgataacttacaatgaaacttcgactggagtcctgaacccattaccagagcttgcaaaggttgcaaaagagcacgataagcttgtattcgtcgatgcagtttcagcaatgggaggggccgatataaagttcgacaagtgggggttagacgttgtattctcaagttctcaaaaggcctttggagtaccaccaggattggcaattggtgctttcagtgagagattccttgagatcgctgaaaaaatgccagagagaggatggtacttcgacattcctctctatgtaaagtacctaaaggagaaggaatcaacaccttcaacacctccgatgccacaggtatttggaataaacgttgcgctgaggataattgagaagatgggaggaaaggaaaagtggctagaaatgtacgagaagagggctaaaatggttagagaaggagtcagggagataggactcgatatacttgcggagccggggcatgaaagcccaactattaccgcagtactcactcctcctgggataaagggtgatgaggtttatgaagccatgagaaagagaggctttgagctagcaaagggatacggtagcgtgaaagaaaagacctttagaattgggcacatgggatatatgaagtttgaagacatccaggagatgcttgataacttgagagaagttataaatgaattaaagaagcaaaaggggatcaac

SEQ ID NO: 44046 - DNA, 414 bp, Pyrococcus horikoshii
gtggtggttgttatgattgaggttggggagtacaaggtcaaggaaggactatactatacaaaggaccatgaatgggctcaggttctagaagatggaaccgtgctcgttggcataactgattatgctcagaaggagcttggagatttagcctatgttgaattacctgaggtaggaaaggaagttagcaagggagacgtgttatgtgaagttgaaagcgttaaggccgtgagcgaagtttacgctcctgtaagtggggaggtcattgaagttaacgaagagctaagtgatagccccgaaaagattaacgaggatccgtatggggcttggatagccaaaataaaaccaaagaacctagaggaagaacttaaagagttaatggatgcagaaaaatacgcggagtacttgaaaactctc

SEQ ID NO: 44047 - DNA, 1203 bp, Pyrococcus horikoshii
gtgaccctaatgataagggcttctaaaagagctctttctatagaatacgcaattagggatgttgtactacccgctagagagctcgaaaaaaagggcataaaagtgatcagactaaacattggcgaccccgttaaattcgacttccagccaccagagcacatgaaagaggcatactgtagggcaattcaggaaggtcataactattatggagacagcgagggattaattgagcttagagaagcaatagtgaaaagggaaaaggagaagaatggggttgatataactcccgatgacgttagagttacggccgctgtaacagaggcactacaattgatattcggggcccttctggatccaggagatgagattctaatcccaggaccgagctatcctccatatacgggcttagtgaaattttatggcggaaagccagtagagtatagaacaattgaggaggaaggatggcaaccagatatagacgacctaaggaaaaagataagtgaaagaacgaaagcgatagccgttataaatcctaacaatccaacgggggccctatacgataagaaaactatagaagagattataaacgttgcaggagaacacgatttagtagttttaagcgacgaaatctacgatttgatgacttatgaaggaaaacacatttctcctggctccttgaccaaggatgttccagttatagtcatgaatggattatcaaaggtatactttgccacgggatggaggcttgggtatatgtactttgttgatcccgaagggaaattaagcgaagtcagggaagcaattgataaactagcaaggataagaatatgtcctaacacaccaggacaatttgcagcgatagcgggattaacaggctccatggactatcttaaagagtatatgaaaaaactaaaggagagaagagacttcatatataagagactcaatgaaattccaggaataagcacaacaaaaccccagggggcattctatatctttccaagaattgaagaaggcccatggaagagtgataaggaatttgtgctcgacgttctacataacgcccatgtcctattcgttcatggctcaggattcggcgaatatgggaagggacacttcagaattgtattcttacctccgattgaaatcctcgaagaagctatggacaggtttgagaaattcatgagggaaaggctttcttca

SEQ ID NO: 44048 - DNA, 1944 bp, Pyrococcus horikoshii
atgctcaatgggatcggaatgggagttagggttgtatgcccatactgtggctttggttgcaacctattaattgacccgaaaagtaggagggtaaagccttatcctggagaacccaacaggggaaagctttgccctaagggattgtatgctttggagcatgtattctcaaaggatagactaaagcatcctttaaaaaaagaaggggaaagctttagaagaatttcatgggaaaaagcgatctccgaaatatcaactaaactgaaggagatcatcgaggattatggcccaggatcaatagcatttattgcctcatcgaaggttactaatgaggaaaattacctaatacagaaaattgcgagacttcttgggacgaataatgttgacaactgtgctagactctgtcacgaatcaagcgtccatgcccttaaacttaccttaggagatggcgttcagacgaacccatactcagatctagagagatttggtgctataatgatctggggttacaatccagcagagacccatccagttgtcatgcaatacatactcggcgcgaaaagaaggggaggcaagataatagtcattgacattagggaaacgctcacaatgagatttgctgattacaggctcgttataaaaccgggaacagatataacgctcgcaaatgctattatgaacgttataatagagggcaacctctacaataaagagtttgtagagagcagaactactggattctcagagataaggatgggggtgaaaaagtacacacctgagtacgctgaaaaggttaccggcgttccagctgagctcataagggaagttgctgaagtttttgctaaagctggaagcggcgcgataatgtggggaatgggaataactcagcaaatttccggcgttgaaaatgtcttggctttggtagatattgcccttcttttaggatatttcggtgagaagggaggattgtacccaatgagagggcagaacaatgttcaaggcgctgcgtacatgggaacattgagtgaatttcttcccggttacattcccttaagcgattctaaatttaggagaaaagttgctaagatgtggggagtggaggatcttcccaccgaaaggggattttatttaactgagtactgggatgctatacttaaaggtgacttaaaggccctctacatcgttggtgagaatccagcggtgagcgatgctaacgcgctgaaggttagaaaagctttaactaagcttgaccttctcgttgttcaggatctgttcctaacgaaaacagcgcgcttcgcacactacatccttcccgcagcggccttctgtgagaaggaaggttcctatatgaacagcgagagaaggatccagtggagttttaaggtctgcgatcctcctggagaaagtaagcctgactgggaaatccttgtaatgcttgcaagggccttaggccttaagggttttgactattcaaaagttgaggatataacgagggagtactttaaactctttccagcgcttaggaatagaagcatcgaggaacttaaagcaaggggaattataattcctgctccaaggctatacgttgattcgtttaatacacacgatggaaaggcccggttcgtagctgttgaacagatcatgccctgggaggaaccaaacggagagtatccacttatacttacaaccgtcaggctgataaatcactacaacacgggagagatgacgaggagaagtccttccttagctaagatgtctggagagtcagttgtctttataagcagggaggatgctcgggagtatggaattgaggatggtgactacgttatcgtggagacgagaaggggaagcttaaggctaaaagcaaagatagcgaaaatccaaaagggcgtcatagcaataccctttcactttgatgccaatctgctgacaaacgatgcgcttaac

SEQ ID NO: 44049 - DNA, 1917 bp, Pyrococcus horikoshii
gtgaaatacatgttctccgcgtgcatgagggattgttatgatacctgttcaataatgagcgagattaaaaatgggaagttaatagtgaggggaaaccccgatcatccaataactcaaggtttcctgtgtcccaagggggctctgttacctaggtggtttcactccaatgaaaggctaaaatctcctctcgtcagggaaggtaagaggggagatgaggattttaaggaagtttcttggggagaagccctcaccttaattaaagaaaagcttcaggagactataaaagagtacgggagcgaaagcattctagtttataagtacgctggagacagaggaattgtcaactattacttcccgatgcgtctcttccactatcttaatgctagcactatagatagtggtatatgcgacagagctggacaggaggctctaaaagatatctatgggactgcagttgggatggatcctgaaaagattaaggagcataaactcctcgtctactgggggataaatgccttctggacgaatcttcatggcttcatgctggcaaagaagggtaatgtagaaatttggacggtagatgttgtgagaactgaaaccgctaagaggagcgataaattcttccaaataaggcctgacacagatgtactatttgcattaggagttgcaaaggttataattgaagaggagctttatgacaaggactttgtaactaagaatgtctatgggtttgaagaattcaagaattatgtaactagactatcacttaattatgtaagccaagagacaggtattaaaccagagaggattaaagaatttgcaagggaatttactgagaagagggggataattcacataggttatggctttcaaagatccctagctggtggagaagctgtaagggcagtggcgatcttaccagtgttggttggtcataagttcggctttatatatgacatgaagacgatagataaaagctatgccgaggggaaattcctgagaacaaaacctgagaataagatcccacaaatggagcttaccaaggtaatagagagcgatgatatcaaattcctctacatttataattcaaaccccttagctagctatcctaatcagaacaggcttagaagagccttaaagaagagtgacgtttttgttgttacccatgacatattccttacggataccgctctattttcagacgtagttcttccagctaacacctttttcgaaagactagatatagttgactcttactatcacagatacgttctattgaatgaacccgtcgctaagggcccaggaaagagtaacagtgaggtgactaggcttatagccaagtccctgggtattagggtcccctatctatatgaaagcgatgaagacgtgattaggaaggttttagaggccaatggaataagttttgaagagcttaagagaagaggttttataaaggtgccagaaggaccaaggaattggaaaacccctagcggaaagatagagttctactctcaaagagctgtttccaggggcctaggaccatttccagagtacaagaagttcaagggcaagtacccgttgaggttgctaactcctacccacaggatgacgataacgagccaatatcataccacccatgggattatagatccaaacttatacatgaatccagaagatgcaaaggttagaggcattaaggatggggataaagtcggtgttttcaatgaaaatggtagagttataactaaagttaagataactgaagatgttccaaaaggagttgttatcctatacaaagctttttggcccaagttacttggttggaatgcaaacttcttaacgacagatgagaaagtagaaaaatatggcaagggatcagcgttccattcaacttgggtggaagttaatccatatgga

SEQ ID NO: 44050 - DNA, 918 bp, Pyrococcus horikoshii
gcaattgaagttgagaagctaactaaaagttatggaaaatttaaggccattgataatctatcctttgttgtagatgaggggatagtgttcggcttcctgggacctaacggagctggaaagacaacgacgatcttaagcatgctcggcattataatcccagatagtggagacgtaagaatacttggctatgatatatttaaggaacctcttaaggctaaggagagacttggattcctaccagaaaatgccacgatatacgaagagttaacggcatggagaaaccttgactttttcgcaagcttctacagaatgtcaaaacaggaaaaagaaaagaggatcgaggagctcctaaagttagtgggactatgggatgtgaggtacaggaaggcaaagacgttctctaagggtatgaggcagagactcctcctcgctcaagccctcataaacgatcctgaacttttaatcctggatgaaccaaccagtggcctggatcccgaaggagcaagactagtaaaagatataattagggagcagagaaagcagggaaagactgtcttcttttcatcccacatacttagtgaagtcgaagaactagcagataaggttggaataatagttaagggaaagcttagaacggtaggaacactggaggagataaagaagcagtacatggaattagagggatacgagataaagatagaaactaagcaaccattacctgagcttgaaattccagatataataaggatcgaaaagacaaccgagaataaggcaataatcttcgcaaagtctgatataagggaaagcataagtgaagagttagccaagaaggggatcaccattataagccttgaaattgaggagcctagcctagaggatgtattcttaaagacaatatataggagggaaggaaatgaa

SEQ ID NO: 44051 - DNA, 1167 bp, Pyrococcus horikoshii
atggcgctaagtgacagattagaattagttagtgcttctgaaattagaaagctctttgatattgctgcaggaatgaaggatgttatctccctgggaataggggaacctgattttgatacgcctcaacatattaaggagtatgccaaggaagccctggataagggattgactcattatggtccaaatatagggcttttagagcttagggaagccatagctgaaaagttaaagaagcagaatggcatagaggctgatccaaagacagagataatggtcttattaggtgcgaaccaagctttcttaatgggcctctcggcttttcttaaggatggtgaagaggtattaataccaactccagcctttgtcagctacgcacctgccgttatattggctggaggaaagcccgttgaagtcccaacgtacgaagaggatgaattcaggctaaacgttgatgagcttaaaaagtatgttaccgacaagactagagctttaataataaactcaccgtgtaatccaacgggagcagtgttaactaagaaagatctagaagagatagcggattttgtcgttgaacatgatctaattgtaataagcgatgaagtttatgagcacttcatttacgatgatgctaggcactacagtatagcctccctggatggaatgtttgaaaggacaataaccgttaacggattctcaaagacgtttgcaatgacgggctggaggttgggatttgttgcagcgccttcttggataatagagaggatggtgaagtttcagatgtataacgctacttgtccagtgactttcatacaatacgctgctgctaaagcgttaaaggatgagagaagctggaaagctgttgaagagatgagaaaggagtacgacagaagaagaaagctcgtgtggaagaggcttaacgagatgggactcccaacggtaaagccgaagggtgcattttacatattcccgaggataagggatactgggctaacgagcaagaaattcagcgagctcatgcttaaagaagctagggttgcagtagttccaggtagtgcctttggaaaagccggtgagggatacgtaaggatcagctatgcaacagcttatgagaagcttgaagaggccatggatagaatggaaagggtgttaaaggagaggaagctagtt

SEQ ID NO: 44052 - DNA, 1563 bp, Pyrococcus horikoshii
atggatatggagcaaagggaaaggtgggcaacaaagattggacttattttagcaatggcaggaaatgccatcggtctaggaaacttcgttagattcccaactcaggttgctggaaacggtggaggagcattcatggttccttatttccttgcactgttcctccttggaattccagtgatgtgggttgagtgggttcaaggtaggtacggtggaaagtacggacatggtaccctaggtccaacgttctacttaatggctagggaaagtttaaagcctagaagtgcgttgtggtttggtttaatcggtggagctttagcgtttgcaacgacaaccttgcttaacagctactaccttcacttaatcggctggtccgcggcttactcgtggttcagcataactggagcatactacggtaagaatacagcccagttcttcagccaatatctgagtaaccatggtctcgtgttcctattctggggaataacggtagttctcctgggaatagcagttggacaaggcgtaagtaagggaattgagagatgggttaaggtaatgatgcccctcttgtatgtgtttgcaataatcctagtaatctacgtgtttgctttaggttctccactaggacaaccccagtggtcaacaattaagggattcgagttcatctggtcaccaaactggggctatctaaaggatcacctatggaaagtaatgcttgcagcgagtggtcagatattcttcacgctctctctaggaatgggtatcatacagaactatgcttcgtacctagggccaaaggatgatgttgcactatcaggattagcaactgtttcactaaacgagtttgccgaagtagttcttggtggttcaattgcagttccattggcagttgcctacgctccaaagatcgttcctccagatgtccttgcaaaaggaagtgatgctgcattagcctggatttcggagaactttggactcggattctcatacacgagccttccaaacatattcgtgcagatgggaacagcaggaaggttctttggagctctatggttcctcctgctctggtttgcaggatttacctcagcaatagcaatgtataactatttaaccgcactacttgaagaagatctaggaataaagaggagcgttggaacatgggtagtcttcataatctacttcctcctgggaattccagtagtttacataaatggttatcttgaccaggtagatgcctggataagcttccagcttgcactacttgcattgttcgacataattgtcagcgtatggctattcaagccagacaacttctggagagagctacacgagggagcactaattaacgttccagagttctacaagtggataacggtgataatagcaccaatattcatagcactaccactgtttggtacgttcactgacctagtaagtaaaactctcgggtggccagctaagatagcaatactcacaatgctaaccattggtgcaattgaagcctactacgctatcaagaagaagtatggcgaagaactagagaagaacgaggtaataataaaggtc

SEQ ID NO: 44053 - DNA, 621 bp, Pyrococcus horikoshii
gtgttgcaattgaccgagaaattcaaaggtacaactacagtaggcatagtttgtaaagatggagtagtgctagctgcagataggagggctagcctagggaacataatatacgcaaggaacgtgactaagatacacaagatagatgagcatctagccatagctggggccggtgacgtaggcgacatactgaacttagttagactccttagggcagaagcaaagctttactattctcaatcagggaaaaggatgagtgtaaaagcattggccacactgctggctaatattatgaatggagctaaatacttcccatacctcgcatggtttttagttggagggtacgatgaaaagccgaaattatattccgttgatatggtgggagggataactgaggataagtacgcaactgccggaagtggtatggagtttgcatattcgattcttgactctgaatataaagataatttaacccttgaagaaggtataaaactggccgttaaggcaataaacacggcaattaagagggatgtattctcaggggatggtattctggtcgttaccataacaaaggagggttacaaagagctttcagattcagagcttgaagcaactctcaagcag

SEQ ID NO: 44054 - DNA, 1014 bp, Pyrococcus horikoshii
atgggtgttcctatcggtgacctcgttccgaggaaggagatagatcttgaaaatctgtatggaaagaagatagcgatagatgccctaaacgccatctatcagtttttatcaacgataagacagagggatggaacaccacttatggactctaagggtaggataacctctcatttaagtgggctcttttatagaacgataaatctaatggaagccggtattaagccggcctacgtctttgatggaaagcctccggaattcaaaaggaaggagctcgaaaaaaggagggaagctagagaagaggcagaactaaaatggaaagaagctctagccaagggaaacctggaggaagctaggaaatacgctcaaagggcaactaaggttaatgaaatgctaatcgaagatgcaaagaagcttttgcaactaatgggaataccaataattcaggctccaagtgaaggagaagcccaagcggcatacatggcaagtaaaggggatgtctacgcgtcagcgagtcaagattatgattcactactctttggtgctccaaggttgattaggaatctgacaattacgggaaaaagaaagatgcctgggaaagatgtttacgttgaaataaagccagagttagtagttctagatgaggtactaaaagagcttaagataacaagagaaaagcttatagaacttgcaattctggttgggactgactataatcctgggggcgtaaaggggataggacctaagaaggcccttgagattgtaagatattcaagggatcccctagcaaagttccaaagacagagcgatgtggatctttacgctattaaggaattcttccttaaccctcctgtcactaatgaatactcgcttagttggaaggagcctgatgaggaaggaatattaaaattcctctgtgatgagcataattttagcgaagaaagggtaaaaaatgggatagaaagactaaaaaaggcgataaaagctggaagacaatcaacgcttgagagttggttc

SEQ ID NO: 44055 - DNA, 1326 bp, Pyrococcus horikoshii
gttaaagagatacccggaccaaaagctaggaaagttattgaggagcaccacaagtacatggcaaccacgacaaacgatccaaacgagtacttcctagttatcgagagggcagagggagtttattggatcgatgtcgatggaaacgtactcttggatttctcctcaggaatcggtgtcatgaacgtaggacttaggaatccaaaagttattgaggccataaagaagcaacttgatctggtacttcacgctgctgggactgactactataacccatatcaagtagaacttgcaaagaagctcgttgagatagccccaggagacatcgaaagaaaggtcttcctaagcaatagtgggaccgaggccaatgaggcagcgttaaagatagcaaagtggtccacaaacaggaagatgttcatagccttcattggagcattccatggaagaacccatggaactatgagccttaccgcgagtaaacctgtccagagaagcagaatgttcccaacgatgcctggtgtagttcatgttccatatccaaatccatacagaaatccatggggaattgatggttatgaaaacccagatgagttgataaatagggtaatcgactacattgaagagtacctctttgagcactacgttccagccgaagaagttgccggaatattctttgaacccatccaaggtgagggaggttacgtagttccaccaaagaacttcttcaaagagctcaagaaattggcagataagcatggaatactcttaatagacgatgaagttcagatgggaatgggaagaactggaaggatgtgggccatagagcacttcgatatcgttcccgatatagttaccgttgcaaaggcccttggtggtggaatacccatcggagcgactatattcagagctgaccttgactttggagtcagcggtgttcacagcaacacattcggaggaaacactgtcgctgcagctgcagcccttgcggtgatagaagagcttcagaatggtttaatagagaatgcccagaagctggaacctctcttcagggagaggcttgaggagatgaaagagaagtatgagataatcggtgatgtaagaggccttggacttgcatggggagttgagttcgttaaagataggaagaccaaggaatatgcaaccaaggaaagaggagaaatagttgtcgaagcccttaagagaggtttagcattgcttggctgtggaaagagtgcaataaggcttatcccaccattgataatcagtgaagaagaggcaaagatgggattggatatctttgaggaagcaataaaggtcgtcagcgaaagg

SEQ ID NO: 44056 - DNA, 930 bp, Pyrococcus horikoshii
atgaatttggtgtttgggatgatagcttcaattggagagctcctaattgacttgatatctgttgaagagggtgacttgaaggatgttaggctctttgaaaaacatcctggaggggccccagccaacgttgccgttggtgtttctagacttggggttaagtcttcccttataagtaaagttggtaatgatcctttcggcgagtacttaattgaagaattatctaaagaaaacgtggatacaaggggaatagtaaaagatgagaaaaaacatactggaatagtgttcgtccagctaaagggtgcgtctcctagctttttattgtatgatgatgtcgcctatttcaacatgaccctgaatgatatcaactgggatattgtggaggaagctaagatcgtaaattttggatctgtaattctagctaggaatccaagcagggagacagtaatgaaggtcattaagaagataaaagggtcttctctcatagcttttgatgtaaatttaaggctggatttatggagaggacaagaagaggaaatgataaaagtgcttgaggaatcaataaagctagcagacattgtaaaggccagtgaagaggaagtcttatacctagagaaccaaggggttgaggtcaagggaagtatgctgacggccataaccctgggtcctaagggatgtaggttaataaagaatgaaacagtcgttgatgttccttcctataatgttaatcccctcgacacgactggagcgggagatgcattcatggccgctttacttgtcggaattctaaagttgaaagggcttgatctattaaaactcggtaaatttgcaaaccttgttgctgctttgtcaactcaaaaacggggggcgtggagcactccaagaaaagatgaactattaaaatataaagaggcgagggaagttctagctcct

SEQ ID NO: 44057 - DNA, 1053 bp, Pyrococcus horikoshii
atgaggcgaggtaagatgcacctaatggaatttccacgagaagtcattcttggaaaaaatctaatccaggaaattaataatgtaattaagagactcaaactcggttctcctggattagtagtttatggtccaataacgaaaaagatagcaggttcaaatgttgagaagatagtaaaagaggaatttgaagtttattccattaccgttaaagaagctcacataaatgaggttgagagggtaatcagtaaaataagagataaaggcattaaatgggcaattgcagttggagggggaagtataatagatgttacaaagctggcaagttttaagatgggaattccattcataagttttccaaccaccgcatcacacgatggtatagcaagcgctaatgcatccattaaaggcttaaacgttaaaacatcaataaaggctaaacctccaatagccgtcattgcagatatagatgtaataaaaacggccccaaaaagatacctagccgctggagttggagatatcgtaagtaatataaccgcagtaagggattggaaacttgcacataagcttaaaggggaatacttcagtgaatatgccgcttcactaagcttgatgagtgcaaagatggttatccgggatgccgagataattagacttggacaggatgagggaattagaaaggttgtcaaggctctaatatcaagtggagttgccatgagcatagctggctcctcaagacccgcaagcggtgctgagcatttattcagccatgccctagatatgctgttagataaaccggccctccatggagagcaaacaggcattggaaccataattatggcatatcttcatgggatcaactggaagaaaataagggatacattgaagatagttggggctccaacgacagcttacgaactaggtatagatcccgagattataatagaagctctaacgatagcccatacaattaggccagagagatatacaatcctgggtaaggaaggcataactagagaggccgctgaaaaggctgctaaaataacgggtgtaatt

SEQ ID NO: 44058 - DNA, 900 bp, Pyrococcus horikoshii
gtgactaagcaaaaagtttgtcccgtttgtggatcaacggaatttatttatgaccctgaaaggggtgaaatagtctgcgcacgctgtggttacgttattgaggaaaatataatagacatgggaccagaatggcgtgcttttgacgcttctcagagggaaaagagatccaggactggggctcctgagagcatactattacacgataagggactttcaaccgacataggaatagacaggagcctaaccggattgatgagggagaaaatgtataggctcaggaagtggcaatcgaggcttagggttagtgatgcagctgagagaaatttagcgtttgcattgagtgagttggacagaataactgctcaattaaaattgccaaagcacgttgaggaagaagctgctagattgtatagggaggccgtgagaaagggattaattagaggaagatcaattgaaagcgtgattgcagcttgtgtttacgccgcatgtagattattaaaggttcctagaacattagatgaaatttcagatatagctagagttgaaaagaaggaaattggaaggagttatcgtttcattgctaggaatctaaatctaactcccaaaaaactatttgtcaaaccaacggattatgtaaataaatttgcggatgaacttggactcagtgagaaagtcagaaggagggccatagaaattttggaagaggcctatcggagaggactaactagtggaaaaagtccggcaggattagtagctgcagccctatacatagcatctcttcttgaaggagaaaagagaactcagagagaggtcgcagaagttgctagggttaccgaggtaactgtaagaaacagatacaaggaactcgtagaaaagttagggataaaggtgcctattacc

SEQ ID NO: 44059 - DNA, 1272 bp, Pyrococcus horikoshii
atgccaaaggagaagccccacgttaacatcgtgtttatcgggcacgtagaccacggaaagagcacgacaatcggaaggctcctttatgatactgggaacattccagagacaatcatcaagaagttcgaggagatgggcgaaaagggtaagtccttcaagttcgcttgggtcatggataggcttaaggaagagagagaaagaggtattacgatcgatgttgctcacaccaagtttgaaactccacacaggtacattaccatcatcgatgctcctggtcacagggacttcgttaagaacatgatcaccggtgcttcacaggcagatgctgcagttctagtcgttgcagctactgatggggtcatgccacagactaaggagcatgccttccttgcaagaacgctcggtatcaagcacataattgttacaataaacaagatggatatggttaactatgaccagaaggtcttcgagaaagtaaaagctcaggttgagaagcttctcaagacccttggttacaaggacttcccagttattccaacgagtgcttggaacggtgacaacgtcgtcaagaagagcgacaagatgccttggtacaatggtccaactctaattgaagctcttgaccagattccggaacccgagaagcccatcgacaagccgctcagaatacccatccaggatgtgtactcaattaagggtgtcggtaccgtcccagttggaagagttgagactggtaagctcaaggttggagacgttgtaatctttgagccagcatcaacgatcttccacaagccaatacagggtgaagttaagagcattgagatgcaccacgagcccctccaggaggctcttcctggcgacaacataggattcaacgttagaggtgtaagcaagaacgatatcaagagaggtgacgttgctggacacaccgacaagccaccaacagtagtcagaaccaaggatacattcaaggcccagatcatagtccttaaccacccaaccgcaattacagttggttacagcccagtcttgcacgcacacaccgctcagattccagttagattcgagcagatcttagccaaggtcgacccaagaactggtaacatcgtcgaggagaacccgcagttcattaagaccggtgattcagctatcgttgtcctcagaccaatgaagccagtagtccttgagcccgtcaaggagattccacagctcggtagatttgccattagagatatgggtatgacaatagctgctggtatggtaatatctatt

SEQ ID NO: 44060 - DNA, 1287 bp, Pyrococcus horikoshii
atgaaggccaatgacataattaagaggtattccaaggttatagctcaagcaaacaaaatgcactactttccactcgttcccgtaaaggccgagaatgctaaggtgtgggatatcaacggaaaggaatacatcgacttccttagcgatgccgcagttcaaaatgttgggcataacaatccaagggttgtaaaggccgtgaaagagcaggtggataagttaatgcatgcaagctacatatatgcctaccccattgaaccgctactcctcgctgaaaagctagccgagatagctccaatagataaccccaaagtatcatttggcctaactgggggagatgccaacgatgctgcaataaagtttgcaagagcttataccaagagacaaacgatacttagctacatgaagagtttttacggctcaacttatggagcaatgagcttaactggtcttgattttcgggtaagggcaatagtgggagagctaagcggagtccactaccttccctacccctactgttacaggtgtccttttgggaaggaaccaggaagttgcaaaatggaatgcgtcgaatacataaaggagaagtttgaaggagaagtatatgctgaaggagttgcagcactattcgccgaaccaatacagggagattctggaatagtagtcccaccaaagaattacttcaaaaaagttaccaaaatcttgagagaacatggaatattgttagttgtcgacgagatacagagtggaatgggaaggactggaaagtggtttgcgatagagcactttggagtaaaacctgatataatcaccgtaggaaaagccttaggtggaggtttacctataagcgctacaataggaaaagcagagattatggattctctacctccacttagtcatgcattcactctctctggaaatcccactacctcaagagcggctttagctgttatagaggaaattgaggaaaagaatctactaaggagggccgaaaaattaggaaattacgcaatgaagaggctaagggaaatgatggataaacatgaattaataggggatgtcaggggaataggtttaatgattggagttgagctcgttaaggatagagaaaccaaggagagagctatagaagagactagtaaggtaattgagagagcttttgatcttggattaatagtcactcactttagtggcaacgtccttaggatagagccacccctaacaatagagagggaaaccctagatgagggtttagatgtcctcgagaaggccatagaggatgttgaagaa

SEQ ID NO: 44061 - DNA, 909 bp, Pyrococcus horikoshii
atggtgaaaaggatgctagaggtaaaactctttggcattagatttgaaaatcccctaatattagcctctggagtagttgacatgacaccggaactactcaggagagcccacaatgaaggagcaggaggagtcgttacaaaatccataggtaaggaacctagaaagggttacgataatccaactatcgttgaactaccctacgggttaataaatgctatgggtctcccaaaccctggatgggaggcatttttaaatgaatttattgatgaaaggtttgactttccagtgatagtttcaatatttggaggcacaccggaagagtttgcatttcttgcagagaagttagaaccagttgcagatgcctttgaattaaatttgagctgtccccatgcgaaaggctatggtatggaaattgggcaagaccctaaaaatgtgtatgaagttgtaaaagctgtcaaggatgtaacagataagccagttatagccaaactaactccaaatgttaatgacataacaaagctcggattagcagcggaaagaggaggagccgatggggtttcagcaattaatactgtgaaagcaatagccattgatatctacgctaagagaccgatacttagcaataaagttggaggatattcagggccggggataaaaccaatagcgcttagggctgtttacgatttagcgaaggttttagatattccagtaattggaattggaggaataactagctggcgggatgctgtagaatttttactagcaggagcatctgcccttcagataggaactgccgtataccttagaggatttaaagtgtttaaggaaatttcgaatgggataattgagtacctcaaggaggagggattctcaagtattagggatatcatcgggctagccctcaaggtt

SEQ ID NO: 44062 - DNA, 3351 bp, Pyrococcus horikoshii
atgagaggtccaactgttgtagaggttactcccgacgacctttggattgttatggagagctactgggaagaaaagggacttgtaaggcagcatcttgattcttacaatgctttcatcgagaggggtctccaggaagttgtcgacgaatttggaggaataaaaccagatattcccgattttgaagttaagtttggaaaaattagagtaggagagcccgagtttcaagagcctcatggtcagagaaaaccactttatccaatggatgcaaggattaggaacttaacttactcggccccactatacctggaaatgatccccgtgataagggggattgaacaggatcccgttgaggttagaataggtgaacttccaataatgcttaagtctaaggcttgtaggctctatggccttagtgatgaggaactaataaagcttggggaagatcctaaggatcctggtggttacttcataataaatggttccgaaagagtgatagtttctatagaggatatagcccccaatagaacgctagttgagaaagatgagaggcaagaaaagtatatagcaaaagttttctcgtataggcatggttacagggccctcgtaaccgttgaaagaaagaaagatggaatcctttatgtagggattccaaacgttcctagacctgtgaagtttgtctatgttatgagagctctaggacttgaaagggataaggatatagtcgatgcagttggaaacgatcccgaggttcaacagatattattcgataacctagaggatgctagtgatataacaacacaacaggaagcgctagaatatattggaaagcttgttgctcctggtcaagctagagaatacaggctaaagagggctgagtacgttatagataataacctccttcctcacatgggagttactcccgaggacaggataagaaaggcttactatcttggaatgatggcactgaaagtaatagagctatccctcggaaagagagatgaggatgataaggatcactatgcgaacaagaggttaaggctggcaggagatcttctaaaagatctctttagagttgcattcagtcagttaattaaggatatacagtatcagatgactaagacatatcaaagaaggggagagaaatatgtgtttagtaacatccacagattcataaggaactcgattagacctgatgttctcaccgagaggattgagcacgccttagcaactggagcttggccaggaggaaggacgggtgtaagccagcttttagacagaacaaactacgtttcaacattgtctcaccttaggagggttacatctccccttgacagagaacaaccccacttcgaggctagagatctacacgggactcattggggtagaatatgtcctactgagacacctgaaggtccaaattgtggattggttaagaatttagccttgatggcccagataacaacagcagtcccagaagaggaagttagggagtacctgatgtccctgggaatagttccaatagaagtgagaagaccgagtcctgagctttggagagtctatttgaatggagttctaattggtaccgttgaggatggtaaagcccttgttgaaaggataaagaaagacagaagaagtggaaagataagtgacataataaacgtagcctactatgaggatgttaaagaggtttacgttaacagcgatgatggtagagttaggaggcctctgattattgttgaaaatggtgttcctaagctaactaaggagcacgtgcaagccattaaggaaggaaggcttaagtggagtgatctagtcagaatgggcgtcatcgagtacctagatgctgaagaagaggaaaatgcctacgttgccatgtggccatgggaagttaccaaggagcacacccacttggagctaatgccggccgctattctaggattacctgcgtctttgattccatacccagagcacaatgctgctccgaggaatacctatggtgcaggtatggccaagcagagccttggtttagggtgggctaactttagaataagggtagataccagaggtcacctacttcactatccgcaaattccacttgttaactcgaggataatgaaagctgtcggttatgaagacaggcctgctggtcagaacttcgtagtcgcagttttagcttaccacggttataacatggaagatgcaattataataaataaagcctccatagagagaggactggcaaggtctacattcttcagaacatacgaggccgaggaaaagaagtatcttggtggtcagacagatagatttgaaattcccgctcctaccgtaaggggatataggggagagaagtactatagacacctggatgaggatggcctaatattccccgagtcaaaggttgagggtaaggatgtcctgataggaaggacatccccgccgaggttccttgaagagagagggttaggggccgtgagcctacaagaaaggagagaaacgagcgttgctgtaagacctagtgaaaagggaatcgttgacaaggtaataattaccgagacgggggatggaactaagctcgtcaaggtcaccgttagagaccttagaataccggagatcggtgataaattcgcttcaagacacggtcagaaaggtgtcataggattaatcgttccccaggaagatatgccctggactgagagtggaatagttcctgacctaatagtcaatcctcacggtattccatcgagaatgacagttggtcagttgcttgaagccatagggggcaaggttgcagccctgaagggaaggagagttgatggtactgcattcattggagagcccgaagaaaagctaaggaaggagctcgaggagcttggctttaagcacactggaagggagataatgtacgatggtataacaggtaagaggtttgaggccgacatattcattggaataatctactaccagagattgcaccacatggttgccgataagatacacgcccgttcaagaggtccagttcaggttctcactaagcaaccaacagagggtagggctagagaaggaggtctgaggtttggtgaaatggagagagatgtcctcgttggtcatggagctgcgatgctactcattgagagattgcttgaagaaagcgataaaactgaggtatgggtctgtgaaaactgtggtcacatagctatagaggataagaggagacataaggtctattgcccagtttgtggagaggaggaaaggattagcaaagttgaaatgagttatgcatttaagcttctcctggatgagcttaaggctatggtgattagacctaagttaaacctcacggagagggtg

SEQ ID NO: 44063 - DNA, 780 bp, Pyrococcus horikoshii
atggcattcgttccaccacaagcagggtacgatagggctattaccgtgtttagtccagatgggagattgttccaggttaactatgcaagggaagcggtaaaaagaggagctaccgctgttggtgttaagtgcaatgaaggtgttgttttagccgttgaaaagaggatcacaagtagattgatagaacccgaaagctatgagaaaatctttcaaattgacgatcatatagcggctgcttcgagtggtataattgcggatgctagggttcttgtaaatagggcgagacttgaggcccagattcacagactcacgtatggtgagcctgctccgttagctgtgatagtgaagaagatatgtgacttgaaacaaatgcatacccaatatggtggggttaggccttttggtgctgctctacttatggctggagttaatgaaaagcctgaactttatgaaacagatcctagtggcgcttattttgcgtggaaggccgtggcaataggaagtggaagaaatacagcaatggccatatttgaggaaaagtacaaggatgatatgagtctagaggaagcgataaagttggccatttttgctctagctaagacgatggagaaaccgagtgcggagaatatcgaagttgcgataataaccgtgaaggacaagaagtttaggaagctatcaagggaggagatagagaaatatctaaatgaggtaatgaaagaagttgaggaggaagaggttaaggaaaaggaggaggattattcagagctcgatagccactac

SEQ ID NO: 44064 - DNA, 1266 bp, Pyrococcus horikoshii
gtggatatggttgagcaggatccctttgaaattgcagttaagcagcttgagagagctgcccaacacatgaagataagtgaagaagctctcgagttcttgaagaggcctcagaggattgttgaggtcacaatccccgttgaaatggatgatggctctgtaaaagttttcacaggatttagagtccaatacaactgggctaggggtccaactaaaggtggaattaggtggcatcccgaagagactctaagtactgttaaggcccttgcagcttggatgacctggaagactgctgtaatggatctcccatacggtggaggtaagggtggaattatagttgatccaaagaagctctccgatagagagaaggagagacttgcaaggggctacattagggccgtttacgatataataagcccatacgaggacatacctgctcccgatgtttacaccaacccacagataatggcttggatgatggatgaatacgagacgattgccaggaggaagacaccagcctttggtataataaccgggaagcccctcagcatcggtggatcccttggaaggaatgaggctaccgcaagaggagcaagctacacaattagggaagcagctaaggttcttggatgggacggactcaagggtaagacaatcgcaattcagggttatggtaacgcaggttactacctagcaaagataatgagcgaagattacggaatgaaagtcgtagccgtaagcgacagcaagggtggaatttacaacccagatggccttaacgctgatgaggttctcaagtggaagagggagcatggaagcgttaaggacttcccaggagctacgaacataagcaatgaagaactacttgagcttgacgttgatgtcctagctccggcggctatagaagaagtcataaccaagaagaacgcagacaacattaaggctaagattgttgcagaggtagccaacggtccggttaccccagaggccgatgagatactattcgagaaaggaatccttcagattccggacttcctatgtaacgctggtggagttacggtcagctacttcgagtgggtgcagaacataaccggttactactggacacttgaagaggttagagagagacttgacaagaagatgacgaaagcattctatgacgtctacaacaccgcaaaggagaagaacatacacatgagagatgcagcttatgtagttgcagtccagagggtctaccaggcaatgctcgatcgcggatgggttaagcac

SEQ ID NO: 44065 - DNA, 1254 bp, Pyrococcus horikoshii
atgaggatagcagttttagggttgggttatattggccttccaaccgcgataatgtttgcatcatctggatatgatgtcgttggctatgacataagatctgaggttatcaaaaagataaactctggagttgcccacataatagagcccgaaatagataggaggttaaaggaggtattatcacttggaaagcttaaggttactgatagggtggaagacctaaagggttctaatgtgttcataatctgtgttcagactccactttcaggagatgaccccgacttaagctacttggaaagagctattagaaccgttgcggaggttatggataggggagctctagttatcattgaaagtactatacctccaggcacgacagagaaaatggccaggcttttggaaaacttaacaggattaagggaaggggttgacttttatgttgctcatgcccctgagagggtgatgccgggtcggatatttaaggaactcgtttataactcaaggatcatcggtggggttagtgaaaaagcagcgaacttggccgagaagctttatagatcattcgttaagggtaggatattcttgacgaatgcaacgaccgctgaaatggttaagctaatggaaaatacgtttagggatgttaacattgcattggcaaacgaatttgccctgcttgctcatcagtatggagttaatgtctatgaagctatagagctagcaaacacgcatccaagggttaagatccacaccccgggaataggagttggaggtcattgtcttccaaaggatccttatctattattgtctaacgccaaagaagattttggtttgataagaatcgcgagaagaataaatgagagaatgccagcatttgctgctggtttactttttgaagcattagagaaggcgaatataaagccttccgaggctatcattgctgttcttggtctcgcatataagggagggaccgatgatactaggaattctccagctcttaagtttgtagagataattcgcaactccgtaaaggaggttagaacttacgatccatacgttaggggaactcatgattccctggagaaagttgttgaaggagctgacgcaattgttatagcaacggatcatcctgagtttaagagtgtaaattgggaaagcattggaaagtcgatgaggcataaaataataattgatgggaggaacattattaaagagcctccagttggctttatatttaggggtattgggaggggggacgtt

SEQ ID NO: 44066 - DNA, 1677 bp, Pyrococcus horikoshii
atgaagtatatcgagcttgcccaactttatcaaaaattggaaaaaacaacaatgaaacttattaaaacaagactcgttgctgattttttgaagagggttccagaagatcatttagacttcattccatacttaatactgggagatgtattcccagagtgggatgaaagggagcttggagttggggagaagctgttgataaaagcagtctcaatggcaacaggtgttgacccgaaggagatagagaactcggtcaaagatactggagatcttggggaaagtattgccctcgccattaagagaagaaagcagaaatcattcttctcccaaccattaacaattaagagggtctaccaaactctagttaaaatagctgagactactggagagggaagtcaagagaaaaaaatgaagtatttagccaacctatttatggatgctgagcctttagaggcgaaatacctcgccagaacagttctaggaaccatgagaacgggagtggcagaaggattgctaagagatgcaatagctttggcattccacgtgaaggtagagctagttgaaagggcttacatgctcacgagcgattttgggtttgtggcaaaaatagcaaaagccgaaggaaatgaaggacttgagaaggtaacaatccagttagggaagcctataaagccaatgctagctcaacaagccgctaacattaaggaggcccttttagaaatggggggagaggccgagttcgaaattaagtacgatggagcaagagttcaagttcacaaagatggagagaaggtgataatatactcaaggagactggaaaatgtaaccagggcaattccagaaattgttgaagccataaaggaagctattgagccagaaaaagttatagttgaaggggaacttgtagcaataggagaagagggaagacctttaccattccagtatgttcttcgcaggttcagaaggaagcacaatatagaggagatgatgaagaagataccattggagctaaatctcttcgatgttctctatgtcgacggtaagagctttgtagatacaaagtttatagagagaaggaagaaacttgaagagatcgttaagccaaacggaaagataaaagtagcagagaacctcataactaagaacgctgaagaagctgagaaattctataagagagcactagagatgggacatgaaggccttatggcaaagagacttgatgcagtatatgaacctggaaacagaggaaagaaatggctcaaaatcaagccaaccatggaaaaccttgacctcgtgataattggagctgaatggggggaggggagaagagcacacctatttgggtcgtttatcctgggagcttacgatcctgagaccggggaattccttgaggtcggaaaagtcggaagtggattcacagacgacgacttagttgagtttacaaagatgttaaagcccttaatagttaaggaagaaggaaagagagtggttatacaaccaaagatcgttatagaagtaacgtaccaggaaatccaaaagagtcctaagtacaggagcggatttgccttaagatttccaaggtatgttgcactaagagatgacaagggacctgaggatgcagacacgatagaaaggatagcccaactctatgaactgcaggaaaggattaagggaaaagtt

SEQ ID NO: 44067 - DNA, 1005 bp, Pyrococcus horikoshii
atggttaagtacgttttagcttcagctcctgcaaaggtaatactcttcggggaacatagcgtagtctatggaaaaccggctatagcttctgctatagaacttagaacatatgttagagctcaattcaatgattcgggtaatataaaaatagaagctcatgatataaaaactcctggattgatagtctcgttttccgaggataagatatactttgaaacagactatggaaaggccgctgaagttttgagctatgtgaggtatgccatagaacttgccctggaggagtctgataagagggttggtattgacgtttcaataacctctcaaattccagttggggccggattgggttcctcagcagcggttgcagttgctacaattggtgcggtctctaggttacttggccttgaattgagtaaggaggaaatagcaaagcttgggcataaagttgaacttctagtgcagggagcttcaagtggcattgatcctacagtttctgcagtgggaggcttcctctattataagcaaggaaagtttgagcctctcccattcatggagcttcccatagtcgttggttacaccggctctactggttcaactaaagaattagtggcaatggtaaggaaaaggtacgaggaaatgcccgaacttgtggagcctatattggaggcaatgggaaaattagtggataaggccaaggagataatactttcaaagctcgatgaagaggagaagcttactaagcttggagagttaatgaacataaatcatgggcttttagatgctttgggggtgtctacgaagaagcttggtgagttagtttacgctgctagaacggctggtgcaattggggcaaaacttacgggtgctggtggtggagggtgtatgtatgccttggcccctgggagacagagggaagtcgccacggcaataaagatagctggtggaattccaatgataacgagggtaagtagggaaggattgagaatagaggaggtttcaaga

SEQ ID NO: 44068 - DNA, 1023 bp, Pyrococcus horikoshii
atgagtgtgatacaaaacattatcggcagaattgccgtattgagaggtggaaaatattcggttgaggtagatgttgcaacagacgagggttttggtagattcacttcccccatagatgacaatccaatgctccatattgccgaggctagaagggcggtaagtgaagtggatgaaataatagggccagaattgataggatttgatgcctcggagcaggagttaatagatagttacctttgggagatagatggaacggaagatttcagccacataggggctaatacagcgttggccgtttctacagcgatagcaaaggctgctgcgaattcaagagacatgcccctatattcatacattggtgggacatttgctactgaattgccggttccagttttgagctttgcccaggatgacatgtttgattattatctggtagttaaagaccttctagaggttaccgatataatagatgccaccaataagatcagagagattgtgaaggagataaaccttgagaacttatcgaaagcttccgaagatgtgggggttgaacttggacttgaggtggccttgggaattggcatgaaaaaagaaatggatattgagaaggtattaaatttggttgaagattataatgtggcatacataaaaccgatagggccacctgaactttttttagagctaatagctggtacccatggagttttcattgatggggaatacctctttagaactaacagcgtacttgataggaggtactataatgcattatcaataaagcctataaaccttggaacgctcaccgatttgtataacttcgtgaatgatgtaaaggccgaaaaaataacaccaattttagccgaggcgaaatacgagcccgccgatgaaacatttccacacattgcattgggtttaaggtgccctgctatgttaataagttggagctcaattgagaagataaacgaattgaatagaattgctgaggaattgggggaaaggggaagaataataacgtttgaagag

SEQ ID NO: 44069 - DNA, 636 bp, Pyrococcus horikoshii
aaggttgctggagttgatgaagcggggagggggccggtaattggcccgttagtaattggagtagccgttatagatgagaaaaatattgagaggttacgtgacattggggttaaagactccaaacaattaactcctgggcaacgtgaaaaactatttagcaaattaatagatatcctagacgattattatgttcttctcgttacccccaaggaaatagatgagaggcatcattctatgaatgaactagaagctgagaaattcgttgtagccttgaattctttaaggatcaagccgcagaagatatatgtggactctgccgatgtagatcctaagaggtttgctagtctaataaaggctgggttgaaatatgaagccacggttatcgccgagcataaagccgatgcaaagtatgagatagtatcggcagcatcaataattgcaaaggtcactagggatagagagatagagaagctaaagcaaaagtatggggaatttggttctggctatccgagtgatccgagaactaaggagtggcttgaagaatattacaaacaatatggtgactttcctccaatagttaggagaacttgggaaaccgctaggaagatagaggaaaggtttagaaaaaatcagcta

SEQ ID NO: 44070 - DNA, 1161 bp, Pyrococcus horikoshii
atgccaaccaatgtaacagcagaatacctagcagcggaagaggagtatagaaatgcaaagacaattccagagaagataagagcacttgagaagatgtacgccttagttccgaaacataaaggaaccgaaaaattacgattacaaataaagaggagacttgcagagcttaggagggaattagaaaagcagagacaacagagaaagggaggaggttattctttagcggttaaaaaagaaggtgcagctcaaatagtcctggtaggattgcctaacgttggaaagtctgaacttttgagagcgttaactggagtggacgttgaaagtgcagattatccttttacgaccacggaacccgttccagcgatgatgaactacaaagatgttcagatacaacttgttgaagttcctgggctcttagaaggggcagctcttggaaaaggtatgggccctcaacttctagccgttataaggaatgctgatgcaatagctatagttatagacctaagtgaggacccgataaagcagatggaaatcctgcttagagaatttgagagggctggaattaaagtgaataaacgaagacctagggtagagatcagaaaaacaccaagtggtgggatagttataaacggggcggagaacataaagggtgatctaagtgaggtaatgagaatgcttagagaagagaagatacactcagcagagattacggtaaaagaacccgtaacacttgaggagtttgcagatgctttagacgatagcctagtctggaaaaaagctataataatagcaaataaaggggacagcccaggaagtaaagagaattaccacaaattgataaataaatatggggagaaatttaagatcgttccagtttcagcaaagaagagaataaacctagaagcagtgaaagaggctatttacgacgttgccgaaataataagggtatttaccaagagtccaggagaagagcctgcatatccaccaatagccctaaagaggggagcaacggtaatggatgttgcagaaaggattcataaggatcttgtaaagaactttagatatgctagagtttggggaaaaagcgtaaaattcccaggacagagagttggcccagaccatgttttggaagatggggatatagttgagatacatgcaaag

SEQ ID NO: 44071 - DNA, 1710 bp, Pyrococcus horikoshii
atggatgtggaaaagatagctctcaaacatgcccttattaatgcaattgagcatggaggtaaggctaatcttaaggccgtcatcggtaaagtgctcggcgagaaccctgagcttaggcccagggccaaggagataattcccataattaataaggtagtggaagaggtcaactcactagcaagggatgagcagctggaaaagcttaaggatatatatccagagtactttgaaaagaaggaagagaagaaggaaaagaagggactacctcttcttcctaaagcagagaaaggcaaggtcgttactcgctttgctccaaatccagatggtgcttttcacctgggtaatgcaagggccgcaatacttagttatgaatacgccaagatgtacggtgggaagtttatactccgctttgatgataccgatccaaaagtcaagaggcctgaacccatattctacaagatgataattgaagatctagagtggcttggaataaagccagatgaaatagtgtacgctagtgatagactcgaaatttactacaagtacgctgaggaactaataaaaatgggtaaagcatatgtctgcacttgtcctccagagaagttcagagagcttagagataagggaattccatgtccgcatagagatgagcctgtggaagttcagctcgagcgctggaagaagatgttaaacggcgaatataaagaaggagaagctgttgtaaggataaagactgacttaaatcacccaaatcctgcggttagggattggcccgcacttagaataattgataacccaaaccatccgagaaccggaaataagtacagggtatggcctctctacaattttgcctcagcgattgatgatcacgagcttggagttacccatatcttccgtggacaggagcacgccgagaacgagactagacagaggtatatctacgagtactttggttgggagtatcccgtcacgatccatcacgggaggcttagcatagagggagttgttttaagcaaatccaagacaaggaaaggaatagaagaaggtaagtatctcggttgggatgatcctaggcttggaacgataagagctttgaggaggaggggaattcttcctgaagccataaaagaattgatcatagaagttggattgaagaaaagtgacgcgacgatcagttgggagaatctggcagcgataaacagaaaacttgttgatccaattgccaatagatatttctttgttgcagatccaattccgatggaagtcgaaggggctcctgaatttatagcagagataccgcttcatcctgaccatcctgaaaggggcgttagaaggcttaagttcactccagaaagacctgtttacgtttcgaaagacgatttgaatctcttaaaaccaggcaattttgtgaggttaaaggatctcttcaatgttgaaatacttgaagttggagacaaaataagagctaggttctacagctttgaatatgaaattgcaaagaagaacaggtggaagatggttcactgggttaccgaaggtagaccctgtgaggttataattcctgaaggagacgagcttgtagtgaggaagggattgctcgagaaggatgccaaagttcaagttaacgaaatagtccagtttgaacgtttcggttttgtaaggatagacagaattgagggggataaagttatcgcaatatatgctcacaag

SEQ ID NO: 44072 - DNA, 615 bp, Pyrococcus horikoshii
atgagggggtatttcatagtacttgaaggtattgatggatcaggaaaaactacccaagctaagctacttgctgaatggttcgaggacaaaggatatgaagttttgctaactaaggaaccaaccgatagcgaactcggaaaacttataagaaggattattcttgaagaaagcgttatagatggttctaaaataagttatgaagcagaggctttactatttgcagccgatcgagctgaacacgtaaagaaaataattctaccagccttaagcgagggtaaggttgtaatttgtgatcggtatttttattcttccctcgcatatcaatgggctagggggctcgatctaaactggctaattcaagtaaattcttttgcaccaagacctgatctagctatcctcttggatttacctgtaaaggagagtttaagaaggattaaacttaggggaaccctaacagagttcgataaaatagtcgaacttcaaaggaaggttagacataactatttaaaactcgctgaaatgttccctgaaatgaggatagttaatgccctatcaagcattgaggatattcactcggatatagttgccctggttaagcatgagctcctgggttta

SEQ ID NO: 44073 - DNA, 1083 bp, Pyrococcus horikoshii
atgcaagcggtattattggcaggtggaaagggaacaagattgttacctctaacggtgtataggccaaagccaatgattcccttttttaataagcctctaatggaatatatgttgatgaaccttattgggataggagttgaggaaataatagttctcgttggatatctaaaggagaagataattgaatactttggaaggggagataaatttggagttgagattaagtattccaatggtgagaatataaagcttggtactgctggcgcactaaagaaggccgagaaatttatagacgacacattcattgtagcctctagcgatgtacttacgaaccttagctttgactcatttataagatttcacagagaaaagggtggaatagcaacaatggccttgactaaagttgaagatccaacaccctatggagttgcggttctcgataatgaaaatagaattctatactttaaggagaagccaaaaagagaggaagcgccaagtaacttagtaaatgcggggatttacatctttgagcctgagatcttggacttaattcctagaggtaaagcttttgatttctcgctagacctctttcccaagatgctagaggaagggattccaatatatggatttccttttgatgagtactggaatgacgttggtagaccttcaacgtatcttcaggcaacggaagatgttttcctgggtaaacttaggttacctcagattaatgtgggaagggataagggaaatattgagagaggtggtagcctgtttacagggagcaaatgcttgattaggaatcccaagatagttggctttgcagtcttggggaataatgttaaagttggaagagatgttaagatagagagatcagttatattttcaaacgtcacgattgaggatgaagttgagataagggaagctataataggggaaaatgtgtatataggaagaggggccgtcattgaacccggaagtgttataggggataattccgtaatagaagaatacagtaagattggggcaaacgttaagatttggactgactcaaaggttggaagagagagtatcgtgcttccagat

SEQ ID NO: 44074 - DNA, 1233 bp, Pyrococcus horikoshii
atgggagagaggagaaaaacaaggcaagctgaggtaaatattggaatggttggtcacgttgaccacggtaaaacaacactaactaaggccttaacaggcgtttggacagatacccatagtgaagagctgaggagaggaattacgataaagataggatttgcagatgcagagataagaaggtgtccgaattgtgggaggtactctacctccccagtttgtccatactgcgggcatgaaacagaatttgtaaggagggtttccttcatagatgctcctgggcatgaagctttgatgacgacgatgcttgcaggagcatcactcatggatggagctattttagttatcgcagcaaatgaaccctgtccaaggccccagactagggagcatttaatggcacttcaaataattgggcaaaagaacataataatagcccaaaacaaaatagagcttgtcgataaggagaaagcccttgaaaattataggcaaataaaagagtttataaagggaactgtagctgagaatgcacccataattccaatttcagccctgcacggggccaacatagacgttctagtcaaagccattgaggattttattccgacgccgaagagggatcctaataagccaccaaaaatgctagttttgaggagttttgatgtaaacaaaccaggaactcccccagaaaagcttgtaggtggcgttttaggaggttccatagttcagggaaagttaaaggtcggggatgagatagagattagaccaggaattccatatgaggaacatggaaggataaggtacgaaccaataacaactgaaatagtttccctacaggctggaggacagttcgtagaagaagcatatccaggaggacttgttggagttggaacaaagctagatccgtatttaactaagggcgatctcatggcaggaaacgtcgtgggtaagcctggaaaattaccaccagtttgggatagcctaagattagaggtacacctacttgagagagtcgtcgggaccgagcaggaacttagagttgaacccataaaaaggaaagaggtactcctgctgaacgtcggaaccgctagaaccatgggactagttacaaacctagggaaagatgaaattgaggttaagcttcagattcccgtatgtgcagaacctggagacagggtagcaataagtagacagataggatcaaggtggagattgataggttatggtattatcaaggag

SEQ ID NO: 44075 - DNA, 1098 bp, Pyrococcus horikoshii
atgagcctctataggaagagacttaagatcataaagggagaagggatatacgtatgggatgatcaggggcgaaggtacgtcgatcttattgctggaataggagtcgcaatacttggacataatcatcctgagtgggtagaaggaattagggagcagttgaacaagctcgtcattgcaggtccaatgtttaatcacgaagagaaggaagaaatgcttgaagaactctcaaagtttgtaaacttcgaatacctctacatggggaattctggcaccgaagctgttgaagctgcactgaagtttgcgagactctatacaggtaggaaagaaataatagcaatggtaaatgcctttcatggaagaaccatgggagctttaagtgcaacctggaaaccaaagtataaaaaagattttgagcctttggttcctggattcaagcatattccctttaacgacgttgaagcagcaaaggaagcaatatctaaggagactgctgcagttattgttgagccaatccagggagaaagtggagttataccggcaaaaaaggaattcatgaaagcacttagggacttaactgaggatgtcggtgcattgctgatagttgatgaagttcagacgggtttaagaactggaaagtttttagcagtagaacactataaaatcgagcctgacatagtgactatgggaaaaggaataggaaatggaattccggtaggcttaacgctgactaacttcgacgttgaaagaggaaagcatggatctacatttggaggaaatcctctagcttgtaaggccgttgctataacacttaggatccttagaaaggaaagactaatagagaaggcaaagaacaagttcattcaaattgatgctgatgaagtagttacaacgagaggaaaaggccttatgataggtattgtgtttaaaaccaccataggaaaatacgttgaagagctccaaaatagagggtatttagttcatactgctggacaaagagttatgagacttcttccacctttaataatttcaaaagagacgatgcaagatgtaaaattggcaatagagggtgtgataaatgatctcagaggaggagaaaat

SEQ ID NO: 44076 - DNA, 744 bp, Pyrococcus horikoshii
aggtgggtttccatgagagttattaaagtcggaggttcagttttggagaaccttgaaaaagtgtttaaacctgaaatattcagagatgctgtcgttgttcacggtggttctagatatgtggatgaacttgcaaaaaagcttggattaaatgtggaaaagctaacgagtccctctggtgtaacatttagaagaacaactaggaaagttttagacgtttatatagctgcagttatgaaggcaaacagagagcttgtctccttcctgcgaaggcagggtatagaagcgataggagttagcggggtcaaggaagttataattggaagaagaaagaagctcattaaggcagtgataaatggaaagatcatggcgataagggatgattactcggggataataaaggaggttaacgtcgagatgataaggaactatatgaaggtgggagttcctgtaatagctccaatagcgtacgatccagttgaaaacgttcctcttaatgttgatggagataaggtagcttatcacgttgcgttagcactcaaaagtagagagctatactttctctctgataccgcatttttgattaatggtgaagtaattgataagattcccaggaatagaatagaagagtatttcccctattcaagtggtggaatgaggaaaaaattgctcatggcaaaaaaagcgattgaaagtggggttgaaagagtgatcatagagggattaaatggaaggacggtgatatct

SEQ ID NO: 44077 - DNA, 990 bp, Pyrococcus horikoshii
atgattaaggtagctattgttggaggaagtggatacattggaggtgagctgataaggttacttgccatgcatcctgaagttgaaattgtggctgtaacatctagagaatatgctggaaagaaagttcataaagttcatccgaacctgagaggtcttaaccttagatttacctcagactataattttgatgctgatgtgatatttctcgccgttcctcatggggtttcaatgaaactcattaacgagttcctgggaagtgcaaagataattgatttgagtgcagatttcagggttagaaaggagctatacgagaagtactatggaaagcatgaaagaccggaactcatagaagattttgtctatggtcttcctgaaatccacaggaaggaaataaagaaggccgaactcgttgccaatcctgggtgcaatgcaactgcggtaatcctagccctttatccgttcaaagacctgacaaaagaagtattagttgatttaaaggttagctcttctgctggaggaaggagagagaacttaccaagcatacatcctgagaggagcaacgttgtaagggtctataaaccttatcatcatagacatgaggccgaagttttacaggaaactggagttagggcaatgtttacggttcattctgtagacattgtgagagggcttctcgccactatatactttacgtttgagggaaacgaaaaggatcttctaaagagaatgctaatttacaaggatgaaccttttataaggcttgtagtggacaaaggtggccttcagagatatccagatccaaaatacgttttggggagtaatttcgttgatcttggattggcttatgatgaggagaattccagggtgatagtgttctcagcacttgataacttgataaagggtggtgcaggtcaggcggttcagaatatgaacataatgtttggccttgatgaaacccttggccttggatattatcccctttatccggtg

SEQ ID NO: 44078 - DNA, 969 bp, Pyrococcus horikoshii
gtggtaaaatctgtgacagataaaattaaattttatgaattcgaagggggtttaagtgtttttaaaaaatatggggtgccaatcagggaggaggatctcgaggaaattaggaagatggatgctatattatttggagcaacgacgacaccctttgatgttcctagatataagagcttaattataacgttgaggaaggaacttgacttgtacgcaaatctaaggataattccaaactttaagttgagaaaagagataattatagttagagaaaatagtgaagggctatacagtggagaaggagcatacgatagtaacaaggtagttgactttaggataataacaaggaaaggtgcggagaggatagctaaatttgcagtaaaacttgcaaaagataggagcaccttcttaacctttgttcataaggcaaacatacttgagagtgatagattcttcagaaaaattgtcctagacattgctaggaaggaagatgttaaagttagagaagaaatagttgactcttttacaataaagttagtgaaagacccttggaacttgggaataatcctttctgaaaatatgtttggtgacatcctttcagatctggcaacgatacatgctggtagcatcgggatcgttcccagcggaaactatggggaggatatagcattgtttgagccaatacatggctctgctccggatatagctggcaagggaatagcaaatccaataggggcaatactgagtgctgcaatgatgctggattaccttggtttagatggttctatcatctggaaagctgttgggaggtatgtgaggagaggaaacctaacaccggatatggaggggagagcaacaactctggaggttactaatgggataatctcggagatatatcgcttggatgagtacgaaatagatgaggtttggagggatgaagttagacttgggaggatactgctcgagataagt

SEQ ID NO: 44079 - DNA, 3202 bp, Pyrococcus horikoshii
tccgctcagcatgcagtatattacattagaatggatgcctttaaggctatacagaggcatagaatggaattttttgataagactttttctggtcagctaataagcagaataacgaatgacacagagaggataacgaggttcctttcttttcgaataagaatgttcgtttattcaatattcctaatagctgtatccttgtattatatgattagaatgaacgtcttccttagcttagttgctttagggactatagctgttgtggttcttttaaatacaacttatgcaactaaagttaggccgatatatgataaaataagacaccaaactggggtgatagcctcaatagccactggaacaatagctggaataaagactattaaatcactttcggttgaagaaaatatccaggaaaaattctctaaagaaaatgagaacctttattccctaaatattgatgccattaaaataactgctctttatgggaatgctccatttttgattttgggattagcgatgagtgcaatgctctactatggggggaaagctataattgccaaaaccttaactgttggtgaactcgttgcatttttaacttacatgcttacaatgatgtggccccttcgtgctttgggattcactattggtgatatacagagaagtttagctgcggcggcaagattgtttgaggttattgattcggcccccaaagcaattgacgcacccgacgctgtagagattaatgatccaaagggggaggtagaatttagggatgtttggcttacttatcatactggaagaactgtgcttaggggtgtaaatctcaaagtatctcctggagagaaggttctcatagtaggtcctcctggatccgggaagagtagtattctaaagcttattgcaaggttttatgtgcctgataagggggaagtgttaatagatggagttaatgtgaagaagataaagacagaaagcctaaggagaatagtggcctatgttcctcaggaacctttcatttttaacaggagcataagggaaaacatcgcactcgcaaagcctgatgctaaaatggatgaaataataagggctgcaaaaatagcaaagatacatgactttatatcctcccttcccaacgggtatgacactatagttggtgaaaaaggtgtaacgctatccgggggacaaagacagagaatagcccttgcaagagctctccttttagatcccaaaattatcctccttgatgatcccgtctctaatctagatgctgaaacggagaaaagattggttgaagacctaaaagagatactaaagggtagaactgctctaatagtatctcagagactttccttagttaaactgacggatagggtgattgtaataaaagatggaaggataattgaggaaggaaaacctagcgagctcgtcaagaagggtggagcatttagcgaaatgattagagctataggtgaggaatatgagaaataacgaatcatcattttcacttcttattaggttcattagggaagcactctccgaaaagaagactctagtagtagttataattagtatagtaggatctgccattgccaacttggcatcgccctacgtccttcatattgctatagataactatatagttccagggaagtatggagagttatggtttgtgacacttttatatctcctatccctcattggccaatggttcttcatgactcttcagacttattatactgaagtttttggccaaggggttcttaagaggttgagaagcaagcttcatgagaagatattaatttcaaacctagatttctttaaagagaaatcaacaggggatctagtttcgaggataattaacgatacaaacatagtcaatgatgttctagtttcaggactcctcgggggattaggaagtttgttgagcttagcgggaattattatcgcaatgtttctcctagacgttaaactaacgctagtaactctagctagcgttcctttaatggtgctcgtggcctattactttggaggtaaaatgaggagggcatatcgtgaaactaggcagaaaatagcaaagatatcgagcgttgttgaagagagtgtggccggaatagagacaattagggcatttggaaaagaaagggacgtggaaagagaattttcaaaagtttccttagagacaataaaagcatatctaagggttgcagtttacatgggagttttctggccacttatgaatattacgagcttactttccgttatagccgttatagcatacggaggttacctggcttataaaggagctgtgagcattggtgttgtggtcgcgttcattcagtacgctcaaaggtttagaggccccataaataatgttgtaagtatgtatgatagtttgcaatcagctttagctgctcttgaaaggatatatgaaatcttggacgatgaaaacgttgaagattacaacggaataaacgttgagaggcttaatggtgaaatagaatttagaaatgtatggtttgaatatgaaagggggagacctgttcttaaggatattaacttattaataccttcgggatctaaagtagcaatagtaggaaagacaggagctggaaagacaactttggctaatctgattatgcgcttctatgatccaactaaaggggatattttctacgatggaatagaggggagaaagataagtaggaaaagccttagaaggagaataggttatgttccccaggaaacatacctatttccaggaaccataatggaaaacatcctcatggcaaacccagaagctagagaagaagatgtgataagggtttgcaaggagctgggaattcacgagttcataatgaagttaccaaatggatataagactagtgcaggtgaagcggggaagttattatccctaggggagagacaattaatatctttggcgagggctttgttaaaggatcctgacatagtcattttggatgaagcgctttcaagcgtcgatcctaagaccgagcaacttgtacagaatgcaatgctaaagttaatggaggggagaactagtataattatcgctcatagattgtcaataacgaggtttgctgataaggtaatcgttgttaaggatggaagaataattgaggagggtcctccaaagcttctcttagaaaagaagggctacttctacaggctttatacctctcaagtt

SEQ ID NO: 44080 - DNA, 903 bp, Pyrococcus horikoshii
atgaaaaacaagctcatagtaattactggaggggctggatttataggttctcatttggctgaagcattaaaagatgaaaatgacgtgattataatagacaatctatattccggtagaatcgagaacattccagaaggtgtcaagttcataagggctgatgtcagggattatgaaagcatagctgaagttataagtgaagccgattatgtctttcatgaggccgctcaaattagtgtcaaagaaagtatcgaagaccccgtatttacggaggaggtaaatgttataggaactataaatgttttaagggctttatcccagggagatgggaaattaatatttgcatcttctgcggccgtttatggtgaacccaaggaactaccaattactgaagatacgttaactaatcctatttctccttatggaattacaaagctggctgcggaacattactgcagagtatatcaaagcttatatggaattccagtagtcatcctaaggtattttaacgtctacggccctaggcaaagttctgcttatgctggagtgataagtatcttcttagaaagggcaataaaaggggaacctttgataatttttggagatgggaaacagacaagagatttcatctacgttaaggatgttgttgaggccaatatccttgttgctaagaaaaggagtgctaatggaaggatttttaatgtcgcgactggaaaggagacaacaatcctcgagcttgcaatgaaaataatagatatgacttcctcttcgtcttcaattttattttatccaccgagacctggtgatatcaggagaagtgttgccaaaatagaaagaataaagaaacttggctttaagcctaggtattcccttgaggagggtctcaaggagacttttaaatggttt

SEQ ID NO: 44081 - DNA, 3537 bp, Pyrococcus horikoshii
atgccatacattgaaaggcttgaactcaaagggttcaaatcttatggtaacaagaaggtagttattctgttctcgaggggctttacggctatagtcggggctaacggttctgggaagagcaatatcggtgatgcgatactttttgttcttggtggattatccgctaaggccatgagggctagtaggataagtgacctaatatttgccggtagcaagagggaacctcccgctaaatatgccgaagttacaatatacttcaataatgaggataggggattccctatagatgaagatgaagtcatcataaaaagacgagtttatccagacggaaggagtcattactggctaaacggtagaagggcaactagaagtgaaatactagatctactcagcgcggccatgatatctccggaagggtacaatataattcttcagggagatataactaagttcattaagatgtctcccctggagaggagattgataatagatgatatctctgggatagcggagtacgatgcgaagaaagagagagcccttcaagaattgaagcaagctgaggaaaacttagctaaggttgatatacttataggagaagtaaagaaacagttagataagctagaaaaggaaagaaatgatgcgctaagatatttagaccttaaggagaagcttgaaaaggctagagttggtctcgtgcttggtgaaataagaaagatcgagtctgaaataaggaataatgatgagagaattggaaatatcgagagagaaatagaaaggatggaaaaaaggttagaggaaatagccaaggaaatcgttgagaaagagaatgaacttaggagaattgaagagatgatagagagggaaagtagcagtgaagccttaaggctgacgcgtgaaattggagaggtaaactccaaaataaatctcgctagaaggaacatagagatcgcaaggagggagcttgacgaatcccaattaaggttagccaaggtgaaggatgagttaaagaaagttatgagcgaaatagagaagtctaaaggagcgataattaggtgggggaggagaagagaagccctaattaagcagatatctgagaaagaggaagagagaaaccatttagtggttaggttgggagagatcgataggacatttgccgtcgctagagaggagtttgatagtgttgttaaagagctcgaaaatgctagaaggctaatgtacgagggagaagccgagataaaaaggcttgatgctgaaaaagagaagttacgttccagaatagcagttcttaaggccaaacttcctggtattagggatgaaattttgaagcttagagataccttagatgagaaaaaagctgaactaagcgagattgaaaataaactatcatcggtatctaataaaagaatgaaagttgaggaggaggttgagaagaaaacattagagcttcaaaaggtttccaaggagcttgaggatgccgaaagagaactaataaggattgaagctcaaaatgaaactaagagcaacagggccgttgaagagcttaagagatctggaatacccggcatatatgggactttacttgaattaattagggttagagatgagaagtactccatagctgttgaggtagccttaggtaatagggctgataacgttgtagttgaagatgaaatcgttgccgagaaagcgattgagtttttaaagaggaataagctcggaaggttaactttccttccgcttaacaaaataaaggcacgacacgtaaatggggatgtagggattccagtagttagtgtcatagagtacgatcccaagatcgagaatgccgtaagctttgcccttggggataccgtcatagtgtcttctatggaggaggccagatcttacatcggtaaggttagaatggtaaccctaaaaggggagctctacgagaggagtggtgcgataaccggtgggcattacaggccgaggggtttacttttggataccaaggaacttaaggaaaaagttgagaaccttagaataatgaaggaatctttagaaggggaagttaactcgctgagggtcaagctaaaggcattagaaaatcaaagctttgagctcaggataaggatgagtgatgtcgagaaggagataagcttgatcagcaaggatttagagaagcttatcaaggaagaggagtcgttgagatcagaaattgaagattccgagaggaagatagctgaaattgatgagacaatcagtaaaaagaaggatgaagtagcgaagctcaaaggaagaatagagaggcttgaaaagaggagggacaagctgaagaaggccctagaaaatcctgaagcgagggaagtaaccgagaagatcagggaggttgagagggaaatagccaaactaagagaagagctcagtagagttgagggtaaattggaatccttaaattcaaggctaaatgatgagttaattcccaggaaagcttctcttgaggaggagatagagggtcttgtaaataagataaacgcgttgaaagctaatataaacgaaaatgaagaggcccttaagtccctaacggaaaaacttgaaaaactaaaaaaagaggagggcgaaatttactctaggatagaggagcagaaaaagaaaaaagaggaacttgaaagaaaggttgcggagttaagagaggaaaaagagaagatctctagaaggatacaggagcttagaatagaggttaacaccctcaaggtaaggaattctcaactaaaatctctcctcatggaaaagaactctcagctgaaacacttctctaaggaagttatcaaatcaataagggatatcccttcggatcttgagggattaaagaaggaaattgagaagatggaggaagaaataaaagcgttagagccagtgaacatgaaggccatagaggattttgaagttgtcgagaggaggtacctagagcttaagagtaagagggaaagactagaggccgagaaggatagcataatagaattcataaatgaaatagagaaggagaagaagaatgtgttcatgaaaacatttgatgctattgcaaagaatttctcagagctctttgctagactatctcctgggggaagtgctaggttaatccttgagaacccagatgatccattctctggagggcttgaaattgaagctaagccagctggaaaggatgtaaagagaatagaagctatgagtggtggagaaaaagctttaacggctttggcatttatctttgctattcaaaaattcaagccggctcccttctatctcttcgatgagatagatgcacaccttgacgatgctaacgtcaagagggttgcagacttgataaaggaatcttccaaggagagccaatttatagtgataaccctcagagacgttatgatggccaatgctgagaagataataggtgtaagcatgagagatggtgtaagtaaggttgtctctctgagcttagagaaggccatgagaatactagaagacattaggagaaggggtgaatatggaggaaattaccccagt

SEQ ID NO: 44082 - DNA, 1224 bp, Pyrococcus horikoshii
ttgaatattgaagaaataatagagaaagtagctaatggggagattaagttttatcaggttgaaaagtacgttaatggggacaaaaggctagctacagaaataaggaggaaggccctggagaaaaggctcggaataaagttgcatcacatagggtattattcaatagatcccaacgagctcattggaaggaatatagagaacatgattggtgtagttcaaataccaatgggagttgctggcccattaaaaatcaatggggagtacgctaagggtgaattctacatcccattagctactactgagggggccttagtggcctctgtgaacaggggatgctcggccttaacggaagctggtggagttgttacaacattgatagatgacaaaatgacgagggccccattgataaggtgtccaaatgcaagaagggctagagaagttgctaagtgggtagaggaaaatctagattacctccaggagaaggccgtttcaaaggtcactagacacggaaagcttaggggagttaagcctttcatcgtcggtaataacctttacctccgctttgagttcgagactggagatgccatgggaatgaacatggtgactatagcgagcgaggagataatgaaggtcatcgaggaggagttcccagatgttagatatctagccctctctggaaatttatgtgtagataaaaagccaaatgctgtaaatttcatcctgggaaggggaaagacggttatagctgaagctgtggttcccagaaaaattgttgaaaagaagcttaagacaacgccggaacttatagctgaggttaactactttaagaacctcgttggttccgcacaagctgggagttacggatttaatgctcactttgctaacattgtaggggcaatattcctggctacgggtcaggatgaagctcagattaccgagggagcccacgggataacgatagctgaggtaacccccgacggggatctttacataagcataacgatgccaagtcttgaaataggaactgtgggaggtggaacgagggttccaagtcaaagggaagccctggagataatgggcgttgcaggtggaggggatcctccaggtattaacgctaagaagtttgctgaaatagttgctggggccgttttagctggagaactttcactacttgcagcgatagccgctaagcatcttgcaagggctcataaaatgcttggaaga

SEQ ID NO: 44083 - DNA, 666 bp, Pyrococcus horikoshii
gaaaacgcgtacaaggaattaagggaactaggtaccgttcactattttcaagctgatctttcatctaaagaggatataaagaggatggtaaaagatgcatgggatgcaatgggaagaatagaggccctaatatggaatgctccaaatgtaaagtgcgaaccttgcatggttcatgaggcaaggtacagggattggctcgaagcggccctcctgcatctagtctcaccaggttatataacaacacttctcatccaagcgtggcttgaaaagaagataaaaggcgttctgatatatttaagctccgcttcagttttggaaccaatgcctccacttctcttagctgatactgctagggcgggactcgttcaattgacgaagggcataactagggcatatggaggaaagggaattagagcttacgtagtattattagggagctttgataccccaggggcaagagagaacctcgcaaagatagccgaagaaagaggtatgagtcttgaagagatctggaggaaagaggttatagagagaacacctctcaaaagaactgggaaatggagtgaactcggagctttgatagatttccttctaagtgagaatgcagagtatatgatgggttcaacgattctcttcgacggtgccatgacgagaggggtcaactta

SEQ ID NO: 44084 - DNA, 2394 bp, Pyrococcus horikoshii
gtgatgctaatggtggagaaaaaggagataaagctgaaggttgcttccgcttatcaaagggatgttggtagagggattgtaagaattgataggagaagtatgagagaattaggagtatcgccaggggatgttgtagagattatcggaaccaagaataccgctgctatcgtttggcccgcttatcctgaggatgagggcctcggaataatcaggatggatggtaccattagaaagaatgcaggggttggccttggggatgaagttaccataagaaaagctgacgttaaggaagccagaaaggtagtactagccccaacggagcctattaggtttggaagggacttcgttgagtggcttcacgagaggctggtaggaaggcctgtagtgagaggtgactatattaaaattggagttcttggccaggagctaacctttgtagttactacaactcaaccgagcggagttgttcaaataacagagtacacggactttgatataagtgaaaagccagtgaaagaagttgaaaagagaatgacaactggagtgacctacgaggatataggtggactaaaggatgttatcgagaagatcagagaaatgatagagctaccattaaagcatccagaattattcgaaaagctgggtattgagcctcctaagggtgttcttctttatggtcctcctgggactggtaagactctcttagctaaggccgttgctaatgaggctaatgcttactttatcgcaataaacgggccagagataatgagcaaatactacggagaaagcgaagaaagattaagggaggtgttcaaggaggccgaagagaacgcaccatcgataatctttattgatgagattgatgcaatagctccaaagagaagtgaggttactggagaagttgagaagagagtcgtagcccagctacttgccttgatggatggtttgaagggtaggggtaaggttattgttattggggctactaataggcctgatgctttggatcctgctttgaggaggcctgggcgttttgatagggagattgaggttggagtgccagacaagcaaggaagaaaagaaatactacaaatccacacaagaggaatgccaatagaaccagacttcagaaaagaggatgtacttaagatccttgaggggcttaaaaaggaagggaagttcagggatgtcattgataaggccattgatagggttatgaaggttagcgaggatgatattcctaaagtgcttaaggaacttaatggtgagctatacgaggaagttagaaccagattagttgatctattacttgaggaattggctgaggttactcatggtttcgttggcgctgacctagcagcactagccagagaagcagcaatggccgcacttagaaggttaatcaaggaaggaaagatagactttgaggccgagacaataccaagagaagtcctagatgaacttaaggtaactagaaaggacttctatgaggctttgaagatggttgagccttctgctttgagggaggtcctcatcgaagtcccaaacgtccactgggatgacataggcggattagaagaagtaaaacaagaactaagagaagcagtagaatggccactaaaatacccagaggccttcagggcttacgggatcacacctcctaagggtgttttgttgtatggtcctcctgggactggtaagactctcttagctaaggccgttgctactgagagtgaagccaacttcatagccgttagaggcccagaagtattaagcaagtgggttggcgaaagcgagaagaacataagggaaatctttaggaaagcaagacaagctgctccaaccgtgatattcatagacgaaattgatgcaatagccccgaggaggggaacagatgtaaacagagttactgataggcttatcaatcaattactcacagagatggacggaatccaggagaatacgggagttgtcgttattgctgctactaataggcctgatattttggatcctgctttgttgaggcctgggcgttttgataggcttattttagttcctgctcctgatgaggaggctaggtttgagattttcaaggttcacactagaagcatgccattagccgatgacgttgatttaagagaattagcaaggagaacagaaggatacacaggagcagacatagcagcagtatgcagagaagcagctatgatagctatgaggaaggcccttgagaaggggataattaagcctgggatgaaagctgacgagataaagcagaaggctaaagttaccatgaaagacttcgaagaggcactgaagaagataggaccctcagtaagcaaggagaccatggagtattacagaaagatccaagagcagttcaagcaggctagagga

SEQ ID NO: 44085 - DNA, 1113 bp, Pyrococcus horikoshii
atgaagatagctctagttagtgactggtattatcctaaaataggaggagtcgcaactcacatgcacaacttagccataaagctgagagaaagagggcatgaagtgggaatagtcacaaacaacaggcccacgggaaaggaagaagagcttaagagatatggaatagagctcataaagatcccaggaattataagtccttttttagatgtaaatttaacctatggattgaaatcctcagaagagctcaacgaattcttgaaagacttcgacataattcattctcatcatgcattcacacctctctccttaaaggctttaaaagctggaaagaatatggaaaagggaaccctgctaacaactcacagcatttcctttgcccatgaatcaaagctctgggatactttggggtttacgatacccctttttaagagttacctgaaatattcacatcgaataatagcagtaagtaaagctgcaaaatcctttatagaacacttcacttcggttcccgttttaatagtacccaatggagtcgatgatgagcgtttcttccctgcaagggataaggagaaaataaaggccaaatttggacttgaagggaatgtggtactctacgtgagcagaatgagttatcgaaaaggcccccacgttcttttaaatgcattctccaaaatagaagatgcaactctcgtaatggttggaaacggagagatgcttcccttcttaaaggctcaaactaaattcctgggaatagaaaataaagtagtattcatgggatatgtacctgatgatattcttccagaggttttcagaatggccgacgtgttcgtcttaccttcgatatcatcggaagcgttcggcatagtaatccttgaggccatggcctccggagttcccattatagctacagacgttggtggtatacctgaggttataaaggaaaacagtgcagggcttttagttccacccggaaatgaacttaagctaagagaagcaattgaaaagctcttaaaaaatgaagagcttagaaaatggtacggaaacaacggaagaagatccgttgaagaaaaatattcctggaataagatcgtagttaagatagaaaggatttac

SEQ ID NO: 44086 - DNA, 888 bp, Pyrococcus horikoshii
atgagactggatgtaatttgtatggggaacctcaactatgacataactttcatacttgaaagatttccagagttccacgaaaaggtgaatgctaaagaagtttatacgggattaggaggttccgcaggaaatacagcgacttggttgtctctcctaggattaaaggttggtttcataggttctgtgggaaatgacgactttggaaggttgcatctggaattctttaagaaaattggagtagatactagagggattaaagtcgtagacgaaccaacgggagtcgccgtaatgatggtgatcggagaagacaaaaggatagttaagtaccctggggccaataggtttaaggaggtaagagaggactatttgaagcttgccaggcatttgcacctctcttcaaatcccctttcacttgtcgaaaaagctgtaaccttggccaaaaatcttggcctaactgtttcttttgatccaggagaaatggaagtcccaaagaatattgaagaaaaagtagacatcttaatgatgaacgaagatgagttcaagaggaagtatggagacttaaaaaatataactaaagttaagtctagaatagccatagcaacgctaaacggtggaggagctctggttagagatcaaaatggaaaagtttacgaggtaaggggactgtcggcaaaggccgtagataccaccggtggtggagactcttttaatgctggatttatatatggctttctaaatggctgggatgtggtaagttcagcaaaattaggaatgctacttgcttaccttacagttcaaaaagtaggagcaagaagtgcggtaattcccctagaggaagttaaaaagaaagcaaatgaattaaacctagatcttccatttaatagctct

SEQ ID NO: 44087 - DNA, 816 bp, Pyrococcus horikoshii
atgttaatgttgttattctttgcaaactccactaaatcctctctgaccgaaagcgttaccttcctcttcaatgcgcgcctctgtacagaatacgtgaactcatctgtgagatgtgagagaatggtaatccatttatatcttttgaccttccatctaatgatggatgagaaagagctctatgaaaaatggaagaggacagttgagatgctaaaggctgaagggataattaagagtgaaaaggttgagagggcttttttaaagtgccctcgatatttgttcgtggaggataggtataaaaagtacgctcacgttgatgaaccccttccgattccggcgggtcaaactatttcagctcctcacatggttgctataatgcttgagattgctgatctgaagcctgggatgaacgttctagaagtgggaactggaagtggatggaacgctgctttaatagctgagatagttaaaggtgacgtgtacagcatagaaaggatacccgaactggtagaatttgctaagagaaatttagaaagggccggagtgaagaatgttcacgtgatcttgggggatggtagcaagggctttcctccaaaatctccctacgatgctataatcgttactgctggagctccagagatacctaagcctcttgttgaacagttaaagcctggaggaaaactcataatccctgtaggaagctatcacctatggcaggagctacttgaagtcataaagagggaagatggaagcataaaaataaagaatcatggaggggttgcttttgtccccctaataggcgagcatgggtggagagaa

SEQ ID NO: 44088 - DNA, 1950 bp, Pyrococcus horikoshii
gtgaatttgatgtacattagaaaggatctactacagccaaggctttatcaggagctaatatacgcaaaatgcaaggaaaggaattgcttgatagttctaccgactgggttagggaagactataatagctatgatgatagcagattatcggttagataaatatggtgggaaagtcttaatgctcgcgcctacgaagcccctcgtccttcagcatgctgaaacctttagaaagttttttaccctaccccctgagaagatcgttgcgttaaccggtgagataagtcccaatgagagggttagagcttgggccagggcaaaagtcgtgatagctactccccaaaccattgaaaatgatttacttgtaggaagaataagtttagaggatgtaacccttataatctttgacgaggcccatagagcagtcggcaactatgcttacgtttatatagctaaggagtacttaaaacaggcaaaaaatccacatgttataggcttaacggcttctcctgggagtactcctgaaaagataatggaggtattgaggaacctcggaatagagcatatagaatacagatcggagaactccccagatgtaaagccttacgttcaggggataaagtttgaatgggttaaggttgagcttcccgagctatataaggaagttagaaagttactaagagatatgctaagggactcacttaaacctttagctgaggccggtttgttggattccacatcagcggatattccaaagaaggaaatactaagggcgggtcaaataataaatgaagaaatggccaaggggaatcacgatctaaggaaacttttgctgtttcatgcaatggccctgaagttgcatcatgcaatagagttactcgaaactcaggggttatccgctttgagggtttatctaaagaggctgtatgaagaagctaaggctggttctactagagcaagcaaggagttattcttggataaaagaatgaaaaaggccttagccttattgattcaggcaaaggaactgggcatcgatcatcccaagatggaggttttgaaggggcttataagggagcagctgaagaggaaggagaactccaagataatagtattcactaactatagggagaccgctaaaaaggttgttgaagaacttatgaaggatggtataaaagctagaagatttgtgggtcaagcaagtagggaaaatgatagggggatgagtcagaaagagcaaaaattaatattagatgcttttgcaaggagtgaattcaatgttttggtcgcaactagtgttggtgaagaaggtttggatgttccagaggttgatctcgtcatattctatgaaccggttccttcagcaataaggagcgttcagaggaggggaagaactggaaggcagaaaccggggagggttgtgatactcatggcccagggtacgagggatgaagcctactactggagctcaagacagaaggagaaaataatgagagagaccataaggatggtaagccaaatggttaggaaggagaggcaattatccttggaatcgtatgttaagagggaagttaatgaagaaataaaggaggagaaaaaagaaactggagggattaaagtcgttatagatagtagggagcttagaagtgaggttgttaagaagcttaaaacccttggaatcaaaattgaggttagaaccctggatgttggggattatatagttagtgaggatgttgccatagaaaggaagtctgcgaatgacttcattcagtcgataattgatggtagactattcgatcaagttaaaagacttaaggaggcgtatcctaggcctgtaattataatcgaaggtcagctctacggaattaggaatgttcatccaaacgccataaggggggccatagcatcgatagttctcgattttggggttcccgtaatattctcttctagttcagat

SEQ ID NO: 44089 - DNA, 789 bp, Pyrococcus horikoshii
atgctaaggatagatctttcaggtaagttagcatttacgacggcatcgagcaagggaataggattcggggttgcgagggttctagctagggccggtgccgatgtcataatactctcaagaaatgaagagaacctaaagagggctaaagaaaagataaagagcgagagcaacgttgaggttcactatatagttgcagacctaacaaaaatggaagacctagagagaacgattaaagaactgaaagacattggagatccagatatattcttcttctccacaggcgggccaaagccaggatactttatggagatgagcatggaagactgggaaggggccgttaagcttctcctttacccggccgtatacctcaccaaagccttagttccaggcatggaaaggaaggggtttgggagaatagtgtactcgacaagcgttgccataaaagagccgatacccaacatagccctaagtaacgttgtaaggatagcgatggccggattagttaggacactggcaaaagagctaggaccaaagggaataaccgtcaacggaataatgccagggataataaggacagacagagtcattcaacttgcccaggatagggctaaaagggaaggaaaaagcgttgaagaggccctaaaagagtacgcaaagcctataccattgggaagactaggagagccagaggagataggatatctagtggccttccttgcaagtgagttaggaagttacataaatggagccatgatccccgtagatggaggtagacttaattcggtattc

SEQ ID NO: 44090 - DNA, 858 bp, Pyrococcus horikoshii
gtgaataaggtgtttgtaattggtagtggagcgaaacaccttgaggaggagatttcaaagaatgccaagatcctcaaaacggagattaaaaaatttcctgatggtgaaaaatacgtgagaatcctggagcatggagaggaagtgatagtagtccaatcgacgtacaggccccaggatgagcatctaattgaaacgataattataggggatgcattgaaagaagctggattcgaaaaacttaagctggtagttccttacttggcatattcaagacaggatagagtcacaaaagagggagaacccattagtgtgagagcgataatgaaaatgctcggcttatattatgatgaactatacgtcttcgacatacataatccaaagacattagatttctttcctggtaaggccgtaaacatatacccagctaaagtgatagcggaatactttagggataagctcgagaatgggctagtgttagctccagatagaggggccctagaaagagcgaaggaagttgcaaatatactcggactggagtacagtcactttgaaaaagaaaggatatcaccaacggaagtcaagatgacgcccgtagacgtcaatgtaaaaggaaggaacgtgctaatagtcgacgatataataagtactggagggactatgataagggctgcagagatcctaaaagatctcggagctgaaaaagttttcgtagtagccacacatggcgtttttgccgaaggggccatagagagagtcagcaaagctgtagatgagctagcagttacaaacacgataccgactaaggtatcaaagataagcatagttcccgaaataatgagatctatcttggaggtaaag

SEQ ID NO: 44091 - DNA, 645 bp, Pyrococcus horikoshii
aaggcagtattgtttgatatagatggaaccctactttcggagaagcccttgataatgttcatccttcctcaggtttacgatgagctagctaataagttaaacatctctagaatggaagctagaaggatttttctttcagaaattgaaaaaaggaaagggaagtatgaatggcacgattggaacttcttctttaggctgttctccctacccttcaagtatgaagattttataatgaagtatccaaccaagattgaagtattcccaggagttgttgaagttttaaagtacctaaaggagaggggatataggcttgggattgtcacaagcggaccaagataccaagtacttaagctcaaggtctccgggatctacagatatttcgatgttgttgtaaccagggatgacgtgggttctataaagcctgagcccaggatattccttgctgctctagaaaagctgaagatttcacctaaagatgctgtaatggtaggtgacagcttggagcaagacattcttggtgctaagggggtaggcatgaagagcgtatggataaacgttgggggtgaaaacggttataacctcccagactttgagataagttcgatccttcaactaccggaggtgatagaggatgaaagtgatatt

SEQ ID NO: 44092 - DNA, 1284 bp, Pyrococcus horikoshii
atggaaaacccatatgaaattactgctatcgttgcaagggagatacttgacagtagggggaacccaacggtagaggttgatgtccatactcctattgcaatgggaagggccgcagtcccaagtggtgcttcaactggaactcatgaagccgttgaacttagagatgggggaaagaggtatcatggaaagggagttaggcgagcagtagaaaatgtaaacaagataatagctcctgaattaataggaatggacgttagatggcagagagaaatagataagctgctaatagagcttgatggtactgaaaacaaaagcaatctaggagcaaatgcaattcttgcagtttccttagccgttgcaaaagcagctgccaattcgctagaattaccgctgtatcaatatctcggaggcgttaacgcttatgttcttccagtaccgctgagcaacgtaataaatggcggggttcatgccgggaacgaattagacttccaggagtttatgataatgcccataggagctagctcatttagggaagctataaggtgggtttcagaaacatatcatgtcctaaagagggtgatcatggggaagtatggaaagaatgcggtaaacgttggagatgaaggtggatttgcaccaccgatgaaggaagttacggaacccttggatgcactaataaaggcaatagaggaggccggctacaaacctggagatgaaatagcccttgcaattgatgcagcatccagcgagttcttcaaggatggaaagtacattgtaggaggaaaggaatacacgagggaggagttacttgacctatacaaagagctcgtatcgacatatccaatagtctcaatagaagatccgttccacgaggaagattgggaaggattcgtgatgataaccaatgaactcggaaagaagatccagatagttggtgatgacctcttcgttacaaatccaagaagacttaagaaaggtatagaactaggagctgcaaacgccctattgctaaaggtgaatcagatcggtacattaacagaagctatggatgcagcttacacagcatttagagctggatacagtgtaatagtttcccatagaagtggagaaactgaagatactacgatagctgacttagcggttgccctcaacgctggacaaattaaaactggagctccggcaagaagcgataggaacgctaagtacaatcagctcataaggatcgaagaggagcttgaaggaatagcagtttacgccggcaagaactttaggaaggttttcttc

SEQ ID NO: 44093 - DNA, 3705 bp, Pyrococcus horikoshii
atgatcctggatgctgattatataaccgaagatggcaaaccgataattaggatatttaaaaaagaaaatggtgagtttaaagtcgaatacgacaggaattttaggccatatatttacgccctccttagagatgactctgcgatagacgaaataaagaagatcacggcccaaagacatggaaaagttgtgagaattgtagaaaccgagaagattcaaagaaaatttttgggaaggccaatagaagtgtggaagctctaccttgagcatccccaagacgttcccgctataagggataagataagagagcatccagcggttgttgatatttttgagtacgatattccatttgcaaaaagatacctcatagacaagggattgactccaatggaaggaaatgaaaagctaacttttctagcggttgacatagaaactctctatcatgaaggggaggaatttggaaagggtcccgtgataatgattagctatgctgacgaagagggagcaaaggtaataacttggaaaaaaattgatctaccttatgttgaagttgtttcgagcgaaagggaaatgataaagaggctaattagggtaattaaggagaaagatccggatgtaataatcacttacaacggtgataactttgactttccatacctcctaaagagggctgaaaagctcggtataaagctcctccttggaagggataatagcgagccaaaaatgcagaaaatgggtgactctctagcggtagagataaaagggagaatacactttgatctcttccctgtgatacggagaacaataaacttgccaacttacacacttgaagcggtttacgaggccatatttggtaagccgaaggagaaggtatatgcagatgagattgcaaaggcctgggaaactggggaaggactcgagagagttgcaaagtactcaatggaggacgccaaggtaacttacgagctcgggagagagttctttccgatggaagcccagctcgcaaggctcgtcggacaaccagtttgggatgtttctagatccagtacaggaaacttagttgagtggttcctcctcagaaaagcatatgaaaggaacgagctagcccctaacaagccagatgaaaaggagtatgagagaaggctaagggaaagttacgagggaggatatgtaaaggagccagaaaagggattatgggagggaatagtaagcttagacttccgcagtctatatccctcaataataataacccacaacgtttctcccgataccctcaaccgagaaggatgcgaggaatatgacgtggctcccaaggtaggacaccgcttctgtaaagactttccagggttcattccaagtctacttggtcagctactcgaagaaaggcaaaagatcaagaagagaatgaaggagagcaaagatcccgttgagaaaaagctcctcgactacaggcaacgggctatcaagatcttagcaaacagcattttaccagatgaatggctcccaattgttgaaaatgaaaaagttcgattcgtaaaaattggagacttcatagatagggagattgaggaaaacgctgagagagtgaagagggatggtgaaactgaaattctagaggttaaagatcttaaagccctttccttcaatagagaaacaaaaaagagcgagctcaagaaggtaaaggccctaattagacaccgctattcagggaaggtttacagcattaaactaaagtcagggagaaggatcaaaataacctcaggtcatagtctgttctcagtaaaaaatggaaagctagttaaggtcaggggagatgaactcaagcctggtgatctcgttgtcgttccaggaaggttaaaacttccagaaagcaagcaagtgctaaatctcgttgaactactcctgaaattacccgaagaggagacatcgaacatcgtaatgatgatcccagttaaaggtagaaagaatttcttcaaagggatgctcaaaacattatactggatcttcggggagggagaaaggccaagaaccgcagggcgctatctcaagcatcttgaaagattaggatacgttaagctcaagagaagaggctgtgaagttctcgactgggagtcacttaagaggtacaggaagctttacgagaccctcattaagaacctgaaatataacggtaatagcagggcatacatggttgaatttaactctctcagggatgtagtgagcttaatgccaatagaagaacttaaggagtggataattggagaacctaggggtcctaagataggtaccttcattgatgtagatgattcatttgcaaagctcctaggttactacataagtagcggagatgtagagaaagatagggtgaagttccacagtaaagatcaaaacgttctcgaggatatagcgaaacttgccgagaagttatttggaaaggtgaggagaggaagaggatatattgaggtatcagggaaaattagccatgccatatttagagttttagcggaaggtaagagaattccagagttcatcttcacatccccaatggatattaaggtagccttccttaagggactcaacggtaatgctgaagaattaacgttctccactaagagtgagctattagttaaccagcttatccttctcctgaactccattggagtttcggatataaagattgaacatgagaaaggggtttacagagtttacataaataagaaggaatcctccaatggggatatagtacttgatagcgtcgaatctatcgaagttgaaaaatacgagggctacgtttatgatctaagtgttgaggataatgagaacttcctcgttggcttcggactactttacgcacacaacagttattacgggtattatggttatgcgaaagctagatggtactgcaaagagtgcgcagaaagcgttacggcatgggggaggcaatacatagatttagttaggagagaacttgaagctagaggatttaaagtcctgtatatagacacggatggactctacgcgactattcctggggttaaggactgggaagaggttaaaaggagggccttagagttcgtagactatataaactccaagctcccaggagttctcgaactcgaatatgagggcttttacgcaagggggttcttcgtcacaaagaagaagtatgccctgatagatgaggaaggaaagatagtgacaagaggtctagagatagttaggagggactggagtgagatagcaaaggagacccaagcaagagttttagaggccatactcaagcacggtaatgttgaagaggccgtcaagatagttaaggatgtaaccgaaaagctgacaaattatgaagttcccccagaaaagctggtcatatacgagcagataacgaggccaataaatgaatacaaggcaatagggccccacgtagccgtggcaaagaggcttatggccaggggaatcaaggtgaaacctgggatggtgatagggtacatagtcctcaggggtgatggcccgataagtaagagggctatctcaatagaagaattcgatcccaggaagcataaatacgacgccgaatactacatagagaaccaagtcttacctgccgttgaaagaatactcaaagcttttgggtacaaaagggaagaccttaggtggcagaaaacaaaacaagtgggattaggagcatggatcaaggtcaagaagtct

SEQ ID NO: 44094 - DNA, 951 bp, Pyrococcus horikoshii
atacttgaggttaagaaccttaagatgtattacttcacctctaggggccccgttaaggccgttgacgacgttaccttcgacttagagaagggtgaagttcttggcttagctggagagagtggttgcggaaaatcatctattggattcactctaatgggaatgccccagcccccaggaagaatcgttggtggtagcataaagatcgacggtagggaaattgttggattacctgaggatgtcctgagaagggagataagatggcagaagatttcaatgatcttccagggggcaatgaatgctctcaatccagtttataccgtgggatatcaaatgattgaacccttgatatatcacaagggaatggacagggaagatgctttagacagggctatgaagtatttagagctcgtaggactcgacccagagatcgtttacaggtatccccacgagctttcaggtggaatgaaacaaagggttgtaatagcaatggccctactcctggaacctgacatagtaatagccgacgagccaacaacggctttagacgtggtagttcaagctcaaataattaatttaatgaagaggttaaagaagaagcttggcctctcaatgatattcattacccacgacttaagcattcttgctgagattagtgatagagtggctgtgatgtacgctgggaagctcgtggagatcgggcctagtgagaagatctattacgaaccagcccatccatacactcagaaactcctagccgcaattcctagacttcacgaagatgtcgaaaaacttgaattcattcctgggagtccaccgaacttgattaacccgccaagcggttgcagattccacccaaggtgtccttatgcaatggataagtgcaaggaagaggagccgaagatggttgaggttgataaggatcactatgcagcatgctggctcctgtgaggt

SEQ ID NO: 44095 - DNA, 642 bp, Pyrococcus horikoshii
atgccagaaattcttaagataaaacccacaagaatggaactcctaaagttgaagagaagagttaagttagctgagaggggccataagcttctcaaggagaagcaggatgccctaatcatggagttctttacaatatatgatgaagccctttctttaaggagagagctaattcgaaagatggaggaggctttcaactctctaagaagggcccaggtggacgttggagcattaagattaaaggaaatagccattggggtcaagcctaacaaagaaattgaaatcaaaacaagaaacataatgggtgttagggtcccgttgatcgaggtacctgaacttaaaaggaaagccagcgaaagaggttatgccttcgtttcaacaacttcaacggtagacatggccgctgaaaagtttgaggaggttttggagttagcaataagacttgcagaagttgaagaatcccttaagaggcttggaaaagagatagagaaaaccaagaggagagttaatgctttagaatacataataatcccgaggatggagaacacgatcaagttcatagagcaacatttggatgagatggaaagggagaacttcttcagactaaagagagttaaggcaatattagaggctagacagtctatg

SEQ ID NO: 44096 - DNA, 1371 bp, Pyrococcus horikoshii
gaatactcaacgataagcaagatttacggtcctctaatgatagttgagggggttaaaggagtagcttatggtgaagtggttgagatcgaaactgagagcggagagaagagaaaggggcaggttttagatgcaagggaaaatatggcaatagttcaggttttcgagggaactagagatttagatataaaaacaactagcgtacgcttcaccggggaaaccctcaaagttccagtaagcatggatatgttgggaaggatattcaatggaatagggaagccaatagatggaggtccagagattattccagaggataggagagacgttcatggtgctccccttaacccagtggctagagcttatcccagggatttcattcaaactggaatttcagcaatagatggtatgaacacacttgttaggggccaaaagctacctatatttagcggttcaggtttaccccacaatcaacttgccgctcaaatagctaggcaagctaaggttctcggggaagaggagagtttcgcagtagttttcgctgctatgggtataacttatgaagaagccaatttctttaagaagagctttgaagagactggagcaatagagagagcagtcctattcctgaatttagccgatgatccagctattgagagaataataacgcctagaatggcccttacggttgccgagtacttagccttcgactatgatatgcacgtattagttatcctcacagacatgacgaattactgtgaagctttgagagagatatcagcagctagagaagaagttcctgggagaagaggctatcctggctacatgtacacagatctagcgacgatctacgagagagctggaagaattaggggaagaaagggttcaataacacagatgccaatactaacgatgcctgacgatgacataactcatccaatcccagatttaacaggttacattacggagggtcaaatagttctaagcagggaattgcacagaaagggaatctatccgcctatagatgttcttccgagcctttcaaggctcatgaaggatggtattgggaaaggaaagactagagaagatcatccacagttagcccagcaattgtatgctgcctacgctgaaggaaggagtctgagggatctcgttgctgtcgttggtgaggaagccctaagtgaaaccgacaagaagtacttagaattcgctgatagattcgagagggagttcgttgcccagggatactacgaggataggagcatagaagaaacccttgaccttggctgggaattactttcaatactacccgaaagtgagctaaagagagtgaagaaagagatgataatgaagtatcatccaaagtacaggaagcgc

SEQ ID NO: 44097 - DNA, 2829 bp, Pyrococcus horikoshii
gttaagaggtgagtaaaaatggtggcgaaggggaggataattagggttactggacctttagtggtcgcagatggaatgaaaggagctaagatgtacgaggtagttagagtgggcgaacttggacttataggagagatcatcaggcttgaaggagataaagcggtaattcaggtttatgaggaaactgctggagttaggccaggagaacctgttgttggaaccggtgcatccttaagcgttgaactaggtcctgggttgttaacttcaatatatgatggtattcagagaccattagaggtcattagggagaaaactggtgatttcatagcaagaggagttacagctccggccctcccaagggataagaagtggcacttcattccaaaagctaaagttggagataaggtggttgggggagacataataggagaagttccagagacaagtataatcgtccataaaataatggttcccccaggaatcgaaggagagatcgttgagattgcggaggaaggagactacacaatagaagaggttatagcaaaggtaaagactcctagcggtgagataaaagagcttaagatgtatcagaggtggcccgttagagtgaagaggccttacaaggagaagcttccacctgaagttcctctaataactggacagagggtaatagataccttcttcccgcaagctaaaggtggaacagctgcaattcctgggcctttcggcagcggtaagtgcgtagatggagatactcttgtgctcaccaaggaattcggcttaatcaaaattaaggagctctatgaaaagctcgatggaaagggaagaaaaatcgttgaaggaaatgaggaatggacagaacttgagaaaccgataactgtttatggctataaggatggtaagatagtggagattaaggctactcacgtctacaagggagtatcctctggaatggttgagatcagaacgagaacagggagaaagataaaggtcactccaattcataggctattcacgggtagggtaaccaaggatggccttatccttaaagaagtaatggccatgcatgtaaagccaggagatagaatagcagtcgtaaagaaaatagatggtggcgagtacatcaaattggatagttctaatgttggagagatcaaagttccggagatcctaaatgaagaacttgcggaattcctaggatatttaatggccaatggaaccttgaagtctgggatcattgagatttactgtgacgatgaatctctgcttgagagggtaaattctctctccctaaagctcttcggagttggtggaagaatagtccagaaagtagatggtaaggcgttagtgatccaaagtaaacctctggttgacgttcttagaaggttgggagttccagaggataaaaaggttgaaaactggaaagtacccagggagcttctactttctcccagcaatgtagttagggcatttgtaaatgcctatattaaaggaaaagaggaagttgaaataacactggcatccgaagagggggcctatgaactaagctatctgttcgcgaaacttggaatatacgtaacgatcagtaagagtggggagtactacaaggttagggtaagtagaaggggcaatttagatacgattccagttgaagtcaacggtatgcctaaggtattaccttatgaggacttcagaaagtttgccaagtctataggacttgaagaggtggcggagaatcacctacagcacatcatctttgacgaggtcattgacgtcaggtacattcctgaacctcaagaggtatatgatgtaacgactgaaacccacaatttcgttggtggcaacatgccaacattgcttcacaacacggtgactcagcatcagctagccaagtggagtgatgcccaagtggttatctatattggttgtggagagagaggaaacgagatgacggatgttcttgaagagttccccaagcttaaggatcctaagactggtaagccattaatggaaagaaccgttttaatagctaacacctctaacatgcctgtggccgctagagaagcctctatttacaccggaatcacgatagccgagtacttcagggatatgggatatgatgtagccctaatggctgattcaacctcaagatgggccgaagccctgagagagatctcaggtagacttgaggaaatgcctggtgaagagggatatccagcttacttagcctcaaagcttgccgaattctacgagagagcaggtagagttgttacccttggaagtgactacagggttggaagcgtttctgtaataggagcggtgtcacctcctggaggagacttcagtgaacctgtagttcagaacacgcttagagttgtcaaggtcttctgggctttagatgccgacttagctaggagaagacacttcccagcaatcaactggttgacgagctattccttgtatgttgatgcagtaaaggactggtggcataagaacattgatcccgaatggaaggcgatgagggataaagccatggctttgcttcagaaggaatccgagttacaggagatagttagaattgttggtcccgatgcattacctgagagggagagagcaatcctcttagttgccagaatgcttagggaggattatctacagcaggatgccttcgatgaagtagatacctactgtccacccgagaagcaggttacgatgatgagggttctcctgaacttctatgacaagaccatggaagccataaacaggggagttcccttagaggagatagctaagttacccgttagggaggaaataggtaggatgaagttt

SEQ ID NO: 44098 - DNA, 297 bp, Pyrococcus horikoshii
aaggtagttatcatgggagattcagatacggtagttggttttagactagcgggaattcatgaggcttatgaatttgacctctctgagctctcaatagagagggccaggaacaagttaaaggagttggtggagagagatgatgttggtatcattttaatcacggagagattggcccaaaaaataggggaactccctcaagtaaatcttccgataatccttcaaatacctgataagttcggctcaatttacggtgaagaattgttaagggagatagttagaagggccgttgggattgag

SEQ ID NO: 44099 - DNA, 594 bp, Pyrococcus horikoshii
atgaacggtgctgagctaataattcaagaaataaacaaagaggctgagagaaagatagagtacatactcaatgaggctaggcagcaggccgaaaaaattaaagaggaagctagaaggaatgctgaagctaaagctgaatggataattagaagagcaaaaacgcaagcagagctggagaagcagagaataatagcgaatgcaaggcttgaagttaggagaaagcgacttgccatacaggaggagataatctctagtgtcctggaggaagttaaaagaagacttgaaaccatgagcgaggatgagtactttgaatccgttaaggcattactgaaagaagctattaaagaacttaatgagaagaaggtaagggttatgtcaaatgagaagacattaggcttaatagcttcaaggatagaggagataaagtcagagcttggggacgtttcaatagagcttggagaaacagtagatacaatgggaggagtcatagtagagactgaagatggaagaataaggatagataatacgtttgaggctaggatggaaagatttgagggggaaataagatccacaatagctaaggtattattcggg

SEQ ID NO: 44100 - DNA, 1554 bp, Rhodopseudomonas palustris
  unsure (1)..(1554): unsure at all n locations
gacgtcctgatcatcggtgccggccacaacggcctcacctgcgcggcctatctggcgcgcgcgggactgaaggtgaaggtggtggagcgccgcaacgtggtcggcggcgccgcggtgacgcaggagtttcatcccggcttccgcaactcggtggcggcctacacggtcagcctgctcaatccgaaggtgatcgcggacctgaagctgcacgagcacgggcttagaatcgtcgagcgcaaggcgcagaacttcctgcccgcacctgacggccaatatctgctcaccggcagcaacaccaccgccgcctcgctggcgcggctcagcgcacatgatgccgcggcgttcggcgggttcgctgccgagctcgaaaccatcgccgacgtgctgcggcacttcgtgctgcgcgccccgcccaatctggtggtgcagttcggcctgcccgcaatccgggaaagcctgaatgcgcttgaaaccgccaaccggctgcgggctctcaccatggagcagcagcggctgctgctcgacctgttcacctgctcggccggcgagatgctcgacgcccggttcgagcatgatctggtcaaggcgctgttcggcttcgacgccatcgtcggcaactatgccagcccctacgccgccggctcggcctatgtgatgctgcatcacgccttcggcgaggtgaacggcaagaagggcgtctggggccacgcgatcggcggcatgggcgcgatcacaagtgcgatggccgcggccgcccgcgccgccggggccgagatcgagacctcggcgggggtgcgcgaggtgctggtcgagaaggaccgcgtggtcggcgtcaccctcgacgacggccgcaacgtgagggcacgcttcgtggcgtccaacgtcaatccgaagctgctgtacacccgcctgttgccgcaggatgctctgcccgatgacgtccgccgacggatgcaaaactggaagaccggctccggcacgttccggatgaatgtcgcgctgtcccggctgccgtcgttcaccgcgctgcccggggacggcgaccacctcaccgccggcatcatcatcgcaccgagcctgggttacatggaccgtgcctaccaggacgcccgcgcccacggctggagccgcgagccggtagtcgagatgctgatcccctcgacgctcgacgacagcctcgctccaaaggggcaacacgtcgccagcctgttctgccagcacgtcgctcccgagctgccggacggcgcctcctgggacgatcatcgcgacgaggtcgccgacctgatgatcgcgaccgtcgaccgctatgcgcccggcttcgccgccagcgtgctcggccgccagatcctgtcgccgctcgatctcgagcgcgaattcgggctcgtcggcggcggcatcttccacggcgcgctcagcctgaaccagctgttcgcagcgcgcccgctgcccggccaggccgactatccgggggcgctgaagggcctctaccacgccggcagtggcgcccagccgaacgagagcgtctccggcgcccccggccncaacgccgcggta

SEQ ID NO: 44101 - DNA, 912 bp, Rhodopseudomonas palustris
atggccccgatcatttccgtcaagaatctgagcaagacctacggcaccgggcgcaaggcgctgaacggcgtcagcctcgacatcatgggcggcgagatcttcgcgctgctcgggccgaacggcgccggcaagaccacgctgatcggcacgatctgcgggttggtcaatccgaccggcggaacggtgacggtcgacggccacgacatcatcaccgactatcgggcggcacgcgagctgatcgggctggtgccgcaggagctgcacaccgatgcgttcgagtcggtgtgggacacggtcagcttctcccgcggcctgttcggcaaaccgaagaacccggcgcatatcgaaaaggtgctgcgcgacctgtcgctgtgggaccgcaaggacagcaagatcatcaccctgtcgggcggcatgaagcgccgcgtgatgatcgccaaggcgctcagccacgagccgcagatcctgtttctcgacgagccgaccgccggcgtcgacgtcgagctgcgcaaggggatgtgggaggtggtgcgcgccctgaaggcgaccggcgtcaccatcatcctgaccacgcactacatcgaggaagccgaggagatggccgaccgcgtcggcgtcatcaaccacggcgagctgatcctggtcgacgagaagtcggcgctgatgcagaagctcggcaagaagcagctcaagctgcatctcgacgccccgatcgacaccgtgccgccgcagctctccgcctacgacctcgcgctgtcggacgaccacaacaagctgatctacacttacgacacccgcgccgaacataccggcatcaccgccctgctcggcgacatccgcgccgccggcatccgcttccacgatctcgacaccagccagagctcgctggaggagatcttcgtcagcctggtg

SEQ ID NO: 44102 - DNA, 1377 bp, Rhodopseudomonas palustris
caggccgtggcaagcgccattgaagcgctcgcggcgcggttcggcaaccgcctcgtcacctcgctggccgtgcgcgagcagcacggccacaccacgacctggctgccgaaccagccgccggacgcggtggtgatggcgcaggagacggcggacattcaggacacggtgcggatctgcgcgcagcacaacgtgccggtgatcgcgttcggcaccggcacgtcgctcgaaggccacgttaacgctccggccggcggcatctgcatcgacctgcgcgatatgaacaagatcctcgaagtccatgccgaggatctcgactgtgtgattcagcccggcgtcacccgcaaggcgctgaacgagaacctgcgcgaccaggggctgttcttcccgatcgatcccggcgccgacgcctcgatcggcggcatggcggcgacccgcgcctccggcaccaatgcggtgcgctatggcacgatgcgcgacaacatcctggcgttgaaggtggtgcgcggcgacggcgagatcatcaccaccggcacccgcgccaagaaatcggccgccggctacgacctgactcacctgttcgtcggctcggaaggcacgctcggcatcatctccgagctgaccatcaagctgcgcggcatcccggagacgattgcggcggcgtcctgctcgttcccgtcggtcagcgacgcctgtcaggcggtgatcctggcgatccagaccggcattccgctggcccggatcgagctgatgagcgaatcccaggtcaaggcggtgaacgcctattccaagctgaccctgccggagacgccgctgctgctgctcgaattccacggcagcgaagtcgaggtcggcgagcagtcgaagaatttcggcgccatcgccaaggattgcggcggcggcgacttcacctggacgacgcgtccggaggatcgcaacaagctgtggcaggcccggcacgacgcctactggtcggtgcgggcgctgcgccagggcgatggcgtcggcgtcgtcgctacggatgtctgcgtgccgatctcgcggctggccgattgcgtcggcgagaccgaggccgacctcaaccggctcggcctgctggcgccgatcgttgggcatgtcggcgatggcaacttccattgctcgctgctgtgcgacgtcaacgatgccgaagagctggcgcgggccgacgagttcatgcaccggctggtcgagcgggcgcagtcgatggacggcacctgcaccggcgagcacggcatcggccagggcaagcagaaatatctgcaggccgagctcggcctcgaagcgctgcaggcgatgcgcgcgatcaagcaggcgcttgatccgcagaacatcttcaatcccggcaagatcctgccgcaa

SEQ ID NO: 44103 - DNA, 1431 bp, Rhodopseudomonas palustris
atgatcatggcccgcacgccccgctctccccgccccgcgcgttctgccgccacgcgaagcgagaccgatagtttcggtccgatcgatgtcgccgccgaccgttactggggcgcgcagaccgagcgttcgcggcaaaacttccgcatcggcaccgagcggatgccgatcggcatcatccgggcgctggcaatcgtgaaactggccgcggccgagaccaacaaggagctcggcctgctcgacaaccgccgcgccggcgccatcgtccgcgccgcccgcgaagtgatcgacggcacccatgacgatcacttcccgttggtggtgtggcagaccggctccggcacccagaccaacatgaacctcaacgaggtaattgctaatcgcgccaacgaactgctcggcggcgagcggggatcgaagaagccggtacatcccaacgatcacgtcaacatgagccagtcgtcgaacgactcgttcccgaccgcgatgcatatcgccgccgcgcaagcgattacggccgacctgatcccagcgctgacgctgctgcacgatgcgttacgcaagaaggagaaggcgttcgccaagatcgtcaagatcggccggactcacacccaggacgccaccccgctgacgctcggccaggaattttccggctacgcggcacagctcgccagcggcatcgcgcggatcaaatcggcgctgaaggagctgtatccgctggcgcagggcggcaccgcggtcggcaccggactgaacacgcatccgaaattcgccaaggcgttcgccaagcgcgccgcggcgattaccaagctgccgttcgtcaccgcgccgaacaaattcgaagcgctcgccgccaacgacgcctacgtgttcgtgcacggcgcactgaacgccgccgccaccgcgctgtttaagatcgccaacgacatccgcctgctcggctccggcccgcgctccgggcttggcgaactgatcctgccggagaacgagcccggctcatcgatcatgcccggcaaggtcaacccgacccagtgcgaggcgatgaccatggtgtgctgccaggtgttcggcaatcagaccaccctcaccgtcgccggcagccagggtcacttcgaactcaacgtctacaagccggtgatggcgcaggcgatgctgcagtcgatcgggctgctcgccgatgccgcacgctcgttcacgaccaactgcgtcgatggcatccgcgccgacgagcagcggatcggcgaactgatgcagcgctcgctgatgctggtgaccgcgctggcgccgagcatcggctacgacaatgccgccaagatcgccaaggcggcgcatcagcgtggtacgaccttgaaggacgaagcggtgcgttcggaactgatcagcgccgccgaattcgaccggctggtgcggccggacaaaatgacgcatccgggc

SEQ ID NO: 44104 - DNA, 492 bp, Rhodopseudomonas palustris
atcgtcctggtcgtggccgtggccgacaatggcgtgattgggcagggcaatgccatcccgtggcggctgaagtcggatctgcagcggttcaaacagctcacgctgaacaagccggtaatcatgggccgcaagacctatcagtcgatcggccggccgttgcccggacgtaccaatatcgtgatcacgcgcgatgccgcgttcacggcgccgggcgtggtggtggcgccgtcgttcgctgcggccgaacaggtcgcgcgcggcgatgcgctgcggcgatttgccaccgagatcgcggtgatcggcggggccgagatctacgcgcagtggctgccgctcgccgccaggatcgaactcaccgaagtccacgcacagcctgccggtgatacctcgtttccgccgatcgatccggaactatggcgggaggtcgcacgtgagcgtcacacggccgggccgcatgacagcgctgatttctcctatgtgacctatcgacgc

SEQ ID NO: 44105 - DNA, 336 bp, Rhodopseudomonas palustris
ttccgcttcgaagccgcccattatttgcccaacgtgccggagacgcaccgctgcaagcggatgcatgggcattcctaccgggtcgaactgcagctcagcgggccgatcaatccggtcaccggcttcgtgctggactttttcgagatcgaggccgcgttcgggccgctgctgaagcggctcgaccattactgtctcaacgaggtcgagggtctggagaatccgaccgcggagaatatcgcgatctggatctggcgccgcaccaagccggagctgccgcagctttgcggcgtgcgggtgtacgagacctcggattgctgggccgattacgccggcgaa

SEQ ID NO: 44106 - DNA, 1308 bp, Rhodopseudomonas palustris
atgaaggccctggcggaacagatcggcgacatcgacagcgtcaatacgtatggccgtgtcgtcggcgtccgcggactgatggtcgaaatcgccgggccgattcacgcgatgagcgttggcgcacgcatcgttgtcgagaccggcgccaaccgtgagatcccttgcgaagtaatcggcttcaccggcaataacgccatcgtcatgccgtttgccgggctcgaaggcgtgcgccgcggctgccgtgcgatcatcgccaactctgctgcccaggtgcgaccgtctccccattggctcggccgcgtcgttaacgctttgggcgaaccgatcgacggcaaggggcctctggtacaaggcccgtcgccgatgcagttccgcaatcagccgccgccggcgcattcgcgcaagcgcgtcggcatgccgctcgatctcggcgtacgtgcactcaacacgtttctcacctgctgtcgcgggcagcgcatgggtatcttcgccggttccggcgttggtaagtcggtgctgctgtcgatgctcgcccgcaacgtcgatgccgcggtatcggtgatcgggctgatcggcgaacgcggccgtgaggtgcaggagttcctgcaggacgacctcggtgaggaaggtctcgcgcgctcggttgtggtggtcgcgacgtcggacgagccggcgctgatgcggcggcaggcggcgtatctgacgctggcgatcgccgaatacttccgcgacaacgacaaggacgtgctgtgcctgatggactcggtcacgcgctttgcgatggcgcagcgtgagatcggactgtcggccggcgagccgccgaccgccaagggctacacgccgacggtgttcaccgaactgccgaaactgctcgaacgtgccggtccggggctgggcgagggcaccatcaccggcatcttcaccgtgctggtcgacggtgacgatcacaacgagccggtcgccgacgcggtgcgcggcattctcgatggccatattgtgatgcagcgctcgatcgccgagcgtggccgctatccggccatcaatgtgctgaagtcggtgtcgcgaacgatgccgaaatcagccgatcccgtttatctgccgatgatcaagcgggcgcggcagatcatggcgacctacgccgacatggaagagctgatccggctcggcgcctatcgtcccggctccagcgccgaagtcgacgaagcggttcggctgcacgagccgcttgaggatttcctccgccaaggcaaggacgaggcgaccagcttgcagtcgggatatgtccaattggagcagatcctgagtaat

SEQ ID NO: 44107 - DNA, 849 bp, Rhodopseudomonas palustris
actctcatgcacgcactcttcatcggacagacctatatcgacgtcaccttcatcaccgaccatttgccgaccggcgacgaaaagcacgtggcgtccgactacgcggtgtcgttcggcggcaacgcggtgaccgcggcgttctgctgcgccaagctcgggatcgtgcccgacctgatcgccaccgtcgccaacgactggctcggacggatgtttcaggacatgagcgcgaaatacggcatcgagattcatccgcgcaaggtcgcgtcgtcgtcgctgtcctttatcatgccaaaggacggcaagcgcgccatcgtccgctgccgcgacgacgaacacatccatccgtttccgctgctcaatctcggcccatgccgcgccctgcatgtcgacggccaccagcccgacgcggcgatccattacgcaaaactctgccgcgaggccggcatcctgacctcgctcgacggcggcggcctgcgcaccaacacccacgagctgttggaattcatcgacgtcgcgatcgtcgccgagcgactgtgcgagcagatggacatgacgccggagaagatgctcgactatctgaagtcgcgcggctgtcgggtcggcggcgtcacgctcggtgagcgtggcctgtattggtacgacgaggccggcacggtccgcacgctgtcggcgctgccgatcccgcgcgagcgggtgatcgacaccaacggcgccggcgacgtgttccacggcgcctatgtgttctcgtacctgaacaacccggcgcagagctggcagcaccacttcgaattcgcccgcgccgcctcgaccttcaagatccagaagctcggcaacgaagccggcctgccg

SEQ ID NO: 44108 - DNA, 894 bp, Rhodopseudomonas palustris
atcgcgatcgatgtccgcggcctcaccaagtcgttcaacggccgcgaggtggtgcacgacctgtcgatgcaggtgaagcgcggttcgatctacggctttctcggccccaacggctccggcaagaccacgacgatccggatgctgtgcggtctgctgaccccggaccgcggcgagggcacatgtctcggcttcgacatccgcaccgatgcggccaagatcaagcgccgggtcggctacatgacgcagcgcttcagcctgtatcaggacctgtctgtgcgcgagaatctcgaattcgtcgcgcggctgtacggcgtgcccgatgcgcgcggcgcggcgcgcgagatgatcaagcggctcggcctgtcaggccgcgaggagcagcttgccggcgaactctccggcggctggaagcagcggctcgcgctcggtgcctgcacgctgccgaacccgcagttgctgctgctcgacgagccgaccgccggcgtcgacccgaaagcgcgccgagacttctggaacgagattcacgcgctcgccgccgaaggtctcactgtgctggtttcgacccactacatggacgaggccgagcgctgccacgagatcgcttacatcgcctatggtcatctgctggcgcacggcaccgtcgatcaggtgatcgcgggctcgaaactcaccacgtgggtcgccaccggcgaaggcctcggcacgctggcacacgaacttgccggcaagccgggcgtcgacatggtggcaccgttcggcaccagcctgcacgtctccgggcgtgaccaagccgcgctcgaccagacgctggcgccgtatcgcaacgatccgcggcagacctggcagcacggcgcgccgtcgctcgaggatgtgttcatcgagctgatgagccgg

SEQ ID NO: 44109 - DNA, 741 bp, Rhodopseudomonas palustris
gtggaagtcgatcgtcagggagccgtcggcatcgtcacgctgaacctgccggaggcccgcaacgcgttgtcgcgagaaatgatcagggcactggccgccgcgctcgatgagctggaacgtgatgccgcgatcgccgcgatcgtgctctccggccgcgaggtgttctgcgccggcgctgacatcgccgagatgcgcggcatcgatctcgccacggtgctggccgaggatttttccggctgctgcgaccggttggccacctgcgccaagccgctgatcgcggcggtcgaaggttacgcgatcggtggcggctgcgagttgatcgagatgtgcgacctggtgatcgctggcatcggtgccaagttcggtcacccagagatcgcgttcggtacgctatcgggcggtggtggcacgcagcggctggcacgagcggtgggccgggcccgcgcgatggatctgatcctgaccggccgtctgatctccgcgatcgaggccgagcggatcgggctgatcagccgcgtggtcgaagacggcgaagctcaccaagccgcccgcgaggcggccaagctgattgcggcgcatccagtgcgcgcggtgcgattcgccaagcaggctgtcgaccgtgcggtctcggccgggctcgcggacgggctggcgttggagcggcggctgtttcacctcagctttgcgaccggcgaactaccgccacggctcgatcgttttctgacgcggcgaagtccgcgc

SEQ ID NO: 44110 - DNA, 1206 bp, Rhodopseudomonas palustris
atggcgaaaatcaaggtgaagaaccccgtcgtggaactcgacggtgacgagatgaccaggatcatatggcagatgatcaaggacaagctcatcaccccgttccttgatgtcgagctgatgtatttcgacctcgggatggagcaccgcgacaagaccgacgatcaggtcacgatcgatgcggccaacgccatcaagcaggtcggcgtcggcgtgaagtgcgccaccatcaccccggacgaagcgcgggtgaaggagttcggcctcaagagcatgtggaagtcgccgaacggcaccatccgcaacatcctcggcggcgtgatcttccgcgagccgatcatctgcaagaacgtgccgcggctggtgccgggctggaccaagccgatcgtgatcggccgccacgcctacggcgaccagtatcgtgcgaccgacatcaagttccccggcccgggcacgctgacgatgaagttcgtcggcgaggacggctcggtgatcgagcgcgaagtgttcaaggcgcccggcgccggcgtcgcgatgtcgatgtacaacctcgacgagtcgatcaaggacttcgcccgcgcctcgctgaactacggcctgatgcgcaactacccggtctatttgtcgaccaaaaacaccatcatgaaggtgtacgatggccgcttcaaagacatcttccaggagatcttcgacgccgagttcaagaaggaatacgacgccaagggcctgacctacgagcaccgcctgatcgacgacatggtcgcctcggcgctgaagtggtcgggcggctacgtctgggcctgtaagaactacgacggcgacgtgcagtccgacaccgtggcgcagggttacggctcgctcggcctgatgacctcggtgctgatgacgccggacggcaagacggtggaagccgaagccgcccacggcaccgtcacccgtcactaccgcgaacaccagaagggcaaggcgacctcgaccaactcgatcgcctcgatcttcgcctggacccgcggcctcgcgcatcgcgccaagctcgacagcaacgaagagctcgctcgcttcgccgacctgctcgagaaggtctgcgtcgacaccgtcgaagccggcgcgatgaccaaggacctcgcgctcctggtcggcgccgaccagcgctggctgtcgaccgagggcttcctcgacaaggtcgcgcagaacctcaacaaggcgatg

SEQ ID NO: 44111 - DNA, 1500 bp, Rhodopseudomonas palustris
tcccgccgccccgtgatgctcgtgattctcgatggctgggggtggcgcgaggaccccgccgacaatgccgtgctgcaggccaagactccgaccttcgacgcgctctggaccaacggcccgcatgcgtttctgcgcacctccggcaaatcggtcggactgccgaacggccagatgggcaactccgaggtcggccacctcaacatcggtgccggccgggtggtgatgcaggatctgccgcggatcagcgatgcaatcgccaacggcgagatcgagcgggcgccgggtctggtggcgttcatcgacaaattgaaggccagcggcggcacctgccatctgatgggcctggtgtcacccggcggcgtgcactcactgcaagatcatgcctgcgcactggccaagatcctggccaaggccggcgtaaagacagtgctgcatgcgttcaccgacggccgggatacgccgccgaaatccgcggtcgacgacatcgtgcggctgcgcgccgaactgccgccgaatgtgccgatcgccactgtcagcggccgctattatgcgatggaccgcgacaaccgctgggagcgcgtctccaaagcctacggcgtgatcgccgacgctgacgggccgcgatttgcggacgcgaacgccgtgatcgccgacggttatgcggccggggtgaacgacgagttcatcgtacctgcggtgatcggcgattatcagggtatgcgcgacggcgatggcgtgctgtgcttcaacttccgcgccgaccgggtgcgcgagattctcgccgccttgctcgactccgcttttgcgggcttcccgcgcaaacaggtgaagcagatcgccgcggcggccggcatgacgcagtactcgaccgcgctcgacgcgctgatgggcacgatcttcccgccgcaaagtctggtgaacggcctcggccaagtggtcgccgacgccggcctgcatcagctccgaatggcggagacggagaagtatccgcacgtcacgtacttcctgaatggcggcgaagaagtgccttatccgggcgaagaccgcatcatggtgccgtcgccgaaggtggcgacctacgatctgcagccggaaatgtcggcgccagagctcggcgacaaggccgtcgcggcgatcgagtccggcaagtacgacctgatcgtcctcaacttcgccaatccggacatggtcggccacaccggtagcctgccggcggcgatcaaagcggtggagaccgtcgacacccagctcggccacatcgtcgcggcgatccgcaaggccggaggggcgctgctggtcaccgccgaccacggcaattgcgagatgatgcgcgatccggaaaccggcggcccgcataccgcgcacaccaccaatccggtgccggtgctgcttgtcggcgacaacggcccgctggccgacggccagctctccgacctcgccccgaccctgctgaagctgatggaattgccgcagccggccgagatgacgggcaaatcgctg

SEQ ID NO: 44112 - DNA, 1611 bp, Rhodopseudomonas palustris
gtgcaagagacgggcgtgcataacggtgcatatggcaccgacaaattcggcctcaaaaatctcaaaggcgtgtactggaacttcggtgcacctcagctctatgagcacgccctgaagaacggcgaagcggtgttgtcgtcggacggcgccctcgttgctgacaccggcgtgttcaccggccgcagcccgaaggacaagttcacggtccgcgacgccaccaccgaaaacaccatgtggtggggtggtaatcagtcgatcactgccgagcagttcgaggcgctgtatcaggacttcctcaagcacgccgaaggcatgaccctgttcgcgcaggacctgtacggcggcgccgatccgaccttccgcatcaagacccgcgtttacaccgagctcgcctggcactcgctgttcatccgcacgctgctgcgccgtcccgagcgcgccgagctggagaacttcgttcccgagctgacgctgatcgatctgccgagcttccgcgctgatccgaagcgccatggctgccgctccgaaaacgtcgtcgcgatcgactttgcccgtaagatcgtgctgatcggcggcactcagtacgccggcgaaatgaagaagagcgtgttcaccacgctgaactactacctgcccgagaagggcgtgctgccgatgcactgctcggccaacgtcggcccgaacggcgacaccgcgatcttcttcggcctgtccggcaccggcaagaccacgctctcggccgatccgaaccgcacgctgatcggtgacgacgagcacggctggggcaaggacggcgtcttcaacttcgaaggcggctgctacgccaagtgcatcaagctgtcgtccgagaacgagccggaaatctacgccgcctcgacccgcttcggcgccgtgctcgagaacgtcgtgctcggcgagctcgatcgcaagccggacttcgacgacggctccaagaccgagaacacccgctcggcctatccgctcgagtcgatcccgaatgcgtcgctgaccggccgcgccggccagccgaagaacgtggtgatgctcgccgccgacgcgttcggcgtgatgccgccgatcgccaagctgaccccggcgcaggcgatgtatcacttcctgtcgggctacaccgccaaggtcgccggcaccgagcgtggcgtcaccgagccgactccggaattctcgacctgcttcggctcgccgttcctgccgcgcgatccgtcggtgtacggcaacatgctgcgcgagctgatcgccaagcacaatgtcgactgctggctggtcaacaccggctggaccggcggcatctacggcaccggccaccgcatgccgatcaaggtcacccgcgcgctgctcaccgccgcgctggacggctcgctgcgcaatgtcgaattccgcaccgatccctacttcggcttcgcggtcccgacggcgctgccgggcgtgccgagcgaaatcctcgacccggtgaagacctgggccgacaaggctgcgttcgacaccaccgcccgcaagctggtcggcatgttccagaagaacttcgccaagttcgaagcgcaggtcgacgccgaagtccgcgccgccgcgccggacgtcaagatggccgtcgaa

SEQ ID NO: 44113 - DNA, 1191 bp, Rhodopseudomonas palustris
atgaccgaatcgtcccactcgcccggctttgccaccaccgcgatccaccacggctacgacccgctggcgcatcacggtgcgctcaacccgccgctgttcctgacctcgacctacgcgttcgccagcgccgctgagggcgcggcgcggttcgccggcgaggccgaaggcttcgtgtattcgcgggtcggcaatccgacggtggcggtgctggagagccgactggcggcgctggaaggcggcgaggccgcgctcgccaccgcctcgggcgtcggggccctgacggcgctgatctggacgctgctgaagacgggcgacggcatcatcgccgaccagatgctgtacggctgcaccttcggtctgttcgagcatcatctgccacggttcgacatcgaggtggtgttcgccgatctcaccgatccggccaatctgcaggccgcgctgcggccgaatacccgcttggtgttcaccgagaccccgaccaatccgaacatgcggctggtcgacatcgccgcctgcgccgagatctgccggcgcgccgacgctcgcctcgtcgtcgacaacacctactgcacgccctatctgcagcgcccgctcgatctcggcgcagatctcgtcacccattcggcgacgaagtatctcggcggccatggcgacctgctcgccggcgcggtggtggggccgaaggagatcatcgatcaggtccgcttcgtcggcgttaaggagctgaacggtgcctgcatctcggcgttcgacgccttcctgatcctgcgcggcctgaagacgttgaacctgcggatggatcgccacagcgccaccgccgtaaagctcgcgcacgatctcgaagcgcatcccgccgtcgccgctgtgtactaccccggtctcgacagccacaagcagcgcaacctcgcgcagcggcagatgcgccagcccggcggcatgatcgcactcgagctcagaggcggattagcagccggccgcagcttcatggacaaggtgaagctggcgacgcgagcggtcagtctcggcgacgccgagaccctgatccaacacccggccagcatgacccacgcgacctacgatccggccgaacgcgcgcggcacggatttacggacggactgatcaggatctcagtgggactggaggattatgaggatctgaaacaggacttgcttggggcgctatgaactacg

SEQ ID NO: 44114 - DNA, 999 bp, Rhodopseudomonas palustris
tctccgacccaggagcccgcgatggatgcgatggtgctgacggcaccgggcacgtcgctgcaatggcaatcgcgcgacacgccgcagccgggtgacggcgaggtgctggtcacggtgagcgcttgcggcgtctgccgcactgaccttcacgtcgtcgatggcgaattgccgaacatccgttatccgatcattcccggccatgagatcgtcggccgcgtcgcggcggtcggcgctggcgtcaccacacatcagatcggtgaccgcgtcggcattccctggctcggccacacttgcgggctgtgccgctactgccgaggcggcatggagaatctgtgcgatgcgccgctgttcaccggctacacccgcgacggcggatttgcgtctcacgccatcgccgacgcgcgctatgcgtttccgctcggcgaggccggcgatgacgttgcgattgcgccgctgctgtgcgccggactgatcggctggcgttcgctggcgatcgccggagacgcagagcggcttggcatctacggcttcggcgccgccggccacatcgtggcgcaggtcgcgcgctggcaagggcggcaggtatatgccttcacccgcggcggcgatgtcgcggctcaggacttcgcccgcagcctcggcgcagtgtgggccggcgcttccgaggagcaaccgccgcagccgctcgacgccgcgatcatctacgcgccggtcggcagcctggtgccggccgcgctgaaggcggtgcgcaaaggcggccgcgtggtctgcgccggcatccatatgagcgacatcccgagctttccgtacgatctgctgtgggaggaacgccagctcgtttcggtcgccaacctcacccgacaggacggtgtcgattttcttgaggtggcgcagcaggccagcattcgaaccgagacccatgcctttccgctacgtgaggccaacacggttttgaacaaactccgcgcgggcgaactgctcggtgcggcggtgctggtg

SEQ ID NO: 44115 - DNA, 624 bp, Rhodopseudomonas palustris
cgcgaactgatggtcgagcgccagatcgcagcgcgcggcgtgcatgatccgcgcgtgcttgccgcgatgcgcaaggtgccgcgcgaagccttcctgccggaaccgatgcgtgatctggcgtacgaagacgcgccggtgccgatcgccgccgagcagacgatgtcgcagccctacatcgtggcgctgatggtcgaggcgctgttactgcagggcagcgacaacgtgctcgaaatcggcgccggctccggctacgccgccgcggtgctcggcgagatcgccggtcatgtcaccacggtggagcgcatcgctacgctggcggacgctgcggcggcgaagctcgccgagctcggttacggcgatgtcgacgtgcatcggagcgatggcacccgcggttggcccgcagcggcgccttacgacgcgatcgtggtcgccgccggcgggccgcaggtgccggagtcgctgaaggcccagctcaagatcggcggacggctggtgatgccggtcggagccgatcagcaagcccaggaactggtgcgcctgacacggctcggcgaggccgatttcaagcgcgagcacctcggtgatgttcgcttcgtgccgctgctcggcgctgaggggtggcag

SEQ ID NO: 44116 - DNA, 1218 bp, Rhodopseudomonas palustris
aagatcgtgtttctcggcgcctccagtgcgtcgttcggtctcagcatgtttcgtgacctgttcgcgtcgccggtgctggccggttcgactctgacgctggtcggacgcaatccggaaacgctcggcagaatgaccgagctggcgaagctgatgaacgcaaggtccggtgccggactgatcatcgaacagaccaccgaccgccgcgccgcactggacggcgccggcttcgtcatcaacgccaccgcgatcgatcgcaaccggctgtggaagcaggacttcgaggtgccgaagaagcacggcatccgtcacaccctcggcgagaacggcggcccgggcggattgttcttcacgctacgcacgctccccttggtgttcgacttcatccgcgacatcgaagagctgtgcccgaccgcgctttttctcaactactccaatcccgagagccggatcattctggcgctcggccgctacaccaaggtgcgccatatcggactgtgtcacggcatcttcatgggccgcgacgcggtcgcctacatcatgcagatgccgcgcgaagagatcgaagtgtggggcgccgggctcaatcacttccagtgcttgaccgagatccgccaccgtgacaccggcgaggatctgtatccgcggtttcgcgccgccgagcagagctttgatcccgatgcgtggcggttcacgcgacggctgtatcgcgcgttcggctattggctgacctgcagcgatgatcatctcggcgagtatctgccgtatggctgggaagccggcgagaagggctacgatttcgaccaggacgaacgctggcgcggcgaattcctcacccagctcaatggcgtgctcggcggcaccatgccgatcccgcagtggtggaccgaaccgtcgggcgagcgcggcgccgccgtgatcgccgcgatgctgcacaaccagaagcgtttcatcgaatccggcattgtcatcaatcggggcgtgatccccaacctgccggcggagctcgcggtcgaagtcccggtgactgtggatgcggccggcgtgcatccggtgtcgctcggcccgttgcccgacccgatcgccaagctgatgctgatgcaggccagcgtgcagcagctcgcggtcgaggccgccgtccatgcctcgaaagagctggcgctgcaggcgttgttgatcgatccggtggtcaactcggcggtcgcggccgagaagatcctg

SEQ ID NO: 44117 - DNA, 1235 bp, Rhodopseudomonas palustris
ccgctccgttcgcccgtcatgcgatggcttacgtgctggcggggggacgcggcagccggctgatggagctcaccgactggcgtgccaaacctgcggtttatttcggcggcaaatcccgcatcatcgattttgcgctgtcgaatgcgctgaattcgggtatccgccgcatcgcagtggcgacgcagtacaaggcccacagcctgattcggcatctgcagcgcggctggaacttcttccgcccggagcgcaacgagagtttcgacattctgccggccagtcagcgcgtctcggaagagatgtggtaccgggggacggccgacgccgtttttcagaacatcgacatcatcgagagctacgatccgaagttcatcgtgctgctggcgggcgaccacgtctacaagatggactacgagaagatgctgcagcagcacgtcgagcaaggcgccgacgtcacggtcggctgcctcgaagtgccgcgcgccgaagcgaccgcgttcggcgtgatgcacaccgatacgaccgaccgcatcatctcgttcctggaaaagccggccgatccgccagcgatgcccggcaaggccgacaagtcgctggtcagcatgggcatctacgtgttcgagaccaagttcctgctcgacgagctgcgccgtgacgccgccgatccgaattcgtcgcacgatttcggtaaggacatcatcccctacatcgtcaagcacggcaaagcggtggcgcatcacttcgacaagtcgtgccgccggtcgagttcggaggccgtcagctattggcgcgacgtcggcacggtcgacgcgtattgggcggccaatatcgatctcaccgacattgtgccggagctcgacctgtatgatcgcgagtggccgatctggacctatggcgagatcaccccgccggcgaaattcgtccacgacaaggaaggccgccgcggcgaggccgtatcgtcgctggtgtctggcggctgcatcatctcgggcgcgtcgctgcgacactcgctgctgttcaccggcgttcgcgttcactcgttctcccatgtcgagaacactgtggtgctgccttacgccgacatcggccgctcgtgccggctgaaaaatgtggtgatcgatgccgaggtcaagctgccggccggtctggtggtcggtgaagatccagagtttgacgcgaagcgcttcaggcgcaccgaaaacggcatctgtctgattacccgcgcgatgatcgagaag

SEQ ID NO: 44118 - DNA, 1428 bp, Rhodopseudomonas palustris
gttctatctgttgcgtcggaactgtttccgctgatcaagaccgggggcctcgccgatgtggccggcgcattgccggccgccctgcgtgccaacgacgtcgccgtcacctcgctgctgccgggctacccggcggtgctcggcgggatcgaggatccgcagcaggtccacagcttcaacgagctgttcggcggcacggcgcggctgctggcggcgcgctgcggcgatctcgatctatttgtgctcgacgcgccgcatctctatgtccggcccggcaatccctatgtcggcccggacggcaaggattggccagacaacggcctgcgttttgcggcgttggcgcaggtcggcgccgcgctcggccagggcctgctgccgcactacaagccggatgtgctgcacgcccacgactggcagaccgggctgttgccggcctatctgaaatacagcggccggcctgggccgaagactgtcttcaccatccacaatctggcgttccaggggaggtttccctacgagctgctcggcaggctgggcctgccggagcgcgccttcggtctcgacggtatcgagtactacggcggtatcggttatctcaaggccggcctgcaactcgccgaccgcatcaccaccgtgtcgccgacctacgcggccgagatccagggttcggaagccggcatgggcctcgacggcctgctgcggctgcgcgccgatcggctgtccggcatcctcaacggcatcgacaccgacgtctggaatccggccagcgatgcgttgatctccgccacctacgatgtcgaaagcatcgcagcccgcgcccgcaacaagaaggtgctgcaggcgcggttcggtctgaagcccgagccgggcgcactgctgtacggcgtgatcagccggctgtcgtggcagaaggggctcgacctcttgctcgaagccctgccgcaattgatcggcggtggcgcccagctcgccctgctcggctccggcgatgccgaactcgaacagggctacgcggccgcggctcgcaagtatcccggccaggtcggcgcagtgatcggctacgacgaagcgctcgcgcatcagatccaggccggcgccgacgcgctgcttgtgccgtcgcgattcgaaccctgcggcctgacgcagctctgcgccttgcgctatggcgcggtgccggtggtggcgcgggtgggcggtctggccgatacggtggtcgacgccaacgagatggcgaccgccacaggcgtcgcgaccggcgtccagttcgcaccggtgacgactgacgcgctgatcaaggcgttcggcaaaacccgcgcgctgtttgcagacgtcgtcgcctggcgcaatctgcaaatcaacggcatgaccaccgatgtgtcgtggaagaacccggcgcagcactacgcgaagctgtatcgcgatctggtggcg

SEQ ID NO: 44119 - DNA, 1314 bp, Rhodopseudomonas palustris
acgatcttgaaaagcctgcccaagggcgaaaacgtcggcatcgctttctcagggggtctcgataccagcgcggcgctgctgtggatgaagcagaagggcgccaaggtgttcgcctatacggcgaacctcggccagcccgacgaggccgactacgacgcgatcccgcgcaaggcgatggagttcggcgccgagaaagcccggctggtcgattgccgcacccagctggtgcacgaaggcatcgcggcgatccaggccggcgccttccacgtctcgaccggcggcatcgcgtatttcaacaccaccccgctcggccgcgccgtcaccggcaccatgctggtgtcggcgatgaaggaagacggcgtcaacatctggggcgacggctcgacctacaagggcaacgacatcgagcggttctaccgctacggcctgctcaccaatccggccttgcggatctacaagccctggctcgaccagcagttcatcgacgagctcggcggccgcgccgagatgtcggcgttcatgacttcgcacggcttcgcctacaagatgagcgccgaaaaggcgtactcgaccgacagcaacctgctcggcgccacccacgaggccaaggatctcgaacacctcgacagcggcatcaagatcgtcaacccgatcatgggcgtgccgttctggcgcgacgattgcgcggtgaaagccgaagccgtcacggtgcggttcgaggaaggccagccggtcgcgctcaatggccagactttcacggatccggtcgcgatgttctacgaagccaatgccatcggcggacgtcacggcctcggcatgagcgaccagatcgagaaccgcatcatcgaggccaagagccgcggcatctacgaggcgcccggcatggcgctgctgcacatcgcctatgagcggctggtcaccggcattcacaacgaagacaccatcgagcagtaccgcatcaacggcatgaagctcggccggctgctgtatcagggccgctggttcgactcgcaggctttgatgctgcgcgagaccgcgcagcgctgggtcgcccgtgccgtcaccggcgaggtgacgctcgaactgcgccgcggcaacgactactcgatcctcaacaccgtcagcccgaacctgacctacgcgccggagcggctgagcatggagaaggtcgaggacgcgccgttcactccggccgaccgcatcggccagctcaccatgcgcaacctcgacatcaccgacacccgcgccaagctcggcctctacgccaagaccggcctgctgtcctccggcgaaggcaccccgatcccgcagctg

SEQ ID NO: 44120 - DNA, 738 bp, Rhodopseudomonas palustris
ctcgcgaacagacggattctgattaccggcggcggctccggactcggcgccgcgatggcggcacgctttgccgaactcggtgcgtcgctggtgctgtgcgggcggcgtgccgaggtgctgcaagagaccgcggagcaacttcggtcacacggcagccaagtcgacaccatcgtttgcgacgtgcgcgatccgcaagcggtcgaagccatgctcgacgagatctggcgcgttgcgccgctcgacgtactggtcaacaacgccgctgcgaccttcatcgcacagaccgaacgcctgtcggcgcgtgccgccgacgcgatcctggcgccaacgctgcacggcgcaatgtactgcacgctcggcgccggccggcgctggatcgacggcgaacatgcgggcgtcgtgctcagcatcctgtcgacctcgacgatcaccggccgcgcctttacggtgccgtcagcaatggccaagtcggcggtgctggcgatgaccaagagcctcgcggtcgaatggggaccgaagcagatccggttggtggccatcgcgccgggtgcatttccgaccgcgggtgcgaccgcgcagctgaggcccgacggccgctccgccgatccggcggaccgggtgccgctcggccgcgtcggtcgccacgacgaactcgccaatctcgccagcttcctgatctccgatcaggccggctacatcaccggcgagatggtggtgcaggacggcggcacccatctg

SEQ ID NO: 44121 - DNA, 948 bp, Rhodopseudomonas palustris
gtccgtattggtacgcgcaagagcgtgatggcgcttgcccagactgaggacatcgccaagcagctgagcgcagctgcgagtgagctcgatccccagatcatcaagttcgagactgtcggcgatagcgatcagatcagcaagctgcttccgcacggcggcaagggcggcgcgtttgtcgccgagatccgcgccgcgatgctgcgcggcgaactgcattgcgcgatgcactcgctcaaggacatgccggccaacgaagaaacgcccggcctgatcgtcgctgccacgctggcgcgcgatcctgcctgcgactcgctggtgttgcgcaaggggctgaccctcgaagagctgaagaaatcccgcggcaagggctacaccatcggcaccaatgcggtgcgtcgtgcggcctatgccaagcggctgtttccggaagtcgaggtgatccatttccgcggcgcggccgacagccggatgcgtaagctcgacaatcgcgaaaagcagcggatgccggacggcagcgaggtcgggcccgctgatgcgctgatcatggcgcgtgccggcatcgagcgcgtcggcttcgtcgatcgcattgctcacgacttcacgccggaagaaatgctgcccgcagccggccagggcatcgtcgcggtggaatgccccgtgcacgagtggaagacccgtcagtatctggcgctgatcgataatcaccagtcgcggctatgctgcgacgccgagcgcgaagtgctgtgggtgctcaacggccattgcaactcgccgatcgcggcgcactcggtcatcaccggcgacgagatgacactgcgcgcctcggttctcgatctggagggcgggatgttcatcgaggcggcccgcaccggcccggccaatcggccgcgcgaactcggccgtacggtcggcctcgaattgctcgacaagggcgccgccgcggtgatc

SEQ ID NO: 44122 - DNA, 1020 bp, Rhodopseudomonas palustris
gtgtttccgttctccgcgatcgtcggccaggaagagatgaagctggctctgctgatcgcagctgtcgatcagaaggtcggcggcgtgctggcgttcggcgatcgcggcgccggcaagtcgaccgccgtgcgcgctctcgcagcgctgctgccaaagatgaagaccgtggtcggttgccgctacaattgcgatcccgatcagcccgatcgttactgcgaagagtgcaaggaaaaggtcaaacacggcaaggtcaagaccgcgcaggtgccggtgccggtggtcgatctgccgctcggcgcgaccgaagaccgcgtcgtcggcgcgctcgacctggagcgtgcgctcgccaagggcgagaaggcgtttgagcctggcctgctggcgcgggcacatcgcggcttcctgtacatcgacgaagccaacctgctggaagaccatctggtcgacctgctgctcgacgtcgccgcctccggcgagaacgtggtcgagcgtgaaggcctcagcattcggcacccggcgcggttcgtgctggtcggcactggcaaccccgaagagggcgaactgcgcccgcagttgcttgaccgcttcggcatgtcggtggaagtgaagacgccggacacgctgccggagcgcatcgaagtggtgcgccgccgtgatgcgttcgagaacgatcctgccgccttcgtggccgattggtcaaaggaagaggccaagctgcgccgcaagatttcgcaggccaaggaacggctgcccgaagtcaccgtgagcgacgcggcgctggagcgtgccgccaagctgtgtatgacgctcggcaccgacggcctgcgcggcgaactgaccttgatgcgcgccgcgcgtgcgctcgctgcgctcgagcacgacaagaccgtgaccgatgaacacctgaagcggatcgcgccctctgccttgcggcaccggttgcgccgcaatccgctcgacgatgccggctctagcgtgcgtgtcgaccgcgcgctcgccgaaatcttcggatgagcatcg

SEQ ID NO: 44123 - DNA, 1554 bp, Rhodopseudomonas palustris
gatgcggtgaccgcggcgcagttgttcgcggtcgatccggtcggtaccggcggtgtgttgttgcgctcacgcgccggcccggtgcgcgatcgctggctcgcaatgatgcgggccgcgctgccgcctgaacaaccctataagcatcttccgctgcatatcgccgacggccgcctgctcggtggactggatctgtctgcgacgctgctcgccggccggccggtcgccgagcgcggcctgctgtcggaagccgacggcggcgtgatggtggtggcgatggccgagcggctgcagtcctcgaccaacgtttatctgaccgcagctatggacgcgcacgaaaccgcggtggagcgcgacggcctgtcgctgcggatgccggcccggttcggtgtggtcgcgctcgacgaaggcctcgaggacgagttctcgccggcgggtctgcgcgaccggctcggcttccatctcgatctcgatcagttcgcctggcgcgagaccgacgacttcccgatctcgctcgacgacatccgcgccgctcgcgcgcggctcgccgatatcaaggtcgagagtgagcagatcgaggccgtgtgcacggcggccgcagcgctcggcatcatctcgctgcgagcgccgctgctggcgatccgcgccgccaaggcgagcgctgctctgttcgatcgcaccaagatcgaacaggacgacatcacgctcgccgcgcgcctggtgctggcgccgcgtgcgacgatcttcccgcagcaggagcagccggatcaggccgacgagccgccgccgcccgagccgcctccgccggaagacgacaatcaggacaacaacgatcaggaacagcagacgcctgatatcgacaaggcgctggacgaggtgatcctcgccgccgtcaaggctgcgatgccgcccggcgtgctggaggcgatgcgcgcctcggccggacgcgcgcgtgcccgctcggccggcaaggccggcgaactgcagaagtcgaagaagcgtggccgccccgccggcagcatccgcggcgaactgcgcgacggctccaagctcaacgtgatcgagacgctgcgggccgcagcgccgtggcagccgctgcggcggcgccaggccgagggacgcaacggcagcgcgccgcgcatcctggtcgagaaggacgatttccggatcgcgcgcttcaagcagcgcaccgagaccatcaccatcttcgtggtcgatgcgtcggggtctgcggctttgcaccggctcgccgaagccaagggcgcggtcgagttgttacttgcggattgctatgtccgccgcgatcaggtggcgatgatctcgttccgcggcaccatcgccgagatcctgctgccgccgacgcggtcgctcgcgcgcgccaagcgcagcctcgccggcctgccgggcggcggcggcacgccgctgtcagccgggctcgactgcgcgttcatgctggcggattcgatcaagcgcaaaggccagacgccgacggtgatcgtgctcaccgatggccgcgccaacatcgcgcgtgacggcgcaccgggccggccgcaggct

SEQ ID NO: 44124 - DNA, 1020 bp, Rhodopseudomonas palustris
ctggtgaccaaaccgttcatggaagtgctttccggcaaccggcaggcctctcctccgatgtggatgatgcggcaggccggacgttacctgccggaataccgcgcaacgcgggcgcaagccggtagtttcctcgatctgtgctttaatgcggagctcgccgccgaggtgacgctgcagccgatccggcgattcggcttcgacgcggcgatcatcttctccgacattctggtggtgccttacgcgctcggccgctcggtgcggttcgaagtcggcgaaggcccgcggctcgacccgctgaattcgcccgatctggtcggcacgctgaacaacgcgatcgatctctccaagcttgagccggtattcgaagcgctgcgcatcgttcgccgcgaactgaagccggagaccacgctgatcggcttctgcggctcaccgttcacggtcgcgacctacatggtcgccggccagggcacctcggatcaacatccggcacgactgatggcgtatcagcaccccggcgcgttcgccaagatcatcgacgtgctggtcgagagctcgattcagtatctgctcaagcagctcgatgccggcgccgacgtgctgcagatcttcgacacctgggccggcatcctgccgccgcgcgaattcgagaagtggtgcatcgagccgacccgccggatcgtcgagggcatccgcaaggtcaagccgggcaccaagatcatcggcttcccgcgcggcgccggcgcgctgctgccggcgttcgtcgaacgcaccggcgtcgacgccgtcagcatcgactggaccgccgaaccggcgttcgtgcgcgagaaggtgcagaccaaggtcgcaattcagggcaacctcgatccgctgctgctgatcgccggcggctcggcgctcgaccaaggggtcgacgacgtcctgaacaacttctcgtcgggccgtcacatcttcaatctcggccacggcatcacgccggacgcgccgatcgctcacgtcgagcagatgatcaagcgcgtccgc

SEQ ID NO: 44125 - DNA, 1494 bp, Rhodopseudomonas palustris
cctgctccccgtccttctcgcgatcgtgccccgcatgcggtggtgatcggctctggtttcggcggcttggccgcagcggtgcgtcttggcgccaaggggtatcgagtaaccgttcttgaaaagctcgataaggccggcggccgcgcttacgtccacaagcaggacggcttctcattcgacgccggtccgaccatcgtcaccgcgccgtatctgttcgaagagctgtggaagctgtgcggcaagcggatgtcggacgacatcaccttgaagccgatgtcgccgttctatcgcatccgcttcgacgacggcacgcacttcgattactccgacgaccgcgacgcggtgctcgaccagatcgccaagttctgcccggacgacgtgccggcctatgaccgcttcatggcggcctcgcacgagattttcaaagtcggtttcgagcagctcggcgatcagccattcagtcacttcaccgacatgctgaagatcgcgccggcgatgatcaagctggagagctatcgcagcgtttacggcctcgtcgccaagcacttcaaggatccgaagctgcgccaggtgttcagcttccatccgctgctgatcggcggcaacccgttcatgtccagctcggtgtactgcctgatcacctatctggaaaagcagtggggcgtgcattcagcgatgggcggcaccggcgcgctcgtcaccggtctggtcaacctgatcgagggccagggcaatacgatccgctacaatcaggatgtccgccagatcgtcgtggaaaacggcaccgcgtgcggcgtcaagctcgccgatggcgaggtgattaaggccgatatcgtggtgtccaacgccgattcggcctcgacttatcgctatctgctgccgccggagacgcgcaagcgttggaccgacgccaagatcgagaagtcgcgctattcgatgagcctattcgtctggtacttcggcacgaagcgtcgctacgaagacgtcaagcaccacaccattctgctcggaccgcgctacaaggaactgatcagcgacatcttcagccggaaggtggtcgccgaggatttcagcctgtatctgcatcgcccgactgcgaccgacccgtcgctcgcgccgcagggctgcgacactttctacgtcctgtcgccggtgccgaatctgctcggtgatactgattggcacaccaaggccgagacttatcgcgcctcgatcgccaagatgctcggtgcgaccgttctgcccgatctggaaaaccagatcgcgacctccaagatcaccacgccgatcgatttccaggaccggctgtcgtcgttccgcggcgcggcgttcggtctggagccggtgttgtggcagagcgcctggttcaggccgcacaatcagagcgaagacgtcaaacgcctttatctcgtcggcgccggaacgcatcccggcgctggcctgcccggggtactgtcctcggcgcgggtactcgatgcgctggtccccgaggcc

SEQ ID NO: 44126 - DNA, 825 bp, Rhodopseudomonas palustris
tggttcgaggggctgcgcgacaggatctgcgccgagatcgaaacgctggagcgcgaagcgccggcggagctgtttcccggtgagccggcgaccttcacctacaagccgtggcagcggaagaccggtgccggcggcggtgtcggcggattcttgtcgaacgggcggctgttcgaaaagatcggcatccacacctcgtcggcgaacggcaagctgaccccggagatggccaagaacgtgccgggcgatggcagcctggactacgtctccaccagcatcagcctgatcatgcatccgcgtagcccgcgggtgccgaccgtgcatatgaatacgcgatttttgtcgacctcgcaggggtggttcggcggcggtgccgacctgacgccgatgctgccggagcagcgcagccaggacgccgaagacgcggtgatcttccacaccgcgatgaagcacgcctgcgacgctcacgatccggcctattacgacaagttcaagccctgggccgacacctacttcttcctgccgcatcgcggcgtcgcacgcggcgtcggcggaatcttcttcgactatctcaacagtggcgatttcgatcgcgactttgccttcacccgcgccgtcggttcagcgctgctcgacgtctatcccaagatcgtgcgcaagcgcatgatcgaaccgtggaccgacgcggagcgggcgcagcagctcgcctgccgcgggctctatgtcgagttcaacctgctctacgatcgcggcacgatgttcggtttgcagaccggcggcaataccgagaccatcatgagctcgatgccgccgctggtgagctggagc

SEQ ID NO: 44127 - DNA, 1488 bp, Rhodopseudomonas palustris
aatcgcgtcgtagtgatcggcgccggcgtcgcgggactgacgtctgcgctgacgctggccgcacgcggcttcgacgtcaccgtgcttgaacgcgccgccgcccccggcggcaaaatgcgcgaagtggccatcggtcccgcgcggatcgacagcggcccgaccgtgttcacgatgcgctgggtgttcgaggagctgttcgccggcatcggcctgaacttctccgaccatgtgcgcctacgacctttgtcggtcctggcccgccacgcctgggacgacacccagcatctcgacctgttcgccgatgaggcacgctcggccgatgcgatcggcgctttcgccggtgctgcggaagcgaagcgttatcggcagttttgcgccgacagccggcgcatctacgagattctggaaaagccattcctacgcgccaccgcgccgagcctgccgaagctggcgaccgccggcggcctcagcggcctgctcgagctgcgcaagatccgcccgttcactacgatgtggaaagcgctcggcgattacttccacgatccgcggatgcggcagttgttcggccgctatgcgacctattgcggttcctcacccttcgatgcgcccgcgacgctgatgctggtcgcccatgtcgaacacgaaggcgtctggatcatcgaaggcggcatgcatgccctggcgcaggcgctcgccgattgcgccaccagcttcggcgccacgattcgctacgagcagagcgtgcgcgaggtgatggtttccggcggacgcgctgccggcgtggtcctggaaagcggcgagcggatcgaagcgcattcggtgatcgtcaacgccgatgtcggtgcgctgccggccggactgttcggcgaagcggtgcgctctgcggccgcaccgttggcgccgcggttgcgatcgctgtcggcgatgacctggagcatggtggcgaaaactgagggcttcccactgagccgccattcggtgttcttctcgcgggattatccacgggagttcaccgagatcttcggccgcggcgaggtgccgagcgagccgaccgtgtatgtctgcgcgcaggaccgcatcgacgacgaggcacgcttggcggcaggcggcgaagaggaattgctggtgctgatcaacgcgccgccggtcggcgatcgcaagagcttcgatcaagccgaggtcgcgcgcgccgccgaacgcgcgttcggcgtgctgcagcgttgcggactgcggatcgatgccgatccgggcaagacccaggtgacaacgccggcggatttcaaccggctgttcccggccaccggcggcgcgctgtatggtcgcgcctcgcacggctggagtgcctcgttcgaacgtcccggagcgggtacaaagatcgccggcctttatctggccggcggcagcacccacccgggccccggcgtgccgatggccgccctgtcgggtcgcgctgcggcggcgaccctgttcgccgatctcggcttcaca

SEQ ID NO: 44128 - DNA, 843 bp, Rhodopseudomonas palustris
atggacgtgaccaatcggatcgagcgtgctctgacagaagcgctcaatcaggccgacatggccggatgtccgccgcggctggcggcagcaatgcgcagtgcggtgttcccgcgcggggcgcgcgttcgtccgcggctctgccacagcgtggcgcttgcttgcggcgaagacaatccgggaattaccgaagctgccggtgccgcacttgagctgatgcactgtgcctcgctgatccatgacgatcttccgtgcttcgatggtgccgacctgcgtcgcggccgcccgtcggtgcacaaggcgttcggggaaccgctcgcggtgctcgccggtgacgcgatgatcgtgctggcgttccagaccatcgcgcgggccgagggccaggcggaccgcctgctgaagctgacccagatcatcggcggcgccgtcggcgtgccgttcggcatcgtcgccggtcaggcctgggaatgtgagaccgaaatcaatctcgcccattatcaccgctctaagaccggcgcgctgttcgtggccgcaaccgcgatgggcgcggcttcggccggctccgatccggagccgtggcggatggtcggtgagaagatcggcgaagcctatcaggttgccgacgatttgcgtgacgctgccgccgatgtcgaagagatcggcaagccggttgggcaggacgtcgcccacgatcgccccagtgcggtgcgcgagatgggtatcgatggcgcgatctaccacctgaagtcgctggtgcgcggcgccgtcgaggcgatgccggaatgcaccaatggcaacgagctgcggtcgctgatcatgtcggaagcgacacgcctggtgccggcg

SEQ ID NO: 44129 - DNA, 1443 bp, Rhodopseudomonas palustris
atgctcgtcctcgatcacgatcgcgccggcggctattggggcgccgtgtacgccttcaccgcggtgaagggcctgcaggtgattatcgacggtccggtcggttgcgaaaacctgccggtgacctcggtgctgcactacaccgatgcgctgccgccgcacgaactgccgatcgtcgtcaccggcctcggcgaagaagaactcggcaagctcggcaccgaaggcgcgatgcaccgcgcccataaggcccttgatccctatctgccggcagtcgtggtcaccggctcgatcgccgagatgatcggcggcggcgtcacgcccgaaggcaccggcatcaagcgcttcctgccgcgcaccatcgatgaagatcagtggcagagcgccgaccgcgcgatctcgtggctgtggaaagaatacggcccgaagaagattcccgagcgcaagcgcaaggatggcgagaagccgcgggtcaacatcatcggaccgatctacggcaccttcaacatgccgtccgatctcgccgaaatccgccggttgatcgaaggcatcggcgccgaagtcaacatggtgttcccgctcgggacgcaccttgctgatattcccaagctggtgaatgccgacgtcaacgtctgcatgtatcgcgagttcggtcggctgctgtgcgaatcattggagcgcccgtacctgcaggcgccgatcggcctgcattcgacgacgcgcttcctgcgcaagctcggtgagctcaccggcctcgatcccgagccgttcatcgagcgcgagaagaacacgaccatcaagccgctgtgggatctgtggcggtcggtgacccaggacttcttcggcaccgccagcttcgcggtcgtcgccacggatacctacgcccgcggcgtgcggcatttcctcgaagacgagatgggtctgccgtgcaccttcgcggtctcgcgctgcgtcggcaagaagaccgataacgaagcggtgcgtgcggcgattcgccagactccgccgctgatcatgttcggcagctacaacgaaagaatgtacttggccgagaccggtggtcgcgccgtgtacattccggcgtcattcccgggtgctgtgatccgccgtcacaccggcacgccgttcatggggtattccggcgccacttatctggtgcaggaagtctgcaacgcgctattcgacgcgcttttcaacatcctgccgctcggcagcgacctcgatcgcgtcgatccgacgccggctcgccggcatgaagaattgctgtggagcgatgaagccaaggcgctgctcgacgaagtgctcgagcagcacccggtgctggtgcggatctctgcggcaaaacgtctgcgcgatgccgctgaaaacagcgcacgtcgtgccggacaggaaaaagtcactaccgagttcgtcagtaaagcgcgtgcggcgctgctcgacgggcaatcg

SEQ ID NO: 44130 - DNA, 849 bp, Rhodopseudomonas palustris
ccagcgccctcggcggtgctcgaggtgctgcacccgatcacctggtttccgccgatgtgggcgttcggctgcggcgtggtgtcgtccggcgtgccgatctcgtcgcgctgggtggaagtgattgccggcatcgtgctgtgcggcccgctgctggtcgccaccagccaggtcgtcaacgactggttcgatcgcgacgtcgacgccatcaacgaaccgaaccgtccgattccgtcgggccgcattccgggacgctggggcctgtatctgtcgttcctgtggaccgcggcctcgctgctggtcgccagccagctcggcgcctgggtgttcggcgccgctgtgctcggcctggtgctggcctggatgtattcgatgccgccgttccgcctgaagcagaacggctggctcggcaacggcgcctgcgcgatcacctatgagggcttcgcgtggttcaccggcgccgcggtgatgctcggcggcctgccgccgtggtggatcgtcacgctcgcgctgctctacagcgccggcgctcacggcatcatgacgctcaacgacttcaagtcgatcgaaggcgacatcaagaccggcgtcggctcgctgccggtcaagctcggcgtcgacaacgccgcgcgggtgctctgtgccgtgatggcgatcccgcaggtgatcgtggtggcgctgctgctgtcgtgggatcggccgatccaggccggtatcgtcggcttcgtgctcgccgtccagctcgccttgatggtgcggtttctgcgctcgccggtcgagcgcgccacctggttctcgggcctcggcgtcgcgctgtatgtttccggcatgatggccagcgccgtcgccgtt

SEQ ID NO: 44131 - DNA, 1179 bp, Rhodopseudomonas palustris
tatgatgtcgttgtcgtcggcggcggccctgccggcgctactgcggcgtgcgatctggcgcgcgccggcaagcgggtggtgctgctcgaccgcgccggccgcatcaagccgtgcggcggcgcgatcccgccgcgcgcgatccgcgatttcgcgattcccgacagcatgctggtcgccaagatcaacgccgcgcggatggtgtcgccgagcaatgtcgaagtcgacatgccgatcgacggcggcttcgtcggcatggtcgaccgcgagcatttcgacgagtggctgcgccagcgcgccgcgaccgtcggcgccgaacggcgcaccggcctgttcaagcggttcagccgcgacgagtccggcgtcaacaccgtgcactatgaagggcgcggccccgacggttcgatgatcgaccagacggtgcgctgccgtgcgatcatcggcgccgatggcgcggtgtccggcgtggcgcggcagttcctgaaggatgccgaccgcgtgccgttcgtgttcgcctatcacgagatcatcaaggcgccgacggcggagcagaaggccgcctatgaaagccgccgctgcgacgtgtactaccagggccacgtctcgccggacttctacggctgggtgttcccgcacggcaatacggtcagcgtcggcaccggctcgatgcacaagggcttctcgctgcgcgattcggtcgcggagctgcgcaagcagaccggcctcgacgaggtcgagaccatccgcaaggaaggcgcgccgatcccgctgcatccgctgccgcgctgggacgacggccacagcgtgctgctcgccggcgatgcggcgggcgtggtcgcgccggcctcgggcgagggcatctactacgcgctgctcggcggccggctcgccgccgaagcggtcgaggaattcctgcagaccgccgacgccaaggcgctgaagctggcgcgcaagcgcttcatgcgcggcaacggttcggtgttccggatcctcggcctgatgcagtggtattggtacgccaacgacaagcgccgcgaacaattcgtcagcatctgccgcgatcgcgacgtgcagaagttgacgtgggacgcctacatgaacaaaaagctggtccgggcgaagccgatcgcccacgtccggatcttcttcaagaacctggcccacatgacggggctggcttcg

SEQ ID NO: 44132 - DNA, 1248 bp, Rhodopseudomonas palustris
accgcggatcaactggtgtctcgcgaaatccgcaccgagagcgggcagcgcgaagtgttctgcgggctgaccggcatcgtctggctgcatcgcaagattcaagatgcgttcttcctggtggtcggttcgcgcacctgcgcgcatctggttcagtcggccgccggcgtgatgatcttcgccgagccgcggttcggcacggcgatcatggaagagaaggatctcgccggtctcaccgacgccaatgacgagctcgaccgtgtggtgacgcagcttctggcgcgtcgtccggacatcaagctgctgtttctggtcggctcgtgcccgtcggaagtgatcaagctcgatctgtcgcgcgccgcgctccgcctgtcgcagcggttctcgcccggcgttcgtatcctcaactactcgggcagcggcatcgagaccaccttcacccagggtgaagacgcgtgtttggcgtcgctggtgccggaactgccggcccagaccgataccaagccgtcgctgctggtggtcggttcgctcgccgatgtggtggaagatcagttcgcgcggatgttcgaggcgctcggcgtcggcaacgtcgcgttcttcccgccgcgcaaatcgaccgcgctgcccagcgtcggaccgaacaccaagattctgatggcgcagccgttcctgcccgacactgtgcgggcactggaagagcgcggcgccaagcgtctcgcggcgccgttcccgctcggcgtggaaggcaccaccggctggctgcgtgcggctgccgatgcgttcggtgtcgacccggcgaagttcgagcaagtcactgcgcccaatcgcgcccgcgccgagcgcgcgctctctgcgttcaagagcgagctcggcggtcggcgaatcttcttcttccccgactcgcagctcgagatcccgctggcacgcttcctgtcgcgtgaactcgacatgcagctcgtcgaagtcgccacgccgtatctgcaccgcgaacatctcgccgaagagctgaagctgttgccgatcgaagtcgcgctgaccgaaggtcaggacgtcgacgatcagctcgaccgctgccgcatcgcgcgtcccgatatcgtggtgtgcggcctcggcctcgccaatccgctcgaagcggaaggcatcaccaccaaatggtcgatcgaactcgtgttcaccccgatccagggttacgagcaggcggccgatctcgctgaattgttcgcgcggccgctggtgcggcgcgccaagttg

SEQ ID NO: 44133 - DNA, 1593 bp, Rhodopseudomonas palustris
atgcagctcaccgtatggacctatgaaggccctccccatgtcggcgcgatgcgcgttgccacgggtatggagaaattgcactacgtgctgcacgctccgcagggtgacacctacgccgatctgttgttcacgatgatcgagcgccgcaacaagcggccgccggtgacctacacgacgttcgccgcgcgcgatctcggcaaggacaccgccgagctgttcatgagcgcggcccgcaatgcctacgcgcgcttcaagccgcaggcgatgattgtcggcgcgtcctgcaccggctcgctgattcaggacgatccgggcgggctcgccaagtcgctcgggttctctatcccggtgatcccgatcgatctgccggcgtatcagcgcaaggaaaactggggcgcgtccgagacgttctatcagctggtgcgcgcgatcgccggtcccaaggcgccggcgcccggtaccaagcgccctgaacgggccgcaggtcagcgcgccaagtgcaatctgctcgggccgaccgcgctcggcttccgccatcgcgacgacatcaccgaaatcaccaggctgctcggccagctcggcattgacgtgaacgtggtggcgccgatgggcgcgacgccggcggatctgacccggctcggcgaggccgacttcaacgttgtgctgtatccggaagtcgcctcgcaggcggcgtcctggttgcagcggatcttccatcagccgttcaccaagacgattccgatcggcgtgtcggcgacgcgcgaattcgtgcgcgaagtcgcgggtcttgccggcgtcgatccggagccggtgctggctgcggcatcgacccggctgccctggtactcgcattcggtcgactcgacctacctgaccaacaagcgcgtcttcatcttcggcgatgccacccatgcgatcgcctcggcgcgaatcgcgtcggaggagcttggcttcaaggtggtcgggctcggcacctacagccgtgaattcggccgcgacgtccgcgaggcggcggcgaaatacggcgtcgaggcgctgatcaccgacgactatctcgaagtcgaagccaaggtcgccgaactgcatccggagctggtgctcgggactcagatggagcgccacatcgccaagcgcctcggcgtgccctgcgcggtgatctcggcgccggtgcatgtccaggatttccccgcgcgctatgcgccgcagatgggcttcgaaggcgccaatgtgatcttcgacacctgggtccatccgctgatgatgggcctcgaagagcatcttctggcgatgttcaaggacgatttcgaattcaaggacggcgcgctgccgtcacatctcggcaccggccacgcaccggcttccgcgcccgcagcggcggaggtcgccgttgcgctgccgcaaagcgcgccggttctcgacggtgcagcatctaacccggctccggtcgcaaccgcccccacaggggccgtgtgggcgccggaagccgaaaaggaactgctgaagataccgttcttcgtccgcggcaaggctcgccgaaataccgagcgcttcgccaacgaaaacggtgtcgcaaccattactgtcgagaccttg

SEQ ID NO: 44134 - DNA, 3735 bp, Rhodopseudomonas palustris
acgatgccaaagcgcacttcgcccgctgacaagaccccggttcgggtcgtcatcgtcacgctggacagccatttgtccggtgccgccgcacgtgctcgcaacgtgttgcggaaggattatcccggaatcgagctgacggtgcactccgccgacgagtgggggagcgacggacacgcgctgcagcgctgcctcgccgacatcgccaccggcgacatcatcattgccaccatgctgttcatggacgatcacgtccgtgcggtaatgccggcgctgcaggcgcggcgtaccgaatgcgacgcgatggtgtgctgcatgtcggcctccgaggtggtgaagctcacccacatcggcaagttcgacatgagcgccgaagcgctcggcatgatcaattggctgaagaagctgcgcggcaagaagcacgaaggctcggccggcaagggcgagatgaagatgctgcggcagctgccgaagctgctccgcttcgtgcccggcaccgcgcaggacatgcgcgcctacttcctgacgctgcagtactggctggccggttgcgagcagaacatcgccaacatggtgcggctgctgatcgaccgctacgcgagcggtccgcgcaagggtctgcgcggcgtcgccaaggtcgagccgccgctcgaatatcccgatatcggcgtgtaccacccgaagatgaagggccggattgccgagtcggtcgacaagctgccgacgggcccgagcgaggccaagggcacggtcggcgtgctgctgctgcgctcctatctgctcgccggcaatgccgggcattatgacggcatgctggagacgttcgaggccaagggcctgcgcgtgattcctgtgttcgcctcgggcctcgatcagcgcccggcgatcgagcagttcttcatcaagaacggccgtcccacggtcgatgcggtggtgtcgctcaccggcttctcgctggtcggcggtcccgcctacaacgactccaaggcggccgaagacatcctcgccgcgctcgacgtgccgtatctgtcggcgcatccggtcgagttccagacgctggagcagtgggcgacgtccgatcgcggcctgatgccggtggaaagcaccatcatggtggcgatccccgagctcgacggctgctccaacccgatggtctatggcggccgctccgacggcggcgacgtcgcctgcccgggctgcgagaagttctgcaagttcgagcgcaacgaaagcggcggcgacatgcatgtctgcagcgagcgcgccgaaatgctggcgtcgcgcaccgccaagctggtggcgctgcgccggagcgaacgcaaggaccgcaaggtcgcggcggtgctgttcaacttcccgccgaacgccggcaacaccggcaccgcggcgttcctcggcgtgttcgagtcgctgttcaacacgctgaaggcgatgaaggccgaaggctacaccgtcgaagtgcccgaaagcgtcgacgcgttgcgcgaggcgatcatcaacggcaatgcggcacggttcggcgccaatgccaacgttcatgcccgcgtgatggccggcgatcacgtcaagaacgaacgctatctgcgggagatcgaagcgcagtggggtccggcgcccggcaagcagcagagcgacggctcgtcgatcttcattctcggcgagcgcttcggcaacgtgttcgtcggcgtgcagccggcgttcggttacgaaggcgacccgatgcggctgctgttcgagaaggggtttgcgccgacgcacgccttctcggcgttctatcgctggatcaagcaggacttcggcgcccatgcagtgctgcatttcggcacccacggtgcgctggaattcatgcccggcaagcagaccggcctgtccggcacctgctggcctgatcgcatgatcggcgatctgccgaacatgtatctgtacgcctccaacaacccgtccgaaggcgcgatcgccaagcggcgttcggcggcgacgctggtcagctacctgaccccgccggtcgcgcatgccggcctgtatcgcgggctgctcgagctgaagtcttcgctggagcgctggcgcggcctgacgccggaggaagagaccgagcgcgcgaatctcgcgacgctggtgcaggcgcaggccgccggcctcgacctcgccccggccgaaccggcctggaccgccgaagaggcgggggcgaccatcgccaagctcgccgactccgtgctcgagatggaatacgcgctgatcccgcacggcctccatgtggtcggcaacgtgccgtccgaagaggagcgggtcgagacgctggaagccgttgcggatgcgatgcacggcaagcggccggacaagtccttgctcgaagcgctggtgcgcggcggtcatcccgagcatctgtccgggaatggtcccgaggctcaggccaatctcgacatgctcaaggagctggccgggatcgacaagctgctcgccgaggatcacgaactcgccgcgatcctgcgcgcgctcgacggcaagttcatccgtccggcgccgggcggcgacctgctgcgcacgcccgcggtgctgccgaccggccgcaacctgcacggcttcgatccgttccggattccgtcggcctacgcgctgcaggacggcgccaagcaggcgcagcggctgatcgacaagcacatcgccgagggcaatccgctgcccgagacggtcgcgatcgtgctgtggggcactgacaacctcaagaacgaaggcgcaccgatcggccaggcgctggcactgatgggcgcccggccgcggttcgacggctacggccgtctcgccggcgccgacctgatcccgctcgaagagctgggccggccgcgcatcgacgtgatcatcaccatgtcgggcatcttccgcgacctgctgccgctgcagatcaagctgctcgccgaagccgccttcatggcggcgagcgccgaggagccggccgagcagaacttcatccgcaagcattcgctggcctatcaggccgagcacaaatgcgacatggagaccgcgtcgctgcgggtgttcggcaatgccgacggtgcctacggctccaacgtcaaccatctggtcgagaacagccgctgggaagacgaggacgagctcgccgagacctataccaagcgcaagagcttcgcttacggtctcaagggccagccagtgcagcacgccgaactgctcaagagcgcgctcgccgacgtcgatctcgcctatcagaacctcgactcggtcgagctcggcgtcaccaccgtcgatcactacttcgacacgctcggcggcatcagccgcgcggtgcgcaaggcgaagggcggccaggctgcgccggtgtatatcggcgaccagacccgcggcgccggtaccgtccggacgctgtcggagcaggtcgcactcgagactcgcactcggatgctaaatccgaagtggtacgagggcatgctcaagcatggctacgaaggcgtgcgccagatcgaagagcacgtcacaaatactatgggctggtcggcaaccacgggtgaagtcgcgccgtgggtgtacaagcagctcaccgagaccttcgtgctcgaccctgaaatgcgggcacgcctcgccgcgctcaatccggtggcttcggcgaaggtcgccaaccgcctgatcgaagcgcacgaacgcaactactggtctccggacccggaaatgctcgagaccctgcgcaaggcaggcgaagagctcgaggatcgcctggaaggcgtg

SEQ ID NO: 44135 - DNA, 1209 bp, Rhodopseudomonas palustris
atgaactacgaagcctatttcaagcggcagatcgaaggcctccatcgcgagggtcgctatcgcgtgttcgccgacctggagcgtcatgcgggttcgttcccgcgcgcgacccaccaccggcccgagggcaccaatgaagtcacggtgtggtgctccaacgactatctcggcatgggccagcacccggcggtgctgagcgcgatgcacgaggcgctggactcctgtggcgccggcgccggcggcacccgcaacatcgccggcaccaaccactatcacgtgctgctggagcaggaactcgcggcgttgcacggcaaggaagccggactgctgttcgcctccggctatgtctccaactgggcgacgctgtcgacgctggcgtcgcgcatgcccggctgcgtgatcctgtcggacgagctgaaccatgcctcgatgatcgaaggcatccgccacagccgcagcgagacccggatcttcgcgcacaacgatccgcgcgacctcgagcgcaagcttgccgatctcgacccgcatgcgccgaagctggtggcgttcgagtcggtgtactcgatggacggtgacatcgcgccgattgccgagatctgcgacgtcgccgacgccgccaacgccatgacctatctggacgaggtccacggcgtcggcctgtacggtccgaacggcggcggcatcgccgaccgcgaaggcctcagccaccgcctcaccgtgatcgaaggcacgctggcgaaggcgttcggcatcgtcggtggctacatcaccggctcggcggcgctgtgcgatttcgtccgcagcttcgcctcgggcttcatcttctcgacttcgctgccgccggcggtcgccgccggtgcactggctagcgtccgccacatccgctccagttcggccgagcgcgaacgccaccaggatcgcgtcgcgcggctgcggatgcggctcgaccaggtcggcgtcgcccacatgccgaacccgagccacatcgtgccggtgatggtcggcgacgcggtgctgtgcaagcagatcagcgacgagctgatcaaccgctacggcatctacgtgcagccgatcaactatccgactgtgccgcgcggcaccgagcggctgcggatcacgccgtcgccgcagcacaccgatgccgacatcgagcatctggtgcaggcgctctctgaaatctgggcacgggtcggcctcgccaaggccgcc

SEQ ID NO: 44136 - DNA, 1641 bp, Rhodopseudomonas palustris
atggcggcatcgatgcgcgacatcaccgatctggtgcaggcggagcgcgaggttcacgacctcaacgccgcgctggagcggcaggtcgccgaacgcacctgccagctcgagaagaccctgacgctgcagaccgctatccttgaacgcgccgcctatgcggtgatcgccaccgacgtcaccggcaccatcacgctgttcaatccggccgccgagcggatgctgggctacaaggccgaggatctgatcggccgggcgagcgcgatgctgttccacgattccgacgaactcgccgcgcgcgccgaggcgatgcggaaagagggcatctcggtcagctccaatctcggcgtgctgcaggctcgcctggcccgcaacgatcccgacaccgcgatgtggacctacatcgatgccatgggcaaccggatcccgacccggctcacgctcagccggctgcgcaccaagaccggcgtcaacctcggcgtgctggggatcgccgtcgacctgaccgagcagctcaaatacgaggacgagctcaaggccgcgcgcgccagcgccgagcaggccagtgccgccaaggcggatttcctcgccaatatgagccacgaaatccgcacgccgctgaacggcatcatcggctatgccgatctcgtgctggaggacgagacgctggcgccggatacgcgccgtcaggtgatgcggatcttcgaggccagcgactcgctgcgggtgatcatcgacgacatcctcgatttctcgaagatcgaagcctgcgggctcaccctggaaagcaagccgctctacatcaacgagctgatcgccaattgcgcctcgatcatcgagccgaaggcggatgagaaggggctgaagctgatcgcgaccgcccaggcgacgccgccggtgctgatcggcgacgcaggacggctgcggcaggtgctgctcaatctgatgaacaacgccgtcaagttcaccacggccggctcggtcgagctgatcgtgtcgtgcatcgggcgggttgatcatctggtccggctgcgcatttccgtcgccgacaccggcatcggcatctcgccggaggcgcagaaggggctgttcaagcgtttcagccaggccgacgagacgatctcgcgcaaattcggcggcaccgggctcgggctggcgatctcgcagcggatcgtccaggcgatgcacggcgaactcaagatcgacagccagccgggcgtcggcagcacgttctatttcgaagtcgagctgccggtcgccgaacggctcgatatcgagcggctcgatgcgcaggtccattgcagtcgttcggtcaagatcctggtggtcgacgacgtcgagatgaaccgcgatctgtgcaagacgatgctgaccagggccggccacgacgtcgatctcgccgacagcggcgccaccgcgatcgcgatggtcgcgagccgcacctacgacctggtcttcatggacgttcagatgggcgaaatggacgggctcgaagccacccgccgcattcgtgcgctcggtcatgcttaccgggacgtgccgatcatcgcgctcacggccaacgtgcttcccgaacaggtggagcgctataaggcggcgggcgtcgacggccatctcggcaagccgatcaatcgcgccgaactg

SEQ ID NO: 44137 - DNA, 1611 bp, Rhodopseudomonas palustris
ttccagcaagctcgtgcctttctgctccaacaccgcaccgactacgacaaggccgtcgccggcttccgctggcctgatccggcgccgttcaactgggcgctcgactggttcgacgctgaactcgccgtccatcccgacagccgcgaccgcgcggcgctgtggatcgtcgacggcgccagcggcagcgaggtcaagccgacctttgcgcagctctccaagcgctccaaccaggtcgccaactatctgcgcgccaaggggctgaagcgtggcgatcatctgctgctgctgctcggcaacgtcgtgccgttgtgggagacgatgctggcggcgatcaagctcggcctcgtcaccattccggcgaccacgctgctcaccccggaggaattgcgcgaccggctcgaccgcggccgcgccaaggcggtggtggcggcgccggatcaggtcgccaagtttgccggcctcggcggcgacgatctgctccgcatcgtcgtcggcgacgcacaggacggctggctcgcttacgccgagaccgcacagcaacccgatgcgttcacgccggacggcccgacgaaggccgacgatccgatgctgctgtatttcacctccggcaccaccgcgaagccgaagctggtgcggcacagccagcgctcctatccggtcggcgcgctgtcgacgatgttctggcttgggctgcagcccggtgacgtgcacctgaacatctcctcgccgggctgggccaagcatgcctggagctgcttctttgcgccgtggaatgccggcgccaccgtgttcgtcgtcaaccagccgcggttcgatgccaagagcctgctcgccaccatcggccgctgcggcgtcaccacgctgtgcgcgccgccgacggtgtggcggatgttcatccaggagaagctggcggactatcatgtcagcctgcgagaggtctgcggcgccggcgagccgctcaatccggaagtgatcgatcaggtcaaagctgcgtgggggcttaccattcgcgacggctacggccagaccgagaccaccgcgatggtcggcaattcaccgggccagaaggtgaagatcggctcgatggggcggcctctgccgggctacgtcgtcaagatcaccgatgccgacggccatccggccaaggagggcgagatcacgctggcgctcggtgacgcgcgccccgccgggctgatgcagggttatcagggcgagggcggcaagctcacgggcgccgacggcgaggtgtatcgctccggcgatgtcgccttcgccgacgaggacggctatctgactttcgtcggccgcaccgacgacgtgttcaaatcctcggactaccggatctcgccgttcgaactcgagagtgtgctgctggagcacgacctcgtggctgaagccgcggtggtgccgagcccggatccgatcaagctggcgatcccgaaagcctatgtgctgctcaccgcgaacgctgagcgctcgcgcgacaccgcgctgtcgatcttcaagcacatgcagggccggctggcgccgttcaagcggatccgcaagctggagatcgtcagcgagctgccgaaaacgatctccggcaagatccgccgcgtccagctccgc

SEQ ID NO: 44138 - DNA, 1161 bp, Rhodopseudomonas palustris
caagatggacatgccttgacagccattgatcagttttccctcaacgaagatcagcgcgccattcgtgacatggcgcgcgacttcgcggccgagaagatcgcgccgcacgcgctgcaatgggatgaagacaagcacctgccgctggatgtgatccgggaagcggcggcgctgggcatcggcggcatctacattcgcgacgacgtcggcggcagcgcgatgacgcggttcgacgcggcgctgatcttcgaagcgctggcgaccggctgtccgtcggtgtcggccttcatctcgattcataacatggcggcgtggatgatcgacagctacggctccgacgcgcagcgtcagcgctggctgccgaagctgtgcagcatggagcaggtcgccagctactgcctgactgaaccgggttccggatcggatgccgcggcgctgcgcacccgcgcggtgcgcgacggcgatcactacatcctcaacggccaaaagcagttcatctccggcgccggcgccaatgacctctatgtcgtgatggtgcgcaccggcagcgacggtccaggcggcatctcgacgctggtggtcgagaaggacacgccgggcctctcgttcggtgccaacgagcgcaagatgggctggaacgcgcagccgacccgcaccgtcattttcgagaacgcgcgggtgccggtcgccaatcggctcggcgacgaaggcatcggtttcaagatcgcgatggccgggctcgacggtggccggctcaacatcggcgcctgctcgctcggtggtgcccaggcggcgctcgacaagacgctggcctacatgaaagagcgcaaggcgttcggcaaacggctcgacgaattccaggcgctgcaattccggctcgccgacatggcgaccgaattggaggccgcgcggacgctgctgtggcgcgccgccgcggcgctcgaccgcaaggacgccgatgccaccaagctgtgcgcgatggccaagcgcttcgccaccgatgctggctttggcgtcgccaacgaggcgctgcaactgcacggcggctacggctatctcgccgaatacggcatcgagaaactggtgcgtgacctgcgcgtgcaccagatcctcgaaggcaccaacgaaatcatgcggctgatcgtgtcgcgcaagctgctcgag

SEQ ID NO: 44139 - DNA, 1482 bp, Rhodopseudomonas palustris
gtcgggcatttcatcggcggcaaagaggtcgagggcaagtcggggcgtttcgccgacgtgttcgagccgatgaccggcgaggtgaaggccaaagtcgccctcgccaccaaagccgagctccgcgcagcggttgaaaacgccaaggccgcgcagccggaatggggcgccaccaacccgcagcgccgcgcccgcgtgctgatgaaattcctcgaattggtgcagcgcgattacgacaagctcgccgagctgctcgcgcgcgaacacggcaagaccatccccgacgccaagggtgacattcagcgcggcctcgaagtcgccgagttcgcctgcggcattccgcatctgatgaagggcgaatacaccgagggcgccggccccggcatcgacatctattcgatgcgccagccgctcggcgtcgtcgccggcatcaccccgttcaattttccggcgatgatcccgatgtggaagttcgccccggcgatcgcctgcggcaacgccttcatcctaaagccgtcggagcgtgaccccggcgtgccgatggcgctggcggcgctgatgctcgaagccggtctgccgccgggcatcctcaacgtcgtcaacggcgacaaggaagcggtcgacgccatcctcgatgatccggacatcaaggcggtcggcttcgtcggctcctcgccgatcgcgcagtacatctatgagcgcgccgcgcagaccggcaagcgcgcgcaatgcttcggcggtgccaagaaccacgccatcatcatgccggatgccgatatcgaccagaccgtggacgcgctgatcggcgctggctacggctcggcgggcgagcgctgcatggcgatctcggtcgcggtgccggtcggcaaggccaccgcggacgcgctgatgagcaagctgatcccgcgcgtcgaagcgctgaagatcggtccttccaccgatccgaccgccgattacggcccgctggtgaccaaggaagcgctggagcgcgtcaagaactacgtcgatatcggcgtcaaggaaggcgcgacgcttgcggtcgacggccgcggcttcaagatgcagggctacgagaacggcttctacatgggcggctgtctgttcgacaacgtcaccaaggacatgcggatctacaaggaagagatcttcggccccgtcctgagcgtcgtccgcgcccatgattatgccgaagcgctgtcgctgccgtccgaccacgactacggcaacggcgtcgcgatcttcacccgcgacggtgacgccgcccgcgacttcgccgccaaggtcaatgtcggcatggtcggcatcaacgtgccgatcccggtgccgatcgcctactacaccttcggcggctggaagaagtccggcttcggcgacctcaaccagcacggcccggactcgatccggttctacaccaagaccaagaccgtcacctcgcgctggccgtcgggcgtgaaggaaggcgcggagttttcgatcccgctgatg

SEQ ID NO: 44140 - DNA, 1508 bp, Rhodopseudomonas palustris
tggcggaatggcttgctgcgagtgcccggctgcggccgggcgctccggcgctgctgacgggcaccacggtcgatgccgactatgcgacattcgcgtcgcgcgcggcatcgttcggcgcggcgctggcgcgcgattacggcattgcgcccggcgaccgggtcgccttgttcgcacataattgcacgcgctatctcgaagcgctgtacggcatctggtgggcgggcgcggtggcgatcccgatcaacgccaaactgcacggcaaggaagtcgcctggatctgcagcaatgcggaggccaggctcgcgctgatctgcgacgacaccgccgacaccttcaatgaggcctcatacgatctgccgcccggcctggcggtgctggcgatcgacagcgacggcttcgatcgcgcgcgtagtggcgcgggtagcaaggcgccggtcgcgcgcgacgacgacgatctcgcctggctgttctacacctccggcaccaccggccgccccaagggggtgatgctcagccacggcaatctcgtagcgatgtcgctgagctatctggccgatgtcgacgcggtgacgcccgaggatgcggcgctgtatgcggcgccgatctcgcacggcgccgggctctacaacatgatccacgtccggttcggcgcccggcatgtcgtgccggagtccggcgggttcgatccggacgaggtgctcagcctcggcaagcagctcggcaacgtcgcgatgttcgcggcgccgaccatgatcaagcggctggtcgaagccgccaagcgtcgcggcgaaaccggcgaggggctgcgcaccatcgtctatggcggcggcccgatgtatctcgccgacattcgtgaggcgctgagcgtgatgggccagcgtttcgtgcagatctacggccagggtgaatcgccgatgacgatcacctcgctgaagcgcgcgctgcacgccgacgtcgatcatccgcgctatctgcagcggctcgcctcggtcggcaccgcgcagagcgtggtgtcggtgcggatcaccggtgcgaacggagaagtgctgccgccgggcgagaccggcgagatcgaggtcaagggttcaaccgtgatgctcggctattggaacaatccgcaggccaatgccgagacgctgaaggacggctggctgcgcaccggcgatgtcgggcgcctggacgacgacggcttcctgacgctgtcggaccgctccaaggacgtcatcatctccggcggcaccaacatctatccgcgcgaggtcgaggaagcgctgctgacgcatccggctgtgcgcgaagtgtcggcgatcggcgtcgccgatccggaatggggtgagaatgtcgtcgcctgcgttgtgcttaccgatggcgccgcggctgacgacgccacgctcgatgcccactgcctcgccaccatcgcccgcttcaagcgccccaagcgttacgtctatctcgacgcgctgccgaagaataattacggcaaggtgctgaagacggaactgcggaag

SEQ ID NO: 44141 - DNA, 1149 bp, Rhodopseudomonas palustris
gccagcatcgttggatgggcccatatgccgttcggcaagttcgacgccgaaaccgtggaaagcatgatcgtccgtgtcgccaccgaggcgatcgccgacgccgggatcgcggcctcggacgtcgacgagatcgtgctcgggcatttcaatgccggcttctcgccgcaggacttcaccgccgcgctggtgctgcaggccgatccggcgctgcgcttcaagccggcgacgcgggtcgagaacgcctgcgccaccggctcggccgccgtgcatcagggcatccgcgcgatcgaagcgggggccgccaagatcgtgctggtggtcggcgtcgagcagatgacccgcaccccggggccggagatcggcaagaacctgttgcgcgcctcttacttgcccgaggacggcgacacgcccgccgggttcgccggggtgttcggcatcatcgctcagaagtacttccagaaatatggcgaccagtccgatgcgctggcgatgatcgccgccaagaaccaccacaacggcgtcgccaacccctatgcgcagatgcgcaaggatttcggcttcgagttctgccgcgccgaaggcgagaagaacccgttcgtcgccggtcctttgaagcgcaccgattgctcgctggtgtcggacggcgccgcggcgctggtgctgacctcggcggagaatgccaaggcgatgggcaaggcggtcaacatccgcgcccgcgcccatgcgcaggactttctgccgatgtccaagcgcgacatcctgcagttcgaaggctgcaccgtcgcctggcagcgcgcgctggagcaggccggcgtcacgctgaacgatctgtcgttcgtcgagacccacgactgcttcaccatcgccgagctgatcgaatacgaagcgatgggcttgacgccgaaggggcagggcgcccgtgcgatcaaggagggctggacccagaaggacggcaagctgccgatcaatccgtctggcggtctcaaggccaagggccatccgatcggcgccaccggtgtgtcgatgcacgtgctgagcgcgatgcagctgcttggccaggcgccggaaggcatgcagatcaaggatgccaagctcgccggcatcttcaacatgggcggcgcggcggtcgccaactacgtgtcggtgctc

SEQ ID NO: 44142 - DNA, 1062 bp, Rhodopseudomonas palustris
atggcgtcggtgcagattcacgacgtgcgtaagtctttcggcggcttcgaagtattgcacggcgtgactgttcccatcgaggatggtgagttcgtcgttctggtcggcccgtccggctgcggcaaatccactttgctgcggatgctcgcagggctggagaagatcaccgccggaacgatctcgatcggtgagcgcgtcgtcaacgacgtgcagccgaaggagcgggacatcgccatggtgttccagaactacgcgctgtatccgcacatgaccgtcgcccagaacatgggcttctcgctgaagctgcgcggcgccgaccagaaggccatcgacagcaaagtgcagcgggcggccgacatcctcgatctcggcaagctgctcgaccgctatccgcgccagctctccggcggccagcgccagcgcgttgccatggggcgggcgatcgtgcgcgatccgcaggtgttcctgttcgacgagccgctgtcgaacctcgacgccaagctgcgggtggcgatgcgcaccgagatcaaggagctgcatcagcggctgaagaccaccacggtttacgtcacccacgatcagatcgaggcgatgacgatggccgacaagatcgtggtgatgcaggacggtatcgtcgagcagatcggggcgccgctcgacctgtacgaccggcccgacaataagttcgtggccggcttcatcggttcgccggcgatgaacttcctcgacggcacgctgaaagtgaacggcggccaaccttatgtcgagaccgccagcggcgccaagctgccgatcgccgcggcacctgcgaacggcaatggccgcgcggtgtcctacggcattcgccccgagcatctcgactttgcagatagtggcatcccggccgaggtcgcggtggtcgaaccgaccggctcggaaacccagatcgtggcccgggtcggcaatcaggaagtgatcgcggtgtttcgcgagcggcatccggtcgggcccggcgatctgatccatctgcagccgcgcgccgacgtcgcgcatctgttcgacaaggagagcggccggcggatc

SEQ ID NO: 44143 - DNA, 723 bp, Rhodopseudomonas palustris
cggctgacaggcaagcgcgcgttcgtcaccgcggcagcggcggggatcgggcgggcatcggcgatcgcttttgctcgcgagggcgccgaagtattcgccaccgatatcgatgaggccgggcttgcctcgctcgccgagcacggcattgcgcggaccgccaagctcgacgtccgcgacaccgccgcggtcgaagcgatcgcccgcgaggccggcaccgtcgacatcctgctcaacgctgccggcttcgtgcatcatggcacggtgctcgactgctcggatacggattgggacttttcgttcgacctcaacgtcaagtcgatgcaccgcaccatccgcgcgtttcttcctgcaatgctggaagccggccgcggctcgatcgtcaacatctcgtcggccgccggcgtgttcaaggcggcaccgaaccgctacgtctatggcgccaccaaagccgcagtggcggcgctgacccgcgcggtcgcggtggacttcatcactcgcggcatccgctgcaacgcgatctgcccggggacgatcgaaaccccgtcgatgctcggccgtgccgccgcgctcgggccgcagggccgcgagatgttcgtgtcacgccagccgatgggccgtctcggcaacgccgaggagatcgccgcgctggcggtgtacctcgcctccgacgaaagcgccttcaccaccggcgtcgcgcacatcatcgacggcggctggacgttg

SEQ ID NO: 44144 - DNA, 720 bp, Rhodopseudomonas palustris
ctcaaccaccgctgcgccgtggtcaccggcggggcgcagggcatcgggcgggcgatcgcggagcggttcgttgcgtcgggtgccaaggttgcgctgtgggaccacgatgtcgcgctggccgagcggaccgccaaggagatcggcgacgatgcgacgatcgcggtggcagtcgacgtcaccgatccggctgcggtcgaccgcgcgcgcgacgcgacgctgcaggcgttcggcaagatcgatatcctggtcaacaatgccgggatcgccggcgtcaacaagaccgtgtgggagaccgactacgccgagtggcagcgggtgttgaagctgaacctcgacggcccgttcctgtgctgcaagtcggtggtgccgtcgatgatcgcgcataaatacggccgcatcgtcaacatcgcctcgatcgccggcaaggaaggcaacccgaacgccgcgcactactcggcctcgaaggccggcgtgatcgcgctgacgaaatcgctcggcaaggagctggcggcctacgacatcgccgtcaacgcggtgacgccggccgcggcacgcacggcgatcttcgaccagatgacgcaacagcatatcgacttcatgctgtcgaagatcccgaagggccgcttcgtgctggtcgaagaagtcgccgccctggtggcgtggctggcctcggaagactgcgcgttctcgaccggcgcggtgttcgacatctccggcggg

SEQ ID NO: 44145 - DNA, 807 bp, Rhodopseudomonas palustris
ggttacatccccgatctgccaacgccgttcaacgaagccggcgacatcgacctggtctcactggctcgcttgatcgcgcgggcgatcagttcgggcgcatctgcggttgtgatctgcggaaccgccggcgaggcatcaacactcacaccagccgagcagacagccgttatcagcgaggccgtcgggatcgcaggcagacggatcagggttatcgccggcgccggctcgaacgcgacgagccaggcgatcgaactggccgcgcgggcgcaatccgccggtgcggacgccgttctttcggtcgtgccctactacaacaagccgacgcaggacggcattcgcgcacacttcgacgccatcggtcgcgcgatcgaactgccggtcctgcttcacgatgtcccctctcgcaccgctcgtcctctggcagacgatacgatcgtccgccttgcacgatccggccggttcacgggcctggtcgacggctcgggcgacgtgctgcggccgcttcggcttcggccccggttaccagccggttttcaaatgctgtccggcgacgacacaacgtcctttggatttcttgcgagcggcggcgacggggcggtctcagaggtggccaacattgcctccgacctttgccgcacgattcacacctattgtcgccaaggccgcctgcaatcggcgcgctatctccagaagcgtctgctaccgctggcatccagcctcgatcaggactcgcctgcgtctctcaaatacgcgctgaatttgctcggtctgatccggcccgatacacgcctgccgatcgtcccgctg

SEQ ID NO: 44146 - DNA, 2223 bp, Rhodopseudomonas palustris
cctgacctctcgacctgcgacgatgagccgatccatatccccggtgccatccaaccgcatggactgctgctcgccctcgccgccgacatgacgatcgttgccggcagcgacaaccttcccgaactcaccggactggcgatcggcgccctgatcggccgctctgcggccgatgtcttcgactcggagacgcacaaccgtctgacgatcgccttggccgagcccggggcggccgtcggagcaccgatcgctgtcggcttcacgatgcgaaaggacgcaggcttcgtcggctcctggcatcgccatgatcagctcgtcttcctcgagctcgagcctccccagcgggacgtcgccgagccgcaggcgttcttccgccgcaccaacagcgccatccgccgcctgcaggccgccgaaaccttggaaagcgcctgcgccgccgcggcgcaagaggtgcgggagattaccggcttcgatcgggtgatgatctatcgcttcgcctccgacttcagcggcgaagtgatcgcagaggatcggtgcgccgaggtcgagtcatatctaggcctgcactttcctgcctcagacatcccggcgcaggcccgtcggctctataccatcaacccggtacggatcattcccgatatcaattatcggccggtgccggtcaccccagacctcaatccggtcaccgggcggccgattgatcttagcttcgccatcctgcgcagcgtctcgcccgtccatctggaatacatgcgcaacatcggcatgcacggcacgatgtcgatctcgattttgcgcggcgagcgactgtggggattgatcgcctgccatcaccgaaagccgaactacgtcgatctcgatggccgccaagcctgcgagctagtcgcccaggttctggcctggcagatcggcgtgatggaagagcaggcgatcacacgccagacgctcaagggccaggcgatccagcgcagcctgatcaacgacatcgaacaactgcatgatcaccgagccggcctggcgcgcaacagcgaagcgctgctcgaactgatgggcgcgtcgggcctctgccttcatagccgcgagggcgtgatcacgatcggacagaccccccccggaccgatcatcgatcaactggcgcaactggccggccggtccggcggcagcgaactattccagacggacaggttgtcgaccatcatccctgaagccggcgctttcgccgaggtcgccagcggcgttctcgccgtgccgctgtcgcgcacgccgccccgccgggtgatgctgtggttcaggcccgaggtagcgcagacggtgtactgggctggcaatcccgacaagtcggtgacggccgaatccggtcgcctgcggccgcgcacctcgtttgccgcctggaccgagcagacccacggccgcgccatcgcatggcagccgcacgaagtcgccgcagcggtcgagatcagggatctgatcatcgacgtgatcctgcgcaataccgaaaagctggagcgcatcaacacccagctcgcgcgcagcaacgaggagctggagtcgttcgcccatgtggcttcgcacgacatcaaggagccgctacgccacatcgaagcgtttgccggcctgctcgccgacaacattcgcgagatgggagacgaacgactcggcgtcatggtcagcggcatcgagaaatcgtcgcggcggctgcgcaacctgatcaacgatctggcggagttttcccagctcggcaggcgttcgaagccgttgtcgtgggtgtcgctcgaaaccgtcctcaacgaagtgcttgccgatctgcagccaaggatcacagaagcgcgcgccgagatccaggcagacagactgccgttcgcgcgctgcgaccacaatcagatccgccaagtgttgcagaacctgatcgcgaactcgctcaaatatcgcgatccggcgcggccatgccggatccggatctttgcgcagcccgacgacaacggaggacgcgccgagatcggctctgcccccgccatccggatctgcgtcaccgacaacggcatcggcttcgacaagaagtatatcgatcaggtgttcgagccgttccagcggctgcacggccccgacgattacgagggcagcggcatcggtctggcgatctgtcgcaagatcgtacagcgccacggtggccgcgtcggcgtcgacaccgttccggggcaaggctcgaccttctggttcacgctgccg

SEQ ID NO: 44147 - DNA, 1673 bp, Rhodopseudomonas palustris
cggaagcacggcctcacctacgccgactccggcgtcgacatcgatgcgggcaaccggctcgtcgatctgatcaagccgatggtgcgcgccactgcgcgggccggcgcggattccgagatcggcggcttcggcggcctgttcgatctgaaggcggcgggcttcaaggatccggtgctggtcgcggcgaccgacggcgtcggcaccaagatcaaggtggcgatcgacgccgggctgcacaccggcatcggcatcgatttggtggcgatgtcggtcaacgacctcgtggtgcaaggcgccgagccgctgttctttctcgattacttcgcctgcggcaagctcgatccagaggccgcggccgagatcgtcgccggcgtggcggaagcctgccgcgagtccggctgcgcactgatcggcggcgagaccgccgaaatgccgggcctgtataaggacggtgactacgacctggccggtttctcggtcggcgccgccgagcgcggcacgctgctgccgtcgaaggacatcgccgaaggtgatgcggtgatcggactggcgtcctccggcgtgcactccaacggcttctcgctggtccgcaagatcgtcgaaaaatccggcctgccctatgacgcgccggcgccgttttcgccggtgatgacgctcggcggtgcgctgctcgcgccgaccaagctctatgtgaagtcctgcctgcaggcgatccgcgacaccggcgccgtcaaaggcctcgcccacatcaccggcggcggcttcaccgagaacattccgcgcgtgctgccgaagcacctcggcgtcggcatcgacctgccgcggatcccggtgctgccggtgttcaaatggctcgccgagcaaggcgagatcgccgaactcgagttgctgcgcaccttcaactgcggcatcggcatggtcatcatcgtcaaggccgacgccgtcgatcaggtcaccgagagcctcaccgccagcggcgagagcgtacacctgctcggtcaggtcattgccgccaagggcgagcagcgcgtggtctatgacggccacctcgacctcgcctggtgagcgcgccgatgaagcctcgcgttgctatcctgatttccgggcgcggctccaacatggccgcgctgatcgaagccgcagctgaggacggctttcccgccgagatcgctgtggtgatttccaacgtggcgacggcgggtggtcttgcgatcgccgaacgcagcgggatcgccaccgtggtgatcgaaagcaagccgttcggcaaggatcgcgccggcttcgaagccaagctgcaggctgaactcgacgcccgcggcattgagctgatctgcctcggcggcttcatgcgcctgttcacggccgagttcgcgcagcactggtacggccggatgctgaacatccacccgtcgctgttgccgtcatttcccggcctcgatccgcatggccaggcgttgcgcgccggcgtgaagatctccggcgccaccgtgcacttcgtcacgcccgacaccgacgccggcccgatcatcatgcagggcgcggtgccggtgcaggacgacgacacgccggacacgctggccgcgcgcgtgctcgcggtcgagcatcgcatctaccccgaggcgctgcggcttttggctgctggcttgctccggttcgacggcgatctctgccgg

SEQ ID NO: 44148 - DNA, 420 bp, Rhodopseudomonas palustris
atggcgatcgaacggactttctcgattctcaagcccgatgcgaccgagcgcaacatcacaggcgcgatcaacgcgctgatcgaaaaggccggtctgcggatcgtcgcccagaagcgcatccgcatgacccgcgaccaggccgagaccttctacgccgtgcacaaggaacgcccgttcttcggcgaactggtcgacttcatgatctccggcccggtggtggttcaggtgctcgaaggcgagggcgcgatcgcgaagtaccgcgacgtgatgggcgcgaccgatccgtcgaaggcggctgacggcaccatccgcaagctgcacgccaagtcgatcggcgagaactcggtgcacggttcggacgcggcggaaaccgccaagatcgagatcgcccagttcttctccggcaacgaaatcgtcgga

SEQ ID NO: 44149 - DNA, 1041 bp, Rhodopseudomonas palustris
atgcgtcgccagtctctggtgaaattcgacgccccgctttgtgagaccatcatcgatgcgccgaagccgcaggggcgcgaagtgctggtgaagatcgagcgctgcggcctgtgccactccgacctgcacattcaggacggctacgccgatctcggcggcggcaagaagctcgataccacgcgcggcatgacgctgccgttcaccctgggtcatgagatcgccggcgtcgtcgccgaagtcggtcccgacgctccgcaggatctgatcgggaccaagaaagcggtgtttccttggatcggctgcggcaaatgccgtgattgcctcgcgggcgacgagaacctgtgcgccaagaaccgcttcctcggcgtctcgatcgacggcggcttcgcgacccacgtactggtgccggacgccaagtatctgctcgactacgatccgctgccgaccaacgtcgctgcgacgttgatgtgctctggtatcaccgcctatggcgccttgaagcgtctggtggaccggcctcgtcagcgcaatctgctgctgatcggtctaggcggcgtcggcatgatgggtctctcgcttgctcaggcgatgttcaagcagccgatcgcggtggccgatctcagccccgcggcgcgcgaagcggcgctgaagaacggcgcggccgtcgcttacgatccatcggagcccgacgttgccaagcgcatcttcaaggagaccgatggcggcttcgatggcgtggtggatttcgccggcaacgataagtcgatgaacttcgccgtcagcacggttgcgcgtggtggcaagatcgtggtgtcgggtctgatgggcggccagttcagcctgccgatggtgcaatggatctacaagcgcatgaccgtcgaaggcttcatggtcggcacgctcgaagagaccaaggagctgctcgcgctcgcgcgtgccggcaaggtcaagccgactccgatgaaggaagagccgatgcaggatgcgcaaaagtggatcgatcagctgcgtgccggcaaggtcgttggccgcatcatgctg

SEQ ID NO: 44150 - DNA, 1254 bp, Rhodopseudomonas palustris
agacgggttgtcgtcacgggccttggcatggtgtcgccgctgggctgcggcgtcgaaccgacctggagccgagtgctcgccggcgaaagcggcgcacgcaagatcgatacgttcgacgtgtcggatctcgccagccagatcgcctgcgtcattccgcgcggcgacggcaccaacggcactttcaatcctgatcaatggatggagccgaaagaccagcgtaaggtcgatgacttcatcgtctatgcgatggcggcggcgcgtcaggcgctcgacgatgccggctggcatccctccacggaagaagagcgctgcgcctcgggcgtgctgatcggctccggcatcggcggcctgcagggcatcgccgagactgcgctgctgctcgagcaacgcggcccgcgccggatctctccgttctttattcccggccgcctgatcaatcttgcgtccggctatgtctcgatcgaattcggtctgaagggccccaaccattcggtcgtcacggcttgctcgaccggcgcccatgcgatcggcgatgcctcgcggttgatcgcgctcggcgacgccgacgtgatggtcgcgggcggtaccgaatctccgatcagccgtctggcgatggccggtttcgctgccgcgcgggcgctgtcgaccggtttcaacgatgcaccgaccaaggcttcgcggccttacgacaaggatcgcgacggcttcgtgatgggcgagggcgccggcgtggtcgtgctggaagagtacgaacacgccaaggcgcgtggcgcgcggatctatgccgaagtgatcggctacggtctgtcgggcgacgcttatcacatcacggcgccgagctctgatggtgacggcgcattccgctgcatgagcgccgcgatcaagcgcggcggcatcgcagtgtcggacatcgactacatcaacgcacacggcacctcgacgccgctcggtgacgagatcgagctcggtgcggcacagcgcctgctgggcaatgcggcctcgcgcgtgtcgatgtcgtcgaccaagtcgtcgatcggccatctgcttggggccgccggtgctgtggaagcgatcttctgcgtgctcgcgattcgcgacaacgttgcgccgccgacgatcaatctcgactccccctcggtcgagacggcgatcgatctggttccgtggaagccgcgggcccgcgagatcaacgttgcattgtcgaactcgttcgggttcggtggcacgaacgcgtcgctggtgttgcagcgcgtg

SEQ ID NO: 44151 - DNA, 231 bp, Rhodopseudomonas palustris
atgagtgagattggcgagcgggttaagaagatcgtggtcgaacaccttggtgtcgaacccgagaaagtggtcgatagcgccagcttcatcgacgatctcggcgccgacagcctcgacaccgtcgaactcgtgatggcgttcgaagaagagttcggctgcgaaattccggacgatgccgccgagacgattctcaccgtcggcgacgccaccaagtttcttgaaaagaacgca

SEQ ID NO: 44152 - DNA, 735 bp, Rhodopseudomonas palustris
atgttcgatctgacaggcagaaccgcgctggtcaccggcgcaaccggtggcatcggcggcgcgatcgcccaggcgctgcacggccagggcgccaccgtggcgatctccggcacgcggcgcgaggcgctcgacgcgctggccgccaagctcggcgaacgcgtgcacgtgctgccttgcaatctgtcggacgcggcggacgtcgaggcgctggtgccggctgcggccgaagccatgggcgggctcgacatcctagtatgtaacgcaggtatcacccgcgacaatctgttcgtgcaattgcgcgacgaggattgggacgaggtgatcaaggtcaacctcacggcgaccttccggctgacgcgcgctgccaccaagctgatgatgcgcaagaagttcggccgcatcatcgcgatcacttcggtggtcggtgtcaccggcaatccggggcagggcaactacacggcctcgaaggcgggcttgattggcatgatcaagacgatcggcgccgaatacgccaagcgcaacgtcacggcgaactgcattgcgccgggcttcatcgcgacgccgatgaccgacgttctcaatgacaagcagcgcgaggcgattctcggcaaggtgccggccggccggctcggcacgccggacgacattgcggctgcggcggtttatctcagttcgaatgaggccgcctacgtcaccggtcagaccattcacgtcaacggcgggatggcgatgatc

SEQ ID NO: 44153 - DNA, 918 bp, Rhodopseudomonas palustris
gcattcacctttccggggcaggggtcccaggccgtgggtatgggcaaggcgctcgccgaagcctttccggcggcacgggcggtgttcgacgaagtcgacgctgcgctcggcgaaaagctgacctcgatcatttgggaaggccccgctgaaacgctgcagctcaccgagaatgcgcagccggcgctgatggcggtgtcgctggcgacgatgcgcgtgctggagaccgaagccggcgtgtcggtcggcaaagatgccgccttcgtggccggtcattcgctcggcgaatattccgcgctggccgctgcgggcagcctgagcgtgagcgacacggcgcggctgctgcggatccgtggtcaggcgatgcagaaggcggtgccggtcggcgtcggggcgatggccgcgctgctcgggctcgattacgacaccgcggtcgcggtggcggccgaagccgcgcagggccaggtctgccaggccgccaatgataatggcggcggtcaggtcgtcgtctccggtcataaggacgcggtggagcgcgcggtcgagatcgccaagggcaagggtgccaagcgcgcgatgctgctgccggtgtccgctcccttccattgttctctgatgcagccggcggccgaagcaatggccgaggcgcttgcgggcgtgaccatcaaggcgccggccgcgccgttggtcgccaacgtcctggcctcgccgatcaccgatccgcatgaaatccgccgccgtctggtcgagcaggtcaccgggaccgtgcgctggcgcgagtcggtcgccttcatggcgtcgcagggcgtgaatcagtttctggagatcggcgccggcaaggtgctgagcggcttggtgaagcgcatcgctgatggcgcgattggtatttccgtaggtggccccaacgacatcgtgtcggcg

SEQ ID NO: 44154 - DNA, 729 bp, Rhodopseudomonas palustris
agacatgccatcgtcaccggagccagccgcggcatcggacgcgccatcgcgctcggccttgcccagcgcggctacgacctcgccctcaccgatatcgccgcacaggaaagcgtgctgcgtgagactgtcgaagaggtgaagcagctcggccgcaaatgcattccgatcctcgccgacgtcagcaagatcgaggattgccagcgttcggtgaccgaggcggtcgccgggctcggccacgtcgacgtgctcgtcaacaatgccgggatcctgcggctggcgatgatcgacgagaccacgcccgagcattgggatcagaccttcgcggtcaacgtccgcggcgtcttccagatgacccaggcggtggtcgtgcacatgaaggagcggcgctacggccgcatcgtcaatatcgcgtcgctggccgcgcgcaccggcggtcccggccagtcgcactacgcggcgtcgaagtccgccgtggtcggcttcacccgcgtttcttcgatggaattcggcggccacggcatcaccgtgaatgcggtttgccccggcatcatccagaccgaaatgggccgcaacaatctgcgcgatccggagcgggtcacgtatttcgagaagatcaccgacctgcatcggctcggcgagccggaagacgtcgtcggcccggtcgcgttcttcgcatcggacgattcggcgttcgtcaccggccaggcgctcaatgtcgatggcggcatc

SEQ ID NO: 44155 - DNA, 870 bp, Rhodopseudomonas palustris
gacgtcagcgtctgcggcacctacatcctcgacattctcggcgtgccggtgaccgagatcccggccggcggcggccgggcgctgatcgatgaaatacgtctcaccgtcgccggcacggcgggcggcacggtggtgccttgcgcccggcttggcctgaaggccctcgcagtcggcgcagtcggtaccgacgagaaagccgattgggtgctggacgcgatggtgcgcgagggcatcgacatctcggtgatggagaagatcgccggcgcgccgacctcggccaccatcctgccgatccggcccgatggctcgcggccggtgctgcacgcgcgcggcgcttcggcgcgctggaagatttcgcccgaagcccagaaggtcgcctgcggcagcaaagttctgcatctcggcggcgtcggatcgctgctagcaatggacggcgaaccgacggtgtcactgctgcgcgacgccaaggctgcgggctgcatcaccacggtcgatctgatccaggcgcgcggcgaaacgctgccgctgctcgaaccgctgatgccctacaccgacttcttcatgccgagcatcgacgaaactcacgcgctgatcggcagcggcgatccggccacctgcgcccgctacttcatcggcaagggggccggcgcctgcgcgatctcgctcggtgagcacggctcgttcgtgatgacgcgcgatggccgtcagctcaccgtgccggcattcgacatcaccgtgcgtgacacttcgggctgcggcgattcctacaccggcggcttcatcgccggcctggtgcgcgactgggatctccaggactgcgccagactggcgaccgccacggccgcaatcgtcgccacgggactgggctcc

SEQ ID NO: 44156 - DNA, 2328 bp, Rhodopseudomonas palustris
gccgctgccgcgtgcgtcctaagccgaccggccacaatcccacggagacggcgcgtgagtgagatcaagcgaatcccgcactgcagccattggggcgcctatacgctgctggtgcaggacgggagcatcgtcggcgtcgagccgttcgcgcacgatcccgccccgtcaccgatcattcactcggtgccggagtgggccaatcccaagcgccaggtacccagcccgctggtacgcgctggctggctggagaaacgagagcacagcgaccggcgcaagcgcggcgccgagaagttcgttcccgtcagctgggacgaagcgaccacgctggtcgcggatgaaatccgccgcgtctcgaccacctacggcaacgcctcgatcttcgccggctcctatggttggaccaattcgggccggctgcatcacgcctcatcgcttttgaagcggatgctgaatctggtcggcggcttcacccgacacgtcgacacctattcgatcgctgctggtcccgtcatcctgcgccacacgctcggcagctccgatgcctgcgacggccgcgccaatacgctcgacaccatcgccgaacacaccgagacgctggtggtgttcggcgcgctgtcgccgcgcaccgcgcagaccgaagccggcggcatcggcgtgcaccgtgtcgaatcctatctgcgcaagatcgccgatcgcggcatccgcatcgtccacgtctcgccactgaaggacgacctgcccgaatgggtcgacgccgaatggtggccgatccgcccgaacaccgacgcggcgctgatgctcggcctcgccggcgagatcgtgctggcgggtcggcacgcccgcgacttcctcgatcgctgtaccagcggcgccgatcaactgatcgcttatctcgacggatcggccgatggcatccggaaggatgcaacctgggcggcggagatttgcggcctcgatgccgagagcattcgccagctggcccgtcgcctggtcgacacccgcagcatgctgacggtgagttggagcctgcagcgcgcgcatcacggcgaacagccgttctggtccgcgctcggcctcgcctcgatcatcggccagatcggcctgccgggcggcggtgtcggctatggctatgcgtcgctcggcggcgttggctcgccgttcaatatcggcaagtcgccggcgatttcgcagctgacgcggccgatcgacagcttcattccggtggcgcggatcagcgacatgctgctgaacccgggcgggaccttcacctatgaaggcaagacccacacctatccggatacacgcctagtgtattgggccggcggcaatccgtatcaccaccatcaggatctcaaccggctcgccgaagcgtggacgcggccggagaccatcatcgtccaggatccgatgttcaccgcaaccgcgcagcgcgccgatatcgtgctgccggcaacgacctcgatcgaacgcaacgatctcgccggcaatcgccgctccgacttcgtcatcgcgatgaagcaggcgatcgcgccggtcggggagtcgctaccggatttcgagatcttcaatcgtatcgccgccaagctcggcgtcgctgacggcttcaacgaaggtcgcgacgagatgggctgggtgcggcaactctacgaagaggtgcggcaggacgcggtagagcgtctcggcttcgagatgcccgacttcgacacgttctgggagcgcggctacgcccgctgcccggtccgcgccgagcacacattcctggccgacttccgaaccgatcccgccgcacacccgctcaacaccgagagcggccggatcgtgctcggcagccgcacgttggccgggctcggttatgacgattgcccgccgcatccggcgtggcttgagccggccgaatggctcggcaggggcgacgcgtcggatctgcacctgatctcgcatcagccgatcggccggctgcacagccagatcgaaaccggcgtcgccagcgtggcggccaagcgcaacggccgcgaacaggccaagctcaatccgcgcgacgcggcagcgcgcggcatcgacgacggtcagactatccgcgtctggaacggccgcggcgcatgtctggcgacggcgaccgtcaccgactcggtgcgccccggcgtcctggtgctgccgaccggtgcatggttcacgccgcgcgacgagaacggcctcgaagtcgccggcaatcccaacgtgctgacgctcgacatcggcacttcgcaattcggccagggctgctcggcacacacctgcctggtgcgcgccgaagcacacattgccgatcaacgcgacgctttcgacgaa

SEQ ID NO: 44157 - DNA, 873 bp, Rhodopseudomonas palustris
gccgcgcacggtggcagcaatgccgatggcgacgtgcagaaggatctcgacgtcaaggccgagcagatcatcgtcaagtcgctgaaggatgtgccgtacgccgcgctggcgtcggaagaatccgacaccctgctcgacggcgatccgaacgcgccgatttcgatcgcctacgatccgctcgacggctcgtccaacatcgacaccaacatgacggtggggacgatcttctcgatcatcccgaaccagccgggcgtgaagccgttcactgcggccggctcctgccagattgcggcgggcttcgtggtgtatgggccgcagacctcgctggtgctgacgctcggtgacggcgtcaacatcttcacgctcgaccgcaaggccaaggtttaccggctgatccgcgagcgcgtgaaggtgccggccgacaccgccgaatacgccgtcaacgcctccaaccatcgccattgggagcaaccgatccgcgacttcgtcgacgagtgcatcgccggcgccgacggcccgcgcgccaaggatttcaatatgcgctggatcggctctctggtggccgaggtgtatcggatcctcacccgtggcggcgtgttcctgtaccccggcgacaaccgcccgggctacggcaacggccggctgcggctgctctacgaaacccatccgatgtcgttcgtgatggagcaggccggtggcgccgcttcgaccgggcgcgagcgggtgctcgatctcaccgccaagacgatccaccagcggtcgccgctgatcatggggtcgatcgacaaggtcaagcgcatcgaactgctgcacaccgatccgagtgcggcctcgcgttcggcgccgctgttcgcccgccgcggcctgttccgc

SEQ ID NO: 44158 - DNA, 1002 bp, Rhodopseudomonas palustris
atggcgcgcatcactctgaggcaattgctggatcacgccgccgagcacggctacggcgtgcccgcgttcaacatcaacaacatggagcagggcctcgcgatcatggaggcggcggcgctggtcgacgcgccggtgatcatccaggcgtcgcgcggcgcccgctcctacgccaacgacatcatgctggcgaagatgatcgacgcgctggccgaaatgtatccggacatcccgctgtgtatgcatcaggaccacggcaacgacgaagccacctgcgccaccgcgatccgctacggcttcacctcggtgatgatggacggctcgctcaaggccgacgccaagaccgccgccgattatcagtacaacgtcgacatcacccgccgcgtcgtcgacatggcgcactgggtcggcgcctcggtggaaggtgagctcggcgtgctcggctcgctggagcatggcggcggcgagcaggaagacggccacggcgtcgagggcaaggtcagccgcgagcagctgctgaccgatccggatcaggcggtcgagttcgtgcgcgccaccaaggtcgacgcgctggcgatcgcgatgggcacctcgcacggcgcctacaagttcagccgcaagcccgacggcgacgtgctggccatgaaggtggtcgaagagatccaccgccgcctgccgaacacccatctggtgatgcacggctcgtcgtcggtgccgcaggatctgcaggacatcttcaacgagttcggcggcgcgatgccgcagaccttcggcgtgccggtcgaggaaatcgtgcgtggcatcaagcacggcgtccgcaaggtcaatatcgacaccgactgccgtctggcgatgaccggcgtgttccggaaagtcgcgacccagaacaaggcggagttcgatccgcgcaagttcctgaagcccgcgatggatgcgatgcgcgacatctgcaagctgcgcttcgagcagttcggcaccgccggcaatgcctcgaagatcaaggtc

SEQ ID NO: 44159 - DNA, 1557 bp, Rhodopseudomonas palustris
atgaccgagaccgcagagaagatccgcgatcacttcgaactcttccgtgagccccagtacgaagagttgatggagaacaagcggaagaatttcgagaactatgttggcgatgccgaggtcacgcgcgtcgcggactggaccaagaccaaggaataccaggataagaacttcgctcgcgaagctctcgtcatcaacccggccaaggcctgccagccgctcggtgcggtgttcgccgcggtcggcttcgagaagacgctgccgttcgtgcacggctcgcagggctgcgttgcttattaccgcagccacttcacccgccacttcaaggagccgacctcgtgcgtctcctcgtcgatgaccgaagacgccgcggtgttcggcggcctcaacaacatgatcgacggcttggccaacgcctatgcgctgtacaagccgaagatgatcgcggtctcgaccacctgcatggccgaggtcatcggtgacgacctcaacgcgttcatcaagaacgccaaggaaaagggctcggtcccgcaggaattcgacgtcacctacgcccacaccccggcgttcgtcggcagccacatcaccggctacgacaacacgatgaagggcatcgtcgagcacttctgggacggcaagtccggcaccgtggaaaagctcgagcgcaagccgaacgagtcgatcaacttcctcggtgggttcgacggctacaccgtcggcaacatccgcgagatcaagcggatcttcgaactgatgggcgtcgattacaccatcttcggcgacaacagcgacgtctgggataccccggccgacggcgagttccggatgtacgacggcggtaccacgctggagcaggccgccaacgcggtccacgccaaggcgacgatctcgatgcaggagttctgcaccgagaagaccctggcgacgatcgccgatcacggccaggaagtggtcgcgttcaaccacccggtcggcatcgccggcaccgatcgcttcctgcaggcggtgtcgcggatcaccggcaaggcgatcccggaagcgctgaccaaggagcgcggccgtctggttgacgccatcggcgactcctcggcccacatccacggcaagaagttcgcgatctacggcgatccggacctctgctacggcctcgccgaattcatcctcgaactcggcggcgagccggtccacatcctggcgaccaacggcaacaaggcctgggaagccaaggttcaggctctgctcgactcgtcgccgttcggcgcgggctgcaaggtctacgccggcaaggatctgtggcacctgcgctcgctgctgttcaccgaaccggtggacttcatgatcggcaacacttacggcaagtatctcgagcgcgacactggcaccccgctgatccgcctcggcttcccggtgttcgaccgccaccaccatcaccgctcgccggtgtggggctatcaggggtcgatgaacgtcctggtcaagatcctcgacaagatcttcgacgaaatggataaggcgaccaacactgccggcaagaccgacgtcagcttcgatatcatccgc

SEQ ID NO: 44160 - DNA, 708 bp, Rhodopseudomonas palustris
gtggtgaccggcggcagccgtggcattgggctcgcaatcgcgcgccgcctcgcagcggccggctacggcgtgatcgcggtggcacgacgcgagagtgaggagctcaccgcggcgattgccgaggcttcgcaagggcccggcacgatcagcttcaaggcttacgatctcggcgacatcgacggcctcgccggcttcgccaagtcgcttcgccaggagttcggcaagatctacggcctcgtcaacaatgccggcatcggcaccgagggcgtgctcgcgaccatgcacaacagccagatcgagacgctgctgcgcatcaacgtcacctcgccgatcgtactgaccaagtacatcgtccgccacatgatggccgatggtgcgggccgcgtgatcaacatgtcgtcgatcatcggctcgacgggctacaacggactgtcggtgtacggcgctaccaaggcggcggcgatcggctttacccgctcgctcgcgcgcgaggtcggccggctcggcatcaccgtcaacgcgattgcgcccggattcatcgacacagaattgaccgccgggctcgctggcgaaggccgccagaagatcgccggccgcagcgcgctgcgccgcttggcggaggccgacgacgtcgcccggatggtcgaattcctgctcggcgatggtggccgcaacatcaccggcacggtgcagacgatcgacgccggg

SEQ ID NO: 44161 - DNA, 1587 bp, Rhodopseudomonas palustris
gacggctacgcacgctgggcactcgcgcaaggaatcggcaaaggcgtcaccgtcgcgctgctgatgccgaaccgcccagactatctggcgatctggctcggcatcaccaaggtcggcggcgtagtggcgctgctcaacacacagctcaccggctcctcgctcgcccattgcatcgatgtcgcagcgcccaaccatatcatcgtggcgaaggaactgagcggcgcctacgacagctcaacacagcatctggcaactgcgccccggctgtggctgcacggcgacgacgatgccgaggtggggctatcggacgcgctggcgatcgcaaacgacgatccacttacggcggccgagcgacccgctgtgactgtcgatgatacggcgctcctgatctacacctccggcaccacggggctgccgaaggcagcgcgggtcagtcaccgccgggtgatgagctgggccggctggttcaccggcctcatcggcgcgacatccgacgatcgcatctacgattgtttgccgatctatcacagcgtcggcggcgtggtcgcgaccggcagcctgctgatggcgggaggctcggtcgtgatcgccgagaaattctccgcgcggcggttctgggacgatatcgtccgctacgactgtacgctgtttcaatatatcggcgagctgtgccgctatctggtgcaagcgccgagcgggtcgaacgaaacgcggcatcgtctgcggctcgcctgcggcaacggactgcgcggcgacgtctgggaggcgtttcaggcgcggttcgcgatcccccgcattctcgaattctacgcctccaccgagggcaacttctcgctctacaatgtcgagggcgagcccggtgcgatcgggcggctgccgtcgtttctggcgcatcgctttccagccgcactggtgaaattcgatttcgaaacgggactacccgtgcgcgacgaacaaggccggtgcatccgctgcgcccgcggcgaggccggcgaagccatcggccggatcggcgaggccgagcgcggcggcggccggttcgaaggttacaccagggatggcgagagcgagcgcaagatgttgcgcgacgtgtttgcaccgggtgacgcctggttccgcaccggcgacctgatgctgcaggacgccaagggcttcttccgcttcgtcgaccggatcggcgataccttccgctggaagggcgagaacgtcgcagcgagcgaagtggccgacacactcgccgcctgccccggcgtgatcgacgccagcgtctatggcgtcagcgttccgaaccacgatggccgcgccggcatggctgctctggtgaccgaggagaccttcgatctcgcggccctccatcgctatctcgcgacgcggctgccggcctacgcacggccgctcttcctgcggctgcggcaggcgctcgatctcaccggcacgttcaaacaagcgaaacagacgctgattgcggagggtttcgacccgtcggtcgtcggcgatccgctctatgtcgccgacatcactacgggcggctacgtcgcgctcgacgcccccctcttcagccgcatcgcgcgcggcgcatttagactg

SEQ ID NO: 44162 - DNA, 1257 bp, Rhodopseudomonas palustris
acgcttgccatccacgccggctacgagcccgacccgaccactcatgcggttgcggtgccgatctatcagactgcgtcctacgcattcgacagcgccgaccacggcgcggcgttgttcaatctcgagaccgaaggctatcgctactcgcggatcgccaatccgaccacaagcgtgctggaaaagcgcgttgctgagctggaaggcggcgtcggtgccctggcggtggcgagcgggcaggcagcgctgcatttcgccttcgtcaatctcgccgatcatggcggcaatatcgtctcggtgccgcagctctatggcaccacgcatacgctgctgtcgcacatcctgccgcgacagggcatcactggccgcttcgctgccagcgacaagccagacgacatcgccaagctcatcgatgagggcacccgtgcggtgttctgcgaaaccatcggcaatccggccggcaatgtctgcgacatcgaagcgatcgccgacgtggcgcatcgcgccggcgtgccgctgatcgtcgacaatacggtggcgacgccgatcctgttcaagccgatcgcgtatggtgccgatgtcgtggtgcactcgctcacgaagttcctcggcggccacggtaccacgctcggcggcgccatcgtcgacagcggccggttcgattgggccaagcagccggagcgttttccggctttcaaccagccggaccactcctatcacggcatggtctatgcggagcggtttgggccgaccgcttacgtcgagcgtgcgcggtcgatctatcagcgcaccatgggatctgtgctgtcgccgtttaacgcctttctgctgctgcagggcatcgagacagtcgcgttgcggatggagcgccacgtcgagaacgcccgcaaagtcgccgaattcctgcgcgacgatccgcgcgttgcctgggtcaattacaccggcttcccggacagcccgtattatccgctggtgcagaagtatctcgacggccgcgcgtcgtcgctgttcaccttcggcatcaagggaggcatggaagccggcaaggcgttctacgattcgctcaagctgatcacccggctggtgaacataggtgacgccaagtcgctcgcgtgccacccggcgtcgaccacccatcgccagatgtcggctgagcagcagcgtcaggccggagttttgccggagacgatccggctttcgatcggcattgaacacatcgccgacatcatcgaggatctcgatcaggcgctcgcgcaagcc

SEQ ID NO: 44163 - DNA, 753 bp, Rhodopseudomonas palustris
ttgcagggtaagaagggtctggtcgtcggcattgccaacgatcagagcatcgcattcggttgcgcgcgcgcgtttcgcgacgccggcgccgaactcgccgtcacctatctcaacgacaaggccgcgcctcacgtcgtcccactcgccgaacagctcggctgtccgatcgtggtgccgtgcgacgtgcgcgagcctggccagctcgaagccgtgttcgaacggatatcccagcaatggggccggctcgatttcctgctgcattcgatcgcgttcgcgccgaaggaagacctccacggtcgcgtcgtcgattgctcgcaggccggctttgcgatggcgatggacgtgtcgtgtcattcgttcatccgcatggccaagctcgccgagccgctgatgccggacggcggctgcctgctcaccgtgtcgttctacggctcggagaaggtggtcgaagactacaacctgatgggtccggtgaaggccgcgctggaaagctcggtgcgctacatcgcggccgaactggcgccgaaaaagatccgcgttcatgcgctgtccccggggccactgatgacgcgcgccgcgtcgggcatcgcgcggttcgacgaactcctggagcgcacccgcgcccggctgccggcacatcagcttgtgagcatcgaagatgtcggtgcggtcgccgcctttctggtcggtgacagcgcgcggtcgctcaccggcaatatcgaatacattgacgccggctatcatgtgatcggc

SEQ ID NO: 44164 - DNA, 1170 bp, Rhodopseudomonas palustris
atggacttcgcactcaccgatcagcaggaagccatccgcgacgccatcgccaagatctgcgagggcttcgacgacgcctattggctgaagaaggatcgtgagggcggcttcccgcacgacttccacaaggcgctggccgacgctggctggctcggcatctgcgtgccggaagcctatggtggctccggcctcggcatcaccgaagcggcgatcatgatgcgcgcgatctcggaatccggcgccggcatgtcgggcgcctcggcggtgcatattaacgtgttcggtctcaatcccgtcgtggtgttcggcaccgaggagcagcgccagcgcatgctgccgccgatggtggagggccgcgataaggcgtgcttcgccgtgaccgagcccaacaccggcctcaataccacccagctcaagacccgcgcggtgcgcaagggcgaccgctacgtcgtcaatggccagaaggtgtggatctcgacggcgcaagtggcgaacaagatcctgctgctggcgcgcaccacgccgctcgaagaggtgaggtcaccgacccacggcctcagcctgttctacgccgacttcgaccgcaccagaatcaaggtgcacgagatcgagaagatgggtcgcaagatcgtcgactccaacgaactgttcttcgaggatttcgaaatcccggtcgaggaccggatcggcgaggagggcaagggcttccattacatcctggaaggcatgaacccggagcggatcctgatcgcggccgaggcggtcgggctcggcaagctggcgctgtcgcgcgccgccgactacgccaagacccgcatcgtgttcaaccgcccgatcggccagaaccagggaatccagcatccgctggcgaagaactgggtcgagctcgaagctgcctggctgatggtgatgtcggcggcgtggcaatacgatcagggcatgccgtgcggcgccgccgccaatgcggcgaagtatctggccggcgaggcgggcttttcggcctgcgagcaggcggtgatgacccatggcggtttcggctacgccaaggagtatcacgtcgagcgctatttgcgcgaagtgatgatcccgcggatcgcgccggtcagcccgcagcttgcgctcagctttatcgccgagaaggtgcttggcctggcgaaatcgtattgatcg

SEQ ID NO: 44165 - DNA, 1287 bp, Rhodopseudomonas palustris
atggatcggatcaagatcatcggcggcaacgagctgcggggcaccatcccgatttcgggggccaagaacgcggcgctgcccctgatgatcgcggccctgctgaccgacgagaccctgattctcgacaatgtgccgcgtctggccgacgtcgcgctgttgcagcggatcctcggcaaccacggcgtcgacatcatggcggccggcaagcgtccgggcgaccacgaatatcagggccagaccctgcacatctccgccaagaccatcgtcgacaccaccgcgccgtatgacctggtgtcgaagatgcgcgccagcttctgggtgatcgcgccgctggtggcgcggatgcacgaagcgaaggtttcgctgccgggcggctgcgcgatcggcacccggccggtcgaccttctgatcatggcgctggaaaagctcggtgccgagatcacgatcgacggcggctacgttattgccaaggcgcccggcggcctgaagggcgcgaccatcgcgttccccaaggttaccgtcagcggcacccatgtggcggtgatggcggcggcgctcgccaagggcaccaccattatcgacaatgccgcgtgcgagccggagatcgtcgacgtcgccgactgcctcaacaagatgggcgcgaagatcaccggtgccggcaccccgcgcatcaccatcgagggcgtcgccaagctgcacggcgcgcgccacaccgtgctgccggaccggatcgagaccggcacctatgcgatggcggtggcgatggccggcggcgaggtgcagctttccggtgcccgtcccgagctgctgcaggcggcgctcgacgtgctgacccaggccggggccaccatcaccgtcaacaacgacggcatcaaggtcgcgcgcaacggcgccggcatcagcccggtgaccgtcaccaccgcgccgttccccggcttcccaaccgatttgcaggcgcagttgatggcgctgatgacccgcgccaagggcgcctcgcacatcaccgagacgatcttcgaaaaccgcttcatgcacgtccaggagctggcgcggttcggcgccaagatctcgctcgatggcgagactgcgaccatcgacggcgtcgagcggctgcgcggcgcgccggtgatggcgaccgacctgcgcgcctcggtctcgctggtgattgcggcgctcgctgccgaaggcgagaccatggtcaaccgcatctatcatctcgaccgcggcttcgaacggctcgaagagaagctgtcggcctgcggcgccaacatcgagcgcatcagcggc

SEQ ID NO: 44166 - DNA, 1224 bp, Rhodopseudomonas palustris
ctggcgatgaagcgggaggttgcggcggatatcgaggccgccacccgggccatcgtcgacgacgtcgcgcatcgcggcgacgctgcgctgctggaagcgaccgaaaagttcgaccggctgacgctggatgccgccggcatgcgggtcggcgaggccgaggtcgaagccgccgtgaaggcgtgcgattccgagacggtcgacgcgctgaagctggcgcgcgaccgcatcgaatttttccatcgccggcaattgccgaaggacgatcgcttcaccgatccgctcggcgtcgagctcggctggcgctggagcgcgatcgaggcggtcggcctgtacgtgcccggcggcaccgcggcgtatccgtcgtcggtgctgatgaatgcgattccagccaaggtcgccggtgtcgagcgcgtggtgatggtggtgccgtcgcccggcggcacgctcaatccgctggtgctggccgcggcgcagctcgctggcgccaccgagatctaccgtatcggcggcgcacaggcggtggctgcgttggcctacggcaccgcgacgattgcgccggttgccaagatcgtcggccccggcaacgcttatgtcgctgcagccaagcgcctggtgttcggccgcgtcggcatcgacatgatcgctggcccgtccgaggtcgtcgtcgtcgcagacaagaccgccaatccggattggattgcggccgatttgttggcgcaggccgagcacgacgccaatgcgcaatcgattctgattaccgatagcgcggtgctcgccgccgacgtcgagcgcgccttggcggcgcagctcaccacgctgccgcgcgtcaagatcgcgcgcgcctcgtgggacgagttcggcgccatcatcaaggtcgccaagctggaggatgcggtcccgctcgccaacgcgatcgcggccgagcatctcgagatcatgacggccgatccggaagcgttcgccgacaagatccgcaatgccggcgcgatcttcctcggcggccatacgccggaagcgatcggcgactatgtcggcggctccaaccacgtgctgccgaccgcgcgttcggcgcggttctcgtcgggcctcggcgtgctcgacttcatgaagcgcacctcgatcctgaagtgcgggcccgaacagctcgccgtgctcggcccggccgcgatggcgctcggcaaggccgaaggattggatgcgcatgcgcgatcggtgggactgcgt

SEQ ID NO: 44167 - DNA, 642 bp, Rhodopseudomonas palustris
gcactgatcttcgacgtcgacggcacgctcgccgagaccgaagaactgcaccgtcaggccttcaacgccaccttcgcggccgagcaactgccgtggcattgggatgcgacgctgtatcgcaagctgctcgacgtcaccggcggcaaggagcggatcgctcacttcctgaagtcggaaccggatggcgccgagcgggcggccgatcggatccccgaactgcaccgggccaagactgaccgctacaccgcgctggtcgctgccggcacagcgctgcgccccggcgtggcgcggctgatccgcgaggccaaggcggccggcgtgaagcttgggatcgctaccaccaccagcctgccgaatgtcgaagcgctgctggagtcttcgctggggccggacgcgatggcgctgttcgacgcggtcggcgccggcgatgtggtgccggccaagaagccggcgccggacatctacctctacgtgctcgacgccctgaagctgccggccgccgattgcgtcgcgttcgaggattccaccaacggggtccgcgccgcgcgggccgccgggctgccgaccatcgtcaccccagggctctataccgagggcgacgatttccccggtgcgcttgcggtgctcagcgatctcggcgag

SEQ ID NO: 44168 - DNA, 783 bp, Rhodopseudomonas palustris
cgacttgaaggcaaaaccgcgctggtggtcggcgccggttcgatcggacccggctggggcaacggcaaggcgaccgcagtgacgttcgcgcgcgagggcgcgcaggtgttctgcgtcgatcgcaacctcgctgccgccgaggaaaccgtcgacatcatcaaggccgaaggcggccgcggcatcgcgtttgccgccgacgtctcgcgcgccgccgacgtcgaggcgatggtggcggcctgcgtcaaggcgtgggacggcatcgacgtgctcgacaacaatgtcggcatcgcggagaccggcggcgtcgtcgaagtcaccgaagccgattgggatcgggtgttcgcgatcaacctgaagagcgcatatctggcgatgaagtacgtcgtgccggtgatgcagcggcagggcggcggatcgatcatcaacatctcgtcgatcgcatcgatccggtatctcggcatctcctatgtcagctacgcggcttcgaaggcggcgatgaacgcgctgacccgcaacaccgcggtggaatacgccaaggatcatgtccgcgtgaacgcgatcctgccggggttgatgaagaccccgatggtggcgcactccgccggccttgccgccagttattcgggcggcgacgtcgatgcgatgtggcgcgcccgcgacgcccaggtgccgatgggccacatgggcgaggcctgggacgtcgccaacgccgccacattcctcgccagcgacgagtcgaaatacatcaccggcatcgaactggtggtcgacggcggcctgacg

SEQ ID NO: 44169 - DNA, 1878 bp, Rhodopseudomonas palustris
cgttaccgcgaggttcatgcccgctcgctggccgacccggagggattctggggagaggtcgcgaaagagatcgactggatcacgccgcccaccaaggtgttcgatccctcgctcggcctgtatggccgctggtttcccggcgccaaggtcaacacttgctacaacgccctcgatcgccacgtcgcgaacggccgcgctgatcagctcgcgctgatccacgactcgccgctgaccggcacggtgagcaaatacacttacgccgagatgctgcgcgaagtgcagacgctcgccgccatcatgcaggacttcggcgttcagaagggtgaccgcgtcattctctatatgccgatggtaccggaatcgatggtggcgatgctggcctgcgcccgcatcggcgcggtgcattcggtggtgttcggtggcttcgccgccaaggagctcgccacccgcatcgaagacgccaagccgaagctgatcctgtcggcgagctgcggcatcgagccgggacgcatcgtcaagtacaagccgctgctcgatgaagcgattgaactcgcctcggtgaagccggaagcttgtatcatcctcaagcggccgcagcaggattgcgagctgaaggcgggccgcgatcacgactgggcgagcttgcgcgagcaggcgctggcggccggcaagaaggccgactgcgtcgcggtcgatgcgaccgacccactctacatcctctacacatccggcacgaccggtaagccgaagggcgtggtccgcgacaatggcggccatctcgtcgcgctgaagtggacgatggaaaacctctacggcatcaaacccggcgaggtgtggtggtgcgcctccgatatcggctgggtggtcggccacagctacatcatctacggtccgctgatccacggcgcgacttcgatcatgtatgaaggcaagccggtcggcacccctgatgctggcgcgttctggcgggtgatttccgagcacggcgcggtggcgttgttcacggcgccgaccgcgttccgcgccatccgcaaggaagacggcgacgggagcttcatccgcaaatacgacctgtcgaaattccgcacgctgttcctggcgggcgaacgtgccgatccgccgacggtggaatgggccgagcagcaattgcaggtgccggtgatcgatcactggtggcagaccgaaaccggctggtgcatcgccggcaatccggtcggccttggcctgctgccggtcaagcacggctcgccgacggtgccgatgcccggctacaagctcgaggtcgtcgacgagggcgccaagccggtgccggccggaacgatgggctcgatcgtgatcaagctgccgctgccgcccggcaatctgccgacgctgtggcagcaggacgagcgctgccgcgagagctacttcgccgacttccccggctactacaagacttccgacgccggctatgtcgatgaagacggctatgtcttcgtgatgggccgcaccgacgacatcatcaacgtcgccggccaccggctgtcgaccggcggcatggaagagatccttgcgtcgcatccggacgttgccgaatgcgcggtgctcggcatcaacgatccgatcaagggcgaggtaccgtgcggcctgatcgtgctgaagagcggcgtcacccgcgatccggccgaaatcgagaaggagatcgtcaagctggtgcgcgacaagctcggcccggttgcggcgttcaagctcgcgatcaccgtgccgcggttgccgaagacccgctccggcaagatcttgcgcggcaccatcaagaagatcgccgacggcgatacctggacgatgccggccacgatcgaagatccgaccgcgctcgacgacatctcctcggcgctgaag

SEQ ID NO: 44170 - DNA, 615 bp, Rhodopseudomonas palustris
gccgaattgcccgattgcgcctcccgccttccgatgacgaattgcgccatccgtaacgaaagacccgcgccgatgacccccgagtttgcaaacgatttgaaagccagcgtccgggcgattccggactatcccaagcccggcatcatcttccgcgacatcaccacgctgctcggcgaaccgcgcgcgttccgccgcgccatcgacgagctggtgcagccctgggcgggttcgaagatcgacaaggtggcgggcatcgaggcgcgcggcttcatcatcggcggcgcgatcgcccatcaggtgtcgagcggcttcgtgccgatccgcaagaagggcaagctgccgcatacctgcgtgtcgatggaatacgcgctggaatacggcaccgacaagatcgaggtccacgtcgacgccatcacccccggcgagcgggtaatcctggtcgacgacctgatcgccaccggcggcaccgccgagggcgcgatcaagctgctgcgccagatcggcgccgaagtcgtcgccgcctgcttcgtgatcgacctgccggagctcggcggcgccgccaagatccgcgccatgggcgtcccggtgcgcacgctggtcgcgttcgaagggcat

SEQ ID NO: 44171 - DNA, 3435 bp, Rhodopseudomonas palustris
atgaaactcacgcgtctccgcctccacggcttcaagtcgtttgtcgagcccaccgacttcatgatcgagccgggtctgaccggcgtggtcgggccgaacggctgcggcaagtccaatctggtggaagcgctgcgctgggcgatgggcgaaacctcgcacaaatcgctgcgtgcgacggacatggacgcggtgatcttcgccggctcgggcaaccgccctgcccgcaaccacgccgaagtggtgatgtcgatcgacaattccgatcgcaccgcgccggcggcgctgaacgatgccgacacgctcgacatctcgcgccggatcgagcgcgaggccggctcggtgtatcgcatcaacggccgcgaagtgcgcgcccgcgacgtgcaactgctgttcgccgacgccgccaccggcgcccggtcgccggcgctggtccaccagggcaagatcggtgaaatcatccaggccaaaccggaacagcgacgccgcgtgctggaagacgccgccggcgtcgccggcctgcacgcccgccggcatgaagccgaactgcggctgaaggcggccgaaaccaacctgacccgcgtcgaggacgtgatcggccagctgtcaacccaggtcgacggcctgaagaagcaggcgcgccaggcgatccggttccgcgaggtcgccgccaaggtccgcaagaccgaggcgatgctgtatcacctgcgctggcgcgacgcgcaggccgaggtcggcgcggccgccgaggtgcacgatctcggcgtgcggcagctcgccgaatgcacccgcgtgcaggccgaagcctcccgcatccaggccgatcgcgcttccactttgccgagcctgcgcgaggctgaagcccgcgccgctgccggcctgcagcgactgatcaatgcccgcgaacagctcgaccgcgaagaagcccgcgccaaggagcgcgtggtcgaactggagcggcggctgacgcagttctcctccgacgtcgcgcgcgagcagcagcaggcgatcgacgccgacgccgcgctggaacggctcgacaccgaagacgtcgagctgcgcgaggagatcctggagcgggtcgagaagcgcagcggcgtcgacgagcgcgtcgccgaagccgatgcctcgctgggcgaagccgagcagctgttcgccgaactcaccacccagctcgccgaactcaccgcacggcgcaaccagttcgagcagagcgtccgcacccatcgcgaccggctggcgcggctcgacaccgagatcaagaacgtcgagagcgagatcgaccggctctccgccgagacctccggcgccggcgacctcaccgaactcgccgaagcggtcgagatcgcccaggagctgctggccgagcaggaaggcgcggtgcaggaagcggaagctgcacaaatcgccgcgcggcagacgctggacggctcgcgggcaccgctggtcgacgccgagaagaaggtgcagcggctcgagaccgaagccaagaccatcagcaagatcctcaacggcgagaccaagaatctgtggccgccgatcatcgacggcatcaccgtcgccaagggctatgaaaaagcgatcggcgccgtgctcggcgacgatctcgacgcgccggtcgatccctcggcaccgatgcgctggaccgatgtcggcgtgcagccggaagatccggcgctgccggaaggcgtcgaagcgctggcgcagcacgtcaccgcgccgccggagctggcgcgccgcctcgctcagatcggcgtcgtcaccaaggagcgcggcaatgagctgtgcgaacaactcaagaccggccagcggctggtgtcgctcgatggcgacgtctggcgctgggacggcttcgtcgcctcggcccatgcgccgaccggcgccgcccgccgcctcgccgaacgcgcgcgcctgaccgatatcgagaacgaactcgagcaggcccggatcgaggccaccgccaagcgccaggcgctggaaaccgcggaagccgatctgaagatggcggccgccgccgagaccgcctcgcgcgagagcctgcgcggcgcccggcgcgaggtcgacgccgcacgcgagcgcttcgccgccgccgagcgcgaggtcaaccgccacgccgcgcgcaaatcggcactggccgaagcgcagtcgcggctcgccaccgaccgcgccgaagccgaagccgcgctggagaacgccgaggcccagatcgccgacctggagccgaacaccgaggccgaagcccgcctcgccgcggtgcgcggcgacatcgacggccgccgccgcatcgccgcgcagatccgcgccgaagcccaggcgctggcgcgcgaagccgagctcgccgacaagcggctgcaggcgatcgccgccgagcggatggactggcagaagcgcaaggccggcgcggcgtcgcagatcgccaccgtcgaagagcgtgtcgccgaactcaccgccgagcgcgccgagctcgagaacgcgccggaagtgttcgccgagaagcgcagcgcggtgatcaccgagatcgaattcgccgaagccgatcgccgcgccgccgccgacgcgctggcggccgccgaacaggcgatgtccgagaccgaccgcctggcgaaagcctcgctcgaacagctctccagcgcccgcgaagcctgcgcccgcgccgaggagcggatggaagcggcccgccgccggctcgaagacgtcgagcgcgaaatccgcgacatgctcgaggtcgagccgcaggccgccgcccagctcgccgagattgtcgaaggcgctgaactgccgccgctcgccgagatcgaagagagcctggacaagctgcgccgcgaccgcgagcggctcggcgccgtcaacctgcgcgccgaggaagaactcaacgaggtcgagactcagcacggcacgctggcggccgagcgcgacgatctggtcgaagcgatcaagaagctgcgcaccggcatccagagcctcaacaaggaagcccgcgagcgactgctcgcctcgttcgacgtcgtcaacggtcacttcaagcggctgttcaccacgctgttcggcggcggcgaagctgaattgaagctgatcgaaagcgacgatccgctcgaagccggtctcgacatcatcgccaagccgccgggcaagaagccgcagtcgctgtcgctgctgtcgggcggcgagcaggcgctgaccgcgatggcgctgatcttcgcggtgttcttgaccaacccgtcgccgatctgcgtgctggacgaagtcgacgcgccgctcgacgaccacaacgtcgaacggttctgcgacctgctcaccgacatggcgaagaccacggaaacgcggttcatcaccatcacccacaacccgatcaccatggcccgcatgaaccgcctgttcggcgtcaccatggccgaacgcggcgtgtcccagctcgtctctgtcgacctccagggcgcg

SEQ ID NO: 44172 - DNA, 1218 bp, Rhodopseudomonas palustris
ctgcgcgccgatgcgcatcgcatgctcgacgatatgctcgactacatcgcggacgtgcgcgaccgtccggtgtggcagccgatcccgcccgcggtccgcgccggcttcgccgaaccgctgccgcgccagggcacgccgctacccgaagtgtatcgccgcttcaccgaagagatcgcgccgtacgccaccggcaacgtccatcccggcttcatgggctgggtgcacggcggcggcactgcggtcgggatgctggccgagatgctggcggccggactcaatgccaattgcggcggccgcgatcacatcggcatcgaggtcgaacgccagatcgtgcgatggctgcgcgaactgttcggctttccgcaaaccgccagcggcgtgttcgtcaccggctcgtcgatggcgaacttcatggcgctgttggtggcgcgcaccgcagcggtcggcccgcaggtgcgcgagggcgggctgccgggcgaacggctcactgcttacgcttccgcagcagcgcacggctgcgtggtgcaggccgccgatcttgccgggctcggccgcggcgcgctgcggcggatcccattcggcaaggatcaccgcatcgatatcgacgcgctgaagcggcggatcgcggaagatcgcgctgccggctgccaaccgttcctggtgaccggatcggccggcaccgtcgatgtcggcgcgatcgacgatctcgccgcactcgccgagctgtgccgcgacgaaggactgtggtttcacgtcgacggcgcctatggctcgctcggtatgctgtcggacgaaatcgcgccgaagctgaagggcctgtcggaggcggattcgattgcgctcgacttccacaaatggggtcaggtcaactacgacgccggcttcctgatcgtgcgcgacggcgagcagcatcgtgatacgttcgcggcgccggccgcttacttgcgacgcgaaacccgcggcctcgccggcggctcgccgtggccgtgcgactacggccccgacctgtcgcggggttttcgcgcgctgaagacctggttcacgctgaagaccttcggcgccgaccggatgggcgcgatgatcgcccaaacctgcaaggtggcgcgctatctcgaagcccgtgtcgagcgcgagccacagctcgagatgctggcgccggtgacgctgaacatcgtctgcttccgttatcgcgccgcaccgaacgtgatggactcgctc

SEQ ID NO: 44173 - DNA, 1596 bp, Rhodopseudomonas palustris
atgcttggactgatgcaagactggcctttgctgtgtcatcggatcatcgagcacgcggcccggatccacggcaaccaggaggtggtcacccggtcggtcgagggtccgatcgtccgcaccacctatgcgcagatccatcagcgggccctgaaagtcagccagatgttggaccgcgccggcatcaagctcggcgaccgcgtcgcgacgatcgcctggaacaccgcccggcatctggaatgctggtacggcattatgggaatcggcgcgatttgccatacggtcaatccgcggctttttccggaccagatcgcctggatcgtgaatcacgcccaggaccgcgtgatgatcaccgatctcaccttcatcccggtgctggagaagatcgccgaccagatcccgagcgtcgaacgcttcgtcgtcctcaccgacgccgagcacatgccgcagaccacgctgaagaacgcgatcgcgtatgaagagtggctgaaggaagccgacggcgacttcgagtggaagaccttcgacgaaaacaccgcggcggcgatgtgctacacctcgggcaccacgggtgatccgaagggcgtgctgtattcgcaccgctccaacgtgctgcacgcgctgatggccaacaatcccgacgcgctcggcacccgcgccgccgacaccatgctgccggtggttccgctgttccacgccaatagctggggcatcgcgttctcggcgccgtcgatgggcaccaagctggtgatgcccggcgccaagctcgacggcgcctcggtgtacgagctgctgtcgaccgagaaggtcacccacacggccggcgtgccgaccgtctggctgatgctgctgcaatacatgcagaaggaaaagctgacactgccgcatctgaagatggtggtgtgcggcggctcggcgatgccgcgctcgatgatcaaggcgttcgtcgacatgggcgcggaagcgcgccacgcctggggcatgaccgagatgagcccgctcggcacgctcgccacgctgaagccgccgttcgaccagaccaccggcgacgcccggctcgacgtgctggcgacgcaaggctacccgccgttcggtgtgcagatgaagatcaccgacgatgccggcaaggatgtcgactgggatggcaagaccttcggccggctcaaggtgtcgggaccggcgatcgccaaggcgtactatcgggtcgacaaggagatcctcgacgatgccggcttcttcgacaccggcgacgtcgcgacgatcgaccaggacggctacatgcggatcaccgaccgctccaaggacgtgatcaagtccggcggcgagtggatttcctcgatcgacctggaaaacctcgcggtcggccaccccaaggtggcggaagccgcggtcatcggcgtgtatcaccccaaatgggacgagcgcccgctgctgatctgccagctcaagcccgacgtcacctgcacccgcgacgagatcctgcaatacatggatggcaagatcgccaaatggtggatgcctgacgacatcgtgttcgtcgaagccatcccgcacaccgcgaccggcaagatcctgaagacggcactgcgcgatcagttc

SEQ ID NO: 44174 - DNA, 1081 bp, Rhodopseudomonas palustris
ccgaatcccggcatcctcgatattgcgccctacacccccggcaagagcccggtggccgaacccggccgcaaggtgttcaagctctcggccaacgagaccccgttcggcccgtcgccgcacgcgatcgcggcctataagagcgcggcggatcatctcgaggactatccggaaggcacctcgcggatcctgcgcgaggcgatcggcaaggcttacggcctcgatcccgaccgcatcatctgcggcgccggctcggacgaaatcctcaacctgctggcgcacacctatctggcgcccggcgacgaggcgatctcgagccagcacggctttctggtgtacccgatcgccacgctggcgaacggcgccaagaacgtggtcgcgcccgagaagaacctgaccaccgacgtcgacgccatgctggccgcagtgacgccgaacaccaagctggtgtggctcgccaacccgaacaacccgaccggcacctacatcccgttcgacgaagtgaaacggttgcgcgccggcctgcccagccatgtggtgctggtgctcgacgccgcttacgccgactacgtgatgaagaacgactacgagctcggcatcgagctggtctcgaccaccgagaacaccgtgctgacccacaccttctccaaggtgcacggcctcgccgcactgcggatcggctggatgttcggcccggccaacatcgtcgatgcggtcaaccgcatccgcgggccgttcaacgtctcggtaccggcgcagctcgctgcggtcgcggcgatccaggacaccggccatgtcgagcgctcgcgcgcccacaccgacaagtggcgcaacaccctcgccgaagagctgccgaagctcgggctgacggtgacgcggagcgtgtgcaacttcgtgctgatccacttcccgaccaccaagggcaagaccgcggcggaagccgacgcgttcctgacccagcgtggcctggtgctgcgtgcgctcaacaattacggcctgccgcatgcgctgcgcatgaccatcggtaccgacgaagccaacgcgctggtgctggaaaacttgcgcgagttcatgggacagccat

SEQ ID NO: 44175 - DNA, 2571 bp, Rhodopseudomonas palustris
atgaacgttgaaaaatataccgaacgtgtgcgcggcttcatccagtcagcgcaatcgctggcgatgcgcgagggccatcagcagttctcgccgctgcacattctgaaagttctgctcgacgattccgaagggctcgcgggtggtctgatcgaccgcgccggcggcaattcgcgtgcgatcctgaaggcgaccgaggaggcgctcggcaagatgccgaaggtgtccggctcgggcgccggccaagtctatctggccccggcgaccgcccgggcgttcgacgctgccgagaaggcggccgaaaaggcgggcgacagcttcgtcaccgtcgagcggctgcttctcgcgctgtcgctcgataaggacagcgaggccggtcagctgctcaccaagggcggcgtcaccccgcagaacctcaatgccgccatcaacgccctgcgcaagggccgtaccgcggattcggcgacggccgagaacgcctatgacgcgctgaagaaatacgcccgcgacctcacccaggcggcacgcgacggcaagctcgacccggtgatcggccgcgacgaggaaattcgccgcaccatccaggttctgtcgcggcgcaccaagaacaacccggtgctgatcggcgaacccggcgtcggtaagaccgcgatcgtcgaaggcttggcgctgcgcattctcaacggcgacgtgcccgagagcctgaaggacaagaagctgctggcgctcgacatgggcgcgctgattgcgggtgcgaagtatcgcggcgagttcgaagagcggctgaaggccgtgctcaacgaggtcaccgcggccgagggcggcatcatcctgttcatcgacgagatgcacaccctggtcggcgccggcaaggcggacggcgcgatggacgcgtcgaatctgctcaagcccgcgcttgcccgtggcgagctgcactgcatcggcgcgaccacgctcgatgaatatcgcaagcacgtcgagaaggacgccgcactggcgcggcgcttccagccggtgttcgtgtccgagccgacggtcgaggacaccgtctcgatcctgcgcggcctgaaggacaaatacgagcagcaccacggcgtgcgcatcgccgactcggcgctggtggcggccgtcacgctttccaaccgctacatcaccgaccgcttcctccccgacaaggcgatcgacctgatggacgaggccgcggcgcggctgaagatgcaggtcgactccaagcccgaagaactcgactcgatggaccgcgagatcgtgcggctgaagatcgagcaggaggcgttgaagaaggaaaccgatccgggctcgaaggcgcgcctggtgacgctggagaaggagcttgccgatctcgaagagaagtcggcggcgttgacccagcgttggagtgccgagaagaacaagctgtcggatgcccagaagctgaagagcgaactcgacgctctgcggattgaactcgccaacgcgcagcgccgcggtgagtatcagcgcgcgggcgagctcgcctatggccggattccggagcttgagaagaagatcgctgagatcgaagccaacgagaactcgggcgcgatggtggaggaggcggtcaccgccaatcacatcgcccaggtggtgtcgcgctggaccggcgtgccggtcgacaagatgctcgaaggcgagaaggaaaagctgctgcggatggaagagcagctcggccagcgcgtggtcgggcagttcgaagccgtgcatgcggtctcgaccgcggtccgccgtgctcgcgccggcctgcaggacccgaaccgtccgatgggctcgttcatgttcttaggccccaccggcgtcggcaagaccgagctgaccaaggcgctcgccgagtatctgttcgacgacgagaccgcgatggtccgcatcgacatgtcggagttcatggagaagcactccgtggcccggctgatcggcgcacctcccggctatgtcggctacgacgaaggcggtgtgctgaccgaagcggtgcggcgccggccctaccaggtgatcctgttcgacgagatcgagaaggcgcatccggacgtgttcaacgtgctgctgcaggtgctcgatgacggccgcctgaccgatggtcagggccgcaccgtggacttccgcaacacgctgatcgtgatgacctcgaacctcggctcggagtatctggtcaaccagcccgagggcgaggacaccggcgcggtgcgcgagcaggtgatggggatggtgcgggcgcacttccgccccgaattcctcaaccgcgtcgacgagatcatcctgttccaccgcttgcagaagagcgagatggggcggatcgtcgacatccagttcgcgcggctcaccaagctgctcgaggaccgcaagatcgtgctcgatctcgatgctgcggcccgcgactggctcgccgagaagggctgggatccggcttacggcgcccgtccgctgaagcgggtgatccagcgcagcgtccaggacccgctcgccgagatgatcctggaaggctctgtcaaggatggcgaccacgtcgcgatctcggccgagggcggcgtgctgaccttcaac

SEQ ID NO: 44176 - DNA, 742 bp, Rhodopseudomonas palustris
ctgacgggcaagcgggcattggtgaccggagcctcgcgcggcattggcgcagcaatcgcgaaggacctggcggccaagggcgcggacgtcgcgatcacttatgaacgatcggccgatcgagccgccgaggtggtgcgggcaatcgcggcaaagggccgccgcggcgtcgcgattcaggccgatagcgccgatccggcggccttgaagtccgcagtgaacgaggctgcggccaagctcggaggcctcgacatcctggtcaacaatgccggtatcggccgcgtcggcccgatcaccgaactcagtctcgccgatatcgacgcgctgctgaacatcaacgtgcgcgcagtggtgctcgcctcgcaggccgcgatccctcacctcggacagggcggccggattatttcgattggttcgacgcttgccgagcgagtgccgttcgcaggttcgaccgtttacgcgatgaccaagtcggcgctgcacgccttcacgcgcggcctctcacgcgagctggggccgcagggcgtcaccgtcaatctggtgcagcctggatcgatcgacaccgacatgaacccggcgagtggcgagcaggccgaccagctccgcgccctgacggcgctcgggcgctacggcaagcccgaggagatcgccgccgtggtcgcgttcctggccagtccggccgccggcctcatcaccggtacgatgatcaccgcagacgccggcttctcggcctgatcccggatta

SEQ ID NO: 44177 - DNA, 1725 bp, Rhodopseudomonas palustris
gtgcgctcgaccaccacgctcaccgactatccggtgcggattaccgaccggctgcatcacttcgccgagacggcgcccgaccgggtgttcatggccgagcggaacggtgagggcggctggcgcaggatcagctatgccgagatgctgcgcgccgcgcagaccatcgcctcggcgctgatcgcgcgcggactgtcggccgaacggccggtgatgattctgtccggtaattcgatcgaccatgcgatggtgatgttcggcgcgctgtatgcgggcgtcgcgatgtgtccggtgtcgccgccgtattcgctggtgtccaaggattacggcaagctgcgccatatcgtcgggctgctgactccggggctgatcttcgccgatgacatcactgccttcgcgcccgcgatcctcgccaccgtgccggaggatgtcgagctcgctgccacgcgcggcgaggtgaaggggcgcaaggtgacgtcgcttgccgaactgctggcgacgccggaacatcccgaactcgccgccaagcacgaagcgatcggccacgacaccatcgctaagtttttgctgacgtcgggatcgaccggcaatccgaaggcggtgatcaatacgcagcggatgatctgcgccaatcaggtgatgatccgcgaggcgatggcgttcctgaaagacgagccgccggtgatcgtcgactggctgccgtggaatcacaccttcggcggcaaccacaatatcggtctgacgctgttcaacggcggctcgatgtatatcgacgacggcaagccgacgccggccgggatcgcttccaccatccgcaatctgcgcgagatcgcgccgacggtgtatttcaacgttccgaagggctacgagtcgctgctgccggtgctgcgcgaagaccagcagttgcgcaaattgttcttcagccggctgcatgcgatgttcttctccggcgccagcctcgcggcgcatgtctggaacgggcttgacgaggtcgcggtcgcggagaccggcgcgcgggtgccgatgctcaccggccttggcgccaccgagaccgcgccgttcttcatgtcggtgacgccgcagaccagtcgctccggccatgtcggcctgccggtgcccggcaacgaggccaagctggtgccgaacaacggcaagctcgaagtccgcgccaaggggccgaacatcacccccggctattggcgcgcgcccgagctgaccgataaggcgttcgacgaggagggcttctacaagctcaacgatgcgctgaagccggtcgatgccaacgacctttcgcgcggcttcgatttcgacggccggatctcggaagacttcaaactggcgtcgggcacctgggtcagcgtcggtccgctacgcgccaagttcattgccgcctgcgcctccctggtgcgcgacgtggtgatcgccgggctcgaccgcgattacgtcaccgcgctggcgatcctcgatcccgacggctgcaagctgatcaatgcgacgctgccgctggaagacctcgccggcatggcggccgaccatctgatccgcgaggcgttccgcgagcgcttcgccacgctgctgacgcaggcgaccggctcgtccaaccgcgtcacccgcgccgtgctgctcggcgaaccgctgtcgatcgacaagggggagatcaccgacaagggctcggtcaaccagcgggccgtgctggaatatcgcgcctcgttgatcgcggatctttac

SEQ ID NO: 44178 - DNA, 2808 bp, Rhodopseudomonas palustris
atgtcgtcgctgaatctgtccgccggccccgagccggtctccgaacgtcctgacgacgcggccgcgatcgaagccgagacccggctgcgcaacgacatccggctgctcggccgcattctcggcgataccgtgcgcgagcaggaaggccagagcgtgttcgatctggtcgagaacatccgccagacctcgatccgcttccatcgcgatgacgacaagaccgcgcgcgctgaactcgccgccattctcgacggcatgtcgatccaggacacgatgcggatcgttcgcgccttcagctatttctcgcacctcgcaaacatcgccgaggaccagaacaacatccgccagatgcgcgccggctcgaccgccggttcggcgccgcgcgccggcctgctcgccaagacgctggcgcacgcgcggcaggagggcatcagcgccgcggagctgcgcaagttctttgcgaccgcgctagtcagcccggtgctgaccgcgcatccgaccgaggtgcgccgcaagagtacgatggaccgggagatgcagatcgcaggattgctcgatcagcgcgaccgcgttcagctcaccgctgacgaatggaccgacaacgaggagcggctgcgccgcgccgtcgagacgctatggaagaccaacctgctgcgccggaccaagctgacggtgctggacgaagtcaccaacgggctgtcgttctacgactacaccttcctgcgcgaagtgccacggctgcacagcgcgctggaggaccggctcgccgatgcggcgaaagccgaaggcgccaacgccgagggcgagctcgccagcttcctgcggatgggaagctggatcggcggtgaccgcgatggcaatccgttcgtcaccgccgaggtgctgcacggcaccttgaagctacagagcacgcgggtgctgcgctattatctcgaggagctgcacgagctcggctcggaattgtcactggcctcgcatctcgccggcaccaccgacaccgtcaaggcgctggccgaaacttcgcccgacacctcgccgcatcgcaaatacgagccgtatcgcctcgcggtgtccggcatctatgcgcggctcgccgccacggcgctcaagctcgaggtcgagaacctccgcgccccggtcggcgaggccgagccctatgccagcgcgcaggacttcaaggccgatctcgatgccatccatctttccctgaccacgcatcattccggcgtgatcgcacgcggtcggctgcgccagctccgtcgtgcgatcgactgcttcggcttccatctcgccagcctcgacatgcggcagaactcggcggtgcatgagcgcaccatcggcgagctgatggatgcggcccggcccggcacgtcctacgcggtgctggatgaggatgcacggatcgctctgctgatcagcgagttgcgtagtacccggccgctgacctcgatgttcgtcaaatacagcgacgagacggtcggcgagcttgcggtgttccgcgaagccgccaaggcgcacgcgacctacggggcggcggcgatcccccaatgcattatctcgatgacaaagggcgtctccgacctcttggaactcgcggtgctgctcaaggaagtcgggctgatcgatccatccgggcgcagcgccatcaacgtggtgccgctgttcgagaccatcgaggatctgcaggcctgcgccaagatcatggaccggctgctgtcgatccccgaatatcgccgcctggtcgacagccgcggctcggtgcaggaggtgatgctcggctactccgacagcaataaggacggcggcttcgtcacctcaggctgggagctgtacaaggccgagatcggcctgatcgagatcttcgagcaccacggtgtgcggctgcggctgttccacggccgtggcggctcggtcggccgcggcggcggcccgagctacgatgcgatcgtggcgcagccgggtggtgcggtgaacggccagatccgcatcaccgagcagggcgagatcatcaccagtaaatattccaacgtcgaagtcggccgcaacaatctcgagatcctcgccgccgcgacgctggaggccagcctgctgcagccgaagcgggtggcaccgcatcgcgactatctcgaagcgatggagcagctctcggccttggccttcaaggcctaccgcggcctggtgtacgagaccgacggcttcgtcgattacttctgggcctcgacggtgatcaatgagatctcgacgctgaacatcggtagccgcccggcctcgcgcaagaagacccgcgcgatcgaagacctccgcgccatcccctgggtgttctcatgggcgcagtgccggctgatgctgccgggctggtacggcttcggcagcgcggtctcggcctgggtcaccgaacacccggagaagggcatcgcgtttcttcaggcgatgtatcaggagtggccgttcttccgtacgctgttgtcgaatatggacatggtgctgtcgaagagctcgatcggtatcgcctcgcgctatgccgagctggtcgaagacaccgcgatccgcgaccgcatcttcagccgcatccgcgccgaatggcattcgtcgatcgactatctcctggcgatcatgcagcaggaccatttgctgcagagcaacccattgctcgaacgctcgatccgccaccgcttcccgtatctcgatccgctgaaccacgtccaggtccagctgctgcgcgaacatcgtacccacgatccggacgaacaggtgctgcgcggcgtgcaactgacgatcaacgggatttccgcggggctgcggaatagcggg

SEQ ID NO: 44179 - DNA, 1311 bp, Rhodopseudomonas palustris
agcttcgacgaggtgaacgcgcgcgtcgcgaccatcgccggcggcctgcaggcgctcggcgtcaggcccggcgattgcgtttgcgtgctgatgcgcaacgacatcgcctttatggaagcggtgtatggcgtgatgacgctcggcgcctatgcggtgccggtgaattggcatttcaagccggaagaagtcggctacatcatcggcgattccgccacgcgggtgctgatcggccacgccgatctgctgcacagcgtcgcctcggcgattccggcagacctcaccgtgctcagtgtgccgacgccgcccgaagtgatcgccaactacaagattgcgccggatcatctgtcgccgccaaacaatgcgatcgatttcgacggctggctggcgcagcagaagccgtatgacggtccggcgcagccgcagccgcagaacatgatctacacctccggcaccactggccatccgaagggcgtcaagcggttcgcgccgactccggagcaggccgcgcacgccgagaagatgcgcgcgacgatctacggccttaagccgcaggtgcgcgcgctgtgcccggggccgctgtatcactccgcgccgaattcgttcggcatccgtgccggcaagctcggcggcgtgctggtgctgatgccgcggttccacccggaggagttcctgcaattggtgcaggagcacaagatcgacaccgtgttcatggtgccgacgatgttcatccggctgatgaagctgcccgcggaggtgcgcgccaagtacgacgtctcgtcgctgcgccacgttatccacgccgccgcgccatgcccggccgacgtcaagcgcgcgatgatcgagtggtgggggccggtgatctatgagttctacggctcgactgaatcgggtgcggtgacgttcgcgacctccgaagacgcgctgaataagcccggcacggtcggcaagatcgcgcacggcgctgagctgaagttcatcgacgacgacggcaacgaagtgccgcagggcgagatcggcgagatcttctcgcggatcgccggcaatccggacttcacctatcacaacaagccggagaaacgcgccgagatcgaccgcggcggcttcatcacctcgggcgacatgggctatctcgacgacgacggctacgtgttcatctgtgatcgcaagcgtgacatggtgatctccggcggcgtcaacatctatccggccgagatcgaggcggcactgcacgccgtgacgggcgtgcacgactgcgcggtgttcggtattccggacgcggagttcggcgaggcgctgatggcgatgctggag

SEQ ID NO: 44180 - DNA, 921 bp, Rhodopseudomonas palustris
cagcgccgctacagaaaagcgttgtcgggatttagtcaatcgcctaattaacgaccaacttcaacttttccgggcggttttctcatgttcacagatcagcttctcgccggccgtcgcatcctcgtcaccggtggcggcaccggcctcggcaaggcgatggcggcgcgcttcctgcagctcggcgccgaagtgcacatctgcggccgccgcaagggcgtgtgcgacgagaccgcgaccgaactgatggatcagtacggcggcaaggtgatgacctacggcgtcgacatccgcgacgccgcggcagtcgaccacatggtcgagaccatcttcgagagcgggccgctcaccgacctgatcaacaacgcggcgggaaatttcatctcgcggagtgaggatctcagcccgcgcggcttcgacgccgtcgccaacatcgtgatgcacggcacgttctacgtcacgcacgcggtcggcaagcgctggatcgccggcggccaccgcggcaacgtggtgtcgatcaccaccacctgggtgcgcaacggcagcccctatgtggtgccgtcggcgatgagcaagtcggcgatccacgccatgacgatgtcgctcgccaccgaatggggcaaatacggcatccgtctcaacaccattgcgccgggcgaaattccgaccgagggcatgagcaagcggatcaagccgggcgacgaagccggcgcacgcaccatcaagatgaacccgatgggccgcgtcggcaccatggaagagctgcagaacctcgcaaccttcctgatctccggcggctgcgactggatcagcggcgagaccatcgccatggacggcgcccagggcctcgcgatgggaggcaacttctaccagctccgcgactggagcaacgccgactgggatcaggccaaggcctcgatcaag

SEQ ID NO: 44181 - DNA, 1473 bp, Rhodopseudomonas palustris
acctttgcggatttcgaccgccacaccaatcaggtcgcccgcgcgctgcaggcctccggcgtgcaaccgaacgagcgcatcgcctatctcggcaagaacagcgacatctatttcgagctgtggtccggcgcgatcaaagccaaggcggtgatggcaccggtgaactggcggctcgccgggccggagatcgcctacatcgtcgaggactgcaaggcggcgatcctgttcgtcggcccggaattcgtcgatcaggtctgcggcctcaaggaccagatcccgagcgtgcgccacatcatcaccaccgaaggcggcgcgccggagtggcaggacttcaccaaatggcgcgacgcgcagtcgagcgatgatccacaggtcgcgatcgcgccgtccgacatcgcgatccagctctacacctccggcaccacaggaaaaccaaaaggcgcaatgctcagccacgccaacttcctgtccctggtccgcgccggccaggacaacaagccggagtggaaccgatggtcgcccgacgacgtctcgctggtggcgatgccggtgttccacatcggcggctccggctggggcatgatgggaatctatcacggcgccaagggcgtgatcgcgcgtgaattcgatccgaccaaggtgctcgatttcttcgagcagtccggcatcaccaagctgttcatggtgccggccgcgatgcagttcgtggtgcggcagccgcgtgctcgcgaggtcgatttctcgcggctgaaatacatgctgtacggcgcctcaccgattccggcggcgctgctgaaagaatgcatcgacgtcttcaagtgcggcttcgtgcagatgtacggcatgaccgagaccaccggcaccatcgtggcactgccaccggaggaccacgtcgaagggctcgaacggatgcgctcggccggcaaggcgctgcccggcgtggagatcgcgatcctcgatcccgacggcaaaccgctgccgccgcggcaggtcggcgagatcgcgacccgctccggctccaacatggtcggctactggaatctccccgacgccaccaagaagacgatcgacggcgacaactggctgcgcaccggcgacgccggctacatggacgaggacggctacgtctacatccatgaccgcatcaaggacatgatcatctccggcggcgagaacatctatccggccgaggtcgagagcgcgatctgcgatcaccccgacgtcgccgaagttgcggtggtcggcgtgcccgacgatcagtggggcgagtcggtgaaggccgtggtggtgatgaagcccggcaaggaagcgaccgcgcaggacatcatcggcttcacccgcacccgcatcgccggctacaagacgccgaagtcgatcgacttcatcccggccctgccccgcaacgcctccggcaagatcctccgccgccagctccgcgatccgtattggagcggcaaggatcggcaggtgaac

SEQ ID NO: 44182 - DNA, 1173 bp, Rhodopseudomonas palustris
ctggagcaggcggacgacaacatccgcttcttcgatcatcgccgcgaatgggcgcgcacggatttcgagcatggcgggctgccacgccacgagtgggaagatctgctgcgcaaggcgaagaacctcgccgacgacgccggtcatctgcgctttgcgatcccgaagcgttacggcggccaggacggcaccaacctctggatggcggtgatccgcgaacacttcgccgccaagggactcggcctgcacaacgacctgcagaatgagcattcgatcgtcggcaattttccgatcgtgaagatgctggatctgtacggctcgcccgaacagaaggcgatgatcgacggttcgatcaccggcaagtaccgcatcacgtttggcctgacagagcccgatcacggctccgacgccacgcacatggaaacgcgcgccgaagaagcggtgcgcgacggcaagaagggctgggtgatcaacggcgagaaaatgtggacgacggggatgcacgtcgccacgcattgcgcgctgttcgcccgcaccgccggcaaggacggcgatgcacgcggcatcacctgcttcctggtgccggccgatgcgcccggtgtgaaggtcgaagagtatctgtggaccttcaacatgccgaccgaccatccgcgggtgtcgttcaaggacgtgttcgtcaccgaggacgcggtgttcggcgaggtcggtcgcggtctgtcgctggcgcagtgcttcgtgcatgagaaccgcatccgccaagcagcctcgtcgctcggcgcggcggtattttgtatcaacgagagcgtcaaatacgcgcgtgagcgcaagccgttcggcgaggagttggcgcgcaaccaggcgatccagttcccgctggtcgaactcgcgacccaggccgaaatgctgcgcctgttgatccgcaagacggcgtgggagatggatcagatgactcaggcccaggtcgagcacacgctgtccgacaaggtttcgatgtgtaactactgggcgaaccggctgtgcggccaggcggccgaccgcgcgattcaagtgcacggcggcatcggctattcgcgccacaaacagttcgagcacatctaccgccaccaccgccgctaccgcatcaccgaaggcagcgaggaaatccagatgcggaaggtggcgggcttcctgttcggc

SEQ ID NO: 44183 - DNA, 756 bp, Rhodopseudomonas palustris
ttgagcggccgcgtcgcggtcgtcaccgggggcaacggtggtatcggcctcggtatggcacaggctctggctgctgcgggctgtaacgtgtcgatctggggtcgcaacgcggtcaagaatcacgccgcgctcgctaccatggcaaatgctcccggcaaggtcgaagctcagatctgcgacgtcaccgatccggcttcggtgaaggccgcgatggacgcgacgctgaaggcattcggccgggtcgacggctgcttcgccaatgcgggcatcggcggcggcggccggcaggctttcatcgaccgcaccgaagagcaatggcgctcgatgttcgccaccaatctcgacggcgtgttccacgccttccaggctgcggcccggcatatgaccgagcgcgccgccgacggcgatccgttcggccggctggtcgcgacctcgagcctcgcttcgatcttcggcaccgcgcgcaacgagcactacgcggccaccaaggcggcgatcaatgcactggtccgcgcgctcgcggtcgaactcgcgcgctatggcgtcaccgccaatgcaatcctgccgggctggatcaagagcgatatgaccgcgggcatcatgggcaacgacaaattcgtcgccaatgtgatgccgcgtattccggtgcggcggttcggcgagccggaagacttcggcggcatcgcggtgtatctgatgagcaaggcatcgtcgtatcacaccgccgatactttcgtgattgacggcggctacacc

SEQ ID NO: 44184 - DNA, 1047 bp, Rhodopseudomonas palustris
tatcgcatcgccgtgatcgcgggcgacggcatcggcaaggaagtgatgccggaaggattgcgcgtgcttgaagcggccgcgaagaagcatcgggtcaaactggtgttcgaccatttcgatttcgccagctacgactattacgagaagcacggccagatgatgccggacgactggaaggagaagatcggcggtcacgatgcgatcttcttcggcgcggtcggttggccggccaagatcccggatcacatttcgctgtggggttcgctgatcaagttccgccgcgagtttgatcagtacgtcaacctgcgccccgtgcggctgatgcccggggtgccgtcgccgctcgccggacgcaagccgggagacatcgatttctgggtggtgcgcgagaacaccgagggcgaatactcctcggtcggcggccggatgttccccgacaccgagcgtgagttcgtcacccagcagtcggtgatgacccgggtcggtgtcgaccgcattctgaagttcgcgttcgaactggcgcagtcgcggccgaagcggcatctcacctcggcgaccaagtcgaacggcatctcgatcaccatgccgtattgggacgagcgcgtcgaagcggtggcgaagagctacccggaagtgaagtgggacaagtaccacatcgacatcctcacggcgcacttcgtgctgcatccggactggttcgacgtggtggtcggctctaatttgttcggcgacatcctgtccgaccttggtccggcctgcaccggcaccatcggcatcgcgccgtcgggcaacatcaatccggagggcgacttcccgagcgtgttcgagccggtgcacggctcggctccggacatcgccggacagggcatcgccaatccgatcggaatgatctggtcgggcgcgatgatgctggagcacctcggcgagaagcaggctgcggattcgatcgtcaaggcgatcgaacgcaccttggaggaacgcacgctccgcacccgcgatctcggcggtcaggccgacacctcggcctgcggcaagggcgtggccgag

SEQ ID NO: 44185 - DNA, 1319 bp, Rhodopseudomonas palustris
ctgagcccgtggccggtttgccggtgttgtcgcacattcgcaaagacttcatctggggcgtgtcgaccgcgagcttccagatcgaaggcgccgccaacgaggacggccgcggccagagcatctgggacgtgtactgccgctccggctacgtcgccaacaacgacaccggcgatgtcgcttgcgatcactatcatcgctaccaggaagacgtcgcgctgatgaagacgctcggcattcaggcgtatcgattctcgatcgcctggccgcggatcttcccgcaaggcaccggcgcgatcaacgagcccggcctcgccttctatgatcgcctgatcgatgcgctggaggccgccggcatcgagccgtggatctgcctgtatcattgggatctgccgcaagcgctggaagagcgcggcggctggatgaatcgcgatatcgtcggctggttcgccgactacgcgtgggtgatcggcgagcgttacggcaagcgcgtgaagcggtttgccaccttcaatgagcccggcatcttcagcctgttcagccgctcgtttggcgcgcgcgaccgcagcgccgacgagaagctgcaccgctggattcaccacgtcaatctggcgcacggcgccgccgtcgacgtgctgcgcgagaccgtggcggatgcaaagatcggattggtcaccaactatcagccggtgtacccatcgagcgacaagccggaagacgtcgctgaggccaagctgatcagcgactattggaatcgcgctttcgccgatccgcaatatcgcggcgagtatccagacctgatccgcgacgccatcaagccgtatatccagcccggcgacatggagcgcatccaccggccgctcgactggttcggcctgaaccattacagccccgtctatatcaactccgatccgaacgcgatcgtcggactcggctggggaccgaagcccgagggtattccgcgctcgccgatcgactggacgatcgagccggatgccttccgcgatacgctgatcgagatcagccgccgctacggcaagccggtttacgtcaccgagaacggttacggcagcaatatcgagaagccagacgccaacggcgaagtggtcgatccgggccggatcggcttcctgcgcgactacatcaccgccctcgaccaggcggtcgcagccggcgccgatgtgcgcggctacatggtgtggtcgctgctcgacaatttcgagtgggaatccggctacagcgtgcgcttcgggctgatctacatcgactatgcaacgctgcgccgaatcccgaaggcgtcgttcaagtggttcgccgacgtg

SEQ ID NO: 44186 - DNA, 813 bp, Rhodopseudomonas palustris
ctcgagaggctgccgctgtcgcggcgtgggccttccgaggtgctgatcgaggtgaaggcggctgcggtcaatccgtccgacgtcaaggccgcgaccgggctgatgccttacgcggtgtttccgcgcacgccgggccgcgatttcgccggtcgcgtcatcgacggtcctgccgaatggctcggccgcgacgtgttcggctcgtccggcgatctcggcatccgccgcgacggcacgcacgcgacccacttggtggtggaggccgacgcgctggtcgagaagccggggagcgtgtcgtgggaagaggcggccggcatcggcgtgccgttcgtcactgcgaccgaaggtctgcgccgcgctgcgctcgcggccggcgagacgctggtgatcatgggcatcaacggcaaggtcgggcaggcggccgcgcagatcgcgagctggcgcggcgcgcgggtgatcggtgtggtgcgcaaggcggagccctatgctggccatgccaccgcgccggtggagatcatcgactcatcgtccaccgacgtcgccgccaaggtgcgcgaactcaccggcggcaagggcgccgacgtggtgttcaacaccgtcggcgatccgtacttcaaggcggcgaatcagtgcctagcgctgcgcggccggcagatcctgatcgccgccgtgcatcggattgtcgaattcgacattctggcgttctatcgcggtcagcacacctatgtcggtatcgacacgctggcgttctcgtcgatcgcgaccggcgaggtgctgcgctcgcttggggacggcttcgccggcggccatctcaag

SEQ ID NO: 44187 - DNA, 1062 bp, Rhodopseudomonas palustris
aagaagaaggccgagggcggctgggcctgcctgacctggccgagcgaatatggcggccgcggcgcgacgccgatcgagaaggtgatctggcagcaggaagagggcgtttacggcaagctcacccagccgttccagatcggcgagggcatgtgcggcccgaccgtgatggcttacggtgccgaggagcacaagcgccgttacttgccgaagctcgcctccggcgaagagatctggtgccagctgttctccgagccggccggcggctcggacgtcgcgggcctgcgcacccgcgccgagaaggatggcgacgactggatcatcaacggccagaagatctggacctccggcgcacactactcggactacggcctgctcatcacccgcaccgacccgaatgtgcccaagcacaagggcctcaccatgttcttcctggacatgaagagccccggcgtcgaggtgaagccgatcaagcaggccaacggcatgcaggaattcaacgaggtgttcttcaccaacgtgcgcattccggacagccagcgtctcggcgccgtcggcgacggctggaacgtgtcgctgaccacgctgatgaacgagcgtatgtcgatcggcgcgcggcttgccaccggcttcccggagatcttcgcgttctgcaatgatctggtgacggagaacggcccggcgatcgacgatccggcggtgcgcagcaagctggcgaactgggccgtgaaggccagcggcctgaagtacacgtcgtatcgctcgatctcggcgttgtcgaagggccagcgcccgggtccggagaactcgatcggcaagctcgtggccggcccgatgctgcaggacatcgcggcgtttgcgatggatctggaaggcgccgcgggcgtgttcaccgatccggccgaggccgaagccggcggcagcttccaggcgatgctgctcggctcgccctcgatgcgcatcgccggcggcaccgacgagatcctgcgcaacatcatcgccgaacgcgtcctcggtctgcctggtgacatccgggtcgacaaggacgtcccgttcaacaagatc

SEQ ID NO: 44188 - DNA, 2353 bp, Rhodopseudomonas palustris
gaaggcaaggccgactatgaccgcgacctgtggaagggcctcgccgagatgggcttcctcggcgtcgcgattcccgaggaatacggcgggaccggtgcgggccacctcgagctctgcgtgatcgccgaggagctcggccgcgtactggcgccggtgccgttctcgtccaccgtgtatctggccgccgaagcgctgctgctggcgggttcggaagagcagaagcagaagtggctgccgaagatctcgtcgggtgaggcaatcggcacgctggcgctgttcgaaggcaccggcaatccgtcgtcggccgccgtcaagctcgcggtgtcgaacggcacgctcaccggcaccaagaagccggtcgccgacggcgcaatcgccgacttcgcgatcgtcgcggcgcgcaccggcaacagcggccgcgagactgatgtctcgctgtttctggtcgatctcaaggctggtggcgtcaccgccaagccgctgcacaacgtcgatccgtcgcgccagcaggccgaactgaccttcgcgggcgccaaggccgagccgctcggcgcggccaatgagggctggagcattctgtcgcgcgtgatggaccgcgccgcggtgctgatcgcgttcgagcaggtcggcggtgccgaccgtgcgctggagatgggccgcgactacgcgctcgaccgcatcgcgttcggccggcagatcggttcgttccaggcgatcaagcacatcctggccgacatgtacgtctcggcgacgctggcgcgttcgaactcctactacggcgcctgggcgctctcgaccgacgcggccgagctgccggaggccgctgctgcggcgcggatcagcgccacgcaggcgttccagcattgcgccaagcagaacattcaggtgcacggcggcatgggcttcacctgggagttcgactgccacctgtactatcgccgctccaacgcgctggcgctcagcctcggcagccagtcgtattgggaagatcagctgatcgaccggatgcgccagaagaacgcggcgtaacttacgtgaacctcatcctgaggagcccggcgcagccgggcatctcgaaggatgaggatgaacagctcatggttcgagacgcgcgcgagagcgcgctcctcaccatgagggcccgtcaggacaaaggttcgcatcgatgaacttcgacgataccccgcaggaagccgaattccgcgccaaggcgcgcgcctggatcgacgccaacgcgccgaagcaatacgaggaagagctgcgcaaagcgtcgctcggccgggtcgtgctgaagggcgccaatattctcgaggtcgccaaggcctggcagaagaagaaggcggatgcgggctgggccgttccgcattggccgaaggaatatggcggccgcggcgcctcgccgatcgagcgcgtgatctggcagcaggaagagggcgtgttcggcaagctcacggcgatgttcatcatcggccagggcatgtgcggaccgaccatgatggcctacgcctcggaagagcagaagcggcactacctgccgccgctcggctccggcgaaaagatctggtgccagctgttctccgagccggccggcggctccgacgttgcgggcctgcggacgcgcgccgagaaggacggcgacgactggatcatcaacggccagaagatctggacctccggcgcgcactactcggattacggcatcctgatcacccgcaccgacccgaccgtgcccaagcacaagggtctgacgatgttcttcctcgacatgaagagcgaaggcgtcgaggtgcggccgatcaagcaggccaacggcaattccgacttcaacgaggtgtacttcaccaacgtgcggattccggacagccagcgcctcggcgccgtcggcgacggctggaacgtgtcgctgacgacgctgatgaacgagcgcatgtcgatcggcgccaacgtcgcgaccggcttcccggagctgttcgattattgctcgtcgctgacgctcgacggtgcgccggcgctcgacgatcgcgcggttcgcagcaagcttgcgaactgggcggtgaaggccagcggcctgcgctacacttcgttccggtcgatctcggcgctgtcgaagggccagcgtccgggtccggagaactcgatcggcaagctggtcgccggttcgatgatccaggaagtcgcgatgtacgcgctcgatctgcagggcgccgccggcgtgctcagcgggccggaggatgctgaggtcgccggccgtttccaggcgatgctgctgcgttcgccggcgacccgcgtcgaaggcggcaccgacgagatcctgcgcaacatcatcgccgagcgcgtgcttggcctgcccggt

SEQ ID NO: 44189 - DNA, 756 bp, Rhodopseudomonas palustris
atgcagttgaaagacgtctccgttctcatcaccggcggtggttcggggctcggcgccgcgaccgcgcgggcgatggccgccaagggcgccaaggttgccgtgctcgacatgaacaaggacaatgccgagaaggtcgccgccgagatcggtggcgttgcctgcgtcggcgacgtgtcgcaggaagccccggtcaaggaggcgatcgccaaggctgaagccgcgcacggcatcgtccgcgtgctggtgaactgcgccggcatcggcggtgcggtgaagaccgtcagcaagaacggtgcctatccgctcgatcacttctcgcgcatcatcaacgtcaacctgatcggcagcttcaactgcatccggctcgtcgccgagcgcatgcagagcgcgccgaccatcggcgaagagcgcggcgtctgcatcaacaccgcgtcggtggcggcgttcgacggtcagatcggccaggccgcttactcggcctcgaagggtggcatcgtcggcatgaccctgccggtggcgcgcgacctcgcgtcgatgaacatccgcgtcatgaccatcgcgccgggcctgttcctgaccccgctgctgatgggcctgtcggaagatgcccgcaagagcctcggctcccaggtgccgcatccggcccgcctcggcgacccgtcggaatacgcttcgcttgcggtgcagatcgtcgagaacccgatgctgaacggcgagaccatccgtctcgacggcgccatccgcatggcgccgcgc

SEQ ID NO: 44190 - DNA, 1167 bp, Rhodopseudomonas palustris
atggccgaggcctatatcgtcgctgccgctcgcactgccggcggccgcaagggaggtcgtctggctggctggcatccggtcgacctcgccgcctccgtcatcaatgcgctggtcgaccgttcgggcgccgcgccggatcagattgaagacgtgatcatgggctgcgtgggccagggtggcgagcaggccgtcaatgtcggccgcaacgcagtgctggcctcgaagctgccggaaagcgtgccgggcacgtcggtcgaccgtcagtgcggctcgtcgcagcaggcactgcatttcgccgcacaggcggtgatggccggcaccatggacatcgtgatcgccgccggcgtcgaatcgatgacccgcgtgccgatgggctcgccgagcatcctcgccgccaaggccgggctcggtaactacaagagcccgaagatggaagagcgctacccgaacatccagttcagccagtttgtcggcgccgagatggtggcgaacaagtacaacctgtcgaaggacgagctcgacgaattcgcattcaacagccaccagcgcgcgatcgccgcgacgcaaggaggcaagttcaaggacgagatcatcccactcgagatcacccgcgccgacggctcgaccgacatccaccacatcgacgaaggcattcgcttcgacgcgacgctcgacggcatcaagggcgtcaagctgatcaacgaaaacggcggcaagctgacggcggcgaccgccagccagatctgcgacggcgcctccggcgtggtagtggtcaacgagaagggcctgaagcagctcggcgttcagccgctggcgcgtgtccatcacatgacgatgcgcggcggcgatccggtgatcatgctggaagcccccctgcccgccaccgaatacgcgctgaagaaggccgggatgaagatcgacgacatcgatctgttcgaggtcaatgaagcgttcgcctcgatcccggccgcctggctgaaggcgaccggtgccgatccggcgcggctcaacgtcaatggcggcgcgatcgcgctcggccatccgctcggcggctccggcaccaagctgatgactacgctgatccacgcgctgaagcagcagaacaagcgctacggtctgcagacgatgtgcgaaggcggcggcatggccaacgtcaccatcgtcgag

SEQ ID NO: 44191 - DNA, 1482 bp, Rhodopseudomonas palustris
gacaaagttgcctaccggatggcctcgaccggtcaggccctcacctaccgacagctcgacgagcgctccaatcagggcgcgcatctgttccggtcgctggggctgaaggccggcgatcacatcgcgctgctgatggaaaaccggctggcgttcatggagatctgctgggcggcgcagcgcgcgggcctgtattacaccgcgatcagccgctatttgaccaaagacgagatcggctacatcgtgcaggactgcggcgccaaggtggtgatcacctccgcgcagggcagcgagacgatgaagtcgctgctgtcggacgggccgggcgcgccgctctactacatggtcgatccgccgaccgcgggcttccgctcatgggagcaggaaaccgccgcacagccgaccacgccgatcgccgatgaagtcgccggctacgacatgctgtattcctccggcaccaccggccggccgaagggcatcaagcgcgaattcgaaggcaacgccatcgacgtgccgagcccgttcctgcgcctgctgtgcgagaagatgtgcggcatgaacgccgagagcatctatctgtcgccggcgccgctgtatcacgccgctcctttgcgcttcaacatgatggcgaccacgctcggcggcacctcgatcatcatggagcatttcgacgccgagcagttcctggcgctggtcgagaagtacaaggtgacgcagtcgcagctggtgccgacgatgttcgtgcgcatgctgaagctccccgacgaggtccgcagccgctatgacgtgtcgacgctgaaaggcgcgatccacgccgccgcgccctgcccggtcgacgtcaaggccaagatgatcgagtggtgggggccgatcctgatcgagtactacgccggctccgaaggcaacggcgtcacggtctcgacctcgcagcaatggctggcacatcgcggcacggtcggcaaggcggtggtcggcaccatcaagatcctcgacgacgagggcgaggagcagccggtcggcgagatcggcacggtgtacttcgccgatgcgccgtcgttcagctatcacaacgatccggacaagaccaagaaggcctacaacgagaaaggctggtcgacgctcggcgacgtcggctatctcgacgacgagggcttcctgtatctcaccgaccgcaagagctacatgatcatctcgggcggcgtgaacatctacccgcaggagaccgaggacgtcttgctgacccatccggacgtcgccgacgtcgcggtgttcggcgtgcccaatcccgagatgggcgaagaggtgaaggccgtggtgcagctccgcgacggcgcggctccgagcagcgagcgggcggccgagctgatcgcgttctgccgcgagcggctgtcgccgatcaagtgcccgcgttcggtcgacttcgaggccgagctgccgcgcacccccaccggcaagctggtcaagcgccacctcaaggaccgctac

SEQ ID NO: 44192 - DNA, 1182 bp, Rhodopseudomonas palustris
atcctgatcggcgcgtcggtgctgctcagcctcgccatgggcatgcggcaaagtttcgggctgtttcagccctcggtgatccgcgatgtcggtatcaccagcgctgacttctcctttgccacagcgctgcagaacatcatctggggtgtcacgcagccgatggtgggactgatcgccgaccgctacggcacccgctgggtgatggcgggcggtgtgatcgtctatgcggccggtctcgttctgatgatggttgcggactcggcgctgatgttcacgttgggctgtggtgtgtgtgtcggcattgcgctgtcgtgcaccgcctccagcatgaccatgacggtgacctcgcgcacggtgtcgccggccaagcgcagcgtcgcgatgggggcggtctcggcggccgggtcgctcggcctggtgctggcctcgccgctggcgcagacgctgatctcgaccgccggctggcagatggctctgatcggctttctcggccttgccgctgcgatgctgccgtcggcgctgttcgccggccgtgccgacaagctcgacatcgacaagtcggacgacgtgcagcagtcggccggcgaggtggtacagaccgcgctcggccattccggcttcctggtgatggcgatcgcgttcttcgtctgcggtctgcagctcgtgttcatcaccacgcatctgccgaactatctggcgatctgcggcctcgatccgtcgctcggcgcgtccgctctggcggtgatcgggctgttcaatgtgttcggctcttatgcgttcggctggctcggcggcaagtttccgaagcagtatttgctcggcggcatctacatcgtgcggtcgttgacggtcgcggcgtatttctatttcccggcgtcagcgacttcgacgatcgtgttcgccgcgatcatgggatcgttgtggctcggggtgattccgctggtgaacggcctggtcgcccagttgttcggcctgcgctacatggcgacgctgaccggcatcgccttcctcagccatcaggtcggctcgttcctcggggcctggggcggcggcgtgatctacgaccatctcggcagctatgatcgcgcttggcaggctgcggtgctgatcggcctgatcgccggttgtgcccagatgctgatgaacgttcggccgccacgccgccgggacgaattggctgtg

SEQ ID NO: 44193 - DNA, 1326 bp, Rhodopseudomonas palustris
acgctggagcagcgtcaggaccggctcgccaggctgcgcgcgctgatcaaggacaacgaaaaacgattcgagcaggcgatctccgccgatttcggtcaccgcagctcgaccgagacgctgatcgccgagacgctcagcctgctcggcgacatcaagcatacctcgcggcatctcaagcgctggatggcgccgcgcaaggtgtcgacccagctccagttcctgccgggcaagaaccggctgctgccgcaaccgctcggcgtggtcggggtgattgcgccgtggaattatccgctgcagctcaccgtcgcgcctgcgatcggcgcgatcgccgccggcaaccgggtgatgatcaagccgagcgaattgtcgccgcactttgccgcactgctgcaggagacggtcgcggccaagttcgatgccagcgagatgatggtgaccgggatcgaggccggcgtcgccgaggccttcgcgcgactgccgttcgaccacctgatgttcaccggctcgacccgcgtcggccgcatcgtcgccgctgaagctggaaagaacctcaccccggtcacactcgaactcggcggcaaatcgccgaccatcgtcgaccggtcggccgatctcgacgaggtggcaccgcggatcgcctacgccaagctgatgaacgccggccagacctgcatcgcgcccgactacgtgctggccccgcaggacagagtcgaagccctcgccggcaagatctggggcgcgatgcaacagatgtggggcaccgacccggccaatccggactacacctcgatcatcgccgagcatcactacgcgcggctgaagagcctggtcgacgatgctgtcgcacgcggcgcgcggctgctgcagcccgcctcggccgacgatgccgcgtgggcgggcaagcgcaaattcccgccgaccctcgtgctcggcgcaacgcacgagatgaagatcatgcaggaggagatcttcggtccgctgctgccgatcctcggttacagcgagccgaccgagccgatcaatttcatcaacggacgtgaccgcccgctggcgctgtattggttcggcaccgacgacaccgcgcgcgaccaggtgctggagcggaccgtctcgggcggcgtcaccatcaacgattgcctggtgcatttcgcccaggccaaccagccgatgggcggcgtcggtgcctcgggcaccggcgcgtatcacggcgaatggggcttcaacaccttcaccaagatgaagccgatcttctatcgctcgccctacaaccggttcgccgatctgtacccgccctacggcgccaagatcgcgcggctgtcgaaggtg

SEQ ID NO: 44194 - DNA, 1566 bp, Rhodopseudomonas palustris
gatttcgtcgtggtcggcggcggctccggcggctgcgccgtcgccggtcgcttgtcggaagacaccaacacgtcggtggctctgctcgaagccggcggcacggccgacaactgggtggtgaagacgccctacgcgctgtcgctgatggtgccgagcaagctgaacaactggcatttcgagacggtgccgcagcccggcctcaacggccgcgtcggctatcagccgcgcggcaaagggcttggcggctcgtcggcgatcaacgccatggtctatatccgcggccacaaatgggactacgaccattgggccgaactcggcaatgccggctggtcctacgccgatgtgctgccgtacttcaagcgctcggaaaacaactccgatttcaacggcgcttatcacggccagagcggaccattgcacgtcaacaagctgcgcaccgacaatccggcacacgagatcttcctgcaggcggcgcgcgaggcgcagtttcgcatccgtgacgacttcaacggcgaggagcaggaaggcctcggcttgtatcaactcacccagcacgatggcgaacgctggagcgccgcgcgcgcctatgtgcatccgcacatcgggacgcgctgcaatctgcgggtcgaaaccgacgcgcaggcgacccggattctgatcgaaggcggtcgcgcggtcggcgtcgcgtatcggcagaacgatcagatccgcgagatccgcgcgcgccgcgaagtcatcctcgcgtccggcgccttccagtcgccgcagctgctgatgctgtcgggcatcggcgatgccgccgcgctgaaggcgcacggcatcgacgtggtgcaccatctgccgggcgtcggccagaacctgcaggatcacccggacttcatcttcgcctatcagtcggacagcccgtatttcaccggcaccagcttcaccgggatcgcccggctgctgtcgacgatcggtcaatatcgccgcgagggccgcggaccgctgaccaccaacttcgccgaatgcggtggcttcctgaagacacgtcccgacgtcgacgtgccggatatccagctgcatttcggcatggcgatggtcgacgatcacggccgcaagcggcactggggcacgggattttcctgccatttctgtctgctgcggccgaagagccgcggcagcgtcgggctcgccagcgccgatcccttggcgccgccgcggatcgatccgaacttcttcggcgatccggacgacctcgaaaccatggtggcgggctacaagacgacacagcggctgatggagacgccggcgctacgcgccctgcagcagaaggatctgttcaccgccaatgtccgcaccgacgacgacatccgcgccatcctgcgcgcccgcgtcgacacggtgtatcacccggtcggcacctgcaagatgggcagcgacgcgacggcggtagtcgatccgcgcctgaacgtgcatggcatcggggccttgcgcatcgtcgacgcctcggtgatgccgactttgatcggcggcaacaccaacgcccccaccatcatgatcggcgagaaagccgccgacatgatc

SEQ ID NO: 44195 - DNA, 738 bp, Rhodopseudomonas palustris
gtcagcaacgaagtcattctggtcacgggcgcatcgcaggggctgggccggcaattcgcgcgtgtgctcgccgcgcgcggcgccgcgatcgtgctggctgcgcgacagatcgacaagttgcagagcctggaacaggagatcgagggcggcggcggccgcgccgtcgcggtgcgcatggatgtcaccgatctcgggggaatggcagctgcgctcgatcaggccgaggccgcgctcggaccgatcaccgtgctgatcaacaatgccggcgtcgccactgagaaactcgcgatcgacaccagcgaggcggattgggacaaggtgatcggcgccaatctgaagggcgcttacttcctcgccaccgaagtcgcgcgccggatgatcgcgcggcagcagggcggcaacatcgtcaacattgcctcggtgctcggccagagcgtgctgaaattcgtctcgccctacgcgatctcaaaggccggcatcattcaggccaccaaggcgatggcgctcgaactcgccagctcgcgcattcgcgtcaacgcgctggcgccgggctacatcgacaccgacatcaatcgcgacctgtggtcgacgccggccggcgagaagctgctcaagagcatcccgcagcgccgcgtcggccacgagtccgatctcgacggcgccatcctcctgctcgcctcgaacgcatcgcgctacatgaccggcagcgtggtgacggtggatggcgggtttttgctg

SEQ ID NO: 44196 - DNA, 750 bp, Rhodopseudomonas palustris
atcaagggccgccgcgcgctggtgtgcgcatcgagcaagggacttggccgcggctgcgctgcggcgctcgccgccgaaggcgtgcatgtgacgatgactgcacgcggcgccgaagcgctggcgcaggccgcggcggagctgcgcaaggcctatcccgatgtcgagatcatcgaggtcgccggcgacatcaccacgccggaaggccgcgccgccgcgctggcggcctgcccggagccggacatcctgatcaacaatgccggcggcccgccgcccggcgacttccgcaactggacccgcgacgactggatcaaggcgctcaacgccaacatgctgacgccgatcgaactgatcaaggcgacggtcgacaagatgatcgagcgcaagttcggccgcatcgtcaacatcacctcggccgccgtgaaagctccgatcgacgtgctcggcctgtcgaacggcgcacgctccggtctgaccggcttcgtcgccggcctgtcgcgcaagaccgtccgtcacaacgtgacgatcaatgcgctgctgcccggcccgttcgacaccgatcggctgcgcggcgtcgccgctggtcaggccaaggcgtccggcaagccggccgagcagatcctggaagcgcggaagaacgaaaacccggcgggacgcttcggcacgcctgatgaattcggcgcggcctgtgcgttcctgtgcagcgtccacgccggctacatcaccggccagaacctgctgctcgacggcggc

SEQ ID NO: 44197 - DNA, 1134 bp, Rhodopseudomonas palustris
gccgaggcggcgagcgcggccaaatccagcttcgtggcgatgatgagccacgaaatccgcacgccgatgaacgccgtgatcgggctcgcgaccaacctgctcgagacgcgtctcgacgccgagcagcgccaggcggtgaccagcattcacgatgccggcgataacctcctgcagatcctcgacgacatcctcgacttctccaagctcgaagccggccggctcagcctggagccgatcccgttcgcaccgcgcaacatcgtcgacaacacgctcagcgtgatcggcccccgcgccatcgccaagggcttggtcatccgcctggaggcgcgaggcgacattcccgaagcactgaccggcgacgccgggcggattcggcaggtgctgctcaacttgatctccaacgcggtgaagttcaccacggcgggcgagatcgtcatcacgacggagtgcatctctcgcgatacgaccaacgcccggatgcgatggatcgtcaccgacaccggcatcggcatcgccgccgacaagatcgactcgctgttcaaagatttcgtccaagccgacagttcgatcagccgccggttcggcggctcgggcctcgggctggcgatcagcaagcgcctgatcgagcagatgggcggcaagatcggtgtcagctcggcgccgggccgcggctccgaattccacttctcgctgacgctgccgatcgccgaccatgcggcgccgccggagcaggacgatcaggacgtctacgcgcaattccgcgcccggatcgaggcggccggccggccgctgcggatcttggtggtcgacgataatccgaccaaccgcgccatcgccacacagatgctcggagaattcagggtccagaccaacaccgcatgcgacggcaccgaggcggtgaccgccgcgacccggttcggctacgacgtcgtgctgatggacgtgcggatgcccgaaatggacgggctcgatgccacccgtgcgatccgctcacacggtggagcgctcgccaatgtcccgattatcgccttcaccgccaatgctttcgccgaggacgccgccgcctgccgcgccgccggtatgaacgatcacgtcgccaagccggtccgcaagaaggcgctgatcgaagccatc

SEQ ID NO: 44198 - DNA, 1197 bp, Rhodopseudomonas palustris
acgctacgaggtgtcgcttaagcggagcgagcacccagcatgatgtccaacgcgcagagcctgttcaacttcgatctcggcgagaccgccgacgcgatccgggagaccgttcgcgacttcgccgccaatgagatcgcgccgcgcgccgaggccatcgacaagacaaatacgttcccgcgcgatctgtggccgaagctcggcgcgcttggcctgcacggcatcaccgtcgaggaagattacggcggcgccgggctcggttatctcgagcactgcatcgcgatggaggagatctcccgcgcttcggcctcggtcggcctgtcctacggcgcgcactccaacctctgcatcaatcagatccgccgcaacggcaacgaagcgcagaagcagaagtatctgccgaagctgatctccggcgagcatgtcggcgcgctggcgatgagcgagccgggcgccggttccgacgtcgtgtcgatgaagacgcgtgccgacaagaagggcgaccgcttcgtcctcaacggcaacaagatgtggatcaccaacggcccgatcgccgagacgctggtggtgtatgccaagaccgatccgaacgccgggccgcgcggcatcaccgcgttcctgatcgagaagggcttcaagggtttctcgacggcgcagaagctcgacaagctcggcatgcgcggctccgacaccggcgaattgctgtttgaggattgcgaagtgccggaggagaacgtgctcggcgaggtcggccgcggcgtcaacgtgctgatgagcgggcttgactacgagcgcgcggtgctggccgccggcccggtcggcatcatgcaggcctgcatggacgtggtgctgccctacgtgcacgagcgcaagcagttcggcgagccgatcggcaccttccaattggtgcagggcaaggtcgccgacatgtacgtgacgatgaacgcctcgcgcgcttacgtctatgcggtggcgaaggcctgcgaccgcggcgagaccacccgcgaggatgccgccggcgcgatcctgtacgccgccgaacgtgccacccaatgcgcgctggacgcgatccagctgctcggcggcaacggctacatcaacgactacccgaccggccgcctgctgcgcgacgccaagctctacgagatcggcgccggcaccagcgagatccgccgcatgctgatcggccgcgagctgttc

SEQ ID NO: 44199 - DNA, 1098 bp, Rhodopseudomonas palustris
gacgaataccacgacatccgcgacgccgtcgccaaactgtgtgcgcagtttcccggcgagtactggcgcaaactcgaccgcgaaatggcctatcccaaggcgttcgtcgacgccctgacggaggccggttacctttcggttctgatccccgaggaatacggcggcgccggcctgaagctgtcggcggcggcggcgatcctggaagagatccagcgcgccggctgcaacggcggcggctgccacgcccagatgtacaccatgggcaccctgctgcggcacggcagcgacgagcagaaggccaagtggctgccgaagatcgccagcggtgaactccgcctgcaggcgttcggcgtcaccgagccgacctcgggcaccgacaccacctcgctgaagaccttcgccaagaaggacgcgaacggcgactacgtcgtcaacggccagaagatctggaccagccgggcggaatattccgacctgatgatcctgctcgcgcgcaccacgccgaaggatcaggtgaccaagaagaccgaaggcctctcggtgttcctggtcgacatgcgcgaagcgcgcggccatggcctcgagatccgcccgatccgcaccatgatgaaccacgccaccaccgaagtgttcttcaccgacatgaaggtgccgaaggagaacctgatcggcgaagagggcaagggcttccgctacatcctctccggcatgaatgccgagcgcatcctgatcgcctcggagtgcgtcggcgacgccaaatggttcatcgccaaggccagcgcctacgccaaggaccgcgccgtgttcggccgaccgatcggccagaaccagggcatccaattcccgatcgccaaggcctacgccaacatgcgcgccgccgagctgatggtgaaggaagccacccggaagtacgaagccggcatggattgcggcgccgaggccaacatggccaagatgctcgcagccgatgcgtcgttcgaggcggccaatgcctgtatccagacccacggcggcttcggcttcgccgaggaatacgacgtcgagcgcaaattccgagaaacccggctgtatcaggtcgcaccgatctcgaccaacctg

SEQ ID NO: 44200 - DNA, 1548 bp, Rhodopseudomonas palustris
gtcacgaccgttaaatccgccacgctcgacctgctgcgcgccttcaagatcgacaaggtgttcggcaatcccggctcgaccgagcttccgttcctcagcgactggccggacgatatcgactacgtgctggcgctgcaggaagcttcggcggtggcgatggccgacggctacgcgcaggcgacgcgcaacgccggcttcgtcaatctgcattcggccgccggcgtcggcaatgcgctcggcaacatctatagcgcattcaagaaccagacgccgctggtaatcaccgccggccagcaagcccgcagcctgctgccgctgcaggcattcctgggcgccgagcgcgcctccgagtttccacggccttatgtgaagtacagcgtcgaaccggcgcgcgccgaggacgtgcccgccgcgatcgcccgtgcctactacgtcgcgatgcagccgccgtgcgggccgaccttcgtgtcggtaccgatcgacgattgggcgcggccggcggcgccggtgccgccgcgcacgatcactcgcgagatcggcccggatcgatcagcgatgcaggtgctggccgatacgcttgccaacgccaagaagccggcgctggtggtcgggcccgcgatcgaccgcgccgccgcggtcggtctgatggcgcggctcgctgagcgcgccaaggcgccggtgtgggtctcgcccttttcggcgcgctgcagtttccctgaacggcatccgctgttcgccggctttctgcccgcctcgccgggacaactctccgaaacgctcggcgcctacgacgtcatcgtgttgatcggcgcgccggtgttcacctttcatgtcgagggacatgcggcgatcttcgatggcgcctcgcagctgttccagatcaccgatgatgccgaagctgcttcggtgacgccgctcggcgccagcatcatcgcgacgatgacccctgccctgacgctgttgctggagctgctgccggagaccaagcgtgccgcaccgccggcccgcgcggtgccaccagcaccccggccggccgagccgatgccggtggagtatctgctgcacaccctccgcgccgcgatgccggagagcgcgatgctggtcgaggaagcgccgtcgcaccgcccggcgatgcagacatacatgccgatgccgggccaggacagtttcgccacgatggcgagcggcggcttgggctggtcgctgccggcctccgtcggtttcgcgctggcgcatccgaaccgccgcaccgtctgcctgatcggcgacggctcggcgatgtactcgatccaagcgctgtggacggcggcgcagcgcaagctgccgctgaccgtggtggtgctgaacaacggcggctacggcgcgatgcgctcgttcagccaagtgatgcaggtgcggaacgtgcccgggctggaactgcccgggatcgacttcaccgctctggcgcaatcgctcggctgcgatgcagtgcgggtgacgcgcagcgaggagctggcgccggcgctgacgcgcgcccttgcatgggacggcgtcagcctggtcgaggtg

SEQ ID NO: 44201 - DNA, 2940 bp, Rhodopseudomonas palustris
ccgaccgccatgccgtcagacccgccgcttgccgaattcaccgcggcttacgcgccggacgatgctgcgctggctgcggagctgctgacgaccgccacgctgacgcccgaccgtgaagcccagatcgacgccatcgcgaccgacctgatcaccgcgatccgcggttccgaacacggcctgaggggcgtcgaagccatgctgcgcgaattcgcgctgtcgaccaaagaaggcctggccctgatggtgctggccgaggcgctgctgcgggtaccggatgctgcgactgcggacgccttcatcgaggacaagctcggccagggcgacttcgcgcatcaccgtatcaagtccgatgccgtgctggtgaacgcctctgcctgggccctcggactatcggcacgcctcgtccatgccggcgagacgccgcaaggcacgcttgcggccttaacgcggcggatcggcgcgcccgcggtgcgcgccgcgacacgtcaggcgatgcggctgatcggcaatcacttcgtgctcggcgaaacgatcgacgcggcgctcgcccgcgcacagccgtatgcgcgtgagggctctcgctattcttacgacatgctcggcgaaggcgcccgcactgccgcggatgccgaacgttattaccaatcctacgccgatgcgatcaccgcgatcggccgccgcgccggcaacgcggcgctgccggcgaggcctggcatctcggtgaagctgtcggcgctgcacccacggttcgaggcgatcagccgcgaccgcgtgatgcgggaactgacgccgcggctgctcgaactggcgcagctcgccaagagccacgacctcgctttcacggtcgatgccgaagaagccgaccggctcgaactgtcgctcgaggtgttcgccgcctgctttgccgatccatcgctcaaaggctgggacggttacggtctcgcggtgcaggcgtatcagaagcgtgccgccacggtgatcgaccacgtcgccgagctcgcgcgcgcgttcgaccgccgcatgatgctgcggctggtgaagggcgcctattgggacaccgaaatcaagcgcactcaggagcgcgggcttgccgactatccggtgttcaccaggaaggcgatgaccgacctcaactacctgcactgcgcgcgcaagctgctggcgctgcgcccgctcctgttcccgcagttcgccagccacaacgcgctgacggtcgccaccatcctggccgaggccggtgatggcgacggctacgaattccagcggctgcacggcatgggcgaggcactgtatggccggctgctcgccgaccacccgcaggcggtgtgccggatctacgcgccggtcggcgggcatcgcgacctgctggcctatctggtgcggcgcctcttggagaacggcgccaattcatccttcgtggcccaagccggcgacgacagcgtgccgatcaccgaactgcttgcgcgtcccgcgacgttgatcggccatcccgagaatgcgcgcaattcggcgatcccgttgccgcgcgatctgtaccagccgcagcggatcaattcgcgcggcatcgaattcggcgaccgcagcgcgctcgcggcactgctcggcgacatcgaaggcgcacgccggccgctgccgacggtcgcgtccacctcgccggaacaagccgcggccacggtcactgccgcacgcaaaggcttcgagtcctggagccggacgtccggcgatcatcgcgccgcgatcctgcagcgcgccggcgatctgctggagcaacgccgtggcgagctgatcgcgctcctgcaggacgaaggcggcaagacgctcgatgatggcgtggcggaagtgcgcgaagcagtcgactactgccgctactacgccagcgagggtcgccggctgttcggcgagccgcaggccctccctggcccgaccggcgagcgcaacacgctggccttgcgcggccgcggcgtgttcgtcgcgatcagcccgtggaacttcccgctggcgatcttcctcggccagatcacggcggggctgatggctggcaacgcggtggtcgcaaagccggccgagcagacgccggtgattgccgaggtcgcggtgcgcctattgcacgaagccggcgtgccgccggctgcgctgcatctggtgcaaggcgacggccgcatcggcgcggcactggtcgaacagcgcgacatcgccggcgtcgtattcaccggatcgaccgaggtcgcgcgcgcgatcaaccggacgctggccgccaaggacggtccgatcgtgccgctgatcgccgagaccggcggcatcaacgcgatgatcgtcgatgccactgcgctgcccgagcaggtcgccgacgacgtcattgcctctgcattccgctccgctggtcagcgctgttcggcgctgcggctcctgtgcgtgcaggacgacgttgccgaccgagtgatcgcgatgatcgccggcgcggcgcgcgagctaacaataggcgatccgcgcgatccggcgacgcatgtcggaccggtgatcgacgccgaggcgaagaccaggctcgacacgcatatcgccacgatgaaacgccaggcgcagcttcacttcgccggcaccgcgcccgcgagcggcaactttgtggcgccgcacatctttgaactcaaccgtgcctcagagctcaccgaggaagtgttcggcccgatcctgcacgtggtgcgctacaaggcggcgcagttcgacgatctcctcgatgacatcgccacgaccggctatgcgctcacgctcggcgtgcagtcgcggattgacgacacgatcgcgcgtgtgatcgcgcggcttcccaccggcaatgtctatgtgaaccgcaacatcatcggcgccgtggtcggcgtccagccgttcggtggctccggcctgtcgggcaccggccccaaagccggcggccctcattatctgccgcgg

SEQ ID NO: 44202 - DNA, 633 bp, Rhodopseudomonas palustris
atgaagctgtacgattcgatcggacccaatccacgcctggtgcggatgttcatcgccgaaaagggcctgacgattccgacccaaacgctcgacatccgcgccggcgagaatcgaaagcccgagcatctcgctcgcaatccccacggccagactcctactctcgaactcgacaatggcagcttcttggcggaggtcaccgcgatctgcgaatatctcgaggagaagcatccgcagccgccgctgatcggcaccacgccggaagagcgcgccgaatgccggatgtggacgcggcgcatcgatctctacatctgcgaaccgctgaccaacggcttccgtttcgccgagggcctgaagatgtttcaggatcgagtggtgtgcgtgccggaagccgcgcccggcctgaagaagatagctgccgatcgcatccggtggatgaacgagcagatgaagggcaaggaatatgtctgcggcgcgcggctgacgctcgccgatctgctgctgtacggctggctggatttcggcgcccaggtcggccagccgctcgcccccgccaacaccaccatcgccgagtggttcaagcgcatcgcggcgcggccgtcagcgaaggcgtgaggcgctttcgtttcgaaggcc

SEQ ID NO: 44203 - DNA, 855 bp, Rhodopseudomonas palustris
tttcacggcgtattcccttatctggtgtctccggtcgatgcggagggccgcgttcgcgccgatgtgatgggacggctgtgcgacgatctgatccaggccggcgtgcacgggctgacgccgctcggctcgaccggggaatttgcctatctcggcaccgcgcagcgcgaggccgtggtgcgggcgacgatcgaagccgcgcagcgccgggtgccggtggtggcaggcgtcgcgtcgacctcggtggcggacgccgtggcgcaggccaagctgtacgagaagctcggcgccgacggcattctggcgattctcgaagcgtattttccgctgaaggatgcgcagatcgaaagctatttccgcgccattgcggatgcggtcgagatcccggtggtgatctacaccaacccgcaattccagcgctcggatctgacgctcgacgtgatcgcgcggctcgccgagcatccgcggattcgctacatcaaggatgcctcgaccaataccgggcggctgttgtcgatcatcaaccgctgcggcgacgcgctgcaggtgttctcggcctcggcgcacatccccgcggcggtgatgctgatcggcggcgtcggctggatggccggccccgcctgcatcgcgccgcgccagagcgtcgcgctgtacgaactgtgcaaggcgcagcgctgggacgaagccttgatgctgcagcgcaagctgtggcgggtcaacgaagccttcgccaaattcaacctcgccgcctgcatcaaggccggtctggccctgcagggttacgacgtcggcgaccccatcccgccgcaagccgcgctgacggccgaggagcggaaagcggtcgagaaggtgctggcg

SEQ ID NO: 44204 - DNA, 1260 bp, Rhodopseudomonas palustris
tttgaaaccctcagcctgcacgccgggcaacatcccgatccgctgaccggctcgcgcgcggtgccgatctatcagaccacgtcctacgtgtttcaggacaccgaccacgccgcggcgctgttcaacatggagcggcccggccacctgtacacgcggatttccaatccgacgatcgcggtgctggaagagcggatcgccgcgctggagaacggcgttggcgcggtcgcgaccgcgagcggcatggcggcgctgcatctggcgatcgcgacgctgctgaatgccggcgatcacatcgtcgcgtcgtcgtcgctgtacggcggcacgatcaacctcttggcgcacacgctgccgcgtttcggcatcaccaccaccttcgtggcgccgcgcgaccacgctggtctggccgcggcgatccagccgaacaccaggctggtgatcggcgagaccatcggcaatccgggcctcgaagtgctcgacatcccgaaggtcgcagccatcgcccatgaggcgaaaatcccgctcttgatcgacaacaccttcgcgacgccgtacctgagcaagccgatcgagctcggcgccgacatcgtgatgcattcggtcaccaaatggctcggcggccacggcatcgccatcggcggcgtgctggtcgatggcggccggttcgactggcgcggctccggcaagtttccgacgctgaccgagccctacgccggctatcacgacgtcgtcttcgacgagcagttcggcccgcccgccttcgtcattcgtgcgcggatggaaggtctgcgcgatttcggcgcctgcctgtcgccgaccaacgcattccagctgctgcagggcatcgagacgctgccggtgcggatggatcggcatgtcgccaacaccaaggcggtgctcgacttccttcaggccaacaaggcggtcgactgggtgctgcatccgacgctggagaaccacccggactacgaactggccaagacgctgctgccgaatggcgccggctcgatcatctcgttcggcatcaagggcggccgcgccgccgggcgcaaattcatcgaagcgctgcggctgaccagccatctcgccaatgtcggcgacgccaagacgctggtgatccatccggcatcgaccacgcatcagcagatgagcgccgagcagctcgaggccgccggcatcggtgaagagctgatccggctgtcggtcggcatcgaaaccgccgacgatattatcgctgacctggcgcaggcgctgcgcgtttcg

SEQ ID NO: 44205 - DNA, 705 bp, Rhodopseudomonas palustris
ctcgcctcccgcattgctctcgttaccggcgcctcgcgcggcatcggctatgccaccgccaaggcgctcgccaaggctggtgcgcacgtcatcgccgtcgcccgcacccagggtggcctcgaagagctcgacgacgaagtgcgtaaggacggcggtcatccgctgacgctggtcccgctcgatctcaccgactaccaggccatcggccgcctcggcggcacgatctacgaacgccacggcaagctcgacgtcctggtcggcaacgccggtatcggcgggccgtcctcgccgctcggccatatcgagctgaagccttggctcgatgtcatcggcatcaatctgaacgtgaacttccagctcgtccgctgcatggaaccgctgctgcgcgcctccgacgccggccgtgccgtgttcctgacctcgcgcgccggcggtaaggcaccgggctatcgcggcccctacgcggcatcgaaggcggcactggaaacgctggtgcaggtgtgggcgaaggaagtggtcaacaccacgcctatccgcatcaacctgttcgatccaggtcccacccgcaccaagctgcgcgccagcgtgatgccgggcgaagatcccgagaccctgccgacgccggaccaggccgccgaactgctgctgccgctgtgcctgccctcgttcaccgaaaccggcaagctgttcgacggcccctctcgc

SEQ ID NO: 44206 - DNA, 1599 bp, Rhodopseudomonas palustris
cttgcgaccgcgctgctcgacgccctcaaggatcatggtgcccgagagattttcggcattcccggcgatttcgtgctgccgtttttcaaggtgatcgaagagagcggcacgctgccgtatttcaccatgagccacgagccggcggtcggcttcgcggccgatgcggcgtcgcgctatcgcggcagcatcggcgtcgcggtggtgacctacggggccggcgcgttcaacctcgtcaactcgattgccggcgcctatgcggagcgctcgccggtggtggtgatcgccggcgcgccgggcgcgcgcgagcgcaccagcggctatctgctgcatcatcaggtccgcaccgtcgattcccaactcgcggtattcaaggaagtcacttgcgatcaggccgtgctgagcgatccggcgaccgcgcccgcggagatcgcgcgggtgctgcggagcgcgctcgaattgtcgctgccggtgtacatcgaatttccccgcgacatggtcgacgccaaggtcgacccggtgccgaagctgccgcggcgcgaggccgatatcggcgcgcgggacgagtgtgccgaagaaatcctggatcggatcgccagggcaaagtcgccggtgatggtggtggacgtcgaaatccgccgctacggcgtcgagcagcaggtcgccgcgctggcccgcaagctcggcctgccggtggtgacgacgttcatgggccgcggcctgctcgaaggcgacgacgacgtggtggctggcacctatctcggcgcggctggtgatccggacctgtcggcgctggtcgagggcgccgatctggtgctgatgttcggtgtcatcctgtccgataccaacttcgcgctgtcctcgaacatgaccgatccgcgccgcaccgtgctggcgactgggcgcgaggtgcagatcggccaccacgtctatcgcgacctgccgctggctgacctgatcgccggtctcgatgcccacgcctcgcagcatccaccgcggccgcgcaatgtcggtaaggggatggcctatccgcgtgggctgacgctcgacgcgtcgccgatcgcaccgtcggatatcgccaccgcgatcaacgatctgttcgaccgccacggcaagatgccgatgaccgccgatatcggcgattgcctgttcaccgcgatggagatcgacaacactgcgctggcggccccgggatactacgcaggcatggggttcggcgtgcccgccggcgtcggcgttgccgcgaccggcctgcggccgctggtgctggtgggcgacggtgcgtttcagatgaccggctgggagctcggcaactgcaagcgctacgggctcgatccgatcgtggtgctgttcaacaattgcagctgggaaatgctgcgggtgttccagccggaatccaagttcaacgatctggacgactggcactttgccgacatcgcgcattcgatcggcggcttcggcgagcgggtgacgacgcgcgccgaactcgccgcggcgctgcagcgcgcggtcgagcggcgcggggtgttctcactgatcgaagtgatgttgccgcgtggcgttacctcgcacacgctggcgcggttcgtcaccggcttcaag

SEQ ID NO: 44207 - DNA, 939 bp, Rhodopseudomonas palustris
cggcatctgctgggaatcgaagggctttccgccgccgacatctccggcctgctcgacctctccgaggagtatgtcgagctcaaccggcaggtcgacaaaaagcgcaccagtttgcgcggccgcacccaggtcaatctgttcttcgaggcgtcgacccggacgcagtcgtcgttcgagatcgccggcaaacgcctcggcgccgacgtgatgaacatgagcgtgtcatcatcgtcgatgcgcaagggcgagaccctgatggacaccgcggtgacgctgaacgcgatgcacccggacatcctggtggtccggcatcatgcctccggcgccgtggaactgctcgcccgcaaggtcgacggctcggtgatcaacgccggcgatggcgcccacgagcatccgacccaggcgctgctcgacgcgctaacgatccgccgcaacaaaggacggctcgaagggctggtggtggcgatctgcggtgacgtgatgcattcgcgcgtcgcccgctccaacatcctgctgctgaacaccatgggcgcccgcgtccgcgtcgtcgctccctccacgctgctgccggccgggatcgagcggatgggtgtcgaggtggcgcgcgacatgcgcgaagggctcgacggcgccgacatcgtgatgatgctgcggctgcagcgcgagcgcatgaacggctcgttcgtgccctcctcggccgaatacttcaactatttcgggctcgaccagaagaagctgtcctacgccaagccggacgcgctggtgatgcacccgggcccgatgaaccgcggtgtcgagatcgactcgatcgtcgccgacggcgcgcagtcggtgatccgcgaacaagtggaaatgggcgtggcggtgcgaatggcggtgctcgaagcgctcgcccgcaacctgccgaacgcctgatgccggaacgggaaacaacatgct

SEQ ID NO: 44208 - DNA, 2250 bp, Rhodopseudomonas palustris
gagatgccgacattttcccaaagccttgagcaatccctccatcgtgcgctcgccatcgccaacgagcgtcaccaccagtacgcaaccctcgaacatctgctgttgtctctggtggacgattccgacgcggccgcggtgatgcgcgcctgcagcgtcgatctcgacaagctgcgcaccagcctggtcaactatctcgaaaccgaattcgagaatctggtgaccgacggctctgaggacgccaagccgaccgccggctttcagcgcgtcattcagcgtgccgtgatccatgtgcagtcatcgggtcgtgaggaagtgaccggcgccaacgtgctggttgcgatcttcgccgagcgtgagagccatgccgcgtacttcctgcaggagcaggacatgacgcgctacgacgcggtgaactacatcagccacggcatcgccaagcgtcccggcgtgtccgaagcgcgcccggtgcgcggtgtcgacgaagagaccgagaccaagggcggcgacgactccaagaagaagggcgacgcgctcgagacctattgcgtcaacctcaacaagaaggcccgcgacggcaagatcgatccggtgatcgggcgcaacgccgagatcagccgagcgattcaggtgctgtgccgccggcagaagaacaacccgctgttcgtcggtgaagccggcgtcggcaagacggcgattgcggaaggtctcgctaagcgcatcgtcgatggcgaggtcccggaggtgctgtccgccgccaccgtgttctcgctggacatgggcacgctgctggcaggtacgcgctatcgcggtgacttcgaagaacgcctcaagcaggtcttgaaggaactcgaagcgcacccgaacgcgatcttgttcatcgatgagatccacaccgtcatcggcgccggtgccacttccggcggcgcaatggatgcctcgaatttgctcaagcctgccttggcttcgggcaccattcgatgcatgggctcgaccacctacaaggaataccgtcagcactttgagaaggaccgcgccctggtgcggcgcttccagaagatcgatgtcaacgagccgacggtcgaagatgcgatcgcaatcctgaaggggctgaagccttacttcgaggactatcacaagctgaagtacaccaacgaggcgatcgaatccgcggtgcagctgtcgtcgcgctacatccatgaccggaagctgccggacaaggcgatcgacgtgatcgacgaatccggcgcggcgcagatgctgctgtccgagaacaagcgcaagaagacgattggcataaaggagatcgaagccacggttgcgaccatggcgcggattccgcccaagagcgtgtcgaaggacgacgccgaggtgctcaagcatctcgagcagaccctgaagcgcgtggtgttcggtcaggacaaggcgatcgaggcgctgtcggcgtcgatcaagctggcgcgtgccggcctgcgcgaaccggagaagccgatcggctgctacctgttctcgggcccgaccggcgtcggcaagaccgaagtcgccaagcaactcgcctcgacgctcggtgtcgagctgctgcggttcgacatgtcggagtacatggagcggcacaccgtgtcgcgtctgatcggcgctccgcccggctatgtcggcttcgaccagggcggcctgctgaccgacggtgtcgatcagcatccgcattgcgtggtgctgctcgacgaaatcgagaaggcacatccggatctgtacaacgtgctgctgcagatcatggatcacggccggctcactgatcacaacggcaagcaggtcaacttccgcaacgtgatcctgatcatgaccaccaatgcgggcgcggcggatctggcgcggcaggcgttcggcttcacccgcaacaagcgggaaggtgacgatcacgaggcgatcaaccggcagttcgcgccggaattccgcaaccgtctcgatgcgatcgtgtcgttcgcgcatctcaatgccgacgtcatcggcatggtggtggagaagttcgtgcttcagctcgaggctcagctcgcggaccgcgacgtcaccatcgagctgtccgagcctgccaaggcgtggctggtgcagcacggctacgacgagcagatgggcgcgcggccgatggcccgggtgatccaggagcacatcaagaagccgctcgccgacgaggtgctgttcggcaagctgaagggcggcggtcacgtcaaggtcgtgctggtcaaggacgacgccgtc

SEQ ID NO: 44209 - DNA, 738 bp, Rhodopseudomonas palustris
catggggccaagatccccgcactcgggctcggcacctgggaactgagcggacatagctgctcgcggatcgtcgagcaggcgctccgcctcggctatcgccatatcgacaccgctcagatctacgacaacgaacgcgaggtcggggagggcatccgcaattcccacatccgccgcgatcagttgttcgtcaccaccaaggtctggacgacgcatttcgcgcccaatgatcttgttcgctcggccaaagagagcctggtcaagctgcggctgtccgaggtggatctgctgctgctgcactggccgaacgcgcatgtaccacttgcggaaacactcggcgctctggcgcaggcccgtgcgctcggcctgactcggcacatcggcgtctccaacttcacggtcgcgctgctcgccgaagctgtcgcggtctgtccggcgccgctggtgtgcaatcaggtcgagtaccacccgtttctcgatcagcagaaggtgctcgccgcctgcgcgctgtacggcatggcgctggtcgcctacagcccgatcgcccgcggcaatgccaagaagagcgaggttctcacccggatcggcaacgtgcacggcaagaccgccgcgcaggtctgcctgcgctggctgatccagcagaacgtcgcggcaattccgcgcagctcgcggctcgagcggctggcgcagaatatcgacgtattcgacttcgaactgtcggatgccgaaatgcaggagatc

SEQ ID NO: 44210 - DNA, 2007 bp, Rhodopseudomonas palustris
ttcaaacgaattctgatcgccaaccgcggcgagatcgcctgccgggtcatcaagaccgcgcgtcgtatgggtatcgagacggtcgccgtctattccgaggcggatcgcgacgcgctgcacgtcgaaatggccgacgaagcggtgctgatcggccccccggcggcggccgagagctatctggtgatcgagaagatcgtcgaggcctgcaagaagaccggcgcagaggcggtacatccgggctacggcttcctgtccgagcgtgaagcgttcccgcgcgcgctggccgaggccggcatcgtgttcatcggtccgaaccccggcgcgatcgccgcgatgggcgacaagatcgagtcgaagaaggccgccgcgcaggccaaggtttcgaccgtgcccggcttcctcggcgtgatcgaggatgccaagcatgcggtgaagatcgccgacgagatcggctatccggtgatgatcaaggcctccgccggcggtggcggcaagggcatgcgcattgcgcactccacggccgaagtggcggagggtttcaatctcgccaaagccgaggcgaaggcgtcgttcggcgacgaccgcgtcttcatcgagaagttcatcgtcgatccgcgccacatcgaaatccaggtgctcggcgacaagcacggcaacgtcatctatctcggcgagcgtgagtgctcgatccagcgccgcaatcagaaggtgatcgaagaagcgccgtcgccgctgctcgacgaagtcacccgtcgcaagatgggcgagcaggcggtcgcgctggccaaggccgtgaactacgactcggccggcaccgtcgagttcgtcgccggccaggacaagagcttctacttcctcgagatgaatacccgcctgcaggtcgaacatccggtcaccgaaatggtcaccggcatcgatctggtcgagcagatgatccgtgtggcggccggcgagaagctggcgctggcgcagaaggacgtcacgctgaagggctgggcgatcgagtcccgcgtctatgcggaagatccgttccgcaacttcctgccgtcgatcggccgtctggtgaagtaccgcccgccggccgagagcgcggcctctggcatcaccgtgcgcaacgacaccggcgtgcaggagggcggcgagatctcgatgttctacgacccgatgatcgccaagctggtgacgcacgggccgtcgcgcgccgcggcgatcgaggcgcagacccatgcgctcgatgcgttctacgtcgacggcatccgccacaacattccgttcctgtcggcgctgatgacgcatccgcgctggcgcgagggcaatctgtcgaccggcttcatcgccgaggaatttccgcagggcttccatccgcgggtgccggagggcgaagttgcccgccgcatcgccgcggtcggcgcggcgatcgaccgcgtcatcggcgaacgcaagcgcaagatctcgggccagatgatcggccgcgcggtgatccgcgagcgccgacgctgcgtctggctggagcgcagcgaagtgccgctcgacgtgatccgtgagggtgaggcgttcgtcgtccgcttcgccaatcccgatggctcgctcggtcagccgcaccagttgctgtcgtcctggatgccgggcgacccggtgtgggaaggcaccatcgacggccatccggtcgcggtgcaggttcgcgcgatcccgaacggcttcaagctggcgcatcacggctacgaagtctcggtcaacgtcttcaccgagcgcgaagctgcctcggcgcgctggatgaaggaagccgacaaggccgacaccggcaagaaggtgctgtgcccgatgccgggcctgatcgtgtcgatcgcggtgaccgaaggccaggaggtcaaggccggcgagacgctggcggtggtcgaggcgatgaagatgcagaacgtgctgcgcgccgaacgcgacggcaccgtcaagaagatccacgcctctgccggagcgacgctcgcggtcgacgcgatgatcctcgagttc

SEQ ID NO: 44211 - DNA, 2076 bp, Rhodopseudomonas palustris
ctgatggctgcgctgctgacgccggcggtcgccgcggcgcaagactccaagggctccgccgcgcacatccgcgcggtgacaggcgcggtcgatagcgccgcgatcgtcgccaacgtcaagaccaccaaggattggccgagttacggcctcgactacgccgagacccggttcagcaagctcgaccagatcaacaccgaaaacgtcaagcagctcggcctgcagtggagctacagcctcggctccgaacgcggcgtcgaagcgacgccggtggtggtcgacggcatcatgtacgtcaccgcgtcatggagcgtcgtgcacgcgatcgacacccgcaccggcaagaagctgtggacgttcgatcccaaggtcgatcactcgaagggctatcgcggctgctgcgacgtcgtgaaccgcggcgtcgcgctgtacaagggcaaagtgttcgtcggcgcctatgacggccggctgatcgcgctcgatgccgcgaccggcagcaaggcctgggagatcgacacgctgatcgaccacgagcactcctacaccatcaccggtgcgccgcgggtgttcaacggcaaggtggtgatcggcaacggcggcgccgaatacggcgcgcgcggctacgtcaccgcctatgatgccgagacaggcaagcaggcatggcgctggttcacggtgccgggcgatccgagcaagccgttcgaagacgagtcgatggagaaggccgccaagacctgggatccggccggcaaatggtggctcaatggcggtggcggcaccgcgtgggacaccatcaccttcgatcccgacctcaatctgatctatgtcggcaccggcaacggctcgccgtggaatcggcatctgcgcagcccggcgggtggcgacaatctgtatctggcgtcgatcgtcgcgctgaatgccgacaccggcaaatacgtctggcactatcaggagacgcccggcgacaactgggattatacctcgacccagccgatgatcctcgcggacatcgcgatcgacggcaagccgcgcaaggtgatcctgcacgcgccgaagaacggcttcttcttcgtgatcgaccgcaccgacgggaagttcatctcggcgaagaatttcgtcgatgtgaattgggcgactggctacgattccaatggccggccgatcgaagtgcccgaagcgcggtcggcggacaaatcgttcgatgcgatcccggggccgtatggcgcgcacaactggcacccgatgtcgttcaacccgcagaccggtctggtgtatctgccggcgcagggcgtgccggtcaatctcaccggcgagaaggcgctgacccagaacaagatggagccgttcaagttcggttcgaccaccggctggaacgtcggcttcacgctgaacgcggtgccgccgaagaacctgccgttcgggcgcctcgtggcatgggacccggtgcagcagaaagaagtctggcgcgccgaatacgtctcgccgtggaatggcggcaccttgaccaccgccggcaacctcgtgttccagggcacggctgacggccgcttcgtcgcttacaatgccaagaccggcgagaagctgtgggagagcccgctcggcaccggcgcggtggcggcgcctgcgacctacatggtcgacggcgtgcaatacgtgtcgatcgcggtcggctggggcggggtgttcggcatcagcgcccgcgccaccgagaccgaggcgccgggcacggtgtacaccttcgcggtcggcggcaaggccaagatgccggaattcgccaagtatcagatgggcaacctgctcaccggcatcgaatacgatccgaaggacgtggcggaggggaccgcgatctacgtcgccgcctgtgccacctgccacggggtgcccggtgtcgaccgcggcggtaacgtcaagaacctcggctattccaccaccgaccggatcgcccacctgaaggacatcgtgttcaaggggccgttccgcgacaagggcatgccggacttcaccggcaagctgaccgaggccgacgtggtcaagatccaggccttcatccaaggcaccgcggacgcgatccggccgaag

SEQ ID NO: 44212 - DNA, 834 bp, Rhodopseudomonas palustris
atgggattgctcgatggcaaggtggcgttgatcaccggggcgggcggcgggctgggtgaggcctatgccaagctgttcgcgcgcgaaggcgcagcggtggtggtcaacgatctcggcggaccgcgtgacggttcgggctccgacgccggcatggcgcagcaggtggtcgacgccatcaaggccgcgggcggccgcgccgtcgccaacaccgccgacatctcgacgatggcgggcgggcaatcggtgttcgacgatgcgatcaagcactttggccgcgccgatatcctggtcaataacgccggcatcctgctcgaccagaccttcgccaaggcctcggaggcgagctgggacaaggtgatgaaggtgcacctcaagggcacgttctgcgtcacccagccggtgttcaaatggatgaaggacaatggcggcggcgtcatcgtcaacacctcgtcgacctccggtctgctcggcaatttcggccaaagcaattacggcgcggcgaagggcggcatctggggcctgtccaacgtgctggcgatcgagggccgcaaatacaacatccggatctggacgctggcgcccggcgccctgacccggatgaccgaagacctgccgcgctatcgcgaaaatccgggcgcggcgctgacgccggagggcatcgccccggcggttctgtacatggtctccagcctgtcgggcgaccagaccggcaaggtgctcggcgtgtccggcccgcgcggggtgcgtgagatgaagctcatggaaatggacggctggaagccgccgcacaacggttggtcggcggaggacattgtgagccacgccggcgagatt

SEQ ID NO: 44213 - DNA, 1089 bp, Rhodopseudomonas palustris
gccggcatctacgaacaccccacgcgccacgcgcccgataaatccatcgcccagctccatgctgaagtcgccaaaggtgcgctcgacgacgcaggcctgaccaaggccgacatcgacggctacttctgcgccggcgatgcgcccggcggcgtgatggcgatggtcgattatctcggcctcaaggttcgccatttcgattcgaccgacaccggcggctgctcctatctggtgcatctcggccacgctgccgaggcgatcgccgccggccgctgctcggtggcgctgatcacgctggccggcaagcctcgcaccggtgcgttgccgccgcgcccggtcggcgccgaaggtgacttcgagctggcctatggtgcgaccacgcacaacgtttatgcgatgtgcgccgcgcgccacatgcatcaatacggcaccacgtccgagcagctcgcctggatcaaggtcgcggcctcgcatcacgcgcaatacaatgagcacgcgatgctgcgcgacgtcgttaccgtcgaggacgtgctgaattcgccgctgatcgccgacccgctgcatcggatggattgctgcgtcgtcaccgacggcggcggcgcgctgatcgtcaccaccgaggagatcgcgcgcagcctgaagaagccgctggtgcggatgatcggcgccggcgaggcgatcaaggggccgcgcggtggccacaacctcgatctgacctattcggccggcgtgtggtccgcgccgccggcgttcgagatggccggcgtcacgcccaaggacatcaaatacgcctcgatctacgacagcttcaccatcacggtgctgatgcagctcgaagatctcggcttctgcgagaaggggcagggcggaaagttcgtcgccgacggcaacctgatctcgggtgtcggcaagctgccgttcaacaccgacggcggcggtctgtgcagcaaccacccggtcaatcgcggcggcatgacaaagctgctcgaagcggtgcgccagcttcgtggtgaggcgcatcccaaggtgcaggtacccaactgcgacctcgcgatcgcccatggcaccggcggcatgctcggcatccgccac

SEQ ID NO: 44214 - DNA, 813 bp, Rhodopseudomonas palustris
tatcggatcatccgcgagctgcacggctcgagccgcagccacatctatcttgccagcgacctcgccaccggggaactggtggtactgaagatcccgtccgcagatctgcgagacgatccggagtatcgcaagcgcttcatgctggaggagtgggcggcacggcggatcgacagtccgcacgtgctgaagccatgcgtggtgcagcggccgcgcagctatctctacgtcaccttcgagtacatcgaagggcagacgctggcgcagtggatgatcgaccatccgcgcgcggagctcgaaaccgtgcgcggcctgatcgagcagattgccaaggggctctacgctttccaccgcaaggaaatggtgcatcaggatctgcggccggccaacgtgctgatcgatcgcagcggcacggtgaaaatcatcgacttcggctcggtgcgtgtcgccggcgtcgccgagctcgggccggccggcggcgatgagctgctcggcacggtgcaatacatggcgccggaatatttcgccgggcagggcggctcggcgctgtcggatcagttttcgctcggcgtcatcgcctaccagatgctgaccggccggctgccttatggggcagagctggcgcgcgccaatcaggcgctgaaatcccgcaagctgcgttacagcgcggccgccgaccacaatgcgaaagtgccggtctgggttgaccgcgcgctgcaacgcgcggtcagcctcgacccggccaagcgctatccggcgctgtcggagttcgttcacgatctgcggcatccgcgggcggactatctcgacgcccgg

SEQ ID NO: 44215 - DNA, 789 bp, Rhodopseudomonas palustris
atgcacatcgatctctccggcaagaccgcgctcgtcaccggctcgaccgccggcatcggccatgccatcgccaaggggttcgccgcgaccggcgccaatgtggtgatcaacggccgcggtcaggccaaggtcgacgcggcagtcgccgcagtttcgaaagtcgccaagggcggcaaagtgactggcgttgcggccgacgtctcgaccgcggacggctgcgccaaactggttgccgctcagccggacgtcgacatcctgatcaacaacaccggcatcttcgagccgaagccgttcttcgagattccggatgaagactggcagcgcttcttcgacgtcaacgtgatgagcggcgtgcggctgtcgcgcgcctacatgccggcgatgctggagcgcaactggggccgcatcgtcttcatcgcctcggaatctgcgctgatgattccgaaggagatgatccactacggcatgaccaagaccgcgcagctctcggtctcgcgcggcctcgccgaactcacccgcggcacggcggtgacggtgaacgcggtgatgccggggccgacgatgagcgaaggcgtgcagaccttcgtggccgatcttgccaagcagaacggccaatcggagagcgaagccgccgccaacttcatcaagcagcatcgccccggttcgctgatccagcgcttcgccaccgtcgaagagatcgccaacatggtggtctatgtcagctccaaggaagccgccgccactaacggcgccgcgctacgcgccgaaggcggcctgctgcagacaatc

SEQ ID NO: 44216 - DNA, 825 bp, Rhodopseudomonas palustris
atggcattgaagacctttaatcccacgacgccgggccagcgccagctggtgatggttgatcgttcggcgctgtacaagggcaagccggtcaagcggctgaccgagggcaagaactcgaacggcggtcgtaacaacaccggccgtatcaccgttcggttccgcggcggcggtcacaagcaggcttatcgtctggtcgatttcaagcgcaccaaggtcgacgttccggccaaggtcgagcgtctggagtacgatccgaaccgcaccgccttcatcgcgctgatcaagtacgaggacggcgagcaggcctacatcctggcgccgcagcgcctggcggtcggcgacaccgtgatcgcgggcgcctatgttgacgtgaagccgggcaacgtgatgccgctgggcaacatgccgatcggcaccatcgtgcacaacgtcgagctgaagatcggcaagggcggccagctggcccgttcggccggcacctacgctcagatcgtcggccgcgaccacgactacgtgatcctgcgcatgaactcgggcgagcagcgcctgattcacggtcgctgcatcgcggcgatcggtgcggtgtcgaacccggatcacatgaacatctcgatcggcaaggccggtcgcaagcgctggctcggccgtcgcccgcacaaccgcggcgtcgtcatgaacccgatcgaccacccgcacggcggcggtgaaggccgcacctcgggcggccgtcacccggtcaccccgtggggcaagccgaccaagggtaagaaaacccgttcgaacaagtcgaccgacaagttcatcctcatcagccgccacaagcgg

SEQ ID NO: 44217 - DNA, 2214 bp, Rhodopseudomonas palustris
cgagatccccaatcgcgagatggtccgcctgcatgtcttgaccctgtagccgctacagggtgcatatggggtgccacaacgctttgtcgaggtgacgccatggcgaccgacgcctacagaattcgcgtagaaggcatggattgcgcctcctgcgcgctcaagatcgagaccgcgatgcagcggctgtcgggtgtcgcggatgtccgcgtcagctactcggccggcaccttggcgcttcggttcgatcaggacagaatctcgccgagcacaatcgacgatgagctttgctcgctcggttttcgaccgcaggcaattgcttcgtcgccaagcagcatcgcgaccgaacgaaaacgactgccatggtggcaggacgcgaagctgcaatcggtcatgatcgcagcggcggtttttgctctggcgttcgccttatcgcagctctttccggccttcgagcgatggctctattccgcggcggccgcgatctgtctgatcccgatcgctcgccgggccttgatcggcgcgcgttcgggatctcccttcagcatcgaaacgctgatgagcgttgcggccgtcggtgcggtcatgatcggcgaggccgaggaagcggccgtggtcatcgttctgttcggtgttggcgaatggctggagactttcgcggcggggcgcgcacgagccggcattgaatcgctgatcgacgtggtgccgcgcaccgcgaggcgactgcgcgatggttcagacgaagtcgaggagatcccggctgccgacctgatgatcggcgatgtggtggtggtgcgtcccggcgaccgcatcccgtcggacggcaaggttatcgacggccactctgacgtgaacgaagcaccgatcaccggcgagtccgtgccggtcgccaaggcggtcggcgatcacgtctatgccggcagcatcaacgcgaacggcgagctgcgcatcgagacgacgaatgcggcggccgacaacacgatcgcgcgcatcatccacctcgtcgaacaagcgcaggagaccaaagcgccgacggagcggatgatcgatcggctcagccggtggtacacgcccgccgccatgctggtggcgctccttgtcatcatcgtgccaccgctcggcttcggcgaggattgggcgacctggatctaccgcggactcgccacgttgctgatcgcctgcccatgtgcacttgtcatttcgacaccggcggccatcgcttccggccttgcggcgggcgcccgcaaagggctgctcatcaagggcggtgcggtgctggaaacgctcggtaaggtgaagaccgtggccttcgacaagaccggtacgctgacgctggggcagcctcaggtgaccgacgtggtttccgtcatcggccaggacgacgctgtgctcgcgcgcgcggccgcggtcgaaggcaacaccagtcacccgatcggacaggcgattgtccgcgccgcgaaggcgcgcgcactgcagacccccatcgtgtttggcgggagtcaggcggtgccaggcaaggcgatctccgcgcggctgaaagacggctttgccttcgtcgggtctccgcactttgccgccgagcggaccacgatcccgccggagcttgcgacgacgatctccggtctcgagcacgaaggtaagacggtcgtggtgctcatctctggcaagacgtgcgagggagtgattgcgctgcgcgacgagccgcgcccggatgcggcaggagctttgcggcaactgacgtccaaaggcatcgcggtggttatgctgacgggcgacaacgcgcgaaccgctcaggccatcgcgggccaactcggcatcgaggctcgcgctgagcttctgcccgacgccaagctggccgagattcgtcgcctgaaggcagtgtcgcccgtggcgatggttggcgacggcatcaatgacgcgcctgcgctcgcggccgcttccgtcggcatcgccatggggggaggaacggacgtggcgctggagaccgccgacgcggcgctgctgaatgatcgcgcccatggcgtcgcggaattgatcgcgctgtcgcaggccacgctcggcaacatctggcagaacatctcgatcgcgctcgggctgaaagcggtgttcctcgccaccagcctcctaggcgtgacgacgttgtggatggcgatcctcgccgacaccggcgccaccgtcctggtcaccgcgaacgccctcagattgctgcggtggcgg

SEQ ID NO: 44218 - DNA, 1158 bp, Rhodopseudomonas palustris
taccgttgggtgatcgttgcggctggtggcgtgctcggctgcgtcgcggccggggcgatgttctcgctgccggtgttgatcaggccgatgtcgcaggacaccggctggtcggtcaccgggatctcgaccgcgatgacgatcggcttcctggcgatggccgccgccagcatggtgtggggcaatctgtcggacaggttcggcccgcgccccgtggtgctgactggatcggtggtgctggcggccagcctcgcgctcggcagccgggccacctcgctgatcgaattccagctgctgttcggcgcgcttgtcggggctgcaacggccgcggtgttcgccccgatgatggcctgcgtcaccggctggttcgacaccggtcgaggcctagcggtgtcgctagtctccgccgggatgggcatggcgccgctgacgatggcgccgctggcggcatggttggtgacgatccacgactggcgtggcgcgatgctgatcatctctgcgatcacggctgcgctgatgattcctgcggcgctgctggtgcggcggccgccggccctcgaacccggcggcgcggagggcgcctgggccgatgcgcaggacgacatgacgctcaggcaggcggtgcggtcgccgcaattcgtcacgctgttgctggccaacttcttctgctgcgcgacccattccggcccgatcttccacaccgtcagctacgcggtgacctgcggcatcccaatgatcgccgccacctcgatctatagcgtcgagggactatccggcatgttcggccggctcggcttcggcctcgccggtgatcgcttcggcgcgcagcgcgtgctcgtgatcggcttgctcgcgcaggcgttcggcgtgctcgcttacgccttcgtcggcggactcggcggcttctatgcggtcgctgtcgcggtcggcttcatctacgcgggcaccatgccgctctacgccgtgatcatccgcgagaactttccgctgcggatgatgggcacgatcgtcggcggcaccgcgatggccggcagcctcggcatgtcgaccggcccggtgcttggcgggctgatctacgatgcctacgacagctatgcaccgatgtatgtcgcctcctgcggcatgggcctcgccgcgatgctgatcctggcgacgttccgg

SEQ ID NO: 44219 - DNA, 798 bp, Rhodopseudomonas palustris
atgaacttgttcgacctgagcggcaaagtcgccgtcatcaccggttcgtcgcgcggcatcggcaaggcgatcgccgagcggatggccgagcacggcgccaaggtggtgatctcgtcgcgcaagcaggacgcctgcgatgcggtggccaagtcgatcaacgacacctatggcgccgggaccgcgctggcgctcgccgccaacatctctagcaaggacgatctgaagcgcctcgcgcaggaagcgacgcagaccttcggcaagatcgacgccctggtctgcaacgccgcgtcgaacccgtattatggcccgcaggccggcatcaacgacgatcagttccgcaagatcctcgacaacaacatcgtcgccaaccactggctgatcagcgaagtcgtgccgcagatgatcgcgcgcaaggacggttcgatcaccatcgtgtcctcgatcggcggcctgaagggctcgaccgtaatcggcgcctattgcatctccaaggccgccgacatgcagcttgcgcgcaatttggcctgcgagtacggcgagcacaacattcgcgtcaattgcattgcgcccggcctgatcaagaccgacttcgcccgcgcactgtgggagaacccggagacgctgaaggcctcgaccgcgcgttcgccgctgcagcggatcggcgaacccgacgagatcgccggcgccgcgatcttccttgcctccaaggccggcaccttcaccaccggccagaccatcgtcatcgacggcggcgcgacgattagttgacctctcgggtcattccggggcgcgcgaagc

SEQ ID NO: 44220 - DNA, 741 bp, Rhodopseudomonas palustris
ctcgaaggcaaatccatcatcatcaccggcgccggcagcggcatcggccgcgcggcatcgctgctgttcaccaaggaaggcgcgcaactgatcgcggtcgatcgcaccgaaggcgtgcaggagacggtcgagcaggtgcgcaaggccggcggcaccgccgaggccgtgatggccgatgcaggctccgaggacgacgtgaagggcttcgtcgccaaggcgatcgccgtttacggcaagctcgacggcatctgggccaatgccggtatcagcggcggcctgctgccgctgcccgaacagacgccggagcattggcaggagatcctgcgcgtcaatctgatcggtccgttcctggcgatcaagcacgccacgccgcatctgatcaaacagggccacggcgcgattgtctgcactgcctcggtcgcgggtttgaagagcggcgcctcgggacacccttacgctgcatcgaaggctggtgtgatcagcctggtgcagaccaccgcctactcgctgtccggcaccggcgtgcgcatcaacgcggtgtgccccggcctgatcgagaccggcatgaccaagccggtgttcgacggtgcgcgcgcccgcggcaccgatcacaagatcggccagctcaacccgctgaagcgcgccggccagccgcacgaactcgctaccatggggctattcctgctcagcgacgaagcgtcctacgtcaacggccaggcgttcccagtcgacggcggcctg

SEQ ID NO: 44221 - DNA, 1197 bp, Rhodopseudomonas palustris
atgtccgatcgccagcgtgaatggctggaccgcgtcaccaagttcatgaacgaccacgtccgccccgcggtgccgatctacaagcagcaggacgccgagggcgagcgctggaaggtgatcccggtcctcgaggagctgaaggccaaggcgaaggccgaaggtctgtggaacctgttcctgccgccgtcctcgcacgacgacgatgaattccacggtgcgggtctctccaacctcgaatacgcgctgctgtcggagcagatgggccacatctcctgggcctccgaagtgttcaactgctcggcgccggacaccggcaacatggaagtgctgttccgttacggcaccaaggagcagaagcagaagtggctgcggccgctgatggccggcgagatccgttcggcgttcctgatgaccgagccggcggtggcctcgtcggatgccaccaacatcgagacccggatcgagaaggacggtgatcactacgtcatcaacggccgcaagtggtggtcgtcgggcgtcggcgatccgcgctgcaagatcgcgatcgtgatgggcaagaccgatccgaacgccgcgcgccatcagcagcagtcgcagatcctggtgcctctcgacacccccggcatcaccatcgagaagatgctgccggtgttcggcttcgatgacgcgccgcacggtcacggcatggtcaagctggagaacgtccgcgttccggcgtcgaacctcctgctcggcgaggggcgcggcttcgagatcgcccagggccgcctcggcccgggccgcatccatcactgcatgcgcaccatcggcaaggccgaagaagcgctggagaagatggtcaagcgcctgcagtcgcgcgtcgcgttcggcaagcggatcatcgaattctcggtgtgggagcagcggatcgccgaagcccgcatcgacatcgagatgaaccgtctgctgtgcctcaaggccgccgacatgatggataaggtcggcaacaagaccgcgcagctcgagatcgcgatgatcaaggtggcggcgccgcggatggcgcagcgcatcatcgacgaagcgatccaggcattcggcggcgccggcgtgtccgacgacgcggggctggccaaggattacgccaacatccgcacgctgcggctcgcggacggtccggacgaggtgcacaaccgcgccatcgcccgcctggagatgaag

SEQ ID NO: 44222 - DNA, 1570 bp, Rhodopseudomonas palustris
aacatcacccacggcctgcggcgcgcgctgcagatcaacccggaagagctggccaccgtctgcgccggccgccggcgtaactggcgcgaggtcggcgaccgcgtcgcgcggctcgctgccggcctgcgcgccagcggcgtcggcgagggcgaacgcgtcgcgatcctgtcgctgaattcggaccgctatctggaaatgtatctcgccgccggttggtgcggcggcgtgatcgtgccgctcaacatccgctggagcgcgctggagaacgaagacgcgctcaaggactgccgcgcggtggcgctggtggtcgacaaggcctttgccgcgaccggcggcgcgctggcgcaggcgatgccgtcgatggcgctgatctatgccgacgacggtgacgtgccgcccgggatgcaaagctatgaggatctgatcgccacgcacgcgccgatcccggatgcgatgcgcaaggccgaagacctcgccgggatcttctacaccggtggcaccaccggccgctccaagggcgtgatgctgagccacggcaatctgatggcgaatgcactcaacgcgctgggtgaggggctgtttcccggcacgtctgtctatctgcacgccgcaccgatgttccacctcgccaacggcgccgcgatgtattcgctgctgctgtcgggcggctcgaacgtgatgatcccgtcattcacgccggagggcgtgatgcaggcgatgcagaacgatcgggtcaccgacgtgctgctggtgcccaccatgatccagatgttcgtcgatcatccggcgctgaagaattacgacctgtcgtcgctgaagaacatcgtctacggcgcgtcgccgatcagcgaggcggtgctggcccgcgcgtccgcggcgctgccgaacgttcagttcacccaggcctacggcatgaccgagctgtcgccgatcgctacgctgctgcactggaaggagcatatcggcgagggcaaggccaaaggccgccagcgcgccgccggcagggcgacgcttggctgcgaggtccggatcgtcgatgccgatgatcgcaccgttccttatgggacggtcggcgagatctgcgtccgcggcgacaacgtgatgatgggctattgggagcggcctgaggagaccgcgcgggcgctcgcgggcggctggatgcacaccggcgacggcggctacatggatgagcacggcttcgtctacgtcgtcgaccgggtcaaggatatgatcatctccggcggtgagaacgtgtactcggtcgaggtcgagaacgcggtggcgcagcatccggcggtggcgcaatgcgcggtgatcggtattccgcacgaggcgtggggcgagcaggttcacgccgtcgtcgtcaccaaggccggtgccaccgtgacggcggaggagctgatcgcccactgcaaggcgttgatcgccggctacaagtgcccgcgcagtgtcgagatcaccgagacgccgctgccgctgtccggcgccggcaaaatcctcaagcgcgaactgcgccagccgtattgggagagccgcgaacgtcgcgtcagctgacgcgccggcgggctgc

SEQ ID NO: 44223 - DNA, 1161 bp, Rhodopseudomonas palustris
gtccacgtcgccggcgtcggcatgatcccgttcgtcaagccgggcgcgaacgaaccgtatcacctgatgggcgccgaagcggcgcggctggccctgcgcgatgccggcctcggctacgatgcaatccagcaggccttcgtcggttacgtctatggcgactccacctgcgggcaacgcgcgctgtaccaggtcggcatgaccggcatcccgatcgtcaacgtcaacaacaactgctcgacaggctcgaccgcgctgtatctggcgcggcaggcgatcgcctccggcgccgccgactgcgtgctggcgctcggctttgagcagatgaagcccggcgcgctcggctcggtgttcgtcgatcgccccagcgctttcgaggatttcgatgccgccgccgatcagttgatcgacgcgcccggcgtgccgctggcactgcgctacttcggcggcgccggcctcagccacatgcagaaatacggcaccccgctgtcgtccttcgccaaggtgcgcgccaaggcgagccgccacgcggcgaagaatccgctggcactgttccgcaaggaggtctcggccgacgacgtgctcaacgaccaggtgatctggccgggcgtgatgacccgactgatggcctgtcccccgacctgcggcggcgccgcggcggtgctggtgtccgaagcattcgccaggaagcacggcctcaacaccgacgtccgcatcgccgcgcaagcgatgaccacggacacgccgtcgaccttcgaagcgcacgacatgatgcgggtggtcggctacgacatggcgcgtgccgcggcgaccaaagtgtacgaagacgccggcgtcgggccggacgacatcgacgtcgtcgaactgcacgactgcttcgcccataacgagctgatcacctacgaggcgctcggtctttgcccggagggcggtgccgagaagttcatcgccgacggcgacaacacctatggcggccaattcgtcaccaatccgtcgggcgggctgctgtcgaagggccatccgctcggcgccaccggcctcgcgcagtgctacgaactgacccggcagctccgcggcaccgcggaggcgacccaggtgggcggcgctaagcgcgcgctgcagcacaatctcggtctcggcggcgcctgcgtggtgacgctgtac

SEQ ID NO: 44224 - DNA, 819 bp, Rhodopseudomonas palustris
aaactgcaaggcaaggtggcgctggtcaccggatcgggccgcggcatcggccgcgccatcgcgctgaagctcgcgtccgaaggcgcgcgcgtcatcgtcaacgatctcgacgccgagcctggcgacgcggtcgccgccgagatcaaggcgatgggcagcgacgcgattgcgatcaacggcagcgtttcggaagccggcttcgccgaccgtttcgtcggcgccgcggtggagaagttcggcggcctcgacatcatcgtcaacaacgccggctacacctgggactcgacgatccagaagatgaccgacgagcaattccaggcgatgctcgacgtccatctggtggcgccgttccgcatcctgcgcgcggccgccgagccgatccggatcttcgccaagaaggaagccgaggccggtcaggaggtgttccgcaaagtcgtcaacatctcgtcgatcgccgggctctacggcaatgccggccaggccagctactcgtcggcgaaggcctcactggtcggactgacccgcacgctgtgcaaggaatggggccgctacaaggtcaacgtcaattgcgtcgcgttcggcctgatcaacacccgcctcacccagccgatcgaagcgcagcagaagaccatcgacgtcgccggccgcgacatcaaggtcggggtgcaaccgcaaatgctggaagcgatggcgcggatgatcccgctcgggcgcggcggcacgccggaggaagccgccgacgcggtgtatctgttctgcagcccggaatccaactacgtcagcggccaggtgctggtctgcggcggcggcctgatcctg

SEQ ID NO: 44225 - DNA, 759 bp, Rhodopseudomonas palustris
gtgaagatcgcgaccttcaacgtcaacaatgtcaacaagcggctaccgatactgctcgcgtggctgaagacggcgcggccggacatcgtctgcttgcaggagctgaaggcggccgaagcggattttccggaagcggcgctgcgcaaggcgggctatgcggcggcgtgggtcgggcagaagagctggaacggcgtggcagtcctcgcgcgccggcgcgagatcgtggtgacgcggcgccggctgcccggcgcgccgcacgacaagcagagccgctacatcgaggcggcggtcgccgggatcatcgtcggctgcctgtatgcgcccaacggcaacccgcaaccggggccgaaattcgacgacaagctcgcttggctgaagcggctgaaccgccatgccgcgacgctgctgaagagtggcgcgccggtggtgctggccggcgatttcaacgtggtgccgacgccggccgatatctacccgggcaagtcatgggacaaggatgcgctggtgcagccggcgccgcgcaagctgttcgccgcgttgctgcgccagggctggaccgacgcgctgcggcactgccacccggaggacgcgccctatacgttctggtcgtactggcgaaaccggttcgagcgcgatgccggtctgcggatcgatcacctgctactcgatccgtcgctggcggcgcggctgaagcgggccggcgtcgatcgcaaggtgcgggaggcgccggaggcgagcgatcacgcgcccgcctggatc

SEQ ID NO: 44226 - DNA, 2052 bp, Rhodopseudomonas palustris
tcgcgcggcgaaggcggcgagctgcaccagaccgccgaagatctcggcaccgaggtgatgaccaccgcgcaaggcggcccgatctccgacgaccagaacaccctgaagatcggcccgcgcggaccggcgctgatcgaggacttccacttccgcgaaaagatctttcatttcgaccacgagcggattcccgagcgcgtggtgcatgcccgcggctacggcgcgcacggctttttcgaaacgacccattcgctggcgaagttctcccgcgccgatctgttccagcgcgtcggcgaacgcactccggcgttcgtgcgcttctccactgttgctggcagcaagggctcggtcgatctagcccgcgatgtgcgcggctttgcggtcaagatctacaccaaagagggcaactgggatctggtcggcaacaacattccggtgttcttcattcaggatgcgatcaagtttcccgacctgatccattcggtgaaggaagagcccgaccgggcgtttccgcaggcgcaatcggcccacgacaatttctgggacttcatcagcctgacgcccgaaagcatgcacatggtgatgtgggtgatgtcggaccgcgcaatcccccgctcgttccgtttcatggaaggcttcggcgtccacaccttccgcctcgtcaatgccgacggcgaatccaccttcgtgaagtttcactggaagcccaagctcgggatgcagtcggtgctgtggaacgaggcggtgaagatcaacggcgccgatcctgacttccatcgccgggatctgtggaccgcaatctcgaccggcaatttcccggaatgggagctgcgggtgcagctgttcgatcaggaattcgccgacaagttcgatttcgacatcctcgacgctaccaagatcatcccggaggagatcatcccgccggtgccggtgggtcgcctcgtgcttgaccggatgccggacaacttcttcgccgagaccgagcaggtcgcgttcatgactcagaacgtgccgccggggatcgatttctccaatgatccgctgctgcagggccgcaacttctcctatctcgacactcagctgaaacggctcggcagtccgaatttcgcgcatctgccgatcaacgccccgaaatgtccgttcgcgcacttccagcaggacggccacatggcgatgcacaacccggtcggacgcgccaactatcaaccaaactcgcacggcctcggtccgcgcgaatctccgcagcgcggcttcgtgccgttccccgaggccgaagaaggcgccaaggcgaagtttcgcgccgagagctttgccgatcactatagtcaggcgcggcaattctacctcagccagacccgcaccgagcagcaccacattgtttcggcactgacgttcgaactcagcaaggtcgagatttcggtgatccgcgaacgcgtgctgtcgcatctgctgctcatcgacgagaccttggcgaccaacgtcgccaaccggctgggcatcaaggcaatgccgaagcccgcggacgctgcggtgccgacgcggcaggacctgccgccctcacccgcgctctcgatcatcgagaacggaccggagcggttcggaggccgcaagctcggcatcctgatcaccgacggcaccgacgcggcgctgctgaagagcttgcagaaggctgtcgagaaggcgggcgcgacgttcgaactgatcgccccccgcgtcggcggcgtaatcgcgagcgacggcagcgagatcgccgcgcaccagatgatcgatggcggaccgtctgtcctgtacgacgcggtggcgctgctgccgggagacgatgaaatcgacgacctgctgcaggaatcgaccgcccgcgacttcgtcgccgacgccttcgcgcactgcaagttcatcggctacgtcgccgccgcccggccgctgttcgccaaagccggcatcggcgacgacctcgatgaaggctgcatcgagctcgccgcgcgtaaggatgccggcgccttcgtcgatcagctcggcaagctccgggtgtgggcgcgcgaatccgtcgtcaaaatg

SEQ ID NO: 44227 - DNA, 2079 bp, Rhodopseudomonas palustris
gttcgcgagggtctgccttatccgctcggctcctgctgggacggccatggtaccaacttcgcgctgttctccgccaacgccaccaaggtcgaagtctgcctgttcgacggcgacaccgagcgccggatcgagctgcccgaatataccgacgaggtgtttcacggctacatccccgatatcggccccggcaccttctacggttatcgcgtctatggaccgtacgagccggagaacggtcaccgcttcaatccgaacaagctgctgctcgacccttacgcgcgggcccacgccggtttgctgacctgggatcctgccgtgttcggctatgtgatggagagcggcgacgataccacatttgacgagcgcgacagtgcgcgcttcgtgccgaaatgtgtggtggtcgatcccgacttcgactggaagggcgagcccggccgcaaattcgtgccgtgggaccaggcgatcatctacgagacccacgtcaagggtttcaccaagctgcatccggacgtgcccgagcatctgcgcggaacctatgcaggcttcggcaccaagccggtggtcgattacatttcctcgcttggcgtcaccgcggtcgagctgctgccgatccacaccttcgtcaatgacagctatctgctcgacaagaacctggtgaactattggggctacaacaccatcggtttcttcgcgcccgacccgcgctatgccgccgacgtgcccaacagcttgcgcgagttcaaggagatggtggcgcggctgcacgatgtcggcctcgccgtgatcctcgacgtggtttacaaccacaccgcagagggcaacgagctcggcccgacgctatcgttcaagggcatcgacaacgccagctactaccgtctgctgcccgagcagaagcgctattacatcaacgacaccggcaccggaaacaccgtcaacctcacgcatccgcgcgtgatccagatggtcaatgacagcctgcgctactgggccggcgaaatgcacattgacggctttaggttcgatctcggcaccatcctggcgcgcgagcattacggtttcgacgaacagagcggctttttgaaatccgtgatgcaggacccgctgctcagctcggtgaagctgatcgccgaaccttgggattgcggtcccggcggctatcaggttggtggcttcccgccgggctgggcggaatggaacgacaaattccgcgacaccgcgcgcgattattggcgcggcgaagccccggcggcggcgttggcgccgcggctgtcggcctccggtgacgtgttcaaccgccagggccggcgcgcctgggcgagcgtgaacttcatcaccgcgcatgacggcttcaccctcaatgactgggcgagctacaacgacaagcacaacgaggccaatggcgaagacaatcgcgacggccactccgacaaccgctcgtggaattgcggtgcggaaggtccgaccgacgacgagaccatcctcagcctgcgagaacgtcagaagcgcaacatgctggcgacgctgctgctcgcccaaggtacgccgatgctgctggccggcgacgagtttggccgcacccagaacggcaacaacaacgcctactgccaggacaacgagatctcctgggtgcactgggaccacgacgaggccgcgcaacatctgcgcgccttcacccagcggctgctggaactgcgccggaccacgccaacgctgcggcgcagccggttcctcaccggacaatacgacgagacgctcgacgttcgcgacgtcacctggatcaacgccaatggcggcgagatgcagcaagagcattgggacgattccaacgtgaaatgcttcggcatgctgctcgacggccgcgcccagaccaccggcatccgccggctgggcgaagaagccaccgtgctgctcgtgctgaacggcttcgacggcatggtggagttcaccctgcccgaggttccacacggcaccaaatggtcgctgctgatcgacaccaacctgccccacggcgtgccggatgaggagttcgaatgcggcgcggcgtatcaggtgacagcacgctcggtgctgctgttcaag

SEQ ID NO: 44228 - DNA, 1359 bp, Rhodopseudomonas palustris
ccgatggtgaagcccaccggttttcgcgagtacgacgcgcgctggctgttcggccaggagatcaacctgatgggggtgcaggcgctcggcatggggctcggcacgctgatcgccgagctcggccggccgcaggagatcgtcaccgggcatgatttccgcggctattcggcctcgatcaaatacgcgctgatcgccggcctgatggcgtcgggctgcaaggtccacgacatcgggctcgcagtgacgccgatggcgtatttcgcgcagttcgagctcgacgtgccgtgcgtcgcgatggtcaccgcctcgcacaacgacaacggctggaccggcgtcaagatgggcgccaaccggccgctgaccttcggccccgacgagatgaaccggctgaaggagatcgtgctcggcgcggcgttcaagcagggcgccggctcttatgtgtttcatccgaactttccggcccgctacatcgccgacctcaccaagcacgctaagctgaagcgtaagctcaaggtggtggtcgcctgcggcaacggcaccgccggcgcgttcgcgccgcaggtgatggaagcgatcggctgcgaggtgatcccgctcgacaccgagcttgaccacaccttcccgaagtacaatcccaatcccgaagacatggagatgctgcacgcgatccgcgacgcggtgctgcagcataaggccgatctcggtctcggttttgacggcgacggcgaccgctgcggcgtggtcgacgacaccggcgaggagatcttcgccgacaaggtcggggtgatgctggcgcgcgacatgtcggcgatccatccgaacgcgcgctttgtcgtcgacgtcaaatcgaccggcctgttcgcgaccgatccggtgctgcaacagcagggcgcccagaccgaatactggaagaccggccactcctacatgaagcggcgcaccaatgagctgaacgcgctcgcgggcttcgagaagtccggccacttcttcttcaacgccccgctcggccgcggctatgacgacgggttggtgtcggcgatcgcgatctgcgagatgctcgcccgcgcacccggcaagtcgatgtcggatctgaagaacgcgctgccgaagacctggtcgtcgccgacgatgtcgccgcattgcgccgacgaggtgaagtaccgggtgatcgatcaggtggtgaagcacttcgaagccgccaagaccaatggcgacctcgtcgccggccagccgatccgcgatctggtcaccgtcaacggcgtccgcgtcacctgcgaagacggcagctggggcctggtccgcgcctcctccaacaaacccgagctggtggttgtggtcgaaagtccggtgtcggagcag

SEQ ID NO: 44229 - DNA, 678 bp, Rhodopseudomonas palustris
aaagtcgccctgatcaccgcgggcggcagcggcatgggggctgcggcggcgcgccggctggccgcggacggctttcgcgtcgcggtgctgtcgtcgtccggcaagggtgaagccctggcgagcgaactcggcggcttcggcgtcaccggatcgaaccagtcgaacgacgatctgaagcgcctggtcgatcaggcgatggcgcagtggggccggatcgacgtgctggtcaacagcgccggccacgggccgcgcgcgccgatcctcgagatcaccgacgagcagtggcatcaggggctcgacgtctatttcctcaacgtcgtccgcgccacgcggctggtggcgccgatcatgctgcagcagaaggccggcgccatcatcaacatctcgaccgcctgggcgttcgagccgagcgcgatgtttccgacctcggcggtggcgcgggcggggcttgccgcctacaccaagatcttcgccgaccaatacgccgccgataacgtccggatgaacaacgttctgccgggctggatcgacagcctgccggccaccgagcagcgccgcgacaccgtgccaatgaagcgctacggcaccagcgccgaaatcgccgccaccatcgccttcctcgcctccgacggcgccgcctacatcaccgggcagaacatccgggtggacggcggcctg

SEQ ID NO: 44230 - DNA, 606 bp, Rhodopseudomonas palustris
ctcgaaccgtccgagttcctcgaagtcgcggtgcagcccgatcagccgcgcccgtcgcgcgccgaggctgaggccgcggtgaagacgctgctgtcctatatcggcgagaacaccgagcgcgaggggctgatcgataccccgcgccgggtggtcgaagcctatgacgagctgttccagggctatcaccagtgcccgaaggaagtgctggagcgcaccttcggcgagactgccggctatgacgatttcgtcctggtccgcaacatcagcttcacctcgcattgcgagcaccacgtgatgccgttctacggcaaggcgcacatcgcctatacgccggtggagcgcgtggtcgggctgtcgaagctggcgcgcctcgtcgatatcttcgcccgccggctgcagactcaggagcatctcaccgcgcagatcgccgccgcgatcgacgaggtgctgaaaccgcgcggcgtcgcggtgctgctcgaagccgagcacacctgcatgtcggtgcgcggcatcgccaagaagggcgccaccaccttcaccagccgctacaccggcgtgttccgcgacaatccggcggagcaggcgcggttcatgtcgatggtcagg

SEQ ID NO: 44231 - DNA, 690 bp, Rhodopseudomonas palustris
gccggcaaagccgcgctggtcaccggcggcagtaagggcatcggttttgcgatcgcgcaggcgctggcgcaggccggcgcgtcggtgatgatctgcgcccgcgacgagagcgagatcgcccaggcgctgccggcgctgcgcaacggcgtccgcggccgggttcatggtctcgcatgcgacgtccgcgacgaggccgaggtgcgccagctggtcgaccacaccgtcaccgcgttcgacggcctcgacatcctggtcaacaacgccggggtcggtctgctcgggccagtcgagacgtttccgcccgagcactggcggctcaccctcgataccaacctcaccggcgcgttctattgctgccactacgcgatcccggcgctgaaggcgcgcggcggcggcgccatcgtcaacatcggcagccgctccagcgtcaacgcctatggcggcggcgcggcgtattgcgcctcgaaattcggcctgctcgggctgtcggagtcgctgctgcaggagctgcatccgttcggcatccgcgtcagttgcgtgatgccgggccgggtcgccaccgattttgccggcgagccgccgcaggactggcacctgtccgccgacgatgtcgcgcaggcggtgatcgatgtgctgtcgttcgcgccgcgcgctctggcgagccggatcgagctgcggccggcgcggccg

SEQ ID NO: 44232 - DNA, 732 bp, Rhodopseudomonas palustris
ggccgccgcgcgatggtcaccggcgcggcgcagggcatcggcctcgcgatcgcccgcacgctggcactgcacggcgcacaggtcgtgctggtcaacctcaagcacgagtccggcgaagccgcagcacgcgcgattaccaatgccggcggcgatgcgcgcttcatcgtcggcgacatgagcgacgaggatgcgattgccgcaacggtggcggcgagcaccgccgcgatcggcgggctcgatatcctggtcaacaacgccgcaccgacgcagcgggcacggccgccattcgccgaacagagcgccgcgctgtgggatacgaccgaagcggtgatgctgcgcggctacatgctcaccgcgcaggccgcgctgccgcatctggcgcaagcgcgcggcgcgatcgtcaacctgtcgtcggtgctggcgcgcagcgtggcgcacgaaaccgccgcctatcacgtcgccaaggccggcgtcgaacagctcacccgctatctcgcctggcatctcggccgcagcggcgtgcgggtcaacgcggtggcgcccggcgtggtcgatcgcgatatcggcgccaagctcagcgacgatccggtcaatcgggctgtgctcgaagcggcggtgccgctcggccgtgccgccaccggcgccgagatcgccgaggtcgtggcgttcctgtgttcgccggcggccggttacatcaccggtcagacgctggtgatcgacggcggattgtcg

SEQ ID NO: 44233 - DNA, 1866 bp, Rhodopseudomonas palustris
ctcgctgctgacgccgttcgtccgctggtgcgcattgtcatcgtcggccacgtcgaccacggcaagtcgaccctggtcggccgcctgttgcacgaaaccggctcgctgcccgaaggcaagctcgagatgctgaaggcggtcagtgcccgccgcggcatgccgttcgagtggtcgttcctgctcgatgcgctgcagaccgagcgcgaccagggcatcaccatcgacaccacgcagatccgcttccgcacgccctcgcgcgacgtggtgctgatcgacgcgcccggccacgccgaattcctgcgcaacatgatcaccggcgcctcgcaggccgacggcgcggtgctgatcatcgacgcgctcgaaggcgtgcgcgatcagacccggcgtcacggctatctgctgcaactgctcggcatcaagcaggtcgccgtcgtggtcaacaagatggaccgcgtcgagttttcggctgcgcggttcggtgacatcagcaacgagatcactgcgcatctgacctcgctcggtattacgccgacggccgtgattccgatctcggcccgtgagggtgacggcgtggcggagcgcaccgacaacatcgcctggtacgacggcccgaccgtggtcgaagcgatcgacaaactgacgccggcgcagccgctcgacgcgttgccgctgcggctcgccgtgcaggcgatctacaagttcgacgatcgccgtatcgtcgccggccgcatcgagtccgggcatctgcgggcgggcgacgacatcgtcatcatgccggccggcaagatcgccaagatcaagaccgtcgaaggttggccggtgaccccgcttgccggcgcgttcggcgccggccgttcggtcggcattacgctcgaccgtgagctgttcgtcgagcgcggcgatgtgatcggccatgccggcaatgctccgcgcgacacccgccggctccgcgcgcggattttctggctgcatgatcagccgctcaccgccggcgcctcggtgctggtgcggctcggcacccgtgagacccgcgcgaacgtcgtggcgatcgagaaggctgtcgatcccggcgatcttgccagcgaggccgcaaccgagatcaaacgcaatcatgtcggcgaaatcgacctgtcgctgtcgcagccggtggcggccgatccggccgataacaatccgcgcacagggcggctggtgatcgagatcaacggccggattgctggcggcggtctggtgctcagcgtcgacagcggccagcgcgccgccaccgccgatatcgtgccggtggagtccgcgctgctgccgggcgaacgcgccgcgcgctatcgtcacaacggcgcggtgttgtggttcaccgggctgccgggctccggcaagaccacgatcgcgcgggcgctcgaacgccggctgttcgatcgcggcggctcgccgatcctgctcgacggcgacacgctgcgcgctgggctcaacagcgacctcggcttctcgccggcggaccgcgcggagaacatccgccgcctcggcgagatcgcggcgcatctggccgccaacggccacattgccatcgtcgcggcagtatcgcccgggctcgccgatcgtgccgcggcgcgccgcatcgccggcgatcgcttccgcgagattcacgtcgcgacgtcggctgaagtttgcgagcagcgcgatccgaaggggcactacgccaaagcgcgttccggcggcctgccgaacttcaccgggatcggcaacgactatcagccgccgaccgccagcgaattggtgctcgacaccgccggcctgtcggtcggcgaagccgtggcgcaggtcgagaccatgctggcgcagaccgacgtgctgatcgaagaccccgccgac

SEQ ID NO: 44234 - DNA, 1467 bp, Rhodopseudomonas palustris
catcacgccgaggtccgccccgagcggattgcggtggtcgatctcgccagcagtcgcaagatcagctaccgcgcaatggacgaacgggtcgatcggttggctgcccatctcgctgcgcttggcgttggccgtggcgaccgggtcgcggtgctggcgctgaatgcggtcgagacgctggaggtgcagttcgcctgcttccggctcggcgcgatcttcgtgccgcttaatgtccggctcaccgtgcacgaactatcctacatcgtcggcgacgccgcgccgcgggtgctggcgcatgacgacgagctggctccgatggcgaaggagttgaaggcggcttgcagcgtgccgcatctcctggcgttcggcgcggcctacgaggcggcgctggcggcctcgccgcggctcggagcctccgagcctgtgacgctcgatgacgtctccaccatcatgtacacctccggcaccaccggaaagccgaagggcgccatgatcacccatggaatgactttcatcaacgcggtcaatctcggcattccggcgttcatttcgcaacgcacggtgtttctctgcgtgctgccgctgttccacaccggcgggcttaattgctacaccaatccggtgctgcacgccggcggcaccacactgttgatgcgcgcgttcgatccgggcgcagcgctgtcgattatcggtgatccgtcggtcgggctgacgcatttcttcggggtgccctcgatctatcagttcatgtgccagcatccggcgttcgcggcgaccgatctgtcgcggctgcagatcgccggggtcggcggcgccccgatgccggtgccgctcttgaagatctggcaggagcgtggctgcgccttggtccaaggctacggcatgaccgagaccagcccggcggtgctgatgctcgatgccgacgatgccgcgcgcaaggccggctcggccggcaagccggtgctgcacgccgatctcaagatcgtcggcccggacggcgacccggtgaagccgggcgagatgggcgaactctgggtgaagggcccgaacatcacccccggctattggaacaggccggacgccaatcgcacctcgttcaccgacggctggctgcacaccggtgacgcggcgcgggtcgacgacgaaggcttctattacatcgtcgaccgcaccaaggacatgtacatctcgggcggcgagaacgtatacccggccgaggtcgaggacgtgctgtaccaattgccggagattgccgaggctgcagtgatcggcgcgcctgatccgcaatggggcgaaacaggcgtcgcggtggtcgcgctcaaacccggccaagagttgagcgaggcgaagctgctggcgcactgccgcgagcggctggcgcggttcaaatgtccgcagcgcgtcagcttcgtcgaagcattgccgcgcaacgccaccggcaaggtgcacaagccgacgctgcgcgaacgc

SEQ ID NO: 44235 - DNA, 2844 bp, Rhodopseudomonas palustris
atggctctggtccacgaaaccgatttcggcacgccgccctcgctctccgaaaacatggtgacgctgacgattgacggtcgcagcgtcagcgtacccgagggcacctcgatcatgcgcgccgcgatggagatcggcacggcgatcccgaaactctgtgccaccgacatggtcgatgcgttcggctcatgtcggctgtgccttgtcgagatcgatggccgcagcggcaccccggcctcgtgcaccacgccggtcgccgacggtctcgtcgtccacacccagaccgagcggttgaagcagatccgcaaaggcgtgatggagctatatatctccgatcacccgctcgactgcctgacctgctcggccaacggcgattgcgagctgcaggacatggccggcgcggtcggcctgcgcgacgtgcgctacggttactccggcgagaagcatcccaatccgggcctcgacgagtccaatccgtatttcacctacgatgcgtcgaagtgcatcgtttgctcgcgctgcgtccgcgcctgcgaggaggtgcaaggcaccttcgcgctgaccatcgccggccgcggcttcgattccgtggtgtcgcccggcatgcaggagagcttcctcggctcggaatgcgtgtcctgcggcgcctgcgtgcaagcctgcccgaccgcgacgctgaacgaaaagagcgtgatcgagatcggcacgccggagcgctcggtggtgacgacctgcgcgtattgcggcgtcggctgcaccttcaaggccgagatgcgcggcgaagagctggtccgcatggtgccttacaaggacggcaaggccaatcgcggccattcctgcgtcaagggccgcttcgcctggggctacgccaatcacaaggagcgcattctcaagccgatgatccgcggcaagatcaccgagccgtggcgcgaggtgagctgggacgaggcgtttgcctatgcggcgtccgaactgaagcggatccaggcgaaatacggccgcgactcggtcggcggcatcacctcgtcccgctgcaccaatgaagaaaccttcctggtgcagaagctgatccgcgccggcttcggcaacaacaatgtcgatacctgcgcccgggtctgccactcgccgaccggctacggcctgtcgaccgcgttcggcacctcggccggcacccaggatttcgactcggtcgagcacgccgacgtggtgatgatcatcggcgccaacccgacggacggccatccggtgttcggctcgcgcctgaagaagcggctgcgccagggcgccaagctgatcgtggtcgatccgcgccggatcgacctcgttcgctcggcgcatgtcgaggccgcacagcatctgccgctcaagcccggcaccaacgtcgcggtgctgaccgcgctggcgcacgtcatcgtcaccgaagggctggccaacgaagcgttcgtgcgcgagcgctgcgactggagcgaatacgagcactgggcggcattcgtctccgatgagaagcacagcccggaagccactgcggccttcaccggcgtcgatccgcaggcggtacgcgaagccgcgcggctgtacgccaccggcggcaacggcgcgatctattacggtctcggtgtcaccgagcacagccagggctcgaccacggtgatggcgatcgccaatctggcgatggcgaccggaaatctcggccggcccggcgtcggcgtgaacccgctgcgcggtcagaacaacgtgcaaggctcgtgcgacatgggctcgttcccgcacgagctgccgggctatcgccacatctcgaccgatgcggtgcgcgaaagcttcgaggcgttgtggaacgtcaagctcgacaacgagcccggcctgcgcattcccaacatgctcgacgccgcggtcgagggctcgttcaaggcgctgtacgtgcagggcgaggacatcctgcagtccgaccccaacaccaagcacgtcgccgccggcctcgaagcgatggaatgcgtcatcgtccacgatctgttcctcaacgagaccgccaactacgcccacatcttcctgcccggttcgaccttcctggagaagaacggcaccttcaccaatgccgaacgccgcatccagcgggtccgcaaggtgatgaccccgaagaacggcctggaagactgggaagtcacgctgcggctcgccgaggcggtcggctacaagatgaactacacgcatccgtcgcagatcatggacgagatcgcggcgctcaccccgaccttcacgggcgtgtcctatgatcgcctggaagaactcggctcgatccagtggccgtgcaacgagcgcgcgccggaaggcacgccggtgatgcacatcgatcatttcgtccgcggcaagggcaagttcgtcatcaccgaatatgtcgccaccgacgaacgcaccgggccgcgcttcccgctgctgctgacgaccgggcgcatcctgtcgcaatacaatgtcggggcgcagacgcggcggaccgccaatacggtgtggcacgacgaggaccggctcgagatccacccgcacgacgccgagcagcgcggcgtgcgggacggcgactgggtgcggctcgccagccgcgccggcgaaaccacgctgcgggcgctgatcaccgaccgcgtcgcgccgggcgtggtctacaccacgttccaccaccccgatacccaggccaacgtggttaccaccgagtactccgattgggccaccaactgcccggaatacaaggtcacggccgtgcagatcgcgccgtcgaacggcccgtcggagtggcaacgctcctacgagcagcaggcggcggccgcacggcggattgctgtgccggcggaggccgcggag

SEQ ID NO: 44236 - DNA, 981 bp, Rhodopseudomonas palustris
cacggcggcgatctcactgcggcgatggcacggcacggcggcgatgccgccgactggctcgatctctccactggcatcaatccgcggccctggccgattccggatatcgctgcggatgcgtggctgcgtctgccgtcgcaggccgacgagaccgcgctgtgcgatgctgcgcgcctggcctacgaggtgcccgatgagtccggcatcgtcgccgctgccggcacccaggcgctgatccaatggctgccgtatctcgccgcacctggcggcgttgcgatcgtcgggccgacttacgcggagcacgcgttggcttggcgtaacgctgggcgcgagctggtcggcatcgcttcgctcgatgacattccggagcaggcccgccacgcggtcgtggtgaatccgaacaatcccgacggccgcgtcgtcgaaccagacaccttgcgccgcgcagccgcgcaactgcgccggcgcggcggctggctggtggtcgacgaagccttcgccgacgttgatccgtcgttcagtgcggcatcgctcacgcccgaattgccgatcgtcgtgttgcgctcgttcggcaagttctacggccttgccggcgtccggctcggatttgcgatcgcgggtgaggcgactgctcggaggatcgcattggcgctcgggccgtggagctgttccgggccggcgctgcggatcggcgccgcggcgctgcgcgatcaagcgtggaccatcgaaacccgcgacgaactgcgcgaacaggcgacgcggctcgacgacgtgctgcgcgtcggcggattcgaaatcgtcggcggaacgccgctgttccggctggcgcgtcacgccgaggcacatcggttgcacgaggcgctggcgcagcagcggatctggtgtcgcaggttcgattgggccgacgatctgctcaggttcggcctgcctgccgacgcagccgggctcgatcggctcgcagccgcgctcgccgcgcccttg

SEQ ID NO: 44237 - DNA, 3732 bp, Rhodopseudomonas palustris
atgcacctgaagctcgacaccagcgtcagcatcgacgacggcgatgtcgcgcgcgatctcgggcagtcgacggccgatatcgtggtgttgtcggcggctgatagcgatctggcggcattcggcgcagcgcgggccgggatgccggacgactatccgacgctccagctcaccaattttctggcgcttggccatccggcttcggtcgacctctatgtcgagcgcacgctggcgaaagccaagctggtgatgctgcgaatgctcggcggcgaagcctattggccgcacggcgtcgacagcttgcggcgcgatgcgctggcacgtggcgcgcagttcgtctgcattccgggcgagatggagtggaatgcggagctcgcggcgcgcggtacggccgatctcgacgacgctcacgcgctgtggcgctattgcagcgagggcggcgtcgacaacatccgattggcgctgcgctacgccgcctggatgatcctgcgcgacgattgcccgccaccggcgcggccgatgccggccgctgggttttggccggccgagccgccgtcatcgccgcgccgccgcgcgctagtgatcttctatcgggcgctggcggcgagcggtgataccgcggcgatcgcggcgctgcgtgatgcgctgaccgcccgcggcctcgaccccgtctgcgtcttcgtcaccagcctgaaggatgcgcgctcgatcgcgtttttacgcagcgtgctgaccgcgacgccgcccgacgtcatcgtcaacgccacggcgttcgcgaccgccaccgcaaccgacgagtccggcgtcctcgcgtccgcagactgtccgatcctgcaggtggcgcaggccggagtgacgcgcgagcactgggagcaatccggccgtggcctcaatccgcgcgacctcgccatgcatgtcgtgctgccggaagtcgacggccgcgtgttcgccggcgcggtagcgttcaagcagcgcggcggcgacgctgaatttgcgccgaccgtgtatcagccgcttcaggaccggatcgacgcggtggcggatctggcgcgggcctgggtgcggttgcggcatttgcaacgcgatcagcgccgcgttgccatcgtgctcgccaactatccgaaccgcgacggacggctcggcaacggcgtcggtctcgacaccccgcaatcgctgcacgacctgctgtttacgctgcggaccgaaggttacctcaccggcgagctgccggccgacaccgccgcgctgatggatcggctgcagcgcggtccgaccaatgaactggatgaccgagcggcgcgggatggcggcgtgagctggccggttgcggactatgcggcggcgttcgagggattgccgcaggcggtgtgcgacgcagtgacggcgcggtggggggcgccggaggacgatccgcatgtcgcggatggggtcttccgtctcggcctgcatcgcttcggcaacatcctggtcggcgtgcagccggcgcgtggctatgcgatcgatccgaaatcgagcttccatgatccggagctgccgccgccgcatcactatgtggcgttctatctgtggctgcggcaagcgttcggcgccgatgcggtgatccatctcggtaagcacggcaatctcgaatggctgccgggcaagagcgccgggctgtcgcgcgattgttttccggccgcgctgctcgggccgctgccgcatctctatccgttcatcgtcaacgatcctggcgagggcatccaggccaaacggcgcagtgccgcggtgatcgtcgatcatctgacgccgccgatgacccgcgccgagctgcacgacgagatggcgcggctggaagcgctggtcgacgaatatgcgatggcggccgatctcgatcccaatcgcgccgacgcgatcgccgaggacatcatctcgctggcgcgggcgacgcgcctcgacgaagacgtcgcgatcgatcgcgacactgcgacgctcgatgcgctgcgggcgatcgacgcgcatctgtgcgatctgaaagagatgcagatccgcgacggcctgcacgtgttcggccgcacgccgcaggcatcccagcgcgacgagctgctggtatcgattgcgcggttgccgcgctccgaactgaagccgcaggacgcctcgctgcatcgtgcgctggcacgagacctcggactgacggctagcgacggagccgaattcgatccgctgacccgtgacctcgcgacgccttacatcggcgcccgcccggccgttctcgcggcgctgagcgatcggccgtggcggacgagtggcgacaccgtcgagcgcgtcgagatgctggcgctgcaactggtgtcgactcttcatcaagccgccccctctcccgcgagggacgaggctgagcggcctcagccgctgcctcatactcagcccgtgctcgactggatcgccacctcgctgcgtccggcgatcgaagcgtccggcgatgccgagcgcgaggcgttgctgcgcgggctcgatggacggttcattcggccggggccctccggggcgccgacccgcggccgtcccgacgtgttgcccacgggacgcaatttcttcgcagtcgatgtccgcgcggtgccgacgccgtcggcgtggcgaatcggccagctcgccgccgagcggctggtcgagtcctattggcaggaagccggcgagtggcctcgctcgatcgcgctgtcggcgtggggcaccgccaatatgcgcaccggcggcgacgacgtcgcccaggcgctggcgctgatcggcgttcggccgacctgggaagacgccaccggccgcgtcaccggttttgcaattgtgccgttgtcggagctgcggcggccgcgcgtcgacgtcactttccgcgtctcggggctgttccgcgacgcctttccggtgcagatggatctgatcgccagtgcggttgcggcggtggcagcgttggacgaacctgctgacgccaatccgatcgccgcgcaggtccgcctccgcagcgaacaattggttcagagcggcgtcgatcccgagctggcgaaaaagcaggccggcgcgcgggtgttcggcgcgcggcccggcagttacggagccgggctgcaggcgatgatcgatgacggcggctggactagccgcgatgatctcgcggatgcttacctcgcctggggcggctacgcctatggggcggggcaggacggcgccgaggcgaccgatgcgttcgcggcccggctgaaggcggtcgatctggtggcgcaggcgcaggacaaccgcgaacacgacattctcgactccgacgattactaccagttcatcggcggcctcgccgcgacggttgaaagtctgcgcggacaggcgccgcggatcgctcatgtcgacacgtcgcggcccgaagcgccgctgccgcggacgctggcgcacgagatttcgcgtgtggtgcgaggccgcgctgccaacccgaagtggattcagggggtgatgcgccacggctacaagggcgcctccgaaattgccgccacagtcgattatctgtttggctttgcggcctcgaccgatgccgtcggcaaccgccatttcgacctgctgttcgccgcttacctcgaagacgacgcggtgcgccagtttctgcaggacaccaatccggcggcgctgcgcgacatcgtcgcccgcttcgacgaggcgatccggcgcgggctgtggacgccgcgctccaaccgcgccgccgacgtgctcgccgaaattctcact

SEQ ID NO: 44238 - DNA, 672 bp, Rhodopseudomonas palustris
gcgatcgaagccgagaacctgacctgtcggttcggcgatttcaccgcggtcgaccacgtcaacttccagatcaagcgcggcgagatcttcggcttcctcggctccaacggttgcggcaagtcgacgacgatgaagatgctcaccggcctgctgacgccgaccgaaggcgaggcgcggctgttcggcgaggtgctcgacgcctccgacatggcgacccgcaagcgcgtcggctacatgtcgcagagcttctctctctactcggaactgacggtccggcagaacctgttgctacacgcgcaactgttcgaacttccgagcgcgcagattcctgatcgcgttgccgaaatgctgacgcggttcgaccttgccgacgccgccgattcccggcccgacagcctgccgctcggtatgcgccagcggctgcagctcgcggttgcggtgatccatcgccccgaggtgctgattctcgacgagccgacttccggcgtagatccggtggctcgggattcgttctggcggatgctgattgcgctgtcgcgggaggatggcgtcaccatcttcatctcgacccacttcatgaacgaggccgagcgctgcgatcggatttcactgatgcacgccggcaaggtgctggcggtcggtgcgccgcatgaactggtcgagcgccgcggc

SEQ ID NO: 44239 - DNA, 1101 bp, Rhodopseudomonas palustris
atggacattcgggcggccgtgtttcgggaagtcggggctgcgctacgcgtcgagcggatcgtgctggatccgccgcagccgaccgaagtgctggtgcggctcgccgcaattggtctgtgccgcaccgactatcacgtgatgcgcggcgagcgccgggtcgcgatgcagccgatggtgctgggccatgaagccgcgggtatcgtcgaggcgatcggcgaccaagtgcaaggcgtcgcaccgggcgatcacgtggtgctcaccttcattcccggctgtggccattgtcgctggtgccagcgcggattgcatcatctatgcgccgaggggccgcgcatcacgcatggcccacagctcgatgggagctttcgccggcgcgatgccggcggccgcgacgtcggtgcgttctgcatgatcggagcgtttgccgaggccacggtcgtcgatcaggcttcggtgctcgtgatcgacaaggatattccgctcgatcatgccagcctgatcgcgtgcggcgtgccggccggcgtcggcgccgcgcggcatcgggcgcgcgtcaagccgggcgatacggttctggtggtcggttgcggcggcgacggcatgaacgtggtgcagggcgcaaaactctgcggcgcttcgatgatcatcgccgccgacatcgtcgcgcagaagctggaatgggcgcgggatttcggcgccacgcatggcaccacggcgcaaggcgatgagctgatcagcacggtgctggcgctgaccgacggcatcggcgtcgatcacgccttcgtctgcatcaatcccgccgagacgctgctgccggcgtttcgtgccaccaccaaggctggcaacgtggtggtcaccgcgattacgcccgacaccgtcaagcagatcgacgtgccgccgctggaactgttcgccacccagaaggcgatcatgggcgcggtgtacggcttcgccagcccgcggctgcagatccccgaactgctgggtctctatcgccgcggcgacctcaagctcggtgagctgatcagccggacctatcggctcgacgagatcaaccaaggctatgctgacctcgacgccgggcggaacctgcgcggcgtggtg

SEQ ID NO: 44240 - DNA, 1548 bp, Rhodopseudomonas palustris
acaatgccgctacgcgactacaacgcggcggtcgatttcgtcgaccgcaacgtggcggaaggccggggcggcaaaatcgccttcatcgacccgcagcgcagtttgagttatggcgagttgcgcgacgccgtcgcacgcgtcgggccgatgctggcacggctcggcgtcgagcaggaaaaccgcatcgcgctggtcctgaaggacaccgtcgacttcccgatcctgttctggggtgccatccgggccggcatcgttccggtgcttctcaacacccggctgaccgccgatcagtatcgctatctgctcgaggattcacgatccagggtggtgttcgcctcatcggaattcctgccggtgatcgaagaggccgcggccgacctaccgcacctgcgtacgattatcgctgtcggcgacgctccggcgccgaccttgcaactagccaatctgctcgctaccgagcaagagggcggcgcgccggcagcgacctgcgccgacgacatcgcctattggcaatattcctccggcaccacggggatgccgaagggcgtaatgcacgtgcattcaagcccgcgggtgatggcggagaacgccggccgccggatcggctaccgcgaagacgacgtggtgttctcggcggccaagctgtttttcgcctatgggcttggcaacgcgatgttctgccccatggggatcggcgccacctcggtgctgtatcctgaacgaccgaccgccgactcggtatttgatacgttacggctgcaccaaccgacgctactgtttgcagtaccgacgctgtatgccgcgatgctcgccgatccgcgctctcgcaccgagacacttccggaccggctccggctgtgcgtatccgctggcgaacccctgccggcgcaggtcggcctcaactggcgcaatcgtttcgggcacgacatcgtcaacggcgtcggctcgaccgagatgggccatttgttcctgaccaatctgccgcacgcggtcgaatacggcacgtcgggcgtgccggtcgacggctatcggctgcggctggtcggcgaccgcggccaggacgtcgccgacgacgagatcggcgaattgctggtgagcggcggctcgtcggccgcgggctattggaatcagcgcgacaagacacgaacgaccttcgtcggcgaatggacccggaccggcgacaaatatcaccggcgcgccgacggcgtttacacctattgcgggcggaccgacgacatcttcaaggtcagcggcatctgggtgtcaccattcgagatcgaacaggcgctgatgagtcacgccaaggtgctggaggctgcggtgatcccggccgaggacaccgatgggctgatcaagccgaaggcattcatcgtactggcgtcgcgcggcgatatcgatcccggcgcgctgttcgacgaactgaaggagcacgtcaagtccgcgatcgggccatggaaatatccgcgctggattcagatcatggacgacctgccgaagacatcgagcggcaagcttcagcgctatcttctgcgcgagatgacgctcggc

SEQ ID NO: 44241 - DNA, 1578 bp, Rhodopseudomonas palustris
atgaatgccgcagcggtcacgccgccacccgagaaattcaatttcgccgaacacctgctgcggaccaaccgcgtgcggccggacaagacggcattcgtcgacgacatctcgtcgctgagcttcgcgcaactcgaagctcagacgcgtcagcttgccgccgccttacgcgcgatcggggtgaaacgcgaggagcgcgtgctgctgctgatgctcgacggcaccgattggccggtggcgtttctcggcgcaatctacgccggcatcgtgccggtcgcggtcaacacgctgctgacggcggacgactacgcctacatgctcgagcattcgcgggctcaggccgtgctggtcagcggcgcgctgcacccggtgctcaaggcagcgctgaccaagagcgatcacgaggtgcagcgagtgatcgtttcgcgcccagcggctccgctggagccgggcgaggtcgacttcgctgagttcgtcggcgcgcaggtgccgcttgagaagcctgccgctacgcaagcggacgatccggcgttctggctgtattcgtcgggttcgaccgggcggccgaagggtgtggtgcacacccacgccaatccgtattggacctcggagctgtacggccgcaacacgctgcatctgcgcgaagacgacgtctgcttttcggcggccaaactgtttttcgcttacggcctcggcaacgccctgacgtttccgatgtcggtcggcgccaccacgctgctgatgggcgagcgaccgacgccggacgcggtgttcaagcgctggctcggcggcgtcggcggtgtgaaaccgaccgtgttctacggcgcgcccaccggctacgccggcatgttggccgcgccgaacctgccggcgcgcgaccaggtggcgttgcggctcgcgtcctcggcgggcgaagcactgccggcggagattgggcagcgcttccagcgccatttcggcctcgacatcgtcgatggcatcggctcgaccgagatgctgcacatcttcctgtcgaatttgccggaccgggtgcgctacggcaccaccggatggccggtgccgggctatcagatcgagctgcgcggcgacggcggcggaccggtcgccgccggagagccgggcgatctctacattcacggcccctcatcggcgacgatgtactggggcaaccgggccaagagccgcgacaccttccagggcggctggaccaaaagcggcgacaaatacgtccgcaacgacgacggctcctacacttatgcgggccgcaccgacgacatgctgaaagtcagcggcatctacgtcagcccgttcgagatcgaagcgacgctggtgcagcatcccggcgtgctcgaagccgcagtggtcggggtcgccgacgaacacggcctgaccaagccgaaggcctatgtggtgccgcggcccggccagactctgtcggagaccgagctgaagaccttcatcaaggatcgactggcgccgtacaaatatccgcgcagcacggtgttcgtcgccgaattgccgaagacggcgaccggcaagattcagcgcttcaagctgcgcgagggtgtgttgggctgaacc

SEQ ID NO: 44242 - DNA, 753 bp, Rhodopseudomonas palustris
cggctgcagaacaagacggcagtgatcacgggtggcggaggcggcatcggcggagcgacctgccgccggttcgcgcaggaaggcgccaagatcgcggtattcgacctcaatctcgatgctgccgagaaggtcgccggcgcgatccgcgacgcaggcggcaccgcggaagcggtccgctgcgatatcgccgaccgcacaagcgtcgatgccgcgatcgccacgaccaccaccacgctcggaccggtggacattctggtcaacaacgccggctgggacatcttcaagccgttcaccaagaccgagccgggcgaatgggaacggctgatcgccatcaatctcaccggcgcactgcacatgcatcacgcggtgctgcccggcatggtcgagcgccgccacggccggatcgtcaacatcgcctccgacgccgcccgcgtcggctcgtcgggcgaagcggtgtacgcagcctgcaagggaggcctcgtcgcgttctcgaaaacgctggcacgcgagcacgcccgccacggcatcaccgtcaacgtggtctgcccggggccgaccgacaccgcgctgctcgccgacgtgacctccggcgccgctaatccggaaaaactgatcgaagccttcaccaaggcgatcccgctcggccggctcggcaagccggacgatctcgccggcgcgatcgcgttcttcggcagcgacgacgccggcttcatcacaggccaggtgctgagcgtctccggcggcctgacgatg

SEQ ID NO: 44243 - DNA, 1122 bp, Rhodopseudomonas palustris
atgaatccatatttgaacgaagacctcgtggcgctggctgcgcaggcgcggcggttcgctgccgaccggatcgcgccgggatttcaggagcgagaccggacgcgggtgctcgaccgcggcttgatgaaggccatgggcgagatgggcttcatcgcgccggagctgccggaagtgtgcggcgggctcggcatgggcagcctcgcagccggcgtgatccacgaagagatcgcgcgcgccgacctcagcatgtcctacgtcaatctgctcgcttcgctgaacggccagatcctgtcgcagcacgggcgacccgagatcgtgcagccgtggctggcgaagctgatcggcggcgaggcactgttcgcgatcgcgttgaccgagccccggggcggctcggatgcggccaacttgcgtctgcggatcgagcgcgacggcgacgactacatcgtcaacggcgagaagacttcgatctccgcagccgatcaggcggatgcggcagtagtgttcggccgcaccggctcgatcgacgccggcgcacatggcgtcaccgcgctgctgattccgatggacctgcccggcatcacccgcaacaggttcgactgtcacggccagcgtgcgatcggccgcggctcgctgtttttcgagaacgttcgcgtcccggccgcgcatcggctcggcgacgagaacaaaggtttcgtccaggtgatgcagggcttcgatttctcccgcgcgctgatcggcctgcaggtgctcgccgtcgcccgcgtcgcactcgaggagacctgggcgcatgtcgcagagcggcaggcattcggcaaacctctgtcggcgtttcagggcgtgtcgcatccgctcgccgacctcgacacccaggtcgaggccgcgcgtctgctgtgcctgcaagcgctgtggctaaaggaccacggcgcgccgcacagcgccgaggccgcgatgtgcaaatggtgggcgccgaagctcgcttacgacgtgatccatcaatgcctgctgatgcacggccacggtggctacgaccgcggcccgatggagcagcggctgcgcgacgtgctgggcttccagatcggcgacggcaccgcgcagatcatgaagacgatcatcgcgcgccac

SEQ ID NO: 44244 - DNA, 1455 bp, Rhodopseudomonas palustris
aacatggagttcgacgccgttctgctgccaccacgccgcgccgcgagcatcgccgccggcctgtggcacgaccgcaccatcaacgacgatctcgacgcctgcgtggcgcattgtcccgacaaggtcgccctgaccgcggtccggctcgacggcggcgcggtgcgccgcttcagctaccgcgagctcgcaacgctggccgatcgcgtcgcggtcgggctgaaccggctcggcgtcggccgcggcgatgtcgtcgccatgcaacttccgaactggtggcagttcaccgtgctgtatctcgcctgctcgcggatcggcgcggtgctcaatccgctgatgccgatcttccgagagcgcgagctgtcgttcatgctgaagcatggcgacgccaaggtcctggtggtgccgaagagcttccgcggcttcgaccatgaagcgatggcgcgtagcctgcagcccgatttgccggctctgcgtacgatcgtcgtggtcgatggcggcggtgcagacgatttcgacacgctgctgacgacgccggaatgggagaagcagccggacgccgcggcgatccttcaaggcagccgtccttctcctgacgacatcacacaactgatctacacctccggcaccaccggcgagccgaaaggcgtgatgcacagcgccaacacgctgatggccaatatcgtgccctacgcgcagcggctcgcgcttcgcgagtccgacgtgatcctgatggcgtcgccgatggcacaccagaccggcttcatgtatgggctgatgatgccaatcatgctgcgcgccagcgcggtgctgcaggacatctgggagccgacgaaagcggccgaactgattcgcaccgagcgcgtcaccttcaccatggcgtcgacgccgttcctcaccgacctgacccgcgtagtgaaggagagcggcgagccggtacccagcctgaagaccttcctgtgcgccggcgcgccgattcccgggccgctggtcgaacaggctcaggccggtctcggcgccaagatcgtgtcggcctggggcatgaccgagaacggcgcggtgacgctgatcaagctcgacgacgacgacaagctggcctcgaccaccgacggctgcccgctgcccggcgtcgaggtgaaagtaatcgatggcgacggcaaaacgctgccgccgaaccagatcggccggctggtggtacggtcgtgttcgaacttcggtggctatctgaagcggccgcattggaacggcaccgacgccgacggctggttcgacaccggcgacctcgcctacatgacggccgatggctacatccggatcagcggccgcagtaaggacgtgatcatccgcggcggcgaaaacatcccggtcgtcgaggtcgaggcgctgctctacaagcaccccgccgtcgcccaggtcgcgatcgtcgcctatccggacgaacggcttggcgagcgcgcc

SEQ ID NO: 44245 - DNA, 855 bp, Rhodopseudomonas palustris
caggcccggattctgtccgaagcgttgccgcacatgcagcgctacgacgaagaaaccatcgtcatcaaatacggcggccacgccatgggcgccgaggacaccgccaaggcgttcgcgcgcgacatcgtgctgctcgagcagaccgcggtgaacccggtggtggtgcacggcggcggcccgcagatcgcgcagatgctcaagcgccttggcatcaagtctgaattcgctgcaggcctgcgcatcaccgacgccgccaccatcgagatcgtcgagatggtgctggccggctcgatcaacaagcaactcgtcggctatatcaacgaagccggcggcaaggcggtcggcctgtgcggcaaggacggcaacatggtgtccgcctccaaggcgacgcgaaccatggtcgatccggattcgcgcatcgaagaggtgatcgatctcggtttcgtcggcgagccggagaaggtcgacctgaccctgctcaaccagctgatcggccacgaattgatcccggtgctggcgccgctcgcgacctccgcctcggggcagactttcaacgtcaatgccgacaccttcgccggagcggtcgccggtgcgctgcgggccaagcgcctgctgttgctgaccgacgtcccgggcgtgctcgaccagaacaagaagctgatccccgaactgtcgatcaaggatgcccgcaagctgatcgcggacggcaccatctcgggcggcatgatccccaaggtcgagacctgcatctacgcgctcgaacagggcgtcgaaggcgtcgtcatcctcgacggcaaggtcccgcacgcagtgctgctcgaactgttcaccaaccagggcaccggcacgctgatc

SEQ ID NO: 44246 - DNA, 759 bp, Rhodopseudomonas palustris
atgcccgccgacatccgcatcgttccgtgtctcaccgacaatttcggctatctggtccatgatccggccaccggtgccaccgcttcgatcgacgcgccggaagctgctcccctgattgccgccttggacaaggaaggctggaagctgaccgacattctggtcacgcatcaccacggtgaccatgtcggcggcatcgcagagctgaagaagaagtatcagtgccgcgtccatgcgccgcacgacgccaacgccaagatcgccgatgccgacgtgaggctgcaggaaggtgatgtcgttcgggtcggtgatctcaccgcgcgggtgctggaaactcccggtcacaccctcgatcacctttcctacgtgttcgacgacgaccgtgcgctgttcgcggccgacacgctgttctccatcggctgcggccgggtgttcgagggcacctatccgatgatgtgggaatcgctgctgaagctgcgggcgctgcccgacgacttcaagctgtattgcggtcacgaatacaccgcctccaacgtcaaattcgcgctcggcatcgagcccgacaacgctgcgctgcaggcacgcgccaagcaggtcgagtcacttcgcgccgaaggtaagccgacgattccggtgacacttggcgaggagaagcaggccaacgtcttcctgcgcgcggacgtgccgtcggtcgccgccgcagtcggaatgcccggcgctcccgccgccgaagtgttcggcgagatccgcgagcgcaagaat

SEQ ID NO: 44247 - DNA, 2271 bp, Rhodopseudomonas palustris
ttgctgagacggctccgcgaaaccatggcggagcaagtctccgcgcaggaacgcctcgacaagatcgtggtgttgatcgcggccaacatggtcgccgaagtgtgctcggtctatgtgctgcggatcgacaacaccctcgagctgtacgccaccgaaggtctgaaccgcgaggcggtgcaccagaccgtgctgaacgcccacgaaggtctggtcggtctggtcgcctcggaagcgacgccgctgaacctgtcggatgcgcaaagccatccggcgttctcgttccgcccggagaccggcgaagaaatctaccactcgttcctcggcgtgccgatcctgcgcgccggcaataccctcggcgtgctggtggtgcagaaccgcgccaagcgcacctatgtcgaggaagaggtcgaggcgctgcagaccaccgcgatggtgctggccgagatgatcgcctcgggcgagctgtcggcgctggctcagcccggtgccgaaccggcggcgcggcactcgatccacaaaaccggtgcggtgctgtccgacggcatcgcgcttggtcacgtcgtgctgcacgagccgcgcgtcgtcatcaccaattacatcgccgaagacctgccgaaggaaatcaagcggctcgacgcggcgctcgccaagctgcgctccgatctcgaccggatgctggagcggggcgacttcgccgagggcggtgagcatcgcgacgtgctcgaagcctaccggatgttcgccaatgatcacggctggtcgcacaagctgcacgaagcggtcgccaccggtctcaccgccgaggccgcggtcgaacgcgtgcagtcggacaccagagcgcggatgctacgctcgaccgatccttacttgcgcgaccggctgcacgatctcgaagatctcggccaccgcctgatgcgccagctcgtcgggcaggaccatgcgccgtcgcgcgagcaactgcctgacaatgccatcctgatcgcgcgctcgatggggcctgcggcgctgctcgactacgaccgcaagcggctgcgcggcctggtgctcgaagaaggcaccgccaattcgcacgtctcgatcgtggcgcgcgccctcggcatcgcggcgatcggcgaggtgccgaacgcgccaggcatcgccgatccgggcgacgcgatcatcgtcgatgccacctcgggctcgatctatgtccgcccgtctgccgaaatcgaagccgcctatgcggagcgggtgcgcttccgcgcccggcgacaggcgcagtattcggcgctgcgcgatctgccctgcgccaccaaggatggccagccgatcgatctgatgatcaacgcgggtctgaccatcgacctgccgcacatcgaagacaccggctcttccggcatcggcctgttccgcaccgagctgcagttcatggtcggccagagcctgccgcgctcgtccgatcagctcgcgctgtatcgcgccgtgctcgacgccgccggcagcaagccggtgaccttccgcaccctcgacataggcggcgacaaggcgctgccctacatggagacggtggtcgaggagaatccggcgctgggctggcgcgcgatccggctcgggctcgaccggcccggcctgctgcgcagccagattcgagcgctgctgcgtgccgccgcgggtcgttacctgcgggtgatgttcccgatgatctctgaggtggccgagttcgatgccgccaagagcatcatcgagcgcgaactgacttatctgcgccagcatggccataccctgccggagcgcgtcgacgtcggcaccatgctggaagtgccggcgctgttgtatcagctcgacgagctgttcaagcgcgcggacttcgtgtcggtgggctccaacgacctgttccagttcctgttcgcagtcgatcgcggcaactcgaaagtgtcggaacggttcgacacgctgtcggcgccgatcctgcgggcgctgcgcgacatcgtccgcaaggcgcgtgcggccaagcgctcactgtcgctgtgcggcgagatggcatcgcagccgctggcggcattggccctgatcgcgatcggctaccgctcgctgtcggtgtctgcactggcgcacggcccggtgaaggcgatgatcctcggtctcgacctcgccaaggcggaggcgatgatcgggccgctgctcgacgcgccggccggcagcgtctcgattcgcgacaagctgatcgaattcgccgaagcgcatcagctcgctttgtagcgacgcggctgccccgccgccgctttgtcgtct

SEQ ID NO: 44248 - DNA, 1242 bp, Rhodopseudomonas palustris
atgggccggctggtgatgaaattcggcggcacgtccgtcgccaatatcgagcgcatccagaacgtcgcgcgccatgtcaaacgcgaggtcgacgctggccatgaggtcgccgtggtggtgtcggcgatgtccggcaagaccaacgagctggtggcttggtgcactgaagcctcgccgctgcacgatgcccgcgaatacgacgcggtggtggcgtccggcgagcaggtgacgtccggccttcttgcgattgccctgcagtcgctcggcattcaggcgcggtcctggcagggctggcagatcccgatcttgaccagcgacgctcacgcctcggcgcggatcgtcgggatcgacggcagcgaaatcatcaagcgcttttccgagcgcaaggaagtggcggtgatcgccggtttccagggcatccatgccgaaacgggccggatcaccacgctgggccgcggcggctccgatacctcggcggtggcgatcgcggcggcgctgaaggccgaccgttgcgacatctataccgatgtcgacggcgtctacaccaccgatccacgggtggtgccgaaggcgcgccggctcgacaaggtgtcgttcgaagagatgctggaattggcctcgctcggcgccaaggtgctgcaggtccgctcggtcgagctcggtatggtccacaacatgccgatcttcgtccgctccagtttcgacaagcccgaagatatcgatccgcacggcacgccgccgggcacgctgatcagcagcgaggagaattccatggagaaccacgtcgtcaccggcatcgccttttccaaggacgaggcgcagatctcggtgcgccggatcgaggacaagccgggcgtggcggcgtcgatcttcggtcccctggccgacgccaacatcaacgtcgacatgatcgtccagaacgtctccgaggacggcaagaccaccgatctgaccttcacggtgccggcctctgacttcgcccgcgccaagcagaccatcacgtcggcgcaggacaagatcggctatgcccgcttcgacagcgagaccgacgtcgccaaggtgtcggtgatcggttcgggcatgcgcagccatgccggcgttgccgcccaggcgttcgccgcgctcgccgcccgcaacatcaacatccgcgccatcaccacctcggagatcaagttctcggtgctgatcgatgccgcctacaccgagttggcggtgcggacgctgcatacgctctatgggttg

SEQ ID NO: 44249 - DNA, 1194 bp, Rhodopseudomonas palustris
atgccgatgatcgccggcgtgcgcctcgcgaccgccgcggccggcatccgctacaagggccgcaccgacgtgctgctggtcgaaatggagaagggcaccacggtcgccggggtgttcaccacctcgaaatgcgcctccgcgccggtggaatggtgccgcgacaagctgaagggcggcagcgcccgggcgctggtggtcaactcgggtaacgccaacgccttcaccggcaagtccggcaagcaggccgccacgctgaccgcacagctcgccgccaaggcgatcggctgcaagccggccgaagtgttcctggcttcgaccggcgtgatcggcgaaccgctcgacgccaccaagttcgacggcgttctcgatgcgctggcgcttgacgccggccccgacggctggatggacgccgccaaggcgatcatgaccaccgatactttcccgaaggtcgcgaccgccaccgtcaagctcggcaaagccaaggtgacgatcaacggcatggccaagggcgccggcatgatcgcgcccgacatggcgacgatgttgtcgttcatcttcaccgatgcgccgctgtcggcctcctgcctgcaggcgctgctcaaggccggcgtcaccgacactttcaacgccgtgaccatcgacggcgatacctcgacctccgacacgctgctggcgttcgcgaccggcgcagccgccgagaacggcgcgccgaagatctcgcgcgcctcggacccgcggctgaaggccttcgtcaaggcgttcaacgcggtactggccgatctcgccgagcaggtggcgcgcgacggcgaaggcgctcgcaagctggtcgagatcatcgtcgagggcgccaagaccaaggtttcggcgcgcaagatcgcgctgtcgatcgccaattcgccgctggtgaagaccgcgatcgccggcgaagacgccaattggggccgggtggtgatggcggtcggcaaggccggcgagccggccgatcgcgacaagctgtcgatctcgttcaacggcatccgggtcgccaaggccggcgcgcgcgatccttcgtataacgagaaggaagtctcggccgagatgaagaagccggtgatccagatcaaggtcgccctcggcctcggcaaaggccgcgaccgcgtgctgacctgcgacctgaccaaggaatacgtcgcgatcaacggcgattatcggtcg

SEQ ID NO: 44250 - DNA, 1401 bp, Rhodopseudomonas palustris
agcggcgacggcgaggtccgccacctgaagcggtcgctgtcggcagtcaatctggtcgccctcggggtcggcggcatcatcggtgccggcatcttcgtgctcaccggccacgccgccgccgccaacgccgggccggcggtgtcgctgtcgttcctgctcggcgcgatcacctgcgcgttcgccgggctgtgctacgccgagatggcctcgaccgtgccggtgtctggcagcgcctacacctatgcgtatgcgacgatcggcgagctggtggcctggatcatcggctgggacctgatcctggaatacgcggtcggcgccatcacggtggcgatcggctggtccggttacttcgtcagcctgctcggcaatttcggcattcatctgccgccgcagttcaccacggcaccgctcgcctacgacgccgcaacccacgcctggtcgaccaccggggcgtttctcaacctgccggcaatagcgatcgtcgtcgcgatcgccacgctgctggtgatcggcatccaggaatcggcgcggttcaacaacgtcatcgtcggcatcaagctgacggtgatcgcgctgtttctgatcttcgccgctccgatggtgacgccggccaactgggtgacggcggccaatccggatggcgcgttcattccaccggcgcaggagaacggcatcttcggctggtccggcgtgctgcgcggcgccgcggtggtgttcttcgccttcatcgggttcgacgcggtctcgaccgccgcgcaggaagccaagaacccgcagcgcgatatgccgctcggcatcctcggctcgctggcgatctgcaccgtgctgtatgtctcggtcgcattcgtgctgaccgggatcgtgccatacgaccggctcaacgtgcccgatccgatcgcggtcgggatcgacgccgccgggatcggctggctgtcctcgatcgtcaagatcggcgtcgtcaccgggctgacctcggtgatcctggtgctgatgctcgggcagacccgcgtgctgcgggcgatggcgcatgacggcctgatgccgaggggcgccgccgccacccacccgcgcttccgaaccccgcatgtcgccaccatcggcaccggcgtgatcgtcgccggccttgccggggtgctgccgatcggactggtcggcgaattggtcagcatcggcacgctgttcgcgttcgcggtggtctgcgtcggcgtgctggcgctgcggatcaagcatcccgagcagcatcgcccgttcaaggtgccggcgatctggctggttgcgccggccggcgcgatcgtatcgttcatcctgatgctcggcctgccgctcgatacctggatacggctggcggtgtggctggcgatcggccttgcgatctacttcctgtacggccgtcatcacagc

SEQ ID NO: 44251 - DNA, 831 bp, Rhodopseudomonas palustris
cgcaccgcgctggtcaccggcgccaattccggcctcggcaaggccatcgtcaccgcgttggcggcggacggcctgcgtgtcggcctggtggcgcgcgaccgcggccgcggcgaggcagcgctcgcggatgttcgcgccgccaccggcaatcaagacctgcacttgttcgtcgccgatctcgccgaccaggaatcaatccgggcgctggcacaggatgtgcgcgcgcgcttcgaccggctgcatctgctcatcaacaacgccggcaccgccttcccggagcggcggctgagcccccaggggatcgagcgcgccttcgcgatcaatcacctcggcccgttcctgctcaccaatctgctgctcgatctgatcaaagccagcgcgccggcacggatcgtcaatgtcggcacccgcatcgacgcggcgatcgatttcgacgacctcaactgggacaagcgcccctacggcatgatgaagggctatgcccagtccaagctcggcaatctgcacttcaccttcgaactggcgcgccggctcgaaggcagcggcgtcaccgtgaattgcgtgtttcccggcgtattcaaatccaacctcggcggcaccgacggggcgcaaggtctgttctggaagctactcgccaaactcggcggctgggcgattccgaagccggaaagcgcggcgcagcgggtgctgtatctcgcgaacgcaccggagctggagagtgtcagtggacagtactacgcgaaccgcaagacgatcccggcaccggctcaggcgctcgatgcggaagcgaacaggcggctgtgggagatcagcgagaggatgacgggactg

SEQ ID NO: 44252 - DNA, 1258 bp, Rhodopseudomonas palustris
tcgctgtttgggcaggtggtcaccgccctcgtgcttggtgtcgttgtcggtgcgctgtggcctgaggtcggggtcgcgctgaagccgctcggcgacctgttcatcaaactgatcaagttcgcgatcgcgcctctggtattcggcgtcgtcgtcaacggcatcgtcggcgccggagacctgaagaaggtcggacgcgtcgggctgaaatcgctgatctacttcgaggcggtgacgacgctggcgctcgcgctcggcatcgcgctggcctacgtgttccagcccggcgccggcatgaacgtcaacacggcgacgctcgatggttcggcgctcgccggctacagcagccacgtcaaggaagtcaccggcttcaccgacttcatcatgcggctggtgccgaccaccttcatcgatgcgttcgccaagggcgacgtgctgcaggtgctgatcatcgcgatcctgttcggtgccggattgtcgttgctcggcgagcgcggcaagcccttggccgacagcatcgagcggatcaccgaggtgctgttcaagatcatcggcatcatcgtcaagctggcgccgctcggcgtgctcggcgcggtgtcgttcacggtcgccaaatacggcatcggctcgctcaagcagctcggcctgctggtcggcctgttctatgtcggcgtcgcgctgttcgtgttcgtgatcctcggcggcatcatgcggctggcgggcttcagcctgatcaagctgctggcttatttgcgcgaagaactcacggtggtggccggcaccgcgtcgtcggacagcgtgctgccgcaggtgatgcgcaagctggagcggctcggcatcaaggactccacggtcggtctggtgattccgaccggctactcgttcaatctcgacgcgttctcgctgtatctgacgctggcgacggtgttcatcgcccaggccaccaatacgccgctgtcgttcggccatctgctggtgatcctcggcatcgcgctgctcacctccaagggcgcccacggcgtccccggctccgcgatcgtggtgctggccgcgacgctgtcggcggtgccggacattccgctgatcggcctggtgttggtgctgtcggtcgactggttcgtcgggattgcccgcgcgctcggcaatctggtcggcaactgcgtagcgaccgtggtgatcgccgcgtgggagggcgatatcgaccgggctcaagcgaaacgcgtgctgaacggcgaggtcaccaccgacaccgcggcgatcc

SEQ ID NO: 44253 - DNA, 2448 bp, Rhodopseudomonas palustris
ctgccgatcgacgacgctctcgacgagctcaccgccgcgcttgaggcgagcaataccgccgtgttggtcgcgccccccggcgccggcaagaccacccgcgtgccgctcgcgttgctcgatgcaccgtggctgagaaaccaaaagatcatcgtgctggagccacggcggatcgccgcccgcgccagcgccgagcggatggcgaagacgctgagcgagaaggctggcgagaggatcggttaccgcgtccgattcggctccaaggtgtcacgcgccacccggatcgaggtcgtcaccgagggtattttcacccgccagatcctcgacgacccggaactcaacggcgtcgccgcggtgctgttcgacgagtttcacgaacgctcactcgacgccgatctcggcctcgccctggctcgcgacgcccagcaaggtctgcgcgaagatctgcgaattctggtgatgtcggccaccatcgacggtgcccgcgtcgcccggctgctcggcgatgcgccggtggtcgaaagcctcggccgggcgtttccagtcgagacccgctatctcggccggcgcagcgacgcgccgttggagaggcagatggccgaggcgatcgcgcaggcgctgcgggcggaaaccggctcggtgctggcgtttctgcccggcgccgccgaaatccggcggaccgagacgatgctgcgcgagcgggtgcaggatccggcggtcgagatcgtaccgcttttcggcgcgctcgacgccgcggtgcaggaccgcgccatccagccggcaccgaaaggccagcgcaaagtggtgctggcgacctcgatcgccgagacctcgctgaccatcgagggcgtgcggatcgtcgtcgattgcggcttgtcacgggtcccccgttacgagccggacctcggcttgacccggctggagacggtgcgcgcctcgcgcgccgccgtggaccagcgccgcggccgtgccggccggatcgagcccggcgtgtgctaccgactgtgggacgagccgcagaccgcgtcgctgccggcctatacgcaacctgaaatcctatccgccgatctgtcatcgctgctgctcgacctcgcccaatggggcgttgccgatccgtcgtcgctggcgtttctcgatccgccgccgcagccggcgctgaaggaagcccgtgagctgctcggcgagctcggcgcactcgacccggacggccgcatcaccgacgagggccgcagcctgcgggcgatggcattgccgccccggttggcgcggatgatcgtcgatgccgcccgccacgactgcgccaaggacgccgccgaagtcgccgcgattctgaccgagcgcgggctgggcggcgatagcgccgacctcgacaatcgccgcgatcaattccgccgcgaccgctcgcagcgcgccagcagcgcccggcagatggcgcagcgttgggcgacgcaggccgcatcgtcatctccctccccgcaagacgcaggcgagctcagctccggcgtgctgctcgccttcgcgttcccggatcgcgtcgccaagaatcgcggcaatggtagcttcacgctcgccaacggccgcggcgccgcggtcgagcaaacttccgcgctggcgcgcgcaccgtatctggcggtcggcgaacttaccggcagcgccgcgcagggccgcatcctgctggcggcgccgatcgcactgtcggagatcgagctgcatttcggcgatcagatcaccgacgccgacgaggtgagcttcgaccgctccgcgatggcgctgcgggcgcggcggcgccgcgcgctgcatgcgatcacgctgtccgaagcaccgctggcgctgacaccgtccgaacagaccgcgcgcgtgctcgccgagggccttgtcgtggccggactcgaccggctgccgtggtcgaagcagcttcagcaatggcgcggccgggtaatgttcctgcgcaaggccgagggtgatccctggcctgatctgtcggatgccgcactcgccgagacgcgcgaaaactggctggtgccggcactgttcgacaagaccggactgaaggatttttcggcctccgacctgtcggacgccctgatgaatctgttgccgtgggagctgcgcgcccggctcgaccgcgaggcgccgacgcatttcgaggcgcccaccggctcgaagctgccgatcgactacgaggccgagcaggggccgaccatcgcggtgcggctgcaggaattgttcggcctgaccacccatccatcggtagccggcggcgcagtgccgctggtgctggagctgttgtcaccggcgcaccgcccggtgcaggtcacgcgcgaccttccagggttctggcggggctcctacgccggggtgcgggccgatctgcgcggccgctatccacgccacccctggcctgaagaccccgcctcggcgccgccgacccgccgcgccaagcccaaaggc

SEQ ID NO: 44254 - DNA, 717 bp, Rhodopseudomonas palustris
atgacgcgggtggcgttggtgactggggggacgcgcggtatcggtgcagcaatcagcaaggcgttgaaagcggcgggctacaaagtcgcagcgtcttatgcgggcaacgattcggcagcggagaaattcaaaaacgagacgggtattccggtatataaatgggacgtgagttcgttcgatgcctgtgccgagggcgtcaagaaagtcgaggccgaactcggtcccgtcgatgttctggtcaacaatgccggcatcacgcgcgacggcgcctttcacaagatgacgctcgagcaatggaatgcggtgatcaataccaatctcggctcgctgttcaacatgacccggcaggtgatcgaaggcatgcgcacgcgcaagttcgggcgcatcgtcaacatctcgtcgatcaacggtcagaaggggcagttcggtcaggtgaactattcggccgcgaaggccggcgacatcggcttcaccaaagcgctggcgctggagaatgcgcgcggcggcatcaccgtcaatgtgatctgcccgggctacatcaacaccgaaatggtgcaggccgtgccgaaggacgtgctcgacaaggcgatcctgccgctgattccgtgcaaccggctcggcgaagccgaggagatcgcgcgcgccgtggtgttcctcgccggcgacgatgcgggctacatcacaggttcaacgctcaccatcaacggcggccaatac

SEQ ID NO: 44255 - DNA, 1161 bp, Rhodopseudomonas palustris
gtcgtcatcgtcagcgccgcacgcaccgctgtcggaagttttaacggcgccttcgccaatacgccggcgcacgagctcggcgcggtcgcgatcaaagctgcgctggagcgcggcggcatcgatccggcgcaggtctccgaagtgatcatgggccagatcctcactgccggtcaggggcagaatccggcgaggcaggcctcgattgccgccggtattccggtcgacagcccggcatggggcatcaaccagctttgcggctccggtcttcgctcggtcgcgctcggttaccaggcactgatgaacggcgactccgatatcgtcatcgccggcggccaggaatcgatgagcatggcaccgcatgcgcaatatttgcgcggcggcgtaaagatgggcgcggtcgaactcgtcgacaccatgctcaaggacggcctgtgggatgccttcaacggttaccacatgggcaacaccgccgagaacgtcgcgcggcagtggcagatcacccgcgatcagcaggatgaattcgcggtggcttcgcagcagaaggccgaagctgcgcagaaggccggcaagttcaaggacgagatcgtcccggtgacgatcaagacccgcaagggcgacatcgtggtcgacaccgacgagtacccgcgccacggcgccacgctcgaagcgatggccaagctgaagccggcgttcgagaaggacggcaccgtcacggcgggttctgcgtcgggcatcaacgacggcgccgctgcggtggtgctgatgaccgccaagcaggcggagaagctcggcaagaagccgctggcccgcatcgtgtcgtgggggcaggccggtgtcgatccgaagatcatgggctcaggcccgatcccggcgtcgcgcgcggcgctgaagaaggccggctggtcggtcggcgatctcgatctgatcgaagccaacgaagccttcgcggcgcaggcctgcgcggtgaacaaggatctcggctgggatacttctaaggttaacgtcaatggcggtgcgatcgcgattggtcatccgatcggtgcgtcgggggcgcgcgtccttgtgacgctgctgcacgagatgcagaagcgcgattcgaagaaaggtcttgccacgctttgcatcggcggtggcatgggcattgcgatgtgcctcgcgcgc

SEQ ID NO: 44256 - DNA, 888 bp, Rhodopseudomonas palustris
gccaagcggctcgacactaccgccgaggaaaccgaagcgctgctcggccggctgttgtccgacgaattgatgtccgacgagatcgcccggccgcgccggctgatggacgcgatccgctactccacgctcggcggcggcaagcggctgcggccgttcctggcggtcgagagcgccgcagtgttcggcatcgatcgtgccgccgcgctcttggtcggcgccgcgctggagtgcatccactgctactcgctgatccacgacgacctgccttcgatggacaacagcgatctgcgccgcggccgtccgacgctgcacaaggcctatgacgacgccactgcgatcctcgccggcgacgcgctgctgaccttcgcgttcgacatcgtcacccgcgacgaagtgcacaacgatccgacggtgcggctgctgctgacacgagtgctggcgcgctgcgccgggctcggcggcatggtcggcggccagatgcttgatcttgccggcgaaggccggttcggcgaccgcgagccggtcgacgtcgcgcggctgcagcagatgaagaccggcgccctgctccgctacggctgcgtcgccggcgcgatcctcggccaggcaagccccgaccagtatcgcgcgctcgacgattacggccgcgcactcggtgaagcgttccagattgccgacgacctgctcgatgtcgaaggcgacgctgccgcgctcggcaagccggccggcgccgatgccgcgctcggcaagaccaccttcgtcacccaactcggcatcgacggcgccaagcagcggctgcgcgacctggtcgcgcgtgccgaccaggcgctggcgccgttcggcgagcgcggcgaggtgctgcgcgccgccgcccgcttcgtcgccgagcgg

SEQ ID NO: 44257 - DNA, 1203 bp, Rhodopseudomonas palustris
atggccgacgtgtttgtctgcgacgcggtgcgcaccccgatcggccgttacggcggatccctcgccaaggtgcggaccgatgatctcgcggcggtgccgatcaaggcgctgatggccaaacatccggacatggattggagcgcggtggacgaggtgttcttcggctgcgccaatcaggccggcgaagacaaccgcaacgttgcccggatggcggcgctgctggcgggcttgccggattcagtgcccggccagactctcaatcggttgtgcgcctccggcctcgatgcggtcggcgccgcgggccgtgcgatccgcggcggcgagatcgatctggcgatcaccggcggcgtcgagtcgatgacccgggcgccgttcgtgcagggcaaggccaccgaagcgttcgcgcgctcggccgacatcttcgacaccacgatcggttggcgcttcatcaatccgctgatgaaacagcaatacggcgtcgactcgatgccggagaccggcgagaacgtcgccgaagaattccagatctcgcgcgccgatcaggatgcgttcgcgatccgcagccagcagcgcgccggcgcggcgatcgcggccggctacttcgccgaggagatcgcgccggtgacctacgcgggcggcaaggccggcccgatcacggtcgataaggacgagcatccgcgccccgaaaccacgctggaaggcctcgccaagctcaagccgatcgtgcgcaatccgggcaccgtgacggccggtaacgcctcgggcgtcaatgacggcgccgcagcgctgctgatcgcctcggaagccgcggtgaagaaatatggcctgacgccgcgcgccaagattctgggcctcgcctcggcggcggtgccgccgcggatcatgggcatcggcccggtgccggcgacccgcaagctgatggaacggctcgggctgaagatcagcgacttcgacctgatcgagctgaacgaagcgttcgcctcgcagggcatcgcctgcctgcgccaactcggcgttgccgacgatgccgacttcgtcaatccgcacggcggcgcgatcgcgctcggccacccgctcggtatgagcggcgcccgcctggcgctcaccgcggtgcacggcctcgaaaagcgcggcggcaagctggcgctggccacgatgtgcgtcggcgtcggccagggcgtcgcgatggcgatcgagaagctg

SEQ ID NO: 44258 - DNA, 2631 bp, Rhodopseudomonas palustris
tcgccgatgatggagcagtaccacgagatcaaggccgccaatcctggcctgttgctgttctaccggatgggcgatttctacgagctgttcttcgaggatgccgaaatcgcgtcacgcgcgctcggcatcaccctgaccaagcgcggcaagcatctcggcgccgacattccgatgtgcggtgtgccggtcgagcgctccgacgactacctgcaccggctgatcgcgctgggtcaccgcgtcgctgtgtgcgagcagaccgaagacccggccgcggcgcgcgcccgcaagagcgtggtgcggcgcgacgtggtgcggctgattacgccgggcacgctgaccgaagataccctgctcgacgcccgcgccaacaactacctgctggcgatcgcgcgcgcccgcggctcggccggcgccgatcgcatcgggctcgcctggatcgacatctcgaccggcgaattctgcgtcaccgaatgttcgaccgccgagctcgccgcgacgctggcgcggatcaatccgaacgaagccatcgtgccggacgcgctgtacagcgacacagaactcgccccgaccttgcgcgagctcgccgccgtcacgccgctgacgcgtgacgtgttcgattccgccaccgccgagcggcggctgtgcgattacttcgctgtcgccaccatggacggcctcgccgcgctgtcacggctggaagcgaccgccgccgcggcctgcgtcacctatgtcgaccgtacccagctcggcaaacggccaccattgtcgccgccggcacgcgaggcgaccggctcgacgatggcgatcgacccggcgacccgcgccaatctcgaactcacccgtacactcgccggcgagcgccgcggttcgctgctcgacgcgatcgactgcacggtgacggccgccggctcgcggctgctcgcgcagcggctcgccgcgccgctcaccgatgcggccacgatcgcccggcggctggatgcggtcgaagccttcgcggtggattccggacttcgcgaacagatccgcagctcgctgcgggcggcgcccgacatggcgcgcgcactggcgcggctgtcgctcggccgtggcggtccgcgagatctggcgaacttgcgcgacggcatccgcgccgccgacgaggtgctggtgcagcttgcacagctcgcaagcccgccgcaggagatcgcaagcgcgatggcggcgctgcagcggccgtcgcgcgagctgtgcgccgagctcggccgcgcactggccgatgatctgccgcttctcaagcgcgacggcggcttcgtgcgcgaaggctacgagccggcgctcgacgagacccgcaagctgcgcgacgcctcgcggctggtggtggcgtcgatgcaggcgcgctacgccgacgacaccgggatcaaggcgctgaagatccggcacaacaacgtgctcggttacttcgtcgaggtctcggcgcagcacggcgagaagttgatggcgccgccactgaacgccactttcatccatcgccagacgctggccgggcaggtgcgcttcaccaccgccgaactcggcgagatcgaggccaagatcgccaatgcgggcgatcgcgcgctcgggctggagctggagatcttcgatcggctggccggctcgatcgatgccgccggcgacgatctgcgcgccgctgcgcatgccttcgcgctgctcgatgtcgccactgcgctcgccaagctcgcgtccgacgacaactacgtccggcccgaggttgacgagtcgctggcgttcgcgatcgaaggcggccggcacccggtggtcgagcaggcgctgaagcgtgccggcgagccgttcatcgccaacgcctgcgatctgtcgcccggcccggcgcagaagaacggccagatctggctgctgaccggcccgaacatggccggtaagtcgaccttcctgcgccagaacgcgctgatcgccctgctcgcccaggtcggcagcttcgtgccggcgatccgggcacggatcggcatcgtcgaccggctgttctcgcgcgtcggcgccgccgacgacctcgcccgcggccgttcgaccttcatggtcgagatggtcgagaccgccgcgatcctgaaccaggcctccgaacgggcgctggtgatcctcgacgagatcggccgcggcaccgcgacgttcgacggcctctcgatcgcctgggcggcgatcgagcacctgcacgaacagaacaggtgtcgttcgctgttcgccacgcactaccatgagctgaccgccctgtcggccaagctgccccggctgttcaacgccaccgtgcgggtcaaggaatggcgcggtgaggtggtatttctgcacgaggtgctgccgggctccgccgaccgctcctacggcatccaggtcgccaagctggcggggctcccccccagcgtggtgagccgcgcgaaggccgtgctggccaagctcgaagccaacgaccgcggccagccgaagacgctgatcgacgacctgccgctgttcgccatcacggctcgcgcacccgccgaagccgccccaccgagcgaggccgagcagctgatcgacgcggtcaaggcgctgcatcccgacgagatgaccccgcgcgaggcgctggatgcgttgtacgccctgaag

SEQ ID NO: 44259 - DNA, 582 bp, Rhodopseudomonas palustris
ccacggatgccgagaatgtctgaaaccgtaccgacggctgctgccggcaggtcgccccaggaagccgagatcgtcgcggcgctgggcgatcgcccggtcgtgctcatcggcatgatgggcgccggcaaatccaccgtcggacgccggctggcgctgcgactcgggctgccgtttctcgacgccgacaccgagattgaatcggcggccgcgatgaccatcccggagatcttcgaaacccatggcgagccgcattttcgcgacggcgaggctcgggtgatttcgcggctgctcgacggcggcaccaaggtgctggcgaccggtggtggggccttcatgcgcgaggaaactcgtgaccggattcgcgagaaggcgatctcgatgtggctcgaggcggaggccgacgtgatcctgcgccgggtcaagcgccgcgcggaccggccgctgctgaagacgccagatccggccggcaccatcgcccggctgatcgcggaacgctatccgctataccgcgaagccgatatcaccatcgcgtcccgcgacgtgccgcacgagaagatcgtcgacgaatgcgtcgcggcgctc

SEQ ID NO: 44260 - DNA, 1092 bp, Rhodopseudomonas palustris
accgtcgaagtcgccctcggcgaccgcgcctatgagatcgtgatcggccgcgacgtgatcgcctcgctgggcgagcggattgccaagctgcggcccggcgcacgcaccgcgatcgtcaccgatcgcaccgtggcgaagacctggctgaagcgcaccgaggaggtgctggatcaggccggcatcgcgcatgcgtcggtgattgtcggcgaaggcgaaagctccaaaagctatgcggggctcgagcaggtgtgcgaggcgctgatcgccgccaagatcgagcgcaacgatctggtgatcgcgctcggcggcggcgtgatcggcgatcttgccggtttctcggcctcgctgctgcgccgcggcgtcgatttcgtgcaggtgccgacctcgctgctggcgcaggtcgactcctcggtcggcggcaagaccggcatcaactcgccgcagggcaagaatctgatcggcacgttccatcagccggtgctggtcttggccgacaccgcgatcctcgacacgctgtcgccgcgccaattccgcgccggctacgccgaagtcgcgaaatatggcgcgctcggtgacgaggcgttcttcgcctggctcgaagccaaccatgccgagctgttcagcggcggcgccgcgcgcgagcacgcggtggccacctcatgccgagccaaggccgcgatcgtcgcccgcgacgaacgcgagaccggtgaccgcgcgctgctcaatctcggtcacaccttcggccatgccctggaagcggcgaccggattctccgaccggctgttccacggcgagggcgtggcgatcggcatggtgctggcggcggagttctccgccgaacgcggcatgatgccggccaccgacgcggagcggttggccaagcacctcgccgaagtcgggctgccgacgcggctgcaggacatcgcaggcttcacccaggaaggccttgccgacgccgaccgcctgatggcgctgatggcgcaggacaagaaggtcaagcgcggcgaactcaccttcatcctgatggaaggcatcggccgcgcggtgatcgcgagcaaggtcgagccggcgccggtgcgcgacttcctgcag

SEQ ID NO: 44261 - DNA, 753 bp, Rhodopseudomonas palustris
attgtcaccggatcggcctcaggcctcggcgccgcgaccgccaagatcctcgccaaggacggcgcgcgcctggtgatcaactacgcatcgagcaaggacgacgccgaaaagaccgccgaagagtgccgcaagctcggcgccgccgaagtgatcgtggtgcagggcgacgtcgccaaggacgaggattgcaaacgcatcgtcgaggccgcggccccctggggcaagctcgacgcgctggtcaacaatgccggcaccaccaagcacgtggcgcatcatctgctcgatcaattatcggccgacgacttccagcgcatctacgcgatcaacaccgtcgggccgtaccagatggttcgcgcggcgcgcgagctgctcgtcgccggcgccaaggcggccggccgggcttctgcagtggtcaacgtctcatcggtcgcgggaatcagcggtatcggctcgtcgatcgcctatgcggccagcaagggcgcgctcaatactatgacactgtcgctgtcgcgcgcgctggcgccgaacatccgcgtcaacgcgatctgccccggctacatcgacacgccttggttcaccaaaggccgcggcgccgaggaagccaagcaggtgcgcgacatggtggtgtcgcgcgtgccgctgaagatcgcctcgaccgccgaagacatcgccgaactggtgtgcttcctggcgacgccgaaatcgagcagcatgaccggcgaactggtgcggatggacgccggcatgcatctg

SEQ ID NO: 44262 - DNA, 1422 bp, Rhodopseudomonas palustris
agatggacctatgcgcagctcaatgacgacgcgcgccgctgcgccagctggctgctgacgcagttcaaaaccggtgaccacatctgcgtctgggcgccgaacgtgcccgaatggatcgtgctgcaatatggcgcggcgctgtccggtctcgtgctggtgacggccaatccggccctgaaggcgtcggagctggagttcgtgctgcagcaatcgcaatcggtggcgctgttccatctcgatgcattccgcggtgtcgagaccggtgcggtcgcacgtagctttgcgtccgcgaagctgcgctgcatttcgttcagcggctggctggcggagattcgccgcaccgaaatcggcgctctgccgcggattgaccccggtcagccggcacagatccagtacacctcgggcaccaccggccgtcccaagggtgcgctgctgcatcatcgcgggctgatcaccaacgccagctacgtcgcggcgcgcgccgggctcgatcacagcgtgctgctgagcccgatgccgctgtttcatacggccggctcgatcatgagcgtcttaggctgcctcaattcgcgctcgactctggtgctgccgctgctgttcgatccgggcacggtgctcgatgcgatcgcgcacacccgcgccgacacgctgttcggcgtgccgacgatgctgctcgcggtgatcgatgcccagctccaggcgccgcgcgatctgtcctcgctccgcgtcgctgcctccggcggggcccaggtgccgcccgaactgcatcgccggattcacgacgcgctgaagctgccgctgctcaccgtgttcggccagaccgaactcagcccaatcgtctcgcagacctgtatcgacgatccggacgagcagcgcattcactccgtcgggcggccgctgtggaatgtcgaggtgcggatcgtcgatccgaacggcgaccgcgtggtcgttatcggcgtcgagggggagatccaggtccgcggctatcagaccatgctcggttacttcaacgcccccaaagagaccagcgagacgatcacggctgacggctggctgaggacgggcgatctcggcgcgatggatgaagccggttatctgcggatcaccggccggctcaaggacatgatcatccgcggcggcgagaacatctatccggccgaagtcgaagcgtgcctgctgcggcatcccgcggttgccgacatctcggtgttcggtgcgccggacgacaaatggggcgaagtggtcgccgccgcggtccggctcgtgccggatgtgcccgtaacggccaccgaacttagcgctttctgcaagactgagatcgcgccgcacaaggcgccgacggtctggtacgcctgcacgggatttccgctgacggcgtccggcaagatccagaagttccgcctccgcgacgcagcggtcgaa

SEQ ID NO: 44263 - DNA, 870 bp, Rhodopseudomonas palustris
gaattctcgaccttgacgatcgcgccggacccgaatgccccgcggatcgcgcggctggtgctgaatcgccccgaccgcttcaacgccatcaatgacgcgatgccgcgggaaatccgcgccgcggtggaatgggcgcaggccgaggacgcgatccatgtgatcgtcatcgaaggcgcaggaaagggcttttgcggcggctacgatctggtcgactacgccgaaagcgacatcgaccacccctgccagcaggagaaggagccgtgggatccgttggtcgactacgcggcgatgaagcgcaacaccgaggacttcatgagcctgtggcgctgctcgaagccgaccatcgccaagatccacggcgcggcggtcgccggcggcagcgacatcgcactatgctgcgacatgatcgtgatggccgacgacgcgcgcatcggctacatgccgacccgcgtctggggatgccccaccaccgcgatgtggaccttcaagctcggcccgacgcgcgccaagcaaatgatgttcaccggcgacgtgatcaccggccagaccgcggccgagtggggcctcgtcaatctgtcggtgccggtcgccgagctggaacaagctactatgaagctcgccacacgcgttgccggcgtgccgaaaagccacctcgcgatgcacaagctcgtggtcaatcaggtgatgctgaacatggggctcgaacagacccagatgctcgccacgatcttcgacggcgtctcgcggcacaatcccgagggcctgtggttccgccgctacgcgcaagacgccggcttcaaagccgccatcgaatggcgcgacagcggccgcccgatccccgagggcgacgacgcgcgggcgcggatcagg

SEQ ID NO: 44264 - DNA, 1365 bp, Rhodopseudomonas palustris
gcggtgactaatccggcgagcgggcagacgatcgccaaggtgccgcatctcggcgccgccgaggcaactcaggcggtggaggctgccgcgcaagcatttccggcctgggcgaagctcaccgccaagcagcgctccaacatcttgcgcaaatggttcgagctgatcatcgccaaccgcgaggatctggctctgatcctgacctccgagcagggcaagccgctcaccgaggcgctcggtgaagtcgatatcggcgccgcctatgtcgagtttttcgccgaagaggcgcggcgggtgtatggcgaaaccatcccgacccaacgcgccgatgcgcggctgatcgccatcaagcagccgatcggtgtctgcggcgcgatcacgccgtggaacttcccgagctcgatgatcacccgcaaagtctcgccggcgctggcggcgggctgcacagtggtgctgaagccggccgaggaaacgccgctgagtgccttcgcgctggcggcgctggccgaaaaggcgggcgtgccgaagcgcgtgttcaacgtcctcaccggcgatgcgccggcaattggaaaggtactgtgcgaacatccggccgtccggttcgtcggtttcaccggttccaccgaagtcggcaagatcctctacaagcaggcgtcggtcggggtgaagaagctcggattggagctcggcggtaacgcgccgttcatcgtgttcgatgatgccgatgtcgacgctgcggtcgaaggcgcgatggtgtcgaaatatcgcaacatgggccagacctgcgtctgcgctaatcggctctacgtgcaggatggcgtctacgacgcgttcgtcgagaagctcgccgccaaggtcaaggcgatgaaggtcggcgacggcaccgagcagggcgtcacccaggggccgctgatcaatgaggccgccgtcgagaagaccgagcggcacatcgcggatgcgctatccaacggcgccaagatcatcaccggtggaaagcgtcatgcgctcggcggcaccttcttcgagccgaccgtgctggccgatgtccggcccgacgcgctggtggcgcatgaagaaaccttcggcccgctggcgccggtgttccgcttcaaggacgaagccgaagtgatcaagcttgccaacaactcgccgttcggcctcgccagctacttctacgcccgcgatttgggccgcgtctggcgcgttgccgaggcgctggagagcggcatggtcggcgtcaacaccggcctgatcaccaccgaagtcgccccgttcggcggcgtcaaggaatccggcctcggccgcgaaggctcgcatcacggcatcgaagaatatgtcgagattaaatacgtgatgatggcggggatc

SEQ ID NO: 44265 - DNA, 1640 bp, Rhodopseudomonas palustris
cccagctatgtctgcggcgtctccgacgccccgctgctcggaattaccattggccaggcgctcgaccgcgcagtggcgctgtggccggatcgcgaagcgctggtttcacccagccatgacacccgatggacctggagcgaattcgccgcgcgggtggatgcgctggcagccggttttctcgcgctcggcctggagcgcggagcccgcatcggcatctggtcgatgaaccggccggaatggaccctcacacaattcgccgccgccaaagcgggactgatcctggtcaccatcaatccggcctaccgcctgagcgaactggaattcgcgctcgccaaagtcggctgcgccgcgctggtgacggccaccgcgttcaagacctcgcactacatggagatgttgaatacgctgatcccggaactggcgatctcgtcgccggcgcgctgcaatcggccaagctgccgaagctgcgcaccgtgatccagatcggcggaccgaaagcgccggggacgatcgcattcgacgaggtcgcggccatgggcggcgcgcggcaccgcgatcagatcgccgccttcgcaagcgagctgcagttcgacgatgccgtcaacatccagttcaccagcggcaccaccggctcgcccaagggcgtgacgctgacgcaccacaacatcctcaacaacggttacttcgtcggccgcgcgatgaagctgacagaggcggaccggatctgcattccggtgccgctgtatcactgcttcggcatggtgatgggcaacctcgcctccgtcacctccggcgccgcgatggtgtatcccggcgaaggcttcgacccgctggtgacgctgcagaccgcgtcacgcgagaagtgcaccgcgctgtacggcgtgccgacgatgttcatcgccgaactcgatcatccggaattcgccagcttcgacctgtcgtcgctgcgcaccggcatcatggcgggcgcaccgtgcccggtcgaagtgatgcgccgggtcaacgatgcgatgaacatgcgcgaagtcacgatcgcctacggcatgaccgagaccagcccggtcagctttcagagcgcggtcgacgatccggaagaccggcgggtctcgaccgtcggccgcatccatccgcatgtcgaagtgaaagtcgtcgatctcgacggcaagatcgtgccgcgcggccagcgcggcgaactctgcacccgcggctacagcgtgatgctcggctattgggacgaggcggaaaaaaccgccgacgtgctggatgccgccggctggatgcataccggcgatctcgccaccatcgacgacgaaggcttctgcaacatcgtcggccgcatcaaggacatggtgatccgcggcggcgagaacctgtatccgcgcgagatcgaggaattcctgtatcgccatcccaagatccaagacgtccagatcttcggtgtcgccgacgaccgctacggcgaagaactctgcgcctgggtccgcccgcgcccgggcgaaacgctgaccgccgacgacgtccgcgcgttctgccagggccagatcgcccataacaagatcccgcgctacatcgaattcgtcgacgaattcccgatgacggtgaccggcaagatccagaaattcatcatgcgcgagaaggtc

SEQ ID NO: 44266 - DNA, 939 bp, Rhodopseudomonas palustris
caatacgacgtcctcgccatcggcaatgcgatcttcgacgtgctggtccgcaccgaagaggactttctggtcaagcacggcatggccaagggcggcatggcgctgatcgacgaagcccgcgccgcggcgatctatgccgacatgggccaggccaccgaaatgtccggcggctcagcggccaataccattgtcggcctcgcctcgttcggtgcccgcaccgcctatctcggcaaggtcaaggacgatcagatcggcaagctctacacgcacgatatccgcgccgcgggcgtcaccttcgacaccaagccggcgacggcaggcccggcgaccggctgctcctacatcctggtgacgccggacggccagcgcacgatgaacacctatctcggcgctgcgcaggatctgtcgccggccgatatcgacgaggccaagatcgccgcctcggccatcacttatctcgaaggctatctgtgggatccgccgcaggccaaggaggcgttcctgaaggcgtcgcagatcgcccacggcgccggtcgcaaggtggcactgacgctgtcggatgcgttctgcgtcgatcgctatcgcggcgaattcctcgagctaatgcggtccaagaccgtcgacctgatcttcgccaacgaggccgagctgcactcgctgtatcagacctcggatttcgatgcggcgctgaccctgctggctcaggacgtcgcgctcggcgtcgtcacccggagcgagaaaggctgcgcggtggtcgataaggacggcgtcaccctggtgcctgccgccgcgattgatcagctcgtcgacaccaccggcgccggcgacttgttcgcggccggcttcctgttcggtctggtccgcaacctcggctacgaaaacgccggccgcctcggcgcgctggcggcggccgaagtgatccagcacatcggtgcccgc

SEQ ID NO: 44267 - DNA, 639 bp, Rhodopseudomonas palustris
gaacttgttatttttgattgtgacggtgtcctggtcgacagtgagctgatctcctgtcgggttcacgccgagacgctgacccgctacggctatccgatcacgccggaccaagtcgcggcgcgttttctcggccgttcgggtcgcgaagcccggcgcgagatcgaagccgagattggccggcgcttcgccgatgacatcgaagcaaacctgctcgacgcactgctgcgcgccttcgccgaaacgctgcagccgatcccattcgtcaccgacgctctcgacacacttggacgaccgttctgcgtcgcctcgagcggcacgctcgatcgcatcggggtggcgctgacccatgccggcctgcatgcccggttcgccccgcatctgttttcggcccagcaggtcgcgcacggcaaaccggcgcccgacctgttcctgttcgcggcggcccagatgggcgccgccccggagtgctgcgtggtgatcgaagacagcgttcccggggtgctgggtgcgaaagccgccggcatgaccgtgctcggttttcacggcggcagtcattgcaccgatgctactgccgccgcactggccgctgccggggccggccgctgttttgacgacatgagacaattatctggaatcatt

SEQ ID NO: 44268 - DNA, 1917 bp, Rhodopseudomonas palustris
ccggccgccaagccgggcgcctcgaagcagcgcggccgtctcaccgtcgtcaccgcgctcaatgccgatgacgtgcgcgaacgttcgatcgcctcgttccgtcgccgcacccagcggctgaagggccacgcctcgaacgagccgaaagaaaagttggtgcgtgaagtcgttattcccgaagtgatcgccatccaggaactcgccaaccgcatgtccgaacgtgcggtcgacgtgatccgcctgctgatgaagcagggcgcgatgcacaagatcaccgacgtgatcgatgccgacactgcgcagctgatcgccgaagagctcggccacaccgtcaagcgcgttgccgcgtcggacgtggaagaaggtctgttcgacgtcgtcgacgattccaccgataccgagccgcgttcgccggtcgtgaccgtgatgggccacgtcgaccacggtaagacctcgctgctcgacgcgctgcgccacgccaacgtggtgtcgggcgaagccggcggcattacccagcacatcggtgcgtatcaggtgacctcgccggaaagcggcaagaagatcaccttcatcgacacccccggccacgccgcgttcaccgcgatgcgcgcccgcggcgccaaggtgaccgacatcgtggtgctggtggtggctgccgacgacggcgtgatgccgcagaccatcgaggcgatcaatcacgccaaggcggccggcgttccgatcatcgtggcgatcaacaagatcgacaagccggacgccaagcccgaccgtgtccgcaccgacctgctgcagcacaatgtgcaggtggaatcgatgggcggcgacgtcgtcgacgtcgaggtttctgccaagaacaagatcaatctcgacaagctgctcgagatgatcgcgctgcaggccgaaatcctggagctcaagaccaacacccagcgtccggccgaaggcaccgtgatcgaagccaagctcgaccgcggccgtggtccggtcgccaccgtgctggttcagcgcggcaccctgcgggtcggcgacatcatcgtggccggcgccgaaatgggccgcgtccgcgcgctgatctccgaccagggcgagaccgtgcaggaagccggcccgtcggtcccggtcgaagtgctcggcttcaatggtccgccggaagcgggcgaccgcctcgcggtggtcgagaacgaagcccgcgcccgccagatcaccgattaccgtgcgcaccagaagcgcgagaagtccgcagcctcggtttccggcatgcgcggctcgctcgagcagatgatgacgcagctgaagacgtccggccggaaggaattcccgctgatcgtcaaggcggacgtgcagggctcgctggaagcgatcctcggctcactggagaagctcggcaccgatgaagtcgccgcgcgcatccttcacgccggcgtcggcggcatcagcgagagcgacgtgacgctggccgaaggcttcaacgccgtgatcctcggcttctcggtccgcgccaacaaggaggccgctgcggccgccaagcgcaacggcatcgagatccgctactacaacatcatctacgacctggtggatgacattaagaaggcgatgagcggcctgctcgcgccgaccctgcgcgaaaccatgctgggcaacgcgcagatcctggagatcttcaacatctccaaggtcggcaaggtcgccggctgccgcgtcaccgacggtaccgtcgagcgcggcgccaatgtccgcctgatccgcgacaacgtcgtggtgcacgaaggaaagctgtcgaccttgaagcgcttcaaggacgaagtgaaggaagtcgtcgccggccaggaatgcggcatggcgttcgagaactacaccgacatgcgggcaggcgacatcatcgagtgctaccgcgtcgagaccatccagcgctcgctg

SEQ ID NO: 44269 - DNA, 2205 bp, Rhodopseudomonas palustris
gatcggagagacaccatggacgcaaagacggacgacaagggcgcaggcaagtgcccgttctcgggcggcagccacggccatcgcaaccgtgactggtggccggatcagctcgacatttcggtgctgcacaacaattcgaagaagtccgacccgatgggtgcggcgttcaattacgccgaagagttcaagaagctcgatctggaagcggtgaagaaggaccttcacgcgctgatgaccgattcgcaggaatggtggccggccgacttcggtcactacggtggcctgttcgtccgcatggcctggcattcggccggcacctatcgcatcaccgacggccgtggcggcgccggcgccggccagcagcgcttcgcgccgctgaactcgtggccggacaacgccaacctcgacaaggcacgccgtctgctgtggccgatcaagcagaaatacggcagcaagatctcctgggccgacctgatggtcctcaccggcaacgtcgcgctggaatcgatgggcttcaagactttcggcttcgccggcgggcgcgccgacgtctgggagccggaagagctgtattggggcccggaaggcacctggctgggcgacgagcgctattccggcgaacgccagctcgccgagccgctcggcgctgtgcagatgggcctgatctacgtcaaccccgaaggcccgaacggcaatcccgacccggttgccgccgccaaggacatccgtgagacgttcgcccgcatggcgatggacgacgaagagaccgtggcgctgatcgccggcggccacaccttcggcaagacccacggcgccggcgatccgtcgctgatcgggccggctccggaaggcgggctgctcgaggagcagggcctcggctggaccagcaagtacggcaccggctttggcgccgacgccatcacgggcggcccggaagtgatctggacccagaccccgacgcagtggagcaaccacttcttcgagaatctgttcggcttcgaatgggagctcgacaagagcccggccggcgccaagcagtggaaggccaagggcgccgaagcaaccgtgccggatccgttcgatcccgccaagaagcgcgtgccgacaatgctgacgaccgacctgtcgctgcgcttcgacccgatctacgaaaagatctcgcgtcgcttcctggagaatcccgatcagttcgccgacgcgttcgcccgcgcctggttcaagttgacccaccgcgacatgggaccgcgcgagcgctacctcggcccggaagtgccgaaggaagagctgatctggcaggacccaatcccggccgtgaaccacgaactggtcggcgaggccgatatcgaagcgctgaaggcgaagatcctcgcctccggtctgtcggtggcgcagctcgtctccaccgcgtgggcgtccgcctcgaccttccgcggctcggacaagcgcggcggcgccaacggcgcgcgcatccgcctggctccgcagaaggactgggaggtcaaccaaccggccgagctggcgcaggtgctcggcaagctcgaagcgatccagggcgagttcaacggcgcgcagaaggacggcaagaaggtctcgctcgccgacctgatcgtactcggcggcgccgcggcaatcgagaaggccgccaaggacgccggcaccgccgtcaaggtgccgttcacgccgggccggatggatgcctcggcagagcagaccgacgtcgagtcgttcaaggtgctggagccgcgggccgatggcttccgcaactacatcaacaccaagcggcatcagttcatgcatccggaagaggcgctggtcgacaaggcccagctcctcacgctcaccgggcctgaactgacggtgctggtcggcggcctgcgcgtgctcggcgccaactacgcgcactcgacccacggcgtgctcaccgaacggcccgagaagctgaccaacgacttcttcgtcaacctgctcgacatgggcaccaagtggaccaaggcgaacggcgaggtcgagatctacgaaggccgcgaccgcaagaacggcgaactgaagtggaccggcacccgcgtcgatctggtcttcggctcgcactcccagctccgcgcctttgccgaggtgtatgcgtgctcggatgcgcaggagaagttcgtcagcgacttcgtcgccgcctggagcaaggtgatgaacgccgatcggttcgacatcgtc

SEQ ID NO: 44270 - DNA, 756 bp, Rhodopseudomonas palustris
ggactgatgcagggcaagcgcgggctgatcatgggcgtcgccaacgaccattcgatcgcctggggcatggcgaagacgctggcggcgcacggcgccgagctcgctttcacctaccagggcgaagcgctcgcgcgccgcgtcaagccgctggcgcagtcgctgaattccgatctggtgctgccctgcgacgtcgaagacatcgccagcgtcgatgcggtgttcgacacgctgaaggacaagtggggcaagctcgacttcgtgatccacgcgatcggcttttccgacaagaacgagctgcgcggtcagtacatcgacaccagccgcgcgaacttctcgcgcaccatggtgatctcctgcttctccttcaccgaggtcgccaagcgcgccgcggcgctgatgccggatggcggcgcgatgatcacgctgacgttcggcgcgtccgagcgcgcgatgccgaactacaacgtgatgggcctcgccaaggccgcgctggaagccagcgtgcgctatctcgcctgcgatcttggccccaagggcatccgcgtcaacgcggtctcggccggtccggtgcggacgctggccggcgccggcatcggcgattcgcgtgcgatgttcggcttcatggaaaagcactcgccgctcggccgcggcgtgacgctggaagaactcggcggttcggcgctgtatctgctgtcggacctctccggtggtgtcaccggcgaaacccactacgtcgactccggctacaacatcgtg

SEQ ID NO: 44271 - DNA, 1215 bp, Rhodopseudomonas palustris
atgagacgagttgttgtgacggggatggggatcgtctcgtcgattggtaacaacacccaagaagttctggcgagcctgcacgacgccaagtcgggtatttcgcgtgccgaaaagcatgccgagctcggcttccgctcgcaggtccagggcgctccgacgctgaatccggccgatgtggtcgatcgtcgcgcgatgcgtttcctcggtgagggcgcggcgtggaaccacgtcgcgatggaacaggcgatcgccgattccgggctggaagagtccgaaatttccaatatccgtaccggcatcgtgatgggttcgggcggcccgtcggcacgcaccatcgtcgaggccgctgatatcacccgcaccaagggtccgaagcgcgtcggtccgttcgcggtgccgaaggcgatgagctcgaccgcgtcggcgacgctcgccacctggttcaagatcaagggcgtcaactactcgatctcgtcggcctgcgcgacctccaaccactgcatcggcaacgcctatgagctgatccagtggggcaagcaggacgtgatgttcgcgggcggctgcgaggaactcgactggtcgctgtcggtgctgttcgacgcgatgggcgcgatgtcgtcgaagtacaacgacaccccggccactgcctcgcgtccctatgacgtcaatcgtgacggcttcgtgatcgccggcggcgccggcgtgctggtgctggaagagctcgagcacgccaaggcgcgcggtgccaagatttacggcgagatcatcggctatggcgcgaccagcgacggctacgacatggtggcgccgtcgggcgagggcgccgagcgctgcatgaagatggcgctgtcgaccaccggcggcatcaagatcgactacatcaatccgcacgcgacctcgacgccggccggtgacccgccggaaatgaacgcgatccgcgccgtgttcggcatcggcgacaagtgcccgccgatctcggccaccaaggcgctgaccggccactcgctcggcgccaccggtgtccaggaggcgatttactcgctgctgatgatgcagaacggcttcatctgcgagagcgcgcacatcaccgaactcgatccggccttcgccgacatgccgatcgtgcgcaagcgcgtcgacaacgccaagctcggtgccgtgctgtcgaactcgttcggcttcggcgggaccaacgcgacgctggtgttcaagcgg

SEQ ID NO: 44272 - DNA, 738 bp, Rhodopseudomonas palustris
gtaacgttgattacaggcgcatcggccgggatcggtgtcgaactggcgcgaatttttgcagacaatgctcatcgggtggccctggtggcgcggcgtggcgaccggctcgaatcgctggcggctgagatccgcgccaagggcgggccggaaccgatcgtaatcgcgtgcgatctcggtaagcccgacgcggccgagcagatcatcgcggcgcttgccgctgccggcgtcgaggtcgagtacctcgtcaacaacgccggatacggactattcggccgggcgatggagctcgatcgtgaaagccagcttggtatcatcgacgtcaataacagggcgctcaccgatctgacgctgcggtttgccgacagcatcgcacggcttcgcggcggcatcctcaatgtcgcgtcgatcgccggcttcttgcccggccccggcatggcggtgtactacgcgtccaaggcctatgtgctgtcgttcagcgaggcgatgcatcaggagctcgggccgaagggcgtgcgcgtcaccgcgctgtgccccggcccggtgcagaccgagttccagaaccgcgccggtttcgagccgggtttcgacagcgccgtgctcaacgtcacccccgccgaggtcgcacgtcaggcctatcagggactgatgaacaacaagcggatcgtgctgcccggcctcggcgtgaagatcgtgccgttcctgctgcggttcttcccgcgcggcttcatcgccgccgcc

SEQ ID NO: 44273 - DNA, 858 bp, Rhodopseudomonas palustris
atgaccgcccggatcatcgacggaaaaaccatctcggccgaggtgcgcgcccgcgtcgccgccgaggtcacgcggctgaagaccgaccacggcatcacgccgggcctggcggtggtgctggtcggcaacgacccggcttccgaggtctatgtccgctccaagcacaagcagacccaggaggccggcatggcctcgttcgagcaccggctgcccgccgacgtgccgcaggccgagctgatggcgttgatcgcaaagctcaatgccgatccggccgtgcacggcattctggtgcaattgccgctgccgaagggtctcgacagcaacgcggtgatcgacgcgatcgatcctgccaaggatgtcgacggcctcaacccgaccaatgccggccggctggcctccggcctgttcgcactgacgccgtgcacgccgctcggcagcatcatcatggccaagaccgtgcacgcctcgctggagggcatgaacgcgctggtgatcggccgctccaacctggtcggcaagccgctggtgcaattgctgctgaacgagaacgccacggtgacgatcgcgcattcgcgcacccgcgacctgccggcgctgtgccgccaggccgatctggtgttcgcggcggtcggcaaggccgagatggtgaagggcgactggatcaagccgggcgccaccgtgatcgacgtcggcatcaaccgcacgccgggcaaggacggcggcaaggacaagctgctcggcgacgtcgccttcgccgaagccaaggaagtcgccggcgccatcaccccggtgcccggcggcgtcggcctgatgacggtggcctgcctgctggtgaacaccgtccgtgccgcctgcgcg

SEQ ID NO: 44274 - DNA, 1245 bp, Rhodopseudomonas palustris
gtcagcgccgtggtaggatcgcgcatgccatcatccagctttccgtcctcggtcgacatcgcgatcatcggcgctggcgcgtccggcctcggcgcggcgcggacgctggaggggatgggcctgtcggtgatcgtgctggaagcgcggaaccggatcggcggccgagcctggacccggatggtgacgccggagatcgcattcgacgtcggctgcggctggctgcattcggccgacgaaaactcattcgtcggcatcgccaagcagctcggcattggcatcgacaagacgcacccgccgtggggcgaggcgagcttcggcgatgtgtttcccaagcgcgaccgcgcggccttcggcaaagcactcgacgcgttctacgaacgggtctggcgtgcggcgaaaaacaagaccgatgtggctgcagcgacgctactcgagccgggcaaccgctggaatccgatgatcgatgcggtgtcgacctacgtcaacggcgccgagctcgatcgcatctcggtgcacgatctcgaatcctatcgcgacaccggcatcaactggcgggttcgcgaaggctacggctcgctgatcgcggcttatggcgcgccttgcccggtggcgctgaactgtgtggtcgagcagatcgatcactccgagcggcggatcaaaatcaacacctcgctcggcacgctcagcgccagccagatcatcatcacggtgccgaccaatctgatcgccgacgaggcgatccggttcgcgccggcgttgccgggcaaggtcgaggccgcgcgccatttgctgctcggcgtcgacgacaaggtgatgctgaagctgtccgactctaacggttttcctgccgacggcaacttacgtgccgccacgatgcggagcgcgatggggacgtatcacctgcgcccgttcggccaagattgtatcgaaggctttttcggcggccgctacgcgcgcgagctggaggacgccggcgagggggctttcgccgcgcaggcgatcgacgagatcgccgatctgctcggcaacgacatccgccgcaagctgtcgccgctggcggaatcgcgctgggcgcatgatccgttcgcgcgcggcgcctattcgcatgcgctgcccggccatgccggtgcccgagccgtgctggcggcgccggtcgatggccggctgttcttcgccggagaggcgacctcgccgcagttcttctcgaccgcgcatggcgcgcgtgattcgggcgagcgtgcagcg

SEQ ID NO: 44275 - DNA, 714 bp, Rhodopseudomonas palustris
ctcgtcacaggcgccgcgagcggcatgggccgtgccaccgcgcacgtgttcgccgaggaaggcgcacgcgtcgccgtcaccgacgtcaccctcgccggcgcgcagccggttgccgacgccatcaaggcgcgcggcggcgacgcaaccgcgttcgcgctcgatgtcggcgatgcgcaggcgatcaggagcggcgtcgaacaaatcgcgcaatcactcggcggtctcgacatcgtcatcaacaatgccggcatctcggcagcgctaccgatcgacgacgccaactacgaggcggtgtgggaccgtgcgctcgccattctgctcaccgcgcatccgcgcgtgatccgcgccgcgctgccttacttgcgcaagtcgcagagcccgcgcatcgtcaacatcgcctccaccgaagcgctcggcgccaccgcaactcacagcccgtattcggcggcgaaagccggcgttaccggactgacgcgctcgctcgcagtcgagctcggccccgaaggcatcaccgtcaactgcatctgccccggcccgatcaccaccggcatgaccgaccgcatcagcgccgagcacaaacagaaatacgcgcgccgtcgcaccgcgctacaccgctacggcgatccggaagaagtcgcccacatgacgctaagtctgtgcctgccggcggcgtcgttcatcaccggcgcagtgatcccggtggatggcgggctg

SEQ ID NO: 44276 - DNA, 855 bp, Rhodopseudomonas palustris
gggctgtggctgccgctgatcacgccgtttcgcgacggtgagctcgacgccgcatctctgcgccggctgatcgcgcactacgcgcgagctccgctcgacgggctgatcttaggtgccaccaccggcgaagggctgacgctcgacgaggccgagctcgaacgcctggtgatgctgaccgccgatgcattggcggcgagcgaccgcaagctgccggtgtatctcgggctgtccggcagcgacacgcgcaagctggtgaagacgctggcgcggaccgcacactggccgatcgacggcgtgctgatcgcctgcccgtactacacccgtccgtcgcagcggggattggtgctgcatttcgaagccgcagccgacgccaccgcaaggccgatcctgatctacaacataccgtatcgcaccggcgtcaatctgcagaacgaggcgatgctgcggctcgccgaacgcgccaacatcgtcggcgtcaaggattgctgcgccgatcctgcgcagactgccgagctgctgcggctgcggccgccgggctttgcggtgctcaccggcgaggatgcgctcgctttcgatgcgctgagccgcggctgcgacggcgcgatcctggcctcggcgcatctggagaccgaggcgttcgccgcgatgatgcatcggctgcaggccggcgatcggctcggcggggcgaccgaatggcaacgactcgccgacctgccgaagctgctgttcgccgagccatccccggcgccggtgaaatatgcgctgtggcggcgcgggttgatcgacagcccagaagtgcggctgccgatgacaccggtgtcacccacgctcgccgccgccattgatgcgcggatg

SEQ ID NO: 44277 - DNA, 969 bp, Rhodopseudomonas palustris
atgaccgtggttgggatcagcaagcccggcggtcccgaggtcctgctgcccgagacgcgggacgtgccgaagcccggccccggggaaatcctggtcaaagtggctgccgccggcgtcaatcgtcccgatgtggcacagcgctccggcagctatccgccgccgcccggcgccagcgatctgccgggcctggaaatcgccggcgaagtagtggcgcttggcgacggcgcctcccggcacaagctcggcgacaaggtgatgtcgctggtggctggtggcggctacgcggaatattgcatcgcccaggacgcgcaggcgatgaaggtaccggccgcctattcgatgatcgaagccggcgccacgcccgagacgctgatgacggtgtggcacaacgtgttcgagcgcggcggcttgcagcccggcgaaacgttgctggtgcacggcggctcgtccggtatcggtacgatggcgatccagcttgcggtcgcgctcggatcgaaagtgatcaccaccgtcggctcgcaggacaaagccgacgcctgcctcaagctcggcgccagccgcgccatcaactacaagaccgaggatttcgtcgcggcggtgaaggaagctaccggcggcaagggcgtcgaggtgatcctcgacatggtcggcggcgattacatcgagcgcaactacgacgccgcggcgatggacggccgcatcgtgcagatcgcgttccttggcggtgccaaggccaacgtcaacttcgtcaagctgatgaccaagcggctgcaccacaccggctcgacgctgcggccgcgctccaacgccgataaggccgcgatggtcgcggcgatcgaagccaaggtgctacctctgctcgagcagggccggatcaagccgctgatcgacggcaccttcgcgctgcgggacgccgccgatgctcaccggcggatggaaaccagccaacatattggcaaaattgtgttg

SEQ ID NO: 44278 - DNA, 1803 bp, Rhodopseudomonas palustris
accttgcgggccgatgccgatccgagccaggtcgaggaggtcgcggccgtcgtcaagcgcagccggctgaagccgctgctctcgctgatgccgtatgtggcccgctaccgcggccgcgccacgctggcgctgatcgccctgatcgtcgcggccgccacgaccctggtggttcctgtcgcggtgcgtcggctgatcgatttcggcttcagcgccgaaggtgtcgagctgatcaacggctatttcagcgtcatgctcggcgtcgtggtggtactcgcggccgccagcgcggcccggtattacctggtgatgacgatcggcgagcggatcgtcgccgacgtccggcgcgacgtgttccggcatctcacggcactgtcgccggcgttcttcgattccgcccgcagcggcgagctgatctcgcggctgaccgccgacaccacccagatcaaatccgccgtcggcgcctcggtgtcgatcgcgctgcgcaacatgctgctgttcgtcggcgcgatctcgatgatggtgatctcgagcccgcgtctgtccggcttcgtgctggcggcgattccgctgatcgtgattccgctggtggcgttcgggcgctgggtgcggaggttgtcgcgcaacgcgcaggacacgctggcggacgcttcggcctatgcggccgaactggtcggcgcgatccgtaccgtgcaggcctacaccaacgaacgcgtcgccaatgcgcggttcggcggcgcggtcgaagagtcctacgaggcggcgcgcagttcgaccggggcgcgggcgctgctcaccgcgatcatcatcttcatcgtgttcgccagcgtggtggcgatcctgtgggtcggctcgcacgacgtcgccatcggcgccatgtcgcccggtcggctcggccagttcattctgtatgcggtgtttgccgcctccagcctcggccagctcagcgaagtgtggggcgaagtctcggcggcctcgggcgcggccgagcggctgttcgaaatcctgcgggtgaagcctgagatcgccgcgccggcgaagccgaaggcgctgccgatgccggtgcgcggcgacgtgctgttcgacaatgtcagcttctcctatccaacccggccggacttcctggcgctcgacggcctgtcgctgagcatcaaggccggtgaaaaggtggcgatcgtcggcccctccggcgccggcaagagcacgctgtttcatctgttgctgcggttctacgatccgacctccggcacgattgcgctggacggtgtcgccatcaacgccgccgatccgcaggcggtccgcgagcggatcgctctggtgccgcaggactcggttgtgttcgccgcgaccgcgcgcgacaatatcagtttcggccgcgacgacgccagcgagctcgacgtcgagcgcgccgcccagcaggctcacgccaccgaattcatctcacgtctgccggaaggcttcgacaccaagctcggcgaacgcggcgtgacgttgtccggcggccagcgccagcggatcgccatcgcccgtgcgatcctgcgcgacgcgccgctactgctgctggacgaggcgacctcgtcgctcgacgccgaaagcgaagtcctggtgcagaccgcgctgcagcagctgatgcgcgaccgcaccacgttggtgatcgcccatcggctcgccaccgtgctgtcgtgcgaccgcatcgtggtgatggagcacggccgcatcgtggagcaaggcacccacgcccagctcgtcgcccgcggcggcctctacgcccgcctcgccaagctgcagttcgaggcggcgtaggtt

SEQ ID NO: 44279 - DNA, 999 bp, Rhodopseudomonas palustris
gctgacttgaaccagatcgctcgcgccatggtcgcgcccggcaaaggcattctcgccgccgacgagtcctcggggacgatcaagaagcggttcgacgtcatcggggtggagtcgaccgagaccaaccgccgcgactatcgcgagatgctgttccgctccaaggaagcgatgagcgactacgtctccggcgtgatcctgtacgacgagacgatctggcagaacgccgccgacggcaccccgctggtgaagctgatcgagcaggccggcagcatccccggcatcaaggtcgacgagggcactcagccgctgccgaactgtccgggcgaaaccatcacggtcggcctcgacaagctcgccgagcggctcgccaaatactacaagcagggtgcccggttcgcgaagtggcgcgcggtgatcgacatcgacactgcccgtggcgttccgagccacaccgcgatcatgaccaacgcccacgcgctggcgcgctacgcggcgctgtgccagcaggcccagatcgtgccgatcgtcgagccggaggtgctgatggacggcgcccacgacatcgacacctgctacaacatcaccgaatgggtgctgaaggaaaccttccagcaactgtacttccagcgcgtcgcccttgaaggcatgatcctgaagccgaacatggctgtccccggcaagaaatcggctaagaaggcgtcggtgcaggaagtcgccgagaaaaccgtgaagctgctgaaggcctgcgtgccgtcggcggtgccgggcatcgccttcctgtccggcggccagtcggacgaagaagcgacggcccacctcgatgccatgaacaagatcggtggcctgccctggggcctcaccttctcgtacggccgtgcccttcaggccgcaccgcagaaggcgtggtcgggcaaggccgaaaacgtcgcggccggtcaggctgcgttcacccaccgggcccggatgaactcgctcgccgccaagggcgagtggagcgcc

SEQ ID NO: 44280 - DNA, 1176 bp, Rhodopseudomonas palustris
ttccgcaccctcgacgacgtcgatgtgaagggcaagcgcgtgctgctgcgcgtcgatctcaacgtgccgatggacgccggcaaggtgaccgacaccacccggctcgaacgcgtgatgccgaccatcaccgagctgtcgggcaagggcgccaaggtgatcctgctggcgcatttcggccggccgaagggccgcgacgacaagaactcgctcaagccggtcgctgctgcgctggccgacgtcatcaagaagccggtcggcttcgccgacgactgcatcggcgagcccgccgccaaggcgatcgccgcgatggccgacggcgacatcctgtgcctggaaaacacccgcttccatcccgaggaagagaagaacgatccggcgttcgtcgccaagctcgccgagctcggcgacatctgggtcaacgacgcgttctcggccgcgcaccgcgcccacgccaccaccgaaggcctcggccacaagctgccggcttacgcgggccgcaccatgcaggccgagctcgtcgcgctgaacaaggcgctggaagcgccggtgaagccggtgatcgcgatcgtcggcggcgccaaggtgtcgaccaagatcgacctgctcgaaaacctggtcaccaaggtgcaggcgctggtgatcggcggcggcatggccaacaccttcctgcacgcccagggcgtcaaggtcggaaagtctctgtgcgagaaggacctggctccgactgcgctgcgcatcctcgataaggccgaagctgccaactgcgccatcatcctgccggtcgacgccaccgtggcctatcacttcgaggccaacgcgccgtcgttcgcctacgggctcgacgccatcccggacgatgccatgatcctcgacgtcggcccgcgctcgatcgagcgcattcacgccgcgatcgacgatgccgcgaccctggtgtggaacggcccggtcggcgcgttcgagctgacgccgttcgacaagggcacggtcgaagccgccaagcacgccgccaagcgcaccaaggccggcaagctggtgtcggtcgccggcggcggcgacaccgtcgcggcgctcaaccatgccggcgtggccgacgacttcacctacatctcgaccgccggcggcgccttcctggaatggatggaaggcaagccgctgccgggcgtcgaagtgctccag

SEQ ID NO: 44281 - DNA, 993 bp, Rhodopseudomonas palustris
atggcagtccgggtcgcgatcaatgggtttggccgtatcggccgcaacgttctgcgggcgatctacgagtccggtcgtaaggatatcgaagtcgttgcgatcaacgatctcggcccggtcgagaccaatgcccatctgctccgcttcgactccgtccacggccgcttcccgttcgaggtgaaggtcgacggcgacaccatcgatgccggccgcggcaagatcaaggtgacggccatcaaggatccttcggcgctgccgtacaaggaagtcggcgtcgacatcgctctggaatgcaccggtatcttcaccgcgcgcgacaaggccgccacgctgctgaccgccggcgccaagcgcgtgctggtttcggctccgtcggacggcgctgacgcgaccatcgtgtacggcgtcaaccacgagaccctgtcgaaggaccacatggtggtttcgaacggctcgtgcaccaccaactgcctggctccggtcgccaaggtgctcaacgacaccgtcggcatcgaaaccggcttcatgaccacgatccacgcctacaccggcgaccagccgacgctggacaccatgcacaaggatctctaccgcggccgcgctgcggcgatgtcgatgatcccgacttcgaccggtgccgccaaggcgatcggcctggtgctgccggagctgaagggcaagctggacggcgtcgcgatccgcgtgccgaccccgaacgtctcggtggtcgacctcaagatcattgccaagaaggccaccaccaaggaagagatcaacgaagcgatcaagcgcgccgccgagcaggagctgaagggcatcctcggctacaccaacgcgccgaacgtctcgatcgacttcaaccacgatccgcactcgtccaccttccacatggaccagaccaaggtgcagaacggcacgctggtgcgcgtgatgtcgtggtacgacaacgagtggggcttctccaaccgcatggccgacaccgccgtcgcgatt

SEQ ID NO: 44282 - DNA, 1965 bp, Rhodopseudomonas palustris
gatcattcccgtatggcaaacgcaatccgggcgctggcgatggatgcggtggaaaaagccaaatccggccatcccgggctgccgatgggcgccgccgacgtcgcgaccgtgctgtggacgcagttcttgaaattcgatgcggtcgacccgcactggccggatcgcgaccgcttcatcctctcggccggccacggctcgatgctgctctatgcgctgctgtatctgaccggcaacgaggagctgacgctcgaccagatcaagaatttccgtcagctcgactccaagacgccggggcatcctgagaactgcatcacctcctcggtcgagaccaccaccggtccgctcggccagggcgtcgcctcctcggtcggcaccgcgctggcagaacgactgttgcaagcggagttcggcgacattgtcgatcactacacctacgtgctgtgctcggacggcgacctgatggaaggcgtcagccacgaagcgatcgcactagccgggcatctcaggctgtcgaagctgatcttcctgtacgacgacaacggcatctcgatcgacgggccgctgtcgctgacagacactgtcgaccaggtcgcgcgcttccaggcgcatggctggaattcgttccggatcgacggccacgaccacaaggcgatcgccgacgcgatccgcaaagcccaagcctccgaccggccgaccatgatcgcctgcaagaccacgatcgggttcggcgcgccgcacaaggccggcacctcaaaggcccatggcgagccgctcggggccgaggagcttgcgggcgccaagaaggcgctcggctgggattacggcccgttcgagattccggacgacgtgctcagcgcctggcgcaatgtcggcaagcagggggcatcggcgcgcgccgactggctggcgcggttcgacgccctgccggcggacaagcgcggcgacttcaagcgccgggtgatcgaccgcaagcggccggcggcgattgcggacgcgatccgtacgctcaaggacaagctggttgccgagccgcagaccatcgcgacccgcaaagccagcgagctggcgctggaagcgctgacgccggtggtgcccgagctgctgctcggctccgccgacctgacgccctccaacaacacccgcgtcaagcaggccaaggacgtgacgccggacgatttctccggccgctacatccactacggcatccgcgagatgggcatggcggcggcgatgaacggcttggcgatgcacggcgggtttgcgcccgcgggcggcaccttcctgtgcttcaccgactacgcgcgcccatcgatgcgggtggcggcgctgtcgcatgtgccggtcgtgtacatcatgacccacgactcgatcgggctcggcgaagacggcccgacgcatcagccggtcgaacatctcgcggcgctgcgggcgatgccgaacatgcgggtattccgcccggccgacgcggtggaaaccgccgagtgctggcagctcgcactggaaaacaccaatgggccaaccttgctggcgctgtcgcggcagaacctcgcccaggtccgcaccgcgacgtccgaggccaacctctgcgccaccggcggctatgagctgatcccggcacccggcaaggcgcaggtttcgatcttcgccaccggctccgaggtcgagatcgcagtcgcggcccagaagctgctcgaggtgcagggcgtcgccgcccgcgtcgtgtcggtgccgtcgctcgatctgctgctggctcaggacgatgccacccgcgcggcgatcatcggcgatgcaccggtcaaggtcgcggtcgaagccgcggtgcggttcggctgggacgcggtgatcggtccggacggcggctttgtcggcatgaccggcttcggcgccagcgcaccggccaaggacctctacaagcacttcggaatcaccgccgaagctgtggcggacgccgctaagcgtcggctt

SEQ ID NO: 44283 - DNA, 1890 bp, Rhodopseudomonas palustris
accgaatttagtaaaacaccgcttctcgacaccattcgcacaccggaagatctgcgcaagctgcggatcgatcaggttcggcaggtcgccgacgaattgcgattggagacgatcgacgcggtatcggtcaccggcgggcatttcggcgccgggctcggcgtggtcgaactgactaccgcactgcactatgtgttcgacaccccgcgcgaccgcctgatctgggacgtcggccaccaggcctacccgcacaagatcctgaccggccggcgcgaccgcatccgcaccctgcgcaccggcggcggcctgtccggcttcaccaagcgcaccgagagcgaccacgacccgttcggcgccggccactcctcgacctcgatctcagccggcctcggcatggcggtcgccagcgaactcgccggcaagaagaacaacgtcatcgcggtgatcggcgacggttcgatctcggccggcatggcctacgaggcgatgaacaacgccggcgcgatgaactcccggctgatcgtcatcctcaatgacaacaacatgtcgatcgccccgccggtcggcgcgatgtccgcttacctgtcgcggttgtactcgggcaagacctatcggtcgctgcgcgaggccggcaagcagatcgggaagcacctgccgaagctgatcgccgaccgcgccgcccgcgccgaggaatattcccgcggcttcatgatgggcggcggcaccctgttcgaggaactcggtttctactacgtcggcccggtcgacggtcacaacctcgaccacctgctgccgatcctgcagaacgtccgtgatgccgacaccggcccgttcctgatccacgtcgtcacccagaagggcaagggttacggcccggccgaagcggcggccgacaagtatcacgcggtggtcaagttcgatatcgccaccggcgcccaggccaaggccaagtcgaacgccccctcctaccagaacgtgttcggccagagcctggtcaaggaagcccagaaggacgacaagatcgtcggcatcaccgcggcgatgccgtcgggcaccggcatcgacatcttcgagaaggccttcccgaagcgcacgttcgacgtcggcattgccgaacagcacgccgtgaccttcgcggccggcctcgccaccgaaggctacaagccgttctgcgcgatctactcgaccttcctgcagcgcgcctacgaccagatcgtgcacgacgtcgcgatccagaagctgccggtgcgctttgcgatcgaccgcgcgggcctggtcggtgccgacggcgccacccacgccggttcgttcgacaacgcctatctcggctgcctgcccaacatggtgatcatggctgcggccgacgaagccgagctggtgcacatggtcgccacccaggtggcgatcgacgaccggccgagcgcagtgcgctatccgcgcggcgaaggccgcggcgtcgagatgccggaagtcggcattccgctggaaatcggcaagggccgcgtcatccgccagggcaacaaggtcgcgctgctgtcgttcggcacccggctcgccgaggccgagaaggccgcggacgaactcgccactctcggcctctccaccaccgtcgccgacgcccgcttcatgaagccgctcgacgtcgagctggtactgaagctcgcccgcgaccacgaagtgctgctcaccatcgaagaaggttcgatcggcggtttcggcagccacgtgatgcaaacgctggccgagcacggcatgctcgacggcgaagtgaagatgcgggcgctagtgctgcccgacgtattcatggatcacgacaatccggtggcgatgtacgcccgcgccggcctcgacgccaaggcgatcgtcaagaaggtgttcgacgtgctcggcaag

SEQ ID NO: 44284 - DNA, 1611 bp, Rhodopseudomonas palustris
cccgcaccgcgcgcggccgaattgctgccgccgccggtcgatctgcggattctcgcgatcaacgacttccacggcaatttgcagccaccgcccggcggcatcgcgatcgacgatccggccgatcggaccaagaagattcacgtctccgccggcggcgccgaacatatggcgacgctggtcaaagcgctgcgcaaggatcatcccaatgcaatcttcgtcgccgccggcgatctgattggcgccagcccgtttctgtcggcgatgtttcacgacgagccgaccatcgagtcgctgtcgctgatggggctggcgctgtcctcggtcggcaatcacgaattcgacgagggcaagaccgagctgttgcggatgcagaacggcggctgccatccggtcgacggctgccaggggccgcatccgttcaagggcgcggcgttcaactatctggccgcctccacggtcgagaccgcgaccggcaagacggtgtttccgccctatgcgatccgcaagttcggcggcgttccggtggcgttcattgggctgacgctgaagaacacgccgaatatggtgtcaccgccgggggtcgccggactgtcattcaaggacgaggccgagaccgtcaacgccctgatcccggagctgaaggccaagggcgtcgaggcgatcgtggtgctaatccatgaaggtggttttccgaccggcgactacaatgaatgcccgggcatctccggcccgatcgtcgagatcgtcaacaagctcgatcgcgccgtcgacgtggtgatcagcggccacacccaccgcgcctacacctgccggatcgacggccgcctcgtcaccagcggcgacaaatacggcaccatcgtcaccgcgatcgacctcaagctcgatccgaccaccggcgacataatcagcgccgccgccaataacacgatcgtccgaaccgaaacgctggccaaggatccggcgcagaccgaactgatcgccgcctacgacaaactggccggcccgatcgcggcacggccggctggctcggtgaccgcggcgctgtcgcggatgtcgaacgcggccggcgagagcgtactcggcgacgtcgtcgccgatgctcagctcgccgccaccctcgacaaggacaaaggcggcgctgagatcgcgctgaccaatccgggcggcgtccgctccgatatcctgggcggcgaaggcggagcagtgacattcggccaggtgttcgccgcgcagccgttccgcaatcagctggtgacgatgacgctgaccggcgctcagctcaaggcagcgctcgaacagcaatgggctgagccggcgcgaccacgcattctgcaggtgtcgaagggctttcacttcgcctgggatgcggcgggcgcccccggcggacgaattccgcccgacaggatgtcgctgaacggagcgccgatcgacccgaaccgcacctatcgggtgacgctcaacgcctatctggcagccggcggcgacggcttcaccgtgttcaaggacggtgctgcaccgcaaaccggcgtctacgacgtcgacgcgttgttctcttatttcaagactcacagcccggtggcgccgccgccgaccgaccgggtgacgcgattg

SEQ ID NO: 44285 - DNA, 1728 bp, Rhodopseudomonas palustris
acctatcgcgctccgatcgacgacatccttctttccctgaaccacggtgcgggattgcaggccgccgtcgccgccggccattttggcgactacgacagcgagatcaccgcgcaagttctggacgaggcgggcaaattcgccagcgacatcctggcgccgctgaaccgagtgggcgacaagcacggcatcaagctcgagcatggcaaggtcaccaccgcgccgggctggccggatgcctatcagcgctggatcgcggccggctggaatgcggtgtcgggaccggaggatttcggcggccaggggctgccgatggctgtgaacgccgcctgcaccgagatctgggcgtcgtccaacatggcgttcgggctgtgcccgctgctcaccctgtcggcgatcgacgcgctgcacacccacggcagcgacgcgctaaagcaggtctatctcggcaagctgatctccggtgagtggaccggcacgatgcagctcaccgagccgcaggccggctccgacgtcggcgcgctgcgcacccgcgccgagcgggccgccgacggcagctacaggatcttcggcagcaagatcttcatcacctacggcgaccacgacatgaccgataacatcgtgcatttcgtgctcgcgcggctgccggatgcaccggccggcaccaaaggcatctcgctattcctggtgccgaaattcctcgtcaacgccgacggcacgctgggcgcccgcaacgacatctatccgagcggcgtcgagcacaagctcggcatccacgcctcgccgacctgcaccatgacgatgggcgaccacggcggcgcaatcggctatctgatcggcgaagaaaaccgcggcatgcagtgcatgttcacgatgatgaaccaggcccgccttgcggtcggcctcgaaggcgtcggcattgcagaccgcgcctatcagcaggcgctggcctatgcgcaggagcgcaaacaaggccgcgcgatcggcagcgccggcccggggtcggatccgatcatcaagcaccccgacgtcaagcgcacgctgctgacgatgcgggcgctgatcggcgccgcacgcacgatttgctactcgaccgctgtggcactcgacatcgcggcgcgcagcaccgacccgaaggtcaaagcctccgccgcggcgcgcggcgcgttgctgacgccgatcgccaaggcgttctccaccgacatcggcatcgaagtcgcctcgctcggcgtccagatccatggcggcatgggcttcatcgaagagaccggcgccgcgcagcactaccgcgacgcgcggattgcgccgatctatgaaggcaccaacggcatccaggcgatcgacctcgtcacccgcaagcttggcgctaacggcggcgcctctgtgttcgcgctgctcgacgagctgacgctgatcgtcaaggatgtggaagcatcgaacgatccgggcttcggcctcaccggcctgcggctgcgcgaggggctggaagcgctcgaccgcaccagccgttatctcctggacaagctcggcagcgacaccaacgacgcgttggccggcgccacgccctacctgcgtctgttcggcgccacgctcggcggctgcgcgctggcggccgaagcgctcgcggcgcgcgatctcgaaggcatcaacgatccgtcgcgctacgtcgcgctggcacggttcttcgccgagaccgtcgcggtgcaggcccctgcgctggagcgcagcgtg

SEQ ID NO: 44286 - DNA, 1125 bp, Rhodopseudomonas palustris
accgaagagctggacacgttccgcgaccaatttcgcaaattcctcgccaaggatctcgcgccccacagcgacacgtggcggaagcagaagatggtcgatcgctcggcctggctgaagctcggcgaaatgggcgcgctgctgcccagcgttccggaagagtacggcgggctcggcgccagcttcgcctacgatgccgcggtctatgaggacatggagaagatcgtcccggacgcgctgtccggggtcaccgtgtcgagcggcatcgtggcgcactacatcctcaactacgggtcggaagaacagaagcggcgttggctgcccggcatggcgcgcggcgagctgatcggcgcgatcgcgatgaccgagcccggcaccggatctgacctgcagagcgtgcgcaccaccgccaagctcgacggcgacgactacgtcatcaacggccagaagaccttcatcaccaacggccagaactgcgacctgatcattgtcgtcgcccggaccggcggcgccggcgccaaggggctgtcgctgatcgtgctggagaccaaggacaatcccggtttcaagcgcggccgcaacctcgacaagatcggcctacacgcctccgacacctccgagctgttcttcgagaacgcccggacgccgaaggagaacctgctcggcggagaggaaggcaaaggcttcgtgcagctgatgcagcagctgccgcaagagcggctgatcatcgcgatcggcgcggtggcagcgatggagcgcgcggtcgcgctgacttcggaatacacgcgggagcgcaaggcgttcggccaaccgatcatcgaattccagaacaccgctttcacactcgccgaacgcaagaccgaagccttcatcgcgcgtgtgttcgtcgattactgcctggtccagctggtcgccggcaatctcgacgcggtcaccgcctcgatggcgaaatggtggacgacgcaaaagcaggtcgagaccgtggacgagtgcctgcagctgcacggcggctacggctacatgcaggaatacccgatcggccggatgttcatcgactcgcgcattcagaagatctacggcggcaccaacgaggtgatgaagctgctgatcgcccgctcgctgtaacac

SEQ ID NO: 44287 - DNA, 1437 bp, Rhodopseudomonas palustris
gaccgcgcgctcagctatcgcgagctcgatctgctggttcgcaagatcgcggtgtctctggccgcactcggcattggcaaaggcgaccgcgtcgcactgttcctcggcaattgctgggagttcctggcggtgacgctcgcctgcaaccggctcggcgtcctggtagtcccgatcggcatccggcagcgccgcgctgaactcgaattcctgttgaacaacagcggcgccaaggtggtggtgttcgaggcggagctgactgacgagatcccggcagccgccgaagtgccacagctcgcgcatcgcttcgtcgcgcacggaaccgccgagggcgcgcggccgttcgaggatctgctcgccgccgagccggcgaacgcgccgctcgcagagatgcacgaagacgataccgcggtgatcctctacacctcgggcaccaccggcaaaccgaagggcgccgagctgacgcatctcagcatcctgcattcatcctacgcgttcgcgcgcgcccatgagctgactgaacgcgaccgcggcttggtcgcggtgccgctatcgcatgtgacgggcctcgtcggcgtatcctatgcaacgatcgcggccggcggctgcgttgtgctgatgcggcaggcgttcaaaaccgtcgacttcctcgccctcgcggcgcgcgagcggatcacctattcgatcctggtgccggcgatctacacactcgcggtgatgcatccggagttcgacaagcacgatctgtcggcttggcggatcggctgcttcggcggcgcgccgatgccggtaccgaccatcgagatgctggcgaagcgactgccgaacctgcagctccgcaacgcctacggcgcgaccgagaccacctcgccgaccacgatcatgccgcaggcgtattggcgtgatcacatggacagcgtcggccaggcggttccttacgcgcatgtccgcgtgctcgacgccgacgacaacgaggtcgcacccggcgagcccggcgaactcctgatcgccggcccgatggtggtgccgcgctattggcagcgtcccgatgccaacgccaaggaattcgtgaacggctactggcgcagcggcgacatcggttcgatcgaccaggacggcttcgtccgggtattcgaccgcaagaaggacatgatcaaccgcggcggtttcaagatcttctcggccgaagtcgagaacgtgatctgcggcatcgacggcgtgctggaaaccgcgatcatcggcacgcccgacccagtgctcggcgagcgcgtcaacgccatcgtggtgaccagcgaaggcgccagcctgagcgagcgcgacgtcgccgcctactgcgcggcacggatgtcggactacaaggtccccgagagcatcatcatccgctccgagcccctgccccgcaatgccaacggcaagattcagaaaacggtgctgcgcgag

SEQ ID NO: 44288 - DNA, 930 bp, Rhodopseudomonas palustris
atggagcgcgtcaacgccaccatcctgtcgcggaccggctccgacgtcaccatgattccggaagtcgccaaccacctgatctcttccggcggcaagcggctgcggccgatgctgactttggcgatggcgaatctcaccggctacaccggcgacggccacatcaagctcgctgccgcagtcgaattcatgcacaccgccaccctgctgcacgacgacgtcgtcgacgagagcgagatgcgccgcggcaagaagtcggcgcgaatgctgtggggtaacgaggccagcgtgctggtcggcgacttcctgctcggccaggcgttccggatgatggtggaggtcggcagcttgcgcgcgctcgacatcctgtcgtcggcgtccgccaccatcgccgaaggcgaggtgatgcagcttgccgccgccaagaacaccgcaaccaccgaagacgaatatctcgcggtgatccgcggcaagaccgccgaactgttcgccgccgcctgcgaagtcggcccggcgatcgccaaccggccgaagccggagcagtcggcctgccgctcgttcggcatgaacatcggcatcgccttccagctgatcgacgacgtgctcgactacggcggcaaggccgccaagctcggcaagaacgtcggcgacgacttccgtgagggcaagatcaccctgccggtggtgctggcgttccgccgcggcaacgacgccgagcgcgagttctggatcaagtcgctggagcgcggcgagatttcggatgccgacctcgatcaggcgatcaagctgatgaccaagcatcgcgcgctcgacgacaccatccagcgtgcccatcactacggcgcgatggcggtcgacgcgctggcgctgttcccctcctcgccgatgaagacggcgctggagcaggtggtggctttctgcctggcgcgttcg

SEQ ID NO: 44289 - DNA, 2640 bp, Rhodopseudomonas palustris
gtctacaccttcggcgacggcaaggctgaaggccgcgccaacatgcgcgacctgctcggcggcaagggcgccaacctcgccgagatggccaatctcggcctgccggtgcctccgggcttcaccattccgacctcggtctgcacctacttctacgccaacggcaagacctatccgaaggagctgcagtcgcaggtcgagcgcgcgctcgatcacgtcggcaagctcaccaacaagaagttcggcgacgccaagaacccgctgttggtgtcggtgcgctccggcgcccgcgcctcgatgccgggcatgatggacaccgtgctcaacctcggcctcaacgaccagacggtcgaagcactggccgagaagtcgggcgatcgccgctttgcctatgacagctatcgccgtttcatcacgatgtactcggacgtggtgctcggcttcgagcaccatcatttcgaggaaatcctcgacgcctataaggacgccaagggcttcacgctcgacaccgatctcgatgccgacgactgggtcgatctggtcggccagtacaaggaagccgtggcgcgcgagaccggcgaggacttcccgcaggatccgcacgcccagctgtggggcgcgatcggcgcggtgttctcgtcgtggatgaacgcccgcgcggtgacttaccgccgcctgcacgacattccggaatcctggggcaccgccgtcaacgtccaggcgatggtgttcggcaacatgggggagacctcggcgaccggcgtcgccttcacccgcaacccgtcgaccggcgaaagccgtctgtacggcgaattcctgatcaatgcgcagggtgaggacgtcgtcgccggcatccgcaccccgcaggacatcaccgagcacgcccgcatcgaatccggctccgacaagctgtcgatggaaatggcgatgccggaggcgttcaaggaactgacccggatctacaccctgctcgagaagcactatcgtgacatgcaggacatggagttcacgatcgagcagggcaagctctggatgctgcagacccgcggcggcaagcgcaccgccaaggcggcgctgcggatcgcggtcgagctcgccaacgaaggcctgatcaatcgcaaggacgccgtgacccggatcgagccgggctcgctcgaccagctgctgcatccgactatcgaccccaacgccaagcgtgacgtgatcgccaccggcctgccggcctcgcccggcgccgcctccggcgagatcgtgttctcgtcggatgaggccgccaagctgcacgccgacggccgcaaggtcgtgctggtgcgcatcgagactagccccgaagacatccacggcatgcacgcctcggaaggcatcctcaccacccgcggcggcatgacctcgcacgccgcggtggtggcgcgcggcatgggcaagccctgcgtctccggctgcggcgcgatccgcgtcgattacggccgcggcacgatgatgatcggcaaccgcaccttcaaggcgggcgacatcatcactatcgacggcggcaccggccaggtgctggccggcaagatgccgatgatcgagccggaactgtcgggcgacttcaatacgctgatgggctgggccgacgaagtccgcaagctcaaggtccgcgtcaatgccgacaccccggccgacgcccgcaccgcgatcaagttcggcgccgaaggcatcggcctgtgccgcaccgagcacatgttcttcgaagagacccgcatccgcaccgtgcgcgagatgatcctcgccgaagacgagcagtcgcggcgctccgcgctcgccaagctgctgccgatgcagcgcgccgacttcgtcgagctgttcgagatcatgaagggcttgccggtgacggtgcgcctgctcgatccgccgctgcacgagttcctgccgcacacccaggcggagatcgaggaagtggcgcgggcgatgaacgccgatccgcgccggctcgccgatcgcgcccgcgagctcgccgagttcaacccgatgctcggcttccgcggctgccgtctggcgatcgcctatccggagatcgccgagatgcaggcccgcgcgatcttcgaggccgcggtcgaggccgagaagcgcaccggcgagcaggtcggcctcgaagtgatggtgccgctgatcgcgacccgcgccgagttcgagctggtgaaggcccggatcgacgccaccgcgcaggcggtgaaccgcgataccggcagcaatctgaagtaccaggtcggtaccatgatcgagctgccgcgcgcctgcctgatggccggtgacattgccgaaagcgcggagttcttctcgttcggcaccaacgacctgacccagacgacgttcggcatcagccgcgacgacgccgccagcttcctcggcacctatatcgaaaagggcatcttcacggtcgacccgttcgtgtcggtggaccgcgacggcgtcggcgagctggtccggatcggcgtcgagcgtggccgcaagacccgcgccaagctcaaggtcggcatctgcggcgaacacggcggcgacccggcgttggtggcgttctgccacgaggtcggcctcgactacgtgtcgtgctcgccttatcgcgtgccgatcgcgcggctcgccgcggcgcaggccgcactc

SEQ ID NO: 44290 - DNA, 1485 bp, Rhodopseudomonas palustris
gtccatggtgacgtcgttatcgtcggcggcggtctcgccggcctgttctgcgcgctgaaattggcgccgcggccggtgacggtgatcagcgccgcaccgctcggcgaaggcgcctccactgcctgggcgcagggtggcatcgccgctgcggtcggcgaaggcgacagcgccgaatcgcatgcggccgacaccatcgcggtcggcgccggactggtcgacgaagcggtggcgcatcgcctcgccggcgaagcggccgcgcggatccacgatctcctcagctacggcgtgccgttcgaccgcgacctcgagggccggctggcggtggcgcgcgaggcggcgcattcggcccggcgcatcgtccacgtccgcggcgacatggcgggccaggcgatcatcagcgcgctcaccgaagcggtgcgcaacacgccgtcgatcaaggtgatcgaaggctggtttgccgacgggctgctgatgcacgacgatgcggtcgccggactgcggctgcgcaaggtcggcaacgccgccggctcgccgatgcacatcgcggcacgcgcggtggtgctcgccaccggcggcatcggtcatctttatgccgtcaccaccaatccgatcgaggcccgcggcgtcgggctggcgatcgcggcccgggccggcgcgcgaattgccgaccccgaattcgtgcagtttcatccgacggccatcatggtcggccgcgatccggcaccgctcgccaccgaggcgctgcgcggtgaaggcgcgatcctgatcaacggccagggcgaacgcttcatgctggccgcgcatccgctcgccgagctggcgccgcgcgacatcgttgcccgcggcgtgtttgccgaagtcgcctccggccgcggcgcctatctcgacgccaccaaggcgcttggcgcgcatttcgccgagcatttcccgaccgtgtacgagagctgcatctcggctggcatcgatccggcgacacagccgatcccgattgcgccggcggcgcactaccacatgggcggcatcgcggtggacatgcgcggacgcagttcgctgcacgggctgtgggcggcgggcgaagtgtcctgcactggcgcgcacggcgccaaccggctcgcctccaactcgctactggaagccgtggtgtacgcggcgcggatcgccgaggacatcgccagcaccgaactcgccgcgaccaagtcgcggctcgacgtgcacgagacacacagcacgccaatcgatccagcgcaggagctgctgctgcgccagaccatggccggcaaggtcggcgtggtccgcgaccgcgacggactaaccgaagcggtgcgaaccttcgcggcgctggaggccgaaacgacctcgaccacgctcgccaacatggcgaccaccgcgctgctggtcgccaccgcagcgctggcacgcaccgaaagccgtggcgcgcactatcgcgccgactatccgaccgaaaacccggcgcaggcgaaacgc

SEQ ID NO: 44291 - DNA, 1395 bp, Rhodopseudomonas palustris
acgctctcgcccgaactgatcgcccgcttcaccgcgatcgtcggcgacaagcacgcgctgaccgatcctctcgagctcgaagcctacatcaccgaggagcgcaatctgtatcgcggccactcgccgttggtgctgcgtcccggctccaccgaggaggtggtggcgatctgcaagctggcgaacgaggcgcgtgtcgcgctggtgccgcaaggcggcaacactggtctcgtcggcgggcagacgccgcacaatggcgaggtggtgatttcgctgaagcggatggacaagatccgcgaaatcgacacctcgtcgaacaccatcacggtcgaggcgggggccatcctgcagcgggtgcaggagaaggccgcggaggtcgaccgactgtttccgctgtcgctcggcgcgcagggaagctgcaccatcggcggcaacctctcgaccaatgccggcggcaccgcggcgctcgcctatggcttggcgcgtgacatggcgctcggcgtcgaggtcgtgctcgccgacggccgggtgatgaacctgctgtccaaactgaagaaggacaacaccggttacgacctgcgcgatctgttcatcggcgccgaaggcacgctcgggatcatcaccgcggcgacgctgaagctgtttccaaagccgcgcgcggtcgagaccgcgttcgtcgggctgcagtcgccggacgacgcactgaagctgctcggcatcgcgcaaggagaggccgccggcaatctgacgagcttcgaactgatcgccgagacgccgctcgatttctcggtgcggcacgccaacaatcgcgacccgctcgaggcgcgctatccgtggtacgtgctgatcgaattgtcgtcgccgcgcgacgacgcccgcgccgcgctggagtcgattctcgagcgcggctttgaagacggaatcgtggtggacgcggcgatcgcgaattcggtgcagcagcagcaggcgttctggaaactgcgcgaggagatctcgccggcgcagaagccggaaggcggctcgatcaagcacgacatctcggtgccggtcgctgcggtgccgcagttcatcgaacaagccaacgccgcggtggtcgccctcatcccgggcgcgcgccctgtgccgttcggccatctcggcgacggcaacatccactacaacgtcagccagccggtcggcgccgacaaggccgagttcctggcgcgctggcacgacgtcagccaggtggtgttcgaggtggtgctgcggctcggcggctcgatctcggccgaacacggcatcggcgtgatgaagcgcgacgagcttgccgaggtgaaggacaagaccgcgatcgagttgatgcggtcgatcaaggccctgctcgacccgcacggcatcatgaatcccggcaaagtggtg

SEQ ID NO: 44292 - DNA, 1203 bp, Rhodopseudomonas palustris
cgcgcgcaaaccaaggacaagccggctcaggcgagcttcaagtgggatgatccgctgctgctggaagatcagctcaccgaagacgagcggatgatccgcgacaccgcgcgcgcttacgcccaggacaagctgctgccccgcatcaaccaagcgtatctcgaagagaagacagaccgcgagatcttcaacgagatggggtcgctcggcctgatcggcgtcacgctgccggaggaatacggctgcgccaatgccagctacgtcgcctacggcctggtggcgcgcgagatcgagcgggtcgacagcggctaccgctcgatgaacagcgtgcagtcgtcgctggtgatgtatccgatctatgcttacggcgacgagaaccagcgcaagaagtatctgcccaagctcgcctccggcgagtgggtcggttgcttcggcctcaccgagcctgacgccggctccgatcccggcggcatgaagaccaaggccgagaaggtcgccgacggctatcgcctcaccggcagcaagatgtggatctcgaacgcgccgatcgccgacgtgttcgtggtgtgggcgaagtcggccgcgcacgacaaccagatccgcggcttcatcctcgagaagggcatgaagggcctgtcggctccgaaggtcggcggcaagctcagcctgcgtgcctcgatcaccggcgagatcgtgatggacggcgtggtcgttccggaagatgcgctactgccgaacgtgtcgggcctcaaggggccgttcggctgcctcaaccgcgcgcgctacggcatctcctggggcgcgatgggcgccgcggaagactgcttccaccgcgcccggcagtacacgctcgaccgcaagcagttcaatcgtccgctcgctgcgacccagctcgtacagaagaagctcgccgacatggagaccgagattaccctcggtctgcaggccagcttgcgcgtcggccggctgatggacgagggcaagatggccccggagatgatctcgatcgtcaagcgcaacaattgcggcaaggcgctcgacatcgcccggatggcccgcgacatgcacggcggcaacggcatccagatcgagtatcacgtgatgcgccatgcccagaacctcgagacggtgaacacctacgaaggcacccacgacgtgcacgcgcttatcctgggccgcgcaatcactgggctgcaggcgttttct

SEQ ID NO: 44293 - DNA, 714 bp, Rhodopseudomonas palustris
gtcgcgctggtaaccggagccgctcgcggcatcggactcgcagcggccaagcgctttctcgccgacggctggtcggtggcgctgctcgaccgcgacgatgacggactgcgcgccgcaatgcaggcgttggccctgcccgaacgcaccatcgcgctgcattgtgacgtcgccgatcgcgggtcggtcgcccgcgacatcgctgcggtcactgagcggttcggacggctcgatgcgctcgtcaacaacgccggcatcgcggtgttcaagccgctgatggagacgacgccggacgaatggcagcgggtgatggacgtcaacctgaccggtccgttcctgatgacccaggccgcggtgccactgatgcgcgactccggcggcggcgcgatcgtcaacattacgtcgatttcatcgctccgtgcctcgaccctgcgcgtcgcctacggatcgagcaaagcggggctggcgcacttcaccaagcagtgcgcggtcgaactcgccgcgctcggcatccgcgtcaacggcgttgcgcccggtccggtcgacaccgcaatggccaagcaggtccacactgcggacatccggtccgactatcgcgacgcgattccgatggcacgctacggcctcgaggaggagctggcggaggccatcttcttcctgtgcagcgatcgcgccagctacatcaccggacaaattctagcggtggacggcggcttc

SEQ ID NO: 44294 - DNA, 1946 bp, Rhodopseudomonas palustris
atgaacgccaatctgcgcaatttcgccctctgggtcatcatcgtgctgctgctgttggcgctgttcacgctcttccagaatccgggccagcgcaccgcgtcgcaggaaattccgttctcgcagctcctcagcgagatcgaccagaaccatgttcgggacgtggtgatccagggccaggaaatccgcggcaccttcaccaacggctcgaccttccagacctacgcaccgaacgatccgtcgctcgtgacccgcctgtacaacggcaaggtgtcgatcaccgccaagccgccgggcgacaacgtgccgtggttcgtgtcgctgctcgtgtcctggctgccgttcatcgcgctgatcggcgtgtggatcttcctgtcgcggcagatgcagggcggcgccggcaaggcgatgggcttcggcaagtcgcgcgccaagatgctgactgaagcgcatggccgcgtgacgtttgaagacgtcgccggcgtcgacgaggccaagcaggacctgcaggagatcgtcgaatttctgcgcgacccgggcaaattccagcgtctcggcggccgcattccgcgcggcgtgctgctggtcggccctcccggtactggtaagaccctgatcgcgcgcgcggtcgcgggtgaagccaacgtgccgttcttcaccatctccggttcggacttcgtcgaaatgttcgtcggcgtcggcgcctctcgtgtgcgtgacatgttcgagcaggccaagaagaatgcgccgtgcatcatcttcatcgacgaaatcgatgcggtcggtcgtcatcgcggcgcaggtctcggcggcggcaatgacgaacgcgagcagaccctcaaccagttgctggtcgagatggacggcttcgaggccaatgagggcgtgatcctgatcgccgccaccaaccggcccgacgtgctcgatcccgcgctgctgcgtcccggccgcttcgaccgtcaggtcgtggtgccgaatccggacgtcgtcggccgcgagcagatcctcaaggtccacgttcgcaaggtgccgctggcgcccgatatcaacctgaagaacatcgcgcgcggcactccgggcttctcgggcgccgacctgatgaacctcgtcaacgaagcggcgctgatggcggcccggcgcaacaagcgcatggtcactcagtccgagttcgaagacgccaaggacaaggtgatgatgggcgccgagcgcaagtcgctggtgatgacggaagaggagaagcttctcaccgcgtatcacgaaggcggtcacgccatcgtcggcctcaacgttccggcgaccgacccgatccacaaggcgaccatcattccgcgcggccgtgcgctcggcatggtgatgcagctccccgagcgcgacaagctgtcgatgtcgctcgagcagatgacctcgcgtctcgccatcatgatgggcggccgcgtcgccgaggagatggtgttcggccgcgagaaggtgacttccggtgccgcatccgacatcgaacaggcgaccaagcttgcgcggatgatggtgacccgctggggcctgtcggaagagctcggcaccgtcgcttacggcgagaaccaggacgaagtgttcctcggcatgtcggtgtcgcgcacccagaacgcgtccgaggcgacgatccagaagatcgacgccgagatcaagcggctggtcgaagagggctacaacgaggccaagcgcatcctcaccgagcgtcgcgccgacctcgaagcgctcgccaagggcctgctcgaatacgagaccctgaccggtgacgagatcaccgacctgatcaacggcaagaagccgaaccgcgaatcggtgctggagccgtcgggcccccgcacctcggcggtgccgccggccggcaagccgcggccgcggcccgatccgggcctggagccgcagccccaggcgtaagccgaccggccaacctgacttcgaaaaac

SEQ ID NO: 44295 - DNA, 1491 bp, Rhodopseudomonas palustris
atgaccattctgatgccggagccggatcagtcggtgctggcccgtcgcgacgagatcatcgcggccttgcgcaagatcgtgccgggcgagggcgtgatctccagtgccgcggaaatgaaaccctacgagtccgacggcctgatggcgtatcggcagccgccgatggtcgtcgtattaccgagcacgaccaaacaggtttccgaggtgctgcgctattgccaccagaacggcatcaaggtggtgccgcgtggctccggcacctcgctgtccggcggcgcgttgccgctcgccgatggcgtgctgcttggcctcggcaagttcaaacggatccgcgagattgacttcgacaaccgcgccgtggtggtcgagcccggagtcaccaatctggcgatcagccaggcggtcgatcatgccggattctactacgcgcccgatccgtcgtcgcagatcgcctgttcgatcggtggcaacatcgccgagaactccggcggcgtgcactgcctgaaatacggcatgacaaccaacaacgtcctcggctgcgaaatcgtgctgatgaccggcgagatcctcaagatcggcggcaaggcggccgaatgcgccggctacgatctgatgggcgtcatcaccggttccgaggggctgctcggcgtcatcaccgaagtcaccgtgcggattctgcgcaagccggaaacggcgcgggcactgatgatcggcttccagagcgtcgaggcggccggacagtgtgtggccgacgtcatcagcgccggcatcattccgggaggcatggagatgatggacaagccggcgattcacgccgccgaagccttcgttcatgccggctacccgcttgacgtcgaggcgctgctgattatcgagctcgacggtccgcaggtcgaggtcgatgaactgatcagccgtgtcgaggcgatagcgctcggctgcggctcgaccacctgccagatctccaccagcgagcagcagcggctattgttctggagcggccgcaaggcggcgttcccggcggtgggacgaatctcgccggactatctgtgcatggacggcacgattccgcgcaaacagctgccgctggtgctgcggcggatgaacgagatgtccgagaaatacggcctgcgcgtcgccaacgtattccacgccggcgacggcaatctgcatccgctgatcctgtatgatgccaacaagccgggcgagcaggacgcggccgaagccttcggggcagacatcctcaagctgtgtgtcgaggtcggcggcgtgctgaccggcgagcatggggtcgggatcgagaagcgcgatctgatgccggagatgttctccgacatcgatctcaaccagcagcagcggctgaaatgcgcgttcgactccgaaggtctgctcaaccccggcaaagtgttcccgacgctccaccgctgcgccgagctcggacgcatgcatgtccacaaaggccaattgccgttcccggatattccgcggttc

SEQ ID NO: 44296 - DNA, 303 bp, Rhodopseudomonas palustris
atcaattttcgtcctctccatgaccgtgtcgtggtgaagcgtatcgacgccgaaaccaagaccaagggcggcatcatcatcccggactccgccaaggagaagccgcaggaaggtcaggtgatcgccgtcggcccgggcggccgcgacgagaccggcaagctgaccccgatcgacgtcaaggtcggcgatcgcgtgctgttcggcaagtggtcgggcaccgagatcaagctggacggcgaagaactcctgatcatgaaggagtcggacatcatgggcgtggtcggctgagccgcatcgcgacag

SEQ ID NO: 44297 - DNA, 564 bp, Rhodopseudomonas palustris
acgcttccgaacatcctcacctatgcccgcatcgcggcgatcccggtggtggtcggctgcattttcgctcagtccatcctcggtggaccgctggcgctgcgctgggtggccctggcggtgttcatcgccgcggcgatcaccgatttcctcgacggccatttcgcccggatctgggatcagcagtcggcgttcggccgaatgctcgatccgatcgccgacaagctgctggtagcatcctgcctgctgatgctggcggccgacagcatcatccatggctggacgctgtgggccgcgatcgtgatcctgtgccgcgagatcctggtgtcgggcctgcgcgaatatctcgccgcgctgcgcgtcagcgtgccggtgacgcggctggcgaaatggaagaccaccgcgcagctggtcgcgatcggcttcctgctcgcgggcgaagccggcgacgaggtcctgcccttcaccaccgagatcggcgtatcgctgctgtggctgtcggcgctgctgacgatgtacaccggctacgactatttccgcgccggcattcaccacctgatcgaagag

SEQ ID NO: 44298 - DNA, 972 bp, Rhodopseudomonas palustris
cggatgcgcgacccctatgaggtcctgggggtgcagcgggacgccagcgctgcggcgatcaaaagcgcctatcgcaagctggcgaagaagcatcaccccgacagcaacaagaacgatcctaaagccgccgcgcgcttctctgagatcaactccgccaacgaaatcctcggcgacgagaccaagcgcaagcaatacgaccgcggcgagatcgatgccgaaggcaagccgcgcttccaggggttccctggtggtggcggccgcgcgggcggcgccggtgggttcgagcaatattccttccgcagcggcggcggtgcccccggtggtggattcggcggtgcggctggtttcgaggacatcctgaattcgatgttcggcggcgcagccggcgcgcgcggcgctggtgcgcgtggtcgcacccagggcttcgacttcgataccggcttcgcgcccgacctcgatcaatcggtgtcgatgacggtgacgttggaagaggcgacccgcggtaccgaaaagcgggtgcggctgccgaccggtaaggagctcaacgtcaagattccggccggcgtcagcgcgggccagcagatccggctgaaagggcagggcgagagcgcgcccggtcaccgcgccggcgacctgctgatcaccgtcaacatcgccccgcatccctacttcaagatcgacggcaatgatctgaagctcgagctgccgctgacgttgtacgaggcggtgctcggcgccaaggtccgggtcccgacgctgaccggcgcgatcgaattgtcgatcccgaagaacatctccagcggccggatcttccggctcaagggcaaggggctgccgaaaggcagcgcggtcggcgatctgttcgtcaccacccgcatcattctcccggacggccacgacgccgcgctggagaagctgatgcagaagtggcgggacgaacatccctacaatccgcggaccgaactcggctaa

SEQ ID NO: 44299 - DNA, 762 bp, Rhodopseudomonas palustris
tccggcctgatgcaaggcaaacgcggtgtcattcttggcgtcgccaacaaccgttcgattgcttggggcatcgcgaaagcctgccgcgcccagggcgccgagatcgcgctgacctatcagggtgacgcgctgaagaagcgggtcgagccgctcgccgccgagctcggcggcctggtgctcgggcactgcgacgtcaccgacggcgccacgatcgacgcggtgttcgacgcggtgaaggagaagtggggcaagatcgacttcgtggttcacgccatcgcgttcgccgacaaggacgagctcgacggccgttatgtcgacacctcgccggaaaacttctccaagtcgatgctgatctcgtgctactcgctgaccgcgatcgcgcagcgcgccgagaagctgatgaccgacggcggctcgatcatcacgttgacctattacggcgccgagaagtggatgccgcattacaacgtgatgggcgtcgccaaggccgcgctggaggccagcgtgcgctacctcgcagccgacctcggcgagaagaacatccgggtcaacgccatctcggccggcccgatcaagacgctggccgcgtccggcatcggcgacttccgctacatcctgaagtggaacgaatacaacgcgccgctgcgccgcactgtgacgatcgaggaagtcggcgacagtgcgctgtatttcttgtctgacctgtcccgcggcgtcaccggcgaagtccaccatgtcgattccggctaccacgtcgtcggc

SEQ ID NO: 44300 - DNA, 1077 bp, Rhodopseudomonas palustris
atgtcgttcaataccttcggccatctatttcgcgtcaccaccttcggcgaaagccatggggtggcgatcggctgcgtggttgacggctgcccgccgctgatcccgctgaccgaggccgatatccaaggcgatctcgaccgccgccggcccggccagtcgcgcttcaccacccagcgccaggaagccgatcaggtgaagatcctgtccggcgtgatggtgcatcccgagaccggggtgcaggtgacgaccggcacgccgatcgcgctgttgatcgagaataccgaccagcgctccaaggactattcggacatccagaacaagtttcggcccggccacgccgacttcacctatgaggcgaagtacggcatccgcgactatcgcggcggcggccgctcgtcggcgcgcgagaccgcgagccgggtcgccgccggcgcgatcgcccgcaaggtgattgccggcatgaccgtgcgcggcgcgctggtgcagatcggtccgcacaagatcgaccgtgacaaatgggattgggacgagatcggcaacaacccgttcttctgcccggacaaggataaggcggcgttctacgccgactatctcgacggcatccgcaaatccggctcgtcgatcggcgcggtggtggagatcgtggccgagggcgtgccggccgggctcggcgcgccgatctatgccaagctcgacggcgacctcgccgcggcgctgatgagcatcaatgcggtcaagggcgtcgagatcggcgacggcttcgccagtgccgaactaaccggcgaacagaacgccgacgagatgcggaccggcaatcatggtccggctttcctgtcgaaccatgccggcggcatcctgggcggcatttccaccggccagccggtggtggcgcggttcgccgtcaagccgacctcgtcgatcctgaccccgcgcaagaccgtcgatcgcaccggccacgacaccgagatcctcaccaagggccgccacgacccctgcgtcggcatccgcgccgtgccggtcggcgaggcgatggtcgcttgcgtgctggccgaccacctgttgcggcaccggggacag

SEQ ID NO: 44301 - DNA, 1149 bp, Rhodopseudomonas palustris
atgaccgcaacgaccttcttcattccctctctcaatctgttcggcgccggctgcgtatcgagcgcagcggaccacgccaaggcacgcggcttcaagcgcgcgctgatcgtcaccgacagcgggctgcacaagctcggcgtcgccgatcagatcgcctcgatgctgatcgagcgcaacgtgaccagcgtcgtcttccccggcgcgaagccaaacccgacgatcaagaacgtcgaagacgggcttgcactgctgaagcaggagaactgcgactgcgtgatctcgctcggcggcggttcagcgcacgattgcgcgaagggcatcgcgctgaccgccaccaatggcggcagcatcaaggactatgaaggcgtcgatcggtcggcgcacgctcagcttccgctgatcgccatcaacaccacggcgggcacggcgagtgagatgacgcggttctgcatcatcaccgacgaggaacgccaggtgaagatggcgatcgtcgaccgccacaccacgccgctgctgtcggtcaacgatccggtactgatgctcggcaagccgccggccctgaccgccgcgaccggcatggacgcgctgacgcacgcgatcgaagcctatgtgtcgatcgccgcaacgccgatcaccgacgcctgcgcgctaaaggcgatgtcgatcatctccaacagtctgcgcaccgtggtcgccgagggccagaacctcgtcgcccgcgaggcgatgtcgtatgcgggcttcctcgccggcatggcgttcaacaacgcctcgctcggctatgtacatgcgatggcgcaccagctcggcggcttctacgacctgccgcacggcgtctgcaacgcggtgctgctgccgcacgtgcaggcctacaacgcgcaagtcgcggcgggacggctgaaggacgtcgcccacgcgctcggcgtcgacaccaccggcatgaccgatgcccaaggcgccgatgccgccattcatgccatccaacggctatcggccgatgtcggcattccgcccggtctcggcggtctcggcatgaaggaaaccgacgtgccgatcctcgccgccaacgcgctgaaggatgcgtgcggcttcaccaatccgaagcaggcgacgcagaccgagatcgaaaccatcttccgggcggccgcc

SEQ ID NO: 44302 - DNA, 1476 bp, Rhodopseudomonas palustris
ttcaaggcccgctatggcaacttcatcggcggccgctgggttgcgccggtcgatggcagatacttcgacaacaccacgccgatcaccggcgcaaaactgacggaaattccgcgttcgcagaaggaagacgtcgaactcgcgcttgatgcagcgcacaccgcgagcgtcacctggagcaagaccacgacgacagaacggtcactcattctcaatcgcatcgccgatcggatggaagccaatctcgatctgctggcgatcgccgagacgctcgacaacggcaagccgatccgcgagacgcgggccgccgacctgccgctggcgatcgatcacttccgctatttcgcaggtgcactgcgcgcgcaggaaggttcgatctcggagatcgatcacgacaccatcgcgtatcacttccacgagccgctcggcgtcgtcggccagatcattccgtggaacttcccgttgctgatggccgcctggaagctggcgccagcactcgccgccggcaactgcgtggtgctgaagcccgccgagcagaccccggcctcgatcctggtatgggccgaactggtcggcgatctgttgcctcccggcgtcgtcaacgtcgtcaacggcttcggcgtcgaagccggcaagccgctggcgtccagcccgcgcatcgccaagatcgccttcaccggcgagacctcgaccgggcggctgatcatgcaatacgccagcgagaatctggtgccggtgtcactggaactcggcggcaaatcgccgaacatcttcttcggcgacgtcacggccgaagacgacccgttcttcgacaaggcgatcgaaggcttcgtgatgttcgcgctcaatcaaggcgaagtgtgcacctgcccgagccgcgcgctggtgcaggaatcgatctacgatcgcttcatggagcgggcgctcgcccgcgtcgccgcgatccggcagggcgatccgcgcgatccggcaacgatgatcggtgcgcaggcgtcgcaagagcagctcgacaagatcctgtcctacatcgacatcggtcggcacgaaggtgccgaactgctggccggcggcgggcgggcgcagctgcccggcggcctcgccggtggctactacgtgcatccgaccgtgttccgcggccacaaccagatgcggatcttccaggaggagatcttcggccccgtggtgtcggtcaccaccttcaaggacgaagccgaggcgatcgccatcgccaacgacacccagtacggactcggcgcaggcgtctggacgcgggacggcactcgcgcctatcggttcggacgcgccatcgctgcgggccgggtgtggaccaattgttaccacgcctatccggcgcacgccgccttcggcggctacaagcagtccggcatcgggcgtgagacccacaagatgatgctcgatcactatcagcacaccaagaacctgctggtgagctacggcaccggcccactcggcttcttc

SEQ ID NO: 44303 - DNA, 1590 bp, Rhodopseudomonas palustris
cgccagcacggcgatgccgtggtgttgcgctggaagcgctacgggttgtggcagccggtccgcggccgacaattcgcggatcgcatcgaggcgatcgccgccggcctgcgcgcccaaggcgtcggccccggttcggtcggcgcggtgatgggcgacaattgttacgagtgggtgctggcggatctggcgatcggcgctgccggcggtgtctcagccgggctcgatccgcacggcgacgccgatgatctcgcgcgcgtgctcggcgactgcaaggccagcgtgttgttcgtcgccggcgacgaccaactgcacaaggcgctccgcgtccgcgagcgctgcccgtcgctccggcgcattgtcgcgatgcatcaacagtgggacgatggcgccggtgatcccggcgtgatcccgctgtcggcactcgaagctgcgggacgggacggcgcctcgggaacggcaggccgcgaggccgtgatcatctacacctccggtagcactggcccggttcgcggggcgatcctcggccatgatgcggtaatcgtgcaggccgagcgggcgaagcaggcgctgggattgcgtgccagcgatgagcggctgtcgctgacgccgctgcaccacgtgctggagcgggtcgtcggcatctacgcctcgctgctcgccggcacggtgatcaattttccggaaagtccggacacggcgctggccgacctcgccgaactgcagccgaccatcgtgcaggcttcgccgcagctgttcgccaggctgcacgccggcatcatgctggcgatcggcgaaaccacgaagtttcagcgttgggcttgccgcatcgcgttcgcccgtggccgtggcggctcgccactacgcctcgtcaccgatcccttggtgttggcgccgatccggcgacgcctcgggctcggccgcgcccggctctgcctatcgagcggggcggtgctgcggcccgatgtggccgattggttcgccgcgctcggccggccgctgacggatatctatggccatgctgaagccggcggcgccgtgcggattgccgatcatcacgcgatggagtggaagctcggcgaccatgacgaactctggctgcgcggcgacgcactgttcctcggctatgcgggcgacaccacgcctgtcctacatcgcgacggatggtggcacaccggcgacatcgcccgccgtgagagcgcggatcgttacgctatcgtcggccggctcgaggacgtgctgcagcggggcggcgagcgcgtgctgccgttcgctgccgagcaggcgctcagcgcatcgccctacatcgccgatgccttcgtgtatctcgacgccgccggccgcgccgtggcgcgggtgctgctcgatagcgaccacgcggtccgctacgcacaggaccgcggcattccgttcacgcacttccagagcctgtgccaggcggacgagatccgcgcgctggtcggcgaggccatcgccgacgtcaaccgccgccacaccgcgatccgcatcgagcatttcacgctgatcgagcgcgcgctgcgcgcgggcgatgccgagctcgcgccgtcgggaacgctgcggcggcatctgctg

SEQ ID NO: 44304 - DNA, 2364 bp, Rhodopseudomonas palustris
atggatctcacgcccagtgacgaacagcggctgctgcgcgaaagcgccgaccgcttcatcgccgagacctacacgacgaagctgcgcgagcagaacgccaaggagccgttcggcttcagcgaagcgatctggaagcagttcgccgatctcggctggctggcgctgccgctgcccgaggcgcatggcggcatcggcggcggcgcgatcgaagtcggcatcctgatggaagcgttcggccgcggcctcgtcagcgagccgtatctgtcgaccgtggtgctcggcgccggactcgtcgccgaacacggccgcgacgagcagaaggcggcgctactgccacagatcgcggaaggaacgttgcggctcgctttcgcgcatgccgaacgcgccgcgcgcgcggatctatcgcgcgtcgacaccaccgcgcgcaaagacggcgatcactatgtgatcgacggcgccaaagttgcggtgctggacggcgcctcggccgatcagctgatcgtctcggcgcggctggcgaacaacggcagcggctcgctgcggctgttcctggtgccgcgcgacgcggcggggctatcactcgccgactatccgcggctcggtggcggacgggcatgcaatctgacgctgcaagtcgtgcgcgtcccggccgacgcgatgctcggtactgacagcgatgcgtatccggcgatcgaggccgtggtcgatcgcgccctcgcggcgatgtcggccgaggcagtcgggatgatgcagacgctgaccgacaagacgctcgactacaccaaagttcgaaaacagttcggccggccgctcgccgccaaccaggtggtgcggcatcggctgaccgacatgtcggtgcaggtcgacgaagcccgctcgatggcgctgcgtgcggctctgaaggcggatgccgaggccaccgagcgtggccgcgccgcctccggcgccaaggccaagatcggcaagggcgcacgcttcgtcgccgagcagtcggtgcagcttcacggcggcatgggcgtcaccgaggaactcgacgtcggcgcatatttcaaacgcctgctggcgttcgagacgctgttcggcggcagcacccatcactatcgccgccatgccgcgctcagcggccggcctgtttaagcaaagcgaggcatcgacatggacatgaccttcggcgacgccgagctcgcctttcaacaggaagtccgcgatttcatcgcggcgaatctgacgccggacatgaagcgggccgagtcgctcaacgcctcggtgttctccgagccggagaccggcgtgccttggcaacgcgccctcaacgccaagggctggggcgcgccgggctggccggtcgaatatggcggcaccggctggacgccggcacagcgctggattttcgaaaccgaatgcgcccatgcgggcgtgccctccccgacgccgatgggcgtcaagatggtcggccccgtgatcatcggcttcggctcgccggagcagaagaactacttcctgccgcggattctgtcctgcgaggattattggtgccagggctattcggagccgggctcgggctcggacctgtcgtcgctgaagacccgtgcggtccgcgacggcgatgagtacgtcatcaacggcaccaagatctggaccacccacgcgcacaacgccaacatgatgttcgcgctggtgcgcaccagcgacgagccgcggcagcaggatggcatcagcttcgtgctgatcgacatgaagagccccggcatcaccatccgcccgattctcacgatcggcggcgaccacgaggtcaaccaggtgttcttcgacgacgtccggattccggcgtcgaacttggtcggccaggaaggcaagggctggacctacggcaagtatctgctggaattcgagcgtggctcgggcatcgcctcggcgaagctccgcaaggcgctgcaccggacggcagcgctcgccgagtcggaagcgaccggccgggcgatcgaggatccggagatcgcgatccggatgtcggaggccgaggtcgatatcgacgcgctggaaatgaccgaactgcgggtgctgtcggcgctgcagaacggccagaaccccggcgcggtgtcgtcgatcctgaagctgcggaccagcgagatctaccaggcagtgagccggctcggcgtcgacgtcatcggcaccgatggcctctatgtcgagccgacccgcccgctgcaccggctcaacgcccagccggcgattccggagaatgaactcgccgtgatgccgacgcatctcaacggccgcgcctacaccatcttcggcggcacctccgagatccagcgcgacatcatcagcaagctggtgcttgggctataggcgcgaagtcca

SEQ ID NO: 44305 - DNA, 813 bp, Rhodopseudomonas palustris
cggcgccataagccgagacaataagaaaagggaggatggatgagctcctacgagacgatcctggtcgagcgaccggatccggcggtcgcacgaatcgtgatgaaccgtcccgacgcgcgcaacgcgcaaaatctgcagatgacctacgacctcaacgccgcgttcgacgacgcggtgcaggacgacagcgtcaaggtgattatcctggccggcgccggtccgcacttctccgccggccacgatctgcgcgcgaccaccaagaatgaagccggtatcgactttccgccgatcggcgcctggggcgggtttcgcgagccgggcgcgcacggacggatggcacgcgagcaggagatctatctgcagatcacccggcggtggcgcaatctcgccaagccgaccatcgccgaagtgcacggcaagtgcattgccggcggcttgatgctggcctgggcctgcgacctgatcgtcgccgccgactcggccgagttctgcgatccggtggtgacaatgggcgtgtgcggcgtcgagtggttcgtgcatccctgggagctcggcccacgcaaggccaaggagttgttgttcaccgccgatagctggagcgcgcaagaagcccatcagctcggcatggtcaatcacgtggtgcctgccaccgaactatccgctttcaccatggcgcttgcgcaacgtatcgccgccaagccgagctttgcgctgaagatgaccaaggaagcggtcaaccgctcggtggatatccaggggcagccggccgcgatcgatcaggcgttcgcgctgcatcagctttgtcacgctcat

SEQ ID NO: 44306 - DNA, 1458 bp, Rhodopseudomonas palustris
cccgatcgcacggctttcatggtcgatggcgtccgcctcacccaccgcgactatctggcacgggccgagcggctggccagcggcctgctccgcgacggcgtgcacaccggcgaccgggtggcgattctgtcgcagaattgcagcgagatgatcgagctgatcggcgcggtggcgttgatcggcgcgatcctgctgcccgtaaactatcggctcaacgccgacgagatcgcctttgtgctcggcgacggcgcgcccagcgtggtggtggccggcaccgattatcgcgacatcgttgcaggggtgctgccttcgctcggcggcgtcaagaaagcctacgcgatcggcgacggtagcggaccgtttgcgccgttcaaggatctcgcctcggacacgccgttcagcgccccggagttcggcgctgccgacggcttcgtcatcatccacaccgcagcggtgggcggccggccgcgcggcgcgctgatctcgcaagggaatctcttgatcgctcaaagctcgctggtcgacgcatggcggctgaccgaagccgacgtcaatctcggcatgctgccgctgtttcacgtcaccgggctcggcctgatgctgaccctgcaacaggccggcggcgcgagcgtgatcgccgcgaagttcgacccagcgcaggccgcacgcgacatcgaagctcacaaggtgacggtgatggccgagttcgcgccgatgctcggcaacattctcgatcaggccgcgccggcacagcttgcgagcctgcgcgccgtgaccgggctcgacacgccggagacgatcgagcggttcgaggccacctgccccaatgcgacgttctgggcgacgttcggccaatcagaaacctcggggctctcaacttttgcgccctatcgtgaccggccgaaatccgccgggcgccccctgttctggcgcaccgtcgctgtggtcgatgcggaagatcgcccgctgccgccgggcgaagtcggcgagatcgtgctgcgcggcccgaccgtattcaaaggctactggaacaatgcggccgccacccagcatgcgttccgcaacggttggcaccataccggggacatgggccgattcgatgccgacggttatttgttctacgccggccgcgcgcccgaaaaggagctgatcaagaccggcggtgagaacgtctatccggccgaggtcgaaggcgcactaaagcagcatccagcgatcgccgacgcggtggtgatcggcgtgcccgatccgcaatggagcgaagcgatcaaagcggtgtgcgtgtgcaaaccaggcgaaagcatcgccgcagacgccctcgccgaattcgtcgcatcgctgatcgcgcgctacaagaagccaaagcacgtggtgttcgtcgaggcgctgccgaaggatgcgaagggtgctatcgatcgggccgcagtgaagacagcgcacgggcaggcctgacgccgg

SEQ ID NO: 44307 - DNA, 1296 bp, Rhodopseudomonas palustris
atcgtcggtgtggtgagctggctgttcgtgctggcgcggctcagccggcaggcagccgaagccgagacgcggcgacaaacccagctgctgatgcaggagatcgacgcccaccgccagaccgacgccgagctgcagcgcgccaaagaagcggccgagtccgccaacctcgccaagagccgctacgtcgtcggcctcagccacgagctgcgctcgccgctcaatgcgatcagcggctacgcgcagctgctcgaacaggacaacactctgccgccgcggccgcgtgaccagatccggctgatgcggcgcagcgccgaccatctctccggcctgatcgacggcctgctcgacatctccaagatcgaagccggccggctgtatctgtcacgcgacgaggtgcggttcggcgaatttctcgaccagcttgtcggcatgttccgactgcaggccgccgccaaggacatcgaattcgtgttcaagcggccgcaatatctgccgccgatggtctatgccgacgagaagcggctgcgccaagtgctgatcaacctgttgtcgaacgccatcaagttcacccaggaaggcagcgtccacttcatcgttcactatcgtaacccagtggccgaactcgaagtgcgcgatacgggccccggcatccataccgacgacctcgagcgcatctttgcgccgttcgagcgcggcgcgctcggcgcggcacagccgcacagcggtaccggcctcggcctcaccatcagcaagctgcttgcgggcgtgatgggcggtgacctcaccgtcacctcgacgcccgataagggctcgaccttccgcgtcaagctgctgctatcggaggtcacaaacccgacccgcactcgctcgatccgcgctccggtgctcggctatcacggcccgcgcaagaccatcctggtgactgacgacgatccggcgcagcgcggcctgctgcaggatgcgctggcgccgctcggcttcatcgtgctggtcgcaaccgacggctattcctgcatcgatctcgccgagcattgccaacccgatctgttcttgctcgacatctcgatgccggggatggacggctggaccgtggcggagacgctccgcacccaaggccaccatcacgcgcgcatcctgatgctgtcggcgagcgcgctggaggcgcacggcacgctgctgtcgcagccgttccacgatgcctatctgatgaagccggtcgacattccgcggctgctcgaactgatcggccagctgctcaacatcgattggatctacaagggtgaggctaccgccact

SEQ ID NO: 44308 - DNA, 2655 bp, Rhodopseudomonas palustris
tggcacgcgatcgatgccgaccgcgttctcaccggcctcgccaccagccgaggcggcctcagcaccgaagaggccaaacgccggctgcagagctacggacccaatgcgctgccagagccgccccgccgctcggcgattctgcggtttctgtcacagttcaacaacacgctgatctacttcctgctcgccgccgcggtcgcagccgcattcctcggccaccagatcgatgccgcagtgatcgtcgcggtggtgacgatcaacgccatcgtcggctacattcaggaagacaaagccgaaaaggcgctggccgcgatcaagaagatgatctcgccgcgcgcgcatgcctggcgtgacggccaccgcgtcgtgttgccagctgaagaactggtgccgggcgacgtggtgatgatcgaggccggcgatcgcgtgccggcagatttgcggctgacgcgcgcccgcggcctgctgatcgacgaggcgatgctgaccggcgagtcggtggcatccgaaaagcacgaccagcccgcggcggtggatgtgccactcggcgaccggctgtgcatggggttctccggcacgctggtgtcggccgggcagggcttcggcgtcgtggtggcgaccggcgcacgcaccgagatcggccgcatcagcacgatgatccagggcgtcgagcaactggcgacgccgctgctcgcacagatcaacaagtttggtgagcgcttcacctgggtggcgatttcggcggcggcggcgatcttcgccttcgccacgctggtgcgcgactatgcctgggccgatgcgctgatcgctgtggtggcgctcgcggtcggcgtggtgccggaaggcttgccggcggtgatcaccatcacgctggcgatcggcgtgcagcggatggccaagcgcaacgccatcatccgccgcctgccggcggtggagacgctcggcgccacctcggtaatctgctccgacaagaccggcacgttgacgcgtaacgagatgaccgcgcgtcgcatcgtcaccgccgatcacaccattctggtcagcggctccggctacgtgccgaagggtgacctcaccgtcgacggtaaggataatcctgaagcggtgtcgtcggcgatgcagctcgttcgctccgcactgctgtgcaacgacgcgcagctgcgcccggtcgatggtcactacgtggtcgacggcgatccgatggagggcgcgctagtcgcactcgcaatcaaggccgggctcgatcccgacaccgagcgggccgcgtggaagcgctccgacgagatcccgttcgatgcgcagcatcgcttcatggcgacccgccacgccaccgattccggcgcgcaggtgatcttcgtcaagggcgcgccagagcggcttctggcgatgtgcgcaactcaagtcgggcccggaggcgcattgcatccgatagatcaagaattctggaccgcgcagatcgcgcgtgcggcggccgaaggcgagcgtgtgctcggctttgcgctccgttcgccggcgcggccgtccgaccagctcggatttgccgatctcgacgaggggctggcgttcatggggctggtcggcttcatcgatccgccgcgcgatgaggtgatccaggcgatcgccgaatgccgctcggccggcatcgtggtgaagatgatcaccggtgatcacgccgcgaccgcggaggcgatcgcgcggcagctgaacctgaccgaccatcccgacgtcgtcacaggggccgatctcgaccgcaccccggattccggcttcgtcgaactggcgcggcgcaccgatgtgttcgcccgcaccaacccggagcataagctgcgcatcgtgcaggcgctgcagtccaccggcgcagtggtggcgatgaccggcgacggcgtcaacgacgcgccggcgctgaagcaggccgatgtcggcatctcgatgggccacaagggcaccgagacagccaaggaagcctcgcaggtggtgctgctcgacgacaatttcgtctcgatcgtcgccgcggtgcaagaaggccgcacggtttacgacaacatccgcaaagtcatcgcctggacgatcccgaccaacggcggcgaggtgctcaccgtcatcgtcgcgatcctcttcggcttcaccatgccgatgacgccggtgcagatcctctggatcaacctgatcctcaccgtcacgctcggcctcgtgctggcgttcgagccgccggagcctggcgtgatgaagcggccgccacggccggcgcacgcgccgctgctgtcgcgcttcttggtgtggcggatctttttcgtctcgttcctgttcacggtcggcgcgctggcaatcttcttcttcgcgctcggcaagggactgtcgctcgacaccgcccgaaccatggtggtgaacgtgcttgtggtgttcgagatcttctacctgttcaacgtccgctatctgcacaccagctcgatctcgctgcgcggcgcgctcggcaccatgccggtgctggccgcgcttgtcgtggtgatcgccgcacagctcgccttcacctacgcgccgttcatgcacagcctgttcgccaccacgccgatctcgctggtcgacggcgccgtggtgatcggcgccggcgtggtgctgatgatcgtgctcgaactcgaaaaattggtgatgcgcaaa

SEQ ID NO: 44309 - DNA, 1566 bp, Rhodopseudomonas palustris
tacggctggggtcgggaaggcgaggggatgaacgaggccgagcaggccttcgtgctcggccgctacaaggcgaagttcggccgcgacagcttcgacaccgtcgaggtcgcgcacctcgacgacatcaagctgcgcgaaccgcggatcgtgccgccgaaatcactgtcggaaatctgcgcggttgacgtctatcatcgcgccgcccacgcctatggcaagtcctatccggactacgtccgtggcatgctcggcgactacgacgcggcgcccgacgtcgttgcctatccgcgtgacgaggccgagatcgcggcggtgatggattgggccggtggagccggtgcagcgctgacgccgttcggcggcggctcgtcggtgtgcggcggcgtcgaatgccgggtcgatggcaaccgccataaggcggcggtgacgctcgacctccgtcatctcggcaaggtgctggaggtcgacgccacctcgcgcgctgcgctgatccagggtggtgcttacggccctgcgctcgaggcgcagctcaagccgcataacgtcacgctgcggcacttcccgcagagcttcgaatattccacgctcgggggctggatcgcgacccgctccggcggtcactacgccagcctctatacgcatatcgatgatttcgtcgaaagcgtccgcgtggtgacgccgcgcggcgtgctcgagacgcggcggctgcccggctccggcgcagggccgagcccggaccggatgttcatcggctcggaaggcatcctcggcgtgatctcggcagcgtggatgcggctgcaatcgcgccccaggtttcgcgccggcgcctcggtgcgcttcccgtccttcttcgccgcggcgcgcgcggttcgcgcggtggcgcaggctggcctgtatccctccaactgccgcatcctcgatccgcaggaggcgtacaacacgggcgcggccgacggcagcgttgccattatggtgctggcgttcgagagcggcgatcatccggtcgagccgtggatggcgcgggcgctggaatgctgcgctgatcacggcggcatcagggaagaggcagaagcctcgtcaggacatctcgaaggcgccgccgggctgtggcgcaacgccttcatccggatgccttatgcgcgcgaattcctcactcccgccggtctgatcaacgacactttcgagacgtcgattacctgggagcggttcgagagcttccacgacagcgtcaagaccgtgaccgaacaggcgatcctcgatgcgaccgggatcaagggcgaagtcacctgccgcttcacccacgtgtatccggatgggccggcgccgtacttctcgtttcatgcgctcggccggcacggagagctgctcgagcaatggcaggcgattaaggatgcggcgagtgacgcgctgatcgcagcgggtggtaccatcacccatcaccacgcggtggggcgcgatcatcgcaaatggtacgaccgccagcggccggacttgttcgccgttgcgttgcgcgccgccaagcgcgagctcgatccgcaggcgatgctcaatccgggagtgctgatc

SEQ ID NO: 44310 - DNA, 1098 bp, Rhodopseudomonas palustris
ggcttcggcctcggcgcagagggccacgccgttggcgaggtctgcttcaacaccgcgatgaccggctacgaggagatcctcaccgatccgtcctacgccgggcagctcatcaccttcaccttcccgcatatcggcaacgtcggcaccaacgacgaggatatcgagacggtgaacatggcggcgacgccgggcgcgcggggcgtgatcctgcgcagcgccatcaccgacccgtcgaactatcgctcgtcgcgccatctcgacgcctggctgaaggctcgtggcatcatcggcctgtcgggcatcgacacccgtgctctgactgcgctgatccgcagcaagggcatgcccaatgcggtgatcgcgcattcgcccaccggcgagttcgacctgcacgcgctgaaggaagaggcccgcgagtggcccggcctggaaggcatggacctggtgccgatggtcacctcggcccagcgcttcacctgggacgagacgccttgggcgtggggcgagagcttcggacggcaggacaagcccgagttcaacgtcgtcgcgattgactacggcatcaagcgcaacatcctgcggctgctggccggcgaaggctgcaaggtcaccgtcgtgcccgccaccacttcggccgaagacatcctggcgatgaagccggacggtgtgttcctgtcgaacggcccgggcgatccggccgcgaccggcaaatacgcggtgccggtgattcggaaggtgatcgagactggcgtgccgaccttcggcatctgcctcggacaccagatgctcggcctcgcgctcggcggcaagaccgtgaagatgcatcagggtcaccacggcgccaatcatccggtcaaggatctcaccaccggcaaggtcgagatcacctcaatgaaccacggcttcgcagtcgacaaatcgacgctgccggccaatgtgcagcagacccacatctcgctgttcgatgacagcaactgcggcatcgcgctggccgacaaaccggtgttctcggtgcagtaccaccccgaggcatcgcccggtccgcaggactcgcactatctgttccgccgcttcaccgatctgatgcgcgcgaagaaa

SEQ ID NO: 44311 - DNA, 984 bp, Rhodopseudomonas palustris
atcgaagccggcgagatcgagccgctgcagccgtcgtcctccgaattcatcgagaaggcttcgggcatcaagtcgcgctacgtggtggccaagccgggcatcgtcgatccggacgtgatgcgcccgatcatcccggagcgctccaacgacgaattgtcgatcctcgccgaaatggcggtgaccgcggccgaacaggcgatcgaacgctggggcaagccgcgcgagcggatcggcgcggtgctgtgcgcctgctccaacatgcagcgcgcctatccggcgatggcgatcgaggtgcagaacgcgctggggctcggcggcttcgcgttcgacatgaacgtcgcctgctcgtcggcgaccttcgggctgaagaccgcggcggatttcgtcggcggcggctcggtcgatgcggtgctgatggtcaatccggagatctgctccggccatctcaacttccgcgaccgcgacagtcacttcatcttcggcgacgtcgccaccgcggcgatcgtcgagcgcgccgacgatgcgcaaggcggctggtcgatcctcggcaccaagctgaagacgcagttctccaacaacatccgcaacaacgccggcttcctcaaccgtgcctggccggaaggccgcgacaaggccgacaagctgttcgtgcagcagggccgcaaggtgttcaaggaagtggtgccgctggtgtcggagatgatcatcgagcacgcccgcgagatcggcatcgatccgcacgggctgaagcggatgtggctgcaccaggccaacatcaacatgaacgagatcatcggccgcaaggtgctgggccgcgatccgactcgcgacgaaaacgtcatcatcctcgacgactacgccaacacctcgtcggccggctcgatcatcgccttccacaagcatcaggacgacatggcgcaaggcgacctcggcctgatctgctcgttcggcgccggctactcggccggcacggtgttcgtgcag

SEQ ID NO: 44312 - DNA, 624 bp, Rhodopseudomonas palustris
atcgatcgcgcgggcgtggcgaaagcctacgcgcgctgggcgccgatttacgatctggttttcggcaaagtgttcgacagcggccggcaatcgaccatcgcggtggccgatgcgatcggcggacgggtgctcgacgtcggcgtcggcaccgggttgtcgctgtcggattattcgaagaccacgcggctgtgcggtgtcgatatttccgagccgatgctgcgcaaggcgcatgagcgcgtccgcacgttgaacctcagcaatgtcgacgtgctcgcggtgatggacgccaagaacctggcgtttccggccaattacttcgacgccgtcgtggcgcaatacgtcatcaccgcggtgccggacccggaagccacgctggacgatttcatccgcgtgctgaagccgggcggcgagctgatcctggtcaaccacatcggcgccgagagcgggccgcgcaagctgttcgagctggcgttctcgccgatcgcgcgccggctcggttggcggccggagtttccgtggcagcggctggtaaactgggcggcacgccatcgcggggtggaacttgccgagcgccggccgatgccgccgatgggccacttctcgctgatccgctatcgcaaactg

SEQ ID NO: 44313 - DNA, 1371 bp, Rhodopseudomonas palustris
cagcgccgcgaattcgacagcatgggcagcgtcgacgttccggcggatcgttattggggcgcgcagacgcagcgctcgttgcagcatttctcgatcggcggcgaccgcatgccgaaagcggtgtaccacgcctatggctacgtcaagaaagcctgcgcgctggtcaaccacgccgcgggccggctgccggcctggaagaccgaggccatcgtccgcgcagccgacgagacgatctcgggcgcgctggacgatcactacccgctgttcgtttggcagaccggctccggcacccagagcaacatgaacgtcaacgaagtcgtctccaaccgggcgatccagctgctcgggggtacgctcggcacgcagcagccggtcggccccaatgacgacgtcaatatgggtcagtcgtcgaacgacaccttcccgaccgccatgcacatcgcggcggtgacagcgatcgacgatcaggtcgtgccgcggctttccaagctgatcgagattatcgaacagaaagccgacggctggatggacgtggtcaagatcggccgcacccatctggaagacgccgtgccgctgacggtcggccaggaatggcacggctgggccggtcaattgcgcgacgcccgcgatgcgatcgaagccagccgcgccggcctgtatcagctcgcggtcggcggcaccgcggtcggcaccggcctcaacgcccccaagggcttcgctgccgacgttgctgccaggatcgccgagctgaccggcaagccgttcgtcaccgcaccgaacaagtttgccgcgcagggctcgctcgacgcgatggtccgcgcccacggcgcgctgcgcgatctcgcggtggcgctgatgaagatcgccaacgacatgcgctggctcgcttctggtccgcgctgcggcttcggcgaattgctgctgccgagcaacgagcccggctcctcgatcatgcccggcaaggtcaacccgacgcaatgcgaggcgatggtgatgatctgcatccaggtgatgggcaacgacagcgccgtcgccttcgccggcagccagggcaatttcgaactcaacgcgatgcggccggtgatcatcaacaacttcctgcattcggcgcgcatcctcgccgacggctgtgagaagttccggacctattcggtcgagggcaccgagctcaaccgcgatcgtgtcgcgcagtacgtcgaaggcagcgtgatgctggtcaccgcgctgtcaccggtgatcggctatcagaacgccgcgcatatcgccgaagatgcgatcgccaagaatctcacgctgaagcaggcggcactcgcctccggcaaggtcgacgaggcgacgttcgaccgcatcgtccggccgatcgacatggtc

SEQ ID NO: 44314 - DNA, 2224 bp, Rhodopseudomonas palustris
ccgccgacccggccgcggccggagtagcgtccgatggcgagcgtgccggcgagcggcaccgtattctgggtcagcttgtagccgtcggtgacgccgtcgggacgcgcatcggtctggcgcgtgccggtgatcacttcggcgacgatgctaccttcgaacacgctggtcggtgccgacaggacaagccggccggcgtcgcggccgatcgtgtagccctcgtcccagcgcgatgtcgttgcgccgtggctcggactgccccagacgtccttgacgccccagcgcgaatggtcgaccgtgaagctccggccgagcgcgatgatcggcatgccggccggcacgctgccgatcggatacaaccgcccgtcggcgccgagcacattggtggtgagtacctgccccgcctgataagtaatcgtgccgcccgacaggttgaacaccgagccggcctgcgccaccagctcggccgcgctcagcgtgatgacgccgccgactgcggtccactcgccgatcgtatgcccggtgttggccagatagccggagacctcgagcaacccgcctttggtgtagtaacggtccgacgcatagccgccggtgccggccggcaccagcaccaggtcgcgcgcgtcgatccagacgtccttgctggtgagcaccccggagtcgcgattgaccggcgcgtcgcgcatctcgttgggctggatgttgatcttcaggctgttggccgacatcggcagcgcgctcgaggtaccggagacgtcgagcacggcgttgtttgcggtgaacacgcggcctgcggcgctgaccgcgatctggccgccctgcgccagcgtcagcgagccgccgtcgaatttcaccacaccgccgctgacgatctcgacgcggccgagatccaggcggtcggcgaggctggagagattgtcgaactggccgctgccggcaccgacgcgcgaatttgccgtcagggcatcgcgctgagagttgagcgcggtgtcggcgctgccgagttcaggcatgatctgggtcagcgacgccgcaccgagggtgacgctgccgctcccatccgaagccgcattgagcagatggatggtgccgcggacgtcgaccgaagtagtggcgatggcgacgccgctttgtgtcaccgcgtgaccggccagcgtgatgtcgccctgctgggcgaagacgagaccgctgttacgcactgcaccgccgcccggcgtccaactgttgctgccggcgttccaaagtccgggcgcgacctcgctgccgcgcgtggtcgagacgctgttggcgtcggtggcgtagcccttgcggatgacgaagtcgcgccccgccgccagcacggtctggcccttgggcgtggtgatcgagccggcgttgtcgactttggcgcccagcagcatcacgaagccgccgccttgcgtcactgcgccgggcgcgcgcgtggtgatcagcgcgccctgctccaccacgattgatcctccagcaccggtgaaactcggcgtgtagctcgtgcccgatacgttcgaatagatgccgttcgccttgaactgcgcgtcggagatcaacgccgcagacgcgatcaggctgccgacattgatctggctggcgccgccgaagatgatgccgttctggttgatgacatagacctgtccgtcggcctggatgcggccgaggatttggctcggcgacgacgcaccgacgacgcggttgagcgcgacccaattgctgttgccctgctgatcgaacaccaggctggtatttgctccgacattgaagctcgaccagttgaggatcgctcgggcgccggtctgctgcacggtcaccgtcggcgcatcgctcggtccgctctgcaccggcgtgcgcgcgctgatccaactcagcaccggattggcgacgcccggcgccgcaagcccggaatccggcacaagtcctccagccgccagaccgttcggcacgaccaccggcgccgtgaccgacacccccgccgcctgcgcggccgcgcgcgccgccgcctgtgccgcctgcacaccctgcagcgcctgcgccgcctgcgtcagcgactcgatcgagcgctgtgccgccgcgctgccctgctgcgccgctgccgtcgccgcagccgccgcggctgcagccgccgaataatccggcgacgctccaccacccagcgaacgcgccagcgccggcgtcgaggccagcagcagcgtcaacgccagcgcgctggtgc

SEQ ID NO: 44315 - DNA, 1476 bp, Rhodopseudomonas palustris
accaagcgcaacgtgctgttcatcatgtgcgaccagctgcgatacgactacctcggcgtatccggccatccgcgattgaagaccccgaatatcgatgcactggcgcaacgcggcgtccgcttcgtcaatgcctatgtgcagtcgacgatctgcggcccgtcccggatgagcacctataccggccgttacgtgcggtcccatggttcgacctggaacggcatcccgctgcgggtcggtgaaccgaccctgggtgatcatctcaaagagatcggcgtccgtaacgtcctggtcggcaagacccacatggtgccggatcgcgagggcatggcgcggctcggcatcgtgccggattcgctgatcggcgttcacgtctcgcaatgcggcttcgagccgtacgagcgcgacgacggtttgcatccggacggtccgtacgatccggcgccggactacgatgcctatctgcgcagccagggcttcgacgccgacaacccgtgggaggtgtgggcgaattccgccgagggcggcgacggcgaactgctcagcggctggctgctctcgcatgccgacaagccggcgcgcgtccccgatgaacattcggaaacgccctatatcacccgccgggcgatcgagttcatcggcgaggcggaagccgatgggcggccatggtgtttgcacctgtcatacatcaagccgcactggccctatatcgtgccggcgccgtatcacgatcgctacggtgtagacgacgtcctgccggtggtgcggtccgatcgtgagcggcagcacccgcatccgatcttcgccgagtttcagcacgagcgcgtgtcgcaggcgttctcgcggccgggcgtacgtgaacgggtaatcccggcctatatggggttgatcgaacagatcgacgaccaactcgggctgctgttcgcttatctcgacgaacgcggactgaccgacgataccctgatcgtgttcacctccgatcacggcgattatctcggcgaccactggctcggcgagaagcagatgtttcacgacgtctcggtgaaggtaccgttgatcgtggtcgatccgtcgcctgcagccgacgctacgcgcggcacggtttcggaggtgctggtcgagcagatcgatctggcaccgaccttcctcgattatttcggcggccggcccaagccgcacattctcgagggacggtcgctgctgccgctgctgcgcggcgagcgcgttgaaaactggcgatcctacgtcttttcggaatacgactacgcactggatcgcgcccggatcaagctcgggacgccggtgcctgattgtcggctgacgatggtggccgatggtcgctggaaggcggtgttcgtcgagggattccgcccgatgctgttcgacctcgacaatgacccgcacgagttcgacgatcttggtgacagcgaagatcatgccgaggtgcggcaacgcctgtccgatgcgttcttcgcctgg

SEQ ID NO: 44316 - DNA, 1395 bp, Rhodopseudomonas palustris
atgcctatggtacttctgaagtgcgacaaggacattccagagcgcgaaaagcacatctacctgaaagtggatggtgaagacacgcgcgactacctgccagtttcaaacgcgccgaccattccgggcaccctgtccgaacgtggctgcgccttctgcggcgccaagctggtgattggcggtgtcctgaaggacaccattcagatgatccacggcccgatcggctgcgcctacgatacctggcacaccaagcgctatccctcggacaacggccacttccagatgaagtacgtctggtcgaccgacatgaaggaaagccacatcgtgttcggcggcgacaagcggctggagaagtcgatccacgaagcattcgacgagatgccgcacatcaagcggatgatcgtctacaccacctgcccgacggcgctgatcggcgacgacatcaaggcgacggtgaagcgggtgatggaagtgcgccccgacgtcgacatcttcacctgcgagtgcccgggcttcgccggcgtgtcgcagtccaagggccaccacgttctcaatatcggctgggtcaacgagaaggtcgggacggtcgagccggaaatcacctcaccctacaccatcaacttcatcggcgactacaacatccagggcgatacccagcttctgcagcagtactgggacaagctcggcatccaggtgatcgcgcatttcaccggcaacgccaattatgacgacctgcgcgccatgcaccgcgcccagctcaacgtcgtcaactgcgcccgctcggccggctacatcgccaacgagctgaagaagcgctatggcatcccgcgcctcgatatcgactcctggggtttcaattacatggcggaaggcatccgcaaggtctgtgccttcttcggcatcgaggagaagggcgaggcgctgatcgctgaagaatacgccaaatggaagccacagctcgactggtacaaggaacggcttaagggcaccaagatggcgatctggaccggtggcccgcggctgtggcactggaccaagtcggtcgaggacgacctcggcgtccaggtcgtggcgatgtcgtcgaaattcggccaccaggaagacttcgagaaggtcatcgcccgcggccagtccggcacctactatgtcgacgacggcaacgagctcgaattcttcgagatcatcgatctggtcaagccggacgtgatcttcaccggcccgcgcgtcggcgaactcgtcaagaagctgcacatcccctacgtcaacggccacgcctatcacaacggtccgtatatgggcttcgaaggcttcgtgaacctcgcgcgcgacatgtacaacgcggttcacaatccgctcttgaagctcgcggccaccgatatccgtggcgaaacttccacc

SEQ ID NO: 44317 - DNA, 1365 bp, Rhodopseudomonas palustris
aaggaacgcgtcggcgtcatcaacccgatgtacgactgccagccggccggcgctcaatatgccgggatcggtgtcaaggattgcatcccgctggtgcatggcggccagggctgcacgatgtttgtgcggctgctgttcgcccagcacttcaaggagaatttcgacatcgcctcgacctcgctgcacgaggattcggcggtcttcggcggccatcagcgcatcatcgacggcgtgctgacgctggcccgccgctatccggaactgcgggttatcccggtgatcaccacttgctcgaccgagatcatcggcgacgatatcgaaggcaatatcggcaaggccaacgcggcactgaagaaggaattccccggccgcaagatccacgtcgttcccgtgcatacgccgagcttcaaggcgagtcaggtcggcggctacgccgagtgcatgcaggcgatcatcaagacgatctgcgatcacaaggtggcgccgaccggcaagctcaacgtgttcccgggatgggtcaacccgggggatgtggtgctgctcaagcactatttcaacgagatgggcgtcgacgccaccatcttcatggataccgaggatttcgactcgccgatgctgccggacaagtcgatccacacccacggccgcaccacggtcgaggacatcaagcatgcgagcggtgcgatcgcctcgctggctcttgccaaatacgagggcggctcgaccgccgactatctgaagaccgagttcgaggtgccgtcgcatctggtctcgactccctacggcatcgccaacaccgacgcgatgctgaagaggatcagcgagatcaccggcaagccgatcccggactcgctggtcaaggaacgcggcatcgcgctcgacgcgctgcaggaccttgcccacatgttcttcgccgataagaaggtggcgctgttcggccatccggacctggtgatcgggctggccgaattctgcctcgaggtcgagatgaagccggtcttgatgctgctcggcgacgacaacagccgttacaagaaggacccgcgcattctggccctgaagaacaagtgcaactgggacatggaggtcgtctgcaacgccgacctctgggagctcgagaagcgcgcgctcgacaaggactacggcattgatctgatcatgggccattccaaggggcgctatgtggcgatcgacgccaacatcccgatggttcgggtcggcttcccgaccttcgaccgtgccggcttgtaccggcatccgaccatggggtatcgcggcgccatgttgctcggcgagaccatcgccaacacgctgttcgcccacatggaatataacaaagaccgcgagtggttgttgaacacctgg

SEQ ID NO: 44318 - DNA, 1472 bp, Rhodopseudomonas palustris
ttcagcaaagttctgattgccaaccgcggcgagatcgccgggcggatcggccgcaccttgcgtcggatggggatcgcatcggtcgcgatctattcggacgccgaccggttcacccgcccaatgcgcgaggccgacgaagcggtgcgggtcggcggcgacgcagcaagcgacagctatctcaatgtcgatgccgtgatcgacgcctgcctcttaaccggcgcgcaggctgtgcatcccggctatggcttcctgtcggaaaaccgcggctttgccgaacggctgaagcagcacggcatcgccttcatcgggccgcgccccgaacatctcgaggcgttcggcctgaagcaccgcgcccgcgaattggcgcagggtagcaacgtgccgctgctgcccggcaccggactgatcgacagcatcgacgaggctctggaagccgccgcgcggatcggctttccgctaatgctgaaaagcaccgcgggcggcggcggcatcggcatgcagctctgccatgacgaagcgacgctgcgcgagcgcttcgccacggtgcagcgcaccgcccgcgccagctttggcgacgctcgggtgtacctcgaacgcttcgttgccgacgcgcggcacatcgaagtgcagatcttcggcgacggccagggcaacgtgatcgcgctcggcgagcgcgactgctcgctgcagcggcgcaatcagaaagtggtcgaggaaaccccggcgcccggcatctcggacgagatgcgggcgcggctgcatcaggccgcggtcgcgctcggccagagcgtcgcctacgaatccgccggcaccgtcgaattcatctacgacgtcgcccgcgacgaattctatttcctcgaggtcaacacccgccttcaggtcgagcatccggtcaccgaagcggtgttcggggtcgatctggtcgaatggatggtgcgccaggctgccggcgacagcccgcttgcgacctacacgccgcgtccgccgaagggcgcggcgatcgaagtgcggctctatgcggaaaatcccggcgccggcttccggccctccgccgggcggctgacgcgggtcgactttccggacgatgtgcgcgtcgacggctggatcgagaccggcgacgaggtgacaccgttctacgacccgatgctggcgaagctgatcgtccatgcggccgaccgcgacgctgcgatcgaccagatcatcggcgcgctagccgccactaccgtcgccgggatcgagaccaatctcgattacttgcgcgcgatcgcttcgtccgctctgttccacagcggcaaggtcgccaccaaggtgctggcggacttcagcttcgcagcgcgcaccatcgacgtggtggcgcccggcgcgcagtccggattgcaggagctgccgggccggctgcatctgtggcacgtcggcgtgccgccgagcggaccgatggacgagcgctcgttccgcctcgccaaccggatcgt

SEQ ID NO: 44319 - DNA, 1521 bp, Rhodopseudomonas palustris
atgcagttgacggcgggcttgcgcaaggcggcgtcgttccgcgccgacgacgtcgcgctcgtgacctccgagcggagcttcagccacggtgaaatgctggaccgagtggcgcggctggcgagcgtgttccgccgcctcggtgtcacgggcggcgagcgcgtcgcgatccttgcggctaacggccatgaatacatcgaatgctatttcgcggtgctgtgggccggcggcgtcgtggtgccgatcaattcgcggttctcgctggccgaaatgatcgagcaggtgaccgacgccgagccgatagtgctggtgagcgatcgcagctttctcgacagtgcgctgcaactcgccgatgcctgccgtggcatcactgccgtggtcgctgcagcgccgggcgctgctgggttgcctaagctctacgattacgaggctgcgctcgcggacgagaagccttgcgccgacgccggccgtggcaacgacgatctcgcttgcctgttctacaccggtggcaccactgggcgcgccaagggcgtgatgctcagccatcgcaatctgtgggtcaacgcagtggtgacgtcgctgtctttcggcttcgatgagaccacggtggcgttgcacgccgggccgctgttccatcttggtgccggtgcacgggtctacaccacctcgatcatgggggggcgccatgtggtgatcccacggttcgcgccgaaggacgtgctggccgccatcagccatcacaaggtgacggtcgcgacgttcgtgccgacgatgctcggcatgatcctgcaactgccagatctcgacagctacgatctgtcgagcctgaagctgatcacctatggtgcttcgccgatgcccgaagcggtgttgcaggagtgcctgcggcgatttccgtcgatcaggttcggccaatcctacggcatgaccgagctgtcgccggtcgcgaccattctgtcacctgacgatcatctgccgtccgcgccgcggcatcggctccgctccgccggtcggccggtggtgtcggcagaagtgaggatcgtcgatgccgaggaccgccagctgaaacctggcgaggtcggcgaggtggtggtccgtggcccaatggtgatgatgggctactggaaacagccggaactgaccgcgcacgtgctgcgcggcggctggatgcacaccggcgattccggccggttcgataccgagggctatctctacatctccgaccggatcaaggacatgatcatcaccggcggtgagaatgtgtattcgatcgaggtcgagaacgcgatcgcggcgcatcccgacgtgctgcaatgcgcggtgatcggcgtcccacatgccaaatggggcgaggcggtgcatgcggtggtggtgcgccgcccgggctcttctttgacgacggacgagctgattacgttctgccgttcggtgatcgccgactacaaatcgccgcgcagcatcgaatttcgcgacgatccgctgccgctgtcgagcgtcaacaagatcaacaaggcggcgctccgt

SEQ ID NO: 44320 - DNA, 1383 bp, Rhodopseudomonas palustris
atgaactgtcaattcaagccgaaggaccggatcggcaccatcaatccgatcttcacctgccagccggccggcgcccaatatgcctcgatcggcatcaaggactgcatcggcatcgtccacggcggccagggctgcgtgatgttcgtccgcctgctgatctcgcagcacctgaaggagagcttcgaaatcgcctcctcgtcggtgcacgaggacggcgcggtgttcggcgcgctcgaccgcgtcgaggaagcggtcgacgtgctcttgatgcgctacccgcacgtcaaggtggtgccgatcatcaccacctgctcgaccgaagtgatcggcgacgacgtggatggcgtcgtgaccaagctgcaggaagagctgctcgacgtgaagtatccagaccgcgaggtgcacctgatcccgatccactgcccaagcttcgtcggcagtatggtgacgggctacgacgtcgccgtgcgcgacttcgtcaagcatttctccaagaaggacaagccgagcctgaagatcaatctgatcacaggctgggtcaatccgggcgacgtcaaggagctcaagcatctgctcgccgagatgcaggtcgaagccaacgtgttgttcgagatcgagagcttcgatagtccgctgatgccggacaagagcgcggtgtcgcacggctcgaccacgattgcggacctgaccgcgaccgccgatgcgcagggcaccatcgcgctcaaccgctacgagggcggcctcgccgcgacctggctgcagacccgctgggacgtgccggcagtgatcggcccgaccccgatcgggatccgcaacaccgacaccttcctgcgcaacgtcaaggagatgaccggcaagccgatcccggaatcgctggtcaaggaacgcggcatcgcgctcgacgccatcaccgacctcgcccacatgttcctggccgacaagaaggtggcgatctacggcaatccggatctcgtgctcggcctcgccgagtactgcctcgacctggaaatgaaaccggtgctgctgctgctcggcgacgagaacgccggctacgccaacgaccctcggatcgcggcgctgaaggccaatgtcgactacccgatggagatcatcaccaacgccgacctgttcgagctcgaagagcgcatcaagaacggcctcgagctcgatctgatcctcggccactccaagggtcggttcgtcgcgatcgactacaacatcccgatgctgcgggtcggctttccgacctacgaccgcgccggcctgtatcgctaccccgtcgtcggctacgccggcgcgacctggctcgccgaacagatggccaacacgctgttcaacgacatggaggtcaagaagaaccgcgaatggatcctgaacgtgtgg

SEQ ID NO: 44321 - DNA, 1536 bp, Rhodopseudomonas palustris
atgccataccacgagttcgactgttcgaaatgtctgcccgaacgccagaagcacgccgtcaccaagggcgccggcgataatctcgccaccgcgctgccgctcggctatctcaacaccatccccggatcgatctccgagcgcggctgtgcctattgcggcgcaaagcatgtgatcggcacgccgatgaaggacgtgattcacatgagtcacggccccgtcggctgcacctacgacacctggcagaccaagcgctacatctccgacaacaacaacttccagctcaaatacaccttcgccaccgacgtccgcgagaagcacatcgtgttcggcgccgaaggccttctgaagcagaacatcatcgaggctttcaaagcctgccccgacatcaagcggatgacgatctaccagacctgcgccaccgcgctgatcggcgacgacatcaacgcggtcgccgccgaggtgatggaggagatgccggacgtcgacatcttcacctgcaactcgcccggcttcggcggccccagccagtccggcggccaccacaagattaacatcgcctggatcaacgacaaggtcggcaccgtcgagcccgagatcacctcggactatgtcatcaactatgtgggcgaatacaacatccagggcgaccaggaggtgatgctcgactacttcacccggatgggcatccaggtgctgtcgaccttcaccggcaacggcacctatgacggcctgcgggcgatgcaccgcgcgcatctcaacgtgctcgaatgcgcccgctcggccgaatacatctgcaacgagctgcgcgtccgctacgggattccgcggctcgacatcgacggcttcggcttcgagccgctgtcgcagtcgctgcgcaagatcggcatgttcttcggcatcgaagaccgcgccgaagcaatcatcgccgaagagaccgcgcgctggaagccggagctcgactggtacaaggaacggctgaagggcaaaaaggtctgcctgtggccgggcggctccaagctgtggcactgggcgcacgccatcgaagaggagatgggcgtcaaggtcgtctcggtctacaccaagttcggccaccaaggggacatggagaaaggcatcgcgcgctgcggcgaggatgcgctggcgatcgacgatcccaacgaactcgaaggcctcgaggcgctggagaagctgcagccggacatcatcttcaccggcaagcgtcccggcgaagtcgccaagaaggtccgcgttccatacctcaacgcccacgcctatcacaacggcccctacaagggtttcgaaggctgggtgcggttcgcccgcgacatctacaacggcatctactcgccgatgcaccagctctccgggctggacatcagcaaggacgagattccggccgatcgcggtttcgtcacgcagcggatgctgtcggacgcgaagctgccggaggagatcgccaagtcggagacgctgcggcgctacaccggcaaggacgacatcatctccgacctgcgcaagaagaacgcgccctacttc

SEQ ID NO: 44322 - DNA, 1629 bp, Rhodopseudomonas palustris
tgggccaaggcgtggccgaaggacacgccgcgtgagccgcaatatctgcacggcgaggtcgccctcagcgagtatctgcgcgcctgggcgaaatcggcgccgctgcgaccggcggtgatcttctacggtcacgtcaccacttatgcggatctggacgagcagagcgatcgcttcgctgcgctgctgctgcagaaaggcgtgaagaagggtgaccgagtcgcggtgttcctgccgaactgtccgcagttccacatcgtgttcttcggcatcctcaagcttggcgcgatccatgtgccggttagtccgctgtcgcgggcgttcgaactgtcctacgagctcaacgacaccgacgccgaagtgatcgtggcgctcgaccagcttgccggcgtggtcgagcaggtccgagccgagacttcgctgcgcgaggtgatcgtcaccagctttgccgatgtgatcccatccgacccgacgattccggtgccggattctgtgagcggctcgcgcatcatcgtacctggcgcgaccgacctgctgtcggcgctcgccgcgctgccgaagccggagccgttgccgccggccgcgctcgacgaggtcgcagcgctcaactacaccggcggcaccaccggcatgccgaagggctgcgtccacactcagcgcgacatggtctatacggcggccgccaatcacggtatctcggttgtggccgatcagaacagcgtgttcctgtcgttcttccccgagttctggatcgccggtgaaaacttcggcctgatcttcccgctgttcaccggcgcgacgctggtgctgttggcgcggtgggatgcgctcggcgtgctcactgcgatccagcgctacaaggtcaacgtcaccgcaatgccggtcgacggcgcggtggagctgatggatcatccgcggttcaaggagttcgacttgtcctcgctgagccaggtgcgggtggtgtccttcgtcaagaagctcaacccgacctaccgcaagcgctggaaggatctcaccggcacgatcctcaccgaagccgcctggggcatgaccgagactcacacctcgaacaccttcacggccggtttccagggcgacgatttcgaccttgtctcccagccgatcttcgtcggcctgccggtgccgggtgcggagttcaagatcaccgacttcgagaccggcaaactggtgccgctcggcggcgaaggcgaaatccgagtgcgcacgccgtcgctcttgaagagctactggaataagcccgaggcgaccgcggaatcgctggtcgatggctggctgcgcaccggcgacatcggcacgattgatccgcagggcttcctgcacttcctcggccgccgcaaggagatgctcaaggtcaaggggatgagcgtgtttccgccagagatcgaggcgctgctcggccagcacccgaaggtgctcggttcgggcgttgtggggcgcgacgatcccggcaagggccaggtaccggtcgcctttatccagctcaagccggaagccgaaggcaccatcacgccggccgagctgcaggcctggtgtgccgagcggatggcggtctacaaggttccggagatccgtattatcgacgcgctgccgatgaccgcgaccggcaaggtg

SEQ ID NO: 44323 - DNA, 1665 bp, Rhodopseudomonas palustris
aaactgctgatcgccaaccgcggcgagatcgcgatccgtatcgcgcgcgccgccgccgagtccggcctcactaccgtggcgatccatcccgccgatgatgcggcgtcgctgcacgtccgcatcgccgatcacgccgagcagattcccggccgcggcgcgcgggcctatctcgacatcgaggcggtgatcgtggcggcaaaggcggctggctgcgatgcgctgcatcccggctacggtttcctcagcgagaacgccgatctggcgcggcgctgcgccgaggagggcatcacgttcatcgggccgtcgccggaggcattgcggctgttcggtgacaaggttgccgccaaggagctggcgaagcgctgcggcgtgccgatcattgccggcaccatcgggccgtcgaccctggaagaggtgcaggcgttcttcgcctcgcttggcgacaagccggcggtgatgatcaaggcgatggccggcggcggcggccgcggcatgcgcgtggtcgagcgtgccgaagagctcgccgacgcctatgcgcgctgccagtccgaagccaaggcggcgttcggctatgagggcgtctatgccgagcggctgatccgcaacgcccggcatatcgaggtgcagatcatcggcgaccggcacggcaatgtcagtcagctctgggagcgcgaatgcacgatccagcgccgcaatcagaagctgatcgaaatcgcgccgagcccgtcactgtcggagggactgcgcagccgcattgttgacgcggccaagaccctcgcggcggcggcgaactacgacagcctcggtaccttcgaattcctggtcgacagcgaagccggcgagggcgacggtgccttcgccttcatcgaagccaatccgcgactgcaggtcgaacacaccgtcactgaagaggtgttatccgtcgatctggtgcgctcgcagcttgcggtcgccggcggggcgatgctgacggcgcttgggctcgatcaggcctcggtgccgcgtccccggggctttgcgatccaacttcgcgtcaacatggagacgatggacgccaaaggagcgaccaagccgaccggcggcacgctggcgatcttcgagccgccgtctggtcccggcgttcgcgtcgatacgttcggctatgctggctacaccaccagcgccgcgtacgactcgctgctcgccaaggtgatcgtgcatggccgcggcgattgggccgaggcggtcgccaaggcgtcccgtgcgctgcgtgagttcagagccggcggcgtcgttaccaacatcccgctgctgcaggcgatcctcgcgcataacgacttcaaggccaatcgcgttagcaccagcttcatcgatcgccatgtcgcggatctggtcgaggccgcgcagcagttcgatcagccgctgatcgcgacggacggtgctgacaaccggagcagcgctgccgccgcggcaagcaaggagccggtccccgagggcgcggtcgcgatcgctgcgccgctgcagggcaccgtggtggcgatcactgtcgcggaaggcgacgtggtgcggccggggcagcagctcgcggtgatcgaatccatgaagatggagcacctggtcgccgccgagcaaggcggccgcatccgccgcatcgtcgccaccgacggcgtgacgctgatgcagggc

SEQ ID NO: 44324 - DNA, 1632 bp, Rhodopseudomonas palustris
gtgagcccgctggcgggcaagaccgtcgatccgaacagtctggtcaacgtcccgcggctggtgacggcatatttcgccggcaagccggacccggcggtcgcgaccgagcgggtggcgttcggtacctcggggcatcgcggctcgtcgctgaacaacgccttcaacgaaagtcacatcgtggcagtcagccaggcggtgtgcgatcatcgccgcgctgccggcatcaccggccctctgtatatcggcatcgacacccatgcgctggccgagccagccctggtcagcgcgctcgaagtgttcgccgccaacgagatcgacgtggtgatcgacgaacgcggcggctacaccccgaccccggtgatctcgcacgcgatcctcacccacaatcgcggccgcaccgacggtcttgcggacggcgtggtggtgacgccgtcccacaatccgcccgaggacggcggcttcaagtacaatccgccgaacggcggcccggccgacaccgacatcacctcggcggtggaaaaggctgcgaatgccatgctcgaaaacgggctgaagggcatcaagcggatctcctacgatcgcgcccgcaaggcgagttgcgtgcatcgccgcgactacatcacgccgtatgtggaagacctcgccaatgtggtcgacatggaggcgatccggtcgagcggagtgaagctcggcatcgatccgctcggcggcgccgcggtgcattactggcagccgatcatcgagcgctacaagctggacgccaaggttgtcagcgacgctgtcgatcccaccttccgctttatgaccgcggattgggacggcaaggtgcggatggactgctcgtcgccttacgcgatggcgcggctgatcgggatgcgcaacgacttcgacgttgcgttcgccaacgacactgacgccgaccgccatggcatcgtcacccgttccagcgggctgatgaatccgaaccattatctatcggtggcgatcgcctatctgtttgcgcaccggccgcattgggggcgcgacgccgcgatcggcaagaccgcagtgtcgagcgcgatgatcgaccgcgtcgccagcaagatcggccgcaaggtggtcgagaccccggtcggtttcaaatggttcgtagacgggctgatcggcggtagctttggcttcgccggtgaagagagcgccggcgcgtcgttcctgcgccgcgacggcagcgtctggaccaccgacaaggacggcatcatcctcggcctgctcgcggcggagatcaccgccgtgagcaaggccgacccgggcgaattgtatcaacggctcaccgccgagctcggcgcgccgttctacgcgcggatcgatgcggcggcatcgccggcccagaaagcgctgttcaagacgctgaccgcggagaagctcggcgtcaagcagctcgccggcgagccggtcaccgcaacgctgaccaaggcgcccggcaacggccaatcaatcggcggcgtcaaagtcaccaccgccaacggctggttcgctgcgcggccgtccggcaccgaggatgtttacaaaatctacgccgagagcttcgtcagcgctgaccatctcagcaagattcagcacgaagcccaggccgccctcagcgcgatgttcgcc

SEQ ID NO: 44325 - DNA, 1335 bp, Rhodopseudomonas palustris
atgaagcgtaatctgttttttgtaacggccagcgtgctggtgttgtcttcgagtgctgcgttcgctgctgattccaatacggtgtatctgaatcagaccggcaacgatcagcaggccaacatcacacaatccggcaacggcaacagtgtcggcgccttcaacggtaactcgggatttctccaggagaatggcacgttatcgggagcgaacctcctcacggtgaagcagtccggcaactccaacagcgtcggtcgcgacatccagggcaagcaatccggtgctggcaactctgccgcaatctttcaggaaggtaccggcagcgacgtcgagcttcagcagaccggcaccagcaatggcgccgttccgtccggctggaactggaccaacgatccgggtgtcttcaacaagattactcaggattcgtcgtcgaacggaagcaaggtttccgtcatccaggatggcaagaacaacgtcttcagcatcaagcagggcaataccggcaactcgacctcggtcaatcaaatcggcgagtggggcatggcctatgttcgtcagggcatcggcgcagccgagaccgatgcctctacgggcaatgcgctgccgaccggtggcaactacaacgtcgcctcgatcacgcagaacagcgccggcctgaattacgcggtcgccgtgcagggcggcggcaattcgaactctctgtcgatcagccagtcgggaaatctgcagggcgccaacgcctggcagaacggtaacgcgaacgtcttcagctcgatccaaacgaatgtcgggaacgtcgtcggcttgacgggaggtatctacggcaccgacagcccgatcacgcagaccggtgacaacaacacctacatcaacacccagaccgggtcgtccaacagcgccaacggctcccagaccggcaacttcaaccaagtgttcaacacgcagagcggaggcagcgagactgtgcgaggaacgcaggtcggcacgtacaactatgtcagcaatagtcaggcgggatccagcaacctcctggactacaagcagaccaataccgtcagcaccgccttcaatcagatcgtcaacgaccagtcgaccacagctgtgtcgaacaccgcttacgtcgttcaggacggcaatggtctgtacagcaagggcttgcagactggcgggagctacaattcggccaatgtctcgcaaaccgggcagttcagcgccagctactacacgcaggacggttcgagcaattcgatcattgtcgctcaggtcggcaattacaacgtctccaacgtgagccagatcggcgcaggcaaccacgccaacatccagcagaagccgtag

SEQ ID NO: 44326 - DNA, 822 bp, Rhodopseudomonas palustris
gacggcgtgcaactccgctttgcgcgatgggagccgccggggcaccgcaaaggcaccgtatgcgtcttcaccggacgcaccgaacagatcgagaagtacttcgagacggtgcgcgatctgcgcgatcgcggctttgcagtcgcggcgctcgactggcgcggccagggccattcggagcgccggctgcgcgactatcgcaagggctatgtgcgcaacttcgccgacttcgaggtcgacgtcgaaaccttcgtgcgtgaagtcgtgctgccggactgcccgccgccgcatttcgcactggcgcattcgatgggcggggcggtgatgctgcggatcgcccgctccggcaagcgctggttcgaccgcatggtgctgtcggccccgatgatcgaccttgcgggcaacaccaccgcgctgccgatcaggctattgctgcgggcgatgcggctggccggccaaggcggccgttacgttcccggcggcaacgacgtgctcgccaacaccgagccgttcgtcggaaacaagctgacctcggatccggtacgctacgcccgcaacgccgcaatcgtcgccgaagatccgaccctgggcctcgcctcgccgaccgtcgcctgggctgacaccgctttccgcgccatgcacgccttcaaggcgaccaactatccgtcgcaaatccggcagccgatcctgatgatcgcggccggtatggacggcgtggtgtcgacgccggcgatcgaagagttcgcttatcatttgcgggccggctcgcatctggtgatccccggcgccaagcacgaaatcctccaggagcaggatcgctaccgc

SEQ ID NO: 44327 - DNA, 852 bp, Rhodopseudomonas palustris
atccgcaaagccgtcttcccggtcgccggcctcggcacccgcgttctccccgccaccaaggcgatgccgaaggagatgctgaccatcgtcgatcgaccgctgatccagtacgtcgtcgacgaagcgcgggaagccggcatcgagcacttcgtcttcgtcacgggacgcaacaagggcatgatcgaggatcacttcgaccgccagttcgagctcgatgtcacgctggagaagcgcaacaagaagagcgagatggagatcctggcgcgcgaccagccggaggccggcgcgatgagcttcacccgccagcaggcaccgcacggcctcggccacgcggtgtggtgcgcccgcgacatcgtcggcaacgagccgttcgcggtggtgctgccggacgaactggtgctcaatactccgggctgcctgaagcagatgatccaggccgccgagaagctcggcgacaaggccaacgtcatcgcggtggaggaagtgccggccgacaagacccatcaatacggcatctgcggcgtcggcaagcgcgatggcaagatgttcgagatcgacggcatggtggagaagccggcgcccggcaccgcgccctcgaacctgtcgatttccgggcgctacatcctgcagccggaaatcttccagatcctggcgacgcaggagcgcggcgccggcggcgagatccagctcaccgacgcgatgatcgggctgtcgaagacgcagaaattctacggcgtggagttcgaaggcgagcgtcacgactgcggttcgaaggccggcttcctgcgcgccaacatcgcgttcgcgatgcagcgcgacgacctgcgcgccggcctgatcgaagacatgaag

SEQ ID NO: 44328 - DNA, 1035 bp, Rhodopseudomonas palustris
atgagcgtcattgttccgatccatggacctgcgatcgccccggcgcccgcgccggagcgagtcggtgtgctgttggtgaacctcggcacccccgacagctgcgacaccaagggcgtgcgcatctatctgcgcgagttcctgtcggatccgcgggtgatcgagaaccagggactgttctggaagctggcgctgaacggcatcattctgaacacccgtccggcccgcaaggccaaggactaccagaagatctggaaccacgagaagaacgagtcgccgctcaagaccatcacccgcgcgcaggccgagaagctgtcggcgtcgctcggcgatcgcggccatctgatcgtcgattgggcgatgcgttacggcaacccgtcgctgcgcgaccggatcgaagcgctggttgccaagggctgcacccggctgctggttgtgccgctgtatccgcaatattccgccgcgacctcggcgacggtatgcgatcaggcgttccgggtgctgcgcgaactgcgcgcccagccgacgctgcgggtcacgccgccgtattatcgcgactcggcctatatcgacgcgctggcgacctcgatcaaatcgcacctcgcctcgctgacgttcgagccggaactgatcgtggcctcgttccacggcatgccgcaggcctatatcgacaagggcgatccgtatcaggcgcagtgcgtggcgaccgtcgaggcgttgcgcgagcggatgggcgttgccgacgacaagctgctgctgaccttccagtcgcggttcggcttcgatcagtggctgcagccttacaccgacaaaaccatcgaggcgctggcccgcaagggcgtgcgcaagcttgcggtggtgatgccgggtttctcggccgactgcctggagacgctggaagagatcgcgcaggaaaacgccgagatcttcatggaacatggcggcgaggaattcaccgcgatcccctgcctcaacgattccgacgccggcgttcaggtgatccgccagctcgtgttgcgcgagctgcaaggctggctg

SEQ ID NO: 44329 - DNA, 2022 bp, Rhodopseudomonas palustris
aatccgctgctggccgcctggaccaccccgttcgagacaccgccgttcgccgagatcaggcccgagcacttcatgccggccttcgagcaggcgttcgccgaccacgcgggcgagatcgccgcgatcgtcaacgatccgaccgagccggacttcgacaacaccgtcacggcgctggagcgctcaggcaagctgctgaaccgggtcgccgcggtgttctacgatctggtgtcggcgcattcgagcccggagctgctgaagatcgacgaagaggtgtcgctgcggatggcgcggcactggaatccgatcatgatgaacgcggtgctgttcggccggatcgcggcgctgcgcgacaaggcggcgcggctgaacctgacgccggagcagagccggctgctggagcgcagctacacccgcttccaccgcgccggcgccggcctcgacgaggcgtccaaggcacgcatggcggcgatcaacgaacgcctggcgcagctcggcaccagcttcagccatcatctgctcggcgacgagcaggaatggatgatggagctcggcgagggcgataccgaggggctgcccgacagcttcgtggcggcggcgcgcgctgcggcggaagagcgcgggctgcccggcaaggccgtggtgacgctgtcgcggtcgtcggtcgagccgttcctgaagatgtcgagccggcgcgatctgcgcgagaaggtgtaccgcgccttcatcgctcgcggcgataacggtaacgataacgacaacaacgcgatcatcggcgagatcctgagcctgcgcgaagaaagcgccaagctgctcggctatccgacctttgcggcctaccgtctggaagactcgatggccaagacgccggaggcggtgcgcggccttttggagcgggtgtggaagccggcgcgcgctcgcgcgctcgccgaccgcgacgcgctgcaggagctggtcacggaagagggcagcaacttcaagctggcgccgtgggactggcgctactacgccgagaggctgcgccagcgccgcgccaatttcgacgatgcggcgatcaagccgtatctgacgctcgacggcatgatcgccgcggcgttcgacaccgccacgcggttgttcggcatcaccttcgaggaacgcaaggacgtcccggtgtggcatccggacgtccgggtgtgggaagtgaaggacgccgacggcgcgcatcgcgggctgttctacggcgactactatgcccggccctcgaaacgttccggcgcctggatgacctcgctgcgcgatcagcagaagctcgacagcgcggtggcgccgctgatcatcaacgtctgcaacttcgccaagggcgccggcggcgagccgtcgctgctgtcgcccgacgacgcccgcacgctgttccacgaattcggccacggcctgcacggtatgctgtcagacgtgacctacccgtcgctgtccggcaccagcgtgttcaccgacttcgtcgagctgccatcgcagctttacgagcactggcaggagcagccgcaagtgctgcggcagttcgcccgtcactatcagaccggcgagccgctgcccgacgatctgctgcagcggttcatcgccgcccgcaagttcggccagggcttcgccaccgtcgagttcgtctcctcggcgctgctcgatctcgaatttcacacccagcctgccgccagcatcggcgaggtccgcgccttcgagcgcaaggagctcgacaagatcggcatgcccgaagagatcgcgctgcggcaccggccgacccagttcggccacatcttctccggcgatcactacgcctcgggctactacagctacatgtggagcgaggtaatggacgccgacgcgttcggcgcgttcgaagaggccggcgacatcttcgcgccggacgtggccaagcggctgcgcgacgacatctattcgtccggcggctcgcgcgatccggaggaagcctatgtggcgttccgcggccgcaagccggagcccgacgcgctgctgcgccgccgcggcctg

SEQ ID NO: 44330 - DNA, 1089 bp, Rhodopseudomonas palustris
cgccgcgccaagggtctggacgtcgagccgtgcctggtcgtcgacctcgaagtggtccgcgacaacttcatgcatttcgccaaggcgctgccggacagccgcgtgttctatgcgatcaaggccaacccggcgccggaagtgctgtcgctgctggcctcgctcggctcgtgcttcgactgcgcctcggtgcaggaaatccagatggcgctggccgcgggagcgaccccggaccgcatctcgtttggtaacaccatcaagaaggagcgcgacatcgcgcgcgcctacgagctcggcatccgcctgttctcggtcgactgcactcccgaggtggagaaggtcgcgcgtgcggctcccggctccaaggtgttctgccgcatcctgtacgattgcgccggcgccgagtggccgctgtcgcgcaagttcggctgcgatccggagatggcggtggacgtgctcgacaacgccaagcgtctcggcctggaagcctatggcatttcgttccatgtcggctcgcagcagcgcaaggtgaaggcgtgggaccgtgcgctggcgatggccgcgcaggtgttccgcgactgcgccgagcgcggcatctcgctgtcgatggtcaacatgggtggcggcttcccgaccaagtatctgaaggaagtcccgccggtggtgcagtacggccgctcgatcttccgggcgctgcgcaagcacttcggcaaccagatcccggagaccatcatcgagccgggccgcggcatggtcggaaacgccggcgtgatcgagaccgaagtcgttctgatctcgaagaagagcgacgaggacgacgtgcgctgggtctatctcgacatcggcaagttcggcggtctcgccgagacgatggacgagtcgatccgctacgcgatcaagtcgcgtcatgacggcgccgagatgacgccctgcgtgctcgccggcccgacctgcgattcggccgacgtgctgtacgagaagatgccgtatccgctgccggtgacgctcgagattggcgacaagctgctgatcgaaggcaccggcgcctatacgtcgacctactcgtccgtggcgttcaacggcttcccgccg

SEQ ID NO: 44331 - DNA, 1227 bp, Rhodopseudomonas palustris
atgcagtacaatcaattctttcaagacgctctcacccgcctccacgacgagcgtcgttaccgggtgttcgctgatctcgagcggatggccggtaggtttccgcatgccacgtggcactcgaactccggacctcgcgatgttgtgatctggtgctcgaacgactatctcggcatgggccagcacccgaaggtggtcggcgcaatggtcgagaccgcgacgcggatcggcaccggtgccggtggtacccgcaatatcgccggtacgcatcacccgctggtgcagctcgagcaggaaatcgcctcgctgcacggcaaggaagcggcgctgctgttcacctcgggctatgtctccaaccagaccggcctgtcgacgctcggcaagttgatcccgaactgcctgatcctgtcggacgcgctcaatcacaattcgatgattgaaggcatccgccagtcgggctgcgagcgcgtggtgtggcgccacaacgataccgcgcacctcgaagagctgctgatcgccgccggtcccgaccgaccgaagctgatcgcattcgagagtctgtactcgatggacggtgacaccgcgccgctggcgaagatctgcgatctcgccgagaagtacaacgcgatgacctactgcgacgaagtgcatgcggtcggcatgtacggtgcccacggtgccggcgtcgccgagcgtgacggcgtgatggatcgcatcgacatcatcgaagcgaccctggccaaggcgttcggctgtctcggcggctacatcacaggcaagaacgaagtgatcgacgccgtacgctcctacgcgccgggcttcatcttcaccacgtcgctgccgccgccgatctgcgccgccgcgactgccgcgatcaagcatctgcgcagctcgacctgggagcgtgaacgccatcaggaccgcgctgcccgcgtcaaagcggtgctgaacaacgccggcattccggtgatgccgaccgacacccacatcgtgccggtgttcgtcggcgacgccgagaagtgcaagaaggcgtccgatctgctgctcgaacagcacaacatctacattcagccgatcaactacccgaccgttgcccgcggcctcgaacggctccgcatcacgccgtcgccgtatcacgacgacaagctgatcgatgcgctcgccgaagccctggtgcaggtctggaacgagctcggcctgccgctcggcgccaaggcgatcgctgcggag

SEQ ID NO: 44332 - DNA, 1191 bp, Rhodopseudomonas palustris
cttccttccggcctcaccatcgtcaccgacaccatgccgcatctcgagaccgccgcactcggcgtctggaccggcgtcggcggccgcgacgaaaagccggacgagcacggcatctcacatctcctcgaacacatggcgttcaagggcaccacgcgccgcacctcgcgcgagatcgccgaggagatcgaggcggtcggcggcgacctcaatgccggcacttcgaccgagaccaccgcgtattacgcgcgggtgatgaaggcagacgtgccgctggcgctcgacgtcttgtccgacattctcgccaatccgtcgttcgaggccgaagagctcgaacgcgagaagagcgtgatcgtgcaggagatcggcgccgcgcaggacacgcctgacgacgtcgtgttcgaatacctgaacgagctgtgctacccggagcagccgatcggccgctctctgctcggcaccgccaagacgctgaagagcttcagccgcgaaaagctgcagtcgtatctgtcgacgcattatcgcggccccgacatggtggtggctgcggctggcgcggtggatcacgcccgcatcgtcgaagaggtttcccaccgcttcgccagcttcgacggcacgccggcaccgaagccgcagccggctatgttcggcgcgggaggctcccgcgtcgtgcaccgcgacctcgagcaggcgcatctgacgctggcgctcgaagggctgccgcagagcgcgccgacgctgttcagcctgcaggtgttcaccaacatcctcggcggcggaatgtcgtcgcggctgttccaggaggtgcgggagaagcgcgggctgtgctactcgatctacaccttccatgcgccctacagcgacaccgggttcttcggtctctataccggcacagatccggccgatgcgccggagatgatggaagtgatcgtcgatgtcatcaacgatgcggtcgacaccctgaccgacgccgagatctcccgggccaaggctcagatgaaggcaggcctgctgatggcgctggaaagctgttcgtcgcgtgccgagcagctcgcgcggcacatcctggcctacggccggccgttgccggtcgacgagctggtcgggcgaatcgatgccgtcactatcgataccgcgcgggaagcagggcgcacgctgctggcgcgcagccggccggccgtggtggcgctcggc

SEQ ID NO: 44333 - DNA, 606 bp, Rhodopseudomonas palustris
atgaagctgtattattcacccggtgcatgttcgctgtcgccgcatatcgcgctcagcgaggccggcctgccgttcgacctggtcaaggtcgacatccgggcgaagaagctggagaacggcgacgactacgccgcgatcaatccgaaggggtcggtgcctgcgctcggcctcgacgacggctcggtgctgaccgagggaccggcgatcgtgcagtacatcgccgacaaggaaggctccggcaagctggcgccggccaacggatcgccggagcgctaccggctgcaggaatggctgaactatatctcgaccgacctgcacaagagcttcggcccgctgttcgccccgacgctcggcgacgatgccaagaatttcttcaaggaccgcatcgctcgccacctcggctatgtcgacaagcagctcgccggcaaagactatctgatgggctcgtcgttcacggtggccgacggctatctgttcgtgatcctgagctggtgcgaccgcatgcagatcgatctggcaccgtatcccaacctcaccgcctacaaagcccgcatcgcggcgcggccgaaggtgcaggcggcgatgcagagtgaagggctgctgcag

SEQ ID NO: 44334 - DNA, 1200 bp, Rhodopseudomonas palustris
gaagcctatatctacgatcacgttcgcaccccgcgcggccgcggcaaggccgacggttcgctgcacgaggtgaccgcgctggcgctcgccaccgtgccgctgaaggcgctgaaggagcgtaacaacctgaagcaggacgtggtcgacgacgtcgtgatgggcgtggtcgatccggtcggcgaagccggctcggacatcgcgcggttcgcggcgatgaaggctggcctcggtgaagcggtgccgggcattcagatcagccggttctgcgcctcgggtctcgatgcagtgaacttcgccgcggcgcagatcatgagcggccagcacgagctggtaatcggcggcggcgccgaatcgatgagccggatcggcatcggcgcttcggggggggcctggccgatggatccgtcgatggcgatcccgtcctacttcatgccgcagggcatttcggccgatctgatcgccaccaaatacggcttctcgcgcgacgacgtcgacgcctatgcggtccggagccagcagctcgccgcgaaggcgtgggacgagggccggttcgacaagtcggttgtgccggtcaaggacatcaacggcctgaccatcctggccaaggacgagcacatgcgcccgtcgacgacgatgcagtcgctggcgcagctgcagccgtcgttcgcgccgatcgccgcgatgggcgggttcgacgcggtggcgatccagtcgcacccggaagtcgagaaggtcaactacgtgcaccatgccggcaactcgtcgggcatcgtcgacggcgccggcgcggtgctgctcggcagcaaggaagctggcgagaaacatggtttgaagccgcgtgcgaaaatccgcgccttcgccaatatcggctcggagccggcgatgatgctgaccggtccggtcgacgtcaccaacaagctgttcgagcgctcgggcatgaagaagagcgacatcgatctgttcgagctcaacgaggcgtttgcctcggtggtgctgcgctacatgcaggcgttcgagatcgataacgacaagatcaacgtcaatggcggcgcgatcgcgctcggccatccgctcggcgccaccggcgcgatgatcctcggcaccgtgctcgacgagctggagcgcaccggcaaggcgaccgcgctggtgacgctgtgcatcggcggcggcatgggtactgccaccatcatcgagcgggtg

SEQ ID NO: 44335 - DNA, 968 bp, Rhodopseudomonas palustris
ttcgatgccgtctcgctgccgctgctgcgctggctcgatccggaggatgcgcaccggctggcaatccagggcctgaagctgtggccgccggtcaagccgcgccccgacgattccaagctcgcggtgcgcgcgttcggactcaatttctccaatccggtcgggatcgccgccggcttcgacaagaacgctgaagcgcccgatgcgctgctccggctcggcttcggtttcgtcgaggtcggcacggtgacgccgaagccgcaggccggcaatcctcggccgcggctgttccggctcgaacgcgacgaagcggtgatcaaccgcatgggcttcaacaacgagggtgccgaggtggtgctgcgccggctggcggcgcgcgcgcaatatggcggcatcgtcggcgtcaatgtcggggccaacaaggacagcgacgatcgggtggcggactacgtcaagctgatcgagaccttcgcgccgctggcgagctacttcaccgtcaacgtctcgtcgccgaacacgccgggcctgcgcaatctgcagcaggcggcggcgctcgacgatctgctggcgcgggtgatcgatgcgcgcgagcgggtgcgggcggcggccggcgatacgccggtgctgctcaagatcgcgcccgatctatcgctcggcgaactcgacgatgtcgtgcatatcgcccggtcgcgccgggtcgacggcatgatcgtcgccaacaccacgctgtcgcgctcgccgacgctgcgcgagcggacgaagatgaatgagcagggcgggctgtcgggccgccccctgttccggctgtcgacccggatggtggcggagacgtttgtgcgcgccgagggcgcgttcccgctgatcggcgtcggcggcatcgattccggtggcgcggcgctgaccaagatccgcgccggtgccacgctggtccagttgtattcggcgctggtctataagggcctcggcctggt

SEQ ID NO: 44336 - DNA, 759 bp, Rhodopseudomonas palustris
cggctcgacggtaaggttgcggtgatcaccggtgcgaccagcggcattggttggcgcaccgcggaggtattcgttgccgaaggcgcccggatcgtcgtcgccggccgccgcatggccgagggcgaggcgctggcggcgcagctcggctcgtcctgcgtgttcaagcagaccgacgtcaccgacgaggctcaggtgaaggccttgatcgacaccgcgctcgacaccttcggccggctcgactgcctgttcaacaatgccggcggtccggcgcagaccgggggcatcgaaggcctcgaggtcgatcgcttcgacgccgcgatggcgacgctggtgcgcagcgtgatgctgggcatgaagcatgccgcgccggcgatgaagaagcagggcgccggctcgattatcaacaacggcagcatcgccggccgactcgccgggttttcgtcgtcgctggtgtacggcgccgccaaggcggcggtgaatcatttgaccaaatgcgtcgccatggagctcggcgaatccggcatccgcgtcaattcgatctcgcccggcgcgatcgcgaccggcatcttcggcaaggcgctggggctcaccaccgatgcggccgaaaagaccgcagcgacgatgcgcgagatttacaagaccgcgcagccgattccccgcgccggcattccggacgatatcgcccaggccgcggtgtttctcgccagtgacgagtcgaccttcatcaacggtcatgatctcgtcgtcgacggcggcatc

SEQ ID NO: 44337 - DNA, 1206 bp, Rhodopseudomonas palustris
atggatttcgaccacagcgacaaggtgcaacggctgcgcgcgcagctgtccgacttcatgcgtttccacgtcgagccggccaacgtcgcgtggcatcgcgaggtggccgcggggcactatccgctggctctgatcgagcgactgaagtcgcgggcgttctccgaggatctgtggaatctgtttctgccgggcctgcgggatcaggatcccggccagcgtctcagcaacgtcgaatatgcgccgctcgccgagatcatgggccgggtgcattgggcgtcggaagtgttcaactgcaacgcgcccgacaccggcaacatggagctgctgcatctggcggcaacgccgaagcagcgcgccgagtggctcgatccgctgctgatcggcgaaatccgctcctgcttcgcgatgagcgagccggatgccgcctcgtcggatgcgcgcaacatccgcaccaccatcacccgcgacggcgacgactacgtcatcaacggccgcaaatggttcatcaccggggcggcgcatccgaactgcaaactcgcgatcgtgatgggcgtcaccggcgaacacctgccggcaacttcgaccgagcggcactcgatgctgctggtgccgatgaacacgccggggctttcgatcgtccgcaacatcccggtgatgcactatcactcgccggaaggacattgcgaactggtgttccgcaacgtccgggtaccggcgtccaatctgctcggcgaagaaggcaaaggctttcgcctggcgcaggatcggctcggtcccggccgggtacatcattgcatgcggaccatcggccaatgcgaggtcgcgctcgaactgatggcggagcgtgcgctcgaacgcgaagcgttcggcaagcacctagccgacttcgcgaatattcaagactggatcgccgaatcgcggctggagatcgatcaggcacggctgttggtgatgcaggcggcgcaccgcatggatcgcgccggcaacgccgcggcgcgggtcgatgtctcggcgatcaagctggtggcggcgcggctgcaaacgaggatcgtcgatcgcgccatgcaggtgttcggggcgatgggcctgacgccggatacgccgctgtcttacttgtggacctggggccgcgcgatgcggtttctcgacgggcctgatgaggtgcatctgcgcgtggtggcccgcgccgaattggcgaaggcgaaa

SEQ ID NO: 44338 - DNA, 1032 bp, Rhodopseudomonas palustris
ttcacttccaatgattacctcggccttgccgagtctgacgagttgcgccaggccgccgccaatgcggttgcgcgcggcgtgccgatcggagccggcggctcgcgattgctgcgtggtaatcatgaagagcacgaagcgctcgaagcggaagcggctgattacttcggcgcggaaagcgcgctgtatctcggtggcggcttcagcgccaatcacgcgatcttcgcgacgctgccgcagcgtggcgatctcgtactgtacgatgagctgatccatgccagcgtgcacgaaggcatgcgccgcggtcgcgcgacctgcgaaagcgtgccccacagtgatatcgacgcgttcgacgcgcggctgcggcaatggcgcgccagcggtggccgtggccgcgcctggatcgcggtggagagcgtgtacagcatggacggcgacagcccgcggctcgacgagctggtcgcggtggcggatcggcacgacgccattctagtgatcgacgaggcgcacgcgaccggcgtcgctggaccggaggggcggggactggccgcttcgttcgagggccgtgccaacgtcatcaccctgcatacctgcggcaaggcgctcggcaccatgggcggctttgtgctcggtccgaagatcgtgcgcgacttcctggtcaaccgggcgcggccgtttatcttcgccaccgcgccgtcgccgctgattgcggcggtgacgcgcgcggcgctcgacatcagccgcacccggccagagcgacgggagcggctcgccgcgctggtcgcgttcgcggatcgcgaactgaagcagcgttgcggcatcacctcgtcgggctcgcacatcctgccgatcatcgtcggcgccaacagcacggcggtggcgctcgcggcatcactgcaacggcgtggcttcgacgttcgcgcgatccggccaccgacggtgcccgaaggcaccgcacggctgcgcatcgcgctcagcgccaatctgtccgaggacgtgatcgcctcgctgttcgcagcgcttgccgaagatatg

SEQ ID NO: 44339 - DNA, 1197 bp, Rhodopseudomonas palustris
gtctggcatccgttcacccagcatgcagtgcagggcgacaccccgacgatcgtgcacagcgagggcgcctggcttcaagccgatgacgggcgacggatcttcgatgcgatcagctcgtggtgggtggtgacgcacggtcatcgccatccgacaatcatctcggcgatcaagcagcagtccgaccagctcgatcagatcatcttcgccggattcacccatccgccggccgaacagctggcgcagcgcctggtcgagatcacgccgcccgagctgacgcacgtgttcttctccgacagcggctcgacctcggtcgaggtcggcctcaagatggcgctcggctattggctgcattccggcgagagccggcggcgtattctggcgctggaaggcgcgtatcatggcgacaccatcggcggcatgtcggtcggtgagcgcggcgtgttcaacgcgccgtatgacccgctgctgttcgatgtcagccggctgccgtttccgcgcgcgggcgccgaacaggcaacgctcgacgcgctggagcaggcatgccgcaatgaggcggtggcggcgctgatcgtcgagccgctggtgctgggcgcaggcggcatgctgatctatccgccctgggtgctcgccgagatggcgcggatctgcaaggcgcacggcctgctgctgatcgccgacgaagtgatgaccggctggggccgtaccggcacgctgttcgcgtgcgagcaagcgaatgtcgtgcccgacatcgcctgctactcgaagggcctgaccggcggctcggtgccgctcgcggtgacgatgtgccggcgcgagatcttcgacgcgcatttctcgaccgaccggcgcaagacgttctttcactccagctcctacaccgccaacccgatcgcctgcgctgcggcgctggccaatcttcaggtgtgggcgagcgagccggtacggcaacggatcgacgatctggcggccgtccacgctcgcgcgctgaaccgtttccgggacgatgcacgtttcagcaatgtccgccagatcggcaccatcgcggcggtcgatctgcaggtcggcgacagcggctatctggccgacgtcgggccgcggctgtacgcatactttatcaatcgcggtctgttggtccgcccgctcggcaacacgatctatctgatgccgccgtattgcagcacggcggtggagatcgag

SEQ ID NO: 44340 - DNA, 1254 bp, Rhodopseudomonas palustris
atgagtaaggtcggtacgagcgactccaagaacaccctgtactgctcgttctgcggaaagagccagcacgaggtccgcaagctgatcgccggccccacggtattcatctgcgatgaatgtgtggaactgtgcatggacatcattcgcgaggagaacaagtcctcgctggtgaagtcgcgtgacggaatcccgacgccgaaggagatctgcaaggttctcgatgactacgtcatcggtcagaaccatgcgaagaaggtgctctcggtcgcggtccacaatcactacaagcggctgaatcaccagaccaagcacaacgacgtcgaactggcgaagtcgaacatcctgctgatcggtccgaccggctcgggcaagacgctgctggcgcagacgctggcgcggatcctcgacgtgccgttcacgatggcggatgcgaccacgctgaccgaagccggctatgtcggcgaggacgtcgagaacatcatcctgaagctgctgcaggcggccgactacaatgtcgagcgggcgcagcgcggtatcgtgtacatcgacgaaatcgacaagatcagtcgcaagtcggacaatccctcgatcacccgcgatgtctcgggcgagggcgtccagcaggcgctgctgaagatcatggaaggtacggtggcgtcggtcccgccgcagggcggccgcaagcatccgcagcaggagttcctgcaggtggacaccaccaacatcctgttcatctgcggcggcgcgttcgccgggctcgagaagatcatctcgtcgcgcggccggaccacctcgatcggctttgcggcacaggtgctcgcgccggaagatcgccgcaccggtgagatcttccgccacgtcgagcccgaggatctgctcaagtacggcctgatcccggaattcgtcggccgtctgccggtggttgccaccctggaagacctcgacgagaactcgctgaagaagatcctgaccgatccgaagaacgcgctggtcaagcagtaccagcggctgttcgaaatggagaacgtcgagctcaccttcgccgacgaagcgcttggcgcggtcgcccgtaaggcgatcgaacgcaagaccggcgcccgtggcctgcggtcgatcctggagagcatcctgctcgagaccatgttcgacctcccgggcctggaaggcgtcgaggaagtggtgatctcgcgcgaagtggtcgatggcaccgcgcggccgctttacatctatgccgaccgcaccgaccgtgcggcc

SEQ ID NO: 44341 - DNA, 2397 bp, Rhodopseudomonas palustris
tcgatcacctacggcgaaagccactcctatccggttcttccgctgcgcgacatcgtcgtgtttccgcacatgatcgtgccgctgttcgtcggccgcgagaagtcgatccgcgccctcgaagaggtgatgaagaacgacgcgctgatcatgctggcgacgcagaagaacgcgtccgatgacgatccggctcccgatgcgatctatgagatcggcacgctggccagcgttctgcagctgctgaaattgcccgacggcaccgtgaaggtgctggtcgaaggcctcgcgcgcgccaaggtcgacaagtacaccgatcgcgccgattactacgaggccgacgccgtcgcgctcgaagacagcgatgccacctcggtggaagccgaggcgctgggccgctcggtcgtgtccgacttcgagagctatgtgaagctcaacaagaagatctcggccgaagtcgtcggcgtggtgcagtcgatcaccgacttcgccaagctcgccgacaccgtcgcatcgcatctcgccgtcaagatcgccgaccgccagggtatcctggagacgctgtcggtgacgcagcggctggagaaggtgctcggcctgatggagagcgaaatctcggtcttgcaggtcgagaagcgcatccgctcgcgcgtcaagcgccagatggagaagacccagcgcgagtactatctcaacgagcagatgaaggcgatccagaaggagctcggcgacgaagacggccgggacgaactcgccgaactcgaagagaagatcgccaagaccaagctctccaaggaagcgcgggagaaggcgcagcacgagctgaagaagctgcgccagatgtcgccgatgtccgcggaagcgaccgtcgtgcgcaactatctcgactggctgctgtcgatcccgtggaacaagaagtccaaggtgaagaaggatctggaagcggctcaggccgtgctggattccgatcactacgggctcgagaaggtcaaggagcggatcgtcgagtatctcgcggtgcagtcgcgcgccaacaagctgtcggggccgatcctctgcctcgtcggcccgcccggcgtcggcaagacctcgctcggcaagtcgatcgccaaggccaccggacgcgagttcgtccgcgtgtcgctcggtggtgtgcgtgacgaagccgagatccgcggtcaccgccgcacctatatcggctcgatgcccggcaagatcatccagtcgatgcggaaggcgaagacttcgaatccgctgttcctgctcgatgagatcgacaagatgggcgccgatttccgcggcgatccgtcatcagctctgctcgaggtgctcgaccccgagcagaacggcaccttcaacgaccactatctcgaggtggactacgatctgtccaacgtgatgttcatcaccacggcgaacaccctgaacattccggggccgctgatggatcgtatggagatcatccggatcgccggctacaccgagaccgagaaggtcgagatcgcacgcaagcacctgatcccgctggcgctgaccaagcacggcctggagccgaaggagtggtcgatcgacgacaacgcgttgttgctcgtcatccgccgctacacccgcgaggccggcgtccgcaacctcgagcgcgagatctctaccctcgcgcggaaggtggtgaaggacctgatgctgtcgaagaagaagtcggtccatatcgacgagaagcagatcgaggaatatctcggcgtgccgaagttccgcttcggcgaaatcgagaaggacgatcaggtcggtgtggtcacgggtctggcgtggaccgatgtcggcggcgagctgctgacgatcgaaagcgtgatgatgccgggcaagggccggatgacggtcaccggcaacttgcgcgacgtcatgaaggaatcgatccaggcggcggcgtcctacgtccgcagccgtgcgatcaccttcgggatcgagccgccgttcttcgagaagcgcgacatccacgtccacgtgccggagggggcgaccccgaaggacggcccttcggccggcgtggcgatggcgactaccatcgtgtcggtgctgaccggcatcccgatccgccgcgatatcgccatgaccggcgagatcacgctgcgtggccgggtgctgccgatcggcggcctcaaggagaagctgctcgccgcggcccgcggcggcatcaagacggtgctgatcccggaagataatgccaaggacctcaccgagatctcggacgcgatcaagggtggtttgaacatcatcccggtggcgcggatggacgaggtgatcgccaacgcgctgacccgcgcgccggtgccgatcgtctgggaagaggaaaccaagctgcccggcaccccggacagcgccgaagccgacgaagccggcggcggcctg

SEQ ID NO: 44342 - DNA, 2094 bp, Rhodopseudomonas palustris
gctcgacgatcagggcgtgctcgatccggcgcacatgcaagcggcggagtgactgccatgatcaagatcatcgtcgacggcaaggaagtcgaagttccgccggagtacacgctgctgcaggcctgtgagtccgctggcgccgagattccgcggttctgttaccacgagcggctgtcgatcgccggcaactgccggatgtgtctggtcgagctgaagggcacgccgaagccggtggcgagctgcgcctggggcgtgcgcgactgtcgcccgggcccgaacggcgagccgccggagatctcgaccaaatcgccgatggtcaagaaggcgcgcgaaggcgtgatggagttcctgctgatcaaccatccgctcgactgcccgatctgcgatcagggcggcgagtgcgacctgcaggaccaggcgatgggctacggcgtcgatcagagccggttcgccgagaacaagcgtgcggtcgaggacaagtatctcggcgtgctggtcaagacctcgatgacccgctgcatccagtgcacccgctgcgtgcgcttcgcggcggaaatctgcggcgtgcccgaaatgggtgcgatcggccgcggcgaggacatggagatcaccacctatctcgaacgggcgctgacttcggagctgcagggcaacctggtcgacatctgcccggtcggtgcgctgacgtccaagccttacgccttcgcggcgcggccttgggagctcggcaagacccagtcggtcgacgtgatggacggcgtcggttcggcgatccgcgtcgacacccgcggccgcgaagtgatgcgcatcctgccgcgcgtcaacgaggcgatcaacgaggagtggatctccgacaagacccgccacgtcgtcgacggcctgcgcacccagcggctcgatcggccgtacgttcgcgagggcggcaagctgaagccggcgagctggcagcaggcattcgccgcgatcaaggccaagctcgacggcacctcggccaagaagatcggcgcgatcgccggcgatctcgccgcggtcgaagagatgttcgcgctgaagcagctgctcgccaaactcggctcgaccaacgtcgcggcgcagaacgtcgcggcgttcgatccgaaggccggccgcgccagctacatcttcaatccgggcatcgtcggcatcgagcaggcggatgcggtgcttatcatcggctccgatccgcgcaaagaggcggcgatcctcaacgcccgcatccgcaagcgctggcgggccagcggcatgccgatcggcgtgatcggcgaccaggccgagctgacctatcactacgactatctcggcgccggcaccgacacgctgaatgatctgatcgccggcaagctcggctttgccgagactctgaagaacgccaagcgcccgatcatcctggtcggcgcggcggcgaccgcacgtcgcgacggcgctgcgatcctgtcgctggccgccaagctcgccgccgacgtcggtgcgctcgatgacggctggaacggctttgcggtgctgcatccggcggcctccagcgtcggcgcgctcgacatcggcttcgtgccgggagcgggcgggctgggcgcagcggagatggcgaccgccggcggcgtcgacgtgctgttctcgctcggcgccgacgaggtcaagctgccggacggcgcgttcgtggtttacatcggcacccacggcgatcgcggcgcacaccgcgccgacgtgatcctgccgggcgccgcctacaccgagaagtccggcatctacgtcaacaccgagggccgcgtgcagatcgcgggccgggcgtcgttcccgccgggcgatgcgcgtgaggactgggcgatcctgcgggcgctatccgaagcgctgggcgccaagctgccctacgactcgctggcggcgctgcgcaaggcgctgttcgccgaggtgccgcatctgatgcgggtcgatcaaatcgaggccggcaatccggccgatctgcgcaagctggcgagcgccggcggcagcgtcgagaagacgccgttcaagccggtgatcgccgatttctacatgaccaacccgatcgcgcgggcatccgcggtgatggcggaatgttcc

SEQ ID NO: 44343 - DNA, 420 bp, Rhodopseudomonas palustris
gacatcaacaccatcctcaagacccttccgcaccgttttccgtttctgctgatcgatcgcgtgatcaacatccgcgaggactacagcggcatcggcatcaagaacgtcaccgtcaacgagccggcgttccagggccacttcccggagcggccggtgtatcccggtgtgctgatgatcgagggcatggcccagaccgcgggcgtgatcggtatcctgtcggtgactgggaccgagaagccgcgcgcggtgtatttcctgaccatcgacaagtgcaagttccgcaagccggtgatgcctggcgataccgtcgagtatcacctgacccgcaccgggcggcgcaagacgatgtggtggtttcacggcgaggccaaggtcgacggacagatcgtggcggaagccgatgtcggcgcaatgctggca

SEQ ID NO: 44344 - DNA, 1299 bp, Rhodopseudomonas palustris
atggacgcaacgaccaacaacaaaacggcaacgctgacggttggaaacaagaacttcgatcttccggtgctcaccgggacagtcggtcccgacgtcatcgacatcggcaagctctacgcgcagaccggaatgttcacctacgatccgggcttcacgtcgacggcgagctgccagtccaaaatcacttacatcgacggcgacgcaggcgttctcgagtatcgcggttacccgattgaacagctcgccgaaaaaggcgacttcctagaaacttgctatctcttgctgtacggcgaactgccgaccaaggcgcagaaggaagatttcgactaccgcgtcacccgccacaacatggttcacgagcagatggcccggttcttccagggcttccgtcgtgacgcgcatccgatggcggtgatggtggcttcggtcggcgcgctcgccgcattctaccacgactccaccgacattaacgatccgacccagcggatggtcgcttcgatccggatgatcgcgaaggtcccgacgctggccgcgatggcctacaagtactcggtcggccagcccttcatctatccgaagaacacgctcagctacgcagcgaacttcctgcggatgtgcttcgcgactccgtgcgaggaatacgtcgtcaatccggtgctggcgaacgcgctcgacaagatcttcacgctgcacgcggaccacgagcagaacgcctcgacctcgaccgtgcgcatcgccggctcgtcgggtgccaatccgttcgcctgtatcgcggcgggtatcgcctgcctgtggggcccggcgcatggcggtgccaacgaagcggcgctggcgatgctgaaggagatcggcaccgtcgagaacatcccggacttcatcgccaaggtgaaggacaagagctcttcggtgcggctgatgggcttcggccaccgcgtctataagaactacgatccgcgcgccaagatcatgcagcaggtctgccacgaagtgctggccgaaaccggccatcacggcgacccgctgctcaaggtggcgatggagctcgagaagatcgcgctcagcgatcagtacttcattgaccgcaagttgtacccgaacgtcgacttctattcgggcatcacgctgaaggcgatgggcttcccgaccgacatgttcaccgtgctgttcgcggtcgcccgcactgtcggctggatcagccagtggagcgagatgatcgaggacccgcagcagaagatcggccgtccgcgccagctcttcaccggtgcgaccacccgcaactacgtcgagatcggcaagcgc

SEQ ID NO: 44345 - DNA, 1413 bp, Rhodopseudomonas palustris
cgtcccgttgtcacccgcttcgcgccctcgcccactggttttctgcacatcggcggaggccgcaccgcgctgttcaattggctgtacgcgcgcaagcacggcggcacgatgctgctgcgaatcgaggacaccgaccgccagcgctcgacccaggaggcgatcgacgccatcctcgacgggctgaaatggctcgggatcgattgggacggcgacaccgtctaccagttcgcacgtgcggcgcggcaccgtgaggtcgccgagcagttgctggcggccggcaaggcctaccgctgttacgccaccgccgaggagctgacggcgatgcgcgacaaggcccgcgccgagggccgcgccaagctgtacgatggaagctggcgcgaccgcgatccgtccgaggccccggcaggcgtcaagccgaccatccggctgaaggcgccgctgaccggcgagacagtgatcgaggatcaggtgcagggccgtgtcgcctggcagaacgagaacctcgatgacctggtgctgctgcgcggcgacggcaccccgacctacatgctggcggtggtggtggacgaccacgatatgggcgtcacccacgtcatccgcggcgatgaccatctgatcaacgcagcccgtcagaagcagatctacgacgccatggagtgggagctgccggtgatggcgcacatcccgctgatccacggccccgatggctcgaaactgtcgaagcgccacggcgcgctcggcgtcgacgcctaccgcgcgatgggatacctgccggccgcgctgcgcaactatctggtccgactcggctggagccacggcgatcaggaaatttttaccacgcaggaaatgatcgatgcgttcgacctgccggcgatcggacgttccgcggcgcggttcgatttcgccaagctcgagagcctcaacggtcactacatccgccagagcgatgatcactctctcgtgactctgctcgaggacctgctgaaatacatcccccagggcccggcgatcgccaccaagttcgacgacagcatccgcgccaagctcacccaggcgatgccggggctgaaggagcgtgccaagacgctgatcgagttgctcgacaacgccggcttcattttcgccgaccggccgctggccctcgatcccaaggcgcaggcggtattgacgcccgaaacccggcagctgatcggccggctgcgcgccgcgctggaggatgtatcgccgtggacggcggcgaccaccgaggcagcgatgcgggcgttcgccgagcaggctgggctgaagctcggcgcggtggcgcaaccgctccgcgtggcgctgacgggacggaccacatcgccgggaatcttcgatgttttggcggtgctggggcgcgacgagtgcctgtcccggctcgccgatcaatccgcg

SEQ ID NO: 44346 - DNA, 1626 bp, Rhodopseudomonas palustris
gacttcattcgcgacatcgtccaggccgatctcgacagcgggaagcaccggaccatcgtgacccggttcccgccggagcccaacggctatctgcatatcggccatgccaagtcgatcgcgctgaatttcggcatcgcgcaggaattcggcggccgctgccatctgcggttcgacgacaccaatccgaccaaagaagagcaggaatacatcgactcgatccaggccgacgtccgctggctcggcttcgattggggcgagcacatgttctacgcctcggactatttcgagcagctctacgcctgggcggagctgatgatcaaaaacggcgacgcgtatgttgacgatcagtcgcaggacgagatccgcgccagccgcggcacgctgaccgagcccggtaagaacagcccgttccgcgatcgctcggtcgaggagaatctcgacctgttccggcggatgaaggccggcgaattcccgaacggcgcgcgggtgcttcgcgccaagatcgacatggcgtcgggcaacatcaacctgcgcgatccggtgctgtaccgcatcctgcacgcccaccatccgcgcaccggcgacaaatggtcgatctatccgagctacgactacgcgcacggccagtcggatgcgatcgaaggcatcacgcattcgatctgcacgctggagttcgaggatcaccggccgctgtacgaatggctgctgtcgaagctgccggtgccgtcgcagccgcgtcagtatgaattcgcgcggctcaacatcacctacacgctgctgtcgaagcgcgtgctgaccgagctggtgcgcggcggccatgtcgcgggctgggacgacccgcggatgccgacgatcgcgggcatgcggcgtcgcggcgtgccgccggcggcgctgcgcgacttcgtcaagcggatcggcgtcgcgaaagccaacagcgtggtcgatctcggtatgctggagttctgcatccgtgaggaattgaaccgcacggcgcagcggcggatggcggtgctgaagccgctgaaggtggtgatcgagaactacccggaaggccagaccgaagaactcgaggcgatcaaccatccagacgatccgagcctcggcacgcgcaagatcgccttcggccgcgagatctacatcgagcaggacgatttcatggagaacccgccgaagaaattcttccgactgtctccaggcaatgaggtgcggctgcgctacgcctacttcatcaagtgccgcgacgtgatcaagaatgacgccggcgagatcgtcgagctgcgctgcacctacgatccggaaacccgcggcggcaacgcgcccgacggccgcaaggtcaaggcgacgatgcactggctgccggcggcgcagtcggtgaaggcggagatccggatctacaatcagctgttcgccaacccggcgccgagcgcgtcgacctttgccgacgatctcaatccgcagtcgctcgaagtcctgaccgaggcgcggatcgagccggagacggcggcgagcacgtcggccgagccgctgcagttcgagcgccagggttacttcgtccgcgatcgcgactcgaccgcagataagccggtgttcaatcgcaccatcgggttgcgcgatacctttgccaag

SEQ ID NO: 44347 - DNA, 2484 bp, Rhodopseudomonas palustris
ggcctcagcgagcgcgaggccgccgcccggctcgccagcgagggctacaacgagctgccaagccctgatcgccgcacgctgctcggcatcgtgctggaggtggtgcgcgagccgatgctggcgctgctgctcggcggcggcgtggtctacatggcgctcggcgatctgaaggaagcgatcatcctgctgatcttcgccacgctgtcggtggtgatcacggtggttcaggaagcacgcaccgaacgcgtgctggagacgctgcgcgatctcaccagcccgcgtgccctggtgatccgcgacggcatccgcaaacgcattgcggggcgcgaggtagcgcgcggagacgtcatggtgttgtcggagggtgaccgcgtcgccgccgacgcggtgttgctgcaggccgacgatctcttggtcgacgagtcgctgctcaccggcgagtcggtgccggtgcgcaagctctctcgcggcgaagccgacgccaccacactgcgccggcccggcggcgacgatcagccggcggtgtactccggctcgctggtggttcgcggcggcggcctcgccgaggtcgtcgccaccggcccccgcagcgagatcggcaagatcggccaggcgctcggctcgttgcaaaccgaagcgccgcgtctgcaaatccagacccgcgcggtggttcgcaccttcggcttcatcgccgccggcttcacggcgctggtcgtggtgctctacggcacgctgcgcgacggctggctcgacgccgtactggccggcatcaccgtcggcatgtcgatgctgccggaggagtttccggtggtgctgacggtgttcatggcgatgggcgcctggcggatctcgcaggcgcgggtgctgacccgccgcgccgccgcgatcgaggcactgggctccgcgaccgtgctgtgcaccgacaagaccggcacgctgaccgagaaccggatgtcggtcgccgaactgcgtctgacctccggcgaggtgttccggccgcgcgagggcggcgcgctgccggtcggatttgcgaccctgctcgagaccggcctgctcgcagctgcgccggatccgttcgatccgatggatcaggcgctgcaccgtttggccggcgatcatctgcccggaggtagcggcgaccgcaccctggtgcacagctatgggctgcgccgtgatcttctcgccatgacccaggtatggcgcgacaccgatgatcgttcagactacgtcgtcgcggccaaaggcgcgccagaagcgatcgcacggatgtgcgggctcgacgatgccacgttgggcgcgctgtcgggcgctgtcgacgcgatggcgaccgagggactgcgcgtactcggagtcgcgcgcacctcgcatcccgatcaggattggccggcaacccagctcggcttccgcttcgagtttcttgggctggtcggccttgccgatccgttgcgcgccgcggttcccgccgcggtcgccgattgccgcgcagctggcatccgtgtggtgatgatcaccggggactatcctgcgaccgcgcaggcgatcgcccgtcaagcggggatcgacgccgaaacatgcgtcaccggcgaggagatcgccgcacttgatgacgccgcactcgccgagcggctgcgccgcgccacagtgtttgcgcgaatcatgccggagcagaagctgcggatcgtccaggcgctcaaggccgacggcgaagtcgtggcaatgaccggcgacggcgtcaacgacgcaccgtcgctgaaggcggcgcatatcggcatcgcgatggggggacgtggcaccgacgtggcgcgcgaggcttccgcgatcgtgctgctcgacgacgacttcgcctcgatcgtcaaagcggtccggctcggccggcggatctacgacaatctggtcaaggcgatgggcttcatcttcgcggtccacgtgccgatcgccgggctggcgctgctgccgctgctgttcgggctgccgatcctgctcgggccgatccacatcgcgttcctggagatgatcatcgatccggtgtgctcgatcgtgttcgaagccgagaccgccgaggacgacgcgatgcgccgcccgccccgcgatcccgaacagccactgttcagccgggcgctgatcgtgtggggcatgttgcaagggctcttggtgttcctgctggtcgccggcgtgttcgtgattggccagatgcgcgcgatgccggataccgagctgcgcgcgctgacgttctttgcgctggtgctgagcttcgtcggactgatcttcgtcaaccgctcgttcagcgcctcgctgctgacggcgctgcggcgacccaacgctatgctggcggggatgctcggtatcgtcgcggtggtgctgatcgccagcctggcgtggccctggctgcgcgatctgttccgcttcggcccgctgcatccggacgatctcggcctcaccgcggccgcggcactgttggtgcttatcgtactggagctggtcaag

SEQ ID NO: 44348 - DNA, 744 bp, Rhodopseudomonas palustris
cgtcctctgattgctggaaactggaagatgaacggcctgaaggattcggtggccgagctcgatgcgatgctgaaaggcgccgcggaactgccgcagggcatcgatctgttggtctgcccgccggcgacgctggtggcgagcttcgcggcgcgagtcgcggaagcccaggccggcaaggcactgccgttctcgatcggcggccaggattgccacgccaacgcctctggcgcccacaccggcgatatcgccgccgagatgctggccgatgccggcgctgcggcaatcatcgtcggccattccgaacgccgcgccgaccatgccgaaaacgacgcgatcgtccgcgccaaggcgcaggcggtgtggcgcgccgggctggtggcgatcgtctgcgtcggcgagactcagggcgagcgcgacgctggccacaccctcgatgtggtcgccggcatgttggccggctcgctgccggacggcgcgaccgcggcgaatctggtggtggcttacgagccggtctgggcgatcggcacgggacggaccccgaccgcggccgatgtcgaggaagttcatggctttattcgcaagactttgagcgatcggttcggcgctgcgggcgagacgatgcgaatcctctacggcggctcggtgaagccctcgaacgcccgcgaattgctggcggtgccgcacgtcaacggcgcgctgatcggcggcgccagcctgaaggcgtccgatttccttgcgattgcg

SEQ ID NO: 44349 - DNA, 1272 bp, Rhodopseudomonas palustris
atgaccgccatcgtcgacatcatcggccgcgaaattctcgacagccgcggcaatccgaccgtcgaagtcgacgtggtgctcgaggacggctccgtcggccgcgccgccgttccgtcgggcgcctccaccggcgcccacgaggcggtcgagctgcgcgacggcgacaaggcccgctatctcggcaagggcgtgcagaaggcggtcgaggcggtcaacggcgagctgttcgacgcgctcggcggcatggacgccgaacagcaggtgcagatcgatcagaccatgatcgagctcgacggcaccccgaacaagggccggatcggcgccaacgccatcctcggcgtttcgctggccgcggcgaaggcggcggcggcatcctacgacatgccgctgtatcgctacgtcggcggcacctcggcccgcaccctgccggtgccgatgatgaacatcgtcaacggcggcgtgcacgccgacaatccgatcgacttccaggaattcatgatcatgccggtcggcgcgccgaccttcgctgacgcgctgcgctgtggctcggagatcttccacaccctcaagggcgaattgaagaaggccggccacaacaccaatgtcggcgacgaaggcggctttgcgccgaacctgccgtcggccgatgcggcgctcgacttcgtcatggccgccatcggcaaggccggctacaaggccggcggcgacgtgatgctggcgctggactgcgccgccaccgagttcttcaaggacggctcctacgtctatggcggcgagaacaagacccgctcgcgctccgagcaggccaagtacctcgccgatctcgtcgcgcgctatccgatcgtgtcgatcgaagacggcatgagcgaagacgacatggacggctggaaggagctgaccgatctgatcggcagcaagtgccagctcgtcggcgacgatctgttcgtcaccaacgtcacccggctcgcggacggcatcaagaacggtcgcgccaactcgatcctgatcaaggtcaaccagatcggcacgctgaccgagacgctcgccgctgtcgaaatggcgcacaaggccggctacaccgcggtgatgtcgcatcgttcgggcgagaccgaggactcgaccatcgccgacctcgcggtcgccaccaattgcgggcagatcaagaccggctcgctggcgcgcgccgaccgcaccgccaagtacaaccagctgctgcgcatcgagcaggagctcggcgctcacgcgcactacgccggcaaggcggcgctgaaa

SEQ ID NO: 44350 - DNA, 1029 bp, Rhodopseudomonas palustris
gccatggccgcacccaagaagagcgccgcgaaggaaacaacacaggacaaggccggaggagcgtcaccatcgaacgtgccgcctttcaccaaggagcaggagctcggcgcttttcttgaaatgctgctgatccgccgcttcgaagagaaggccggtcagctctacggcatgggtgcgatcggcggattctgccacctctacatcggccaggaagccgtcgtcgtcggcatgcagatggcgctgcgcgaaggtgatcaggtgatcaccggctatcgcgatcacggccacatgctcgcctgcggcatggaggcgaacggcgtgatggccgagctcaccggacgccgcggcggctactccaagggcaagggtggctcgatgcacatgttcagccgggagaagagtttcttcggcggacacggcatcgtcggcgcgcaggtctcgctcggcaccggcatcgccttcgccaaccgctatcgcggcgatggccgcgtctgcctcgcttatttcggcgacggcgccgccaatcagggccaggtgtacgagagcttcaacatggcggagctgtggaagctccccgtagtttacgtgatcgagaacaaccgctacgcgatgggcacgtcggtgacgcgttcctcggcgcagaccgatttctctaagcgcggtgtgtcgttcaatattccgggcgagcaggtcgacggtatggacgtgcgtgcggtgaaggccgccggcgacaaggcggttgcacattgccgcgccggaaacggcccgttcatcctcgaaatgcagacctatcgctaccgcggtcactcgatgtcggacccggcgaaatatcggtcgcgcgaagaagtcgacaagatccgcaacgatcaggatccgatcgagcaagtgcgcaagcgtctgcttgggctcgacatgaccgaagacgatctcaaggcgatcgatgccgaggtccgcaaggtcgtcaacgagtccgcggacttcgctcagcacgatctcgagcccgatccgtcggagttgtacaccgatgtg

SEQ ID NO: 44351 - DNA, 1407 bp, Rhodopseudomonas palustris
atgccaatccaagttctgatgcccgcgctgtcgccgaccatggagaagggcaacctgtcgaaatggctgaagaaggaaggcgacaaagtcaaaagcggtgatgtcatcgccgagatcgagaccgacaaggcgacgatggaagtcgaagccgccgacgaaggtacgctgggcaagatcctgattcccgaaggtaccaacgacgtcgcggtgaacaccccgatcgccaccatcctgggcgacggcgaaagcgcggccgatgccgacaaggcgtccgacccggccgcacagagcaaggcctcgcaatcggcgccgccgtcggcggagcctgaggccgcgcaggcgaagtccgcacccgcgcccgcccagcacgcgcccgaagcgccgacggtgtcggcggcggctgatccggatattcctgccggcactgagatggtgacggtgacgatccgcgaagcgttgcgcgacgcgatggcggaggagatgcgccgcgatcccgacgtgttcgtgatgggcgaagaggttgccgagtatcagggcgcctacaaggtcacccaggggctgctgcaggaattcggcgaccgccgcgtgatcgacaccccgatcaccgaacacggcttcgccggcgtcggcgtcggcgccggctttgccgggctgaagccgatcgtcgagttcatgaccttcaacttcgccatgcaggcgatcgaccagatcatcaactcggcggcgaagacgctgtacatgtcgggcggtcagctcggctgctcgatcgtgttccgtggtccgaacggcgccgcctcgcgcgtcgccgcgcagcacagccaggactactcggcctggtacgcgcagatcccgggcctcaaggtggtggcgccgtattcggccgccgacgccaagggcctgctcaaggccgcgatccgtgatcccaatccggtgatcttcctcgagcacgagatgctgtacgggcagcacggcgaagtgccgaagctcgacgactacgtgatcccgatcggcaaagcgcgcatcgtccgcgagggcaaggacgtcacgctgatctcgtggtcgcacggcatgacttacgcgctgaaggccgccgacgaactggcgaaggatggaatcgccgccgaagtgatcgacctgcgtacgctgcgtccgctcgacaccgacaccatcatcgcctcggtgaagaagaccggacgcgcggtgacgatcgaagagggctggcagcagaacggtgtcggcgccgaactctccgcccggatcatggagcatgcattcgattacttggatgcgccggtgactcgcgtgtcgggcaaggacgtgccgatgccgtacgcggccaatctcgaaaagctggcactgcccagcgtcgccgaggtggtcgaggccgccaaagccgtctgttatcgg

SEQ ID NO: 44352 - DNA, 1389 bp, Rhodopseudomonas palustris
atgccgatcaacattctgatgcccgcgctgtcgccgaccatggagaagggcaaccttgcgaagtggctgaagaaggagggcgacaaggtcaagagcggcgacgtcatcgccgagatcgagaccgacaaggcgacgatggaagtcgaagccgccgacgaggggacgctcgccaagatcatcgtgcccgaaggcacccaggacgttcccgtcaacgacgtgatcgcggtgctggctgcggacggcgaggacgtcaaggcagcgggggcaggctggaaggccagtgccggcggtgctccctctccccagaggggagagggagccggcccctcgggcggcaaggccgaggccaattcgcacatacaggacaaggctgaccaaaggccgacgccacagccgccttcgcctctccccaacggggagaggtcgctgccgcaggcggcgggtgagggggctccagcgccggcgaatggccgcgtgttcgcttcgcctttggcgcggcggctggcgaaagacgccggcatcgacatcgcccgggtcaccggaaccggcccgcacggccgcgtcatcgcccgcgacgtcgagcaggccaagtctggcggtggcctcaaggctccggcttcggcgcccgccggtcctgcgatcgctgcggcgatgtcggatcagcagatccgcgcgctgtatccggaaggctcctatgaagtcgtgccgcacgacggcatgcgccggaccattgcgcaaaggttgacacagtcgacccagaccatcccgcatttctatctgacgatcgactgcaacctcgaccggctgctggctgcccgcgaggacatcaacgccgccgcgccgaaggacaaggacggcaagccggcctacaagctgtcggtgaacgacttcatcatcaaggcgatggcgatcgccctgcagcgcatccccgacgccaacgtatcatggaccgaaggcgggatgctgaagcacaagcattccgacatcggtgttgcggtggcgatgccgggcggactgattaccccgatcatccgcagcgcggagacgcagtcgctgtcgtcgatctcagcgcagatgaaggacttcgctgcccgcgcacgggcccgcaagctgaagcccgaagagtatcagggcggcaccacggcggtgtccaatctcgggatgttcggcatcaaggacttcaccgcggtgatcaacccgccgcatgccaccatcctggcggtcggcaccggcgagcagcgcgccatcgtcaaggacggcaagatagaggtcgccaccatgatgagcgtgacgctgtcttgcgatcaccgtgccgtcgatggtgcgcttggcgccgaactgatcggcgccttcaagacgctgatcgaaaatcccgtgatgatgatggtg

SEQ ID NO: 44353 - DNA, 1401 bp, Rhodopseudomonas palustris
ttcgacgtcatcatcatcggttccggccccggcggctatgtcgcggcgatccgggcggcgcagctcgggttcaagaccgcgattgtcgagaagtcttatctcggcggcatctgcctgaactggggctgcatcccgaccaaggcgctgctgcgctcggcggaaatctatcactacatgcagcacgccaaggattacgggctgtcggcggacaacatctcgttcgatccgaaggcgatcgtgcagcgctcgcgcggggtgtcgaagcggctgaacgacggcgtcggcttcctgatgaagaagaacaagatctcgatcatctggggccaggcaaccatcgatgcgccgggcaagctgacggtcgctgcttccaagaccgatgcgccgaagggcgcgctgccgccgggcagctatcaggccaagcacatcatcgtcgccaccggggcacggccgcgggtgctgccggggctcgaaccggacaagaagctggtctggacctatttcgaagcgatggtgccggaagtgatgccgaagtcgctcttggtggtcggctcgggcgcgatcggcatcgagttcgcctcgttcttccacaccatgggcgccaaggtcaccgtggtcgaagtgctgccgcagatcttgccggtcgaggacgccgagatcgccgcgctcgcccgcaagcggttcgagaagcagggcatcaagatcctgaccggcgccaaggtcaccaagctcgacaagaaggccgacagcgtggttgccaccatcgatcccggcaacggcaagccagagactgcggagttcgaccgtgtgatctcggcggtcggcgtggtcggcaatgtcgaaaacctcggcctggacaagctcggggtgaagctcgaccgaggcaccatcgtcaccgacgggctcggccgcaccaacgtccccggcctctatgcgatcggggacgtcgccgggccgccaatgctggcgcacaaggccgagcacgagggggtgatctgtgtcgaggccatcaagggcctgcatccgcatccgctcgacaagagcctgatcccgggctgcacctactgccagcctcaggtggcctccgtgggcctgacagaggccaaggcgaaggagcagggacgggagatccgggtcggccgcttcccgttcaccgccaacggcaaggcgatcgcgctcggcgaggaccagggcctggtcaaggtgatcttcgacaagaagaccgggcagctcttgggtgcgcatatgatcggcgccgaagtgaccgagctgatccagggctacgtggtggcgatgaacctcgagaccaccgaggaagaactgatgcacaccgtcttcccgcacccgacgctgtcggagatgatgaaggaagccgtgctcgacgcctacggcaaggtgctcaac

SEQ ID NO: 44354 - DNA, 762 bp, Rhodopseudomonas palustris
atgcggattgcgacttggaacgtcaactcggtccggcagcggctggaccatctggtcagctggctgcaggactgccagcccgacgtggtctgcctgcaggaaatcaaatgcgtcgacgaggcgtttccgcgcgagccgatcgaggcgctcggctacaacgtcgtcacccacggccagaagactttcaacggcgtggcgctgctgtcgaaatacccgctcgaagaagccaatccgggtctcgccggggacgagagcgacgtgcacgcccggtttctcgaaggcgtcgtgtcgctgaagcacggtgtcgtccgcgtcgcctgcctgtacctgccgaacggcaatccggtcggcagcgagaagtatccctacaagctgagctggatggcgcggctgcgcgactacgcccagcagcggctgaagaccgaggagccgttgatcctggcaggcgacttcaacgtcatcccgcaggctgaggacgtccacaatccggccgcctggaccgaggacgcgctattccggccggagacccgcgagagtttccagaccctgctcgggctcggcctgaccgacgccctgcgcgccaccaccgacgcgcccggccaatacaccttctgggattaccaggccggcgcctggcagaagaactgggggatccggatcgaccacctgctgctgtcgccccaggccgccgaccggctgcgtcatgtcgggatcgacagctatgtgcggaattgggagaagccatccgaccacgttccggtg

SEQ ID NO: 44355 - DNA, 585 bp, Rhodopseudomonas palustris
ctgcggcggcgcggcatcagtgatcaggcggtactgcggaccatggaggcggtgccgcgcgaccagttcgtcgaccccggctatcgcgacggcgcctggcgcgacaccgcgctgccgatcgcctgcggccagaccatcagtcagccgttcgtggtcgccttcatgaccgagcagctcgagctgcgtccgcgcgaccgcgtgctcgagatcggcaccggctccggctaccacgcggcggtgctgtcgcggctggcggcggacgtgctcagcttcgagcgcttcaagacgctggccgaccgcgcccgcaaacgactcgccgagctggggtgccgcaatgtcgaggtggtattcggagacggattcgatctgccggagaccgccggcacatttgaccgcatcctgatcactgccgctgtcccggagctgcccgcgcggctgctcgagcgactcgatcctggcggtgttctgatcgcaccggtcgggccgccgaacggtcgacagacgctgctccgtgtacgccgcacgccgaacggcgacgagcacaaggccctgggtgaggttcgtttcgtgcccgctctccgcggc

SEQ ID NO: 44356 - DNA, 1944 bp, Rhodopseudomonas palustris
ctcgatggcctcaatcccgagcagcgctgcgccgtcgagcacggcgcggggccggcgccctgcccgccgctactcgtgatcgccggcgccggcagcggtaagaccaacacgctggcgcaccgggtggcccatttggttgtcggcggcgccgacccgtatcgcatcctgctgatgacgttctcgcgccgcgccgccgccgagatgacccgccgggtcgagcggatcgcccgcaaggtgctcggcgaccgcgcatcggcgctgagcggcggcctgcactgggccggcacgttccacggcatcggcgcccggctgctgcgcgactatgccgagcggatcgggctcgatccaggtttcaccatccacgatcgggaagactctgccgatctgatgaacctggtccgccacgaccttggcttctccaaggccgacagccggtttcctgcaaaggcgacgtgcttgtcgatctactcgcgctgcgtcaatgccggccagccgctcgatgtcgtgctcggcgccaactacccgtggtgcgccggctgggccgccgagctgaagcaactattcgcggcctatgttgaagccaagcaacgccacaacgtgctcgattacgatgacctgttgctgtactgggcgcaggtgatggaggagccggctttcgccgaagagatcggcagccggttcgatcacgtgctggtggacgagtatcaggacacgaacgcgctgcaggcgcgggtgctactggcactcaagcccaacggcgtcggattgaccgtggtcggcgacgacgcccaggcgatctactcgttccgcgccgccacggtgcgcaacatcctcgacttcccgaaggccttcgatccgcccgcccgcgtcgtcacactggaccgcaactatcgctcgacccaggcgatcctgtcggccgccaacggcgtgatcgatctggcacgcgagcgcttcaccaagaacctgtggaccgaccgcgccgacggtgcacggccgctgctggtcagcgtgcgcgacgaaaccgatcaggcgcgctacatcgtcgagcgggtgctcgatgcccgcgagggcggcgtaacgctgaagcagcaggcggtgctgttccgcacctcgtcgcattccgctccgctggagctcgagctgacccggcgcaacatcccgttcgtcaaattcggcgggctgaagtttctcgacgccgcgcacgtcaaggacatgctggcgctgctgcgcttcgtgcagaacccgcgcgaccgcgtcgccggattccgggtgatgctgctgatgcagggtgtcggcccggcgtcggcgcagaaggcgctggatacaatgacggccgcggccgacccgctcggcgccctcaccgcgctgcccgccccgccgcgcgccggtgccgactggcgcggcttcgtcgccgcggtacaggagctgcgcagcggcgatgccggctggcctgcggagattgagcgggcgctgatctggtacgcgccgcatctcgatcgcatccacgaggatgccgaaacccgcaaggccgacctggtgcagctcgcgcagatcgcctcgggctatccgtcgcgcgagcgcttcctcaccgaattgacgctcgatccgccggacgcgacctccgatcaggccggtgtaccgacgctcgacgacgattatctgatcctgtcgacgatccattccgccaagggccaggaatggaagcaggtgttcgtgctcaacgtcgtcgatggctgcatgccgtccgacctcggcaccggtacctcggccgagatcgaggaagagcggcgcctgctgtatgtggcgatgacgcgggcgaaagacgatctgcacctcgtggtgccacagcggttcttcacccacggccagaacgcccaaggcgaccgccacgtctatgcggcccgcacccgcttcattcccgagcggctgctgccgctgttcgaa

SEQ ID NO: 44357 - DNA, 1656 bp, Rhodopseudomonas palustris
gccaacttcgtgccgctgtcgccgttgagcttcctggaacgcaccgccaacgtctatccggagatgacctccgtggtgtacgaggggcggcactacacctggaaagagactcgcgcacgctgccgccgctttgcttcctggctgacccgcagcggcatcggccgtggcgacaccgtcgcggtgatgctgcccaacgtgccggcgatggtcgaagtgcatttcgcggtgccgatggccggcgcggtgctgaacgcgctcaacattcggctcgatgctgcggcgatcgcgttccagctcgatcacggtggcgccaagatcatcctggtcgatccggagttctccagcgtcgtcgccgaggcgctgaagctgatgaccaagccgaagccgctggtgatcgacgtcgacgacaagatgtatcccggtagccaccgtatcggcgaactggaatacgaatacgcggtcgcgtccggcgatccgaccttcgccggccatcgccccgaggacgagtgggacgcgatctcgctcggctacacctccggcacgaccggcaatccgaagggcgtcgtcacgcatcatcgcggcgcgtatctcaacgccgtcagcaacattctcgccggcaatctcggccagcatccggtgtatctgtggacgctgccgatattccactgcaacggttggtgcttcccgtggacgctcgcggccgcggccggcatcaacgtctgcctgcgcaaggtcgatccggccaagatcttcgaactgatcccgaagcacggcgtcactcatatgtgcggcgcaccgatcgtctacaacgcactgatcaatgcacctgaagcgccgaagggcgttccgacgaagcccgtggtcggcctgatcgccggcgccgcgccgccgatggcggtgctggccggcgccgagaccatcggcatcaagctgacgcatgtgtacggcctgaccgaggtctacggccccgcctcggtctgcgccgagcagcccggctgggacgagctgccggtcgccgagcgcgccaagctgaagcgtcgccagggcgtgccctacccgatgcaggaagccgtcaccgtgctcaatccggagacgatgcaggaagtgccgcgcgacggcgagaccatcggcgaggtcatgttccgcggcaatatcgtgatgaagggctatctgaagaacgagaaggctaccaaggaagcgctcgccggcggctggtttcacaccggcgacctcggcgtgctcgatgccgacggctacgtcatcatcaaggaccgctccaaggacatcatcatctcgggcggcgagaacgtctcgtcggtcgaggtcgaagacgtgctgtacaagcacccggcgatcctgttcgccgccgtggtcgccaaacctgatccgaaatggggcgaagtcccctgcgccttcgtcgagctgaaggacggcgccagcgccaccgaagccgagatcatcgcctactgccgcgaacacctccccggcttcaagaccccgaagagcatcgtgttctcgtcaatcccgaaaacctcgaccggcaagatccaaaaattcatgctgcgcgatcaggtgaagtcggcgaaggcgatcttggagtagttagttttcgtcattccggggcgcgcgaagcgcgaacccggaatttcgaggtta

SEQ ID NO: 44358 - DNA, 812 bp, Rhodopseudomonas palustris
ttgcccgctttcgcagcgacccagccttcaccgattctgctgcgtgagaccgtcgatggcggtgttgcagtgctgacgttgaaccgaccggccgcgcgcaacagcctgtcgctggaaatgatcgacgatctgcacgcggcgctggatctgatcgcgcgcgacgatggcgtgcgtgtcgtggtgatcgccgcaaatggcccggcgtactgcgccggccatgaccttaaagagctgaccgcgcatcgcaacgacgccgatcgcggccgcgccagcttcacccggatcatgaccgcctgcagtgcgatgatgcaggccatcgtcaagctgcccaagccggtgatcgcggcggtgcagggcgtcgccaccgcggcgggctgtcagctggtcgcgagctgcgacctcgcgatcgcatccgagcaggcgaccttcgcgacgcccggcgtcgatatcggactgttctgctccaccccgatggtggcgctgtcgcgcaacgtgccgcgcaagaacgcgatgcacatgctactgaccggcgagccggtcggcgccgaagaggcccgccagatcggcctgatcaaccgcgtggtgccacacggcaccgagcgcgccgcggccgtcgcactggccgagcagatcgccggcaagtcggcccacaccatcaagatcggcaaggaggcgttctaccgccaggccgagctcaacctcgccgacgcctatcactacgcctcgcaggtgatggccgagaacatgatggccgccgatgccgaagaaggcatttgtgccttcctggaaaagcgccagccggaatggaagga

SEQ ID NO: 44359 - DNA, 1272 bp, Rhodopseudomonas palustris
atgaccgaacgcaacccaggattcgcgacgctcgcggtccatgccggcgcccagcccgatcccaccaccggtgcgcgcgcgacgccgatctatcagaccacatcatttgtcttcaacgacgccgaccatgccgcctcgctgttcggcctgcaggcgtttggcaacatctacacccgcatcaccaacccgacgacgtcggtgctggaagagcgcgtcgccgcgctggaaggcggcaccgcggcgctcgccaccgcctcgggccacgccgcccagctcgtcgcgctgcagcaactgatgcagcccggcgacgagttcatcgccgcgcgcaaactgtacggcggctcgatcaatcagttcacccacgccttcaagagcttcggctggaacgtggtgtgggccgacaccgacgacctcgccagcttccagcgggcggtgtcgccaaagaccaaggcgatcttcatcgagtcgatcgccaatccgggcggcagcatcaccgacatcgaggcggtagcggaagtcgcgcgcaatgcgggcgtgccgctgatcgtcgacaacacgttggcgacgccctacctgatccgcccgatcgaccatggcgcagacatcgtggtgcattcgctcaccaagttcctcggcggccacggcaactcgctcggtggtatcatcgtcgatgccggcaccttcgactggtcgaaggacggcaagtatccgatgctgagcgagccgcgtcctgaatatcacggcctgaagatccaggagacgttcggcaacttctcgttcgcgattgcctgccgcgtgctcggcctgcgcgatctcggtcccgcgctgtcgccgttcaacgccttcatgctgctgaccggcatcgagacgctgccgctgcggatgcagaagcactgcgagaacgccaaggcgattgccgaattcctctccacccacaaggcggtagacgaggtcaactactccggcctcgcgtcgagtaaatacgccgccctcgcccgcaaatatgcgccgaagggcgccggcgcggtgttcaccttcagcctcaagggcggctatcaggcgggcatcgatctggtcgccaatctgaagctgttctcgcacctggccaatgtcggcgacacccgctcgctgatcatccacccggcctcgaccacccacagccagcttgacgacgcccagaagaccgccgccggcgccgcacccaacatggtgcgggtgtcgatcggcatcgaggacaaggacgacctgatcgccgacctcgaccaggcactc

SEQ ID NO: 44360 - DNA, 1659 bp, Rhodopseudomonas palustris
ctggtcggcggacaattgctggcaaagacgctgaaggccgccggtgtcagccaggcatttgcgctgcacggcggacatctcgaagcgctgctcaaggggtgcatcgaggaagagattgcactgatcgatttccgtcatgagtcgtcagccggccacgctgccgatgcgtatgcgcgtgcgaccggcaagctcggtgtgtgcatcgtcaccgccgggccagggttcaccaacgtgctgtcggcgatgaccaatgcgcagctcgatggctcaccggtgctgttcatcgtcggcgccccgccgctgcgtgaggtggaaaccaatccgctccagggcgggatcgatcaggttgcgatggctcggccggcggtgaaatgggcgttctcgatccccagcacggagcggatcgccgatctgacggcgatggctatccgcaaggcgatgacgctgccgcggggcgccgtgctgctcgaagtgccgatcgacgtgctgcacatgagcgtcgctgctgcgcgcgccactcctccggccggcgtcggcgtcaatccgcgcccggcgcctgccccggctgaggtcgcgcgattagttgaactgctgcaggcagccaagcgccctgtgctgatcgccggcaatggcgcagccaatcatgaaacggcggaggcgctgcgagcactgtgtgccagggtgccactgccggtcttcaccaagtctctggcggccggcatcctgccgccgggccaccactgcaatggcggggcagcgggcaacctcgccttgttgccgatgctggggattgatcggccggatctcgttatcctgctcggcggcaaactcggcctgttgctcggcggacgttcgggcgcactggtgccgcatggcgcaaccctggtgcagatccacggcgatgcggccgagatgggccggatccgcgacgtcgatctggccatcctggcggattgcaccgaagcgacgcgcgcgctcgacgcagctctgaaagacggccagtttgaggagatggaggcttggcgggcgcaggcattctcggcaaccgggctgttcgcgacgatgttccccgagcgcgaaacgacacgaggcattcatccgtatcatgcggcccgcgccgtggctgacgcggctgggactgaggctgcctatgtgttcgatggcggggaagcggcgtcgtggggcgctgcggcagcggtcgtcgaccggccgggagcgctgctcggtcacggctatctcggctgcctggggatcggaccggggttcgcgatcggcgcccaactcgccgctccggagcgccgggtgatccacctgaccggtgacggcgcacttggattccacctgcaggaactcgacaccatggtccggcaccgcttgccgatcgtcaccgtggtcctcaacaatgaagtctggggaatgtcgatccacggacagcaaatcatgttcggcagcaactatcatgtgatctcgaagctgggcggaacgcagtttgccaacatcgcccaggctttcggctgtcacgccgagcgtgtgacccggtttgccgatctcgcgccggcgctggagcgcgccttcgccagcggcggcccggcctttgttgaagtgatgacggatgccgacgttgtgcatccggtcacggtggcgatgctcggtcaggtt

SEQ ID NO: 44361 - DNA, 966 bp, Rhodopseudomonas palustris
attcgttcggtcgtactgggctgcggcgcttacttgccggagcgggtcctcaccaacgaagaactggcccggacggtcgacacctcggacgaatggatcgtccagcgcaccggaatccgcgaacgccacatcgccgccgatggcgaattcacctcgcatctggccaccaaggccgcccaggcggcgctcgacaatgcgggcatcactgccgatcagatcgacctgatcgtgctggcgacctcgacccccgaccacaccttcccggcgactgcagtgcaggttcaggccgcgctcggcatgacccacggcgtcgccttcgacctgcaggcggtgtgctccggcttcgtgttcgcggtcgccactgcggacaattacctgcgcgcgggctcggccaagcgggcgctggtgatcggcgccgagaccttctcccgcatcctcgactggaatgatcgcggcacctgcgtgctgttcggcgacggtgccggcgcgatcgtgctcgaggcgcaggaaggctggagtacgtccgctgaccgcggcgtgctgaccacgcatctgcgctcggacggtcgtcacaaacacaagctgtatgtcgacggcggcccgtcgagcacccagaccgtcggccatctgcggatggaagggcgcgaggtgttcaagcacgcggtcggcatgatcaccggggtgatcgtcgacgctttcaacgcctccggcaccagcgccgacaatgtcgattggttcgtgccgcatcaggccaacaagcggatcatcgacgcctcggcgcagaagctgcacatcgcgcccgagaaggtggtgatgacggtcgaccgccacggaaatacctcagcggcctcgattccgctggcgttgtgcactgcggtcgctgacggccgcatccaaaagggccacttggttctgctcgaagcgatgggcggcggcttcacctggggcgccgcgctgctccgctgg

SEQ ID NO: 44362 - DNA, 1050 bp, Rhodopseudomonas palustris
atggcgatcaaattcggccgtcccatcgagattcgtgacccctcgacccggcccgccgctccgccgctcgatctcaccatccgtccgcgccgcaaccgcaagaccgagtgggctcgccgtctggtgcgtgagaatgtcctcaccaccgacgacctgatctggccaatgttcgtggtcgacggcaccaaccagcgggttcaggtcgcctcgatgccgggcgtcgaacgactcagcgtcgaccagatcgttcgcgacgccgaacgcgccgcgaagctcgacatcccgtgcatcgcgctgttcccgttcaccgagccgtcgctgcgcgacgagcacggcaccgaagccgccaaccccgaaaacctgatctgcaagaccgtccgcgcgatcaagaaggaattcccgcagatcggcgtgctgtgcgacgtcgcgctcgacccctacaccagccacggccatgacggcctgatcgaggacggccgcatcctcaacgacgagaccgtcgcggtgctggtgcagcagtcgctggtgcaggcgcaggccggctgcgacgtgatcgcaccgtcggacatgatggacggccgcatcggcgcgatccgcgaagcgctcgatgccgccggctacctcgacgttcagatcatggcctatgcggccaagtatgcgtccgccttctatggcccgttccgcgacgcgatcggctcggccaaggcgctcaccggcgacaagcgcacctaccagatggatccggccaacaccgacgaggcgatccgtgaggtcgagctcgatctcgccgagggcgccgacatggtcatggtcaagccgggcatgccgtatctcgacatcgtccgccgcgtgaaggagaccttcggcgtgccgaccttcgcctatcaggtgtcgggcgagtacgcgatgatcgccgcggcagccaacaatggctggctggacggcgaccgggcgatgatggagagcctgctcgccttcaagcgcgccggcgccaacggcgtgctgacctacttcgccccggcggcggccgaaaagctgcggcagcagggc

SEQ ID NO: 44363 - DNA, 888 bp, Rhodopseudomonas palustris
atggcagccaagacgaaatttcgggggtcgtttaccgccttggtcacgccgttcaaaaatggcgccctcgacgaacaggcgtttcgcagcctggtgaactggcagatcgagcagggcacccacggtctggtgccggtcggaaccaccggcgagagcccgacgctgagccacgaggaacaccacaaagtggtggagtggtgcatcgcggaggccaagggccgcgtgccggtgatcgccggcgccggttccaattcgacccgcgaagccgtcgagcttgcgcgccacgccgagaaggcgggcgccgatgcggtgctggtggtgacgccgtactacaacaagccgacccaggaaggcatgtatcagcacttcaaggcggtgaacgacgcgatcgggattccgatcatcatctacaacattccgccgcgctcggtcgtcgacatgtcggtcgacaccatgagccggctgtatgagctcgacaacatcgtcggcgtgaaggacgcgaccgccaatctcggccgggtgtcgcagcagcgccacgcgatgggcccggacttcatccagctctccggcgaggacatgaccgcgctggcctatatggcggccggtggccacggctgcatctccgtggtgtcgaacatcgcgccgaagctgtgttcggatctgatgggcgcggtgttcgcgggcgactatcctggcgcgctgaagatccaggaccgtctggtgccgctgcacgacgccgtgttcaaggagccgggcgtcgccggtgccaagcatggcttgacgctgctcggccgtattcaggaagatgtccggctgccgctgatgacggtgaccgaaccgaccggcaaggcgatccgtgcggcgatggtgcacgcaggagtgatcaac

SEQ ID NO: 44364 - DNA, 1149 bp, Rhodopseudomonas palustris
atcgagcctaacagctacgacgccatcgttgtcggcggcggccccgccggcctgaccgccgccatcgcgcttgccgaaaccggcgccgtcaccgcattgatcgcgcgacaagtgccctacggcgataatcgcactacggccctgctcggcgattcgatcgacattctcgaccggctcgacgtctggcgccgctgctcgagcaaggccgccgcgctgcgatcgatgcgactggtggacgacaccggccggttgatccgggcgccagaagtgaagttcgcgtccgatgaaatcggcatggacgcgttcggctacaacatcgagaaccgtgccctgctggtcggcctcgaagaacgcgcggccgagctgtcgaacctgcagcgtttcgacgatgaagctgaatcagttgtgccgggcgacgacgaagtgatcgtgcggatgcgcggcggccggaccgtctcggccaagctggtggtcggcgccgacggccggcagtcccaatgccgcgaggccgccggcatcaaggtgagtagccgcgccctgcaccagtcggcgctgaccttcaatgtcaagaccacccgctcccacgacaacatctcgaccgaatttcacaccaaggaaggcccgtgcgtgttcgtgccgctgccgggtcggcggatgagcatcgtctgggtcgcggcgccgaaggaagcgcagcggctgatggcgctatccgacgacgaactgtctgcagcggcggaaaagcagtcacagtcgatctacggtaggatgaccgtcgagcccggccgcaatctgtttccgctggcgatcgagaagcccgccgcttacgcacagcggcgcatcgcgttggttggtgaggccgctcacgtcgtccccccgatcggcgcgcaggggttgaatatggggctgcgggatgccggggacctcgccgagatcgtgcgcgacgcgatggcgaatggcacggacatcggctccgacgctgtgatgacgcgctatggccgtagccgcgggcccgacatcgccagccgcaccgccgcgatcgacatcgccaaccgcaccctgctcagcgatctcttgcccgcgcagatgctgcgggcgacggggatgcatctgatcagctcggtcggcccgatccgccggttcgcgatgcgc

SEQ ID NO: 44365 - DNA, 1824 bp, Rhodopseudomonas palustris
atgtgcggcatcatcggaattctgggacgtggaccggttgctgagcagctggtcgattcgctgaagcggctcgagtaccgcggctatgactcggccggggtcgcaacgctcgaagacggcgagctcgtgcgccgccgggccgaaggcaagttgaagaatctcgaagctgtgttgaagcggcagccattggccggccatgtcgggatcggccacacccggtgggcgacccacggcaagcccaatgaggccaatgcgcatccgcatgcggcgtcgggcgttgcggtcgtgcacaacggcatcatcgagaacttccgtgagctgcgcgatgagctcgagggcggcggtgcgaccttcgccagcgagaccgacactgaagtggtggcgcatctggtcaattcgtttctggtcaaggggctgtcgccacaggacgcggtgaaggcggcgctgccgcggctgcgcggcgcgttcgcgctggccttcgtgttcaagggctacgacgatctgatgatcggggcgcgaaagggctcgcctctggcgatcggctatggcgacggcgagatgtatctcggctcggacgcgatcgcgctggcgccgctcaccgatgacatcagctatctcgacgacggcgactgggtggtgctgacccacaccaccgcagaagtccgcgatgccaagggcgacgtggtcaagcgcgatgtgatgaagtccggtgcgtcgtccttcgtggtcgacaaggcgaactatcgccacttcatggccaaggaaatccacgagcagccggaagtcgtcggccacactctggcgcgctatctcgacatggcgagcgagcggatcgcgctgccgatgaagctgccgttcgatttcaaggacgtgcagcatctgtcgatcaccgcctgcggcacggcgaactacgccggctatgtcgccaaatactggttcgagcaattcgcgcggctgccggtcgagatcgatatcgcctcggagttccgctaccgcgaggcgccgctgcgcagcggcgatctggcgatcttcatctcgcagtcgggcgaaaccgccgacacgctggcggcgctgcgctacgccaaggagcaggggcttcacacgttgtcggtggtcaacgtgccgacttcgacgatcgcccgcgagagcgaggtggtgatgccgaccctggcgggccccgagattggcgtcgcctccaccaaggctttcacctgtcagctcacggcgctggcggcgctggcgatcgcggccgggcgggcacgcggcaccctgaccgatgccgacgaagccaagctggtgcacggcctgatcgagttgcctcggctgatggcggcggcgctgacgcatgagccgcagatcgagcggctggcgcgagacatctccaaagcccaggacgtgctctatctcggccgtggcacctcctatccgctggcgctcgaaggcgcgctgaagctcaaggagatttcttacatccacgccgagggctacgccgccggcgagctcaaacacggcccgatcgcgctgatcgacgagaagatgccggtggtggtgatcgcgccttacgaccgggtgttcgagaagaccgtctccaacatgcaggaagtggccgcccgcggcggccggatcatcctgatgaccgacgccaagggcgccgaggaggccaccgtcgattcgatggtgacgatcatgatgccggacatgccggccgccttcaccccgatggtctatgccatcccggtgcaactgctcgcctatcacaccgcggtggtgatgggcaccgacgtcgaccagccgcgcaatctggcgaagtcggtcacggtcgaa

SEQ ID NO: 44366 - DNA, 1179 bp, Rhodopseudomonas palustris
ggcccggctacctgggccctgtatatgggtgagcaacaccgccaggtcggagatccggtgacgcccggccctgctctcagtgcgagctttctcaccgcgcccaacgcagtcggcttctccgccaacgacctcggtgccgccgcgccgcatttctacacaagatggagcaatcccaccgtcgagctgctggaggcgcggctggcggcgctcgatgccggcgaagccgcggtgacattcgcgtccggcatggccgccgtggccgcgttgttttccgaccgcctccatgccggcgaccatctggtgctgtccgacgtctgctacgccggcgtcgccgaactcgcccatgatgagctcactcgcaatggcatcgcggttacgaccgtggattcgtcgaagcccgaggcgatcgcggccgcgcttcgtcccaacacccggctggttcatatcgaaacgccggccaatccgatcctgcgcctcgccgacatcgccgcgattgctccgctcgtgcacgcggccggcgccgaattgtcggtcgacgcaacgatcgcgactccgctgggtctacggccactcgaactcggagccgactacgtcgtccactcgctgaccaaatacatctgcggtcacggcgacacgctcggcggcgcggtgatcggacgagccgaggcgatcgcgcgactgcgccgcggcagcctgatccacctcggcggctgtttggcgccgttctcggcgtggttgatcctacggggtctcgagacactcgcgccgcggatgcggctgcacgaggccaacgcaagagccgtcgaagcgcttctcgccaaccacccgaaggtgaaggcggtctactggcccgggtcgcctcgccatccgcagcacgagctggcgcaacgaaccatgcgttgcttctcaggcctgctctcgtttacagtgaatggcgacggaccggcattggccgagcaactcgccgagcggatgcgcgtcgtctcctacgcggtctcgctcggcaagaccaagagcctgctggtctacatcccgaccgaggacattttgcgctcgtcgttccgactgaccggcgacgcggcggcgagttatcgcgcctgggccggcgacggtgtctttcggctgtcagtcggcatcgaggattccgctgatatcatcgcagatctcgagaccgcactc

SEQ ID NO: 44367 - DNA, 1563 bp, Rhodopseudomonas palustris
gatttcatcatcgtgggagcagggtcatcgggatgtgtcctcgccaatcgcctcagcgaggatcctgccacctcggtcgcgcttttggaggcaggcccccgcgactccaacccgtggattcacattccgatcggctatgccaagacgatccgaaatcccaacatcaactggtgctacgagacagagccggaaccaacgatggacgggcggcgaatcttctggccgcgcggcaaggtgctcggtgggaccagtagcattaacggtctcgtctacatgcgggggcaccccgacgattatgacggctgggccgccgccggcgcgtctgggtgggcttggtctgatgtcctgccgtatttcaagcgctcggaggatcaggtccgcggcgctgatgcgtatcatggcgtgggcgggccgttgtcggtcgctgacctcagcgagcgcaatccgatctgccaggccttcatcgacgcagccaccgccgccggcgtaccggccaatctggactttaacggcgagtcccaggatggcgtcggctatgtgcaactgacgacccgcgagggccgccgttgctccagcgcggtggcgtttctgcgtccggcgctgcgacgcgccaatctccgcgtcgagaccgaggcgctggtcggccgcgtcctgatcgagggaggccgagctgtcggtgttgaatatctacgtggcggcgaacggcgggtcctgcgtgcgcgatccgaggtgatcctgtgtggcggtgccgtcaactcgccgcagctactgcagctgtccggcatcgggccggccgcacacttggcgagcgttaatgtcgaaccggtgcaggacttgcctgccgtcggtgccaatctgcaggatcatctccaggttcgcatcgtctggaaggcggcccatccgctgacgttgaacgatatcgtccgcaatccggtgcgcaagctatggatgggggcgcgatatctgctgagccggtccggcccgatgacgatcagtgcctgccaggtcgggctgtttgcgcggacacgtacggagctgacgcgtccggatatccagtatcatttcatgatgtttagcgccgagagttccgcagaccagttgcattcgttctcaggcttcaccgcgaatgtttgccagcttcgtccagaaagccgcggtagcgtgctgatcgccgccccggatccgcggcaggcgccgcgcattcgggcgaattatctggcaaccgaaacggaccgccgtgccgtgatcgacggcttgcgtctggcacggaccatcgcgaacgagcagccgctggcggacttcatcgtcgaggagtatctgccgggagctggcgcgaccagtgacgacgcccttgcggcgcacgcgcgtcagaaggggcagacgctatttcatccggccggaacctgcgcgatcggaccggtgctcgacccgcagctgcgggtccacggcatcgagggattgcgtgttgccgattgctcggtgatgccgacgctggtgtccggtaataccaatgcccctgcggtgatgatcggtgaaaaggcgtccgaccttgttctccggcag

SEQ ID NO: 44368 - DNA, 1128 bp, Rhodopseudomonas palustris
acccgcctcgtcaccgcggggcgcgacactgcggcgcagaagggcttcgtcaatcctccggtggtgcacggttcgacggtgctgtatccgaccgcggccgacctgcacgcccaccgcggcgagtactcctatggacggcacggtaccccaaccaccaaggcgctgcagcaggcgttgatcgcgcttgaaggtccgcagtgtgccggcgtcggcatcaccccctccggcgtgtcggcgatctcgaccgccctgctcgccgtggtcaaagccggcgatcatgtgctggtctgtgacaacgcctatcgcccgacccggctgttctgcgatcagatgctgaatcggctcggcgtcgagaccagttatttcgatccgctgatcggcgccggcatcgcgtcgcatcttcggccgaacaccgtggcagtggtggtcgaggcgccgggatcgcagtcgttcgagatgccggatatcccggcgatcgccgcggtcgccaagcagcacggtgcgctggtgatcgacgacaacacctgggcgacgccgctgtatcatcgctcgctggaacaaggcgtggatatctcgatccaggccgcgaccaaatatattggcggtcactccgacatcatgttcggcaccgtctcggccaatgcggcggcgtggccgaaggtgtcggaagcgatccggctgctcggcgtctgcgccggaccggacgatgtgttcctggcgctgcgcggcctgcgcaccctggaggtgcggctggcccgccactatcaggccggcctggacatggcgcgctggctcacggcgcgtccggaggtgcagcgcgtgctgcatcccggcctcgacaccgatccgggccatgcgatctggaagcgcgacttcaccggcgcatcgggcctgttctcgatcgtgctgcagccggcgccgcaggccgccgtcgatgcgctgctcgacaccgtgtcgctgttcgggatgggctattcctggggcggcttcgaaagcctggtgatcccgttcgactgcgcgtcataccggacggcgacgcaatggaacccgggcggcccggccctgcggctgcacatcggactggaatcgaccgacgatctgaaggcagatttggagcgcggcttcgcc

SEQ ID NO: 44369 - DNA, 1950 bp, Rhodopseudomonas palustris
ctcctgatcgccaaccgcggcgagatcgcctgtcgtgtcatccgcaccgcgcgtgcgatgggcctgcgcaccgtcgcggtgtattccgaggccgatgtcggcgcgcagcacgttgccgaggccgacgaggccgtgctgctcggcccggcgcgggcccgcgacagctatctcaatatcgaacgcatcatccaggccgccaagcagaccggcgccgaggcggtgcatcccggctacggcttcctgtcggagagcgccgaattcgcgcaggcctgcgccgacgcggggctggtgttcgtcggaccgacgccgcagatgatcaccgcgatgggctcgaaatcgggctccaaggcgctgatggaaaaggccggcgtgccgctggtgccgggctatcacggcgcggcgcaggacgaggcgacgctggcggcggccgcggacaagatcggctttccggtgctggtgaaggcctcggccggtggtggtggccgcggcatgcgggtggtgcgcgaggccggcgaactcgccgccgcgatcgtcagcgccaagcgcgaggccaaggcggcgttcggggacgacacgctgttgatcgagcgttatgtcgacaatccgcgccatatcgaggtgcagatcgtcggcgacagccacggcaatctcgtctcgctattcgaacgcgaatgcacgctgcagcgccgccaccagaaggtgatcgaggaggcgccgtcgccgaccctcgacgccgcgcaacgcgagaccgtctgcgccgcggcgcggcgcgccgcgggtgcggtgaactatgtcggcgccggaaccatcgagttcgtctccgacggcaaggacgtgttcttcatcgagatgaacacccgtctgcaggtggagcatccggtcaccgaacggatctccggcgtcgacctggtcgaatggcagctccgcgtcgcgttcggcgaagcgctgccgctgaagcaggatcagctcaagctgagcggccacgccatcgaggcgcgggtgtatgccgagaacccggcgaagaacttcatgccgtcggtcggcaagatcaccacctggcgaacgccggccgaggtcgatggcctgcgcatcgatgccggctatcgcggcggcgacagcgtgtcgccgtattacgacgcgatgctcgccaaggtgatcgcctgggcgccgacccggcaggcggcgatcgaccggctcgaccgcggactgaacgagaccgacgttcgcggcgtcgtcaccaatatcccgtttctctcggcgctggtgacgcatcctgaggtgcgcgccaacgccatcgacaccggtttcatcgaacgcaatctcgcagcgctcaccgccgcaccaagcacgctcggcgatctcgaattcgccgctgcggtcgcggcgatcctgcgcggcgaggacgaagccgccaaggcagaaggtccgtcgccatggcggacggcaggctggatgccggtcggccggcgcaagcgcagcttcctgttccgtcgcgggcaggggcatgaccacactgatcacacgatcgagctgacctatggcggcggatcgtcggcgctgaccatcgacggccgcgagcttgccttcgcgtggaccgccgctggcgacggcatcgatgtggcactcggcgatgcgcgctcgcgaatccacgccgtggtcgatggtgccgagttgtatgtgcgcacgcggagcgggaggttcgagctgcatctcgtcgatccgttcggcggcgaaagcgaggaggccgtcggcgaagacaagatcgtggcgccgctccccggcaccgtagtggcgctgcttgcggaagtcggcgccaagctcgacaagggcgcgccgatcctcacgctcgaagtgatgaagatggagcagaccctgcgcgcgccgttcgccggaacgttgacggcggtgaaatgcaaggtcggcgacatcgtccaggaaggcgccgagctt

SEQ ID NO: 44370 - DNA, 1308 bp, Rhodopseudomonas palustris
ctcagagtgggtattgcgggtctcggcaccgtgggtgccgaagtcgtccgcgtcatcgaacggcaggagcggaccttgtccgctcgttgcggccgccccgtgcgggtggtcgcggtcaccgcgcgctccaaggcgaagaagcgcgggctcgacctctccggtatcaaatgggccaagagtccgctcgcgatcgccaccgatcccgaggtcgactgcttcgtcgagctgatcggcggtgccggcgatcccgccggtccggcgatcgaggcggcgctggctgccggcaaggcggtggtcaccgccaacaaggcgctgatcgccaagcacggcctcaagctggcgtcgctcgccgagaagcacaatgcggcgctgaactacgaagccgccgttggtgccgcgatcccggtgatcaagacgctgcgcgagggcctcgcgggcaccgacatcgatcgcatctacggcattctcaacggcacctgtaactacatcctgacccggatggagcaggaggggctgtcgttcgacgactgcctcgccgatgcccagcggctcggctacgccgaagccgatccgaccttcgatatcgacggccacgacaccgcgcagaagctggcgatcctggccagcctcgcgttcggcaccaaggtgtcggagagctcggtttacgtcgaaggcatccgctcgatcaccccggaagatctccgcgcagccgatgatctcggctaccgcgtcaagctgctcggcgtggcggttcgcaccgccaagggcatcgagcagcgcgtgcatccgaccatggtgccgaagacctcgtcgatcgcccaggtgatgggcgtgaccaacgccgtctcgatcgacggcgatggcattccgccgatcacgctggtcggtgccggcgccggtgccgccgcgaccgcatccgcggtggtggcggatatcgccgacgtcgcccgcggcatccgcgcggtgccgttcggccggccggtggccgggctgaaggccaccgcgaaggcgccgatgcagcgccatgaaggcggctattacttgcggctgctggcgcgcgatcacgccggcaccgccgcgaccatcgccaagcggcttgccgagcaggacatctcgatcgagtcgatcgtgcagcggcatccgcaccgcagcctcgatgccaatggcaaggctgccaaatcgtcgatcccggtgccggtgattctgatcacttacgccaccgccgaagacgcggtgcgccgcgccctgcaggcggtgcagcgcgacaaggtgatcagtggccggccacaggtgatccggatcgagaag

SEQ ID NO: 44371 - DNA, 1170 bp, Rhodopseudomonas palustris
gagtcgaggaccatggaagaattctaccgcatccgccgcttgccgccctacgtgttcgagcaggtcaaccgggccaaggccgccgcgcgcaacgccggagccgacatcatcgatctcgggatgggcaatccggacctgccggcgccgccgcacgtcctggagaagctgaaggacactctcggcaagccccgcaccgaccgctactccgcctcccgcggtatcaccggtctccgcagggcccaggccgcgtattacgaccgccgcttcggcgtgaagctgaaccccgacacccaggtggtcgcgaccctcggctccaaggaaggcttcgccaacgtcgcccaggcgatcaccgcccccggcgacgtcgtgctgtgcccgaatccgagctatccgatccacgccttcggcttcctgatggcgggcggcgtgatccgctcggtgccgtccgagccgaccccggatttcttcgccgcggccgagcgggcgatcattcattcgatccccaagccgatcgcgctgatcgcctgctatccgtcgaacccgaccgcctatgtggccagcctcgacttctacaaggatctggtggcgttcgcgaagaagcacgagatcatgatcctgtcggatctcgcctacgccgaagtctatttcgacgacaacaatccgccgccgtcggtgctgcaggtgccgggcgcgatggacgtcaccgtcgagtttacctcgatgtcgaagacgttctcgatggccggttggcgcatggggtttgcggtcggcaacgagcgcatcatcgccgctctggcccgcgtgaagtcgtatctcgattacggcgccttcaccccggtccaggtcgccgccaccgcggcgctgaacggccccgacgactgcatcaaggagatgcgcgagacttacaagaagcgccgcgacatcctggtcgagagcttcggccgcgccggctgggagatcccgccgccgtccgcctcgatgttcgcttgggcgccgctgccgccggccttccgcgagatcggctccatgcagttcgccaccctgatggtggagaagtgcggtgtcgtggtgtcgcccggcgtcggcttcggcgagcacggcgagggcttcgtccgcatcgcgatggtggaaaacgagcagcgcatccgccaggcggcgcgcggcgtccgg

SEQ ID NO: 44372 - DNA, 927 bp, Rhodopseudomonas palustris
aaaccggtggtgttcatcgacggcgccgccgggaccacgggcctcggcatccgcgaacggctggcccgccacggccaggtcaccgtgaaggatatcccggacgacaagcgcaaggatcccggcgccaagcgtgcgctgatggccgaggtcgatctcgtcatcctgtgcctgccggacgatgccgccaaggagacggtggcgctgatcgacgacctcggtgcgtcgggcccgaaggtgctcgacgcctcgaccgcgttccgcgtcgcgccggactgggtctatggcttcgccgagctggcgccggatcaggccgacaacatccgcgccgccaagaaggtggccaatcccggctgctacccgaccggcggcatcgcgctgctgcggccgctggtcgacgccggcctgctgccggccgactatccggtgacgatcaacgccgtcagcggctattccggcggcggcaagtcgatgatcgcggcttacgaggccggtaccgcgccggcgttcgagctgtacggcctcggcttcgcgcacaagcatctgccggaaacccagaagtacgcgggcctgtcgcgccggccgatcttcattccctcggttggtaacttccgccaggggatgctggtgtcggtgccgctgcatctcgatacgctgccgggcaagccggcggccgccgacctgcacgccgcgctgacacagcgctatgccggcagcacctatgtgtcggtgccgccgctggatgctgcgccttacgcggccggccggatcgagccggaagcgctgaacgacaccaaccggcttgaactctacgtgttcggcagcgatgcccaccgccaggcggtgctggtggcgcggctcgacaatctcggcaaaggcgcctccggtgctgccgtccagaacatgcgcctgatgctcggcctggccgac

SEQ ID NO: 44373 - DNA, 1363 bp, Rhodopseudomonas palustris
atgtctttttccaatctgggactttccgagaaagtccaagccgccgtcgccgccgccggttacgtttcgcccactcccattcagcagcaggcgatcccccacgtcctcgcccgcaaggacgtcctcggcatcgcccagaccggcaccggtaagaccgccgcgttcgtgctgccgatgctgacgatgctggaaaagggccgcgcccgggctcgcatgccccgcacactgatcctcgaaccgacccgcgaactcgccgcccaggtcaaagagcagttcgacaaatacggcgccggacagaagctcaacgtcgccctgctgatcggcggtgtctcgttcggtgaccaggacctcaagctcacccgcggcgtggatgtcctgatcgccaccccgggccgcctgctcgaccacaccgaacgcggcggcctgctgctcaccggcgtcgagatgctgatcatcgacgaagccgaccggatgctcgacatgggtttcatcccggacatcgagcggatctgcaagctggttccctttacccggcagaccctgttcttcaccgcgacgatgccgaccgaaatccggcgcatcaccgagaccttcctgcacaatcccgaaaagatcgaggtcagcaagccggcctccaccgcggtgacggtgacccagtcgcaggtgccgtgcggccgcgagccgcacgagaagcgcgagacgctgcgccggctgatccgcggcgccaccgacctcaagaacgcgatcatcttctgcaaccggaagcgcgaagtcgcgctgctggcgaagtcgctgcagcgccacggcttcagcgtcggcgcgctgcacggcgacatggaccagaccgcgcggacggccgcgctcgaagcgttccgcaaaggtgacctgccgatcctggtcgcttccgacgtcgccgctcgcggcctcgatattccggaagtgagccacgtcttcaacttcgacgtcccgcatcaccccgacgactacgtgcatcggatcggccgcaccggccgcgccggccgcaccggcaccgcggtgacgatcgtcgcgccgtccgaccagaagtcgatggccgcggtcgagaagctgatcggccaggcgatatcccgggccgaagtcggtccgtcggtcgagagcgaggctgccaacaccgaggccgaggccgagcgtccgtcacgctcccgccgcgccgcgccggaagcccgtcagcgcgaaccgcgccgcgagccgcgcgaacagcgcgagcgcaagccgcgccgcgagccccgcagccccgcaagcaccacaggcaccacagcgccccccaccgcccacgcctccttcggctccccccctcccgctcgcgacacgtcgtcggaggcgg

SEQ ID NO: 44374 - DNA, 1263 bp, Rhodopseudomonas palustris
gcgatcaaggccaatccggacgcggcggacgcctacaccacgcgcgccaatttctggaacgtcagcggcaagccggagcgcgctctggccgatgccgatcaggcgatcaagctcgatccgaacctgccgctggcgcatttcgtgcgcggcagcgctgaactgaagctcgggcacgacgatcgcgccatcgcggactattcccgcgccatcgagttgcggccgaaagagagtggcgaggtctatgcggtgcgcggctttgcgtatcaccgcaagggcgacgacattcgcgcagtggccgattacaccgaggcgctgaaagccgcgccagaagacgtcggcacgctgctcaatcgcggcgatgcgcggcgaaacctgcgcgacaccgccggcgcagccgccgactatagcgaggcgatcaagcttgcccctggcaacgccggtggcttcaaggggcgcggcttcatccggctgctgacgcaggacaccggaggagcggtagccgatttcaccgaggcgatccggctgtcgccgagcgagagcgggctgtatctcaaccgtgcctcggcgctcgggctgcagaaccagagccttctcgcgctggccgacgaggacatggcaatccggctcgagccgcagcatccgctcgcctacgtcaatcgcgctgagacgctgaagctgctcggcgacaaggttgcggcgcgcgcgtcggtgaccaaagcgctgcagctcgcacctggctttccgccggcggtcgaggtgctgaagaagctcggcgagccaaagcgcagcaaggagccgtcatccgaggcagcgcaggaagcctatcggcgctgcaccttcccggtgaccgatctcggcccgggcgaggagggcatcaagcagatcatcaaggtctgcacgctgctggtcactgcgcagggcggcagcgacgccaatcgcgcactggtgcatctgcagcgcggcagcatgtatcgccggcagggcgactatcagcacgcgctgatcgatttcagcgagtcgctgcgctacgatccggaatcggcgctggcctataccggccgcggcaacgcctatcgtgggctgaagctgctcgatcaggcgctcgccgatcacaccgaagcgatccggctcgatccgaaatacgccaccgcctacaacaatcggggcaacgtctggcgcgacaagaacgatctggccaaggcgatcgccgattttgaccgcgcgatcgcgatcagcccgaactacgcgatggcgtatttcaac

SEQ ID NO: 44375 - DNA, 1197 bp, Rhodopseudomonas palustris
attctcggcctgtgcttcgtgctgtcgctgctcggccgcgggctcggcgagagcttcaccgtgttcctgctgccgatctcgggctcgttcggctgggaccgcgccgaggtggtgtcgatctattcgctgacggcgctgtgtaccggcctcgcctcacctctggtcggccggctgttcgatcgttccggcccgcgcgtggtctacaccctcggcatgacgctgctgggcggcgcgctgctgatcgccgcttatgccgagcgtctgtggcaattgcagctcaccgtcggcctctgcgtcggcctcggcatcgccttcaccggtaacgttccgaactcgatcctgctcggccgctggttcggcgcgcggctaccgaccgcgatggcggtggtgtattcggcgatcggcgccggcgtgctggtgatgctgccgatcgcacagctgctgatcgaccggtacggctggcgcgaggcgtatctgatcctgggcggcgcgatgctgatcctgctggtgccgctatcgctgatgccgtggcgccggttcgccgccggggcggacgcacacgcgcagcggcccgcacaggatgccgacgaggacggctggacgctgggaagcgcgatgcgccatcacgcgttctgggctctgttcgcgacgttcttcttcaccgcaatcgggatgtactcgatctcggcgcaggtggtcgcctatctggtcgacgcaggtttcacgcccctacaggcagcgaccgcctggggcttctccggcgtcgtgctggtagtcggcatgctcggcgtgagctggctggatggcgtgatcggacggcggccgtcgatcctgttctcttacgcgatctcgatcaccggcctcgtgctgctgtggctgctgcagtggtatccgaacctgttgctgctcggcggcttcgtgatctgcttcggctcgatgatcggctcgcgcggcccgctgatcaccgctaccgcgatgagcatcttccgcggcaggcgcgtcggtacgatctacggcacgatctcgatcggcagcggcctcggctcggcgttcggctcgtggtgcggcggcctgctgcacgacctcacccagagctacaatccggtgctcggcttcgcgctggtcagcgtggtgctcggcatgatcccgttcctggtggtcccggcactgcgggagcgacaataagcctacgctgtt

SEQ ID NO: 44376 - DNA, 1215 bp, Rhodopseudomonas palustris
ttctacaaggtgctttacgtgcaggtgctgttcgcgatcgtggtcggcgtgctggtcggctggctgtcgccgcatttcgccaccaacgaatggatcaaggcgctcggcgacggcttcgtcaagctgatcaagatggtgatcgcgccgatcatcttctgcaccgtggtgtcgggcatcgcccacatccaggacgcccgcaaggtcggccgcgtcggcatcaaggcgctgctgtatttcgaagtagtgtcgtcgttcgcgctggtccttggcctgatcgtcggcaatctgtttccggtcggtcacggtctcgccgccaagccggacgccggtgcggtggccaagtacgtcgatcaggccagccacatgagcgccgtcgacttcgtgctgcacatcatcccggacagcgtggtgggcgccttcgccaagggcgacatcctgcaggtgctattgttcgcggtgctgttcggcttcgcgctgatggcgctcggcgagcgcggccaccggctgcgcgacgtgatcgatgacgccgcgcacgcggtgttcggcgtcatcgccatcgtgatgaaggcggcgccgatcggtgctttcggtgcgatggcgttcacgatcggcaaatatggcccggccgcgctcggcaatctgatcggcctggtggcgctgttctacgccacgtcggcgctgttcgtcgttctggtgctcggcaccatcgccaaattcgtcggcttcaacatcttcaagttcatcggctacatcaaggacgagctgctgatcgtcctcggcacctcgtcttcggaaagcgcgctaccgcagttgatggagaagctggagcggctcggctgttcgaagtcggtggtgggcctcgtggttccgaccggctactcgttcaacctcgacggcaccaacatctacatgacgctggcgacgctgttcatcgcccaggcgctcggcatcgaattgtcgttcggcgatcaggtcgcgatcctcttggtggcgatgctgacctcgaagggcgccagcggcgtcaccggtgccggcttcgtcacgctcgccggcacgctggcggccgtgaacccggcgctggtgcccggcatggcgatcgtgttctcgatcgacaagttcatgagcgaggttcgcgccctcaccaacatcaccggcaacggcgtcgccgcggtgttcgtgtcgtggtgggaaggtgaactcgaccacgaccgcttg

SEQ ID NO: 44377 - DNA, 618 bp, Rhodopseudomonas palustris
atgtcccttcatatcggcgacattgcccccgacttcaccgccgacaccaccaagggcaagatttcgttccacgacttcatcggcaactcctgggtcttcttcttcagccatcccgccgacttcaccccggtctgcaccaccgagatgggcaagaccgccaagctggcgcagccgttcgcatctcggaacgtcaagccgatcggcctgtcgaccgacaccgtggatgagcacctgaagtggatcgcggacgttaacgatacccagcagaccgacctgcaattcccgatcatcgccgatccggagctgaaggtcgccaagctgtacgacatgatccatccgaaccagagcgataccgccgcggtgcgttcggtgttcatcatcgatccgaacaagaagatccgcctcaccatgacctacccgatgaatgtcgggcggaacttcgacgaaatcctgcgcgtgatcgatgcgctgcagttcgccgacaagcacaccgtcgcggccccagccgactggcgcccgggcgacaaggtcatcatcccgctgtcggtcaaaggcgaagccgccaccaaggcgttcccgcagggctgggaagaaccccgcccctatctgcgcctgacc

SEQ ID NO: 44378 - DNA, 423 bp, Rhodopseudomonas palustris
atttacgtgctgaacggcccgaacttgaatctgctcgggacccgtgagccggaaatctacggtcgcgccaccttggccgatgtcgagaagctgtgcgccgagaccgccgccggtttcggtctgatcgccgtgtgccgtcagtccaaccacgaaggccagctgatcgactggattcaccaggcgcgtagcgaaaaggtggctggcctcgtgatcaatgccggcggctatacccacacctcgatcgccctgcacgacgccctggtcggcgtgcagatcccgacggtggaagttcatgtttccaacgtatttgcgcgtgaggacttccgtcaccactccttcatcgcgaaggccgccttcgccagcctctgcggcttcggcatcgacggctatcgcctggccatcaccggcctcgccgccaaactc

SEQ ID NO: 44379 - DNA, 1329 bp, Rhodopseudomonas palustris
atgttcgataaaatcctgatagctaatcgcggcgagatcgccctgcgcgtgctacgcgcgtgcaaggagctcggcatcgctacggtcgcggtccactccaccgccgacgccgacgcgatgcacgtccgcctcgccgacgagagcgtgtgcatcggcccgccgccgtccaaggacagctacctcaacgtgccggcgctgctcgccgcctgcgagatcaccggcgccgatgcggtgcatccgggctacggcttcctgtccgagaacgcccgcttcgccgaaatcctctccgaccacaatcttcacttcatcggaccgaaggccgaacacatccggctgatgggcgacaagatcgaggccaagaagaccgccaagaggctcggcattccggtggtcccgggctccgacggcggggtcggcccagatgacgatgcgatggcgatcgccaaggaaatcggcttcccggtgctggtcaaagccgcagcgggcggcggcggccgcggcatgaaggtcgcccacaccgccgaagacctggcgctggcgatctccaccgccggcaacgaggccaaggccgcgttcggcgacgcctcggtgtatcttgaaaagtacctgcagaagccgcgccacatcgaaatccaggtgctcggtgacggccgcggcggtgcgatccatctcggcgagcgcgactgctcgctgcagcgccggcatcagaaggtgtgggaggaaagcccctcgccggtgatcagcccggaggcgcgcgcccggatcggcgggatctgcgccaaggcgatgcaggacatgcagtatctcggcgtcgggacgatcgagttcctgtacgaggacggcgagttctatttcatcgaaatgaacacccgcatccaggtcgagcatccggtcaccgagatgatcaccggtatcgatctggtgctggagcagatccggattgccgccggcggcgacctgccggtgacgcaggacgaaatcaccctcaacggtcatgccatcgagtgccgggtcaacgccgagaacccggtgaccttccggccgtcgcccggcaagatctcgcgctatcatccgcccggcggcctcggcatccggatcgattccgcagtgtatcagggctacacgatcccgccctattacgactcgctggtcggcaagctgatcgtccacggcaaaacccgcggcgagtgcctgatgcggctgcgccgcgcgctcgacgagatggtggtggacggcatcgagaccacgctgccgctgttccgcgccctggtgcgtgagccgtcgatcatcgacggcgactaccacatccattggctggagcagtatctg

SEQ ID NO: 44380 - DNA, 735 bp, Rhodopseudomonas palustris
ctgggattgaagggcgccaaggtactggtcaccggcggcaccaaaggcatcgggcgcgcgattgccgagacctttgcggcagaaggtgcgcatatcggtctgtgcgcgcgcaatgcggccgaggtcgacggcgcggtcgctgcgctgaaggcgacgggcgtgtcggccttcggtggcgcggtcgatgtgtccgatggcccgggcttgaaggcctgggtcgccgacatggcggccaagctcggcggcatcgacgtcgttgtcgccaatgtcagcgcgctggcgatcggctcggacgaggagagctgggccaagggcttcgccaccgacatgatgggcacggtgcggctggtcgacgccgcgatgccgtatctcgagcagagtcagcagcccgcgatcgtcaccgtctccagcgtctcgggacgggagatcgattttgccgcggggccgtacgggaccttcaaggcggcgatcatccactacacccagggtctcgcgtatcagctcgccggcaagggcatccgcgccaacaccgtctcgcccggcaacacgtatttcgaaggcggggtgtgggagcagatcaagaacggcaattctgatctctacaacaccgcgctggcgctgaatccgaccgggcggatggggacgccgcaggagatggcgaacgccgtggtcttccttgccagccgtgccgcgagcttcatcactggcaccaacgtggtggtcgatggtgcgctc

SEQ ID NO: 44381 - DNA, 3761 bp, Rhodopseudomonas palustris
gtcgatctggtcatcctcgacacgccgcgccctggggatgcggcaaaagtgcaggagcgcgtcggtgccgacctggccgcgtcggatcgaccatggttgcgggtgggcggcggacagccggcctttgccaatatgtcgccgccgcaagcccgtcggctgtctggctattacgcgggcggcggtgaggctaatctcacggccatgttcgcctatctggccgcatcgaaggctggtaccgacacgtcgaccattgctgcgcctgtgccccttgcgagcaggggattttatcatccgtctgctccgcatccgttcgccgacatcgatgcctatctggcgtggggcgcgcagcgctggaagcccgaggctcccaaggtcgcgttcatcattcatcctggcctgttggccggcttcgagaccgctgcgatcgacatgatgatcacgcgtgccgaagcagccgggctgctgcccgtggcgttttggttcgaggcgcgcgaccccgaggcgctccagcaagtgctgggtccaggcaaggccgatgtgatcgtgatcgcgacacatctccagaatggcagcgctcgcagcgccgagtttcgcaaactcgatgttccagtgctgcaggcgatcagttcccgcgccggctcgccggagcaatgggcggctgcgcagagcggcatcgcgcagcagctggttgcgccgttcctggctgtgccggagagcttgggcgtcagcgatgccattgtgaccgatgcgttagaggacggccggccgacgccgatgcccgagcaggtcgaggccttgatcgccaaggcacgacggctcgccgtgctgcgccacaagccggctgccgagaaaaagctcgccctgatgttctggaactatccaccgggggataagaatttctccgcatcaaacttgaacgtgccgcgtagcgtgcagcggttgatctccgcgcttgcgaaggctggctacgccgtgccgccgcttggagagaaccagctcatcgagattggccaggccttgctcggcggcatctatcatccggaaacgctcccagagttgcacaagcggggctacgccgcgacgttcccggtgcggacctatcgggcttggctggatcggctgccggccgcgcgccgcgacgaactcattgcgcgctggggacagccggaagtggcgcagacggtgttcgagatcgacggggaaaggcagtttgtggttccgcgctacgaggttggtcatcttgccttgatgccgcaaccgcagcgtggcggaggtggcggctcgaactatcacgacacccaggagcctccgtcgcatgcttacctcgctgcttatctgttgctggcagatcgtggtgcggacgcgttgatccatttcgggacccacggtacgcaggaatggacgccgggtaaggaccgcggtcttgccgtcactgactacccatttctctcggtcggcgatctgcctgtgctctatccttatatccaggacaatatcgccgaagccgtccaggcgaagcgccgcggacgagctgtcaccgtcagccaccagacgccgccgttcgcaccggctgggctctacgacgagttgcgggatctgcatgcgaagatccacgaatacattcagctcgacgacggcaacgtgcgcgaccagaccgccgcggagatccgggccatcgcgatcaagagcaacatcaatcgcgacatgagctgggatgaaggacgcatggccggtgatttccttggctttctcgcggcgctgcacgatcacatccacgaactgggccggcaatccatgccgctgggcctgcacacattcggtgaaccggccaccagtgataaccgcattgccacggtcatgcagcaactcggagagccgttctatcgtcaggtgggcagccagcccgacgagttgttcgcggcggatttttcgtcgtttcaggcgaccgctccctaccggatactacgcgacgtgtttgcgagcggcgggacggttccgagcgatgccgccccggagctgaaagcgacgctcgagcgtgcgatcgtgctggaccggcgtctgaccgatacgcaggagatggaagcgctgctggcaggtttggcgggtcgtttcgtgcagccgggcgccggcggcgatccaatccgcaatcccgacgtgccaagcggccgcaacatctatcctttcgagtccgacaaggtgccgacacgtgcggcttatgatgccggcggtgcagctctgagccaattgctggacgcatatcgcaccgagcatgccgacgcgatgccgcagaagctcgctttcagcctgtggggctccgaaacgatgcggcatctcgggattcaggaaagccagattctccatgcgctcggcttaaggccggtctgggacggaggggggcgactcgtccgcctcgacatcatcccgcgcgccgaactcggacgtgcacggatcgacaccgtcatccaggtgacgagcgtctaccgcgatcagttcgatagtttcatgcggatgctggcggatgccatcgaacgcgtggccgcgttggatgagcccgacaatgcagtcgcgtctaatgcgcgggcgttggaagccaggttgatcgggcgcaatcaggatgcggcgacggctcgccgtctcgcttcgctgcgcatgtttagcaacgctgttggtgattatggtacgagcctgcccggcagcgtgctcaagtcggcgtcgtgggacaacgaaggatctgtggccgacgcttacctcgatcgtctgcaatatgcctatggcagccgggactggggcgtccgcgtcggcggaaacaatctgtttgccgagcaactgaagggcgtgcaggcggccgtgctgtcgcgctcgtccaagcttcacggtctgctgtccaccgaccattcattcgaatatctcggcgggttgtcgctggcgatccggcatctaagcggcgcatcgccgtcgctctacgtcgccgatctgcgcgagcagacctcgcgggtcggctcggtcgcccgtttcctggccgacgagctgcgctcccgctatctcaatcctcattggatcgccggcatgcagaaggagggatacgccggaacgctggagatcctgaacgccgtcaacaatctatggggatggcaagtgaccgatccgacatccgtccgaacggatcagtggcaggcagtgcatgacacgtttgtgcttgataagcacgaactcgggctggcggcttggttcaagcagagcaatccggcggcggaaacccagatgatcgagcgtatggtcgaggccgttcgcaagggctactggaaggcctccgaacagaccaagcgcgagctcgtcgagcgtctccgcgagatcgaggacgggccgaacagtcaaatcaccgctgcggcgacgcgagccttcattgccaaactccgggccggttttgatctgtctgcgatcgcgcagccggcgtcggagccggcgtccgctccagctcccgtcagcgaggccggcggcgaatccgtccagggagttgtgatgcagcaggtccaggcgtctccaggaggagaccggccaaaatggcagctatgggggggcctggcctcgcttcttgtgtgctttgtgatcggcgtcttcatgcagggccggtccgacgtgagactgcgcgaagaaaggctatcgacgtgaacgtgatcgagtcgtcgctattcgagttgacgaaactgtttctgttgccggtgcttggattgatcctgctcgcactcgcttatgcattcgtg

SEQ ID NO: 44382 - DNA, 2313 bp, Rhodopseudomonas palustris
acgctcggcacgccgcggattggtccgcggcgagaactgaaatccgcgctcgagagtttctgggccggaaaatcgaccgaagccgatcttctgaaagtcgcggccgcgttgcgggcggcgaactgggcccggcagagcgcgcggggcgtcagtgtgattccgtcgaacgacttctccctctacgatcaggtcctcgacaccagcgtgatggtcggcgcgatccccgagatctatgggtggagagggggcccggtctcacttgctacctatttcgccatggcgcgcggcacccaggccgaaatcgcagggcatggctgcgccaatggccatcaccacggcgattcgacaccgcagggcgttccggctcaggaaatgaccaagtggttcgatacgaactaccactacatggttccggaattctccgccgggcagagcttccaactcgcatcggtcaagccgctcgaagagtatcgcgaggcgaaggcgctgggctatgacacgcgtccggtgctgctcgggccagtcacctatctgaagctcggaaagagcgcggatgccgggctcgacgtgctgtcgctgctgccgaagctggtgccggtctatatcgagatcctcggccggcttgcggccgcgggggcgaagtgggtccagctcgacgagccggcgctggtgctcgatctcgacgatcgcgagcgcctggcgtttcgcgatgcctacggccagatcgcgcgcgagttgccgcatctcgatattatgctgacgacctatttcggcgggctcggcgacaatctcgacaccgcgctggctctgccgatcgctggtctgcatctcgatttggttcgtgcgccgaagcaaatcaacgctgtcattgcgaagggaccgaaagatctggtgctgtcgctcggtgtggtcgacggccgcaatatctggcgcgcagacctgccggacttgctcgaccgcgtcgagccgatcgtgcagcagcgcggggccgaacgcgtgcagcttgcgccgtcctgctcgctgctacatgtgccggtcgatctcgaactcgaaactgggctcgatcctgatctgaagagctggctgtcgttctcgctgcagaagatgggcgaactgtcgacgctgagcagggccttaagcggcgaccgggctgcggtgcaggaccagttgtctgcatcagcgaaggcagccgcgacccgacgcaagtcgcccaaggtgcacgacatggcggtgagcagccgtgccgcggcggtcaccccggcgatgacccagcgcaacagcggatttgccgcgcgtgcgaccttgcagcatcagcggctgcaactgccggcgtttccgacgaccacgatcgggtcgtttccgcagacagctcagattcgccaggcccgcgcggcacatgccaagggtgccatctcggatgcggactacaatactttcctgcgaggcgagaccgcccgggcgattcagtggcaggagaaggtgggcctcgacgtcctggtccacggtgagttcgaacgcaacgacatggtgcagtattttggcgagcagctctctggcttcgccttcaccaaggaaggttgggtccagagctatggctcgcgttgcgttcggccgccgatcctgtttggcgatgtctcgcggccgaagccgatgacggtcggctggtggaagtatgcgcagtcgctcaccggcaggccgatgaagggcatgctgaccgggcctgtgacgatcctgaactggtcgttcgtccgggatgacgttccgcgcagcacggcgtgccttcagatcgcgctcgctatccgcgatgaagtcggcgatctcgaacaggcaggcgccacgatgatccagatcgacgaggcggcgttgcgcgaaggcttgccgctgcgtcgctccgaatggaagggatatctcgattgggcggtcgagtgcttccgtctgtgctcgtccggcgtcaaggacgagacgcagattcatacgcacatgtgctactcggagttcaacgacatcatcgatgcgatcgccgcgatggatgccgacgtgatctcgatcgagacgtcgcgctccaagatggagctgctcgacgcgttcaagacctacaaatatccgaacgagatcggtcccggcgtctacgacatccattcgccccgggtgccgtcggtcgaggaaatgaccacattgctccagctcgcgcgtcagcggctgtccgatgggcaattgtgggtcaatccggattgcgggctgaagacgcgtggctgggatgaggtccagggggcgctcgtcaacatggtcgaagcagcgcggcagattcgccag

SEQ ID NO: 44383 - DNA, 1293 bp, Rhodopseudomonas palustris
cccggcaacatcgacacgctcgctctccacggcggatcgttccgcgccgatccggccaccggcgcgacccaggtgccgatctatcagagcacttcgttcgatctgcagaccaccgaacgcgccgaccggctggtgaatttcgaggagttcggcttcgtctattcgcggatcggcaacccgaccgcgcatgtgctcgaggagcgcctggcggcgatcgagggcggggcggccgcgttggctctcgcgtcggggcaggcggcggtggcgctgtcggtgctgacgctggtgcaggccggcgacaacatcgtcaccggcacggatctctatggcggcacctggaatttcttcgccaatcggctgaagcagttcggcattgaggcccggttcgtcgatccgtccgatcccgaggcgttccgcgccgcgaccgacgatcgcacgcgcttgtacttcggcgagacgctgccgaatccgaagctcaacgtgtttccgatccgcgaagtcgccgacatcggccgcagtttcggcattccgctgatcatcgacaacaccgcggcgccgctgctggcgcggccgatcgagcatggcgcggccatcgtggtgcattcggctaccaagtacatcggcggccacggcaccacgatcggcggtgtcatcatcgatagcggccaatttccgtgggaggagtttgccgaccgtcaccggctgatcaccggtccggatccgtcctacaacggccgcaactggccggacatcgcacgcccgttcggcccggttgcctacgcgtttgcggcgcgggccggcctgctgcgcgacctcggccccgcgctgtcaccgcagaacgcctttcagctgatccagggcgtcgagacgctgccgctgcgcatccgccagcagaccgcgaacgcggcgcggatcgccgactatctggctcagcacccgaaggtcgcgagcgtgatctatcccggcctgcagagcggcgaggcgcggcgccgcgccgacacctatctgaagggcggctacggcgcgctggtcggcttcgaactaccgggcggcttcgcggcgggccggcgcttcatcgactcgctgaagctgctgttccatgtcgccaatatcggcgatgcccacagtctcgcgatccacccgtcgtcgacgacgcatgctcagctcgcaccggacaagcagctcgccgccggcgtcacgccgggctacgtccggctgtcgatcggcatcgagagcgtcgacgatatcatcgccgacatcgcacaggcgctcgacgccacctgaaagctgcta

SEQ ID NO: 44384 - DNA, 774 bp, Rhodopseudomonas palustris
atgacagcctcgccctcgcagcttcccgtcctcgacctcagccggtttcgcagcgacaccgccgagcgcgcggaatttctccgcgatgtccgcgacgccgcattcggtcctggatttttctaccttgtcggacatggcatctcggaccggctgatccgggacgtgctgtttgcctcgcgtaatttctttgcgctcccggaggcggacaagctcgatatcgagatgatcaactcgccgcatttccgcggttacacccgcgccggccgggaattcacccgcggccagccggattggcgcgaacagctcgatgtcggcgccgaacgcgaggcgttccccctcagccgttctgcgccgccctggaccaggttgcagggcccgaaccaatggcccgacgcgctgccggaactgaagccgctgctgctgcgctatcagcaggaggtgacggagcttgcaatcaaagtgctacgggtgttcgccgccgcgctcggccaagccgaggacgtgtttgaaccgatctacgtgccctcgcccaaccagctgatcaagatcatccgctatcccggccgcgcagcggacgagagcgatcagggcgtcggcacacacaaggattccggcttcgtcactatcctactgcaggacaccgtggccggtttgcaggtcgaaactgctgacggctggatcgatgcaccgcccctcccgggctcgttcgtggtcaatatcggggagatcctcgaactggcgtcgaacggcgcactgcgcgccaatgtgcacagg

SEQ ID NO: 44385 - DNA, 1056 bp, Rhodopseudomonas palustris
tcgaccttcgtccagtcggcgccgggcgtgcacaagggctacgaatacgcgcgctcgcagaacccgacgcgcgccgcgttcgaggccgcgatcgccgacgccgagcgcggccacgccggcttcgctttcgcctccggcctcgcggccgaggctgcgctcttggaaatcgccgggcagggcagtcacatcgtcgcgtcggacgacctctatggcggaagctggcggctgttccatcgggtgcgcagccattcggccggcctgacgatcacccatgtcgatccggccaatctcgacgcgctgcgcgacgccatccagccgaacacagccttcatctggatcgagacaccgagcaacccgacgctgcgcctcgccgatctcgaagcgatcgcggcgatcggccgcgaacgcggcgtgctgaccgtggtcgacaacactttcgcttcgccggcggtgcagcgcccgctggagcacggcatcgacatcgtggtgcattctgtgacgaagtacatcggcggccattccgacatcgtcggcggcgcgatcgtggtgcgtgatccggatttggcgcagaagctgcaattcctgcagaacgccacgggaggcatcctcgatccgttctccagcttcctggcgctgcgcggcatcaagacgctgccgctgcgggtgcaacgccacagttcgaatgcgctggcggtcgcccgctggctcgacgcccatcccaagatcgagcgagtggtctatcccgggctcaacagtcatccgcagcacgcgctcgcggtgcgccagatggatggcggcggcggcatggtggcagcttatctgaaggccgacgagcagcaggtcgtcgatgtgctgagccgcttcaggttgttcgcgctggcggaaagtctgggcgccgtggagagcctggtcgggcagccgtggaccatgagccatggctcgctgccggaagccgatcggctggcgcgcgagatcacgcctaatctgatccggctgtcgatcggtatcgaagacgtcgaggacttgaccgacgatctcgagcaggcgctgtccatc

SEQ ID NO: 44386 - DNA, 1113 bp, Rhodopseudomonas palustris
tatcgggcggtgatccatccggtgctgcgcgagttggagagcaggctggccgcgttcgaaggtggcgcttcggcgctggcggtcgcatcggggcaggcggcgtcgacgttctcggtgctgaacctggcgcaggcgggggacaatttcgtcacctccaccggcctttatggtggcacttggattctgttcgacaacaccttgcgcgagctcggcattgaggcgcggttcgtcgatccgtccgacccggagaatttccgacgcgccaccgatgcgcggacgcggctgtattatgcggagacgctgcccaatccgaagctggaggtgtttccgatccgcgaagtggccgcgatcggtcgttcgctcggggtgccgctggtgatggacaacaccgccgtccccggggtggtgcggccgctcgaccatggcgcggcgatcgtgatgtactcgaccaccaaatatatcggtggccacggcaccacgctcggcggcgcgatcatcgacggcggcaacttcccctggcagcagcacgccgaacggtttccgctgctgacggcgccggatgcggtcgatccgcaagttgtctggaccgacgttgctcgaccgttcggcccgatcgcgttttcgcttcgcgcgcggttgaagctgctcggcgatctcggcgccggcatggcaccgatcgccgcgtcgcagatcctgcaggggcttgagacgctgccgatccggatggagcagcacaacgccaatgcgatcgtcgtcgccgactatctgaaggaccatccgaaagtggcggcggtgcattttccgggcctgcagagcggtgagctccgccgtcgcgccgacgcgtcgatgcggggagggtacggcgcactgatcggcttcgaactgcgcgacgggcaggcggccggccagcgcttcatcgaggcgctaaagctgttctatcacgtcgccaatatcggtgatgcgcggtcgctggcgatccaaccgtcggccaccacccattcccagctcagcgagcaggatcagctggcggccggcgtcacgccggggttcatccgcctgtcgatcgggatcgagcatccggacgatatcctggcagatctggcgcaggcgctg

SEQ ID NO: 44387 - DNA, 1152 bp, Rhodopseudomonas palustris
acgcttgcggtccatggcggctcgttccgctccgatccggtaaccggcgcggtggtgcctccgatctatctgaccacctcgtaccagtttcaggacaccgagcacgcgcgccgcatcttcgcgctcgaagagatcggctacacctatacacgcaccgtcaatcccacccgcgagttcctggagcgccgtgtctctgcgctcgaaggcggcgtcggtgcacttgcgctcgccaccggcgagagcgcatcgctgtacgcgctgctcaacatcgcccacagcggcgacaacgtggtgctgtcgcccgacattgtgacgggacgcaatgccggtttggtcgcatcgctgcgccagttcgggatcgacgtccgtttcgccgcagagacgggatcggcggagtcgttcgccacggcgaccgatgcccgcacccgcgcctattatgtcgagagcctcagcgtgccgcagctgcgcgccttcccgctcgccggcgcagccgaagcggcccaacaggccggcgtgccgctgatcgtcgacaacactgcgcagccgctgtcagtgaggccattcgagcacggcgctgcgttggtgatctactcggcagccgaatatctcggcggccatgacggggcccagggcggcttgatcatcgacggggggcggttttcctgggaggctcacggcacccggctgccgaccctgagcgaaccggatgcgtcctatcacggcgtggtctggaccgaactggtgaagaaatggaatgccagcccgttcgtggcgcggacgcgggcacatctgcttcgcgatctcggcgcggcgatcaatccgctggcggtgttccagatcatccagggtgtcgagacgctgccgctgcggctgcgccggcagaccgccaacgcgcgcgaggtcgcgacctatctgggcgcgcacccaaaggtgtccggcctcgccaccggcgccgcgctgatcgccttcgacctgcccagcgcagccgctgcggcgcgcttcaccgacgcattgacgctgtttgatcctgccgtgacttacggcggtgtccgcagcgccgtcctcgaccgaacctcgacctcgccgcgggtggtgctgtcgatcgggctcgaacacgccggcgacctgctcgccgatctcgactccgccctc

SEQ ID NO: 44388 - DNA, 1356 bp, Rhodopseudomonas palustris
gtgttcaatccggcgaccggtgaacgcatcggcgcggtgccgcggttcggcaccgacgaagccgaggaggcggtgcgtgccgccgagatcgcgttccggcagtggtcgaagctgctcgccaagcagcgcgccacgatgctgcgcgcgtggttcgaccagatcatcgctaaccgcgacgatctggcgctgctgttgacgcgcgagcagggcaagccgctcgccgaagcgctcggtgaaatcgactacgcggcatcgttcgttgagttctacgccgaggaggcgcggcgcatctacggcgaaacgattccgtcgcatcgcgccgacgcccgcacgatggtgatccgacagccggttggtgtcgtcgcggcgatcacgccgtggaatttccccgccgcgatgatcacccgcaaggtcgcgccggcgcttgccgccggctgcaccgtggtgatcaagccggcgccggaaacgccgctcacggctctggcgctcggcgtgctggcgcagcgtgccggcttcccgccgggcgtgctcaacatcatcaccggcgatgcgccggcgatcggcaaggcgtggaccgagcatccgacggtgcgggcgatcagcttcaccggctcgactgaggtcggcaagatcctgatgcgccaggccgcctcgacagtgaagaaggtcgcgctcgaactcggtggcaatgcgcccttcatcgtgttcgacgatgccgatctcgatgctgcggtcgaaggtgtgatcgcctcgaagttccgcaacatggggcagacctgcgtctgcgcgaaccgcatctacgcccaggacgggatctacgacgccttcgtcgagaagctcaccgcgaaggtggcgacgctgcaggtcggcaacggtgtcgatgccggcgtgacccaggggccgctgatcaccaccgaagcgatcgccaaggtcgagcgtcatgtgtccgacgcggtcgccaagggcgccaaggtcgtgctcggcggcaagcggcacaaactggggcgcaccttcttcgagccgaccgtgctcgccggcgtcaccaccgcgatgctgatcacgcgcgaagagaccttcggcccggtggcgccggtgtatcgcttcaccgacgaggccgacgtgatcgcgcaggccaacgactcgccgttcggcctggcgtcctacttctacgcacgcgacctcggacgcgtattccgcgtcgccgaggcgctggagtccggcatggtcggcgtcaactcggcgctgctcggcgccgacgtggtgccgttcggcggcgtcaagcagtccggccttggccgcgagggttcgcgccacggcatcgaggaatacgtcgagaccaaatacatcctgctcggc

SEQ ID NO: 44389 - DNA, 1269 bp, Rhodopseudomonas palustris
atgacgaatagtgaattgctgacgcgcaggcagacggctgtcgtgcggggcgtcagccaagcgacgccggtgtttgcagaacgtgcgctgaatagcgagatctgggacgtcgagggcaagcgttacgtcgatttcgccggcggcatcgccgtgctcaacaccggtcattgccatccgcgcatcgtcgcggcgatccgtgagcagctcgatcgcttcacccacacctgtttccaggtcgcgccttatgaaggttacatccggctcgccgagcgcctgaatcagttagcgccgatcaatgggccgctgaagtcgatcctgctcagcaccggtgcggaagccaccgagaacgctgtcaagattgcgcgcgccgcgaccggccgcagcggtgtgatcgccttcacgggtggtttccatggccgcaccgcattcgcctcggcgatgaccggcaaggtcattccttacaagaaggcgcttggtccgccgcttcctggtgtctggcatgttccgttccctgtcgccggtagtgacgtctcggtcgaggatgcgctgcgctgcgtgcagttcgtgttcaaggccgatatcgatgcgtcgcaggttgccgcgatcatcatcgagccggtgcagggcgagggcggcttccatcaagcgccgcccgaactgatgcggggcttgcgcaggctgtgcgacgagaacggcatcgtactgatcgccgacgaagtgcagaccggcttcgggcgcaccggcaagatgttcgcgatggaacactatgacgttcaggccgacatcgtctgcgtcgccaagagccttgccggcggcttgccgctgtcgggcgtgatcggccgcgccgcgatcatggatgcggcggagccgggcggcctcggcggcacctatgcgggcaatccgctggcctgcgccgcagcgctcgcggtgctcgacgtgttcgaagaagagaatttgatcgcgcgtgcgaaccagatcggcgagcggctgcgcagcgcgatcgatcggttcgcgctgtcgaacacgctggtgccgacctcggtcgcgcgcggccctggtgcgatggttgcgttcgatatcctcaagcagcgcggcagtaacgagccggatgcggaggcgaccaagcgggtgacccggctggcgcacgaaaacggcttgatcctgctgtcgtgcggcaccgccgccaacaccattcgcattctggtgccgctgacggcgtccgatgcgatcgtcgacgaggggttggcgatcctggagcgctgcctcgcc

SEQ ID NO: 44390 - DNA, 1119 bp, Rhodopseudomonas palustris
ttgaacgaactgcagacccagatccgcgacaccgcccgcgacttcgcccacgagcggctcgccccgactgcggcggcccgcgatgccgcgcacgcctttccgcgcgccgaactgaccgaaatgggccagctcggctttctcggcatgctggtgccggaagcctatggcggctctgagaccggcatggtggcctatacgctggcgctggaggagatcgcggcgggcgacggcgcgtgctcgaccatcgtcagcgtgcattcctcggtggcgtgcatgccgatcctgaaattcggcaccgaggagcagaagcagcgcttcctgccgaagctcgccagcggcgagtggatcggcggctttgcgctgaccgagccgcaggcgggctccgatgcctccaacctgcggaccaccgcgcgccgcgacggcgatcactacgtcatcaacggcgccaagcagttcatcacctcggggcagaacggccagctgatcatcctattcgccgtcaccgatccgtcggccggcaagaagggcatcaccgccttcatcgtgccgaccgatacgcccggctacgaggtggtgcgggtcgaggacaagcttggccagcattcgtccgacacttgccagctcgccttcaacgacatgcggattcccgccgacctgcggctcggcgccgaaggcgaggggctcaagatcgcgctgtcgaacctcgaaggcggccggatcggtatcgcctcgcaggcggtcggcatggcgcgcgccgcgttcgaggcggcccgcgactacgcgcgcgaccgcgtcaccttcggcaagccgatcatcgagcatcaggctgtcgcgttccggctcgccgacatggcgacccgcatcgcggccgcgcggcagatggtgctgtatgcggcgagcctgcgcgaagccgggctgccgtgcctgaccgaagcctcgatggccaagctgttcgcctccgagaccgccgaggcggtgtgctcgtcggcgatccagacgctcggcggctacggttacttgaaggacttcccggtcgagcggatctatcgcgacgtccgcgtctgccagatctacgaaggcaccagcgacgtccagcgcatcgtgatcgcgcgcaatctg

SEQ ID NO: 44391 - DNA, 1167 bp, Rhodopseudomonas palustris
atcgttatcgtcggctccgcgcgcaccccgatgggcggctttcagggcgagctgaaggacgccaccgcatcccagctcggcgcggctgctatttcggccgcggtcgtgcgcgccggcctgaagccggatgcgatcgacgaagtcgtgttcggctgcgtgctgccggccggccagggccaggccccggcgcgccaggcgtcgctcggcgccggcctgccgctctcggccggctgcaccacggtcaacaagatgtgcggctccggcatgaaggccgcgatgttcgcgcatgatctgttgatcgccggcagcgccaccgtcgcagtcgccggcggcatggagagcatgaccaacgcgccgtatctgctcgaccgcgcgcgcggcggctatcgcatgggccacggccgggtgatcgaccacatgttcctcgacggcctggaagacgcctacgacaaggggcggctgatggggaccttcgccgaggactgtgcgcaaagctatcagttcacccgcgagacccaggacaatttcgccatcacttcgctgacccgtgcccaggcggcgatcaaggacggctcgttcgcgcgcgagatcacgccggtgacgatcaaggccggcaagtcggaagtcaccgtgaccaccgacgagcagccgctgaaggccaagctcgaaaagatcccgacgctgaagccggcatttcgcgaaggcggcaccgtgacggcggcgaactcgtcgtcgatctcagacggcgccgcggcgctggtgctgatgcgccgctcggaggccgacaagcgcggcctgaagccgctcgcggcgatcgtcggccattccactcacgcgcatgagccggcgctgttcgccaccgcgccgatcggcgcgatccgcaagctcagcgaacgcaccggctggaatctcgccgacgtcgatctgttcgaagtcaacgaggcgttcgcggtggtggcgttggcggcgatgcacgatctcggcctgccgcacgacaaggtcaacgtccatggcggcgcctgcgcgctcggccatccgatcggcgcctccggtgcacgcgtgctggtgacgctgctggcggcgctggagaagcacgacctcaagcgcggcatcgcctcgctgtgcatcggcggcggcgaagccaccgctgtcgcggtcgagcggctg

SEQ ID NO: 44392 - DNA, 756 bp, Rhodopseudomonas palustris
attactgatcgcgttttcctggtcacgggcgctgcttccggtctcggcgctgccaccgcccgtacgctggtcgccggcggcgccaaggtagtcggcctcgatctcaacgccgaggctggcgccaagctcgaacaggagctcggtgcgagcttccgctttctcgccaccgacgtcaccaaagccgaggatgccgaggcggcggtgaagctcgcccaagatgtgttcggtcacgtcaacgggctggtgaactgcgctggcgtggcgccgggcgagaaggtgctcggccgcaacggtccgcacaagctcgacagcttcgcccgggcgattaccatcaacctgatcggcagcttcaacatgatccggctcgccgccgaagcgatgagcaaggagcagcccgacgccgaaggcgagcgcggcgtcatcatcaacaccgcgtcggtcgcggcgttcgatggccagatcgggcaggcggcctattcggcgtccaagggcggcgtcgccgcgatgacgctgccgatcgcgcgcgaattggcacagcacggcattcgcgtggtgacgatcgcacccggcatcttcgaaaccccgatgatggcagggatgccgcagccggtgcaggatgcgctcggcaagagcgtgccgttcccgccgcggctcggccggccggccgaatatgccgcgctggtgaaggcgatctgcgagaatacgatgctgaacggcgaggtgatccgcctcgacggtgcactgcggatggcgccg

SEQ ID NO: 44393 - DNA, 1632 bp, Rhodopseudomonas palustris
attgaagattatgccgacgtcctggcgcggtttcgccgcgaggacctcgaagccctgttcgacggcaacttcgcgaccggcatcaacgtctgcatcgaatgctgcgaccgtcacgtcgccggcggcggcaccgcactggattgggagagccaggacggccgcaccgcttccttcagctttgccgagatgaaggactatgcggcccgagtcgccaatctgctggtcgcgcagggcgtgaagcccggcgacgtcgtcgccggcatgctgccgcggacgcccgaactgctggcgctgatcctcggcacctggcgcgccggcgcggtgtatcagccgctgttcaccgcgttcggtccgaaggcgatcgaacaccgcgtcaagatgagcgccgccaagctggtggtcaccgatctggccaaccgcgccaagctcgccgacgtcgccgattgcccgaccgtcgcgatcgtgctccggcccggcgagaccgcgccgctcggcgatctcgatttccatgccgagatcgcggcgcaatcgaccgaattcgcgccggtgctgcgcaagggcaccgacctgttcctgatgatgtcgacctccggcaccaccggtctgccaaagggcgtgccggtgccgatcaacgcgttgccggcgttctattcgtatatccgcgatgcggtcgatctgcgcgcgggcgatatcttctggaacatcgccgatccgggctgggcctatggcttgtactacgcggtcactggcccgctgctgcacggccacgccaccaccttctacgacggtccgttcaccgccgagagcacctacggcctgatcaagcgtcgcggcatcaccaacctcgccggtgcgccgaccgcgtatcggctgctgatcgcagcgggtccggaagcggcggcgccggtgaagggccagctccgcgtcgtctctagcgccggcgagccgctcaatcccgaagtgatccgctggtttgccgagcatctcgccgcgccgatccacgatcattacggccagaccgaactcggcatggtggtcaacaatcaccaccgcctgcgacacaccgtgcatccgggttccgccggtctcgcgatgccgggcttccgcgtcgcggtgctcgacgagcacagcaacgaactgccgccgaacgtcccgggcgtgctcagcgtcgatttgaagcgttcgccgctgatgtggttctccggctactggcagcaggagacgccggcgatcgaaggcggttactaccgcaccggtgacaccgtcgaactggagccggatggctcgatcagcttcgtcggccgggccgacgacgtcatcacctcgtcgggctatcgtatcggtccgttcgacgtcgagagcgcgctgatcgagcacgccgcggtgatcgaggcggcggtgatcggcaagcccgatcccgagcgcaccgagatcgtcaaagcctatgtggtgctcgccaaggacgtgacgccgagcgaggcgctggccgaggagctgcggcaatacgtcaagaagcggctctccgcgcacgcctatccgcgcgagatcgaattcctggagcaactcccgaagacgccgagcggcaagctgcagcgcttcatcctgcgcaagcgcgacaccgaaccggcgggc

SEQ ID NO: 44394 - DNA, 1029 bp, Rhodopseudomonas palustris
gccgccgacgatccgaccttcatgctgcggctcgccgagcgcggcgtcgaggcggtgcggatcaactgcgcccacgacgatgccgccgcctggcagcggatgatcaatcacctgcacgtcgccgaggaagccaccgggcggcggatgaaggtgctgatggacatcgccggccccaagatccgcaccggcgacgcgcgcacgcccgacggccgcgaccgcatcgtcaccggcgatctggtggcgatcgtggcgcagggcgaattcgagcggatcgatctcgacgacgagcatttcgcggtggaatgcaccctgcccgatccgctgacgcgcgccgccgtcggcgcccgggtgttcgtcgatgacggcaagctgtgcgtccggatcgagcgcaagaccgcctggggtctgctcggccgcgtcaccgccaccgccgacaccggcttccggctgaagcctgagaaaggcctgaacttcccggatacgccgctcgatatcccggcgctcaccgccaaggatcgtgcagacctcgatttcgttgcggcccatgccgacggcgtcgagttctcgttcgtgcagtcggtcggcgacgtgaagatgttgcaagccgcgctcgccgaacgccggcccgacgactggcacaaactgtcgctggtgttgaagatcgagacgccggacgcggtcgcgcacctgccggacatcctggtgcaggccgccggccgccagccgaccgcggtgatgatcgcgcgcggcgatctggcggtcgagatcggcttcgcccggcttgccgagatgcaggaggagatcctgtggatcggtgaagccgcccatgtcccggtgatctgggccacccaggtgctcgaacatctggtgaagaagggtaccccgtcgcgcggcgaaatgaccgacgccgcgatggcagcgcgcgccgaatgcgtgatgctgaacaagggcccctatctgttcaaggcgatcactgagctcgataccctgctcggccgaatggccgaccatcagcacaagaagacgccg

SEQ ID NO: 44395 - DNA, 966 bp, Rhodopseudomonas palustris
atcaggttcgacggacgcgtcgccatcgtcaccggcgcgggcaacggtctcggccgcgcgcatgcgctgggtctcgcggcgctcggcgccaaggtggtggtgaacgatttcggcggggcgcgtgacggcaccggcggttcgatgaccgcggccgagacggtggtcgaagagatcaagaaggctggcggcactgcgatggccgacggcgccgacgtgtcgaactacgagcaggtccaggcgatggtcgcgaaggcgaccaaggagtggggcagcgtcgatctgctcgtcgccaacgccggcatcctgcgcgacaagtcgttcggcaagatggagctgagcgacttccagaaggtgatcgacgtgcatctcgccggcaccttctactgctgcaaggcggtgtgggacggcatgaaggagcgcaactacggccgcatcgtgctgaccacctcgtcgtcgggcatgttcggcaatttcggccaggccaactacggcgctgcgaaggccggcatcgtcgggctgatgaacgtgctggcgcaggaaggccgcaagaccgacatccgcgtcaacaccgtgtcgccgacggccgcgacccgtatgaccgaagagctgctgccgccgcaggcgctgcagctgatgaagcccgaggcgatcacgcccgcggtgctgttcctgctcagcgaaaacgccccgacccgcaccacgctcggcgccggcgccggctcgttcgcgcagatcaagatcatcgagaccgaaggcatcaacctgccggagaacgagtggaccccggacgggatcgccgcgcatttcgccgagatcagcgacgactccaaggcccaggcgctcgaaggcgcgttccagcagacgcagaaatacgtggcgcaggccgccgcgcgcctcggcatcaagatgtgagaccgtgctgcggctcggtcgagtcgcagaacaactccggattccgggttcgct

SEQ ID NO: 44396 - DNA, 588 bp, Rhodopseudomonas palustris
atgatcgatctgtattacgcgccgacgccgaacggctggaagatctcgatcatgctggaagagtgcggcctgccttacaaggtggtgccgatgcagctcggccgcggcgatcagcaccagccgggattcctcaagctcagccccaacggacgaatgccggcgattgtggatcatgcgccgatcggcggcggcgcgccgctgtcggtgttcgaaagcggggcgatcctgatctatctggcggagaaatccggacagctgatgccgaccgagacgcgggcgcggttcgaggtgatgcagtggctgatgtggcagatggccgggctcgggccgatgctcgggcagaatggccacttcctgctgtatgcgccggagaagatcccttacgcgatcgaccgctacagccgcgaagcgaagcggctgtacggcgtgctcgatcagcggttggccgaccgcgcgtgcatcgccggcgactactccatcgccgacatcgcctgctttccctggatcatgacccacaaggcacaggggctgacgctcgacgactatccgaacatcaagcgctggtatgcggcgcttcgcgctcgtccg

SEQ ID NO: 44397 - DNA, 738 bp, Rhodopseudomonas palustris
aagatcgccctcgtcaccggcgcagggaccggtgtcggccgtgccgcggcgctggcgctgatgcagtccggcttcaccgtggtgctggccgggcgccggctggaactgctgcaggagacccagaagctcggcgccgaattcggtgacggcctgccggtggtcgccgacatggccgatccggcgtcgatcgccgcgctgttcgacaccatcgtgcagcgctacggccggctcgacgtgctgttcaacaacgccggcatcggcgcgccgccggtgccgttcgaggatctgccgctggagcagtggcaggcggtggtgacgaccaacctcaccgcgccgttcctgtgcacccagcacgcgttccggatcatgaaggatcagaccccgcgcggcggccgcatcatcaacaacggctcgatctcggcgcacgcgccgcggccgttctcggccgcctacaccgccaccaagcacgccatcagcggcctgaccaaggccagcaatctcgacggccgcgcctacgacatcgcggtcggccagatcgacatcggcaatgccgccaccccgatgaccgatcgcatggtgcaaggcgtgctgcagcccgacggccgcaccatcgctgagccgcgaatggacgccaaggcggtcggcgatgcggtggcctacatggccggcctgccgctcgacgccaacgtgctgttcataacggtgatggcgaccaagatgccgtttgtcggacgcggc

SEQ ID NO: 44398 - DNA, 312 bp, Rhodopseudomonas palustris
atgaacttccgtccgcttcacgaccgcgtcgtggtcaagcgcatcgacgccgaagagaagaccgctggcggtatcatcattcctgacacggccaaggaaaagccctcgcagggcgagatcgtcgccgtcggcccgggtggccgcgacgaagccggcaagctgatcccgattgatctgaaggtcggcgaccgcgtgctgttcggcaagtggagcggcaccgaggtcaagatcgacggcaaagagctgttgatcatgaaggaaagcgacatcatgggcgtcatcactgacgtcggcgccaagaagaaggcggcc

SEQ ID NO: 44399 - DNA, 459 bp, Rhodopseudomonas palustris
gaattcggcgcgctcgatgacatcacgccggagcacttccatcgccaattcgacgtcaacgtgctcgggctgctgctggtgacgcaagccgccgcgcggcagttcaacgacggtggcagcgtcgtcaatatctcatccggcgtttcgacgatcgcgatgccaaacaccgcggtctacggcgccaccaaggcgtcggtcgatctgatcacggcggtgctggcgaaggagctggcgccgcgcaagatccgcgtcaacgcggtcaaccccggcatggtggtcaccgaaggcgtcaaggctgccggcttccatgacggcgagatgcgaaagcaggtcgaagcgatcaccccgctcggccgcatcggcgaggctgccgagatcgcttcggtcgttgccttcctcgcctccgacggcgcgtcttacgtgacgggtgagacgctgcatgtcaccggcgggctcaag

SEQ ID NO: 44400 - DNA, 1389 bp, Rhodopseudomonas palustris
tacatcgatggcgcctgggtcgatcccgtcgtcaagaagtcgacgccggtcgtcaatcccgccaccgaagaggcgatgtatgaggttgcgctcggctccaaggccgacgtcgacaaggcagtcgccgccgccaagcgcgcgttcgagacgttctcggtgaccagccgcgaagagcgtatcgcgctgctggagaaggtggtcgcgatctacaagagccggatgaaggaaatcggcgctgcgatctccgacgagatgggcgcgccgctgccgatggccgagaagatgcaggccggcgccggcctcggccacatcatgtcgacgctcgacgtgctgaagaactatcagttcgaggagccgctcggctcggcgatgatcgtgcgtgagccgatcggcgtcgtcggcatgatcacgccgtggaactggccgctcaatcagatcgcctgcaaggttgcgccggcgatcgcggccggctgcaccatggtgctgaagccgagcgaattcaccccgacctcggcgctgctgttcgccgaaatcctgcacgaagccggcgtgccgaagggcgtgttcaacctcgtcaacggccttggcccggaggtcggcgcggcgatgagcgagcatcccgacatcgacatgatctcgttcaccggctcgactcgcgccggcatcgacgtcgcccagcgcgctgcgccgacggtgaagcgcgtcagccaggaacttggcggcaagtcgccgaatgtcatcctcgaggatgccgacctgaccaaggcggtgaccggcggcgtgatgcacatgttcaacaactccggccagtcgtgcaacgcgccgagccggatgatcgtgccgctgtcgaagatgaaggaggtcgcggcgatcgccaagggcgtcgccgagaagaccaaggccggcgatccgcgcggcgaaggcaccaccatcggcccggtcgtcaaccgcatccagtgggacaagatccagacgctgatcaacaagggcatcgaagagggcgccaccctggtcgccggcggtcccggcctgccggaaggcgtcaacaagggcttctatgtgcgcccgacggtgttcgctgacgtcaccaaggacatgaccatcgcgcgcgaagaaatcttcgggccggtgctggtgatcatgggcgccaaggacgagaacgaagcggtcgaacttgccaacgacacgccgtatggtctggccggctatgtctcggcgggctcggttgatcgcgcccgcgcggtcggccgcaagatccgcgccggcaacgtcaacctgcagggcgtgcccaacgaacgcaccgcgccgttcggcggctacaagcagtcgggcaacggccgcgagtggggcaagttcggtctcgaagaatatctcgaggtcaaggcgatc

SEQ ID NO: 44401 - DNA, 801 bp, Rhodopseudomonas palustris
cttgcgccgatcgggcagggcacctggtatatcgaccagggtgaccgcgcgtcggcgctcgccgcgctgcggcgcggcctcgatctcggcctgacgcacatcgatacggccgagatgtatggcgacgccgagccgctggtcgctgaggcgattgccggccggcgcgacgaagttttcttggtttcgaaagtgttaccgagcaacgcgtcccgtcgcggcaccattgcggcctgcgagcgctcgctggcgcggctccgcaccgatcggctcgactgctatctgctgcattggcgcgggcattatcagctcagcgagacggtcgcggcgttcgaggagctagtcgccgccggcaagatcctgtcctggggcgtcagcaatttcgacgccggcgacttgcgcgagctgcaccggatcgccggcgacggcaagatcgcctgtaatcaggtgctgtatcacctgctcgaacgggcgatcgagcacacagttattccgtggtgcgaggctcacggtgtcgcggtgacggcgtattcgccgttcggtcacgacgaattcccggcgccgcgtagcgcggcgggccagctgctgcagagcatcgccggcgcccatggcgcgaagccgcggcaggtggcgctggcgtttctgacccggcggccgtcggtgtttgcgattccgaaggccggcaatccgtcccacgcggcggacaatgcggcggcactcgcgctacggctcagcgaggaggagatcgacgcaatcgatcaggcctgtccgctcgggccggagccggccagcctgccgatgctg

SEQ ID NO: 44402 - DNA, 1464 bp, Rhodopseudomonas palustris
gcggtgatgttcggcgatcagcgcatgaccttcaccgaggtcgacctgctgtcgaaccggatcgccaacgtcttcatcgataccttcaggctcgaggtcggcagccgggtcggaatgctgctgaacaattcgatctacacgctgccgatcgatttcggcttcgtcaaatcgaggctgtcgcgggtgccgctgaactcccgcctgtcgctggtcgaacagcagcagatgctggaaggtgccggcgtcaacatcctgatccacggcaccgacctgaccgaccccgcccgcgaactggcgcaggcgatgcaaggcctcaagctgatcagcatcggcagcgcggacgcggacgatctgctgcagctcgccaaggcccaatccgatgcgccgccggcgcggcgctgcgagccggacgacatcgtcattaccatcttcacctcgggcaccaccggcaagctcaaggcggtggagcacacccaggcgagctgggcggcgatggccaccaacgtgctgatcaacatggaggtcggcgagggcgacgtgatgttgcacgctgcctcgatgatccacgcctcgggctgtttcatcgtgccgtattggctgcgcggcggcgtcgccgcggttctgccgggcttcacgccggcgagctatctcgacgcggtcgagcgctggaagccgactgcgctcaatctggtgccgaccatgatcggcatgctgctcgatcatccgggcatcgagcacgccgacttttcgagcgtcaagcgcatcatctacggcgcctcgccgatgccgcggccggtgatgcagcgggcgctgaaactgtggggcccgcggttcgcgcagtattacggccagtcggaggcgccgatcttcatcacccatctgacccaggccgatcacgtcgggccgaaggccgagcagcggcttgcctcgtgcggccggccgtcgatcgattgcgaggtcaagctggtcgatgaagccggcgatgaggtcgcgccgggcgaggccggcgagattgcgctgcgcacgccgttcgcgatgaagggctactacaacgcgccggaattgaatgcgcagatgtttctgcccgacggttggctgcgcacccgcgacgtcggtcgcttcgacgacgacggctatctttacctggtcgaccgcacctccgacatgatcgtctcgggcggctacaacgtctatccgcgcgaggtcgaggacgcgcttgcggcgcatccggcggtgcgcgaggtggtggtggtcgggctgcccgacgacaaatggggcgagagcgtcgcggccttcgtggcgctgcgcgccggcgcaagtgccgaggaagtcgaactgatcgctttcgcgcgcgagcgggtggcgagctacaaggtgccgaagcaggtgcggttcatcgacgaggtgccgaagagcccggtcggcaagctgctgcgccgcgcggtgcgcgatccgttctggcag

SEQ ID NO: 44403 - DNA, 2038 bp, Rhodopseudomonas palustris
tggcgatctgccgcgaaagcgaagcgcgcgagccacagcgcatgcagttcgcggtgtccaggccatgagtgtgacccgtatgttgaagctgacgcctttctccaagatcctgatcgccaaccgcggcgagatcgcgctgcgggtgatgcgcagtgcccgccggctcggctacggcgtggttgcggtgtattcggacgccgacgccgatgccgcccatgtccgcgctgctgacgaagcggtggcgatcggtggcgcgcagccgtcgcaatcgtacctgaacattcccgcaatcatcgcggcggcgaagaccgccggcgccgatgcggtgcatcccggctacggcttcctcgccgagaacgaggactttgccgcggcgtgccgcgatgcggggcttgtctttatcggaccgtccgcggaatcgatcgccgcaatgggcaacaaggccggcgccaaagagatcatgctgaaggccggcgtgccgtgcgtgccgggctatcagggcgaggaccagagcgacgctgcgatggtccgcgaagccgagcggatcggctttccgatcatgatcaaggcggtggcgggcggcgggggccgcggcatgcggctggtgaaggatgccgccgcgctgcccgacgcgctgcgcagcgcgcgttcggaggcgcaaagtgcgttcggcgatccgaccgtgatcctggagcgcgcgatcctgcagccgcgccacatcgagatccaggtgttcggcgatcgctacggggccggcattcatctcggcgagcgtgactgctcggtgcaacgccggcaccagaagctgatcgaggaggcaccgtcgccagcggtctcggaagccttgcgcgagcagatgggcgccgtggcggtgaatgccgtcaaggcgatcggttacgagggcgccggcacactggagttcctgctcgacgccgaaggcaacttctacttcatggagatgaacacccggctccaggtcgagcatccggtgaccgaggcgatcaccgggctcgatctagtcgagctgcaactgcgcatcgccgccggcgagccgctgccgttgcgccaggacgacgtgactttcaaaggccacgccatcgaggtgcggttgtgttcggaggatgccgatcacgacttcatgccgcagtcgggccgcatggcgctgtggcggatgccgccggagctgcgcgtcgagcacgcgctgcaatcgggcgccgagatcccaccgtactacgactcgatgatcgccaaggtaatcgcggtcggcgccagccgcgacgaggcgcggcgcaagttgatccatggcctcgacggcaccatcgcattcggcgtcaccaccaatcgcggcttcctggccgcctgtctgcgccacaaggcgttcgcggccggggaggcgaccacagcgttcatctcgcagcatcgcgacgaactggtccggtcgctgccggacgatgcggtgtcggcagtggcggttgctgcattgctgctctacgtcaccgattcctacgcgccgccgcatcggcccggccgctcgctggccgcggtgtttccgacccggctcaagttcgaactcgacggggtggagcaggcctgcgaagtggtgcgtgagcgcgacggcagctacgtcgtcagccacgaggggcaatcgatcagcttcgtcatcgaggagctgtccgctggcagcatccgctttcaggcccaggggctcggcgagtcagcagtcttccaccgtgatggccaccggttgttcgtgcagcggctcggcgtgcaaaatagcatcgtcgatctgacccgctcggcgccgcaaagcgcggcgcgtggcggcggtgacggcaagctgcgcgcggcgctcaacggccgcgtcgtcgcggtgctggtcaaagccggtgaccgcgtcgaggccggccagccggtgctgactctggaagcgatgaagatggagcacgtgcacacggcacctggctccggcatcatcacgatcgatgtcgccgaaggcgagcaggtcaccgccggccgcatcgtcgccgagatcgaggcg

SEQ ID NO: 44404 - DNA, 1494 bp, Rhodopseudomonas palustris
ttgcgtaaatcggcgcggcggtttccggaccgcgtcgcgctgaccgatggtggccgcagcgtcacctacaccgagctggaacgcgacgccaaccgcttcgctaacgcgctggtggcgcgcgggctgaagccgggcgccaagatctcgaccgtctgcaacaactcgatcgagttcgtcaaagcgctgttcggcattcatcgcgccggcctcgtctgggtgccgatcaacaccatgctcggccccgacgacatgggctacatcctcgaccacgctggcgtgaaggtcgctgtgatcgacgacaatctgcacggccagccggagcgccgcgccgcgctggaagcgcgcggcatcgatctcatcgccatcaacctggccggcaaggccgccgacaccggattgccggtgttcgatcagctgatcgagggcctgtccgagatcgagccggacgtcgcgttcgacgatcgcgatctggcaatgatcatctacacctcgggcacgacctcgcggccgaagggcgcgatgcactgccatctcgcggtcaccatggcggtgatgagcaacgcgatcgagatgcaattgtcgcgcaaggacggcatcaccgggcagtttccgctgttccactgcgccgcccatgtgctgctgctgagctatttgatcgtcggcggccagatggcgatcatgcgcgggttcgatccggtcgcctgcatggaggcgatccagcgcaacaagctcaccgtgtttatcggcctaccgctgatgtaccaggtgatcctcgatcatccgcggcgcaaggagttcgatctctccagcttgcgctgctgcatctacaccatggcgccgatgccgcggccgctgctcgagcgtgcgatcgccgagctgtgcccgaccttcgtgcagccctcggggcagaccgagatgtatccggcaacgacgatgtcgcagccggaccgccagctcgctcgcttcggcaactactggggcgagtcgacgctggtcaacgagaccgcgatcatggacgatgccggcaatctgttgccgcccggcgaggtcggcgagatcgtgcatcgcggccccaacgtgatgcttggctactacaaggaccccgaggcgaccgaagctgcgcgaaaattcggctggcaccacaccggcgatctggcgctgatcgacgagcacggcgaggtgctgttcctcgaccgcaagaaggacatgatcaagtccggcggggagaacgttgcttcgatcaagatcgaggagacgctgctggcgcatccgtcggtgatgaacgccgcggtggtcggcctgccgcatccgcaatggggcgaggcggtgtccggcttcgtcaagctgaagcccggcgcgtccgcaaccgaggccgagatcgttgaacattgcaagaagcatctcggcggcttccaggtgccgaagctgctgcggatcgtcgacgagatgccgatgaccgcgaccggcaagctgcgcaaggtcgagctgcgcaat

SEQ ID NO: 44405 - DNA, 1134 bp, Rhodopseudomonas palustris
agaaaccagatgctgttcactgccgaccatgacgaaccgcgccgcattctgcagaggttcattcagagcgacatcaatccccacgtcgacgagtgggagaacgccggcatcttcccggcgcacgaactgttcaagaaactcggcgatctcggtttcctcgggctcaacaagccggttgaatatggcgggcaggggctcgattactcctacgcgctgatgatggcggaggaactcggcgcgatcaattgcggcggcgtgccgatggcgatcggcgtgcagaccgacatggcgacgcccgcgctagcgcggtttggctccgatgaactgcgcaaagaatttctggcaccttcgattgccggcgactacgtcgcctgtatcggcgtgtccgagccgggcgccggctcggacgtcgccggaatcaagaccacggcgaaatccgacggcgacgactacgtgatctccggcggcaagatgtggatcaccaacggcactcaggccgactggatctgcctcctgtgcaacaccggcgagggcccggtgcatcgcaacaagtctttgatctgcgtgccgatgaaaaccaagggcgtgacgatcgcgcgcaagctcgacaagctcgggatgcgctcgtccgacaccgcgcagatttacttcgacgaggtgcgggtgccgaagcgcaaccggatcggcgaggagggcaagggcttcacctatcagatggtgcagttccaggaggaacggctgtggggcgcggcggcgtgcctcaaggcgcacgagaagacgatccagaacaccatcgagtacacccgtggccgcaaggcgttcggcaagccgctgctcgacaaccaggtgatccatttccggctcgccgagctgcagaccgaggtcgagctgctgcgctccctggtgtaccgcgccgccgaggcgctggttgccggcgaggacgttacccagcttgccaccatggccaagctgaaggccggccggctcggccgcgagattcccgacgcctgcctgcagttctggggcggcatgggcttcatgaacgagaccctggtgagccgctcctaccgtgacagccgcctgaccgcgatcggcggcggcgccgacgaggtgatgctcggcattctgtgcaag

SEQ ID NO: 44406 - DNA, 1095 bp, Rhodopseudomonas palustris
tttcgcgacgtgatccggcgtttcgtccagaatgaaatcgaaccgttcgccaccgagtgggacgaagccggtggcttcccgcgcgaactgtatgagaaggctgcggcgatcgggctgctcgggctcggctttccggaagaatacggcggtacgccgtgcgatcagttcatgtggatcgtcgccactcaggaattggcgcgggcggcggccggcggcgtcagcgctagcctcaacagccattcgatcggcgcgccgccgattgcgcgcgccggctctcctgagctgaaggcgcgggtactaccggagattctgtccggcaagaagatctcggcgctggcgatcaccgaaccgtccggcggctccgacgttgcgaatttgcgtacccgcgcggtgcgcgacggcgatcactacgtcgtcaatggtgagaagaccttcatcacctccggcatgcgcgccgattacatcaccaccgcggtgcgcaccggcggcgaggggccgggcggagtcagcctcctcttgatccccggagatacgcccggactgacgcggacgccgctgaagaagatggggtggtgggcgtccgacactgcgacgctgcatttcgacaattgccgcgtgccggccgccaatctgctaggcaccgagggcgccggcttcatgatcatcatgatgaacttcaatagcgagcggctgacgatggcggcgggctgcatcgctgcctcaaaggtctgtctcgacgaggcgacggaatacgcgaggcagcgcgtcaccttcggaaagccgctggtgaagcatcaggtgatccgccacaagctggtcgacatggcgcagaagatcgccgcctcgcaggcgatgctcgaactgctcgcttggcgcgtcgatcagggcgaaagcccgatcgccgagatctgcatgctgaagaaccaggcgacgcagacgatggcgttctgcgcctccgaagccgtgcagatcttcggcggcgccggctacatgcgcggcgtcaaggtcgagcggatctatcgcgacgtcaaagtcaacgccatcggcggcggcaccgaggaaatcatgaaggacctcgccagccggcagatggga

SEQ ID NO: 44407 - DNA, 825 bp, Rhodopseudomonas palustris
ttcgtcaagaccaaggacggcgtcgacattttctacaaggattggggcccgaagcaggcccagccgatcgtctttcatcacggctggccgctgtcgtccgacgattgggacgcacagatgctgttcttcctggccaacggttatcgcgtggttgctcatgatcgccgcggccatggtcgctcgtctcaggtcgacactgggcacgacatggatcattacgcggccgacgcctccgccgtcgccgagcacctcgatctgaagaaggccgtgcatatcggtcactcgaccggcggcggagaagtcgcgcgttatgtcgcgaagttcggtgagccgcagggccgcgtcgccaaggccgtgctggtctctgcggtgccgccgctgatgctgaagaccgagaagaaccccggcggcctgccgatcgaagtgttcgacggtttccgcaaggcgctcgccggcaatcgcgcgcagttcttcctcgatgtcccggcaggcccgttctatggcttcaaccggcccgatgcgaagacaatgccgggggtcgtcaacaactggtggcgacagggaatgatgggtagcgccaaggcccactatgacggcatcaaggcgttctccgagaccgaccagaccgacgatctgaaggccatcaccgtgccgaccctggtgctgcacggcgaggatgaccagatcgtgccgatcgaggactccgccaagctttcggtcaagctgctgaagaacggcaagctgaagacctatccgggctatccgcacggcatgctcaccacccatgccgacgtgctgaacgccgacctgctggcgttcgtgaag

SEQ ID NO: 44408 - DNA, 1179 bp, Rhodopseudomonas palustris
atgaaagctctgacctggcacggcaagaacgacatccgctgcgagaacgtgccggatccgaaaatccaacacggccgcgatgcgatcatcaaggtgacggcgtgcgcgatctgcggttcggacctgcacctgatggacggcgtcatgccgtcgatgcagagcggtgacgtgctcggtcacgagaccatgggtgaagtcgtcgaggtcggctccgagaataccaagctgaaggtcggcgatcgcgtggtggttccgtttacgatctcctgcggcgagtgcttcttctgtcagcgcggcttctattcaggctgcgagcgatcgaacccgaacgccaagatggccgagaagatgtggggccattcgccggccggcctgttcggctattcgcacatgctcggcggctatgcgggaggccaggccgagtatctgcgtatcccttacgcagatgtcgggccgatcaaggtgccggatggtttgaccgacgaacaggtgctgttcctgtccgacatcttccccaccggcttcatggcggcggatttctgcaacctgaagggcggcgagaccgtcgcggtgtggggctgcggcccggtcggacagatggcgatcaagagcgccttcctgctcggcgccgagcgtgtgatcgcgatcgacaccgtgccggagcggatggaattagcgcggcagtccggcgcgatcgtcatcaacttcatggacgatgacgtctatgataagattcaggatctcaccaacggccgcggcgccgacgcctgcatcgacgcggtcggaaccgaagccgccgcgaccgcgagcctcgactcgatgatcgaccgcgtgaaagtggcgaccttcatgggcaccgaccggccgcacgtgctgcgccaggcgatccactgctgccgcaacttcggcacggtgtcgatcgtcggcgtttatggcggactgctcgacaagatcccgatgggctcggccatcaaccgaggcctgacgatgcggatggcgcagaccccggtgcagcagtatctgccgcaattgctcggccgtatccaacagggcgagatcgacccgtccttcgtgatcacccaccgcgctacgctcgacgaaggcccagaactctacaagaccttccgcgacaagaaggacggctgcatcaaggtggtgatgcgcccgtaagcgacgtct

SEQ ID NO: 44409 - DNA, 835 bp, Rhodopseudomonas palustris
tatccggagccgccctacccgagccagcgccaatccatgccgggctcgacagacaagatgacgccgcgtccagatcatggcgagcacagctacaagggctccggcaagctgaccggaaaggtcgcgatcatcaccggcggcgacagcggcatcggacgtgcggtcgcgatcgcctacgcccgtgaaggcgccgacctgctgatcgcctatctgagcgaggatgaagacgcccagcaggtcaaggagctggtcgaggcagaaggccgcaaggcagtgctggtcgccggcgatatcgcccaaccggatcattgccgcaaggtggtcgaccacgccgtcgaggaattcggccggatcgacctcctggtcaacaacgccgcgcatcaggcggccttcaaggatatcggcgacatcagcgacgaggagtggcagacgacgttcgccgtcaacatccacgcgatgttctatctgaccaaggccgcggtgccgcacatgaaaccgggcagcgcgatcatcaacacggcctcggtcaattccgacatgcccaacccgatgctgctcgcctatgcaacgaccaagggtgcgatccagaacttcacccggcttggcgcagatgctcgccagcaagggcatccgcgctaatgcggtcgcgcccggcccgatctggacgccgctcattccctcgacgaggccggatgacgcggtgaagaacttcggcaagcaggttccgctgggccgcgccggccagcccgcggagcttgccaccgcctatgtgatgctggccgatccgctgtcgagctacacgtccggcacgacggtcgcggtcaccggcggcaaa

SEQ ID NO: 44410 - DNA, 2130 bp, Rhodopseudomonas palustris
ttcccgatcgtgctgctgatccgccgcaagaggttcgaggaagtgccggtcgaggtgctcgatttcatcgacggctacgtgtttctgtccgaggagacgccgaccttcatcgcccgcaacctgatcagccggctgaagcaatatgccgacacgctgaagacgccgttcttcggcgcgctggtcgactatgcggaggagggcaaccagctctggacctgccccggccacaacggcggcatgttctacagccgcagcccgatcgggcgggtgttcatcgagcatctcggcgaggcggtgttccgcgatgacctcgataattcggtgctcgaccttggcgatctgttgacccacgaggggccggcgctgcgcgcgcagaaggaagccgcgcagatcttcggtgccgagaagacctatttcgtgctcaacggcacctcgacctccaacaaggtcgccctcggcgcgctcgtctccgacggcgatctgatcctgttcgatcgcaacaatcacaaggcggcccatcacggcgcgctgatgatgggcggcggcattcccgtctacattcccacggttcgcaacgcctggggcctgatcgggccgatggcgtgggacgcgctggacgagacggcgctgcgcgaacgcattcgcagccatccgctggtcaaggaccctgaggcctggcgcaagccgcgcccgttccgcgtcgcggtggtcgaacagtgcacctacgacggcaccatccacagcgccgagatgatcctgcgccgcatcgggcatttgtgcgattacatcctgttcgacgaagcctgggccggcttcatgaagtttcatccgctgtatgccggccgcttcgcgatggggctggcgaacctcggcgacgatgcgcccggcatcatcgcgacgcagtcgacccacaagcagctcgccagtttctcccaggcgtcgcagatccacatcaaggatcgccacatccgcggccagaagcggcgggtcgagcatcggcgcttcaacgagagcttcatgcagcacgcctcgacgtcgccgttctatccgctgttcgcctcgctcgatgtcggcgcgcagatgatgaagggccgctccggcgaagtgctatgggacgatacgatccggcttggcatcgagctgcgcaagaagatccgcgcggtgcggagggagttcgaggagaaggaggcgcgggcggagcggcgctggttcttcgatccgttcgtgcccgatcgggtgacgatcgcggacgccgcccgtgaaggcgcggtgcacgatgtcgcctgggaggccgtgagcaccgaccagctcgcgaccgacccgacattctggcagatcgcgccgggcgcggcctggcacggctttgccgatatggcgcctggcttcgccatgaccgacccgaacaagctgacgctgctgacgccgggcttcgaccgggccaccggccgctatgccgagcacggcgtgccggcgccggtggtggcgcaatatctgcgcgagaaccgcattgttccggaaaagaacgatctcaactcgctgctatttctgctgacgccgggcgtcgaggcgagcaaggccggtacgctgatcagcggcctcgtcgcgttcaagaagctgcacgacgacaacgcgccgctcgacgaggtgatcccggaattcagccggcgccggcccgctcgctatgccggggtacggctgcgcgatttgtgcgggcagatgcaccggttcttccgcgacgccgatgtcagcgcgctgcaggccaagcagtttctgcccgaacatctacccgagatcgcgatgtcgccgcacgatgcggcgcgctgcctggtccgcaatgacgtcgactatctgccgatcagccagatcgcgggccggatcgccaccacgccgttcgtggtctatccgccggggatcgcgaccatcgtgcccggcgagcggctgagcgagcgagccaagccgatgctcgattacttgcagatgttcgagcgcagcttcaacgaattccccggcttcgaagtcgagattcagggcgtctatcgcgaattcgatgaattgggccgggttcgtctctacacctacgtcgtggccgaataacctgccgtctcctggagttgccgtggacgccgcctc

SEQ ID NO: 44411 - DNA, 720 bp, Rhodopseudomonas palustris
aaatgtgtcgtcgtcaccggcgtgtccagcgggatcggccatgccattgcgcggatgctgctggataagggatttcgcgtgttcggcagcgtgcggaagcacagcgacgctgagcggctgatcgtcgaactaggggccggcttcacgccgctggttttcgacgtcacggatgaaaccgcgatccgggccgccgcggacgaagtgcgacgggcgctcgacggcgagacgctcgccgggctcgtcaacaatgccggcatcgcggtggcgggcccagtactcgatctgccggccgacgaattccgccggcaatttgaggtcaatgtgatcgggccgatccttgcgacccaggcgttcgggccgctactcggcaccgaccggtcgctgcgcggtgcgccggggcggatcgtgatgatgtcgtcgatcgccggaaagttcggcaatccgctgatggctgcgtactcggcctccaagcacgcgctgaacggcctgtcggacgggcttcggcgcgaactgatgctgttcggcatcgacgtggtcgtgatcatgccgggcgccgtgaagacgccgatctggggcaaggccgagcgcgaggacgtgtcgcggtttgcgaactcgccgttctatccggcgctgcagaagctgcgcgcgctgctgcctgagatggacgaaagcggtctgccgccggagacgatcgcgcagcacgtctatgacgcgctgacc

SEQ ID NO: 44412 - DNA, 357 bp, Rhodopseudomonas palustris
ttccacctgatcgaccgaatcgccgagcttcgccttgctgaccgcagcatcacggtcgaggctcgggtgcccgagaccagtacgatcttcgaaggccacttccccggctacccgctgatgccgggcgtgctcttgatcgagaccatggcccaaagctcgggctggctcttgatcgcgctgatgcagtttcagcgcatgccgttcctggccgcggtcaaggaagccaagatgcgcaccttcgtgacgcccggcgagacgttgtcgatcgacgtctcggtggtgcacgaaggctccggcttcacggtgaccgaagcgaagatcaagagcggcggcaagctggcgtgcaatgccacgctg

SEQ ID NO: 44413 - DNA, 1233 bp, Rhodopseudomonas palustris
gtggtcgtcaccggcatgggcgtggttacctcgctcggcgccggcaagaacgacaattgggccaagctcaccgccggggaatccggcatacgcaccatcacccgctttccgatcgacgggctgaagagcacgatggccggcacggtggacttcgtcccggtcgagccgttctcctcggtcgtgctcggtgaaaagctcgccgacctcgccaccgaagaggcgatcgcgcagtcgggcatcggccgcaagggcgacttccccggcccgctatttctcgcggtcgcgccggtcgagctggaatggctaccgcgccaggagctggcgcgcgccaccggcgccaacaccgcgatcgattacgatgccctgctccgcgtcagcggcggcggcaccttcacacagtatcatcgtcgcttcctgttcggctcggtcgccgatcatctcgccgacaccttcggcaccaagggttcgccgatctccctgtcgaccgcctgcgcctcgggcgcgagcgcgatccagctcggtgtcgaagcgatccggcgcggtgaagcggatgccgcgttgtgcgtcgcgaccgacggctcggtcaacgccgaagcgctgatcaggttctcgctgctatcggcgctgtcgacccagaacgatcctccgcaggcgtcctcgaagccgttcgccaagaaccgcgacggcttcgtgatggcagaaggcgccggcgcgctggtgctggagagctacgagtcggcggtggcgcgcggcgcctcaatcctcggcgtgatcgccggctgcggcgaactcgccgacaacttccaccgcacccgctcgagcccggacggcaagccgatcatcggctgcatcaacaagacactggccgacgccggcatgagcgtcgatcagatcgactacatcaacgctcacggcaccggcacgcccgagaacgacaagatggagtatctcggcatctccagcgtgttcggcgaacgcgcctcatccctcccagtgtcgtcgaacaaatcgatggtcggccacaccctgtcggccgccggcgcggtcgaggcgatcttctcgctgctgacgctggagcatcagcggattccgccgaccatcaactacgacgtgccggatccggcgatcccgctggatgtggtgcccaatcaggcccgcgacgcccgcgtcaccgcggtgatgtcgaactcgttcgggttcggcggccagaacgcctcgctgatcctgacccgc

SEQ ID NO: 44414 - DNA, 1080 bp, Rhodopseudomonas palustris
cagctcgcgcgcgacaacgacgcgatcaatctcggccagggctttccggacgatccggggccggaggacatccgtcgcgccgccgccgacgcggtgctgaacggctacaaccagtatccgtcgatgattgggctgccggagctgcgtcaggcgatctcgacgcactacgcgcattggcatggcgtccagctcgatccgatgaccgaagtgatggtcacctccggcgccaccgaggcgctggcgagcgccattctgtcggtggtcgagcccggcgacgaagtgatcgtgttccagccggtgtacgactcctatctgccgattatccggcaggccggtggcattccacgcctcgtccgtctcgaaccgccgcattggcgcatcaccgaagagtcgttgcggcgggtgttcaacgccaagaccaaggcgatcgtcttcaacaacccgctgaatccggccgcggtggtttatccgcgcgaggacctcgaattgctggcgcggttctgccaggagttcgacgcggtggcgatctgcgacgaggtgtgggagcacgtcacgttcgacggcctcagccacatcccgctgatcactatccccgggatgcgcgaccgcaccatcaagatcggctccgccggcaagatcttttcgctcaccggctggaaggtcggcttcgtctgcgccgcgcccaagctgctacgggtggccgccaaggtgcatcagttcctggcgttcaccacggcaccaaacctgcaggccgccgtggcctacggcctgggcaagagcgacgattacttcctgcagatgcgcaaggaccttgcccgcagccgcgatcggctggcgcaggggttgtccagtatcggctttccggtaatccgctcgcaagggacctattttctcaccgtcgatttgtcgccgctcggccttaacgaaaccgacgaggcgttctgcaagcgcatcgtcaccgactacaaggtcgcggcgattccggtgtcggcgttctacgaggaagagcctgtcacctcggtggtacggttctgtttcgccaagaaggatcagacgctcgacaccgccctcgagcgcctg

SEQ ID NO: 44415 - DNA, 1455 bp, Rhodopseudomonas palustris
ctggcgtaccgtaccttcgtgcacatgcacgatttgtcgctgcggtttcacctcgagcgcaagaccggcggtctgacccgcgtgctggagcgtggccggctcggcatcgaagtgatcgtgcggatggtgatcctgcagctggtgccgaccatcatcgagctgtcgctggtgatggcggtgctgctgtggcagttcgactggcgctacgtcgcggccgtgatggtcaccgtggtgttctacatgctgtacacctacaaggctaccgagtggcggatcggcatccgccgccgcatgaacgattccgacagcgacgccaatcagaaggcgatcgactcgctgctcaactacgagacggtgaagtatttcggcgccgaggagcgcgaggcgaagcgctacgacaagtcgatgcggcactatgaggacgccagcgtcgcgacctatacgtcgctggcggtcctcaacgccgggcaggcggtgatcttcaccttcggcctgaccgcgacgatgctgatgtgtgcctcgggcgtccgcaacggcaccaacaccgtcggcgacttcgtgatgatcaatgcgatgatgattcagctgtatcagccgctgaacttcatgggcatggtgtatcgcgagatcaagcaggcgatcatcgacatcgagaagatgttcgcggtgctgtcgcgcaagccggaggtcgaggatcgtgccggcgccaagccgctggcagtcgaagccggcaccgtgcggttcgaggacgtgaagttcgcttatgatccggcgcggccgatcctgaagggcctcaacttcgaggtcccggccggcaagacggtggcgatcgtcggcccgtcgggcgccggcaagtcgacgatctcgcggctgctgttccggctgtacgacgtctcgggcggccgcatcctgatcgatggtcaggacatccgcagcgtcacccagacctcgctgcgcgcggcgatcggcatggtgccgcaggacaccgtgctgttcaacgacaccatccgctacaacatccgctacggccgttgggacgccaccgatgccgaggtggaggaggccgccaagaccgcgcagatcgacgccttcatcaaggcgtcgccgaagggctacgacaccgaagtcggcgagcgcgggctgaagctctcgggcggcgagaagcagcgggtggcgattgcgcgaacggttctcaaggcgccgccgattctggtgctcgacgaagcgacctcggcgctcgacagccacaccgagcacgagatccagggcgcgctggagcgtgtggcacaaaaccgcacctcgctggtgatcgcgcaccggctttcgaccatcgtcggggccgatgagatcattgtgctcgatcaggggcggatcgccgaacgcggcacccattcgcaattattggcagcgggcgggctctacgccagcatgtggaacaggcagcgcgaggccgaa

SEQ ID NO: 44416 - DNA, 1350 bp, Rhodopseudomonas palustris
ctccgcagcatcgtcggcgacggcggcgtgctcgaggccgccgagctgtcgaagcgctccgccggcacctatcggttcgatacgttgaaagccgcggcgctggtgcggccgacctcgacccagcaggtgtcggagatcctgcgctggtgccatgccaatggcgttcacgtcgtcacccatggtgggttgaccggcctcgttcacggcgccgatgccgagcccagcgaagtgatcctgtcgctggagcggatgcgcacgatcgaggaaatcgacccgaagcagcgcaccgctgtggtccaggccggggtgccgctgcaggcgctgcaggaagaggtcgacaagcacgatctggcgtttccgctggatctcggctcgcgcggcaccgccacgctcggcggcaacgccgccaccaatgccggcggcaaccgcgtgatccgctacggcatgacgcgcgagatgatcctcggcctcgaagtcgtgcttgccgacggcaccgtgctgtcgtcgctcaaccatctgatcaagaacaacgccggctacgacctcaagcagctgttcatcggctcggaaggcacgctcggcgtcattacgcggctggtgctgcgactgcgcgaaaagccgctcgccaccaacatggcgttcgtcggcctcgacagcttcgatgcggtggcgaagttcctgaagcattgcgaccgcgcgctcggcggcacgctgtcagcctacgaagtgatgtggcagtcgttctatcggctggtcaccagcccgccagccaaagggcggccgccgatcgggcaagaccacgcttactacgtgctggtcgaaagccagggctccgacctcgaactcgacagccagcgcttcaccgcggcgatggaggcggcgttggaatctggcctgatcgcggacgcggcgatcgcgcaatcggacgaggattgccgctcgttctgggcgctccgcgacgacgtcggccaggtgctgcaaggcggcctgccgatcgtgttcgacgtctcgctgccgatcgccgcgatggaggggtatgccgaaacgcttcgggagacgctgaccaacgaaatcggcgagcaccggctgtggatcttcggccacctcggcgacggcaatctgcatgtcgtcgtgcaggttaagccgatggagtatctggcgctgcggcccaaggtcgaagccttggtgtatcgcccgctcgccgcctgcaacggctcggtgtcggccgagcacggcatcggcctggagaagaagccgtatctctacgtcagccgcagcgccaatgagatcgcgctgatgcggaggctgaagcaggcgctcgatcccaagggcatccttaatcctggcaag

SEQ ID NO: 44417 - DNA, 1344 bp, Rhodopseudomonas palustris
cgctggacacccgatagctggcgcgccaagccggtgcagcagatgccgcaatatcccgacgcgaaggcgcttgcggatgtcgaggcgcagctcgcgagctttccgccgctggtgtttgcgggcgaggcgcgcaacctgaagaaggcgctggccacggtggcggccggcgacgctttcctgctccagggcggcgattgcgccgagagcttcgccgagcacggcgccaacaacatccgcgacctgttccgcgtcttcctgcagatggcgatcgtcttgacctacgccggcgcctcgccggtggtgaaggtcggccgcatcgccggccagttcgccaagccgcgctccgctccggtcgagaagcgcgacggcgtcgagctgccgagctatcgcggcgacatcatcaatgacgtcgcgttcaccgaggaagcccgcgtacccgatccgcgccggcagatcgaagcgtatcgccagtcggccgcgacgctcaacctgctgcgcgccttcgccaagggcggctacgccagcgtcgagaacgtccatagctggatgctgcagtcggtcagcgacagtccgcagtcgaaggcctatgcggatctcgccgatcgcgtttccggcgcgctggatttcatgcgcgcctgcggcctgaccttcgccgtcgattcctcgctcggcaccaccgatttctacaccagccacgaagcgctgctgctcggctacgagcaggcgatgacccgcgtcgactcgaccacgggtgattggtacgcgacctccggccacatgctgtggatcggcgatcgtacccgtcagctcgaccacgcccatgtcgagtatttccgcggcatcaagaatccgatcgggctgaagtgcggtccgtcgctgaagaccgacgaactgctcaagctgatcgacattctcaatcccgacaacgagccgggccggctgacgctgatcggccgtttcggccatgagaagatcggcgagcacctcccggcgatggttcgcgccgtgaagcgcgagggccggaccgtggtgtggtcgtgcgatccgatgcacggcaacaccatcacgtcgaactccggctacaagacccggccgttcgaccgtatcctgtcggaagtgcgctcgttcttcgcggtccatgccgcggaggggacgcatgccggcggcgtgcatctggagatgaccggccagaacgtcaccgagtgcctcggcggcgcccgcgccatcaccgacgaagacctcaacaaccgctatcacaccgcctgcgatccgcggctcaatgccgagcagtcgatcgacatggcgttcctgatcgcggacctcctgaagcaggggcgggccggc

SEQ ID NO: 44418 - DNA, 1107 bp, Rhodopseudomonas palustris
atgaagacacgggccgccgtcgcgttcgaggccaagaagccgctcgaaatcgtcgagctggatctcgaagggccgaaggccggcgaggtgctggtcgagatcaaggccaccggcatctgccacaccgacgcctacacgctcgacggcttcgatagcgaaggcatcttcccgtcgatcctcggccatgaaggcgcgggcatcgtgcgcgagatcggccccggcgtcacctcggtgaagccgggcgatcacgtcattccgctgtacacgccggaatgccggcagtgcaaaagctgcctgagccagaagaccaatctctgcaccgcgatccgcgccacgcagggcaagggcctgatgccggacggcacctcgcgcttttcctacaagggccagaccatctatcactacatgggctgctcgacgttctcgaacttcaccgtgctgccggagatcgcagtcgcgaagatccgcgacgacgcgccgttcgacaagagctgctacatcggctgcggtgtcaccaccggcgtcggcgccgtggtcaacaccgccaaggtcacgcccggctccaacgtcgttgtgttcggcctcggcggcatcggcctcaacgtgatccagggcgccaagatggtcggcgccgataaaatcgtcggcgtcgacatcaacgacgacaaggaagaatggggccgccgcttcggcatgacgcacttcgtcaacccgaagaaaatcgacggcgacatcgtccagcacctcgtcgggctcaccgatggcggcgccgactacaccttcgactgcaccggcaacaccaatgtgatgcgccaggcgctggaagcctgccatcgcggctggggcgtctcggtggtgatcggcgtggcggaagccggcaaggaaatctcgacccgcccgttccagctcgtcaccggccgagtctggaagggcagcgccttcggcggcgcccgcggccgcaccgacgtgccgaagatcgtcgactggtacatgaacggcaagatcgagatcgacccgatgatcacccacgtgctgaaactcgaagagatcaacaagggtttcgacctgatgcaccagggcaagtcgatccgctcggtggtggtgtac

SEQ ID NO: 44419 - DNA, 792 bp, Rhodopseudomonas palustris
cgcctgatcgttgccggagccggcggccgcatgggccgggcgttgacccgcgccatcagcgagaccgagggcgtggtgctgaccggcgccctggagtcgccgaattccgagctgctcggcaaggacgccggcaccctcgccggcctcccggccaacggcgtgctgctgtcggccgatctgtggtcgctgtcggcgaatgccgacggcatcgtcgatttcaccgtgccgcaggccaccatcgccaatgtggcgatcgcggcgcagcgcggcatcgcccacatcattggcaccaccgggctgtcgacatcggacaacgcagtgattcagagcgtcaccgatcgtgccgtggtggtgaagtccggcaatatgagcctcggcgtcaacctgctggcggcgatcgccaagcgcgtggcgcagtcgctcgacgacagcttcgacatcgaaattgtcgaaatgcatcaccgcgccaaggtcgacgccccgtccggcacggcactcttgctcggcgaagcggtggcggctggccgcaagatcgaccttgccactcactctgcccgcggtcgcgacggcttcaccggcgcccgcaagcccggcgacatcggctttgcgtcgctgcgcggcggcaccgtcaccggcgatcacaccgtgatcttcgccggcgcctcggagcggatcgaactcacccacaaggccgaggatcggatgatcttcgcccacggcgcgctgacggcggcgcgctgggccaagggcaagaagcccggcctgtattcgatggccgacgtgctcggcctc

SEQ ID NO: 44420 - DNA, 1890 bp, Rhodopseudomonas palustris
atgggaaaggtcattggtatcgacctcggcaccacgaattcgtgcgtcgccgtaatggatggtaagtctgccaaagtcatcgagaacgccgagggtatgcgcacgaccccgtcgatcgtcgcgataaccgacgacggcgagcgtctggtcggccagccggcgaagcgtcaggctgtcaccaatcccgagcgcaccttctttgcagtcaagcgcctgatcggccgccgctacgacgacccgatggtcgagaaggacaagggtctcgtcccctataagatcgtcaaggcttccaacggcgatgcctgggtcgaagccgacggcaagacctattcgccctcgcaggtctcggccttcattctgcagaagatgaaggagaccgcggaagcgcatctcggccagaaggtcgatcaggccgtcatcaccgttccggcgtacttcaacgacgcccagcgccaggccaccaaggacgccggcaagatcgccggtctcgaagtgctgcgcatcatcaacgagccgaccgcggccgcgctggcctacggtctcgataaggccaagaccggcaccatcgcggtgtacgacctcggcggcggcaccttcgacgtctcgatcctggagatcggcgacggcgtgttcgaggtgaagtcgaccaacggtgacaccttcctcggcggtgaagacttcgacatgcgtctggtcaactacctcgccgacgaattccagaaggagcagggtatcgatctgcgcaaggacaagcttgcgctgcagcgcctgaaggaagccgccgaaaaggccaagatcgagctgtcgtcgacgacgcagaccgagatcaacctgccgttcatcaccgcggaccagtccggtccgaagcatctgaccatgaagctgacccgcgccaagttcgaagcgctggtcgacgacctggtgcagaagaccatcgagccgtgccgcaaggccctgaaggatgccggcctcaccgccggtgagatcagcgaagtggtgctggtcggcggcatgacccgcatgccgaaggtccaggaagtggtgaagcagctgttcggcaaggagccgcacaagggcgtcaacccggacgaagtcgtggcgatcggcgcggcgatccaggccggcgtgctgcagggcgacgtcaaggacgtgctgctgctcgacgtgactccgctgtcgctgggcatcgagacgctgggtggcgtgttcacccgcatcatcgatcgcaacaccacgatcccgaccaagaagagccaggtgttctcgaccgccgaagacaatcagaacgcggtcaccatccgggtcttccagggcgaacgcgaaatggcggccgacaacaagatgctcggtcagttcgacctgatgggcattccgccggccccgcgcggcatgccgcagatcgaagtgaccttcgacatcgacgccaacggcatcgtcaacgtctcggccaaggacaaggcgaccggcaaggagcagcaaatccgcatccaggcttctggtggtctgtccgactccgagatcgacaagatggtcaaggacgccgaagccaacgcggccgaagacaagaagcgccgcgaggcggtcgacgccaagaaccacgccgacgcgctggtgcattccaccgagaaggcgctggccgagcacggttcgaaggtcgacgaaagcgagcgccgcagcatcgaagacgcgctgagcgatctgcgcgaagcgctgaagggcgacgacgccgaggcgatcaaggccaagagcaacacgctggcgcaggcttcgatgaagctcggcgaagcgatgtacaagcaggccgaagccgccggcggtgcgcagcaggccggtaaggacgacgtggtcgacgcagagttcactgaagtcgacgacgacaagaagaagtcg

SEQ ID NO: 44421 - DNA, 1681 bp, Rhodopseudomonas palustris
gcgtctcaggaaccacctccggatctgcagccaaatcaaagcaagacgcgcgcgctgatcgcggcgcgcgagagcgccgacgccgcgaaccacgccaagtcgcggttgctggcaatggcgtcgcacgaaatccgcaccccactgaacggcatcatcggcatgagccggctgttgctcgatacgccgctcagcgccgaacaggcgacttacgccaaggcggtgaagacatccggcgaggcgctgctggcgttgacggacgagttgctcgactacgcgcggatcgaggctggcaagatcgagctcgactgccgtcccttcgtattgagcagtctgatcgaagacatcatcgaattgctggcgccgcgggcgcaggcgcgcggactcgagattgcggccgatatcgacgagcggctgccggtaagcctgattgtcgatgccgcacggttgcgtcaggtgctgctcaatctctgcggcaacgccatcaaattcactgaaactggcggcgtcgctctgatcgtcgagcgaggcgaccagagtggcgaactccgcatcatcgtccgtgacaccggcatcggcattgcgcccgacgcgcaggcacgaatcttccacgagttcgaacaggccgacgccgggattgcccgcaatttcggcggcaccgggctgggtctcagtatcagcgaccgcatcgtcgcggcgatgggtggccggatcgcgctcgagagtaaacctggggaaggctcgaccttcaccatcactctaccgctgagcaccgccgagaacgatcgcgcaaccgcggcatttgcaccgccggatttgcatggcagctcggtgatgatcgtctcggcgcacggggtcgaagcttcgctggccgcccggcggctggagcgctggggcgccgagacttgcctgtgtgatgatctcgccgcggcgatcgcccggctgccggagcgaagctggcacgcggtgctgatcgatcatgcgttaggttcggacgcgattgagaccctggcgcgcgaggctcaggcgcgtgccacccatcgcctggtgatgctgacgccggcggcacggcacgaactgctgccggatctgcccgccgcgttcacaggctatctggtgaagccgctgcggtccgcgtcgcttgccgcacggctcggcacggcggtcgaggtcgcgacgccaagtatcgcagacggcgatccgccgcccgttcaggatgcgtcctcggccatcacgcatgaagcgttcgcaatcctggtcgccgaagataacgacatcaatgcgctgctgattcgcgcgctactgcaccggctcggtcatcacgccgaaatcgtgggtgacggccgccgtgccgtcgaagcgtggggcgcggctgataacaccggtacgccgttcgatctggtgctgatggacgtgcagatgccaatcctcgatgggctggcagcggcccgacagatcaggacgctcgaggctgagcgggcgaggtcgcgggtgccgatcctggcgctgaccgcgaacactctggccgaggatcgcgaggcatgtttggagtccgggatggacggattcctagtcaagccgatcgatccggataggctcgcagcgatcctggcgggcgtggccgccgcgcaccaagccgcctgacacggcaggcaaataccgagcgccgctgctaacaacaaag

SEQ ID NO: 44422 - DNA, 297 bp, Rhodopseudomonas palustris
cttcatgatctcgccgcgacggtcgatgcccgcgcggcgtccggcggcgagagctcctacaccaagaagctgctcgacaagggccccgagcactgcgccaagaaattcggcgaagaggcggtcgagatggtgatcgctgcggtcgagaacgatcgcggccatctgatctccgaaaccgccgacgtgttgtttcacatgctcgtgctgctgaagtcgcgcggcgtgaagctcgaggaagtcgaggcggcgctggcgcagcgcacctcgatgtcgggcctggaggaaaaggcgtcgcgc

SEQ ID NO: 44423 - DNA, 777 bp, Rhodopseudomonas palustris
atgttcaaggtccgcgtcatcccctgcctcgacgtcaaagacggccgagtcgtcaaaggcgtcaacttcgtcgacctgcgcgacgccggcgatccggtcgaggcggcgatcgcctatgacgccgctggcgcggacgaactctgcttcctcgacatcaccgccacccacgagaaccgcggcatcatgctcgacgtggtgcggcgcacggccgaagcctgcttcatgccggtgacggttggcggcggcgttcgcaccgtcgacgacatcaagaccctgctccgctccggcgccgacaaggtctcgattaattcggccgcggttgcgcggcgcgaattcgtcaaggaagcggccgagaagttcggcgaccagtgcatcgtggtggcgatcgacgccaagcgtgtgccgggccgcgaccgctgggagatcttcacccatggtggccgaaagggcaccgggatcgacgcgatcgaattcgcccaggaagtggtgtcgctcggcgccggcgaaatcctgctgacctcaatggaccgcgacggcaccaagtcgggcttcgacattccgctgacccgggcgatcgccgacagcgtcggcgtcccggtgatcgcgtcgggcggcgtcggcaatctcgatcacctggtcgacggcatccgcgaaggccacgccaccgcggtgctggcggcctcgatcttccatttcggtgagtacaccattcgtcaggccaaggatcatatggtccaggccgggctgccgatgcggctcgatccctagcgttacgcg

SEQ ID NO: 44424 - DNA, 582 bp, Rhodopseudomonas palustris
gcgacgatcaagcgcaagaccaaggagaccgacatcgaggtcacggtcgacctcgacggcaccggtgtggccaacgccgccaccgggatcggcttcttcgaccatatgctcgacctgctcgccaagcattcgcggatcgacatcaccgtcaaggcggtgggcgacctccatgtcgacttccaccacaccaccgaggacgtcggcattgcgctcggccaggcagtcaagcaggcgctcggcaatatggcgggcatcacccgttatgccaccgtgctgatgccgatggacgagaccctgacccgggtggtgatcgacgtctcgggccgaccgttcctggtgttcaaggcggacttcccgcgcgacaagatcggcgaattcgacaccgagctggtgcgggagtggtttcaggccttcgccatgaacgcgggcgtgactctgcatgtcgagaccctatatggcgagaacagccatcacatcgccgaatcctgcttcaagggattggcccgggcgctgcgcgcagcggtcgcgatcgatccgaagacggccggcgaagtcccctcgaccaagggtcagctcggcggc

SEQ ID NO: 44425 - DNA, 804 bp, Rhodopseudomonas palustris
ctcacgctcacgacttggaacatcaactcggtgcggcttcgcatcgatctggtggcgaaattcctcaaagcccagcgcccggacatcctgtgcctgcaggagacgaagtgtccggacgatgcgtttccgctgaagcggttcaagcgactcggctacgagcacatcgcgctcaacggacagaagggctatcacggcgtcgcggtgatttcgaaactgccgttcgtcaccaccgacatccgcaccttctgcgacatcatcgacagccgccacatctcggtctcggtgaagaccgacgagaacgcgcctccgctggtactgcacaatttctacgttccggccggcggtgatattcccgacccagccgttaatccgaagttcaagcacaagctgtcgtttctcgacgaaatgaaagcctgcgagccgctgcatccgtctggcgatcagcggcacattctggtcggcgacctcaacgtggcgccgcacgagcacgacgtctggtcgcacaaacaacttctcaaggtcgtgtcgcacaccccggtggagtgcgagaagctgctcgcggtgctacgcgccggcaactgggtcgacgtcgcgcgcgagcggatcccgctcgatcagaaggtctatacatggtggagctatcgggctgccgattggaccgtcggcgaccgcggccggcggctcgaccacatctgggtctcggaagcgctgaaggaccgcgtggtcgacttcaaggtcctgcgcgacgcgcgaagctgggagcggccgagcgaccatgtcccggtgacgatgacgatggagctg

SEQ ID NO: 44426 - DNA, 981 bp, Rhodopseudomonas palustris
ggttcgttgaattcgattgccgtgctcggcggcggtgcctggggcaccgcgctggcgcagactgctgcgcgcgccgggcgaaaggtgacgctgtgggagcacgatgccggcaacgccgagcatctgatcgcggcgcgcgagagccgtttcctgccgggcgtgcggctggagccgtcgatccaggtgacgcgcgatcttgccgaagcggcgcgcgccgatgcgctgctgctggtggttccggcacaggtgctgcgccaggtggtgacgtcgctgcagccgctgatcgcgccgcgcacgccgctggtcgcctgcgccaagggtatcgagcacggcacccatcggttcatgactgagatcattgccgaagcggcgcccgccgcgatcccggcgattctttcgggcccgagctttgcggccgacgtcgcgcgcggtctgccgaccgcggtgacgatcgccgccactgacgcagcctgcgcgcaggcgctggcccaggcgatgaattccggcagcttccgcccgtatcattcgaccgacgtgcgcggtgtcgaactcggcggcgccaccaagaacgtgctggcgatcgcggccggcatcgtcgagggccggcagctcggtgcctcggcgctggcggcgatgacgacgcgcggcttcgtcgaactggtgcggttcggcaaggcctatggggcgcggatcgagaccatgcatggtctgtcgggcctcggcgatctgacgatgtgctgctcgacgccgcagtcgcgcaacttctcgttcggcatggcgctcggtcgcggcgaagggatcgagtccgccgcgcacggcaagctggcggaaggctactacaccgcaccggtgctgctggagatggcgcaggccaaagacatcgacatgccgatctcgaccgcggtggcggccgtgctcggcggcaagctcagcgtcgatgcagcgatcgaagggctgctgacgcggcctctcaaggcggag

SEQ ID NO: 44427 - DNA, 810 bp, Rhodopseudomonas palustris
ttcgccaagatgaacggcatcggcaacgagatcgtggtggtcgacctgcgcgatcagccggcgccggtgacgccagccgatgcgcgggcggtggcggcgcacgtgccctatgatcagctgatgctgctgcaaccggcgcggctgtccggcaccgaagccttcgtccggatctacaacaatgacggctccgaatccggcgcctgcggtaacggcatgcgctgcgtcgcgcggcagatgttttcaggcagcgaaaagaacggcctgaccttcgagacccgcgccggcctgctcaattgctggcggggcccggccgacggcctctacaccgtcgacatgggtgagccgaagttcggctggcaggacatcccgctcgccgaggaattccgcgacacccgaatgatcgaactgcagatcggcccaatcgacgcgccggtgctgcatacgccgtcggtggtcagcatgggcaatccgcacgcgatcttctgggtcgacgatgtgaacgcctacgatctcggccggttcggaccgctgctggagaaccacccaatcttcccggagcgcgccaacatcacgctcgcccacatcgtcgaccgtcagcacatcaccatgcggacctgggaacgcggcgccgggctgaccaaggcctgcggctccgccgcctgctccaccgcggtcgcggccgcgcggctgaagcgcaccgaccggacggtggagatgacattgcccggcggccagctcaccatcgagtggcgcgagagcgacaatcacgtgctgatgaccggcggcgccgcattcgagttcgaaggccgg

SEQ ID NO: 44428 - DNA, 1011 bp, Rhodopseudomonas palustris
acgatgggttacaaagtcgcggtagtgggtgcgaccggcaatgtcgggcgtgagatgctcgccattctggacgaacgcaaattcccggccgacgaggtggtggcgctggcatcgcgccgctcggtcggcgtcgaggtgagctacggcgacaaaaccctgaaatgcaaggcgctcgagcactacgacttcagcgacgtcgacatctgcctgatgtcggccggcggcgaagtgtcaaaggaatggtcgccgaagatcggcgcgcagggcgcggtggtgatcgacaactccagcgcgtggcggatggacccggacgtaccgctgatcgttccggaagtgaacgcagcggccgcggccggcttcaccaagaagaacatcatcgccaatccgaactgctcgaccgcgcagctcgtggtggcgctgaagccgctgcacgatcacgccaagatcaagcgcgtggtggtgtcgacctatcagtcggtgtcgggcgccggcaaggatgcgatggacgagctgttctcgcagaccaaggccgtctacaccaacagcgagctggtgaataagaaattccccaagcggatcgccttcaacctcatcccgcagatcgacgtcttcatggaagacggctttaccaaggaagagtggaagatggtggtcgagaccaagaagatcctcgaccccaaaatcaaactgaccgcgacctgcgtgcgggtgccggtgttcgtcagccactcggaatcggtcaacatcgagttcgagaacccgatcagcgccgacgaagcgcgcgaaatcctgcgcaaggcgccgggctgcctcgtcatcgacaagcacgagccgggcggctacgtcacgccgtatgaagccgccggcgaggatgcgacctatatcagccgcatccgcaccgacccgacggtcgacaacggtctggtgctgtggtgcgtgtccgacaacctgcgcaagggcgcggcgctgaacgcgatccagatcgccgaagtgctgatcaaccgtaagctg

SEQ ID NO: 44429 - DNA, 1098 bp, Rhodopseudomonas palustris
acgcacaaactgcttcttctccccggcgacggcatcggcaccgaagtgatggccgaggtcagccggctgatcgactggctcaacaaggccggcattgccagcttcgagaccgagcacggcctggtcggcggcgccgcctatgacgccgacaaggtggcgatcaccgacgccaccatggcgctggcgcaggcctccgacgcggtgatcttcggcgcggtcggcggcccgaagtgggacggcgtgccctacgacgcccgccccgaagccggcctgctgcggctgcgcaaggatctcggcctgttcgccaatctgcggccggcggtgtgctacccggcgctggcggactcctcgagcctgaagcgcgacgtggtcgaaggcctcgacatcatgatcgtccgcgaattaaccggcggcgtgtatttcggcgagccgaagaccatcaccgatctcggcaacggccagaagcgggcggtcgacactcaggtctacgacacctacgagatcgagcggatcggccgggtcgcgttcgacctcgcccgcaagcgccgcaacaaggtcacctcgatggagaagcgcaacgtcatgaagacgggcgtgctctggaacgaagtgatcaccgccgtgcatgaccgcgaatacaaggacgtccagctcgaccaccagctcgccgactcgggcggcatgaatctggtcaagtggccgaagcagttcgacgtcatcgtcaccgacaacctgttcggcgacatgctgtccgacatcgccgcgatgctgaccggctcgctcggcatgctgccgtcggcctcgctcggcgaagtcgacgccaagaccggcaagcgcaagtcgatgtacgaaccggtacacggctcggccccggacatcgccggcaagggcatggccaatccggtggcgatgctggcctcgttcggcatggcgctgcgctattcgctcgacatgggtgcgctcgccgacaagcttgacgaagcgatcgccgcggtcctggccaagggcctgcgcaccgccgacatcaagagcgaaggcaccacggtgatctcgacctcgcagatgggcgaagcgatcgtcaccgaactgcaggccctg

SEQ ID NO: 44430 - DNA, 1431 bp, Rhodopseudomonas palustris
ggggacaagatcagctacgccgagctggtggcgcgggcgggccgcgtcgccaacgtgctggtggcacgcggcctgcaggtcggcgaccgcgttgcggcgcaaaccgagaagtcggtggaagcgctggtgctgtatctcgccacggtgcgggccggcggcgtgtatctgccgctcaacaccgcctatacgctgcacgagctcgattacttcatcaccgatgccgagccgaagatcgtggtgtgcgatccgtccaagcgcgacgggatcgcggcgattgccgccaaggtcggcgccacggtggagacgcttggccccgacggtcggggctcgctcaccgatgcggcagctggagccagcgaggcgttcgccacgatcgaccgcggcgccgatgatctggcggcgatcctctacacctcagggacgaccggccgctccaagggcgcgatgctcagccacgacaatttggcgtcgaactcgctgacgctggtcgattactggcgcttcacgccggatgacgtgctgatccacgcgctgccgatctatcacacccatggattgttcgtggccagcaacgtcacgctgttcgcgcgcggatcgatgatcttcctgccgaagttcgatcccgacaagatcctcgacctgatggcgcgcgccaccgtgctgatgggtgtgccgacgttctacacgcggctcttgcagagcccgcggctgaccaaggagacgacgggccacatgaggctgttcatctccgggtcggcgccgctgctcgccgatacgcatcgcgaatggtcggcgaagaccggtcacgccgtgctcgagcgctacggcatgaccgagaccaacatgaacacctcgaacccgtatgacggcgaccgcgtccccggcgcggtcggcccggcgctgcccggcgtttcggcgcgcgtgaccgatccggaaaccggcaaggaactgccgcgcggcgacatcgggatgatcgaggtgaagggcccgaacgtgttcaagggctactggcggatgccggagaagaccaagtctgaattccgcgacgacggcttcttcatcaccggcgacctcggcaagatcgacgagcgcggctacgtccacatcctcggccgcggcaaggatctggtgatcaccggcggcttcaacgtctatccgaaggaaatcgagagcgagatcgacgccatgccgggcgtggtcgaatccgcggtgatcggcgtgccgcacgccgatttcggcgagggcgtcactgccgtggtggtgcgcgacaagggtgccacgatcgacgaagcgcaggtgctgcacggcctcgacggtcagctcgccaagttcaagatgccgaagaaagtgatcttcgtcgacgacctgccgcgcaacaccatgggcaaggtccagaagaacgtcctgcgcgagacctacaaggacatctac

SEQ ID NO: 44431 - DNA, 1782 bp, Rhodopseudomonas palustris
aacgcctatccgatcgaggaccacacctacgatgtcgtggtggtcggcgccggcggcgcgggtttgcgcgcggtggtcggctgcagcgaagcgggcctccgcaccgcctgcatcaccaaggtgttcccgacccgctcgcacaccgtggcggcccagggcggcatctcggcctcgctcggcaacatgcacaaggatgactggcgctggcacatgtacgacaccgtgaaggggtcggactggctcggcgaccaggactcgatcgaatacatggtccgcaatgccccggaagccgtgtacgaactcgagcattggggtgtgccgttctcgcgcaccgaagacggtaagatctatcagcggccgttcggcggcatgacgatggatttcggcaagggccaggcgcagcgcacctgcgcggccgccgaccgcaccggccacgccatgctgcacacgatgtacggtcaggcgctgcgccactcggctgagttctacatcgagttctttgccatcgacctgatcatggacgatcaggggtgctgccgcggcgtcgtggcgctgaagctcgacgacggcaccatccatcgtttcaaggcgcagaccaccatcctggcgaccggcggctacggccgtgcctacgcttcctgcacgtcggcgcacacctgcacgggcgacggcggcgcgatggcgctgcgcgccggcctgccgctgcaggacatggagttcgttcagttccacccgaccggcatctacggctcgggctgtctggtgaccgaaggcgcccgcggcgagggtggctatctggtcaactccgagggcgagcgcttcatggagcgctatgcgccgtcggccaaggatctcgcctcgcgcgacgtcgtttcgcgcgcgatgacgatcgaaatgcgcgaaggtcgcggcgtcggcaagaagaaggaccacatcttcctgcacctcgaccatctggcgccggaagtgctgcacgagcggctgccgggcatctcggaatcggcacggatcttcgccggcgtcgacgtcacccgcgagccgatcccgatcctgccgaccgtgcactacaacatgggcggcatcccgacgaacttccacggcgaagtcgtgaccaagaaggacggcgacgacaacgcagtggtgccgggcctgatggcgatcggcgaagctgcctgcgtgtcggtgcacggcgccaaccgcctcggctccaactcgctgatcgacctcgtggtgttcggccgcgccgcagcgctgcgctgcgccgagaagctggtgccgaacggcaagcagcctgaactgccggccagctccgccgacatgtcgctgtcgcggctcgacaagtatcgctacgccaagggcggcaccccaaccgccaagctgcgcgagcggatgcagcacgtgatgcagaacaactgcgcggtgttccgcaccggcgaagtgctcgccgagggcaaggaactgatcgccaacgtccatggcagcgtcggcgacgtcggggtgtcggatcgcacgctggtgtggaattccgatctcgtcgagaccctggaattcgacaatctgatcgtccaggcggtggtgacgatgaactccgccgccaaccgcaccgagagccgcggcgcccacgcccgcgaagacttcccggatcgcgatgacgccaactggatgaagcacacgctggcctggatcggtgacaagggcgacgtgaccatcgattatcggccggtgcacgactacacgatgaccaacgacgtccagtacatcccgccgaagccgcgggtgtat

SEQ ID NO: 44432 - DNA, 780 bp, Rhodopseudomonas palustris
atggttgaattcgcacttccgaagaattcgaagattgtcggcggcaagacctggccgaagccggaaggcgcgaccgaggttcgtgaattccgcgtctatcgctggaatccggacgacggcaagaacccgagcgtcgacacctactacgtcgacaagcacgactgcggcccgatggttctcgacggcctgatctggatcaagaacaacatcgacccgaccctgaccttccgccgctcctgccgcgaaggcgtgtgcggctcgtgcgcgatgaacatcgacggcgagaacacgctggcctgtaccaaggcgatggacgacgttcgcgacgacgcggtgaagatcaacccgctgccgcaccagccggtggtgaaggatctggttccagacctgaccaacttctacgcgcaatacgcctcgatccagccctggctgcagaccgtgacgccgaccccgcagaaggaatggcggcagagccactccgaccgcgaaaagctcgacggcctgtacgagtgcatcctgtgcgcctgctgctcgacctcatgcccgagctactggtggaactcggatcgcttcctcggcccggcggcgctgctgcaggcgacccgctgggtcgaagacagccgcgatgaagctaccggcgagcgcctcgacaatctcgaagatccgttccggatctatcgctgccacaccatcatgaactgcgccaaggcgtgcccgaagggtctcaacccgtcggaagcgatcgccaacctcaagctcaagctggtcgaacgccagatc

SEQ ID NO: 44433 - DNA, 1923 bp, Rhodopseudomonas palustris
atctacgacgtgcccgcagagtgggcgagccgcgccttcgtcgacgacgccaaatatcgccagatgtacgagcgctcggtcacggatccgaccggattctgggcggagcacgccaagcgcgtcgactggatcaaggcgccgaccaagatcgacaactggtcgttcgcgcccggcaacgtttcgatcaagtggttcgaggacggcgtcctcaacgccgcctacaactgcatcgaccgccacctcgacaagcgcggcgaccaggtcgcgatcatctgggaaggcgacgatccttcgcagtcgcgcagcatcacctatcgcgagctgcacgacgaggtctgcaagttcgccaacatcctgcgcaaccgcaatgtcggcaagggtgaccgcgtcaccatctatctgccgatgattccggaagccgcgttcgcgatgctggcctgcgcccggatcggcgcgatccactcggtggtgttcgccggcttctcgcccgacagcctcgcgggccgcatcaacgactgcaactcgaagatcgtcatcaccgccgacgaaggcctgcgcggcggccgcaaggtgccgctgaaggccaatgtcgacgcggcgctgaagaagtgcgagggcgtcgactgggtgatggtggtcaaacgcaccggcgccgcggtcgaaatggatgacgtccgcgacttctggtaccacgaagccgccgaggtggtgacgaccgagtgcccggtcgagcacatgcatgccgaagacccgctgttcatcctctacacctcgggctcgaccggccagccgaagggcgtgctgcataccaccggcggctatctggtgttcgcgtcgatgacgcaccaatacgtcttcgattatcacgacggcgacatctactggtgcaccgccgacgtcggctgggtcaccggccacagctacatcctgtacgggccgctcgccaacggcgccacgacgctgatgttcgaaggcgtgccgaactatccgaccaattcccggttctgggaagtgatcgacaagcacaaggtcaacatcttctacaccgcaccgaccgcgatccgcgcgctgatgcaggccggcgacgagccggtgaagaagacctcgcgcaagtcgctccgcctgctcggctcggtcggcgagccgatcaatccggaagcctgggagtggtaccaccgcgtcgtcggcgaggaccgctgcccgatcgtcgacacctggtggcagacggagaccggcggcatcctgatcaccccgctgcccggcgccaccaagctgaagcccggctctgcgacccggccgttcttcggcgtggtacccgagatcctcgatccggaaggcaacgttctggaaggcgaatgcaccggcaacctctgcctcgcccgctcctggccgggacaaatgcggaccgtgtacggcgaccatgcccggttcgagcagacctacttctcggcctacaagggcaagtacttcaccggtgacggctgccggcgcgacaccgacggcttctactggatcaccggccgggtcgacgacgtcatcaacgtctcgggtcaccgcatgggcaccgccgaggtcgaatcctcgctggtggcgcatccgaaggtgtccgaggcggcggtggtcggctatccgcacgacatcaagggccagggtatctacgcctatgtgaccctgatggccggcgaagagccgaccgaggagctgcgcaaggaactggtcgcctgggtccgcaaggacatcggcccgatcgcctcgcccgacctgatccagttcgcgcccggcctgcccaagacccgctccggcaagatcatgcgccgaatcctacgcaagatcgcggaggacgaaccgtcctcgctcggcgacacctcgacgctggccgatcccgcggtggtcgacgatctggtcgagcatcgccagaacaag

SEQ ID NO: 44434 - DNA, 2703 bp, Rhodopseudomonas palustris
gacagcttcaaatgccggaagatcctcaaggtcggcagcaagtcttacgtctattacagcctgcccactgccgagaagaatggcctgaaggggatctcccgtctgccctactcgatgaaggtgctgctggaaaacctgctgcgcaacgaggacgaccgcaccgtcaagaaggccgacatcatggcggtcgccaagtggatgcggaagaaggcgctggagcacgaaatcgcattccgcccggcgcgcgtgctgatgcaggacttcaccggcgtgccggccgtggtcgatctggcggcgatgcgcaacgcgatgcagaagctcggtggtgatgccgagaagatcaatccgctggtgccggtcgacctcgtgatcgaccactcggtgatcgtcaacttcttcggtaacaaccaggcgttcaagaagaacgtcgccgaggagtacaagcagaaccaggagcgctacgagttcctgaagtggggccagaaggcattctcgaacttcgcggtggtgccgcccggcaccggcatctgccaccaggtcaatctcgagtacttggcgcagacggtctggaccaagaaggagaagatgacgatcggccgcaagaccggtaccttcgaagtcgcctatccggacacgctggtcggtaccgactcgcacaccaccatggtcaacggtctcgccgtgctcggctggggcgtcggtggcattgaggcggaagctgcgatgctcggccagccgctgtcgatgctgctgcccgaagtggtcggcttcaagctcaagggcgcgctcaaggaaggcgtcaccgcgaccgacctggtgctgaccgtcacccagatgctgcgtaagcagggcgtggtcggcaagttcgtcgaattcttcggcccgggcctcgacaacctctcggtcgccgacaaggcgacgatcgccaatatggcgccggaatacggtgcgacctgcggcttcttcccggtcgacggtgaaaccatcgattacttgaagacctcgggccgtgcctcggcgcgggtcgcgctggtcgagaagtacgccaaggcgcagggcctgttccgcaccgccaagtcgccggacccggtgttcaccgtgacgctgacgctggacctcgccgacgtggtgccgtcgctggccggtccgaagcgtcccgagggtcgcgtcgcgctgccggcggtggcggaaggcttcaccacggcgatggacgccgaatacaagaaggcgctcgacggcgcccgctacaaggtcgaaggccgcaatttcgatatcggccacggtgacgtggtgatcgcggcgatcacctcctgcaccaacacctcgaacccgagcgtgctgatcggcgccggcctgttggcgcgtaacgccgccgccaagggcctcaaggccgcgccgtgggtgaagacctcgctggccccgggctcgcaggtggtcgccgagtatctggcgaactcgggtctgcagaaggacctcgacaaggtcggcttcaacctggtcggcttcggctgcaccacctgcatcggcaattccggcccgctgccggaggagatctcgaagtcgatcaacgacaacggcatcgttgccgccgccgtgctgtcgggcaaccgcaacttcgaaggccgcgtctcgccggacgtgcaggcgaactatctggcgtcgccgccgctggtggtggcctacgcgctcgccggctcggtgaccaagaacctcgcggtcgatccgatcggcaccggcaaggacggcaagccggtttacctgaaggacatctggccgagcaccaaggagatcaacgccttcgtcaagaagtacgtgacctccaagatcttcaaggcgcgctacgccgacgtgttcaagggcgacaccaactggcgcaagatcaagacggtcgagtccgagacctacaagtggaacatgtcgtcgacctacgtgcagaacccgccgtatttcgaaggcatgaccaagcagccggagccgatcaccgacgtggtcgacgcccgcgtgctggcgctgttcggcgacaagatcaccaccgaccacatctcgccggccggttcgatcaagctgacgtcgccggctggtaagtatctgaccgagcgtcaggtccgcccggccgacttcaatcagtacggcacccgccgcggcaaccatgaagtgatgatgcgcggcaccttcgccaacatccgcatcaagaaccacatgctgaagggcgccgacggcaacattccggaaggcggcctgaccaagcactggcccgacggcgagcagatgtcgatctacgacgctgccatgaagtaccaggaagagaaggtgccgctggtggtgttcgccggtgccgaatacggcaacggttcgtcgcgcgactgggccgcgaaaggcacccgtctgctcggcgttcgcgccgtgatctgccagagcttcgagcgcatccaccgctcgaacctggtcggcatgggcgtgctgccgctgaccttcgaagagggcacctcgtgggcctcgctcggcctcaagggcgacgagaaggtcacgatccgcggcctcgagggcgacctcaagccgcggcagatgctggaagccgagatcacctcggctgcaggcaagcgcaagcgcgtgccgttgctgtgccgcatcgatacgctcgacgaactcgattactaccgcaacggcggtattctgcactacgtgctgcgcaagctcgcggcc

SEQ ID NO: 44435 - DNA, 933 bp, Rhodopseudomonas palustris
atggcgcgcgataaaattgctttgattggctccggccagatcggcggtacgctggcacatttggtcgggttgaaagagctcggcgacgtggtgctgttcgacattgccgagggcgtgccgcagggcaaggcgctcgacatcgcggagtcctcgccggtcgacggtttcgactccaagctgaccggtgccaactcctacgaggcgatcgaaggcgcccgcgtggtgatcgtcaccgccggcgtgccgcgcaagccgggcatgagccgtgacgatctgctcagcatcaacctcaaggtgatggagcaggtcggcgctggcatcaagaagtacgcgcccgacgcgttcgtgatctgcatcaccaacccgctcgacgcgatggtctgggcgctgcagaaggcctcgggcctgccggccaagaaggttgtcggcatggccggcgtgctcgactcggcgcggttccgttacttcctggccgacgagttcaacgtgtcggtcgaagacgtcaccgccttcgtgctcggcggccacggtgataccatggtgccgctggtgaagtactcgaccgtcgccggaattccgctgcccgacctggtcaagatgggctggacctcgcaggcgcgcctcgatgagatcgtcgaccgcacccgcaacggcggcgccgagatcgtcaacctgctgaagaccggctcggcgttctacgccccggcgtcgtcggcgatcgcgatggccgagagctatctgaaggacaagaagcgggtggtgccggtcgcggcccacctcaacggcgaatacggcgtcaaggacatgtatgtcggcgttccggtggtgatcggcgacaagggcgtcgagcgcatcgtcgagatcgagctggccggcaaggacaaggaagcgttcgacaggtcggtcgctgccgttcagggcctggtcgaggcc

SEQ ID NO: 44436 - DNA, 1185 bp, Rhodopseudomonas palustris
atgaatattcacgaataccaggccaaggcggtgctgcgcgagttcggtgtgccggtggggcacggcttcccgatcttcaaggcgtccgaagcggaagccgccgccaagcagctcggcggcccggtctgggtggtgaagagccagatccacgccggcggccgcggcaagggcaagttcaaggaagcttccgccggcgataagggcggcgttcgcctcgccaagtcgatcgacgaggtcaaggaattcgccaagcagatgctcggcgccacgctggtgacggtgcagaccggcgctgacggcaagcaggtcaaccgcctctacatcgaggaaggctccgacatcgacaaggagttctacctgtcgctgctggtcgatcgcgccacctcgcggatttccttcgtggtctcgaccgaaggcggcatgtcgatcgaagacgttgcccacgagacgcccgagaagatcgtgtcgttcaccgtcgatccggcgaccggcatcatgggccatcacggccgcaccgtcgccaaggcgctgaacctcaagggcgagcaggccaagcaggccgaagcgatggtggcgaagctttacaccgccttcgtcgccaaagacatggacatgctcgagatcaacccgctggtgctgaccaagcagggcgatctgaagtgcctcgacgccaagatctcgttcgacggcaacgcgctgtaccgccacaccgacatccaggccctgcgtgacgagaccgaggaagacgccaaggaaatcgaagcgtcgaaatacgacctcaactacgtcaccctcgacggcaccatcggctgcatggtcaacggcgccggcctcgcgatggcgacgatggacatcatcaagctgtacggcatgagcccggccaacttcctcgacgtcggcggcggcgccagcaaggagaaggtgaccgcggcgttcaagatcatcactgccgatccgaacgtgaagggcatcctgatcaacatcttcggcggcatcatgaagtgcgacgtgatcgccgaaggcgtggtcgcagcggtcaaggaagtcggtctcgacgtgccgctggtggttcgcctcgaaggcaccaatgtcgaagccggcaagaagatcatcaagcattccggcctcaacgtgctgcccgccgacaatctcgacgacgccgcgcagaagatcgtcgccgccgtg

SEQ ID NO: 44437 - DNA, 876 bp, Rhodopseudomonas palustris
atgtccattctgatcgacagcaacacccgcgttatctgccagggcttcaccggcaagaacggtaccttccattccgaggcagcgatcgcctacggcaccaagatggtcggcggcacctcgccgggcaaaggcggctcgacccacctcggcctgccggtgttcgacaccgtccgtgaggcgcgcgacaagaccggggcggatgcgtcggtgatctacgtgccgccgccgggcgccgcggacgcgatctgcgaggcgatcgacgccgagatcccgctgatcgtctgcatcaccgagggcatcccggtgctcgacatggtgcgggtgaagcggtcgctgaatggctcgaagtcgcgcctgatcgggccgaactgcccgggcgtgatgaccgccggcgagtgcaagatcggcatcatgccggccaacatcttcaagccgggctcggtcggcatcgtgtcgcgctccggcaccctgacctatgaggcggtgttccagacctcggccgagggcctcggccagaccaccgcggtcggcatcggcggcgacccggtcaagggcaccgaattcatcgacgtgctggagatgttcctggccgacgacaacaccgagtcgatcatcatgatcggtgagatcggcggttcggccgaagaagacgccgcccagttcctgatcgacgaggccaagcgcggccgcaagaaaccgatggtcggattcattgccggcgtcaccgcccctcccggccgccgcatgggccacgccggtgcgatcatttcgggcggcaagggcgatgcggcctcgaagaccgcagccatggaagcggctggcatcaccgtgtcgccgtcgccggcgcgtcttggcaaaacgcttgccgaaaaattg

SEQ ID NO: 44438 - DNA, 2952 bp, Rhodopseudomonas palustris
atgtctcgccaggacgcgaatgccgctttcgccctatcctcctttctacagggcgccaacgccacctatatcgacgatctgtactctcggtacgaaagcgatccgtcctcggttgatgccgactggcaggcattcttccggagcctcaaagacgcccccggcgacatccagaagaacgccgagggcccgtcctgggagcaggcgaactggccgctgaccccgcgggacgagctgacctcggcgctcgacggcaactggaaccaagtcgaaaaagccgtcggccagaagatccaggccaaggctcagagccgcggcgtcgaactgtcctccgccgacgtgctgcaggccacccgggactcggtccgggccctgatgctgatccgggcctaccggatgcgcggccatttccacgccaagctcgatccgctcggcctgtcgccggcgaaagatcacgaggagctggacatccgctcctatggcttcaccgaggccgatctcgaccgcaagatcttcctcgatcacgtccttggcctggaatacggctcgctccgcgagatcgtcgcgatctgcgagcgcacctactgccagaccatgggcatcgaatttctgcacatctccaacggtgcgcagaaggcctggatccaggagcggatcgaaggtccggacaaggagatcagcttcacccgcgagggccgtcgcgcgatcctgatgaagctgatcgaatccgaaggcttcgagaagttctgtgacctgaagttcaccggcaccaagcggttcggtctcgatggcggcgaagcgctgatcccggcgctggagcagatcatcaagcgcggcggcaacctcggcgtccgtgaaatcgtgctcggcatgccgcatcgcggtcgtctcaacgtgctgacccaggtgatggccaaggcccaccgggcgctgttccacgagttcaagggcggttcggccaacccagacgaggtcgaaggctcgggcgacgtcaaatatcacctcggcgcctcgtcggaccgcgagttcgaccacaacaaggtccacctgtcgctgaccgccaacccgtcccacctcgagatcgtcgatccggtggtgctcggcaaggtgcgcgccaagcaggaccagcatggcgatctgccggaagagcgcatctcggtgctgccactgctgatgcacggcgacgccgcgttcgccggccagggcgtggtcgccgagtgcttcgcgctgtccgatctgaagggctaccgcaccggcggttcgatccacttcatcgtcaacaaccagatcggcttcaccacctatccgcgctattcacgctcctcgccgtatccgtcagatgtggcgaagatgatcgacgcgccgatcttccacgtgaacggcgacgatccggaagcggtggtgttcgccgccaagatcgcggtcgagtaccggcagaagttccacaagccggtcgtcatcgacatgttctgctatcggcggcacggccacaacgaaggcgatgagccgtcgttcacccagccgctgatgtaccgcaagatcgccggccatccgaccacgctggagatctactccaagcggctgatcgccgacggcgtcatcaccgaaggcgaggtcgagaaggcgcgggccgactggcgcgcccggctcgatgccgaattcgaagcggcgtccagctatcggccgaacaaggccgactggctcgacggcaagtgggccggcttcaagtccgccgaccaggaagaggagccgcgccgcggcatcactggcgtcgacctgccgaccctcaaggaaatcggccgcaggatcaccaaggtgccggagggcttccgcctgcaccgcaccgtgcagcgcttcctcgaaaaccgcgcccgcgcgatcgacagcggcaacggtctcgactgggcgaccggcgaagcgctggcgttctgcaccatgctgctggaaggccatcgcatccgtctgtcgggccaggactccgaacgcggcaccttctcgcagcgccattcggtgctgatcgatcaggaagacgagacccgctacaccccgttcaaccacctctcgcccgaccagggccactatgaggtgatcaactccctgctgtccgaagaggcggtgctcggcttcgaatacggctattcgctggccgagccgaacgcgctgacgctgtgggaagcccagttcggcgatttcgccaacggcgcccaggtgcttttcgaccagttcatctcgtcgggcgagcgcaagtggctgcgcatgtcgggtctggtctgcctgctgccgcacggctacgagggccagggaccggagcactcatcggcccgcctcgagcgctatctgcagatgtgcgccgaagacaacatgcaggtggtgtatccgaccaccccggcgaactacttccatgcactccgccgtcagctcaagcgcgagatccgcaagcccttgatcctgatgacgccgaagtcgctgctccgccacaagcgggcgatctcgcggctcgaagaactcggccccgataccagcttccaccgcgtgctgctcgacgacgcgcagacgctgccggacgacaagaccaagctggtggcggacgccaagatccgccgcgtcgtggtgtgctccggcaaggtctattacgacctctacgacgagcgcgaaaagcgcggcatcgacgacgtctatctgctccgcgtcgagcagctctatccggtgccggtgaagacgctggtgcacgagctgtcgcgcttcaaggatgcggagctggtgtggtgtcaggaagagccgcgcaacatgggcggctggcacttcatcgagccgtatctagagtgggtgcagaaccagatcgaagccaagcatcgccggccgcgttacgtcggccgcgccgcctcggcggcgactgcgaccggcctgatgtcgaagcatctcgcgcagctcaaggcgttcctcgacgaagcgttg

SEQ ID NO: 44439 - DNA, 1251 bp, Rhodopseudomonas palustris
atgactgaaattcgcgttccgacgctcggtgaatcggtgaccgaggcgaccatcggccgctggttcaagaagcctggcgaggcggtggctgtcgatgagccgctcgtcgagctcgaaaccgacaaggtgaccattgaagtgccggccccgtcggccggtacgctcggcgaaatcgtcgccaaggacggcgagaccgtcgcggtcggcgcgttgctcggccagatcaccgatggcgccgccccggccaagccggctgccgctgctccggcgaaggccgcggcaccggctgctgcgcctgccccggcggcaccggcccccgcggctgctcccgccgccaaggctccgccgtccgatgcgccgctggcgccgtcggtgcgccggctgtcaaccgagagcggcgtcgacgcctcgaccgtgccgggctccggcaaggacggtcgcgtcaccaagggcgatatgctggcggcgatcgagaaggcggcctcggcgccgaccccggtcaatcagcccgccgccgcggtgcaggtccgcgggccgtcaccggccgacgacgccgcacgcgaggagcgggtgaagatgacccggctgcgccagaccatcgcgcgccgcctgaaggaagtacagaacaccgccgcgatgctgacgaccttcaacgaggtcgacatgaccaacgtcatggcgctgcgcgcgcagtacaaggacgtgttcgagaagaaacacggcgccaagctcggcttcatgggcttcttcaccaaggcctgcgttcaggccctgaaggatatcccggcggtgaacgccgagatggacggcaccgacctgatctacaagaactactaccacatcggcgtcgccgtcggcaccgacaagggcctcgtggtcccggtggtgcgcgactgcgacgagaagtcgatcgccgacatcgaaaagagcatcgtcgactacggcaagcgtgcccgtgacggtcagctcaagatcgaggagatgcagggcggtaccttcacgatcaccaacggcggaatctacgggtcgctgatgtcgaccccgatcctgaacgcgccgcagtccggcattctcggcatgcacaagatccaggaacgcccggtggtgatcggcggcaagatcgaagtgcgcccgatgatgtatttggcgctgagctatgatcaccgcgtgatcgacggcaaggaagccgtgaccttcctggttcgcgtcaaggagagcctggaagacccggcgcgcctggtgctggatctc

SEQ ID NO: 44440 - DNA, 732 bp, Rhodopseudomonas palustris
gtcgtcatcatcaccggaggcagccgcggcatcggccgcgccaccgcgctgggttgtgcgaagcgcggcttcaaggtcgtggtcggctacgccagtaatgccgcggcggccgacgaggtggtggccgagatcgcagccagcaatggcaaggctatcgcggtgaaatgcgacgtcggcagcgaagccgacattctcgcgctgttcgctgccgcggacgcgttcggtccgctcggcgcgctggtcaataatgctggcatcgtcggaccgaccgcgcgggtcgacgagatgtcggccgaacgcattcagcggatgatggcggttaacgtcaccggcagcattctgtgcgcgcgtgaggcggtgaagcggatgtcgacccggcacggcggtaagggcggcgtcatcgtcaatctgtcatcggtcgcggccaaactcggctcgccaaatacctatgtcgactacgcggcctccaagggtgcggtcgactcctttacggtcgggctcggccacgaagtcgccggcgaaggcattcgcgtcgcggcgatccggcctggattgatcgataccgagatccacgcctcgggcggcgatccggaacgcgcgcatcggctcagcgtcaacgtgccgatgaagcgcgtcggccgcgccgaggaaatcgccaacgccgtcgtctggctgctgtccgacgaggcctcctatgtcaccagcgccatcatcgacgtgtcggggggacga

SEQ ID NO: 44441 - DNA, 1389 bp, Rhodopseudomonas palustris
gatctcgtcgtcatcggcaccggccccggcggctacgtctgcgcgattcgcgcggcgcaactcggcctcaaggtggcggtggtcgagaaaaacgccacgctcggcgggacttgcctcaacgtcggctgcatgccgtcgaaggcgctgctgcatgcttccgaactgttcgaggaagccgggcattcgtttgccaagatgggcatcggcgtgtcggccccgaagctcgatctgccggcgatgatgaacttcaagcagcagggtatcgacggcaacgtcaaaggcgtcgaatacctgatgaagaagaacaagatcgacgtgctggtcggcaagggcaagatcctcggcaccggcaaggtcgaggtgacgggcgccgacggcaaggccaccagcgtcgaggccaaatccatcgtgatcgcctccggctcggcggtggctcagctcaagggcatcgagatcgatgagaagcgggtggtgtcgtcgaccggcgcgctgtcgctcgacaaggtcccgggcaagctgatcgtggtcggcgccggcgtgatcgggctcgagctcggctcggtgtggcgccgcctcggcgccgaggtcaccgtggtcgaattcctcgaccgcatcctgccgggcatggacggcgaggtggtcaagcaattccagcgcatcctcgagaagcagggctttgccttcaagctcggcgccaaggtcaccggcgtcgacacctcgggcgccaagctcgctgtgaaggtcgaggcggcggccggtggcaatccggaaacgctggaagccgacgtggtgctggtcgcgatcggccgcgtcccctacaccgaaggcctcggcctgaaggaagccggcgttgcgctcgacgagcgcggccgggtggtaatcgacgaccacttcgccaccagcctcaagggcgtgtacgcgatcggcgacgtggtgcgcggcccgatgctggcccataaggccgaggacgaaggtgtcgcggtcgccgagctgatcgccggcaaggccggccacgttaattacgacgtcattccgggcgtggtctacaccacgccggaggtgtcgagcgtcggcaagaccgaagaggacctcaagcaggccggcgtcgcctatacggtcggaaaattcccgttcaccgccaacggccgctccaaggtcaaccagaccaccgacggctttgtgaagatcttggccgacgccaagaccgaccgtgttctcggcgtccacatcatcggccgcgaggccggcgagatgatccacgaagcggccgtgctgatggagttcggcggctctgccgaagatctggcccgcacctgccacgcccatccgacccgctcggaggccatcaaggaggccgcccttacggtcggcaagcgcgccatccatatg

SEQ ID NO: 44442 - DNA, 552 bp, Rhodopseudomonas palustris
tctgaagatccatcggtttccggagtctccggtcgttacgcgaccgctttgtttgaactggcccgcgacgagaaatccatcgatgcggtgacggccgatctggacaagttcagcgccatgttggcgggcagccccgatctggttcgcctggtccgcagtccggtgttcgcctcagaggtgcagggcaaggcgctggccgccgtgctcgacaaggcgggcatcaccggcatcagcgccaattttctgaaagtgctcgcggccaaccgccggctgttcgtggtcgcggacgtgatccgcgcctatcgcgcgctggtcgccaagttcaagggcgaggcgaccgccgacgtgaccgtggccgagaagctcagcgacaagaatctcgaagcgctgaaggcggcgctgaagtcggtgaccggcaaggatgtcgccctcaatatcaatgtcgatccggcgatcatcggcgggcttgtcgtcaagctcggtagccgcatggtcgacagttcgctccgcaccaaactcaattcgatcaagcacgcgatgaaagaggcaggc

SEQ ID NO: 44443 - DNA, 1416 bp, Rhodopseudomonas palustris
atccgcgccgcggaaatttccgcgatcctcaaggaccagatcaagaatttcggccaggaagccgaagtctccgaggtcggacaggtgttgtccgtcggcgacggtatcgcccgcgtttatggcctggataatgtgctcgccggtgaaatggtcgagttcgagaacggcacccgcggcatggcgctgaacctcgaaaccgacaacgtcggcgtcgtgatcttcggtgccgaccgcgagattaaggaaggccagaccgtcaagcgcacccgttcgatcgtggacgcgccggtcggcaagggtctgctcggccgcgtcgtcgacgcgctgggtaacccgatcgacggcaagggtccgatccaggcggtcgagcgcaagcgtgtcgacgtcaaggcgcccggcatcattccgcgcaagtcggtgcacgagccgatggcgaccggcctgaagtcgatcgacgcgctgatcccgatcggtcgtggccagcgcgagctgatcatcggcgaccgtcagaccggcaagaccgcgatcgcgctcgacaccattctgaaccagaagccgctgaacgtcgaaggagcgccggagagccagaagctctactgcgtttacgtcgcggtcggtcagaagcgctccaccgtcgcccagttcgtgaaggtgctggaagagcagggcgcgctggaatactcggtcgtcgtcgccgctaccgcgtcggacccggctccgatgcagtacatcgcgccgttcaccggctgcaccatcggcgagtacttccgcgacaacggcatgcacgccgtcatcatctatgacgacttgtccaagcaggccgtcgcttatcgtcagatgtcgctgctgctgcgccgcccgccgggccgcgaagcgtatccgggcgatgtgttctacctgcactcccgtctgctcgagcgcgccgccaagctcaatgacgagcagggcaacggctcgctgaccgcgctgccggtgatcgaaactcaggccaacgacgtctcggcctacattccgaccaacgtgatctcgatcaccgacggccagatcttcctggaaaccgacctgttcttccagggcatccgcccggccgtgaacgtcggtctgtcggtgtcgcgcgtcggttcgtcggcgcagaccaaggcgatgaagaaggttgccggcaagatcaagggcgagctcgcgcagtaccgcgaaatggcggcgttcgcgcagttcggctccgacctcgacgccgcgacccagcgcctgctgaaccgcggttcgcgcctgaccgagctcctgaagcagccgcagttctcgccgctgaagatggaagagcaggtctgcgtgatctgggctggcaccaacggctatctcgatgcgctgccgctcaacaaggtgcgcgcgttcgaagacggcctgctggcgctgctgcgc

SEQ ID NO: 44444 - DNA, 873 bp, Rhodopseudomonas palustris
atggcttcacttaaagacatgcgcgtccgcatcgcctcgacgaaggcgacgcagaagatcaccaaggcgatgcagatggtggccgcctcgaagctgcgccgcgcccagatggcggcggaagcagcgcggccctacgccgagaagatggaagcggtgatctcgaatatcgccggtgccgcggcgggctcgcccggcgcgccggtgctgctggccggcaacggcaaggatcaggttcatctgctgctggtgtgcaccggcgagcgcggcctgtccggtgcgttcaactcctcgatcgtccgcctcgcccgcgagcgcgcgtacgagctgatgagccagggcaagaccgtcaagttcttctgcgtcggccgcaagggttacgagcagctccgccgcaacttcgagaagcagatcatcgacaatgtcgagctgcgctcggtgcgtcagatcggtttcgtcaacgccgaggacatcgccaagaaggtgatcgcccgcttcaacgccggcgagttcgacgtctgcacgctgttctattcgcgcttcaagtcggtgatctcgcagatcccgaccgcccagcagctgattccgctggaagtgacggcgccggccgcaggcacggtggcgacctcctacgaatatgagccggaagaggacgagatcctctcggggctgttgccgcgcaatctcgcggtgcagatcttccgcgcgctgcttgagaacaacgcttcgttctacggcgcgcagatgagcgcgatggacaacgccacccgcaacgctggtgagatgatccgcaagcagacgctggtctacaaccgcacccgccaggcgatgatcaccaaagaactcatcgagatcatctcgggcgccgaggcgatc

SEQ ID NO: 44445 - DNA, 1425 bp, Rhodopseudomonas palustris
gctacacccgccaatcagaccggacgcatcacgcaggtcatcggcgccgtcgtcgacgttcagttcgaagggcacctgccggccattctgaacgccatcgaaaccaagaacggcgacaaccgcctggtgctcgaagttgcgcagcatctcggtgaatcgaccgtccgcaccatcgcgatggacaccaccgaaggtctggtccgtggccaggaagtcaccgacactggcgcgccgatctcggtaccggtcggcgccggcacgctcggccgcatcatgaacgtgatcggcgagccggtcgatgagcagggcccgatcaagtcggaaggcctccgcgccatccaccaggaagcgccggcctacaccgaccagtcgaccgaggctgaaattctcgtcaccggcatcaaggtcgtcgacctgctggcgccttacgccaagggcggtaagatcggcctgttcggcggcgccggcgtcggcaagaccgtgctgattcaggaactgatcaacaacgtcgcccgcgctcacggcggttactcggtgttcgccggcgtcggcgaacgtacccgcgaaggtaacgacctctatcacgagttcatcgaatccggcgtcaacaagaagggcggcggcgagggttcgaagtgcgcgctggtgtacggccagatgaacgaaccgccgggcgcccgcgctcgcgtcggtctgaccggtctgaccgtcgccgagcacttccgcgatcagggccaggacgtgctgttcttcgtcgacaacatcttccgcttcacccaggcgggttcggaagtgtcggcgctgctcggccgtatcccgtcggcggtgggttatcagccgacgctcgcgaccgacatgggcgcgctgcaggagcgcatcaccaccaccaccaagggctcgatcacctcggtgcaggcgatttacgtgccggccgacgacttgaccgacccggcgcccgcgacctcgttcgcgcacttggacgccaccaccgtgctcaatcgtgcgatctcggaaaagggcatctacccggcggtggatccgctcgactcgacctcgcgcatgctgtccgcctcgatcgtcggcgaagagcactacaataccgcgcgtatggttcagcagatcctgcagaagtacaagtcgctgcaggacatcatcgcgatcctgggcatggacgaactgtctgaagaggacaagctcacagtggctcgcgcccgtaagatcgagcgcttcctgtcgcagccgttcttcgtcgccgaagtgttcaccggctcgccgggcaagttcgtcgacctcgccgacaccatcaagggcttccgcgcgatctgcgaaggcaagtacgaccatctgccggaagcggcgttctacatggtcggcaccatcgaagaggcggtcgagaagggcaagaagctcgccgccgaggcggcc

SEQ ID NO: 44446 - DNA, 1215 bp, Rhodopseudomonas palustris
gcccgcgccgccgcgcggaccctggcgctggcgccgccggagcagaagaaccgcgcgctggaagcaatggagcgtgcaatccgcgccggcgcagacaagatcctggcggcgaatgccgaggacgtcgccgatgccaaagctgccggtaccacgtcggcattcttggaccgcctgacgctgacgccggcgcgcgtcgaagcgatggccgaaggcatcgcggtggtgcgcggcatcgccgacccggtcggcaccgtgaccgagagctggcagcggccgaacggcatgaccatcgagcgcgtccgcgtgccgctcggggtggtggcggtgatcttcgaaagccgtcccaacgttgcggctgacgccggcgtgctgtgcctgaagtcgggcaatgcggtgatcctgcgcggcggctcggagagcttccgctcctgccgcgcgattcacgaccgcctggtgcagggtctgcgcgaagcggggctgccggacgcggcgattactttggtgccgacccgcgaccgtgcggctgttggattactcctcgccggcctcgatgggtctgtcgacgtcatcgtgccgcgcggcggcaagagcctggtcgcgcgcgtcgaaagcgaagcgcgggtgccggtgttcgcgcatctcgaaggcgtcaatcacgtctatgtcgatcgcagcgctgatctcgagatggccaaatcgatcgtgctcaatgccaagatgcgccgcacaggtgtctgcggcgctgccgagacgctgctgatcgatcgcgcggccgccacaacgcatctcgccccgctggtgacgatgctgatcgattcaggttgcgaggtgcgcggcgaccagaccgtgcagcaggtcgatccccgagtgaagccggcaagcgatgaggactgggatactgagtatctcgacgcagtcatcgccgccaagctggtcgacggcgtcgacggagcgatcgtgcatattcacaatcacggatcgcaccacaccgatgcgatcgttgccgaagatgcgcaggcggcggcgaaatttctcggcgaagtcgattcagcgatcgtgctgcataacgcatcgacgcagttcgccgatggtggcgagttcggcttcggtgccgagattggaatcgccaccggcaaattccacgcccgtggaccggtcggcgccgagcaactgacgacgttcaagtatcgcatccatggcagcggacagacccgg

SEQ ID NO: 44447 - DNA, 858 bp, Rhodopseudomonas palustris
atcaaaggtattattctggccggtggcagcggcacaaggctgcatccgatgacggctgcggtgtcgaagcagttgatgccgatctacgataagccgctgatctattatccgctggccacgctgatgatggccggcatccgcgagatcctggtgatctcgacgcccgccgatctgcctcgattccagcaactgctcggcgacggcgcctcgtggggcatgtcgttcagctatgccgaacagcccaagcccgaagggctggcgcaggccttcgtcatcggcgccgatttcgtggccggccagccgtccgccttagtgctcggcgacaatttgttctacggccacgacctgatccctctgctgcagaatgccgcgcagcatccggagggcgccacggtgttcgcctatcaggtcagcgatccggaacgctacggcgtggtcgagttcgataccaatcaggtcgcgcgctcgatcgaggagaagccggcacagccccgctcgaactgggcggtcacggggctttatttctacgaccaggatgtcgtcgagatcgcagcgaacctgaaaccctccgcacgcggcgagctcgagatcaccgacgtcaatcgtgcctacttggaacgcggcaagctgcgggtcgagaagatgggccgggggttcgcctggctcgacaccggcacgcccgatagtctgctcgacgccagcgagttcgtgcgggtgctcgagaagcgccagggcttcaagatctgctgccccgaggagatcgccttccggttcggatggatcgatacgcgccagctcgaacgtctggcgcagccgctcgccaagagcaattacggcggctacctgctcaagctggcg

SEQ ID NO: 44448 - DNA, 1428 bp, Rhodopseudomonas palustris
cttcaagcccgtcacctgatcggcaacacgctggtgccgtccgtcggcggtgccacgctcgacgtcatcgatcctgcgaccgggcaagtgatcggcaaggcgccggccgcaagcggcgacgatgtcgctcgcgcggtcgaggcggcgtcggcagcatttccgggatgggctgcgacgccggcacgccagcgcggcaagctgattgcggctgcggcgagcgcaatcgctgaacggagtgacgtgatcgccaccgtgctcgcgctcgaaaccggcaaggcgatccgtaccgaatgccgcggcgaggtcgcgaccgcgatcgacatcaccacgatgtatgcgggtctcgcgtcggagctgaagggcgagacgctgccgttcgatccgcagatcctcacatacacgagccgcgagccgctcggcgtcgtcgccgcgatcctgccgtggaacgtgccgctggtgctgatgatgctgaagatcgccccggcgctggtggcgggcaacaccgtggtggtgaaggcgtccgaagaggcgccatacgcgaccatcgaaatggcgcggctgatggccaggctgctgccggacggcgtactcaacgtgatctgcggcaccggccgcgactgcggtgcggcgctggtcgagcatccggcggttgccaaggtgacgttcaccggctcccaggcggtcggcgagttaatctatcagatggcggcgaagaagatcattccggtcagcctcgaacttggtggcaagagcccgatgatcgtctaccccgacgccgacatggcgcgggtcgtcgctggtgcgatcgccgggatgcggttcacccgtcagggccagagctgcacggcggcgagccggatctatgttcacaccacgctgatcgacgcctttgtggcggcgctgcgcgaagcggtgagcaagctgaagatcggtgatccgctcgatgaggcgaccgatatcggcaccgtgatttcgccgcggcaaaaggccaaggtcgaatcctatatcgacctcggagcgagaaccgccggcgccaaggtggatcgctgcggtgagttgcccggcgcggcgcatctgaaggacggcctgttcttgcagccgaccatcatcaccggcgtgccggaggattcgccgctgatgcgcgaggagatctttggaccggtggtctgcgtgcagccatgggacgacgaggatgacgtcatcgcgcgcgccaacgacagcgacttcggcctggccgcgacggtgtggaccaacgatctgcgcagcgcgctgcgcaccgtgcagcggctcgacgccggctacgtccaggtcaatcagaacctcaccatccagccgaatctgagctacggcggcttccgcaagtcgggcctcggcaaggaagcgtcgctggaggcgatgctcgagcacttcaccaagaagaagaccgtc

SEQ ID NO: 44449 - DNA, 720 bp, Rhodopseudomonas palustris
aaggtcgctgtcgtcacggcagcagcatcgggcattggcgccgccacggccgcccgtctcgcgcgggaaggcgcgtatgtctatctctcggatattgatcaggacgctctgggccgacaggccgaatctttggtcgacgtcgctgagcggatttcgacggtggtggctgatgtcaccgtacccgagcaggtctcggcgctaattgacggagccgcgcgcgagcggggccggctcgatatcctgatcaacaatgccggcatgggcgcgttcggccgcatcaccgaggtgacgccggaagcctggcaccgcgtcttcgggatctgcgtggattcgatctttcacgcaagtcgcgccgcgatcccgcatctaatcaaggcccgcggcactatcgtcaacaccgcttctatctccggtctgttcggcgactacggcttcgctgcctacaacgccgcgaagggcgcggtgatcaatctcacccgcaacatggcgctcgactacagccgcgacggccttcgcgtgaacgcggtctgccccggcctcatcgcgacgccgctgtcgctgaagctgcgcgacaacgcagcggtgatggccgagtacgaccggctgatcccgctcggccgcgccggttcgcccgaagaggtcgctggcgcgatcgctttcctcgcgtccgacgatgcgtcctacatcaccggcgtcgccttcgcggtcgatggcgggctg

SEQ ID NO: 44450 - DNA, 1373 bp, Rhodopseudomonas palustris
cgcgccgccttcgtgttcgcgcgcgagggtgtgttcggcgtggtcgatccggcgttgattccgcccgccggtcaggtgccggtgcggctggcgcggctgatcgagcgccgcggcgccaagtcgggggcgcggctgtcgcgggcgctgacccggctcggcccggcctatctcaagctcggccaattcctcgctacccgccccgacgtcgtcggggtggcgatggcacgcgatctcgaaagcctgcaggaccggctgccgccgttctcgcaggacgaagccgagcaggtgatcgccatttcgctggagcggccggtccgcgatctgttcgtcagcctcagcccgccggtcgcggccgcgtcgattgctcaggtgcatcgcggcgagatcgaactcggcggcgtccgcaagcaggtcgccgtcaaggtgctgcggccgaacgtgtcggcgcggttcaggcgcgacctgtccgactttttctacgtggccgagaaggccgagctgtactccgccgaggcgcggcggttgcggctggtcgaggtcatcaacacgatgtcgcgctcggtcgcgatggagatggacctgcggctggaagcggccgcggcgtccgagatggccgagaacaccaaggacgatccggacttccgtgtccccaccgtcgattgggaccgcactagccacaacgtactgacgatggagtggatcgacggcatcccgctgaacgatcacgcacgtctcaaagaagccaacgtcgacaccgtcgagctcggccgcaaggtgatccagagcttcctgcgccacgcgctgcgcgacggctttttccacgctgacatgcatccgggcaatctgttcctggatcgcgacggcaaactggtcgcggtcgatttcggcatcatgggccggctgctgccgaaggagcggcgcttcctcgccgagattttgctcggcttcatcacccgcaactatcgccgcgtcgccgaggtgcatttcgaggccggctacgtgccgccgcatcattcggtcgagaacttcgcccaggcgatccgcgccatcggcgagccgatccacaatcgcctcgccgaagaaatctcgatggccaagctgctgacgctgctgctcgaggtcaccggcctgttcgacatgcggacccggccggagctgatcctgctgcagaagaccatggtggtggtcgagggcgtggcgcggtcgttcgatcccaagctcgacatctggaaggtggccgacccggtggtgcgcgagtggatccagcgcaatctgggtccgatcggcaaggtcgagggcgcgctcgccggcgccggcgagctcggccacaccctgaccagcctgccgaccatcgtgtcgcgggccgtcaccgt

SEQ ID NO: 44451 - DNA, 1347 bp, Rhodopseudomonas palustris
gccgccggcccagccggccgcgccgcaggcgtgagcgaaggctccgcgcccccggctccgctcggcgagttacgctcgcgcctgacgcagctgcatccggtcgcgatcgacctcacgctcggtcggatcgagcggctgctcgcggcgctcggccatcctgaacgcaagctcccgccggtgatccatgtcgccggcaccaacggcaagggctcgaccgtcgcgtttctgcgcgcgatcctggaagccaccgagctcaaggtccacgcctacacctcgccgcatctggtccgcgtcaacgagacgatccggatcgccggccggctggtcggcgacgaccagctgctgacggcactggcgcattgcgaacgcgtcaacgccggcgcgccgatcacgctgttcgagatcgagaccgccgccgcattgtggctgttcgcgcagcatcctgccgacgtcacgctgctggaggtcgggctcggcggccggctcgacgccaccaatgtgatcgagcatccgctcgcttgcgtgctgacgccgatcggcatcgaccacaccgagtttctgggcccgaccatcgccgacatcgccgccgagaaggccggcatcctgcgccgcggcgcgccggtgatcgtcgccgagcagcgcgacgaggcgatggaggtgatcgaacgcgacgccaagcggctgcgcgcaccgctgttcgcctgcggccagcaatggcacgttcagctcgaacacggccggctcgcctatcaggacgaacgcggcctgctcgatctcactgcgccgaagctgttcggccggcatcagatcgacaatgccggcctggcgatcgcgacgctgcgcgcgcagtcgcggtttacgatcccgcaggacgcctaccaggccggactgctggcagcggagtggccggcgcggatgcagaggatcacgtcgggcaaattgctcgacgacgcaccggccggctgcgagctgtggctcgacggcggccacaatgcggacggcggacgcgtcgcggccgcggcgctcggcgatctggaagaacgggtgtcgcggccgctggtgctgatcgccggcatgatggccaacaaggatgcagccgcgtttctcgccaacttcaccgggctgacgcggcacctgatcgcggtgtcgatcccgaaccgcgacggcgcgatgccgccggaacgcctcgccgacgcaggccgcgcgctcggcctgcgcgtcgaactggccgacgatgtccgggcggcgttgcggcgcatcgcgtcgctggcctacgaactcccgccgcggatcctgatcaccggatcactgtatctcgcgggccacgtgctgagcctcaacggtaca

SEQ ID NO: 44452 - DNA, 621 bp, Rhodopseudomonas palustris
gtgaaaatctgcggtctgacgaccgccgacacgctggaagcagcggtcgaagccggcgccgatatggtcggcttcgtgttctttcccgcttcgccgcgtcacctcgacatcgacttcgccgatgcgctcggccgtcaagtccgcagccgcgccgccaaggtcgcgctcaccgtcgatgccgacgacgacctgctcgacgccatcgtcgagcagcttcggccgaactggctgcaattccacggcagcgagagcccggagcgggtgcgttcgatcaagcgcatctacggcctaccggtgatgaaggcgatcgcggtggcgggcccggacgatctttcggtactgccggattacgccgcggtggccgaccgcatcctgttcgacgcacggccgccgaaggacgccacccgccccggcgggctcggcgcagcgttcgactggaagctgctcgacggcgtcaacctcaaactgccgttcctggtctccggtggcatcaacgccggcaatgtcgcggaggcgctgcgggtgacgcgcgcccagggcgtcgacgtgtcgtcgggggttgaaacctcgcccggcgaaaaggacccggacctgatccgcgacttcatccgcgccgcccgc

SEQ ID NO: 44453 - DNA, 1290 bp, Rhodopseudomonas palustris
tcgaaccagccgatgccgctgcaggcgcgcaagagcggcgcattgcatggcaccgcgcgcgtcccaggcgacaagtcgatttcgcaccgggcgctgattctcggcgcgctggcggtcggcgagacccgaatctccggcttgctcgagggcgaagacgtcatcaacaccgccaaagcgatgcgcgcgctcggtgccaaggtcgagcgcaccggcgactgcgaatggcgcgtgcatggcgtcggcgttgcaggctttgcgacgccggaggccccgctggatttcggcaattcgggcaccggctgccgtttggcgatgggcgcggtggccggatcgcctattgtggcgaccttcgacggcgatgcatcgctgcgcagccggccgatgcggcgaatcgtcgatcccttggagctgatgggtgccaaggtggtgtcgagcagcgagggcggccgattgccgctggccctacagggcgcccgcgatccgctgccgattctgtaccgcaccccggtgccgtcggcgcagatcaaatccgccgtgctgctcgccggcctgtcggcgcccggcatcactaccgtgatcgaggccgaggccagccgcgaccataccgagctgatgctgcagcatttcggcgccacgatcgtcaccgaagccgaaggtgcccatggccgtaagatttcattaaccggccagcccgaattgcgcggcgccccggtggtggtgccggccgatccgtcttcggcggcctttccgatggtcgcggcgctggtggtgcccggctccgatatcgaattgaccgacgtgatgaccaacccgctgcgcaccgggttgatcacgacgctgcgcgaaatgggcgcctcgatcgaggacagcgacgtccggggcgatgccggcgagccgatggcccggttccgggtgcgcggttcgaagctgaagggcgtcgaggtgccgccggaacgcgcgccgtcgatgatcgacgagtatctggtgctggcggtcgccgctgcgttcgccgaaggcaccaccgtgatgcgcggcctccacgaactgcgggtcaaggaaagcgaccggctggaagcgacggcggcgatgctgcgggtcaacggcgtcgcggtcgagatcgcaggcgacgatctgatcgtcgagggtaagggccatgtgccgggcggcggtgtggtcgccacccacatggatcatcgcatcgcgatgtcggctctcgccatgggcctcgcctcggacaagccggtgacggtcgacgacaccgccttcatcgccaccagcttcccggacttc

SEQ ID NO: 44454 - DNA, 1077 bp, Rhodopseudomonas palustris
atgtccaatctcgaaaacctgcaatcccaaatcctcgccgacatcgccgcagcggccgatgaagccgcgctggaagcggtccgtgtcggggcgctcggcaagaagggctcgatctcggcactgctcgccacgctcggcaagatggatcccgagcagcgcaagaccgagggcgcggcgatcaatcgcgccaaggaggcggtgaccgacgcgctgaccgcccgccgcgacgtgctgaaggccgcggcactcgacgccaagctggccgccgaaaccatcgacgtcaccttgccgatgcgcgagcccgccgccgagcagggccggctgcatccgctcagccaggtgtgggacgagctcaccgcgatcttcgccgacatgggcttctcgatcgccgaaggtccggacatcgagaccgacgactacaacttcaccaagctcaacttccccgaaggccacccggcccgggagatgcacgacaccttctatttcaacccgaaggaagacggctcgcgcctcttgctccgcacccacacctcgccggtgcaggtgcgaaccatgctgtcgcagcggccgccgatccgggtgatctgtcccggccgcacctatcgcagcgactcggaccagacccacacgccgatgttccatcaggtcgaagggctggtgatcgacaagggctcgcacctcggccacctgaagtggatcctgcacgagttctgcaaggcgttcttcgaggtcgacaacgtcaacatgcggtttcggccgtcgttcttcccgttcaccgagccgtcgctggaagtcgatatccagtgccgccgcggcaaggacgagatcaggttcggcgaaggcgaggactggctggagattctcggctgcggcatggtgcaccccaacgtgctcaccgcctgcggcctcgatccggacgagtatcagggcttcgcctggggcatgggcatcgatcgcatcgcgatgctgaaatacggcatgagcgatctgcggcagttgttcgaagccgacgtgcgttggctcaatcactacggcttcaagccgctcgacatcccgacgctggcgggcggattgagt

SEQ ID NO: 44455 - DNA, 1032 bp, Rhodopseudomonas palustris
gacgaccttcgccttcagaaaatcaccgagctgagtacgcctgccgaggtgatgggcgagattccgcgcacactgaccgcaacgcgtaccgttgcggcgagccgcagcgcgattcatgccatcctgaacggagccgacgaccggctcctcgtcgtcgtcggcccctgttcgattcacgatccggccgcagccatggactatgccagccgtctggcggcgctgcgcgagaccctggccgaccggctcgagatcgtgatgcgggtgtatttcgaaaagccgcgcaccacggtgggttggaagggactgatcaacgaccccgatctcgatggcagcttccggatcgacaaggggctacggttggcgcgggaagtactctcggccgtgaacaatctcggcctgccagcggcgaccgaattcctcgatctgatcacgcctcaatacatcgcggatctcgtcgcctggggcgcgatcggcgcgcgcaccaccgagagccagatccaccgcgaactcgcgtcaggcctgtcatgcccaatcggcttcaagaatggcaccgacggcaatgtccggatcgccgcggaggcggtgaagtccgcggcgcagccgcatcatttcatggcggtgaccaagggcgggcgcaatgcgatcgcggccaccactggtaacagcgactgccacgtcatcctgcgcggcggcgtcacaccgaactacgatgccgcaagtgtggaagccgccgcagcggtcctcggcaagatcggcctgccgccgcgcctgatgatcgacgccagccacgccaacagcagcaagcagccggacaaccagccgaaggtaacggccgatatcgggcgtcagatggcggctggcgagagccgcatcatcggcgtgatgatcgagagcaatctggtcgccggtcggcaggatgtggcgccgggtcggccgctgcaatacggccagagcatcaccgacggctgtatcgactgggcgacgaccgagacggtgctgcacgagctagccgatgcggtcgagagccggcga

SEQ ID NO: 44456 - DNA, 840 bp, Rhodopseudomonas palustris
tcactgcaaggcaagacgctgttcatcaccggggcgagccggggaatcgggctcgcgatcgccctgcgggcggcgcgggatggagccaatgtggcgatcgccgccaagaccaccgagccgcatccgaagctcaagggcacgatctacaccgccgccgaggagatcgtcgcagccggtggcaaggcgctgccgctggtctgcgacatccgcgacgaggcgcaggtgatcgacgcaatcggcaagacggtggctgagttcggcggtatcgacatctgcgtcaacaacgccagcgcgatcagcctgacgaattcgcaggcgaccgacatgaagcgctacgacctgatgatgggaatcaacacccgcgggaccttcatggtgtcgaaatattgcatcccgcacctgaagaaggcggccaatccgcacatcctgatgctgtcgccgccgctcgacatgaaggcgaagtggttcgcagcgtcgactgcctacaccatggcgaagttcggcatgagcatggtggcgctcggtctctcgggcgaactgaagcactccggcgttgctgtgaatgcgctgtggccgcgcaccacgatcgcgaccgccgcggtcggcaatctgctcggcggcgacgcgatgatccgcgcgagccgcacgccggagatcatgggtgacgccgcccatgcgatcctgaccaggccctcgcgtgaattcaccggccagttctgcgtcgacgacagcgtgttgtatgaagccggcgtgcgcgacttcgagccatatcgcgtcgatccgagcgtgccgctgatgtcggacttctttgttccggacgacagcgttccgccgcccggc

SEQ ID NO: 44457 - DNA, 2132 bp, Rhodopseudomonas palustris
tcaaagacgttgacggccggatcgcgcatctcgacctcgcggtggaaggcgttcactgcgccagctgcatggccaagatcgagcgcggcctgcaatcgattccggatgtgacactcgcccgcgtcaatctcaccgatcgtcgccttgcggtggagtggaacaagggcagcacgctggagcccggccagttcatcgatcgcctcgccgagctcggctacaaggcctatccgtatgagccggtgcgggccgaggtcgaagaggccgaacgcaccaagttcctgctccgctgcctcggcgtcgccgtgttcgccacgatgaacgtgatgatgctgtcggtgccggtgtggtacggcggcgatctcagcccggaagcaagagacttcttccattggttgtcggcgctggtggcgctgccctgtgccgcctatgcggggcagccgttcttccagtcggcgttccgcgcgctgaaggccaagagcgtgaacatggatgtgccgatcacgatcggcatcacgctggcgctcggcatgtcgctggtcgagaccatcaatcacgccgagcacgcttacttcgacgccgctgtgatgctgatcgcgttcttgctggcgggccgcttcctcgaccagaagatgcggcagaagactcgcgcggtcgccggtaacctcgctgcactgaaggccgagaccgccaccaagttcgtcgggcccgacgaaatcagcgaagtgccgatcgccgcagtgcgcgccggcgacatcgtgctgctgcgccccggcgaacgctgcgcggtcgacggcacggtgatcgagggccgctccgagatcgaccagagcctgatcaccggcgagacgctgtatgtaccagccgaacgcggcacccaggtttacgccggcacgctcaacatctccggtaccctgcgcgtccgcgtcgatgcggccgcagaaggcacgctgctgtccgagatcacgcggctgctcgaccacgcgctgcaggcgcgttcgcgctacgtccggctcgcggaccgcgcctcccagctctatgcgccggtggtgcacgcgaccgcgctgctgacgatcatcggctgggtcctggccggtgcgagctggcacgatgcgatcgtgatcggcatcgcagtgctgatcatcacctgtccctgcgcgctcggcctcgctattcctgcggtgcagaccgtcgcgtcaggggcgatgttccgtgccggcgtgctcctcaacgccggcgatgcgatcgaacgcgccgcatcagtcgacactatcgtgttcgacaagaccggcacgctgacgctgcccgagctcgacgtcgtcaacgccgccggcatcccacccgaggtgttcgacctcgcgggccggctcgccctcgccagccatcatccggtcgccgccgcggtggcacgcgccgcgcacgccaagtcgccgctgcccaacgtagtcgaagaaccgggccgcggcgttcggacggtcttcggcggccaagaattacgcctcggcagcccggcgttctgcggcgccgatgccgaagccaatcagatcctcagcgaagaccccgaagtctccgtggtggcgttcagccgcggcgagcagagggtggtattcgcggtccgccagttgctgcggcccgacgccgccaagacgatcgacgccctgaccaatcgcggcattgcggtcgagctcttgtccggcgatcgcgagccggcggttcgccacgcggcggctgcgcttggtgtatccgcctggcgcgccagcgtgacgccggccgagaagattgctcacatcgaggcgctgaagaagcagggccgcatcgtgatgatggtcggcgacggtatgaacgacgcaccgtcgctcgccgcggcgcatgtctcgatgtcgccgatcagcgccacgcatctcagccaggccaccgccgatctggtgttcctcggcaaggagcttgcgccggtgctggccgcggtcgattattcgcggaaagcgatggcggtgatgcgggagaatctcggtcttgccatcggctataacgtactggcggtgccgatcgcgatcgccggctatgccacaccgctgatcgcggcgctggcgatgtctggatcgtcgctgctggtgatgctgaacgcgatgcgggcg

SEQ ID NO: 44458 - DNA, 1065 bp, Rhodopseudomonas palustris
atcagcgccgacaatccgatgggcaccgacggattcgagtttgtcgaattcgctcatccggatccggcgcaacttcatagcctgttcaagctgatgggcttcagcttggtcgcaaagcatcgcaccaaggcgatctcggtctatcgccagggcgacgtcaactatctggtcaacgagcagcccggcacccacggcaccgacttcgtcactgcgcacggcccgtgcgcgccgtcgatggcgttccgcgtggtcgatgccaagcaggcctatgagcgcgcgatctcgctcggcgccgaaccggccggcgtgacggccgcgcaggcgacgctggacgtaccagccatcaagggcatcggcggcagtctgctgtatttcgtcgaccgctacggtgccaaggggtcggcttacgatgccgaattcgactgggtcggttcccgcgacgctcggcccgccggcgccgggctctattacatcgatcacctgactcacaacgtccatcgcggccgtatggatgtctggaccgggttctacgccaaactgttcaacttccggcagatccgcttcttcgacatcgaaggtcgcgcttccggcctgttctcgcgcgcgctgaccagcccggacggcaagatccggattcccatcaacgaggacgccggtgattcaggccagatcgaagagtatctcagcctgtatcgaggcgagggcattcagcatatcgcctgcggctgtcgcgacatctacagcacggtcgaaggacttcgtgccgccggcctgccattcatgccgtcgccgccggagacgtatttcgaacgcgtcgatgcacggctgccgaagcatggtgaggacattgcccggctgcagcggaacggcatcctgatcgacggtgaaggtgtcgtcgacggcggtcagaccaaggtgctactgcagatcttctcggcgaatgcgatcggcccgatcttcttcgaattcatccagcgcaagggcgacgacggcttcggcgaaggcaacttcaaggcgctattcgagtcgatcgaagaagaccagatccgccgcggcgtgctgaaa

SEQ ID NO: 44459 - DNA, 636 bp, Rhodopseudomonas palustris
aaatcgactgcgatgccgagtgccgccgaggcgttgcctggccggccgacgccgatcccgacggcgcggacccatttcgtgagtggcaaccggctgcagccgccgttcccggaaggcctgcagcaggcggtgttcgggctcggctgcttctggggcgcggagcgcaaattctggcagctcggcgacggcgtctattcgaccgcggtcggctacgccggcggcttcacgcccaatccgacctatgaggaggtctgttcgggtcgcaccggccacactgaggtggtgctggtggtgttcgatccggccaggatctcctacgaggcgctgctcaagacattctgggaaagccacgacccgacccaggggatgcggcagggcaacgacgtcggttcgcaatatcgctcggcaatctacaccttcggtgacgaccagaagcgggcggcggaagcctcgcgggtgacctatggcgacgcgctgaaggccaagggctatgggccgatcaccaccgagatcgcagcgtccggcccgttctattatgccgaggactaccaccagcaatatctcgccaagaatcccggtggctattgcgggctcggcggcaccggtgtgtcgtgcccggtcggggttcgcgtcacc

SEQ ID NO: 44460 - DNA, 1443 bp, Rhodopseudomonas palustris
ggcccgtcgcgaagctggagctacggggaatttcacgaccgcgtcggcgcgctcgccgcgggcctggcacggcgcggcatcaagcagggcgactacctgctgattcatctcgacaattgcgtcgaattcctgctcgcctggttcgcctgcacggagctgggagcgatcgcggtcaccaccaacacccgctcggccgccgcggagatcgaatacttcgcagaccattgcggcgcggtcgccgccatcactcagccggcctatgccgatctggtggccgccaattgcaagaagctgaaatggatggcggtgatcggacacgatcccggcgcagcgatcgccgcgcagccggtcgcaaagggccactcgttcgacagcctgttcggcgacagcgacgaccggccgcgccgcccgaccgatccgctggcgccgtgcagcgtgcaatacacctccggcaccacgtcgcggcccaaggcggtgctgtggacccacgccaacgcactgtggggcgccaagatcaacgccgcacaccaaacgctgcgcgccgatgacgtgcatctgttgtatctgccgctgttccacaccaatgcgctggcctattcgatgctgtcgacgctgtgggtcggcggcaccgtggtggtgcagccgcggttctcggcgagccgcttctggaaggtctcgctggagcatggctgcacctggctgtcgacgatcccgttctgcatgaaggcgctgctcgagcacgaggtcccgaaggcgcatcgcttccggctgtggggcagcgcggtcgccgaaccgccgccgttcgcctcgttcggcatcaagatcatcggctggtggggcatgaccgagaccatcacccacggcatcatcgcagaagccgatcagcccaacacgccgatgtcgatcggccgcgctgcgcccgaatacgcgatccgcatcgtcggcgacgacggcgccccgacacgcgtcggcgacaccggcaatctgctgatcaaaggcgtgccgggcctgtcgctgttcaaggagtatctccacaacgaggcggcaacgcgcgacagcttcgacgagcacggttacttcatcaccggcgaccgcgtcacacggctcgagcacggcgcgattcggttcggcgaccgcgccaaggacatgctgaaggtcggcggcgagaacgtggcggcctccgagatcgagcaggtggtgatcaccgtgcccggcgtacgcgaggccgcggtggtggccaagaagcacccgatgctcgacgaagtgccggtggtgttcgtgattccgcaaggcggcgttgccgcggcgccgccggatttcgccgaccgcatcaccgccgcctgcacggccgcgctcgctgacttcaagcggccgcgcgaagtgcggctagtcgacgacatgccgcgctcgacgctggagaaggtggcgaaggccgaactccgc

SEQ ID NO: 44461 - DNA, 1530 bp, Rhodopseudomonas palustris
aggagcacgatgtatcccggccagttcgcgaagacccgccccgaccaccccgccttcatcatggcttccaccggagagacggtgagctatgccgagctcgaggctcgcagcaaccgtctggcgcatctgttgcgcaatcacggcctgcagcggctcgaccactattcgatcttcatggagaacaacaaccgctacatcgaggcgtgcgcagccggcgagcgcagtggctactactacacctgcgtcaactcctacctgacgccggccgagctcgcctacatcctgaccaacagcgaatcgcgcgcgctgatcacctcgaaagccaaactcgacgtcgcccgcgaggcgttgaaggactgccccaacgtcacgctgtgcgtggtggtggacggtgacggcgagagcgagcggatcgtcgggctcgccgaagcgaccaaaaacctgccggacacgccgatcgccgacgaaagcctcggcaccgcgatgctgtattcgtccggcacaaccggccggccgaagggcatcctgcgcccgctgccggagcagccgccgtccgaaccgctaccgctgttccacttcctcaacatgctgtggaagtatcgcgacggcatgatctatctgtcgcccgcgccgctgtatcactcggcgccgcaggctgcggtcggcctcaccatccgcgacggcggcaccgtgatcatcatggagcacttcgatccggagcagtatctggccctgatcgggaagcataaggtcacgcacagccagctcgtgccgacgatgttctcgcggatgctgaagctgcctgaggaggcgcggaagacatatgatctatcgaccctggaggtcgcgatccacgccgcggccccctgcccgccgcaggtcaaggagcagatgatcgaatggtgggggccgatcatccacgaatattacggcgccaccgaaggcctcggcttcaccgcctgcaacagcgccgaatggctggcgcatcgcggcacggtcggcaaggtgatgttcggcgacctgcatatccttgacgacggcatgaagccgtgtccgaaaggcacgcccggccagatctggttcaagaccgccacgccgttcgagtacttcaacgacccgaagaagacccaggaagcccgctcggaagacggcagcatgagcaccgtcggcgacgtcggctatgtcgacgacgacggctatctgcacctcaccgaccgcgccaccttcatgatcatctcgggcggggtgaacatctatccgcaggagtgcgagaacctgttgatcactcaccccaaggtcgcggatgccgctgtgttcggcgtgcccaacgaggatctcggagaggaggtcaaggcggtggtgcagccgatgccgggcgtcgccgccggcgccgacctcgccgccgaactaattgccttttgcgcgcaatcgctgtcgcggcagaaggtgccgcgctcgatcgacttcatggacgaattgccacggctccccaccggcaaactctacaagcgcctgctgcgcgacagatac

SEQ ID NO: 44462 - DNA, 1116 bp, Rhodopseudomonas palustris
atggaggaggttgtctacggtcagccggcagcagccgcgctcgccgctcagctcgaccgcatcggcgcgcagcgcgcgctgctgatggtgtcgggcacgctgaaccgcaccaccgatgaaatcgccaagatcaaggacgcgctcggcggccgctgtgccggggtgttcgacgcgatgccggcgcatacgccgcgcgcggcagtgatcgctgccaccgaacaggcccgcgccatccaggccgacatcatcgtcaccgtcggcggcggctcgatcaccgacggcgccaaggcggtacagatctgcctcgccaataacatcctaagtgccgccgaaatcgaccgcgtccgcaacatcaacgcacccgtcgcccccaaagtccgtcagatcagcgtgccgaccacgatttcgggcggcgagttcagcgcaatcgcaggcgtcaccaatgaggcgacccgggtcaaggagaagctggcgcatccgctgacgatgccgcgcgccgcgatcctcgatccggccatcaccctgcacacgcccgaatggctgtttctgtctactggcatccgcgcggtcgaccactgcgtcgaagcgatctgctcacgcgaggcgcacccgtacggcgacgcccaggcgctgcgcggccttgcgatgctggcggcggggctgccgcgggtgaaggccgacccgaccgatctcgacgcccggctcgactgtcagatcggcacctggctctcaatgggtgcgctgtcgtccggcgtaccgatgggcgccagccacggcatcggctacgtgctcggcgcagtgttcgacgtgccgcacggccacacctcttgcatcatgctgccggcggtgatgcgttggaacaagtccgccaaccgcgaccgtcaggcgctggtcgctgccgcgatgggccatcccggcgaagacgccggcgacgtgctcgacgcgctgatccgggtgctcggcatgccgcgcagcttgcgcgaagtgaacgtcggacccgagcatttcgagcggatcgccacccaggcaatgggcaccccatgggtgccgcgcaatccacgcccgatcgaaggaccggcgcaggtccgggagatcctggagctcgcggcgtgagga

SEQ ID NO: 44463 - DNA, 1848 bp, Rhodopseudomonas palustris
gagacgaagccgttccaggccgaagtggccgagcttttgaacctgatggtgcactcggtctattccgagaccgacatcttcctgcgcgagctgatttcgaacgcgtccgacgcgctcgacaagctgcgctacgagtcgatcgcaaagcccgagctgatggaaaagggcggcgaaccgaagatccggatcattcccaagaaggcgcccgacaccctgacgattgtcgataacggcatcggcatggaccgccaggagctgatcgacaatctcggcaccatcgccaagtccggcaccaaatccttcatttccaagcttgccgagaccaaggacagtgccggcctgatcggccaattcggcgtcggcttttacgccgccttcatggtggccgataagatcaccgttaccagccgccgcgccggctcggacgatgtgtggacctggacgtccgccggcggtgccggcttcgagatcgctccagcgtccgaagaagccgccgcgcgggtcgaacgcggcaccgagatcgtgctgcatctgaagccggatgcgtcgaaatatctcgaagactggcagatcgagcggatcgtcaccgagtattccgacaacatccagtttccgattctgctgatgccggaagaaggcgagcctcgccagatcaactcggccagcgcgctgtggcagcgctcgaagtcggagctgagcgaggacgactacaagcaggcctacaagcagatcgcgggcgcgttcgacgacccggcgatgacgctgcattatcgcgccgagggtcggcaatcctacgctgtgctgctgttcgcgccgtccaccaagccgttcgatctgttcgagccggagcgcaagggcaagatcaagctctacgtccgccgcgtcttcatcacctcggaagccgagctgctgccgccttacctgcgcttcctgcgcggcgtgatcgattccgaggatctgccgctcaacctgtcgcgcgagatgctgcagaagaatccgcagctcgcgcagatccgcaccgcggtgaccggcaaggtgatcagcgagctggaaagcctcgccgacaagaagccggaggacttcaccaagatctgggatgcgttcggcccggtgctgaaggaaggcttgtacgaggacttcgagcgccgcgaaaagctgctgtcgctggcgcgcttcaccaccacggccggcgagaagcgttcgctgaagcaatatgtcgaggcgatgaaggagaaccagaccgagatctactatctggtcggcgactcgctggagcggctgaagtccaacccgaagctggaatcggccaccgcgcgcggcatcgaagtgctgctgctgaccgatccggtcgatgcgttctggacctccgggcaactcgatttcggcggcaagccgctgaaatcgctgagccagggcgatgtcaatttcgatctgatcccgaagcttgagcaggaccaggacaaggacaacaaggacgaggcaaaggtcgacgaggcgaccgtgatcgcggtgatcaaggacgcgctcggtgagcgcgtctccgacgtcaaagcctcgcagcggctgacgtcgagtgcctcgtgtctggtcgcgggcggcatggggccggatcgcgagctcgagaagctgctggcgcgcgccaacaagggcgcaggctccaagccgatcctcgagatcaatctgcagcatccgctggtcgcggcgctcggcgataccaagaccgacaaggcggaagccgccgatcttgctttcctgctgctcgagcaggcgcagatcctcgacggcgaactgcccgaagaccccgccgccttcgccagccggctcaatcggctggtgctgcgtggcgtg

SEQ ID NO: 44464 - DNA, 1191 bp, Rhodopseudomonas palustris
tatcacgggtggcggatcgtggcggtgtgcttcatcgtcgccacgttcggctgggggctcggcttctacggccagagcgtgtacctcgccgaactggcccgactgcatggctggccatcgtcgcagatcgcaaccgccacgaccttcttctatcttgccggtgcgctgctggtggcgttcgtcggcgatgtgatccgcgccatcggcgcgcgcgcctgcctgctcggcggcattgcggcgatggcgctcggcacggtgctgctcggccggatcgacgcgccgtggcagctctatgcggtggatgcgatccttgcggtcggatgggccggcaccagtctcggcgcgatcaccaacacgctcggcctgtggttcgaccggcgccgcggcatggcgatcagcttggcgctgaacggtgccagttttggcggcatcgccggcgtgccggtgctggtggcgctgatcggcgcgctcggcttcaccggggcgaccacggcggcggcgatcgccgcggtagtgttgctgatgccgctggtcgcggtcgtagtcgcgccgccgctgcatcttgtcagtgctgcggccgctgcaccgcgggcgctgtcctccggtgcgatccgcagcggcgcgctgcgggacctcgactttctgaccgctacgatcgcgttctcgctggtgctgctcgcgcaggttgggttcatcgtccacctgatcgcctatctggatccgctgatcgggcgggagcgcgccgcggtggcgatgtcgttgctgaccgcgatggcggtggtcggccgggtttcattgtcggtggtgatcgatcggctcaatcagcgtctggtatcggcgctgtcattcgccagtcaggctgtggcgctgggcgtgcttatctccacccgcgacgcgacgctgctgctggtcgcttgcgcgctgttcggcttctcggtcggcaatctgatcaccttgccgtcgctgatcatccagcgcgaatttcccacctcgtcgttcggtgtcctggtggcgctcaacaccgcgatcaaccaggtcacctacgcgttcggccccggcgtcatcggcctgctgcgcgacgcatcgggcagctatacgctgccgttcaccggttgcatcgcgctgcaacttgctgctgcagcgctgatcatggtgcgactgaggcgaagatgatctttctgccgtcattcc

SEQ ID NO: 44465 - DNA, 1176 bp, Rhodopseudomonas palustris
atgaccgatctcgatacattccgcgccgagacccgcgcctggctggagacgaattgccccgccgagatgcgcacgccgatgcagggcgacgaggacaatttctggggcggccgcaacgccaaattcgcctccgaggcgcagaaggtctggttcgagcggatgcgcgacaagggctggacggtgccggactggccgacgcaatacggcggcggcgggctcgacggcgctcgccacaagatcctgcgtgaagagatggcggcgatcgggggccgctctccactgtcctcgttcggcatctggatgctcgggccggcgcttctgaaatacggcaacgagcagcagaaggccgagcatctgccgaagattgcgcgcggcgaaatccgctggtgccagggctattccgagccgaacgccggctccgaccttgcctcgctgcagacccgcgccgaaagcgacggcgacgacttcatcatcaatggttcgaagatctggacgtcttacgccaactatgccgactggatcttctgcctggtgcggactgacccgaccgccaagaagcacgacggcatcagcttcatcctgttcgacatgacctctaagggcgtgacgaccaagccgatcctgctgatctccggcaagtcgccgttctgcgagaccttcttcgacaacgtccgagtgccgaagtcgcacgtcgtcggtaccatcaaccgtggctgggatgtggcgaagtatctgctgcagcacgagcgcgcgatgatctccggcatgggcggccgcgacggcggccggccgctcggtcaggtcgcggcggattcgctcggcaccgacgagaaaggtcggctcgacgatccgatcctgcgcggccagatcgccaccttcgatgtcgacgaggcggcgctggcctgcgcggcggagcgggcggtcgatctcgccaaagccggacaactgcacccggcgttctcgtcggcgatgaagtactacggcaccgagctgaacaagcgccgtcacgagatcctgatgtcggctggcggcatcgatgcgctggagtgggagagcgagcgcagccaggaaggcgcccgcgcccgtgcctggctgcgcaccaaggccaactcgatcgaaggcggcaccagcgaagtgatgctcggcatcgtcgccaagcgcatcctcgatctgccg

SEQ ID NO: 44466 - DNA, 1122 bp, Rhodopseudomonas palustris
atggctctcgtcctcactgaagaacaaaccatgctgcgcgattccgcgcgcgggctgatcggcgacaaggcgccggtcgctcagttgcgcaagctacgcgacgagcgtgacgccaccggcttctcccgcgacttgtggaagagcttcgccgagatgggctttgccggtctgctggtgccggaggagttcggcggctccgggctcggctgcgtcgaggctggcgtggtgatggaggagatcggccgcaacctgacgccgtcgccgctgctgtcgaccgcgatcctagctgcttccgcactggcgcgcggcggctcggaagcgcagaagaaggcttatctgccgaagatcgccgacggctcgctgatcgcagcgcttgcggtcgacgagggcgccaagcaccggcccgcgaagatcgcgatgaccgcgacgcgcgccggcaacggcttcaagctgaaaggcgacaaggcgctggtggtcgacggccatgtcgccgaccttctgatcgtcgcggcgcgcagcgccggtcagccgggcgatgcggatgggctgacgctgttcctggtcgacccgaaggcgaagggcgttgcgatcgagcgcaccgtgatggtcgacgcccacaacgcagcgcggatcagtttcgacgacgccgaggtgaatgccgatcaggtgctcggcgaggtcgatcgcggcggcgcgctgctcgaggcggtgctaaacgtcggccgcgcggcggttgctgccgaaatgctcggcgtcgcggatgaggcgttcgggcggacagtgagctatctgaaagagcgcaagcagttcggcaagctgatcggcgaattccaggcgctgcaacaccgcgccgcgcatctctacaccgagatcgaaatccttcgcgccgccgtgctcaaggcgctgcaggcagtcgatgcggacgccgtgcaggcgcgcgtcgcggtttcggtcgccaaggccaaggccggaacggtggcgacgctggcggtgcaggaaggcgtgcagatgcacggcggcatgggcatgaccgaccagttcgacatcggcctgttcatgaaacgcgcgcgcgttctgcaggaactgctcggcgacagcgcctaccacgccgaagcgctggcg

SEQ ID NO: 44467 - DNA, 747 bp, Rhodopseudomonas palustris
ttttcgctgcaaggccgcgtcgctctggtgaccggcggctcgcgcggcattggcaagatgatcgcggccggctttctcgcctacggcgcgacgcgcgtttacatcaccgcgcgcaaagcagcggcctgtcaggccaccgccgacgaactcaccgaaatgtatcccggcgagtgcgtcgcgctgccgatcgacatctcgaccatggcgggcatcgatatgctggccgccgagatcaagcgccgcgagagctcgctcgacatcctagtcaacaacgccggtgccgcctgggcggccgacttcgacgaattcccggagagcggctgggacaaggtgatggacctcaacgtcaagacgccgttcttcctgaccaaggcgctggcgccgctgctgcgcgccgccgcgagcgccgaacagcccggcaaggtgatcaacatcgcctcgatcgacggcatcttcgtcaatccgctcgagacctatccctacgcggcgtcgaaggccggcctgatccacctcacccgccggctggctgtgaggctgatcaaggaccacatcgtcgtcaccgcgatcgcgccgggaccgttcgcctccgacatgaacaaggcggcgcgtgacgaatccgacgcagtcgccaagcgcgtccctgcgggccggatcggcaccgacgaggacatggccggcaccgccgtgttcctcgcctcgcgcgccggcgactacgtggtcggctcgaccgtgacggtcgacggcggc

SEQ ID NO: 44468 - DNA, 1191 bp, Rhodopseudomonas palustris
tcggccatgtctcagagcgcttcaacgtcccatctcctcccggttttcgccagagcggatgtcgcgttcgagcgcggagagggcgtctggctgcacgggaccgacggtgagcgctatctggatttcaccagcggcgtcgccgtcaacgcgctcggccattgccatccgcatctggtcgaagccctgcagcagcaggcgagcaaactgtggcacgtctccaacctgttcaagagcccggaaggcgagcggctggcggcgcggctgtgcgagcagagcttcgccgacaaggtgttcttctgcaattcgggcgctgaagccgtcgagtgcgcgctgaagatggcgcggcactatcacttctccaagggcgagcccgagcggacccgggtgattactttcgaaggtgcgttccacggccgcacgctcggcacactcgccgccaccggctcggcaaagtacctggaaggctacggccagccgctcgaaggtttcgaccagcttccgctcggcgacctcgacgcggtgaaggccgcgatcggcccgaacaccgcagcgatcctgatcgagccgctgcagggcgagggcggcgtgcgctcaccggagctggctttcttccgcggcctgcgcgagctgtgcgacgcgcacggcctgctgctggtgttcgacgaagtgcagaccggcatgggccgcaccggcgagctgttcgcctataagcggatcggcgtcgcgccagacatcatggcgctggccaaagcgctcggcggcggctttccgatcggcgcctgcctgtcgaccgcggaagccgcgaagggcatggcgccgggcgcgcacggctcgaccttcggcggcaatccgctggcggtcgcggtcgccaatgcggtgctcgatgtgatgctgcagccgggcttcttcgatcacgtcaagaagatgtcgctgctgctgaagcagaagctcgccggcgtcgtcgatcggcatccgcgcgtcgtcagcgagatccgcggcgagggattgctgctcggcctgaaggcggtcgtgccgtcgcccgaactgatcgcggcgctgcgggccgagaagctgctcagcgtcggtgccggcgacaacgtcgtgcgcctgctgccgccgctgatcgtcaacgaggctgaactcgacgaggcggtcgggcgactggagcgcgcctgcgtcacgcttgccgga

SEQ ID NO: 44469 - DNA, 906 bp, Rhodopseudomonas palustris
cggcacttcctcgatctcaccgagctgccgacctcagaactgcgcaacatgctctctgccgccgtcgccatgaaagcgaagcgcaaggcgaacgccgatggcgagaagccgcttgccggcaagacgctggcgatgatcttcgacaagccgtcgacgcgcacgcgcgtgtcgttcgacgtcggcatgcgccagctcggcggcgagtcgatcatgctgaccggcgccgagatgcagctcggccgcggcgagaccatcgccgacaccgcgcgtgtgctgtcgcgcttcgtcgacatcatcatgatccgcatcctcaatcacgaggcgctgctggagctcgccgccaacgccaccgtgccggtgatcaacggcctgacccgcaagtcgcatccgtgccaggtgatggccgacgtgatgacgttcgaggagcatcgcggcccgatcaaggggcgcaccatcgcctggaccggcgacgacaacaacgtgctggcgtcgttcgcccacgccgcgcagcgcttcgagttcaagctgaacatcgccacgccgccgcagctttcgcccagcaaggcgctgcgcgactggatcaaggcgagcggcgcggcgatcaccatcggcaccgatccggaggaagccgtgcgcggcgccgactgcgtcgtcaccgacacttgggtgtcgatgggcgacaaggacggcgagcatcgccacaacctgctcaagccgtatcaggtcaacgccaagctgatgtcgctcgcccacaaggatgcgatcttcatgcactgcctgccggcgcatcgcggcgaagaggtcaccgacgaggtgatcgacggcccgcagtcggtggtgttcgacgaagccgaaaaccgcctgcatgcccaaaagggcatcctggcctggtgcctcggcgcggtg

SEQ ID NO: 44470 - DNA, 1179 bp, Rhodopseudomonas palustris
accgcgcatttccgccgcgaaacccgcctggtgcattccggcagcttgcgctcgcagttcggcgagacctccgaggcgttgttcctgactcagggcttcgtctacgaaagcgccgagcagtgcgaggcgcgcttcaccggcgacgacgccggcttccaatattcgcggttctcgaacccgaccgtgttcagcttcgaacagcggatggcggagttcgaaggcgccgaagcggcgcgctcgaccgccaccggcatggccgcggtgacggccgcgatgctggcgccgctgcgggcaggcgatcacgtcgtcgcctccaaggcgatgttcggctcgtgccgctacgtcgtcgaagacctgctgccgcgctacggcatcgagtcgacgctggtcgacggcctcgatctcgaccaatggcagcgtgcggtccggccgaacaccaagacgttcttcctggagagcccgaccaacccgaccctcgacgtgctcgacatcggcgcgatcgcggagattgcccatgcggcgggcgcgcgcctcgtggtcgacaacgtgttcgcaacgccgatctggcaaagcccgctgcagcttggtgccgacgtcgtggtttactccgccaccaagcacatcgacggacagggccgctgtctcggcggcgtggtgctgtcgtcgcaggcgttcatcgaagaacatatccagatgtatctgcgccagaccggcccgtcgctgtcgccgttcaacgcctgggtgctgctgaagggcctggaaacgctggcggttcgtgtcgagaagcagacctccaatgcggccgcgatcgccgatgcgctggccggccaaccgaaggtgccgcgcctggtatatccgggccgggcggatcacccgcaggccgcgacggtcaagaagcagatgggcgcaggctcgaccctggtcggcttcgaggtgaagggcggcaaggccgaagcgttccgcttcctcaatgccctcaagctggtgaagatcagcaacaatctcggcgacgccaagagcctcgttacccatccagccacgacgacgcatcagcggctgaagccggaagcgcgcgccgaactcggcatcagcgaaggcttcatccggttgtcggccggcctcgaacacaaagacgatctgatcgaggacctgctcgccgcgctcgacaaggtgtgagcg

SEQ ID NO: 44471 - DNA, 1572 bp, Rhodopseudomonas palustris
gtgtcgtggtgggcggcgggtgtgctgtaccagatctatccgcgctcgtttcaggacagcaacagcgacggcatcggtgatctgcgcgggatcatcgatcggctcggctatctgtccgatctcggcgtcgacgcgatctggctgtctccgatctttccgtcaccgatggcggactttggctacgatgtcgccgactatgtcggcatcgatccaatcttcggcacgatggacgatttcgacgcgctggtgctcacggcccatgcccgcgggctcaaggtcattctcgatctggtgccgaaccattcatccgaacagcatccctggttcatcgagagccggtcgtcgcggcacaaccccaagcgcgattggtacatctggcgcgaccccgcaccgggcggcggaccgccgaccaattggctgtcggaattcggcggcagcggctgggagtacgacgacgcgaccgggcagtattactatcacgcctttctgaagcagcagccggacctcaactggcgcaatccggaggtgcgggccgcgatctatgacgcgatgcggttctggctgcggaagggcgtcgatggcttccgggtcgacgtgatctggcacctgatcaaggacgaccaatttcgcgacaacccgcccaatccggattttcgccccggcatgccgccgcacgccgcgctgatcccgatttactccgcggatcggccagagacgttggaggtggttgccgagctgcgccgtgtcgtcgacgaattcgatcatcggctgctgattggcgagatctatctgccggtggagcggctggtcgcgtattacggagcggagctgaagggtgcgcagctgcctttcaacttcgcgctgctgtcgacgccgtggcgcgcccgggagattgcgacgctgatcgaacgctacgagcaggcgttgccggccggcgcgtggccgaattgggtgctgggcaatcacgaccggccgcgggtggcgagccgggtcgggccggcacaggcccgcgtcgccgcgatgctgctgctgacgctgcgcggcactccgacgatgtattacggcgacgagctcggcatggagcaggtcgagatcgcgcccgaggacgtgcaggatccgttcgagaagaacgtacccggcatcggtgtcggccgcgatggctgccgcacgccgatgcagtgggacgcgtcggaccaggccggattctcggatgtccggccgtggctgccgctggccccgaacgccacccaggataacgtcgctaatctgcgcgccgacgcgcagtcgatcctaaacctctatcgcgctctgctgcggctgcggcgcgcgctgccccagctggcgctcggcgcttaccagccgctcgcggcggagggcgagctgttgctgtatcgccggcatcatcaggggcagtcgatcttggtggcgctcaatcttggcccggatccgatctcggcggcgtccgacgcgatcgggctcgacggcgaggtgctgctgtcgaccatgctcgatcgcgccggcgaacgcatcggtgccacgctcgacctgcgcggcaacgaaggcatcatcgtc

SEQ ID NO: 44472 - DNA, 879 bp, Rhodopseudomonas palustris
atggcggcagcaatcaaaaaagtcggcgtaatcggcgcgggacagatgggcaacggcatcgcccacgtggccgccctcggcgggttcgacgtgatcctgaacgacgtctctgccgaccggctgaaatcggcgatggccaccatcaatggcaacctgtctcgccagatcgccaagaagctcatctctgaagacgctcgcaagcaggccctggcacggatcaccgcgacggagaagctggacgggctgtccgactgcgacctcgtgatcgagaccgcggtcgagaaggaagagaccaagcgcaagatcttcaacgagctgtgcgcggtgctgaagccggaggcgattgtcgcctccaacacctcctcgatctcgatcacccggctggccgcctcgaccgatcggccggagcgcttcatcggcattcacttcatgaatccggtgccggtgatggagctggtcgagttgatccgcggcattgccaccgacgacgcaacgttcgagactgcgaaggcgttcgtcaccaagctcggcaagcagatcgcggtgtccgaggatttcccggcgttcatcgtcaaccgcatcctgctgccgatgatcaacgaggcgatctacacgctgtacgaaggcgtcggcaacgtcgaagccatcgacatggcgatgaagctcggcgcgcatcatccgatgggcccgctggagctggccgacttcatcggcctcgacacctgtctgtcgatcatgcaggtgctgcacgagggcctcgccgactccaagtatcggccgtgcccgctgctggtgaagtacgtcgaagccggttggctcggccgcaagacccagcgcggtttctacgactaccgcggcgacaagccggttccgacccgc

SEQ ID NO: 44473 - DNA, 1362 bp, Rhodopseudomonas palustris
gagcggcgacagatgagcaacaagatgtggggcggccgattcaccgatcgccccgacgcgatcatggaagagatcaacgtctcgatcgacgtcgatcgccatctctacgcccaggacatcacggcgtccaaggcgcatgcagccatgctggccgcgcagggcatcatcaccgcgaacgatgcgaaaaatatcggcaagggtctagacacgattctgtcagagatcaccgccggcaaattcaccttcaagcgtgcgctcgaagacatccatatgaatgtcgagagccggctggccgaactgatcggcccggcggcggggcgcctgcacaccgcgcgctcgcgcaacgatcaggtcgcgaccgacttccggctttacgtccgcgacgtgctggacgagaccgacgcggcgctggcggcattgcagcaggcgctcgccgaacgcgcgctcgagcaggccgacaccgtgatgcccggcttcacccatctgcagaccgcgcagccggtgaccttcggtcatcacctgatggcctatgtcgagatggtggcgcgcgatcgcggccggttccaggatgcccgcaagcggctgaacgaaagtccgctcggcgccgcggcgctggccggcacctcgttcccgatcgaccgccacgccaccgccgccaagctcggcttcgaccggccgatggcgaactcgctcgatgcggtgtcggaccgcgacttcgtgctggagacactgtcggcggcgtcgatctgcgccgtgcatctgtcgcgctttgccgaagagatcgtgatctggacctcgccgctggtcggcctgatccggctgtcggacaagttcaccaccggctcgtcgatcatgccgcagaagcgtaatccggacgcagccgaactggtccgcgccaagaccggccgggtgatcggcgcgctgaacggcctgttgatcgtgatgaagggcctgccgctcgcctatcaaaaggacatgcaggaagacaaacagggcgcgatggaaggcttcgcggcgctgtcgctggcgatccgcgcgatcaccggcatggtccgcgatctcgagccggagccggagcggatgaagcttgctgcgggcgagggctatgccaccgccaccgatctcgccgactggttggtgcggacgctgaagatgccgttccgcgaggcgcatcacgtcaccggccggatcgtcgggctcgccgccaagaagggcgtggcgctgcacgagctgccgctcgccgagatgcagtcggtcgaaaagcgcatcaccaaggatgtgctggcggttctcagcgtcgaatcctcggtgaagagccgcacctcctacggcggcaccgcgccgaagaacgtccgcagccag

SEQ ID NO: 44474 - DNA, 1167 bp, Rhodopseudomonas palustris
caggacgtcggtacgccgttctactgctactcgagcgcgacgctggagcggcactaccgggtgttcaccgaggccttcgccggcctcgatgcgctggtgtgctacgccatgaaggccaattccaatcagtcggtgctgcgcacgctggccaagctcggtgccggcgccgacgtggtgtcgggcggcgaactgcagcgggccttggcggccgggattccgccgagcaagatcgtgttctccggtgtcggcaagaccgaggccgagctgcgcgctgcgctcgaccacgacatcaagtgcctcaacgttgaatccgagcctgaactcgaacagctgtcgcgcatcgcggtcgagaccggccgcacggcgcggatttcgttgcgggtcaatccggacgtcgattccggcacccacgccaagatctccaccggcaagtcggagaacaagttcgggattccgatccgccacgcccgcgaggtctatgcccgcgccgccaagctgccgggcatccaggtcaccggcgtcgacgtccatatcggcagccagatcatcgacctggcgccgatggaagcggcgttccgcaaggttgccgaattcatccacgtgctgcgcggcgacggtcacacggtcaaccacgtcgatttcggcggcggcctcggcatcccgtattacgaggaccgcgacgcgccgccggagccgttcgcctatgcggagatggtcaagcgcgtcacccacaatctcggctgcacgctgctgttcgagccgggccggatgatcgtcggcaacgccggcatcctggtcgccaaggtgatctatgtgaagcacggcgacggcaagaccttcgtgatcatcgatgcggcgatgaatgatctgatccgcccgacgctgtacgaggcgtatcacgagatcctgccggtggccgcgcccgcgcccggcgtagccaccatggtggccgacgtcgtcggcccggtgtgcgagaccggcgattacctcgcgctcgatcgcaagctgcccgaactgaaagccggcgatctgatcgcgatcatgacggcgggcgcttacggcgcggtgcaggcgtgtacttacaacacccgcgcgctggtgccggaagtgctggtgaaggacgatcaggttgcggtggtgcgtccgcgcatcgaagtcgagcaactg

SEQ ID NO: 44475 - DNA, 930 bp, Rhodopseudomonas palustris
cgccgcgttgcgctgctcggcgtgccgatcgagatcggcgccgggcttcgcggcacgctgatgggaccggcggcgctgcgcaccgccggcatcggccgggtgctcgatcagctcggctttgcggtcgaggatcatggcgacatgacgcgcccggcgctggacggcggcaacgatccggtgccggccaacgccaattactacagcgaggtgcggagctgggtcggcgcgatctcggcgcgcgcctacgagcttgcacgctccggcgcggtgccgctgttcatgggcggcgatcacagcctgtcgatgggctcggtcaacggcgtcgcgcgctattggcagagcgagggcaagccgctgttcgtgctgtggctcgacgcccatgccgactacaacacgccggccacgacgctgaccgccaacatgcacggcatgtcggcggcgttcctgtgcggcgagccgggactcgatgatctgctcggcgacgagccgcgggtgtcgattccgccgagccggctcgatttgttcggcatccgctcgatcgatccgctggagaaggacctggtgcggcaacgcgcgatcccggtggtcgacatgcgggcgatcgacgaattcggcgtcggcgtgctgatccgccgcgtcatcgaccgcgtccgcgccgccggcggcgtgctgcatctgtcgttcgacgtcgacgtgctcgatccctcggtcgcacccggcgtcggcaccaccgtgccgggcggcgccacctatcgcgaggcgcatctggtgatggagctgctgcacgactccggcctcgtccgctcggtcgacatcgtcgagctcaatccgttcctcgacgaacgcggccgcaccgcgcgggtcgcggtcgagctgctcggcagcctgttcggcatgcagatcaccgaccgggtgaccccgagcaacgcc

SEQ ID NO: 44476 - DNA, 2463 bp, Rhodopseudomonas palustris
cacttgcccgtgcagtcgctaccagaaaaaaaatcctcccagtcggcgcctctggatgagctggcgctcgcggagatcaagagcgcgatcctcgccaagctgacgctggcgatcggcaaggaagccgcgcacgcgaccaagcacgactggtacaaggcctccgccttggcgctgcgtgaccggatcgtgcaccgctggctggtgtccgagaaggagagctacgacgccggtcgcaagcgggtgtattacctgtcgctcgagttcctgatcggccggctgttcaccgactcgctgaacaatatgggcctgctggcgcagtttgacgccgcgctcggcgacctcggcgtcggcctcaacgacctacgcaaatgcgaacccgacgcagcactcggcaatggcggcctcggccggctcgccgcctgcttcatggagagcatggcgacgctggagatcccggcctacggctacggcatccgttacgattacggcctgttccgccagatcatcaatcacggctggcagcaggaattccccgacgagtggctgagcttcggcaacccgtgggaattgcagcggccggaggtcgtctatcaggtcaagttcggcggccatgtcgaccaggtcaccgacgccaagggctacacccgcgcggtgtggacgccgggtgagacggtgcaggcgatcgcctacgacaccccgatcgtcggctggcgcggcgagcacgtcaatgcgctgcggctatggtcggcgcgcgcgccggatccgctcttgatcgacgtgttcaacaccggcgactatctcggcgccaccgcgcacgaggcgcgcgccgaagcgatctgcaagttcctgtatccgaacgacgagagcccggcaggccgcgagctgcggctgcgccaggaatacttcttcgtctccgcctcgctgcaggacctgatcaagcggcacctggattccgacggccagatccgcaacctcgccaagaaggcggcgatccagctcaacgacacccatccatcgctggcggtcgccgagctgatgcggctcctggtcgacgttcacggcctgcgctgggacgacgcctggcagatcaccgtcgcgacgctgagctacaccaaccatacgctgctgcccgaagcgctggagacttggccgctcgacctgttccagcgcacgctgccgcgccacctcgaaatcatctaccggatcaacgaggtgcatctcggcctcgccgaggcgcgcagccccggcgatatcgaattccgcgcctcggtgtcgctgatcgacgagaaggccggccgccgggtgcggatgggccacctcgccttcatcggctcgcaccgcgtcaacggcgtctcggcgatgcattccgacctgatgaaggagaccgtgtttcacgatctcaacttcctctaccccggccgcatcaccaacaagacaaacggcatcaccttccggcgctggctgacgctggccaatcccggcctgaccgagctggtccgctcggtggccggcgacgaggtgctggacgatccgacccggctggagcggctggaagccttcgccggcgacagcgcgttccagcagcagttccgcagcgtcaagcatcgcaacaaggtggcgctggcgcggctgatcggcgagcgcaacaacatccggatcgacccgagcgcgctgttcgacgtccagatcaagcgcatccacgaatacaagcggcagctgctcaacgtgctcgagaccatcgcgctgtatcaggcgatcaaggacgagccgaaccgcgactgggtgccgcgcgtcaagattttcgccggcaaagccgcggcgagctatcgctacgccaagctgatcatcaagctgatcaacgacgtcgccgaggtggtgaacaacgacgcctcgatcggcggcaagctgaaagtggtgttcctcgccgactacaatgtcagcctcgccgaggtgatcattccggccgccgacctgtcggagcagatctcgaccgccggcatggaagcctccggcaccggcaacatgaagctggcgctgaacggcgcgctgacgatcggcacgcttgacggcgccaatatcgagatccgcgatctggtcggcccgaagaacatcgcgatcttcggcatggaagcgcttgaagtggtggcgcgccgcgcccaggggctcgacgccaccgatgtcatcaaccgctcgccgcagctcgccaacgcgatccgcgcgatcgactccggcgtgttctcgcccgacgaccgcgcccggttcgcctcggtggcccacgcgctgcgccacctcgaccactacatggtcagcgccgacttcgacagctattacgaggcccagcgcggcatcgacgcgcgctggcgcgccggctccgcctggacccgcgccggcatcctcaacgtcgcccggatggcgtggttctcgtccgaccgcaccatccgcgaatacgccgaagagatctgg

SEQ ID NO: 44477 - DNA, 297 bp, Rhodopseudomonas palustris
gctgattcgctcgaccgcctttatcaggccgtgctggcggcacgggatctcgatccggcgacgtcgcgcaccgctcggctgtttcagcgcggctccggcaagatggccaagaagctcgccgaagaggcgatcgaagtggtgatcgacgcggtcaacggtaaccgcgaggcggtgatccgcgaaagcgccgaccttctctacaatctgacggtgctgtgggcttcggcgggcgtccgccctgaggacgtctgggccgaaatgcgccgccgcgagaacctgctcggcatcgccgagaag

SEQ ID NO: 44478 - DNA, 1296 bp, Rhodopseudomonas palustris
agctcgcaggacatcacgcccggctacatgtccggcttcggcaattcgttcgagactgaagcgctgcccggcgcactgccggtggggcgcaactcgccgcagcgctgcgcctacggcctctatgccgagcaattgtccggctcgccgttcacggcgccgcgcggtgccaacgagcggagctggctgtatcgcattcgtccctcggtgaagcactccggccgcttcgccaagaccgacatggggctgtggcgctcggcgccgtgcttcgagcacgatctgccgatcgcgcagctgcgctgggatccgccgccgatgccgcaggaggcgctgaccttcctgcagggcgttcggacgatgacgacggccggcgacgtcaacacccaggccgggatggcgacgcatctgtatcttatcacccagtcgatggtcgatcagcacttctacaatgccgacggcgagatgatgttcgtgccgcagcagggcagcctgcgcctcgtcaccgagttcggaatcatcaccatcgaaccggccgagatcgcggtgatcccgcgcggcgtcaagttccgggtcgaattggtcgatggcccggcgcgcggttatctgtgcgaaaactacggcggcgccttcacgctgccggagcgcggcccgatcggcgccaactgcctggccaattcgcgcgacttcctcaccccggtcgccgcctatgaggacaaggacacaccgactgagctgtatgtgaagtggggcggctcgctgtatgtgaccaagctgccgcattcgccgatcgacgtcgtcgcctggcacggcaactacgcgccgtacaaatacgacctgcgcacctattcgccggtcggcgcgatcggcttcgatcatcccgatccgtcgatcttcaccgtcctgacctcgccgtcggagacgcctggcaccgccaatatcgacttcgtgatcttccccgagcgctggatggtggcggacaacacgttccggccgccgtggtatcacatgaacatcatgtctgagttcatggggctgatctacggcgtgtacgacgccaagccgcagggcttcgtgccgggcggcgcctcgctgcacaacatgatgctgccgcacggccccgatcgcgaagcgttcgaccatgccagcaacggtgagctcaagccggtgaagctgaccggcacgatggcgttcatgttcgagacccggtacccgcagcgtgtcaccgaatatgccgcgagctccggcctgttgcaggacgattacgcggactgctggaacggtctcgaaaagcgtttcgat

SEQ ID NO: 44479 - DNA, 714 bp, Rhodopseudomonas palustris
cccggcgcgctggtgccgcatctcgatcagtgtgcgctgctgctggacatcgatggtacgttgttggacctggcgccgaccccgcgcgaagtctgggtgccgccagagctggaacaaacgctcaccaatcttctggtcaggacgtcgggtgcgctggcgctcgtcagcgggcgttcgatcaacgacatcgatctgattttcgcgccgatgcgattgcccgccgtcggtggtcatggcgccgagatgcggctgtcgggcgagggcgaagcgatcgcgacgcacgcgccgccgctcgattccgagctgaagagccggctcgccgcaatcgctcgcatcagccccggtattttgttggaggacaaaggctactcattggcactgcactatcgtctggcgccgcacactgagaaagcgatctacgaagcggttgcagcgatccgcgcggagaatccggaagcgccgctggaggtcctgcccgggaaatctgtatgcgagatcaagcattcgggtttcaccaaggcgacaggcgtgctggaactgatgactcgcgcgccgttcaaaggccggcgaccgatcttcatcggcgacgacgttactgacgaaacggtgttcgccatcatgccggaacttcgaggcctcgcattctcggttgggcgctatagcgaactgacctccggacacttcgacgagccgcgcgatgtgcgcaattggctc

SEQ ID NO: 44480 - DNA, 1353 bp, Rhodopseudomonas palustris
ctggtcgtggtttcgaaccgagttgcccgagcgtcggggaacgaaccgatgacgggagggctggcagccgcgttgctgccagtggtggaaaaatccggggcgatatgggtcggctcgagcggtcgcgtccgtgatggcgttcaccgcgagccgttcgctgaaatcgaaccgctcggcgctggcgctctcgccatgctggatctgcccgccgcacattacggcggttactacgagggcttcgccaattcggcgctatggcctgcgctgcattcccgcccggatctgatccgggtgtcgcacgacgattatcgctcctatcgcgaagtcaacgccttcatggcgcgggcgctgctgcggttccgcaagccggataccgcgttctggattcaggactatcacttcctcgctttgggcgcggaactgcgtcagctcggcgtccagcatccgatcgggttcttcctgcatacgccatggccgtcgcgggcgacgattggatgcgtaccccatcaccgcgaactgatcgaagcgatgctgacctatgatctgatcgggttccagaccgaagaggatcgccgcaatttcctcggttacgttgaatcggaactcggcctgaagatcgacggcagcgaggtctcgaccacgcacggcaccgcgcgctgcgaggtgttcgcaatcagcatcgacgccgacgcattcgcccaacaagcacagaaggcgatgacccatcccgaagtctcccgcctccgcaagagtctgaacggcgaaaagctcgtaattggcgtcgatcgtctcgattattcgaaggggctgatcaaccgcgtcaaggcgttcgacaagatgttgaccgaccggcctgccttgcagcgggtagtgtcgctgctgcaaatcgcgaccccgtcccgcggcacgatcgaagcttacggcaatctacagggcgatctcgccaagctggtcagcgacgtcaacggccggctcggcgaggtcgactggaccccgatccgctatctcaacaaggggtatcgccagagtgtgctcgcgggcctgtaccgctcggctcatgtcgggttggtcacgccgctgcaagacgggatgaacctggtggccaaggaatacgttgcggcgcagaacccgctcgatcccggcgtgctggtgctgtcgaaattcgccggggccgccaatgagctcgacaccgccctgcaggtcaatccgcacgacatcgagggaatgtcgcgggtgatcgccaccgcgctggcgatgccgctgaccgagcggcggctgcgctgggaggcgatgatggccaagctgcgcgacaacagcatccgccgctggttcgcggacttcctcgccgcgctg

SEQ ID NO: 44481 - DNA, 468 bp, Rhodopseudomonas palustris
ggcatcgtttggggcgtgcgtgggatcgttgcggtgcagttgccgcagccgaccgagacacagacccgcgcccgcatcacccagcgccatcccgacagcgtcgaagcagcgccgacggctgacgtgcagcgtgcgatcgacggcatcgtcgcgctgcttgaaggcgccgcgaccgattttgccgacattccgctcgatctcgacggcacctcggcgtttcagcgccgggtctacgacatcgcccgcggcattccggccggcaagacgctgacctatggcgatatcgccaagcagctcggcggtgtcgagttgtcgcgcgaggtcgggcaggctttggggcgcaatccgtgcccgatcatcgtgccgtgccaccgcgtgctcgccgccggggacaagcccggcgggttctcggccaatggcggcgtcgccaccaagctgaagctgctggcgatcgaaggcgcggcggtc

SEQ ID NO: 44482 - DNA, 1497 bp, Rhodopseudomonas palustris
atcactcttcccgccctggtccgcgacaccgcgcaggcgcggccggaccggatcgcggtgatcgacggggaacggcaattgcgctacgcggaatttgatgcgctgatcgatcgcatcgccgcgactttgcagcgcgatggtctgaaaccgaccgacaccatctcgatctgtgcgctgtcctcgatcgaatatgcggcgactttccttgccgcactgcgcgccggcatcgcggtcgcgccgctggcgccgtcgtcgaccgccaaggacttctccgcgatggtgcgggactccgcggccaagattctgttcaccgacgacttcgccgccaatgcgatgaaggacgccgagatcgatgccgctgtgaagcgcgtggcgttcgacgacggcacgagcggcgaagcgttcacgcgctggctggcgccggaaggtaccaagccagcgccggtgacgatcgatccggaatgggtgttcaacatcatctactcgtccggcacgaccggcacgccgaagggcatcgttcacagccatcagatgcgctgggcgcaatacggcaagctcgacccgatcggctatggccccgacgcggtgacgctgctgtcgacgccgctctattccaacacgacgctggtctgcttcaatccgacgctcgctggcggcggcactgtggtgctgatgaagaagttcgatgcccgcggtttcctggagctggcgcagaagtatcgcgtcactcatgcgatgctggtgccggtgcagtatcgccggatcatggcgctgccggagttcggtcagttcgacctgtcgtccttccagatgaagttctgcacctcggctccgttcgcgccggagctgaaggccgatatcctgaagcgctggcccggcggtctgaccgagtactacggcatgaccgagggcggcggctcgtgcacgctgctggctcacgaattcccgaacaagctgcacaccgtcggccagccgcggcccggtcatgaaatccggatgatcgacgaggacggcaacttcctgccgaacggtgaggtcggcgaaatcgtcggccgctccgacaccatcatgaagggctacctcaatcagccgcagaagaccgctgaagtgttctggaccgataaggacggcaacctctgggtgcgcagcggcgatgtcggccggttcgatgccgacggcttcatcaccctgatggaccgcaagaaggacatgatcatctcgggcggcttcaacatctacccgagcgatatcgaggctgtagccgccaagcaccccgacgtgctcgaggtcgcggtcgtcggcatgccgtcggaagagtggggcgagaccccggtggcgttcgtcgccgcgcgccccggccgcagcatcgatccggccgaactgaaaacctggacaaacggccaggtcggcaagacccagcgtctcgccgaggtggtgctggtcgagtcgctgccgcgcagcgccatcggcaaggtgctgaagcgcgaacttcgcgac

SEQ ID NO: 44483 - DNA, 1155 bp, Rhodopseudomonas palustris
gccgaggccgaaaaccgcgccaagtccagcttcctggcgatgatgagtcacgagatccgcacgccgatgaacggtgtgctgggcctcgccaactcactgctcgaaaccaagctcgatcccgagcagcaacaggccgtcaccacgatccgcgattccggtgacgacctgctgcgcatcctcaacgatatcctcgatctgtcgaaactcgaggccggccggctggagttcgagcaggccgacttctcgcccaccaccctggtcgagtcggtccgcgcgattatcgagccggaagttcgaggcaagggcatcgaactgaaggtcgatatcgatccgcggctaccgccatcgttgaacggtgacgcggcacgaatccgccaggtgctgctcaacctcgctgcgaacgcggtgaagttcaccgagcaaggctcgattgccatcgtgctgacgtgcgtaaagcgcaacgacagccacgccaccgtcgagtggcaggtgaccgataccggcatcggcatttcgccggatcgtgtcggcagcctgttcaccgactttgcccaggccgatgtctcgatcaatcgccggttcggcggcaccgggcttgggctcgcgatcagccggcggatcgtcgaacagatgggcggcgatatcgccgtcacctcccgcgaaggcgagggctcgaccttccgcttcagcctcgacctgccgtggagcaatgcctggattgccgaccaccggctcgaccggctcggcagcgacgatctccgcacccgcatcgcgatgttgggacggccgctacgcgtgctgatcgccgaagacgactccaccaaccagatggtggtgatgaagatgctgcaggaattcgccgccgaaatcaccgtggtgtccgacggcaccgacgcggtgcaggcggcaggtgagggcgagttcgacgtcgtactgatggacgtgcggatgcccaacatggacggcctcgccgccacccgggcgatccgcggcaagggtggcgcgctcgccaaactgccgattatcgcgctcaccgcgaacgctttccccgacgacgtcaaagtttgccgcgacgccggcatgaatgacttcctggcaaagccgctgcgcaagccggcgctggttgcggccgtgctgcgggcgctgcgcggcgca

SEQ ID NO: 44484 - DNA, 1454 bp, Rhodopseudomonas palustris
gacctcgcgatcatcgggggcgggatcaacggctgcggcatcgcgcgcgatgcggcgggccggggacattccgtgttcctgtgcgagatgaacgacctcgccagcggcacctcgtcgtggtcgaccaagctgatccatggcgggctgcgctatctcgaatatttcgagtttcgcctggtgcgcgaggcgctgatcgagcgcgagcggctgtggcagatcgcgccgcatatcatcgggccactgcgtttcgtgctgccgcatcacgacggcctgcgtccggcctggcggctgcggctcggcttgttcatgtacgattatctcggcggccggaagctgctgccgccgacccgttcggtcgatctggcgcatgacgaggttggcaagccgctgattcccggtcgctacaccaagggcttcgaatactccgattgctttgtcgatgacgcgcggctggtggtactcaccgcacgcgacgcggccgagcgcggcgccgagatccgcacccggactcgcgcagtccaggtcagccagcagggcggcatctggcaggtgacgctggaagatgttggtagcggcgcccgcagcacgatccaggcgcgggcattggtcaacgccgccggcccctgggtcgaaggcgtgctccgctccggcgccggggtcgatgcccgctacaaggtgcggctggtgcaaggctcgcacatcgtcacccgcaagctctacgaccacgaccgcgcctacattttccagaacgccgacggccgcatcgtgtttgcgattccctatcagggcgacttcaccctgatcggcaccaccgaccgcgactatcacggcgatccgtcacaggtgaaagcgacgccggaggaaatcgattatctgtgcaaggcggtgagcggctatttcgccaagcccgtgacgccggcggatgtggtgtggaccttctcgggcgtgcggccgctgtatgacgacggcgccagcgaagccaaggcggcgacccgcgactacgtgttcgagctcgacaccccgggcggcgcgccgctgctgtcgatctatggtggcaagatcaccacctatcgccggcttgccgaagaggcgttggagaagctgtcctcctacctgaagggcggaacggccaaacagggctggaccgcgcatcagccgttgcccggcggcgatttcccggtcgacggcggtccggcgctgatcggcgacctgctgcgcgagtatccgttcctggcttcggctcacgcctcgcgtctggtgcacgcctacggcacccgggcgcgtgacgtgctcggctcggccaagtcggcggccgatctcggccgcgacttcggcgccacattgacggaggccgaggtccgctatctgatgagccgcgaatgggcctgcagcgcggacgacatcgtctggcggcgatccaagctcggtttgcggctgacaccggccgcggtcgc

SEQ ID NO: 44485 - DNA, 786 bp, Rhodopseudomonas palustris
gtggttcttgccggcgccggcaagatgggcggtgcgctgctcaccggctggctggcgcaagggctggacggcggcgacgtcgtggtgatcgagccgcatccgaccgaggagatcgcggcgctgagcgcacgcggcgtccgcctcaacgcctccgccggcgatgtcggcgcggtgtcgacgctggtggtcgcggtcaagccgcagatgttcgccgaagccgccgccgcgctgcgcggctatgtcggcccctcgaccctggtggtgtcgatcatggccggcaagccgatcgcagcgctgtccgagcagctcggcggccacgtcgtccgggcgatgccgaacaccccggccgcgatcggccgcggtatcaccgtcgcggtcgcggccggtaacgtgacagccgcgcagcgcggcattgccgatgcgctgctgcgagccaccggcggcgtcgaatgggtcgacgacgaggcgctgatcgatgccgtcacggcggtgtccggctcgggcccggcctacgtgttcctgctcgccgaagaactcgcccgcgccggcgtcgaagccggtctgccggaaggcctcgccatgacgctcgcccgtgccaccgtcgccggttcgggcgaactgctgcaccgctccgacctcgatgccgccacgctgcgcaagaacgtcacctcccccggcggcaccaccgccgcggcgctcgaggtgctgatggcgaacgacggcttccgcccgctgctgacccgcgcggtcgccgcagcaacgaagcggtcgaaggaactggcgaag

SEQ ID NO: 44486 - DNA, 930 bp, Rhodopseudomonas palustris
gtcaaactggtcgccggcaattccaatccggcgctggcccgcgacatcgcgcagtggctgaacatgccgctgaccaaagcgagcgtccgccgcttcgccgataacgaagtcttcgtcgagatccaggagaacgtccgcggctcggacgtcttcatcatccagtcgacgtcgtttccggccaacgaccacctgatggaactgctgatcatcaccgacgcgctgcgccgtgcttcggcgcgccgtatcaccgcggtgatcccgtatttcggctacgcccgccaggaccgtaaggtcggctcgcgctcgccgatctcggccaagctggtcgccaacctgatcacccatgccggtgtcgaccgggtgatgacgctggacctgcacgccggccagatccagggcttcttcgacatcccgaccgacaatctctacgcctcgccggtgatggtgcgcgacatcaaggagcgcttcgatctgtcgaaggtgatggttgtgtcgcccgacgtcggcggcgtggtccgcgcccgcggtctcgccaagcgcctcaacaccccgctggcgatcatcgacaagcgccgcgagcgcgccggtgaatccgaagtgatgaacgtgatcggtgaggtcgccggctacacctgcatcctgctcgacgacatcgtcgactccggcggcacgctggtgaacgccgccgaagcgctgctggcgaacggcgcgactgaagtctacgcctacatcacccacggcgtgctgtcgggcggcgcctgcgcccgcatcaccaactccaagctcaaagagctggtgatcaccgactcgatccaggccaccgaaggcgtctgcaaggcgccgaacatccgcaccatcaccatcgcgtccctgatcgccgaagcgatcggccgcaccgcggcggaagagtcggtgtcgagcctgttcgac

SEQ ID NO: 44487 - DNA, 1245 bp, Rhodopseudomonas palustris
gacgcctacatcatcgacgcagtccgcaccccccgcggcatcggcaaagtcggaaagggcgctctcgccgacatgcatccccagcacctcgccgccaccgtgctgaaggcgattgccgaacgtaacaagctcaacaccgctgacgttgacgacatcatctggtcgacctcgacccagcgcggcaagcagggcggcgacctcggccgcatggccgcgctcgacgccggctacgacatcaaggcctccggcaccacgctcgaccgcttctgcggcggtggcatcaccgctgtgaacttcgccgccgcgcagatcatgagcggcatggaagacgtggtgatcgccggcggcaccgagatgatgtcgctgaccgccgcgatggccgccgaggatatggccgccggcaagccgccgctcggcatgggctcgggcaatgcacgcctcgccaagacgcatccgcagtcgcaccagggtatctgcggcgatgccatcgccacgatggaaggcatcagccgcgagacgctcgacgcgctcggcctggaaagccagcgccgcgccgcgatcgcgattcaggaaggccgcttcgacaagagcatcgtcccggtcaaggacgacgacggcaatgtggtgctggccaaggacgaatatccgcgccccgaaaccaccgccgaaggcctcgcggcgctgaagccggccttcaccgcgatcgccgactatccgctcgacgacaagggcacgacctaccgcaagctgatcaaccagaagtacccggacgtcgatatcaagcacgtccaccacgccggcaactcgtcgggcgtggtcgacggcgctgcggcactgctgctgacctcgaaggaatacgccgagaagcacggcctgaagccgcgcgccaagatcctggcgatggccaacatcggtgacgatccgaccctgatgctcaacgctccggtgccggccgccaagaaggtgctgcagaaggccggtctcaccaaggacgacatcgacctctgggagatcaacgaagccttcgcggtggtcgccgagaagttcatgcgcgacctcgacctcgaccgctccaaggtcaacgtcaacggcggcgcgatcgccctcggtcacccgatcggcgccaccggcgcgatcctggtcggcaccgtgctggatgagctggagcgccgcaacctcaagcgcggcctcgtcaccatgtgcgccgccggcggcatggccccggcgatcatcatcgagcgggtg

SEQ ID NO: 44488 - DNA, 528 bp, Rhodopseudomonas palustris
gcagcggtgctgctcgatatggacggcacgctggtcgataccgagcgcctgtatctggaaagcctgaccgaggtgctgaacgcgttcggcctgccggatgcgatcgagacctgcgagtcgatggtcgggctaccggggccggagtgccaggcgctgctggtcgcacgctacggcgaaacgctgccactgcgcgagatcaatcgcgccttcgtcgagaagcgcgacgcccggttcgcgcaaggtctcccggtgaagcccggcacctgcgagctgctcgacgcgctggacgatgcaggctgcccggtcgcggtagtgacgtcgtcgtcgcgcaagacggccgacatgcacctgacgctcgccggcatccgcgcgcggtttgccaccatcctgacccgcgacgacgtcgttcacggcaaacccgcgccggatctgtatctgctcgccgccaaccgactcggcgtgccgccggcacattgcgtcgcggtggaagattccagcgtcggcgtcgcgtcggccttcacggccggc

SEQ ID NO: 44489 - DNA, 618 bp, Rhodopseudomonas palustris
aagctctattcgatgcagcgatcgggaaacagctacaaggttcgccttgcgctggcgcttctcgatgccccctaccgcgcggtcgaggtcgatatcctgcgcggcgaaagccgcacgccggatttcctcgccaagaatccgagcggccaggtgccgctgctggagaccgcaccgggccgctacctcgccgaatccaacgcgatcctatggtatctcgccgtcggcacctcgctggcgccggacacccgcatggaccgcgccgaagcgctgcaatggatgttcttcgagcagcacgcgctggagccgaacatcggctcggcgtatttctggctgtgcctggtcaagggcggccgcgacctgcagacccacgcgctggaggattggcttgagcgcggctatgcggcgctgcaggtgatggaaaatcatctcaagaccaacgattacttcgcggccggccagctcaccatcgccgacatcgcgctgtacggctacacccacgtcgccgaccaatgcgatttcgacctgtcgacgtttccggcggtgaacgcgtggctgcgccgggtggagcagaccccgggcttcatcaccatggattggaccccggaaaccatcgccgcc

SEQ ID NO: 44490 - DNA, 801 bp, Rhodopseudomonas palustris
aagcgcgccgcgtgtctgatcggctgtccggcggcgcattcgcgctcgccgctgatccatcactattggctgcgccagctcggcatcgagggcggctactcgatcgaagcggtaccgccggaaggctttgccgaattcgtgctgcacctgaagacgcacggctatgtcggcgccaacgtcaccatcccgcacaaggaacgcgccctgcagctcactgagcccgacgagcgcgcttgtgccgtcggcgccgccaacacgctgtactacgacggtgatctgttgcgctcgaccaacaccgacatcgaaggcttcatcggcaatctcgacgcctcggcgccgggctgggaccgctccgcgcatgcgctggtgctcggcgccggcggctcgtcgcgggcggtggtgttcggcttgctggagcgcggcgtgcagcggatcgcacttgccaaccgttcgatcgagcgggcgcaggcgctgcgcgatctgttcggcgaacgcgtggtaccgatcgcgtggagcgacatcccggccgcgctgccgggcgcgggcctgttggtcaacaccacctcgctcggcatgaagggacagcctccgcttcagatcgacctgtcggcgctgccggcggacgcggtggtttcggacctcgtctatgtgccgctggagaccgatctgctcgccgccgccaaggcgcgcggcctgcgcaccgcggacggtctcggcatgctgctgcaccaggcggtgcgcggcttcgatctgtggttcggggcgcggccgcacgtcaccccggagctgcgggcgctggtc

SEQ ID NO: 44491 - DNA, 1323 bp, Rhodopseudomonas palustris
agccgcagatatttcgggacggacggaatccggggccgcgccaacggtttgatcacgccggagctggccctcaaggtcggccaggccgcgggcctcgcgtttcagcgcggcgagcatcgccatcgggtcgtgatcggcaaagacacccgtctgtccggctacatgatcgagaacgcgctggtcgcgggcttcacctcggtcgggatggacgtgctgctggtcggcccgatgccgaccccggcggttgcgatgctgaccaagtcgatgcgcgccgacctcggcgtgatgatttcggcgtcgcataatctgttcgaggacaacggcattaagctgttcggcccgctcggctacaagctcagcgacgacgtcgaaaagcagatcgagctgatgctcgacgagtccctcgacaagaagctggcgcagagcgccagcctcggccgcgcccgccgcatcgatggcgtccacgatcgctacatcgaattcgccaagcgcaccctgccgcgcgagctgagcctcgaaggcctgcgcgtggtgatcgattgcgccaatggcgccgcctacaaagtggtgcccgaggcgttgtgggagctcggagccgacgtgatctcgatcggcgtcgaaccggacggcttcaacatcaacaaggaatgcggctcgaccgcgccgcaggcgttgtgcgccaaggtccgcgagatgcgcgccgatatcggcatcgcgctcgacggtgacgccgacagggtgatcttggtcgacgagcgcggccatgtggtcgacggcgatcagctgctggcggtgatcggccagagctggaaggaagacggccgcctcgccaagccgggcgtcgtcgccaccgtgatgtccaatctcgggctcgagcgcttccttgcaggcgaaggcatcgcgctgctacgcacgccggtcggcgaccgctacgtgctcgagcagatgctgaaggacggctacaatgtcggcggcgagtcctccggccacatcatcctgtccgacttcaacaccaccggcgatggcttcgtcgccgcgcttcaggtgctggcgatggtgcagaagctcggccgtccggtgtccgaagtctgccaccggttcgatccgctgccgcagatcctgaagaacgtgcgctatcgcagcggccggccgctcgatgatagcggcgtgatctcggcgatccaggacggcgagaagcggctgaacggtcacggccggctgctgatccgcccgtcgggcaccgagccggtgatccgtgtgatgggcgagggcgacgatcacgacgtggtcgaggaagtggtcgacagcatcgtcgacgcgctc

SEQ ID NO: 44492 - DNA, 585 bp, Rhodopseudomonas palustris
atgaagatctacggcgacttcaactccggcaattgcctgaaggtgaagtggacctgcgaccggctgggtctgccttatgagtggatcgcaatcgacacgatgaagggcgagacccggacgccggcgttcctgaagctgaatccggccggacaggtgccggtggtcgcgttcgacgatggccgctcgctggcgcaatccaacgccgtgatccgttatctcgcccgcggcagcgacctgatccccgccgatccgtggctcgcggccaagatggacgagtggctgttctgggagcaatatagccacgagccgtatatcgcggtgtgccgcttccagatggtctatctcggcaagccggccagcgaactggatccggacaaggttcgccgcggccacgccgcgctggcccggatggagcagcatctggcgaattccgaatttcttgccggcgagaggctgtcgctcgccgatgtggcgctgctggcctacacccggatggcggagcagggtggtttcgagctgcacgactatccggccattcgaggttggatcagccgcgccgaagctgggctcggcttgcctgctttt

SEQ ID NO: 44493 - DNA, 1137 bp, Rhodopseudomonas palustris
aagcccgcttcgcggcccaatgcgccgcaattctcctccggcccctgcgcgaagcgccccggctggacccccgaaaatctcaaggacgccccgctcggccgctcgcatcgcgcgaaggtcggcaaggccaagctcaagctcgcgatcgacctgacccgcgacgtgcttgaggtccccgccgactacaagatcggcattgttccggcctccgataccggcgccgtcgaaatggcgctatggtcgctgctcgggccgcgcccggtcaccacgctggcctgggaatcgttcggcgacggctgggtcggcgatatcaccaaggagctgaagctccccaacgtcaccaagctcaaggctggttacggcgaaattcccgacctctccaaggtcgattgcaacaccgacgtcgtcttcacctggaacggcaccacctccggtgtccgcgttccgaacgccgactggatcaaggccgaccgtgaaggcctgaccatctgcgacgcaacctcggccgcgtttgcgcagccgctggattgggccaagctcgatgtcgtcaccttctcctggcagaaggcgctcggcggcgaagccgcgcacggcatgctgatcctctcgccgcgcgccgtcgcccggctcgagagctacacgccgacatggccgatgccgaagatcttccgcctcaccaagggcggcaagctgatggagggtatcttccagggggagaccatcaacaccccgtcgatgctgtgcgtcgaggactacatcgacgcgctgcagtgggcgaagtccgtgggcggcctcaagggcctgatcgcccgcgccgacgccaacaccaaggtgctgaccgactggcaggcgaagaccccgtgggtcgacttcctcgccaaggatccggcgatccgctccaacacctcggtctgcctcaaggtggtggatcctgcgatcaccgcgctgtctccggaagcccaggccgacttcgccaagaagctggttgcggcggtcgagaaggaaggcgctggcttcgatctcggcgcttaccgcgatgcccctccgggcctgcggatctggtgcggcgccacggtggaagccgccgacgtcgcggctctgacgcagtggctggactgggcgttcgagaccaccaag

SEQ ID NO: 44494 - DNA, 792 bp, Rhodopseudomonas palustris
ctcaacgtgcccaagctcgggctcggcactttcaagctgcagggcaaggactgccacgaggcggtgctgaccgcgctcagcctcggctatcgccatatcgacaccgccgagatgtacgccaacgaggatttcgtcggcgacgcgctggaagacaccgacgtgccgcgcgatcagattcatctcaccaccaaagtgtggtggaccaacctcgcgccggacgcgatccgcaaggcgttcgaccagagcctgcgcaagctgaagaccgactacgtcgacttctatctgatccactggcccgcgccggacatgaacctcggtgccgcgctggaaacgctgctgaggatcaaggaccaaggcggcgcacgcgcgatcggcgtctgcaacttcccggtggcgctgatgaaacaggcggtggaggagatcggcgcgccgatcgcctgcaatcaggtcgagcatcacgtgctgctcgggcagaccaagctgctgccttatctacagagcaagggcattccgctcaccgcctacgcgccgctggcccagggccggctcgcctcttatcccgagctgcaggcgatcgccgacaagcacggcgccaccgcggcgcaagtggccctggcctggctgctcgagcaggagggcgtgatggcgatcccgaaagcgcgcggcgaagccagccagcgcagcaatctcggcgcgctgaaaatcaagctcgacttcgacgaccgcgccgtgatcgccaagctgccgaagaaccagcgcttcgtcaccccggcgttctcgccgaagtgggat

SEQ ID NO: 44495 - DNA, 1213 bp, Rhodopseudomonas palustris
atggccaatgtcgtcgtggtcggcgcccagtggggcgacgaaggcaagggaaagatcgtcgattggctctcggagcaggccgacatcgtggtgcgattccagggcggtcacaatgccggccacaccctggtgatcaacggccagacctacaagctggcgctgctgccctcgggcgtgctgcggccgtcgaagctggcggtgatcggcaacggcgtggtgttcgatccgcaggccttcctcgatgaagtgaagaagctgcagggccagggcgtcgcgatctcgccggagaatctgcgtatcgccgagaacgtcacgctgattctgccgctgcatcgcgagctcgacgccacccgcgaaaacgccgccaaggccggcgcgatcggcacgacccagcgcggcatcggcccggcctatgaagacaaggtcggccgccgcgcgatccggctgatggacctcgccgacctcgacactctgcccaccaagatcgaacggctgctggcgcatcacaatgcgctgcgccgtggcctcgaccagccggagatcgacgccggccagatcctggccgatctgtcggcgatggcgccgcatcttcttccctacgccgagtcggtgtggcggctgctggacatcaagcgccgcgaaggcaagcgcatcctgttcgaaggcgcgcaaggcgcgctgctcgacgtcgaccacggcacctatccgtatgtcacctcgtcgaataccgtcgcggcgcaggcggcgaccggcaccggcatgggcccgggcgcggtcggctacgtacttggcatctgcaaggcctacaccacgcgggttggcgccggtccgttcccgaccgagctgaccaacgagatcggcgaagagatcggtcgtcgcggcaaggagttcggcgtcaacaccgggcgcaagcgtcgctgcggctggttcgacgcggtgctggtgcgccagacggtgcggacttgcggcatccacggcctggcgctcaccaagctcgatattctcgacggcttcgacagtgtcgaggtctgcgtcggctacaagctcgacggcaaggaaatcgattacctgccggccggcgagggcgcccaggcgcgggtcgagccgatctacgaaaccatcgaaggctggaaggagccgaccgcgaatgcccgctcttgggcggagctgccggcgcaggcgatcaaatatgttcgccgcatcgaggaactgg

SEQ ID NO: 44496 - DNA, 1668 bp, Rhodopseudomonas palustris
atggagcggatctggctcaagcaatacccgccgggagtcccggccgacatcgacgtgacgcagtatccctcgctggtcgacctgttcgaggaaagcttccgtaagtacggcgaccgcaaggccttcatctgcatggataaggcgatcacctatcgcgagctcgacgagatgtcggtcgcgctgggcgcgtacctgcagggcaagggtctgcagaagggcgcgcgcgtcgcgctgatgatgccgaacgtgctgcagtatccggtggcgatcgccgcggtgttgcgcgccggcttcgcggtggtcaacgtcaacccgctgtacacgccgcgcgagctcgagcaccagcttaaggattccggcgccgaagccatcatcgtgctggagaacttcgcccacaccgtcgagcaggtgatcgcccgcaccccggtcaagcacatcatcgtcggtgcgatgggcgacatgctcggcttcaagggcgtgatcgtcaatctggtggtccgcaaagtgaaaaagatggtgccggcgttttcgcttcccggtgcggtctcgttcaacgacgcggtctcggccggccgcggccagaagttcaccaagccggcgatcggtccggagagcgtcgctttcctgcaatacaccggcggcaccaccggcgtatccaagggggcgacgctgctccaccgcaacgttgtggcgaacgtgctgcagaacgacgcctggctgcagccggcgctggccaagccgccgcatgtcgaccagctgttcatcgtctgcgcgctgccgctgtaccacatcttcgcgctgaccgcgtgctacctgctcggcatgcgcgccggcggcgtcaacctgctgatcccgaacccgcgcgacattccgggcttcatcaaggaactgatgaagtatcaggtcaacagcttcccggccgtcaacacgctgtacaacggcctgctccacgcgccgggcttcgacaaggtcgacttctccaagctgaagatctccaacggcggcggcatggcagtgcaacgtccggtcgctgaagcctggctgaagatgaccggctgcccgatcgccgaaggctacggcctgtccgagaccgcgccggtgctgacctgcaacccggcgaccgtcaacgagttcaacggcaccatcgggcttccgatgccgtcgaccgagctctcgatccgcgacgaagaaggcaaggaagtgccgttcggcaccgcgggcgaaatctgcgccaagggtccacaggtgatgtcgggctactggaatcgtcccgacgagaccgcgctggtgatgaccgccgacggcttcttccgcaccggcgatatcggcgtgatgtcaccggacggcttcaccaagatcgtcgaccgcaagaaggatatgatcctggtctccggcttcaacgtctatccgaacgaggtcgaggaagtggtcgccagccatcccggcgtgctggaatgcgcggtgatcggcgtccccgactcgcgcaccggcgaagccgtcaaggcattcgtggtgaagaaggacccggatgtcaccgccgaggacatcatcaagttctgccaccacgaactgaccaactacaaagtgccgcggcagatcgaattccgcaccacgctgccgaagaccaatgtcggcaagatcctgcgccgcgaactgcgcgacgagaag

SEQ ID NO: 44497 - DNA, 1740 bp, Rhodopseudomonas palustris
tggccgatgtcgctgtttcatctctacacccgcgtgctgcaactgctcggcaaggaggcgcggctcggctggattctcgccgtcgccaatctgctgctcgccaccgcgcaattcgccgagccgatcctgttcggccgcatcgtcgacgtgatgagcggcaatctcgccaccggcgcactcgtacccgaaacgcgttcgccctggccgctgctcggcgcttgggtcggctttggcctgttcaccatcatgtgctcggcgctggtcgcgctgcaagccgaccggctggcccatcgacggcgccaggcggtgctgaccagctatttcgaacacatcctgcaactgccgatcagcttccacaccggcacccactcgggccggctgatgaaagtaatgctgcaaggcaccgacgcgctgtggcggatgtggctcggcttcttccgggagcacttcgcggccattctgtcgctggtcgtgctgttgccgctgtcgctctatatcaactggcggctggcgatcctgttgttcgtgctgtgcatcgtgttcacggtgctgaccacgctggtggtgcacaagacctacggcatgcagggcgaggtcgaggcgcaatacagcgacctgtcggcgcgcgcctccgacgcgctcggcaatgtcgcgctggtgcagagcttcgttcgcgtcgacgccgaggtgcaggggctgcgcaacgtctccggccggctgctcgaggcgcagatgccggtgctgtcgtggtgggcgttggtgacggtgatcacccgcgcctccaccaccatcacggtgctgtcgatcttcgcgctcggcatctatctcaatcagcagggcctcaccagcgtcggcgagatcgtgatgttcgtctcgttcgcgacgctgctgatccagcggctcgaacaggtggtgaacttcatcaacaacgtgctgatggaagcgccccgcttgcgcgagtttatcgcggtgctcgataccgtgccggcggtgcgcgaccgagcggacgcgatcgattgcggccggctgtccggcctggtcgaattccagaacgtgtcgttctcctatgacggcaaacgaccggccatcgaagatctgagcttcaccgccctgcccggcgacaccatcgcgctggtcggcgccaccggcgccggcaagtccaccgcgatcgcgctgttgcaccgtgccttcgatccgcagtccggcgtgatcaaggtcgacggcatggacatccgcggtatcacgctggcctcgctgcggcggaacatcggcgtcgtgtttcaggaagcgctgctgttcgaccgctcgatcgccgacaatctgcgggtcggcaagccagacgccacgccggaagaactgcgcctcgccgccgaacgcgcgcaggcgctggagttcatcgagcgcagcgaccacaagttcgacaccaacgccggcgagcgcggccgcatgctgtccggcggcgaacggcagcggctgtcgatcgcgcgtgcgctgctgaaggatcctccgatcctgatcctcgacgaggccacctcggcgctggacgcggtgaccgaagccaagctcaacctcgcgctcgacgaggtgatgaaaggccgcaccaccttcgtgatcgcgcaccggctgtccaccatccgtgacgccacccgtattctggtgttcgacaacggcaaagtgatcgaaagcggaacgttcgatgaactggtggcgcgcggcggtgcattcgcgcaattggcacgg

SEQ ID NO: 44498 - DNA, 2269 bp, Rhodopseudomonas palustris
atcgagatcgacggtcgcgtcatcgaagccaaggacggcgaggacctgctgtcggcgtgcctgacccacggcatcgacgtgccgtatttctgctggcacggcgcgctcggctcggtcggcgcctgccggcagtgcgccgtgaaggtctatgacggcccggacgacactgaaggccgcatcgtcatgagctgcatgacgccggttgccgacgtcgagcgggtgtcggtgacggatccggaagccgtggcgttccgcgcccaggtgatcgaatggctgatggtcaaccatccgcatgattgcccggtgtgcgaagaggccggctcctgccatctgcaggacatgacgatcgccaccggccatatcgaccgccgctacaaattcaccaagcgcacccatcgcaaccaggatctcgggccgctggtgacgcacgagatgaaccgctgcatcgcctgttatcgctgcacccggttctatcgcgactatgcgggcgggcgagatctcgacgcgttcggtgcccacgacaacgtgtacttcggccgcgccgaggacggcccactggaaagcccgttcgccggcaatctcgccgaagtgtgcccgaccggcgtgttcaacgacaagggctggtcgcgggattactcgcgcaaatgggacatgcgggcgacgccgtcgatctgcccgcattgctcggtcggctgcaacatcctggtcgaccagcgcgacggccgggtgaagcgggttcagaaccgttatcacggcgcgctcaacggctatttcatctgcgatcgcggtcgctatggcccgctgcatgtcgtctccgagcatcggctgcggcaaccgctgatcggaggcgtgcctgcgagcgagcacgaggccgcttccgccgcccatgccatcgtggccgaaggcgcgatcggaatcggctcaccgcgcgcttcgctggaagccaactacgcgctgcagcgtctggtcgggccggagcggttcttcgccggcgtttccgatgtcgaagccggcctggtgcgtcgcatcgtcgagatcctgcgcgccggccccgcgaagatcgcctcgttgcacgaagtcgagcacgccgacgccgcgctggtgctcggcgaaaatctcaccggcaccgccccaaggctcgctttggcgctgcgccagaccgcacgcggcgccgagcgcgagctcgccgcgcagaagggcgtgcacgccttcctcgatccggctgtgcgcaccgccggcgaggggcgccgctcgccgatcgtgctggcgacgccgctacccgatgcgctcgacgatctcgccgcgctgtcgctgcggcttgatccgcaaggcatcgccgcattcggcgacagcgttgcggccgcgctcggcgcaggccctgccgacgcgatcgaggagcattccgaagccgcaagggtggctgaaattctggcgaacgccgagcgcccgctgatcgtcgccggctgtgcgttgatgtcgcccgagatcatcgaagcggcggcgcgcatcgtcgccgcgctcggcgtcaaggcgcggatcgtgctgctggccccggaggccaacagcatcggtctggcgctgctcggcggcgacggcctcgatagcgctgctgctctgctcgaacgcggcggtgccaagacggcgatcgtgctcgagaacgatctgttcgaccgcgcgccgcgcgccggcgtcgagcggctgtttgccgccgcaaagggcgtggtggcgctggactcgatggccaacgagaccacggcgcgggccgcggttgcgctgcctgtggcgccgttcaccgaagcgaccggcactttcgtcaactacgaaggccgtgcacaacgcttcttcgccgcggtggcgccacaggaggccgcgccggcaagctggcgcaggctggatgcgttcggcgccggtgactggcacgggctcgatgcgctgatcggggacctgatcgtcgaacggcccgacctcgtggcggtggccgacgcggcgcccggcgaagatttcggaatggccgacggcaaggtcacgcgcgcgccgcgaccctataccggccgcaccgcggacgaccgcgccgggcaattcgccgacgcggtgattccggtcgatcaagacgggccgctgaccttcggtatcaagggcgcgcgcggcaccgcggtgcccgcgccgctgatcactagctacaagacctccggccagcattcggccaacaacgtgacgcgcttcctggaggaagtcggcggccctctgcgcggcggcgatcccggcgcct

SEQ ID NO: 44499 - DNA, 1281 bp, Rhodopseudomonas palustris
gccatgacccagaagctccaccccgaaaccctcgccctgcatgccggctggcgcgccgatccttcgaccggctcagtcgcagttcctctgttccagaccacctcgtaccagtttcacaacaccgagcatgcggcgaacctgttcgcgctgaaggagctcggcaacatctacacccggatcggcaacccgacgaccgatgtgctggagcagcgcgtcgcggcgctggaaggcggcgtcgcagcgctcgcggtggcttccgggcaagccgcgtcggcctttgcgcttcagaacctcgcccgcgtcggcgacaacgtggtgtcgtcgaccgacctctatggcggcacctggaacctgttcgccaacaccctgaaggaccagggcatcgaggttcgcttcgtcgatccgtccgacccgcaggcgttcgagcgcgccaccgacgagcgcacccgcgcctactatgccgagacgctgccgaacccgaagctcgcggtgtttccgatcgaggaagtcgccgcgatcggccgtaaacatggcatcccgctgatcgtcgacaacaccgcagcgccgctgctggtgaagccgctggaacatggcgcggcgattgtggtgtattcggcgaccaagtatctcggcggtcacggcacctcgatcggcggcctgatcgtcgacggcggcaacttcccgtgggagcagttcccgcagcgccagccggtgctgaacacgccggacccgagctatcacggcgccgtatgggtcgaggcagtgaagccgatcggaccggtggcctacatcatcaaggcccgcaccacgctgctgcgcgacctcggctcggcgctgtcgccgtttaacgccttccagatcatccagggtctggaaacgctgccactgcggatcgagcgtcacgtccagaacgcccagaaggtcgccgattatctggagaagcgccccgaagtcgtgaaggtgatccatccgtcgaagcagagcggcgtcgcccgcgagcgcgctgagaagtacctccagggcaagttcggcggcctggtcggcttcgaactcgccggcggtcgggaggccggacgcaagttcatcgacgcgctcgagctgttgtatcacgtcgccaatatcggtgacgcccgcagcctggcgatccacccggccagcaccacccactcgcagctctccaccgaagagcagctcgcgaccggcgtgtcggacggctacgtgcgactgtcgatcggcctcgagcacatcgacgacatcctcgccgacatcgaccgcggcctc

SEQ ID NO: 44500 - DNA, 2055 bp, Rhodopseudomonas palustris
acctgtccgcacgattgcccgtcggcctgcgctctcgacgtcgaagtgattgatggcgggacgatcggtcggcttcgcggctccaagcggcagacctacacggccggcgtcgtctgcgccaaagtcgcccgctatgccgaacgcatccatcatcccgaccggctgacctatccaatgcgtcgcaccgggccgaagggctccggacagtttgcgcggatctcctgggacgaggcgctggacgagatcgccgcgcggttcgatgccgccgaggcggagttcggcgcggagtcagtgtggccttattactatgcgggcaccatggggctggtgatgcgcgacggcatcaaccgcctcgccaatgtcaaaaagtactcgcggttctactcgacgatctgcgcgaacgtcgcctgggcgggctttgcggcaggtgccggcaaagtcgccggtgtcgatccgcgggaaatggcgaagtcggatctgatcgtgatctgggggaccaatccggtctcgacccaggtcaacgtgatgacccacgccgcccgggcccgcaaagagcgcggtgccaagatcgcagcggtcgatatctacgacaacgaaacgatgcagcaggccgatatccggatcatcctgcgtccggggaccgacggggccttcgcctgcggcgtgatgcacgtactgtttcgcgatggtcttgccgaccgcgcctatttggcgcgctacaccgattgtccggacgatctcgaagcgcatctcaagacgcggacgccagcatgggcctcttcgatctgcggcgtgccggaggcgcagatcgaagcgtttgcacatgcggtcggtcacaccaagcgcagcttctttcggctcggctatgggttcacccgcagccgcaacggcgcggcgcagatgcatgccgcgctgtgtattccggcagtgacgggggcgtggcagcacgaaggcggcggcgctttcttcaacaatggagcgattttcggcttcgacaagactttgatcgaggggctggatcagctcgatccggcgacgcgggtgctggatcaatcaaagatcggccgcgtcctcaccggtgatgccgaggcgctggacggcggcgcgccggtcaaggcgatgctgatccagaacaccaatccgatgaccgtcgcgccggagcaggagctggtccgtgccggcttcgcccgcgaggacctgtttgttgcggtgcacgagcagttcatgaccgagaccgcgctgatggccgatctcgtgctgccggcgacgatgttcttggagcatgacgacctgtattacggcggcggccatcagcacatctcggtcggcgcccggctggtcgagccgcccggcgaatgccggtccaatcacgaggtgctgcaggggctggcgcagcggctcggcgtcgatcatccggcattcgcgatgacgccgcgcgaggtcatcgatacgacgctgaaagccagcggccatggcggcatcgagcagctcgaagccgatctgtggcgcgatctgcagccggatttccgcgcgtctcacttcctcgacggcttcgggcatccggacggcaagtttcacttcaaggtcgactggggcaacgtcaacctcgcgcgcaaactgcggctgggaccttggcaggagatgccccgcctaccggatcactgggcggtgaccgaacaggccgacgcggagcatcctttccggctcgccaccagtccggcacgcagcttcctcaacaccaccttcaatgagacgccgtcgtcgcaggcgcgcgagggtgagccgaacgtgatgatgcacccggccgatgccgccgaagtcggcgtcggtgaaggcgacctggtgatgctggggaatgtccggggagaaacgatgctgacggtccggctgagcagcggactgaggcggggcgtcttgatcgccgaatcagtgtttccgaaccgggctcatcgcggcggacggggaatcaacgtcctgaccagcgcagaatccatcgcgccgcacggtggtgcggcgtttcacgataataaagtctgggtaaagaaggctgatgcg

SEQ ID NO: 44501 - DNA, 1647 bp, Rhodopseudomonas palustris
atgtatgcttacgacgacatcgaccgcgccatcgttcacgagcgcgtcgaagaattccgtgatcaggtaagccgccgcctctcgggcgaactgaccgaggacgagttcaagccccttcggctgatgaacggcgtgtatctgcagcttcacgcttacatgtttcgcgtggcgattccgtacggcacgctgtcgtcggcgcagcttcgcaagctggcgcatgtggcgcggacctacgaccgcggctacggacatttcaccacccggcagaacatccagttcaattggatcgcgctgaaggatctgcccgacgcgctcgcggatcttgctgaagtcggcatccacgcgatgcagacctcgggcaattgcacccgcaacgttactgccgatcagtgggccggcgttgcgccgggcgaggtcgaagacccgcgggtctgggcagaaatcctgcgccagcacacggcgctgcatcctgaattctcgttcctgccgcgcaagttcaagttcgccatcaccgcctcggatcatgatcgcgccgcgatcaagatccatgatatcggcctgaagctggtcaagaacgacgccggtgagaccggcttcgaagtgctggtgggcggcgggcttggtcgcagcccttttatcggtcggactatcaagtcgttcgtcgcaggccgcgacatcctcagctacatcgaggcggtcctgcgcgtctacaatcagtatggacgccgcgacaacatctacaaggcccgcatcaagatcctggtgcacgagctcggcatcgagaaattcgccgctgaggtcgagcaggcgtgggccgagatcgccgacggccctctgacgctcgaccacgagatgatcgaggacatccgctcgcgcttcatctatccggcctatgaaaagctgccggccgagccggacgaactgcgtgccgcggccggcgatgcgcggttcgaagcgtggcgcaacaactctgtcgcgccgcatcgccacgacggctacgccattgtcaccctgtcactcaagcccgcgggcggaccgcccggcgacgcaaccgccgagcagatggacgcggtcgcagaccttgccgacaaatattcgttcggcgagatccgcgtcggtcacgaacagaatctggtgttgccgcacgtcgccaggcgcgacctgccggcgctgtgggccgcgctcgacaagctcggtctggccacccccaatgtcggtctggtcagcgacatcattgcttgcccgggcctcgattactgctcgctggcgaatgcgcgatcgatcccgatcgctcaggagttgtcgcgacgcttcgccagtccagagaccgcggcgctgatcggacggctgcacatcaatatctccggctgcatcaacgcctgcggccatcatcacgttggtcacatcggcattctcggcgtcgagaagaacggtgaggagttctatcagatcaccatcggtggtcgcgccgatgagggggccgagcttggcgaactgatcggtccggcagtgccgtacggcgaagtcgccgacgtgatcgaggatatcgtcgaggcctatctcagtctgcggcagcgaccggacgagttgttcgtcgatgccgtcaagcggctcggcgtcgaacccttcaaggagcgggtctatgcc

SEQ ID NO: 44502 - DNA, 891 bp, Rhodopseudomonas palustris
cgcggcaagacgaccatcaaggaattcgagatctatccgacgctcgagcagcttccgctttggggattcgacggctcgtcgacgatgcaggccgagggccacagctccgactgcgtgctgaagccggttgcgatgtaccccgacgctgcgcggaagaacggcattctggttctgtgcgaagtgatgatgccggacggcgtcaccccgcatccgaccaacacccgcgccaccattctggacgacgaaggcgcctggttcggctttgaacaggaatacttcttctacaagaatggccgcccgcttggcttccccgaggccggctatcccgcgccgcagggcccgtactacaccggcgtcggctacaagcacgtcggtgacatcgcccgtcagatcgtcgaagagcacctcgacctctgcctcgcagccggcatcaaccacgaaggcatcaacgccgaggtggcgaagggccagtgggaattccaggtgttcggcaaggggtcgaggaccgctgccgaccagatgtggatggcgcgctatctgatgcttcgtctcaccgagaagtacggcatcgacatcgaattccactgcaagccgctcggcgacaccgattggaacggctcgggcatgcactgcaacttctccaccgcctacatgcgcgaagtcggcggcaaggagtatttcgaagcgatgatgaaggcgttcgaggccaacctcgacgaccacatcgcggtgtatggtcctgacaaccacatgcggctcaccggcaagcacgagaccgcgccgtggaacaagttttcctacggcatcgccgatcgcggcgcgtcgatccgggtgccgcactccttcgtcaacaacggctacaagggctatctggaagatcgccgcccgaac

SEQ ID NO: 44503 - DNA, 765 bp, Rhodopseudomonas palustris
ctgacaggcaagaccgcggtcgtgaccggctcgacctcggggatcgggctcagctatgcccgcgccttcgccaaggccggcgccaacgtcgtgatcaacggcatgggcgacgcggacgcgatcgagaaggaacgcaaggcgatcgagagcgaatttgccgtcaaggcggtgtactcgccggccgacatgctgaagccggccgagatcgccgagatgatcaagctcggcgagaccaccttcggttcggtcgacatcctggtcaataatgccggcatccagttcgtgtcgccgatcgaggattttccgatcgagaagtgggatgcgatcatcggcatcaacctgtcgtcggcgtttcacggcatccgcgccgcggtgccgggcatgaagaagcgcggctggggccgtatcatcaacaccgcctcggcgcactcgctcgtcgcatcgccgttcaagtcggcctatgtggctgccaagcacggtatcgcgggcctgaccaagacggtggcgctggagctcgccacccacaagatcacctgcaactgcatctcgcccggctacgtctggacgccgctcgtcgagaagcagatccccgacaccatgaaggcgcgcggcctcagcaaggagcaggtgatcaacgacgtcctgctcgccgcccagccgaccaagcagttcgtcacccctgagcaggtcgccgcgctcgcggtctatctctgcggcgacgacgccagccagatcaccggcgccaacctgtcgatggacggcggc

SEQ ID NO: 44504 - DNA, 1410 bp, Rhodopseudomonas palustris
atgagacgcctgcgcaggatcaagatcctcgccacgctcggccccgcctcctccgacagcgcaatgatccgcaagctgttcgaggccggcgccgacgtgttccggatcaacatgagccacaccccgcacgacaagatgcgggagctggtgaagaccatccgtaacgtcgaaagcagctacggtcgcccgatcggcatcctggtcgatctgcagggaccgaagctgcggctgggctcgttcgccaatggaccgatccagctcaacaacggctcgaacttcgtcctcgactcgatcaaggagccgggcgacgagacgcgggtgtatctgccgcatccggagatcctcgcggcgctcaaggtcggagacgcgctgctgctcgacgacggcaaggtgcgcttgatctgcgaagagacccaaggcgatcgcgcggtgacccgcgtggtgatcggcggcaagatgagcgaccgcaagggcgtcagcctgcccgataccgatctgccgatgtcggcgatgaccaacaaggaccgcgccgacctggaagctgcgtgcgagaccggcatcgactgggtggcgctgagcttcgtgcagcgcgccgaagacgtcgtcgaagccaagcggatgatccgcggccgtgccgccgtgatggccaagatcgagaagccgcaagcgatcgaccggctcgaggacattctcgacgtctccgacgcgttgatggtggcgcgcggcgacctcggcgtcgagatgccgctggagcgggtgccgagcctgcagaagcagatgacccgcatggcgcggcgcgccggcaagccggtggtggtcgcgacccagatgctggaatcgatgatctccagcccggtgccgacccgtgccgaagtctccgacgtcgcaaccgccgtgtacgaaggcgccgacgcgatcatgctgtcggccgaatccgccgccggcaaatatccggtcgaagcggtgtcgacgatgaaccgcatcggcgaggaagttgagcgcgacgtcacctatcgcaccgtggtgacggcgcagcgccccgatccggaagcgaccgccggcgatgccatcgcgggcgcggcaaggcagatcgcagagacgctcgatctgtcggcgatcatctgctggacctcgtcgggctcgaccgcactgcgggtcgcgcgtgaacggccgaaggtgccggtggtggcgatcactccgagccttcacaccggacgcaagctgtcggcggtgtggggcgtccactgcgtggtagcggaagacgccaaggatcaggacgacatggtcgagcgcgccggccgcatcgcattccgcgacggcttcgccaaatccggccagcgcgtcatcatcgtcgccggcgtcccactcggcacccccggcgccaccaacatggtccgcatcgcctatgtc

SEQ ID NO: 44505 - DNA, 828 bp, Rhodopseudomonas palustris
gcaatccggctcgcggcacggctcggcgtgccttcgtacctgatcacgcagcaccgctttccggacggcgagatcgccgtcaatgtcgggcccaaggcagaaatcacgatcctgtatctgccgctcgaccagcccaacgacaagctggtgaccatcctgttcgccgccgaagcgctgcgccgcgaaggctgcaaccggttggtgctgctggcgccgtatctctgctacatgcgccaggacgtggcgttccatcctggcgacgcgatcagccagaaggcgatgggccggttgctcgctgggctggtcgaccgcgtcatcacggtcgatccgcatctgcatcgcacgccgcggctcggcgatgtgttcccaggtatcacggcggatgagctgtcggcgatgccggcgatcgccgcggcgctgcgcggtacgctcgctcccgacaccgtcgtggtcgggcccgactctgaatcccagcaatgggtcgatgcgctggccaaactgatcggcacgcgatcggcggtggcgcagaagatccgccatggcgatcggtcggtcgaaatcgcgtttggcgatgcgagcgcgatcgcgggccggccggcactgctggtcgacgatatcgtttcctccggcggcacgctgatcgcctgcacccgcgcgctgctgggagccggtgcaacgtcagtcgacgcagtgatcactcacgcgcttttcccgcctgcgatgctgcgcgacttcgccgccgccggcatccgcagcatccgctccacccacactgtgccgcacccgaccaacgcgatcacgctcgacgatctgttcgtcgaggcgctg

SEQ ID NO: 44506 - DNA, 1677 bp, Rhodopseudomonas palustris
cgtcgcagcttcgataatcaccgcgtcgcgcggggcgaccgcgtagagatcgggtcgaaaggccagcgccgatgttacatggtggtcgacgtgatcccggacggcagcggcgtcatcgatcgggcgaccgaagtgacgatcgaccatcgggcgatggcagacgccacgacgtccccttacgacgacgtcggcggcctcgctcgtgaggtcgccctggtgcgcgagatggtcgaattgccgttgcgcttcccgcacgtgttcgcacgcctcgggatcgaggcgccgaagggcgttctgctctacggaccaccgggttgcggcaagaccttgatcgctcgcaccgtcgctcgcgaagccggcgtctatttcctccacgtcaacggcccggagatcattcagaaacactacggcgagtcggaggaaatgctgcgccggatcttcgccgacgcccagaagcaaccggccgcaatcatctttttcgacgagatcgatgccatcgcgccgaaccgggaaaccgtgctcggcgacgtcgaaaagcgcgtcgtcgcccaactgctggcgctgatggacgggctgacggcgcgcggcaacatcgtcgtcatcgccgcgaccaatcttcccaacagtctcgatccggcgctgcgccggcccggtcgtttcgatcgggaaattggcatcgctccgccggatcgggccggccggctcgagatcctgcgcatccacactcggcggatgccgctcgcggacgacgtcgatctggcgcagatcgcggcggcggcgcatggctatctcggcgccgatctcgccgcgctgtgccgcgaggcggcgatgggttgcacccgcgatctcggcccacgcctggtcgccggcgatccgggcgccgccgcggcgctcgatggcgacctccaggtccgcatggatcatttccgtcgcgctctacgcgaagtgccgctcgcctcgacacgatcgctcaccaccgaagtggcggcgtcgcactgggacgaggtcggcggcctcgacgacatcaaggcgctgctgcgtgagacggtcgaatggccgctgaaatatccgcagcgtttggccttcgccaagacgacggcaccgcgcggaatcttgctcaccgggccgaccggaaccggcaagaccctgatcgtgcgagcgctcgccacccagagcgacgtcaatttcatcgccgtcaacgggccggaactgctgtccaaatgggtcggcgagaccgaaagggcgatccgcgacgtgttccgcaaggcccgccagtcggcgccatcgatcatcttcttcgacgaggtcgatgccatcgtcgcgtcgcgcggcggtgacgatggcggcgcccggatcggcgatcgcatggtggggcagttcttgctcgagatggatggactagctggtctcgacggcgtcgtcgtgattgcggcaaccaatcgccccgacctgatcgaccgggctctgctgcgcccggggcgtttcgatcacatcgcgactctggcactgcccgatcgggccgcccgcgccgcgatcctggcgatccactgccgcggccgtgcgctgggcagcgacgtggatttggccgcgctggcgaaggcttgcgccggcatgagcggcgccgatctcgaggcgttgtgccggcgggccgctatggcggccattcgcgcctcgatc

SEQ ID NO: 44507 - DNA, 3309 bp, Rhodopseudomonas palustris
atgcccaaacgaaccgacatctccaccatcctcatcatcggggccggtcctatcgtgatcggccaggcctgcgaattcgactattccggcacgcaggcggtcaaggcgctgaagcaggagggctatcgggtcgtcctggtcaattccaatccggcgacgatcatgaccgatccggagctggcggacgccacctatatcgagccgatcaccccggagatcgtcgccaagatcatcgagaaggagcgctacgtcatccccggcggcttcgcgctgctgccgacgatgggcggccagaccgctctgaactgcgcactttccttgcgcaagctcggcacgctggagaagttcgatgtcgagatgatcggcgccaccgccgacgcgatcgacaaggccgaggaccgcgagcggttccgcgaggcgatgaccaagatcgggctggagaccccgaactcgcgccaggtcaagagcctgcccgacgcgctgcgcgcgctcgacgagatcggcttccctgcactgatccggccgtcgttcacgatgggcggcaccggcggcggcatcgcctacaccaaggccgagttcatcgagatcgtcgagcgcggcatcgacgcctccccgaccaacgaggtgctgatcgaagagtcgatcctcggctggaaggaatacgagatggaggtcgtgcgcgataagcacgacaactgcatcatcgtctgctcgatcgagaacctcgatccgatgggcgtgcacaccggcgattcgatcacggtggcgccggcgctgacgctcaccgacaaggaataccagatcatgcgcgacgcctcgctggcggtgctgcgcgagatcggagtggagaccggcggctccaacgtgcagttcgcggtcaatccggacgacggccggctggtcgtgatcgaaatgaacccgcgcgtgtcgcgctcgtcggcgctggcgtcgaaagccaccggcttcccgatcgccaaggtcgccgccaagctggcggtcggctattcgctcgacgagatcgccaacgacatcaccggcggcgcgacaccggcgtcgttcgaaccgacgatcgattacgtcgtcaccaagattccgcggttcgctttcgagaaattccccggcgcttcaccgacgctgaccaccgcgatgaaatcggtcggcgaagtgatggcgatcggccgtaccttccaggaaagcctgcagaaggcgttgcgcggcctcgagagcggcctcaccggtctcgacgagatcgagatcgacggtctcggccgcggcgacgacaagaatgcgattcgtgcggcgctcggcaccccgacgccgagccggctgctgcaggtcgcccaggcgatgcggctcggctggtcgaatgaggagatcttcaactcctgcaagatcgatccctggttcctggcgcagctccgcggcatcgtcgacatggaagcccgggtccgcgaggcaggcctgccggatcatgcgttcggcatgcgcaccctgaaggcgatgggcttctccgacgcccgccttgccgtgctcgccgacaccacagaagccgaggtcaaggccaagcgccgcgcgctcggggttcgcccggtgttcaagcggatcgacacctgcgcggcggagttcgcctcgccgaccgcctacatgtattcgacctatgaatcgccgttcgccggcccggcatcggatgaaagccgcccgtcggacaagcagaaggtgatcatcctcggcggcggtccgaaccggatcggccagggcatcgagttcgactattgctgctgccatgcctgcttcgcgctgcatgacgcgggctacgaatcgatcatggtcaactgcaacccggaaacggtgtcgaccgactacgacaccgcggaccggctgtatttcgagccgctgacgggcgaagacgtgctcgagatcatcgacaccgaacgctccaacggcacgctgcgcggcgtgatcgtgcagttcggcggccagacgccgctgaagctggcgcgcgcgctggaagccgccgatgtgccgatcctcggcacctcgccggacgcgatcgacctcgccgaggaccgcgaccgcttcaagcgcatcctcgacaagctgcggctgaagcaaccgaagaatggcatcgcctattcggtcgagcaggcccgtctggtcgcggccgagctgggcctgccgctggtggtgcgtccgtcttacgtgctcggcggccgcgcgatgcagatcatccgcgaggacaatcagctcagcgattatctgctcggcaccctgcccgagctggtgccgggcgacgtcaaggcgcgctatccgaacgacaaaaccgggcagatcaacaccgtgctcggtaccaatccgctgctgttcgaccgctatctgtcggacgcgacggaagtggacgtcgactgcctgtcggacggcaaggacaccttcatcgtcggcatcatggagcacatcgaagaggccggcattcattcgggcgactcggcctgctcgctgccgccgcattcgctcagcgcggagaccatcgccgagctggaacgccagacccgcgaactggcgctcggcctcgacgtcgtcggcctgatgaacgtgcagtacgccatcaaggacggcgagatctacgtgctcgaagtcaatccgcgcgcgtcacgtaccgtgccgttcgtcgccaaggtgatcggcatgccggtcgccaagctcgcggcgcgaatcatggccggcgagaagatcgccgatctcggcctgaagaagcgcaacctcgatcacgtcggcgtcaaggaatcggtattcccgttcgcccgtttcccaggcgtcgacaccgtgctcggcccggagatgcgctccaccggcgaagtgatgggcatcgaccgctcgttcgagatcgccttcgccaagagccagctcggcggcggcacccgcgtgccgcgcaagggcaccgtgttcgtgtcggtccgcgaaagcgacaaggcgcggatcgtggacgccgtgaagctgctgcattcggtgggcttcaaggtgatcgcgacctccggcacccagcgctatctgtcggaccacggcgtgccggcagagaaggtcaacaaggtgctggaaggccgtccgcacatcgtcgacgccatcatgaacggcgaagtgcaactggtgttcaacaccaccgaggggccgcaggcgctggccgacagccggtcgctgcggcgcgctgccctcttgcataaagttccctattacaccactctttcgggagcggtggccgccgcaaagggcatccgggcctatttggatggggaccttgaggtccggactctgcag

SEQ ID NO: 44508 - DNA, 1800 bp, Rhodopseudomonas palustris
attaagctttctgactggctcgcccaaaaggtcgtcgagctcggtgtccggcacgttttcatggtgacgggcggcggcgcgatgcacctcaatcattcgctgggcagtcacaaagacctctcctgcgttttcaatcatcacgagcaagcctgcgcgatcggggccgaagcctattatcggctgagcaatcgccttccgctggtgaatgtcacttcgggtccgggcggcaccaacgcgatcaccggagtttacggcgcgttcgtcgactccgtcggcatggtggtgatctcgggtcaggtcaagtttgagacaacggtgcggagcacgggactgccgctgcgccaatacggcgaccaagagctcgatatcatcgagctagttcgcccgatcaccaagtattgcgagatggtgactgatcctcagaccatccgctatcatatcgaaaaagctttctacctcgcaacatcaggacgtcccggcccatgctggctcgatattccgctcgacgtccaggcggcaaagattgatccggacacgctcgtcggtttcgatccgagcgagatcgaagagccttggaagaaaacggatctgactgcggcgtctcaagcgatcttcgatcggattgccaaggcggagcgtccggtcatcttcgcgggtggcggcgtccggttgagcggccggcatgatgcgttcctcaagctgatcgacaagctcggcattcctgtcgttacaggctggaatgctcatgatgccctattcgacgatcattttacctatgcaggccgtcctggaacgatcggcgaccgtggaggcaatttcgtagtccagaactccgactgtctgctggtgttgggtagccgcctgaatatccggcaggtgagctataattggaaatcgttcgcccgcgaagcttacaagatctgggttgagatcgacgagaccgagctgaagaagccgtcggtcaagccggacatgccagtgctggcaagcctgaccgatatcctcccggtcatggcggaaaccgagtattcggggcccaccgaacagcacaagaagtggttggcctgggccaaggccaaacacgaacagttcccggcggttctgccagagtattggcacaaccagctggtcaatccctactgcttcatggacgccttgttcggagccctggacgaggatcagatagtggtcactggcaacggcagcgcctgcgtcatcagtttccaggctgccgcgctcaagcgtggccaacggctttggacgaactcgggctgcgccaccatgggatacgaccttcctgccgcgatcggggcttgcaccgcgtccggtggcaaaccgattgtttgcctggccggcgacggcagcatcatgatgaatctgcaagaaatgcagacgatcatcggtaatggactgcctataaaaatcttccttctcaacaattctgggtacgtttcgatcttccagacgcatcgcaacttcttcaacggcgtcgaaatcggcggcgggccgaagagtggggtgacattcccggatttcgagccggtcagcaaagcctttggattctcgtacgtgcgctgcgcccgacaccaggacatggcggatgccatctctgccacgatgcaggccgatggcccgtccgtgtgcgagatcatgctcgacgagaacgttgcgtttgcaccgaagctcggcgccaagcagttgcccgacggacggatcatttctccaccgctcgaagatctgtcgccgttcctgcctcgagatcagttccgcgccagcatgatcattgacactatcgatgag

SEQ ID NO: 44509 - DNA, 843 bp, Rhodopseudomonas palustris
gaagcgaacaagtcgctggagtacgctcctcatctcatcagcgagctcagaaaagccggcgcagaccgcagcacgcacctagtggcgatcggcggcggaatcatccaggatgtcgtgaccttcgcagcgtcgatcttcatgcgaggcctgccctggacctacatgccgacaactctgctcagcatggtcgactcctgcatcggcggcaaatcctcgatcaacgccgccgggtacaagaacctcgtcggcaatttttatccacccaagaaggtcctcgtggatgtgtctttcatctcgacgctcgacgccgagatgatcgccggaggcctgttcgaagctgcgaaaatctgctatgctagcaactatcaggcctttctcgactacctcgcctgctctccgggtctcaagatgaccgacgaacaggcggtcaacgtgatcagacactcacttctgaccaagaagtggttcatcgagatcgatgagttcgatcagaaggagcgcctgctcctgaactttgggcacacctttgggcacgcactggaggcagctaccgacttcggaatttcacacggagtcggcgtcggtctcggtatgctcgtcgcggctcaatatgcaaaacgcgagaccgagctgacggatgccggcaaggatcatgttgcgcatttgatcgaacatgtgaaagacatgatcggcccgcgggccgaacgcgtattgcagtctccggcgcatgtcgacctggacttggcgatggagaagttcgagttcgacaagaagcacaaatcggactcctatcggatcgtcattcccaaccgcgaaggcgcgctcgctctcgtgtcagtgtca

SEQ ID NO: 44510 - DNA, 660 bp, Rhodopseudomonas palustris
gtatttggtgcaaccggcgcaattggccgcgccatctgtgagtggttcactgagcatagagttcgtgtcgtggcgatcggccgcgctgaacatccgcccagtggagtaccttgcgaccactggctcagctgggacgctgagcggcctgacaatttctctaaggtcctggcgggcgttcaattggacgcggcggtctgggcgcaaggcgccaactacaacgacaatataagaaccttcgatatagaagcacacaagcgcatctatacggcgaatgtgacctacattctcgtcagtttgcagatgctgctgaacggcaaccttttggccccaaccgctaagctgtgcattatcagctcgatctggcagaacatcgccaagcagaacaagatgtcctacggcatcaccaaggctgcgcttcaggggttggtgcaatccctggcgatcgacctcggcggttcgggtatcttggtcaatgcagtgcttccgggcgcgctcgacacgccgatgactagagcgaacttgagttcggatcagatcgcaagactggagcagatgagtccactcggctcgttgccgtcgctggccgacgtctgcaacctgataggcttcctttgctccgaggcgaacaccggaataactggtcaattcatcgcggcagac

SEQ ID NO: 44511 - DNA, 1062 bp, Rhodopseudomonas palustris
atgatccagccggcgttctggcgcggaaagcgagtattcctgacgggtcacaccggcttcaagggaagctggctgtctatatggttcgccgaactcggcgcggatgtggtcggttttgcactcccgccaccaacggagccgagcttattcgaagttgccggcctcgctagacgcatgaattcgatcatcggcgacgtccgcaatgctgatgccctgtgctcagccatgcaagaagcgcgacctgagatcgtcattcatatggcagctcagccgctcgtccgactctcttaccatcagcccgtcgagacatacgcaaccaatgtcatgggccttgtccatgtcttcgaggcggtacgcaaatgtcaaagcgtgcgtgcggtcgtaaatgtgacgagcgacaagtgctacgagaataaggagtgggtatggggttatcgcgaatctgagccgatgggaggctacgacccctatagcagcagcaagggctgcgccgaattggtaactacagcttatcgcaattcgttcttcaatcctgagaattatcagacgcacggcgtcgccatcgcgagcgcccgcgctggcaacgtgatcggtggtggggactgggcgccggatcgtcttattccaaacatcatgcgtgcgatcgaaaccggcatcccggttcaaattcgcaatcccgccgctatccggccatggcagcatgttctcgaaccgctgggcggatacctgtgccttgcgaaaaagctgtatgaagccggcccggctttcgtgggcggctggaatttcgggcccgcagattccgacgccaagcccgtgcaatggatcgttgatcgcatgacccggatgtggggtaaaggcgcgagttggcaggaagtcacggatcgcactgcgccgcacgaagctcactatctcaagttggactgttcgaaagcgcagtcgttgctcggctggaaaccagcctggaacttggaacgtgcgttagagaagatcatcgattggcaccactcttctttacaaggcgcggaccttcatgcaaaaactctcggtcaaatccgtgattat

SEQ ID NO: 44512 - DNA, 762 bp, Rhodopseudomonas palustris
atgaaggtagtgcttctggcaggcggcctcggaacgagaatctccgaggaatcggcattgcgccccaaacccatgattgagatcggcgggagaccgatactctggcacatcatgaagatttatctagcccacggattgcgagatttcgtgatctgctgcggctataaaggctacatgatcaaggaatacttcgctaattactcgctccacatgtctgacattaccatcgacatggaaaacgagtcgatcgagattcatcggaagaagaccgagccgtggcgggtaacgctcgtcgataccggtgaagccacccaaacgggcgggcggctcaagcggatagccgattatatcgatggcgacttctgcctgacttatggtgacggagttggatcgatcaacatcactgagctccttatgtttcaccgcagccatggaaagcccgccacgatgactgccacgcagccgccgggtcgcttcggcgcgctgcaactcaatggaaagtcggtcacgtcgttcctggaaaagccgaccggagacggcggttggatcaacggtggtttcttcgtactttctcctaaggtgctcgatcgcattgacggggacatgactatctgggagcgcgaaccgctcgagagtctagcgcagaacggcgaactccaagcctatttccatagcggcttctggcaacccatggatacgctacgggacaagaatcatctcgaaaatttgtggcaatctggtagggcgccgtggaaaatgtgg

SEQ ID NO: 44513 - DNA, 1860 bp, Rhodopseudomonas palustris
accttccccaagctgctccggctcaatgcaagggaattcgggaccgagatcgcgctgcgcgagaaagatctcgggctgtggcgggtgttcacctgggccgactatcaggcccgcgtgcacgacttcgcgctcggcatggtcgaactcgggctcaagcgcggcgacgtgattggcatcatcggcgacaaccggcctgactgggtttcggcagagatcgccacccatgcgatcggcggcctgagcctcgggctgtaccgcgacgtgctcgatgaggaggccgactatctgctcaactacggcgaggccaagctggtgttcgccgaggacgaggagcaggtcgacaagctactcggcctcgccgaccgcgcgccgcatctgaagcacatcgtctattccgatccgcgcgggatgcggaaatatgacgatccgcgcctcttgccggccgatcagctcgccaagctgggccgcgatcgcgccagccgcgagccgggcctgtacgaccggctggtcgacgccacgcagggcgaggacgtcgcgatcctgtgcaccacctcgggcaccacggcgcaccccaagctggcgatgctggcgtccgggcgcgtgctgaaacactgcgcgacgtatctgtcgttcgatccgaaggggccagacgacgaatacgtctcggtgctgccgctgccctggatcatggagcaggtctacgcgctcggcaaagggctgctgtgccggatgacggtcaacttcgtcgaagagcccgacacgatgatgaacgacttccgcgagatcgcgccgaccttcgtgctgttcgcgccaagggtctgggaaggtatcgccgcggacgttcgcgcccgggtgatggacgcctcgccgctgaagcagcgactttacaacgccggcatgagggccgggctggctgcgctcgaccatggccagcattcggcgttcgccgacgcggtgctgttccgcgcgctgcgcgaccggctcggcttcacgcggctgcgctcggccgcaaccggcggcgccgcgctcggcccggacaccttccgattcttccgcgccatgggcgtgccgctgcgcacactgtacgggcagaccgaactgctcggcgcctacacgctgcacaagccggatgcggtcgatcccgacaccaccggcgtgccgatgggcgccgagatcgagatcaaggtcctgaaccccgacgtccagggcatcggcgaagtggtggtgcgccaccccaacatgttcctcggctactacaagaacccggaagcctcgaccgccgacatcaaggacggctggatgcattccggcgacgccggctatttcaacggcgccggccagctcgtcatcatcgaccgcatcaaggacctcgccgagctgtcccatggagaacggttctcgccgcaatacatcgagaacaagctgaagttctcgccctacgtcgccgaagcggtgatcctcggcgccggccgcgacatgctggcggcgatgatctgcatccgctactcgatcatctcgaaatgggcggagaagaagcggatcgccttcaccacctattcggacctcgcctcccgccctgaagtctacgagctgctgcgccgcgaggtcgcgagcgtcaacgccaccctgccaccggcccaacgcatcagccgcttcctgctgctctacaaggagctcgacgccgacgacggcgagctgacccgtacccgcaaggtccgccgctcggtgatcaacgagaagtacggcgacatcatcgacggcatctatagtggacgtagcgacatctcggtcgataccgccatcaagttccaggacggcaccacccagcggatccgcaccacgctgagggtggtcgacctc

SEQ ID NO: 44514 - DNA, 1305 bp, Rhodopseudomonas palustris
atgcgcatcacgatgattgggacgggttatgtggggctggtgtctggggcctgctttgcggacttcggccaccaggtgacctgcgtcgacaaggatgccggcaagatcgcggccctgcatcggggcgaaattcccatttacgaaccggggcttgacgagctggtcgcggccaacgtcaaggcagggcggctcgacttcaccaccgatctgaccctcccggtgggcgaagcggacgcagtgttcatcgccgttgggactccgtcgcggcgcggcgacggccacgcggacctgtcctatgtgtatgccgcggcaaaggaaatcgccgccgccctgaaaggcttcacggtcgtggtgaccaagtcgacggtcccggtcggcaccggcgacgaggtcgagcgcctgatccgcgagaccaatcccaccgccgacgcggcggtcgcctcgaaccctgaattcctgcgcgagggcgccgcgatccgcgacttcaagttccccgaccggatcgtgatcgggactgccgacgagcgcgcccgtaaggtgatgggcgagatctaccgcccgctgtcgctgaatcagggcccgctgatgtacaccgcgcggcgcaccgccgagctgatcaaatacgccgccaacgcgttcctggcgaccaagattaccttcatcaacgagatggcggacctcgccgaaaaggtcggcgccgacgtccaggacgtcgcccgcggcatcggcatggacaaccggatcggctccaaattcctgcatgccggccccggcttcggcggctcgtgcttccccaaggacacccgcgcgctggtgcagaccgcgcacgaccatgacgtgcccgtgcggatcgtcgaggcggtccttgccgtcaacgacaaccgcaagcgcgcgatggcccgcaaggtctcgcacgcgctcggcggcaacatgcgcggcaagaccatcgcagtgctcggcctgaccttcaaaccagataccgacgacatgcgcgaggcgccgtcgatcccgctcgtcaccggcctcaccgacatgggcgccaaggtgaaggcgttcgatcccgccggcatggcgcaggccaaggcggagttgccggacatcacctactgcgaggacgcctacgactgcgccaagggcgcggacgcgctggtgatcgtcaccgaatgggtgcaattccgcgcgctcgatctgccgcggctgaaagccgcaatggcgcagccgatcgtcgtcgacctgcgcaacatctaccgccccgccgaaatggccgagcacggattcagctatcacagcgtcggccgcggcgac

SEQ ID NO: 44515 - DNA, 1197 bp, Rhodopseudomonas palustris
gcgtcttatatgttcacgagtgagtccgtgtcggaaggacatccggacaaggtttgcgatcggatctccgacgagatcgtcgatctgttctatcgcgaagggccgaaggccggcatcgatccgtgggcgatccgtgccgcctgcgaaacgcttgcgaccaccaacaaggtggtgatcgccggtgagacccgcggcccggcctcggtgaccaacgagcagatcgagcaggtggtgcgcgatgccatcaaggacatcggctacgagcaggaaggcttccactggaagaccgccgacatcgagatcctgctgcatccgcagtcggccgacatcgcgcagggcgtcgacgcgctgcagcccggcaccaacaaggaagagggcgccggcgaccagggcatcatgttcggctacgccactaatgagacgcccgacctgatgccggcgccgatcttctacgcccacaagatcctgcggctgatctccgaagcccgccactccggcaaggagaaggtgctcggcccggactccaagagccaggtgacgatccagtacgagaacggcaagccgcaatacgtccgcgagatcgtggtgtcgcatcagcacctgatcgaggacctgagctcgaaccagatccgcgactgcgtcgaaccctatgtgcgccaggcgctgcccgacggctggatcaccgacaacacgatctggcacatcaacccgaccggcaagttctacatcggcggtccggacggcgacaccggcctcaccggtcgcaagatcatcgtcgacacctacggcggtgctgcgccgcacggcggcggcgcgttctccggcaaggacccgaccaaggtcgaccgctcggcggcttacgcggcgcgctacctcgccaagaacgtggtcgcctccggcctcgccgacaagtgcaccctgcagctcgcctacgcgatcggcgtggcgcggccgctgtcgatctatatcgacacccacggcaccgggaaggtgtccgaggacaagctcgagaccatcgtggccgaggtgatggacctgaccccgcgcggcatccgcacccatctcgacctcaacaagccgatctacgcccggacctcgtcctacggccatttcggccgcaccccggacgccgacggcggcttctcctgggagaagaccgatcttgccgacgccatgaagcgtgcggtgtaagtgaga

SEQ ID NO: 44516 - DNA, 1389 bp, Rhodopseudomonas palustris
gactacatcgtcaaggacatcggcctcgccgagttcggccgcaaggagatctcgctggccgagaccgaaatgccgggcctgatggcgacccgggaagaatacgggccgaagcagccgctgaagggcgccaagatcgccggctcgctgcacatgacgattcagactgcggtgctgatcgagacactggtggcgctcggcgccgaggtgcgctgggtgtcgtgcaacatctactcgacccaggatcacgccgccgccgcgatcgccgccgccggcattccggtgttcgccgtcaagggcgagacgctgaaggattactgggactacaccgccaagctgttcgactggtcggacggcggcaccccgaacatgatcctggacgacggcggcgacgccaccatgttcgtgcatcagggcctgcgcgccgagaacggcgacaccatgttcctcgatcagcacaattcggaagaagaagagatcttcttcgcgctgatcaagcgcatcctcaaagagaagccgaagggctacttcgccacgctcgccaagaacatcaagggcgtgtcggaagagaccaccacgggcgtgcacaggctgtacgacatggagaaggccggcaagctcttgttcccggcgatcaacgtcaatgactccgtgaccaagtcgaagttcgacaacctctatggctgccgtgaatcgctggtcgacggcatccgccgcggcaccgacgtgatgctgtcgggcaaggtcgcgatggtcgccggcttcggcgacgtcggcaagggctcggccgccagcttgcgccaggccggctgccgcgtgatggtgtcggaagtcgatccgatctgcgctctgcaggccgcgatggaaggctatcaggtggtgaccatggaagacgcggcgccgatcgccgacatcttcgtcaccgccaccggcaacaaggacatcatcaccatcgagcacatgcgcgcgatgaaggatcgcgccatcgtctgcaacatcggccacttcgacaacgagattcaggtcgccaccctgaagaacatgaagtgggacaacatcaagccgcaggtcgacgagatcaccttcccggacggcaagcggatgatcctgctgtcggaagggcgcctggtgaacctcggcaacgcgatggggcacccgagcttcgtgatgtcggcgtcgttcaccaaccagacgctggcgcagatcgagctgttccagaaccagggcaagtacgagaagaaggtctacgtgctgcccaagaccctggacgaaaaggtcgcccgcctgcacctcgccaagatcggcgtcaagctcaccgaactgcgcaaggaccaggccgactacatcggcgtcaaggtcgaaggcccgttcaaggcggatcactaccggtat

SEQ ID NO: 44517 - DNA, 1539 bp, Rhodopseudomonas palustris
tccaagctgactctcgccacgcttggtggccggcctcttctcactgatctggatctcagctttgcgcgcgagcgcaccggcctgatcggacgcaacggcgtcggcaagtcgtcgctgctcgcggtgatcgccggcgagggccccgcgttggccgggaccgtcacggtggccggccggatcgcgatgttgcaccaggcggctcagcctcggtccggcgagaccgtcgccgatctgttcggcgcgcgcgacgcgctggcgttgctgcgcaaggcagcgcaaggcgaggccgcgccaagcgaactggacgaagtcgattggaccatcgggcaacgcatcgtgtcgtcgctggcgcggttcggactcgacgtcgatctcgacgtcggtcttgcggctctgtcgggaggccaggcgacgcgcgcgcgcctcgccgcgctgacgttctgcgagccggatttcgtgctgctggacgagccgaccaacaatctcgatcgcggaggccgccgcgccgtgctcgatctgctcgccggctggcgcgggggagcgatcgtcgtcagccatgaccgggagttgctcgaaacggtcgacgccatcgtcgaactcacatcgctgggcgcgtcgcgctacggcggcaactggagccgctatgtcgaacgcaaggacattgaattgtcggcggcaacgcgagatctcgcggaggcggaacggcgtctgaccgagaccggctgcaaggcgcaagccgcgatcgagcggcaggcgcggcgcgacggcgcgggcaaacgcaagcaggcgcggggcggcatgccgcgcattctcgccggtgcgcggaaggatcgcagcgaagatactggcggcgcgggcgctcgcaccgcatcgcgccagcgtgtcgaagcgttggccggcgtcgatctcgcccgccagcgtgtcgaagtgctgcagacgccgtcggtcgcgctcgcgccgaccggtcttgccgccggcaagacggttctcgcgctcgaccgtgtcagcgtgggctatcagccacttcggccggtgctgagcgatctatcgttgtcgatcaccggcccggagcgcgtcgcgatcgttgggcgtaacgggacaggcaagacgaccctgctcaagctgatcagcggcgagctgcgtccgtggcgaggcgtcgtccacgtcacgtcgcgtctggcggtgttcgatcagcagctcagcctgctgcggccgtcggactcggttctcgtcaactatcagcgcatcaatccggattcggacctcaacgcctgccgcgcggcgttggcgcggtttctgtttcgtggggacactgtgctgcagatcgtcggccagttgagcggcggccagatcctgcgcgccgggctcgcctgcgttcttgccgggccgcagccgcctttcttgctggtcctcgacgagccgacaaaccacctcgacctggactcgatccgggcaatcgaggccggcctcattgcgtatgacggcgctttggtggtcgtcagccacgacgaacagtttctcgaggccattggagtgtcg

SEQ ID NO: 44518 - DNA, 1170 bp, Rhodopseudomonas palustris
ctctacgaccacgtcaagaagttcatcgccgacgtcgtcgagccgatgcagcacgagttcgagatcgccgaagcgaagaacccgaaccgctggtcgttcagccaggagcagctcgatctgctcgcgaaagccaaggcgcaggccaaggagcaagggctgtggaacttcttcctgcccgacgctgagaccggtgagggcctcaacaatctcgactacgcttacatcgctgccgaactcggcaaggcgccgctcgcctccgaagtgatgaattgctcggcgccggacaccggcaacatggaagtgctggagcgcgtcggcacccctgagcagaaagagaagtggctgaagccgctgctcgacggcgagatccgctcggcctatgtaatgaccgagccgaacgtcgcctcgtcggacgccaagaacgtctcgacttcggccgtgctcgacggcaacgagtgggtcatcaacggcgagaagtactacatctctggcctcggcgatccgcgctgcaagatcatgatcgtgatggtcaagaccgatccgaccgcggcgcccagcaagcagcagtcgcagatcctggtgcccgtcgacacccccggcgtcgaagtgctcggtccgatgcacgtgtttggccacgaccacgcgccgcgcggccacatgcacatgcgcttcaacaatgtccgggtgccgaaggaaaacatcctgctcggtgaaggccgcggcttcgagatctcgcagctccggctcggccccggccgcatccatcactgcatgcgcaccatcggcaaggccgagaaggcgctcgacttgatggtggcgcgcggcctgacccgcgaggctttcggcaagaagctggcgcatctcggcggcaatctgcagatcatcgcgcaggcgcgctgcgagatcgaagcgatgcgactgatggtgctgaaggccgccaaagcgatggacgtgctcggcaacaaggaagcgcgcgtctgggtcagcatggtcaaggcgatggtgccggagcgcgcctgcaagatcatcgaccaggcgatccagatgcacggcgccaccggcatctcgcagtggaccccgctcgccgagatgtacaccgacgtccgccacctccgcttcgccgacggtccggacgaagtgcactggatggtcgtcggccgccacgaactg

SEQ ID NO: 44519 - DNA, 1560 bp, Rhodopseudomonas palustris
ccgctcgcgcgagctttggcggagcgcaattatctacaggcgacgccggtgcagagcgctgtgctggcgccggacaccgccggccgcgacctcctggtctcggcgcagaccggctccggcaagaccgtggcttatggcctcgcgatcgcgcaggacctgttgggcgacgccgagcagtttgcgcccgccgcagcgccgctggcactgatcgtggcgccgacccgcgagctggcgctgcaggtgcatcgcgaattgagctggctgtatcgccacgccggcgggcggatcgtctcctgcgtcggcggcatggacccgcgccgcgagcagcgcgagctggcggacggtgcccacatcgtggtcggcacgccggggcggctgtgcgaccatctgcgccgcaaccggctcgacgtctcgcagctgaaagccgtggtgctcgacgaggccgacgagatgctcgatctcggcttccgcgaggacatggagttcatcctcgaaaccacgccggaaacccgccgcaccctactgttctcggcgacgctgccgcgcggcatcatcgcgctggccaagacctatcagcacgacgcgatgcggatcgaggtcgaaggcgccgaaggcggccacgccgacatcgagtatcgcgccatccgcatcgcgccgaatgatgtcgagcacgccgtcgtcaacgtgctgcgctacgtcgaatccccgaccgcgatcgtgttctgcaacacccgcagcgcggtgaaccatctgcagacggcgttgctggaacgcggcttcgccgtggtggcgctgtccggcgaactcacccagaacgaacgcaccggcgcgctcaacgcgctgcgcgacggccgcgcgcgcgtctgcgtcgccaccgacgtcgcggcgcgcggcatcgatctgccgaacctcggcctcgtcattcacgccgagcttccgaacgacgccgaagtgatgcagcatcgttcgggccgcaccggccgtgccggcaacaagggcgtcagcgtcctattagttccgccggcgcggcggcggcgcgccgagttgctgctgcagctcgccggcatcgaggcgaactggggcaccgcgccgcaggccgacgagatccgcagcctcgatcagcagcgcatgctgcaggacccgctgttcaccgaagagccgaccgccgaagatcaggcgctggcgcaggcgctgctcgccgagcgctcgcccgagcagatcgcggtcgcgctggccagggtggtgcgggcccggatgccggcgccggaggacattctcgatcccggcgagcggccggcccgcggccgcgacgaacgtcccggcaagaccgcgcgcgaaccgcgcgatcacgaggcgcgcgacaaggctccacggtctcggtcggccaaggccggcgagaagcacgcgatcacgggcggcgtgtggtttcgcgctgcaatcggcaagcgcaagaacgccgaagcgcgctggctgctgccgatgatctgccgccgcggcggcatcacccggcaggacatcggcgcgatccgcatcctcgacaccaccaccgaattcgagatc

SEQ ID NO: 44520 - DNA, 1548 bp, Rhodopseudomonas palustris
atcatgttctggtcggtcgtcacccttgtggtgttcagcctgaagggcgcagcgacctacggccagtcggtgatcctcacccagatcaagaacgcgatcctggccaacaatcagcgccggatgttccacaagctgatgagcgagagcatcggcttcttctcgcagcggcattcatccgagttcctcgcgcgcctcaccgccggcgccaactccgtcaccgaagtgctcaacctgctgatcaatgcgatcggccgcgatctgttgtcgctgatcggcctggtcatcgtgatggtggtgcaggatccgttcatggcgctgttcggccttctggtcgcgccgccggccgcgttcgtggtgcgtaagctggtgaagcgcgtgaagggcctggcgctgacgcagttcaccggcaacgcgcagatcctcgagaccatgcaggaatcgctgcagggtatccgcaccgtgaaagcgttctcgctcgaaaagaccatgagcgaccggatcgacgccaacatcgctgcggtgcaggccaacgccgacaagatggcgaaggtgtcgaaccgctccagcccgctgatggaaacgctcggcggcttcgcggtggcggcgtcgctgatgtatggcggctaccgcgtggtcgcgaccggcgcgacgcccggcgagttcttctcgttcctgacagcgttcctgctcgcctatgaaccggcgaagcggctggcgcggctcaacatcgaactcaacagcggcctggttggcgcgcggatgctgctcgagatcatcgacagcccaccgagcgagccggacgacagccacaagccggcgctgcaactcaccgaggcgcgggtcgaattcgaccatgtctcgttcgcttatcggccggacgagccggtgctgaacgccatgagcttcgtcgccgagcccggcaagatgaccgcgctggtcggcccttccggcggcggcaaatcgacggtgctggcgctgctgctgcgcttgtacgaagtgcagtccggcgaaatccgcatcgacgggcagtcgacctcgaccgtgtcgcgcgagtcgctgcggcggcaaaccgcctatgtcggccaggacgtctatctgttccgcgacaccgtccgcgccaacatcgcgttcggcaagctcggtgccaccgaggacgagatcgtcgccgccgccaaggccgcctgcgcacacgacttcatcatgggcttcccgctcggctacgacactccggtcggcgaacacggcgcgcaattgtccggcggccagcgccagcgcatcgcggtcgcccgcgcgctgctgcgcgatgccccgatcgtgctgctcgacgaagccaccgccgcgctcgactccgagtcggagaagctggtgcaggaggcaatcgatcgtctcgcccgcggccgcaccaccatcgtgatcgcccaccggctgcacaccatcatgcatgccgattccatcctggtggtcgaggccggcgagatcgtcgagcagggccgccacgacgacctgctgcgccgcagcggccgctatgcttcgttcttccggctgcag

SEQ ID NO: 44521 - DNA, 642 bp, Rhodopseudomonas palustris
ccgatgactcccgatctcgataagtccctgattgaaaccgcctacgctcgctgggctccgatctacgacgcggtgtgcgggccggtgatggtgaaggggcggcgcgcggcggcggccgaagcgcgcgcgcacggcggcaagattctcgaagtcggcgttggtaccggattgtcgttcgacgactacgacgcctcgaccgaaatcaccggtatcgatctgtgcgagccgatgctggacaaggcgcgcgccaagatggcgacgggtcgttatccgtgggtcaaggacgtgcgccagatggatgcgcacgcgatggaattcgccgacgcgacgttcgattgcgtcgtcgcgcagttcgtcatcacgctggtggccaatcccgagcaggtgctgtcggagtgtcatcgcgtggtgaagccgggcggccgcatcatcctggtcaatcatctgtactccgaagtcggtgttgccgccgcggtcgaacgctgggcggcacagaagacccgcgggctggggttgcgccccgaattcccgttcgcgcggctgcaggcctgggcgcaggccacctccgacgcaatcctggtcgagcggcgcaagttgaagccgttcggcatctacacgctggtgtgtttcgagcggactccc

SEQ ID NO: 44522 - DNA, 798 bp, Rhodopseudomonas palustris
gatgtcaccgatccgagcgctgtcgccacgatgattgccaagcttcaaccgagccacgtcgtcaatctcgcggcgcttgccgcgccctctgcggccaatgcggacccgtcggcgagctggcgtgtgcatctcgatggtccacgcaacatcgggcgcgcaatcctgcaagcagctccggcctgtgtactgctgcatgtcggttcgggcctcgcctacggaaagaaccgtccaccgatctgtccgaccagcgaggacagggtgctcgcgcccaccgacgagtatggtgcttcaaaggccgcagctgacgttgcgctcggccccctgatcgccaagggactgcactgcatccggttgcggccgttcaatcacaccggcccgggccagactgacgcgttcgtcgttccagcattcgcccgccagatcgcgcggatcgaggccggccttgcgccgccgcagatgcaggttggcaacctcgatggtcagcgtgactttctcgacgtccgtgacgtggtcgccgcctatgcggaaacgatcgcccgcagcgacagcctcacgcccgacgcgattctcaacatcgcctcaggcgtgccgcgccggatcggcgacatgctgcagcaattgctgacaatggcacgtgtgccgatcgccgtgcagaacgatccggcacgaggtaagagtgacgctgccgatgtcatcctcggcgatgcaagccgagcacgatcgatgcttaactggcagccgaccatcgcattcgagcaaacccttgctgacgtgctcgaggaccaaagatccgaggtc

SEQ ID NO: 44523 - DNA, 963 bp, Rhodopseudomonas palustris
atgagcaagacggctttcatcaccggcatcaccggacaggacggtgcctacttggcccagcatctcatcgcgcagggctacgccgttcacggtctgctccgtcgcagtgcctctgcggatggcatgaccagccggttgaagtggctcggcattgccgaccaggtgacgctgcatgacggaaacctgaccgacctctccagcctgatccggctgctgacggatctgcagccagacgaggtctacaatctggcggcacagtcgttcgtcaaatcctcgtggcaacaacccctgctcaccgggacggtaacggggctcggtgccgtaaacgctctcgaagcagtgcggatcgcctgcccgaaagcgcgcttctatcaagcgtcgtcatcggagatgtacggcctgatccagcagcggatccaaagcgaaaccacgccgttctatccgcgttcgccctacgcagcagccaaactctacgcgcattggatgacgatcaactatcgcgagagcttcggcatgcacgcgtcgtgcggcatcctgttcaaccacgagtcgccgctgcgcggcatcgagttcgtcacccgcaagatcaccgatggcgtcgcgcggatcaaactcggcctacagactaccctgtcgctcggcaatctcgacgccaaacgtgactggggtcatgcgcgcgactacacccgggcgatgtggctgatgctgcagcaggacgtgccggacgactacgtgattgccacggggcgcaccgcgtccgtgcgtgagttctgcgaaatggcgttcgcctgcgtaggcctcgacatgaatcaatacgtcgtgaccgatccgcggcatttgcgccccgcggaggtggactatcttcaaggtgatgcggccaaggccaagcggaagctcggctggacgttcgagacatcgctcgagcagatgatcgccgaaatggttgaggccgacctcgcccgc

SEQ ID NO: 44524 - DNA, 942 bp, Rhodopseudomonas palustris
aaatatctggtgattggttcgaattcgtttaccggtgcctcgatggtcagctatctgctcgaccagggtgccgatgtcgtcggcatcagccgctccgacgagccgcatccggcattcctgccgtatcgctggaagaaggccgatcgcttccggtttcagaagctcgacctcaaccacgatctcgacgcgatcatgcaactggtgaccgccgagcggtttccctgcatcatcaattttgccgcgcagagcatggtcggcgagagctgggccaatccggaccattggttcatgaccaatgtggtgtcgacggtgcggctgcacgagcgtctgcggatttgcgacttcctcgagcgctacgtccacgtcaccacgccggaagtgtacggcaacgccaccggcacgctgaccgaggatgcggtgttcgatccatcgacgccctatgcggtgtcgcgcgccgccggcgacatgagcctacggtcgtatttccgcgcctacggctttccggtgctgttcacccgtgcggccaatgtctatggccccgggcagcggctgtatcggatcgtgccgcgcaccatcctgttcatcaagctcggccgcaagctgcagctgcacggcggcggcacctcggagcgctcgttcatccatgcggccgatgtcgccgacgcgaccaggcggatcgcgtgcaacggcaagctcggcgacagctatcacatctccaccgaccggatcgtcaccatccgtgccctggtggagatgatctgcgcgatgatgcgcgttcggttcgaggatcaggtcgagatcgttggcgagcggctcggcaaggacgccgcctacaagctcgacagcagtaaattgcgcagcgaactcggctggagcgaccagatcacgctggagcagggcatcgaacagacgatcgcctggatcgatcgctggttcgaagaa

SEQ ID NO: 44525 - DNA, 984 bp, Rhodopseudomonas palustris
atgaatccggagacctcgcgccgcctgttgttcgacatgctgcggatccgcagcgtggaggagaccatcgcggcgcgctacggcgagcagaagatgcgctgcccgacgcatctgtcggtcgggcaggaggccgtctctgcggcggccggggcggtgctgaggccgaccgatcttgcagtcagcggtcatcgcgcccacgcgcactatcttgccaagggcggatcactgaaggcgatgatcgccgagatctgcggcaaggtcaccggctgcgcccgcggcaagggtggctcgatgcatctggtcgacgagagcgtcggcttcatgggctcgaccgcgatcgtcggcggaacggtgcccgtcggcgtcgggctgtcgtatccgatgaagctgaatcagacgggtcagatttcctgcgtgtttcttggcgacgcggttccggaaaccggcgtgttcttcgagtcggtgaacttcgcggttgtgaagcagctcccggtgttgttcctgtgcgagaacaatggctactcggtgtattcgccgctgtcggtgcggcagccgcccggccgcaagctgtacgagcttgtcgccggcttcggcctcaagacgcatcacggcgacggcaatgatgcgcgcgccgtgtacgccgcgctgagcgaaggcgttgcggcgatcagggccggcgaggggccgcggttctacgaattcgagacctatcgctggcgcgagcattgcggcccgatgtacgacaacgaccttggctatcgcacggtggccgaattcgaggcgtggaagctacgcgatccggtgccggcgttgcagcgcgcgctgattaccgaagctatcgtgactgccgccgacgtcgccgacatgcaggcggagatcgatgccgagatcgaggaggcgttcgccttcgcagaaagctcgccgtttccgccgcccgaagacgccttcaccgacgtctatgcgtcagcagcaggctaaggaggg

SEQ ID NO: 44526 - DNA, 924 bp, Rhodopseudomonas palustris
accgcgcttgcggtcgacgacgatgtgatctgcttcggcctcggcaccgacgaccccaagggcgtgttcggcaccacgctcgacctgcacaaacagttcggccccgaccgtgtgttcgacatgccgacctcggaagcggcgatgaccggctttgcgatcggcgcggcgctgaacgggatgcggccggtgatgacgcatcagcggctcgacttcgcgctgctgtcgctcgatcagctcgtcaacaatgccgccaaatggcgcttcatgtttggcggcaagcgcggcgtgccgatcaccatccggatgatcatcggccgcggctggggccagggtccgacgcattcgcagagcctgcaatcctggttcgcgcatatcccggggctgaaggtggtgatgccgaccaccgccgaggatgccaaggggctgctgcttggggcgatcttcgacgacgatccggtgatcttcctggagcatcgctggctgcacaacatgaagggcgaggtgccggcgggcgatgtccgcagccctctcggcaaggcccgcatcgtgcgccagggcgatgcggtgaccatcgtggcgatgagctacatgacggtggaagcgctgcacgccgtcgatcatctcgccgcgcagggcatcgcctgcgatctgatcgacctgcgcagcattcgtccgctggactggccggctgttatcgcatcggtgcagaaaaccgggcgtctgctggcgctggacagtgggcatctgaccggcggtgtcgccggcgaaatcgtcgcgcgcgtcgcgaccgatcacttcgcgagcctcaagagcgcgccgcagcgcctcgccgcgccggacgtccccgaggccaccagcccggcgctgaccaaaaattatcatgtccgcgctgaacacatcgctgaggctgtcggccggatgctc

SEQ ID NO: 44527 - DNA, 1032 bp, Rhodopseudomonas palustris
gtgaccttccgcgctgcggtgctgcacgaactcaatcggccgctctcgatcgagacggtcgaggcgccgccgctcgcggcggggcagctgctggtcaagctcgcctattccggcgtctgccatagtcaggtgatggaagcgcggggcgggcgcgggccggatcgctatctgccgcacatgctcgggcacgaaggctccggcgtcgtcgtcgagatcggtggcggggtcaccaaggtcaagcgcggcgatcgtgtcattctcggctggatcaaggggcagggcgccgacacccagggggtgcgctacgccagcggggagcgtgttatcaacgccggcgcggtgaccacgttcaacgaatatgccgtcgtcgcggagaaccgggtcacgccgctgccggccggactgccgatggatgttgcggtgctgttcggctgcgcgctgccggtcggcgccggcatcgtcatcaacatcgccaaaccgcagccgggcgcgacgctggcgatcttcggcctcggcggcatcgggctcgcggcgctgatggcctgcaagctgtttgcctgtaaccaggtgattgctgtcgatgtcgaagctgccaagctgaaaatggcgacggagctcggcgccaccacggtgatcgacgcctcgcgcatcgatccggtcgaggagatccgaagacttaccggcggcctcggcgtcgactacgcaatcgaatccgccggcctcactcgcgtgatcgagcaggcgttcgacgccacacggcggttcggcgggctgtgcgtgttcgcctcgcacccgcggagcggcgagaagatcgcactcgatccgttcgaactgatctgcggcaagagaatcctcggcacctggggaggcgacagcaagccggaacgcgacatcgagttgctggcggggctgtaccgcgacggcaagctgccgctcgatgcgatgttcacccgccgctacaagctcgacgagatcaacgaggcgctggacgatctcgagcatcgccgcagcgtgcgcccgctgatcgaaatc

SEQ ID NO: 44528 - DNA, 1473 bp, Rhodopseudomonas palustris
actgaatgcggctccattcgtgggatcgtcgccgatggcgtgaggacgtggcgcggtattccgttcgctgccgcgcctgctggtgcactgcgcttcaacgcgccgcagcctcccaatgcttggcaaggcgtgcgcgacgcttccgagttcggtccgatcccgatgcagaaaaggggatacgaggcgatcggcggagcaggaaagacgacgccgatctcagaggactgtctgaccgtcaatgtttcggcgccgctccaaccgagcggcaaccttcgccccgtcgtcgtatggatctacggcggcggcttttcggtcggtggtacccgagctccgctgtaccgcggcgatgggctggtgaaatccggcgacgtgatctacgtgagtttcaattatcgcgtcggcgtcttcggcttctccgatttctccgcgtggtcgacgccggaaagcccgatccagagcaatccgggcttgcgtgatcaggtcacagcgctcggatggatcaagcgcaacatatcagctttcggcggcgacccggatcgcgtgacgatcgtcggacagtcggcgggagcgatgtccgtcgtcaccttgatgtgtattccatccggcgctgggctcttccaccgggccattgcgatgagtccgaacgcggggtcggctttcgggccagagaggcatcgagcctgggccgcagagattgttaaactgctggggctcgatccggacgacaaggcagcagtctcccatgcattgaagcaagtttcggccgagacgctttgcgaggcgtccagccgcttcttctacgacgtagcgccggatgccattgccggaatgctgcccacctcgccggtggtggacggcgacttcctacctttctccccaattgatgcgtttcgtctggggaaggcgcacccagtaccgctcgttatcggcacgatgtcgcgcgagggagctattctggacaaggtgcttacggtgatcgccacccgaccaaatcggttggaggacatgttcaagcgagccggttgggccgtccgcgaacggatcgcgtcgatctatcatggctatccgtccaagcgcgcggcgatcgatgtcggaggcgacttcaccttctggcatccatctgtgctgattgcggagggccacgctcgggtagcaccctgctgggcctatcggttcgactatgcgacgccgttgacgcggttgatcttcggcgctgccacccacggcctcgatttaccgatgttgttcggaacaaccggtgagggcgatttgggaaagctggacctgttcaggaaaagggcctcgcgagagatgagcggccgctttcagagcgaccttctcggttttgtccgcggtgcccggccgagctggccaacctacgatctcgaccggcgcatgacgcggatcttcgatcatgccgaccgcgaggaagctgacccccgacgcgatcgccggttggcatggggcgagttc

SEQ ID NO: 44529 - DNA, 892 bp, Rhodopseudomonas palustris
gccagcccggtgatggcgcttagaccagaggtatagacatccgatgacagctcacaccgatcccctggtctccaccgactggcttgccgagcggctcggcgatccctccgtcaagatcatcgacgccagcttcaagatgcccggcgtgctgccattgccggcggacgactatctcgccgcgcacattccgggcgcggtattcttcgacgtcgatgcggtgtcggatcacgccagttcgctgccgcacatgtatccaagcgccgaccagttcgcgcgcgacgtcgaggcgctcggcatctcgtcgggcgacactgtggttgcctatgacgctggtggttgggtcgcggcgccgcgggcgtggtggatgttcctgtcgttcggtcacgccaacatccgcattctcgacggcggtctgaagaaatgggtggccgagggcctgccgaccgaggcgggcaagccgacgatcgcgccgggccgcttcagcgccaagctcgatccgtcgttcatccgcagccgcgatcaactggtcgccaatctcgatagcggggccgagcaggtgatcgacgcccgcgccgcgccgcggttcgagggcagcgtcgccgagccgcgtcctggcctgcgggccggtcacatcccgggcagccgcaatctgccctacaacgagctgttcgacgcagcgaccggcacgatgaagccgctcgctgaactgcggcaggcattcgagcgggcagggctcgatctcgggcggccggtggtcacgagctgcggctccggtgtgtcggccgcggtgctgacgctggcgctgtatcggctcggcgtgcgcggctcggcgctgtacgacggctcgtggtcggaatggggccttcaggatggcccgccggtcgcgaccggt

SEQ ID NO: 44530 - DNA, 375 bp, Rhodopseudomonas palustris
ggcatcaaggcgatgctcgacgaagccaattcctcgatcgagacgctgacgaccgcggacgcgatcgcgttgcacaagtccggcgccagcgacgtggtgatcgtcgacatccgcgatccgcgcgagatcgagcgcgacggcaagatcccgggctcgttctcctgcacccgcggtatgctggaattctggatcgatccgcagagcccttacgccaagccgatcttccaggaagacaagaagttcgtgttctattgcgctggcggtctgcgctcggcgcttgccgccaagaccgctcaggacatggggctgaagccggtggcgcatatcgaaggcggtttcggcgcatggcgtgacgccggcggcccgatcgaagcc

SEQ ID NO: 44531 - DNA, 717 bp, Rhodopseudomonas palustris
aagacggcattgatcaccggcggcaacagcggcatcggtcttgcgaccgccaagctgttcgtgaccgaaggcgcacgcgtgacgatcaccggccgtgatcgggcgagactggatgcggccgcgcgcgagctcggcgcgcaggcgctcgcggtcgaggccgatgtcaccgacgtcgccgcgatcgagaacgcggtcgcccgtgcggcggagcggttcggcaagctcgacatcgtgttcgcgaatgcgggtatccccggcgcgacgccgctcggcggcacttcgctggcggcgttcgagcaggtgatccgcaccaatctgacggcggtgttcttcaccgtgcaggctgcgctgccgtatctgaacgacggcgcctcgatcattctcaacggttcggtgatctcggtgctcggcaatccgggctttgcggcctacgcggcgagcaaggccgggctgcgcggaatggcgcgggtgatggcttccgaactgtcgccgcgcaacatccgcgtcaacgtggtggcgccgggcggggcgcggacaccgatctggaaggacaccgcgccgaccgatcaggcgatggccgtgctcgaaaagcggatcgcggcggcaacgccgctcggccggatcgccgagccggagcacatcgccaagaccgtgctgtttctcgcctccgacgatgccgcccacatccagagcgccgaaatcttcgtcgatggcggc

SEQ ID NO: 44532 - DNA, 1059 bp, Rhodopseudomonas palustris
atgcagatcggcatgatcggcctcggccggatgggtggcaatatcgtccggcgcctgatgaaggatggccatcatgccgtggtgtacgacagggacccgcaagcgatcgaaacgctgacgcgcgaaggcgcaaccggcgccggcgggctcgaagacctggtgcgcaagctcgacgcgccgcgcgcggtgtgggtgatgctgcccgccggacagatcaccgagaccaccatcgaacagcttgccaagctgctcgccgccggcgacgtcgtcatcgatggcggcaacaccttctggcaggacgatatccgccgcgccaagacgctgaaggaaaccagcatcgactacgtcgatgtcggcacctccggcggcatctggggcttcgagcgcggctactgcatgatgatcggcggcgacaaagccgtcgtcgaccggctcgatccgatcttcgctacactggcgccgggcatcggcgacatcccgcgcacgccgggccgcgacgatcgcgatccccgcgtcgagcagggctatctgcacgccggcccggtcggcgccggccatttcgtcaaaatggttcacaacggcatcgaatacggcctgatgcaggcctatgccgaaggcttcgacattctcaagaacgccagcagcgactccctgcccgaagcgcaccgcttcgatctcgacatcgccgacatcgccgaggtctggcgccgcggcagcgtgatcccgtcctggctgctcgacctcaccgccaccgcgctggcgaaaaacgatcagctcgacaactactcgggcttcgtcgaggactcaggcgaaggccgctggaccatcaacgccgcgatcgaagaagcggtaccggccgaagtgctcaccgccgcgctgttcgcgcgtttccgctcgcgacgggagcatacgtttgcggagaaaattctctcggcgatgcgggcgggcttcggcggccacaaggagccgcagcagcatcctgagccggagcagcaagccgctccgcagcaaaaactgaaaccgaaagcggagcgcgcgtgaccacgcaagccaacagca

SEQ ID NO: 44533 - DNA, 1482 bp, Rhodopseudomonas palustris
caggtccccgaaggctgcgcgttcgtcatcttcggcgccaccggcgacctcacccatcggctggtgattccggcgctctacaacctcgccgaagccaacctgctgcctgaaaaattctgcgtcgtcggcgtcacccgcaaggagatgtccagcgacgatctgcgcgacagcctgatgcagggcctgcgcaaatacgcgacccgcccggtcgacgacaaggtcgctgatcagcttctgtactgcgtcaccgcggtcagcgccgatcccagcgagccggcctcgttcgagcggttgcgcgagcggctggagaagctcgaggccaatcgcaacaccggcggcaaccggctgttctatctcgccacgccgcctgatgcgttcgcgccgatcgccaccgagctcggccgcgccgggctgcttaaggagaccagcggcgcctggcgccggctggtggtggagaagccgttcggcaccgacctcgcctcggccaaggcgctgaacgatcatctgctcagcatcatctccgagcacgagctgtaccggatcgatcactacctcggcaaagagacggtgcagaacatcctggtgctgcggttctccaacggcatgttcgagccgatctggaacagagagcacatcgaccacatccagatcaccgtcgaggaaaagctcggcgtcggccatcgcggcagcttctacgacaagaccggcgcgctgcgcgacatggtgccgaaccatctgtttcaactgctgtcgctggtggcgatggagccgccggcgcatttcaacgcccacgcggtgcgttcggccaaggccgacgtgctcgcggcgatccagatccaaaccgaagaggaagcgctgcgcaattcggtgcgcggccaatacacttcgggcaagatcggcgacaccgacatcccggactatcgcagcgccaaggacgtcgcggccgacagcaccaccgagaccttcgcggcgctgacactgtcgatcgacaattggcgctgggccggcgtgccgttctatctgcgcaccggcaaggcgctgtcgggcaagcgcaccgaggtggcgatcaaattcaaggaggcgccattctcgatgtttcgctgcaccccggtgcaggaactgtcgcagaactttctggtcattgggatcgaaccggtcgaaggcatctcgctgcagttcaacaccaaggtgccgggaccgatgatcgccatcgacggcgtcgagatgaccttccgctacaaggactacttcaaggtggcgccgagcaacggctacgagacgctgctgcacgactgcatgatcggcgacaacatcctgttccaacgcgccgacggtgtcgaagccggctggcgcgcggtacaacccttcctcgacgcctggaagaaggccggcgcgcacggccttcagatctatcgcgccggcagcgatggcccggaagacgccgacgaactgctggggcgcgacggtcgcaattggcggaag

SEQ ID NO: 44534 - DNA, 486 bp, Rhodopseudomonas palustris
atgggcgtctccggctcgggcaagagcacggtcggcgaagcgctcgcccagcgcctcggctggcgctacgaggacgcggacgcctatcacccgaaagccaacgtcgcgaagatgagcgccggccagccgctgaccgacgacgatcgctggccttggctcaaggcgatcgctgccgagatcgaccgcgtcatcgccggcggcggccacatcgtgttcggctgctcggcactgaagggcgcctatcgcgacgtgctggtgcatggccgggacgacatccggatcgtgtttctcgacggcagccgcgagctgatcggcggccgaatggcggcgcgcaagaaccacttcatgccggccggcctgctcgacagccagttcgcgacgctggagcgccccggcccggacgaacgcccgatcatcgcctcaatcgacgcgcccgtagcaacgatcgtcgatgacatcgtcggtcagcttccgacgtcgaccagc

SEQ ID NO: 44535 - DNA, 1647 bp, Rhodopseudomonas palustris
gacagaccggacgcggaaacttccgacgaactctggtacaaagacgccatcatctaccagttgcacgtcaaggcgttcgccgacagcaacaatgacggcatcggcgacttcgcgggtctcaccgagaagctggattatctgcaggagctcggcgtcaacacgctgtggctgctgccgttctatccgtcgccgcagcgcgacgacggatacgacatcgccgactacggatcgatcaatcccgacttcggcacgatgaaggacttccgccgcttcatcgtcgaggccaagaagcgcaatctccgggtcatcaccgagctggttatcaaccacacctcggatcagcacgcctggttcaagcgggcgcggcgcagcccgaaagactccagcgcgcgcgactggtacgtctggagcgacaccgaccagaaatatctcggcacccggatcattttcaccgacaccgagaaatcgaactggacctgggatcccgaggccggccagtattactggcaccggttcttctcgcaccagcccgatctcaacttcgacaatccgcgcgtcgtcagcgccgtggtcaaggtgatgaaacgctggctcgacaccggcgtcgacggcttccggctcgacgcgatcccgtatctgtgcgagcgcgacggcaccaacaacgagaaccttcccgagacccacgccgtcatcaagcggctgcgcgccgagctcgacgcctacgccaagggcaagctgctgctcgccgaggccaaccaatggccggaggacgtgcagcagtatttcggcgatggcgacgagtgccacatggcctaccacttcccgctgatgccgcggatctatatggcgatcgcgcaggaagaccgcttcccgatcaccgacatcatgcggcagacgccggagattcccgcgaactgtcagtgggcgatgttcctgcgcaaccacgacgagctgacgctcgaaatggtcaccgacgtcgagcgcgactatctgtggaagacctacgcggccgatccgcgagcgcggatcaacgtcggcatccgtcgccgcctcgcgccgctgatggacaatgatcgccgcaagatcgaactgatgaactcgctgctgatgtcgttccctggcacgccgatcatctactatggcgacgaaatcggcatgggcgacaacatctatctcggcgaccgcaacggcgtgcggacgccgatgcagtggtcgcccgaccgcaacggtgggttttcgcgggccgacccggcacggctgtacgcaccgccgatcatggaccccgtgtacggctacgcctcggtcaacgtcgaagcccagcagcgcagcctttcgtcattgctgagcgcgatgaagcgcttgatcgcggtgcgcaaatcgacgccggcgttcggccgcggcagcatcaccttcatccgtccgagcaaccgcgcggtgatcgcctacgttcgccaatacaaggacgaggtcattctgtgcgtcgccaatctgtcgcgtgccgcgcaggcgaccgaactcgacctgtcgccgtggaaggaccgcgtgccgcaggagatgctcggccgcaccaaattcccgccgatcggcgatccggcctacatgatcacgctggcgcccttcggcttctactggttcaagctgcaggag

SEQ ID NO: 44536 - DNA, 2164 bp, Rhodopseudomonas palustris
cgccgcctcccgaggagcttccatgaccgtgcaattgagcgacgaagcctacgcagttgtcgaaggccgtcatgccgaccctttccgctatctcggcgcgcaccctgaggatggcggcaccatggtgcgcgtgctgctgccggatgccgttgcggtcgaggtgatcggcgacaatggcgacgttgcgccgctcgaccaggcgcatccggccggcctgttcgtcggacctctgcccggcgcttcgccgcgctacacgttgcgcgcacggttcggcgacaccacggtcgagctgcaggacccctaccgcttcccgccgatcctcagcgatttcgatctttacctgctcggcgaaggcaccgaccaacgactttacgacaagcttggcgcccatccgatggagctggaaggtgtcgccggcgtcggcttcgtggtgctggcgccgaacgcgcgccgcgtcagcgtggtcggcgatttcaacttctggaatccgctgcgccaccagatgcgggtgcgcggcagcggctattgggagttgtttgtcccgggcgcccgcgccggcgatcactacaagttcgatctcgccggaccgaacggcgaacaactgccgcagaaggccgaccccttggcattcgccgccgagctgcggccgaagaccgcctcgatcgtggtcgacgccaccacgctgccacgaccacggccggcgccggagaacatcaacgcgctgtcggcgccgatgtcgatctacgaggtgcatctcggctcgtggcgccgcaaggaaggcgaccagtggctgacctatcgcgaactcgccgagcaactgccggcctatgtccgcgacatgggctttacccacgtcgaattcctgcccgtcagcgagcatccgttcgacggctcgtggggctatcagccgaccgggctgtacgcaccgacctcgcggttcggctcgcccgaagacttctgtgcgctggtcgacgcctgccatgccgcgggcatcggcgtgatcctcgactgggtgccgggccatttcccggacgatccgcacggcctcggcaatttcgacggcaccgcgctctacgagcacgccaacccgatgcagggtcggcatctcgactggggcacgctgatctacaattacgggcgaaccgaggtcgtcaatttcctcaccgcgaacgcgctgttctggctggagcgttacggaatcgacgggctgcgcgtcgatgccgtggcatcgatgctgtacctcgattacagccgcccggccggcggctggatcccgaacaaattcggcggccgtgagaacatcgaggcgatcgacttcattcgccgcttcaacactgaagtgtacggcaaattcccgcactccaccaccgcagcggaggaatccaccgcctggccgcaagtgtcgcgcccgatcgaattcggcgggctcggattcggctacaagtggaacatggggtggatgcacgatacgctgaactacatcagcaaggatccgattcaccgcaaatatcatcacggccagatcctgttcggactgcactacgcgttctcggagaatttcattctgccgctgtcgcacgacgaggtcgttcacggcaaacgctcgatcctcggccggatgccgggcgatgagtggcaacgctttgcgaatttgcgcgcctactatgcgttcatgttcggccatcccggcaagaagctgctgttcatgggcagcgagttcggccaggagcgcgagtggagccacgatcgctcgctcgactggcatctgctggagtatccgaaatattccggcatccaggcgctgctgcgcgacctcaacaagctgtacaggtcgctgccggccctgcatcagctcgattgcgatccgttcggcttcgaatggctgatcaccgaagacgccaaccgcaacctgttcgcctggatgcgcaagggcaacgatacccgcgcccgctgtctggtcatcgtcaacttctcaccgaacgtctaccaggactatcgcgtccgcgtgccgttccccggccgctggcgcgaagtgttcaattcggattcggccggctacggcggcaccaatgtcggcaatggcggcgaagtccgcaccctggagggtctggtgcctgagctcagcctgacgatcccgccgctggccgcgatcttcctgacgccg

SEQ ID NO: 44537 - DNA, 1998 bp, Rhodopseudomonas palustris
gctatgcgcctcaccgccggaaccgactcccgtctcggagcgacctgggacgggcgcggcaccaacttcgccctgttctccgccaacgctcacaaggtggagctctgcctgttcgacgcccagggccggcgcgagctggaacggatcgaactgccggagcgcaccgaagacgtctggcacggctacctcaacgacgtctcgcccgggcagctctacggctatcgggtgcatggcccgtacgatcccgatcgcggccatcgcttcaacgctcacaagctgctgctcgacccctatgcgaagcggctgaacggacggctggtgtggagcgaggcgcacttcgcctatcgcaccggctcgccacgcgaggacctgtcgttcgaccgccgcgacaacgcgcgcggcatgccgaaggtcgtcgtggtcgacgagaccgtcggcagcggccgccgcgagacgcggcccggtgtgcgctgggaagacaccatcgtgtacgaggcccacgtcaaaggcctgacccagcttcgcgacgatgtaccgcccggactgcgcggcaccttcggcggcctcgcctgcccgaccatgatcgcacatttgaagcggctcggcgtcaccacgattgaacttttgccggtccaaggctttgtcgatgaccgcgtcctggtcgagaagaagcttgtgaactactggggatacaacaccatctcgttcttcgcgccggaggcccgttacgcgccggacaaagacaatccactggactcgttccgcaccaccgtggcgcggctgcacgatgccggcatcgaggtgctgctcgatgtggtctacaaccacaccgccgagggcaatcatctcgggcccacgctgtcgttccgaggcatcgacaacgcctcgtactactggctgaagcccgacaacccgcgctactacgacgacttcaccggctgcggcaattcgatgaacctcacccatccgcgggtactgcagatggtgatggacagcctgcgctactgggtcgaagtctgccacgtcgacggctttcggttcgatctcgccaccacgctggcacgcggctcgaacggcttcgatcgcaactcgggtttcttcaccgcgatccgtcaggatccaatcctggcaggcgtcaagcttgtcgccgagccgtgggatctcggcatggggggctatcaggtcggtgcgttcccgtcacaatggtcggagtggaacgaccgctatcgcagcgtgatgcgacgttactggagcggcgaaggcagcctgatcggcgaagtgtcgcggcgcatgacgggctcgtccgatatgttcaatcgcgacggccggatgccgcgcgcaagcatcaaccacgtcaccgtgcacgacggcttcacgcttgccgacctgttcagctacgagcgcaagcacaacgttgccaacggtgaggacaaccgcgacggctccaacgacaatcacagcatcaactgcggcgtcgaaggtccgaccgacgatccgaagctcctcgggatgcgtcgccagctccgcaagaaccagctcgcctgcctgttcctggcgcagggcgtgccgctgctgctcgccggcgacgaggtcggcaattctcaggccggcaacaacaacgcctattgccaggacaacgagatcggctgggtcggctgggacgggaccaacaccgaagacgacatggtggaattcgtcggactgatgaccgatatccgccgccgcttcccgcagctacgctcgcggcgctggctcgacggacgccgcgccgacggctcctacggcgtgctgtggctaacgccgtccgccgccgaaatgaccgatcaggattgggcgttcccggatggccgcttcctggcttacgtgctcagcccgagcgagccgggcggcagcgcgatcttcatcgtgctgaattcgggcgtgcaggagatcgaattccacctgccgaagctgccggaatatcagacctggaaagaactgttcgacaccaccaagaac

SEQ ID NO: 44538 - DNA, 1050 bp, Rhodopseudomonas palustris
atgaggagctttcgcgtcaccgatttcggcaagccgctgagcgaagacaaccgaccgacgccggaactgaccggcacgcaagtgctggtccgcgtcaaggccgccggcatctgccatagcgatctgcacatctgggaaggcggttacgaactcggccacggccgcaaaaagttgtcgctcgccgatcgcggcgtcgcattgccgctgacgatgggccacgagaccgtcggcgagatcgtcgccgccggccccgacgccaaggatgccaagatcgggcaggtcgcgctggtgtatccgtggatcggctgcggcgaatgcgacgtctgcaaggccggcgacgagaatatgtgcctgaagccgcggtttctcggcgtgtattgcgacggcggctactcggacgaactgatcgtgccgcatccgcgctatctgctcagccttgatgggctcgatccggtgaccgcagcgccctatgcgtgctccggcatcaccacctacagcgcgctgaagaagctcgacttctgcctcgacagcccgatcgtgatcttcggtgccggcggactcggattgatggcgctggagctgctcaaggcgatgggcggcaagggcgccatcatggtcgatatcgatgcggccaagcgcgaggcggcgcagaaggcgggcgcgcttggcgcggtcgatggcgccgcgccggacgcgctggcgcagattgcggccagcgccaaaggtccggtgcgcggtgcgctggatctggtcggcaatccgcagaccgcgcagctcggcttcgattgtctcaccaagggcggcaagctggtgatcgtcggtctgttcggcggcggcgcgccgtgggcactgccgttcatcccgatgcgcgccatcaccatccagggcagctatgtcggcaatctcgccgaaacccaggaactgctcgacctcgtccgcgccaagaaggtgtcgccgatcccggtcaccaaggtggcgttgccgcaggcttacgatgcgctcatcgatctgcagaagggcaagctggtcggtcgcgcggtgctgacgccg

SEQ ID NO: 44539 - DNA, 1608 bp, Rhodopseudomonas palustris
attggcacgcccaacagccgatgacaaagacaagggagacacgacgccatgactgccgagctcaacgcctttccgaccgcaggcacgcagacattgcgggcgctggcgcgctatccatcgcgcaccgcgttcgcctggcccggcggcagcttgagctatcgcggcgccaccgacatgatcggcagcatccagaaggtgttcatggggctcgacctgcagcccggcacgcgggtcgcgctgctcaccgccaatcgcgccgagacttggtgcgccggcgtcgcggcgcagctctgccgtttcgccatcacttggctgcatccgctcggctcgcgccaggatcagctcgatcagatcgaggactccgaagcagccgtgctgatcgtcgacgccgccgcctttctggaacgcggcggcgagcttgccgcccaggccagcggcttgcgccacgtcttcaccatcggccgcgccggctacgggctcgatctgctcaccgcgctggagcaggccggcagcgccacagcgcgcgacttcgcgcagctcgatgatgtcgccgtgctgaactacaccggcggtactaccgggaaatccaaaggagcgctgcgccaccatcgcgagaacgccggcttcgccaatgcgatcctggccgatttcgaaatcccgttcgatccgcgctatctcacggtggcgccgatcagccacgtcgccggcaccaaggtgctgccgtcgctgatccgcggcggcaccatccacatgatgaaggggttcgatccggaagcggtgctgcagacgatcgagcgcgagaagatcaacttcacgctgttcgtgccgacgatggtctacgtgctgctcgatcatccggcgctcgccaagaccgatctgtcgtcgctcgacctggtgctgtacggcgcctcgccgatgtcgccgacgcggctggtcgaaggcatcgagcggatcgggccggtgttctcgcagctctacggccagaccgagtgctacccggtctcggtgctgcgcaaggccgatcacgatccgaagcagccggagctgtttttgtcgtgcggcttcccgatcgcggcctgcgacgcccggattctcgacgagaacgatcaggaagtgccgctcggcgaggccggcgagatctgcgtgcgcgcgccgcacgtgatggcggaatattggaagcgcccggagcagaccgccgaaacgctgaagagcggctggctgcacaccggcgacatcgccaagcaggacgaccgcggctacatgtacattctcgaccgcaagaaggacatgatcgtgtcgggcggcttcaacatcttcccgcgcgaggtcgaggatgtgttgtcgacgcatcgggacgtcgcgatggtcgcggtggtcggcgtgcccgacgacaaatggggcgaagccgtcaccgcggtggtcgtcgccaagcccggcaccaagcccgacgagcgcgagttgatcgagctggtcaagacccgcaagggctcggcgcatgcgccgaaacaggtgcagttcgtcaccgagttgccgatgaccggcgtcggcaagatcgacaagaaagtgctgcgcgccggcttctgggccggtcgggatcggatggtgggg

SEQ ID NO: 44540 - DNA, 1377 bp, Rhodopseudomonas palustris
tcctttcaggaattcggcctcgccgatccgatcgctcgcgctcttcaggaagaaaactaccacaccccgacgccgatccaggcgcagaccatccccctcgccctcgccggccgcgacgtcgtcggcatcgcccagaccggcaccggcaagaccgcctcgttcgcgctgccgatcctgcaccgcctgctgcagaaccggatcaagccggcctccaagacctgccgcgtgctggtgctgagcccgacccgcgagctttccgggcagatcctcgacagcttcaatgcctatggccgccacgtccatctcagcgccgcgctggcgatcggcggcgtgccgatgggccgccaggttcgcagcctgatgggcggcgtcgacgtcctcgtcgccaccccgggccgcctgctcgacctcgtgcagggcaacgcgctgaagctgacccaggtcgaattcctggtgctggacgaagccgaccgcatgctcgacatgggcttcatcaacgacatccggaagatcgtcgccaagctgccgatcaagcggcagacgctgttcttctcggccaccatgccgaaggacatcgccgacctcgccgagcagatgctgcgcgaccctgcccgcgtggcggtgacgccggtgtcctcgacggtggagcggatcaaccagcgggtgatccagctcgaccattccgccaagccggccgcgctcgcccagatcctcaaggacgacaaggtcaatcaggcgctggtcttcacccgcaccaagcatggtgccgacaaggtggtgaagggcctcgcccgggccggtattaccgccgacgcgattcacggtaacaagtcgcagaactaccgcgagcgcgtgctggcggcattccgcaccggcgaattgcgcaccctggtagcgaccgatatcgccgcgcgcggtatcgacgtcgacggcgtgtcgcacgtggtcaacttcgatctgccgaatattcccgagacctacgtccaccgcatcggccgcaccgcgcgcgccggagcggacggcactgcaatctcgctttgcgccggcgaagagatggcgtatctgcgcgacatcgaaaaactcatcaaggtgtcgttgccgaaggaagatcgccgtaccccgggcgcccacgctgctcccaccccgccgccgcatcgcggcccccgtcaagcgccccacggccattctccgcgcaatggcgatgcaccgacgcggggaaagaatcatcggcgccgcggtcccgcagccgggcctgcccgccagtcggacgccagccgccacgaggcggcgccgcgaccgcagcacggtggcaacggtgagggactgcagggcgtggcgtttttgcagcgcaaaaaccgtccggcgcagccgaccgct

SEQ ID NO: 44541 - DNA, 1464 bp, Rhodopseudomonas palustris
ttcgtcatggccatcgatcagggcaccacctcgtcgcgggcgattctgtttcgttccgacatttcgatcgcggcctccgcgcagcaggaattcccgcagcatttcccggcgtccggctgggtcgagcacgagcccgaggacatctgggcgacgaccattgctacctgtcgcgctgcgatggacaaggccggcgcgaccgccgccgacatcgccgcgatcggcatcaccaaccagcgcgaaaccgtggtggtgtgggacgcggtgtccggccaggcgatccaccgcgccatcgtctggcaggatcgccgcaccgcggagttctgcacccggctgaaggccgacgggctggagccgatggtcaccgccaagaccgggctgatcatcgatccgtatttctccggcaccaaggtcgcctggctgctcgacaacgtgcccggcgcacgcgctcgcgccgagcgtggcgagctgaaattcggcaccgtcgattgctatctgctgtggcggctgaccggcggcaaggtccacgccaccgacgccaccaatgcgtcgcgcacgctgctgttcaacatccacgacggcgcctgggacgacgagctgctcaagctgctcggcgtgccgcgctcgatgctgccggaggtgaaggattcatcggcgcatttcggcgacagcgtgccggagctgttcggcggctcgatcaccatccgcggcatcgccggcgaccagcaggcggcgaccatcggccaggcctgcttcaccccgggcatgatcaaatcgacctacggcaccggttgcttcgcgctgctcaacaccggcgcgacgccggtgaagtcgaacaacaagctgctgaccacggtcgcctatcagctcgacggcaagcgcacctatgcgctcgagggctcgatcttcgtcgccggcagcgcggtgcaatggctgcgcgacggcctcggcgtcatcaagcacgcctccgagaccgggccgctcgccgataaatcggattcggcgcagagcgtgtatctggtgccggcgttcgtcggcatgggcgcgccgtattggaatccgcgggtccgcggcgcgctgttcggcctgacgcgcaacaccggcccggccgaactcgcccacgccgccctggagagcgtgtgctaccagaccttcgatctgtgggcggcgatgcgggccgactggccggatgccgacgccgccaccaccgtgctccgcgtcgacggcggcatgaccgcctcggactggaccatgcagcgtctcgccgatcttttagacgcgccggtcgatcgcccggtgatccaggaaaccaccgcgctcggcgccgcctacctcgccggcctcagtgcaggcgtcttccccgagccgcaaaaattcgccgacaactggcgcctcgaccaccgcttccgccccgcgatgagcgcagcgacgcgcgagcgtaaattggcgggctggggcagagcggtg

SEQ ID NO: 44542 - DNA, 1506 bp, Rhodopseudomonas palustris
cgcgtcaccgcgtcgggcaagaagctcaacgaccaggagaagtggaagcgcgaacagcatccgttcgacgcctatgcccggctgaagcagcaggcgaaggataacgccgcaccgaagccggcggacaatttccgctggcgctactacgggctgttctacgtcgccccggcacagacctcatatatgtgccgcctgcgcattcccaacggcatcctgacatcgtggcagatggccggcctcgcctatctcgccgacacgctcgccgacggctacgcgcatgtgacgacgcgcgccaatctgcagatgcgcgagatcgcgccaaaggatgcggtgcaactgctgcagggcatcgagagcttgggtctgtgggcgcgcggctccggcgccgacaacatccgcaacgtcaccggctcggcaaccgctggcatcgacccgcaggagctgatcgatacgcgagcttacgcccgcgactggcatttctacatcctcaacgagcgcgcgctgtttggcttgccgcgtaagttcaacgtcgcgttcgacggcggcgggctgatcccgacgctggaagacaccaacgacatcgcgttccaggcggtgacgatcggcgacggccacggcgtggcgcccggcgtgtacttccgtctcgcgctcggcggcatcaccggccacaaggactttgcccgcgacaccggcgtgatcgtggcgcccgacgaggcgaccgaggtcgcggatgcgatcgtgcgggtattcatcgagcacggcgaccgcaccgaccgcaacaaggcgcggctgaaatacgtgctcgatgcgttcggcttcgacaagtacttggagcttgtggaggacaaactcggccgcaaactgatccgtgtgccggccgaggccgctgcgccgcgccccgcacaggatcgcgccgcgcatctcggcgtgcatccgcagcagcaggccgggatgaactggatcggcgtccgtctcgccaccggccatctcacttccgttcagatgcgcgggctcgccgagatcgcgcgcagcttcggcgacggcgatctgcggctgacggtgtggcagaacctattgatctccggcgtgccggatgcgcgcgtaaccgacgccaccgccgcgatcgaggcgctgggactggcgatcaccgcctcgccactgcgcgccggactgatcgcctgcaccggagccagcggctgccgcttcgccgccgcgcataccaaggagaccgcggaagcgatcgcgcaatattgcgagccgcgcgtgccgctcgacacgccgatcaacatccatctcaccggctgtcataactcctgcgcgcagcacttcatcagcgacatcggcctgatcggcgccaaggtcgcggtctcggatgaagacagcgtcgaaggctttcacatccatgtcggcggcggcttcggcgttgatgcggcgatcggcaccgaggtgctgcgcgacgtcaagcaggacgacgcaccacgcgtgatcgagcggatgctgcagacc

SEQ ID NO: 44543 - DNA, 742 bp, Rhodopseudomonas palustris
ctctctggcaaggtcgccgtcgtcaccggctcgtcgcgcggcatcgggcgggcgtcggcggagctgctggccaagctcggcgccaaggtggtgatctcgagccgcaaggctgacgcctgcgaggaagtcgccgaaggcatccgcaaggagggcggcgacgcgcacgtcatcgcctgcaacatctcccgcaaggccgaggtcgacgggctgatcgacggtgccaccgcgaaatacggcaaggtcgacatcctggtctgcaacgccgcggtgaacccgtattacggtccgctgctcgacattgcggacgaagcgttcgacaagatcatggcgtcgaacgtcaagagcaacatctggctgtgcgcccgcgatcccgcagatggcggaacgcggcaatggctcggtggtgatcatctcgtcgatcgggggcttgcgcggctctaccgtgatcggcgcctacggcatctcgaaggccgccgacttcgcgctgtgccgcagcctcgccggcgagtggggccccaagggcgttcgcatcaacgccatcgcgccgggcctggtcaaaaccgacttcgctcgcgcgctgtgggaagacgaggccaacctgaagcgtcgcaccgccggcaccccgctgcgccggatcggcgaaccgcacgaaatcgccggggccgttgcgtatttgggctcggatgcctcgaccttcatgaccggccagaccatcgtgatcgacggcggcgtcacgaccgca

SEQ ID NO: 44544 - DNA, 1101 bp, Rhodopseudomonas palustris
atggattttgatttgtcggaggagcagcgcctcctcaaggaaagcgtcgaaggcctgctgaagggctcctacgatttcgacagccgcaagaagtacgccaaggagaagggcggctggagccgcgcggtgtggggcaagttcgccgagcagggcctgctcggcctgccgttctcggaagaagacggcggcttcggcgccggcgcggtcgagaccatgatcgtcatggaggcgctcggccattcgctggtgctcgaaccctatctgccgaccgtggtgatcggcggaggcttcctgcgccgtgctggttcggccgcgcagaaggccgcgcatttgccgggcattatcgacggctccaagaccttcgcattcgcccagctcgaaaagaactcccgctgggatctcggcgacgtctccaccaccgccaagaagagcggcgacggctgggtgatcgacggcgagaagttcgtggtgttgaacggtgaggccgccgacacgctgatcgtcaccgcccgcaccaagggcggccagcgtgaccgcaccggcgtcggcgtgttcctggtgccggccgatgccaagggcatcacccgcaagggctatccgacccaggacgggctgcacgccgctgacatcaccttcaccggcgtccaggtcggcgccgatgcggcgattggcgatccggagaacgcgctcgagctgatcgaggcggtggtcgacgatgcccgcactgcgctgtgcgccgaagcggtcggcctgatggatgaatcgctcactaccacggtcgagtacatcaagacccgcaagcagttcggcgtgccgatcggctctttccaggtgctgcagcatcgcgccgccgacatgttcgtcgccaccgaacaggcccgctcgatggcgatgttcgccaccatggcggccgagttcgacgacgccaaggaacgcgccggcgcgatcgcggccgccaaggtgcagatcggcaagtccggcaagttcgtcggccagcagtcgatccagctccacggcggcatcggcatgacgatggaagccaagatcggccactacttcaagcggctgaccatgatcgagcagaccttcggcgacaccgat

SEQ ID NO: 44545 - DNA, 1188 bp, Rhodopseudomonas palustris
atggatctgaatttcagcaaggaagagatcgcgttccgcgacgaggtacggcagttcttcaaggacaatgtgccggccaagacgcggcagaaactgatcgaaggccgccacaacaccaaagaagaaatggtcgagtggtaccgcatcctcaacaagaagggctgggcggtgacgcactggccgaaggaatatggcggcaccggctggagctcggtgcagcactacatcttcaatgaggagctgcaggccgcgcctgcgccgcagccgctcgccttcggcgtctcgatggtcggcccggtgatctacaccttcggcagcgaggagcagaagaagcgcttcctgccgcgcatcgccaatgtcgacgactggtggtgccagggcttctccgagccgggctcgggctccgacctcgcgtcgctcaagaccaaggcggagaagaagggcgacaagtggatcatcaacggccagaagacctggaccacgctggcgcagcacgccgactggatcttctgcctgtgccgcaccgatccggccgccaagaagcaggaaggcatttccttcatcctggtcgacatgaagaccaagggtatcaccgtccgtccgatccagaccatcgacggcgggcacgaagtcaacgaagtgttcttcgatgacgtcgaagtgccgctggagaatctggtcggccaggagaacaagggctgggactacgccaagttcctgctcggcaacgagcgcaccggcatcgcccgggtcggcatgtcgaaggagcggatccgccgcatcaagcagctcgccgcccaggtcgagtctggcgggaagccggtgatcgaagaccccaagttccgcgacaagctggcggcggtcgagatcgagctgaaggcgctcgagctcacccagctccgcgtcgtcgccgatgaaggcaagcatggcaagggcaagccgaacccggcttcgtcggtgctgaagatcaagggctccgagatccagcaggcgaccaccgagcttctgatggaagtgatcggcccgttcgccgcgccgtacgacgtccatggcgacgacgattcgaacgagacgatggattggaccgcccagatcgcccccggttacttcaacaatcgcaaggtctcgatctacggcggctccaacgagatccagcgcaacatcatctgcaaggcggtgctcgggctg

SEQ ID NO: 44546 - DNA, 1179 bp, Rhodopseudomonas palustris
atgaccgaggccgttatcgtttcaaccgcgcgcacgccgatcggcaaggcgtatcgcggcgccctcaacgccaccgagggtgccacactgctcggccacgccatcgagcacgcggtgaagcgcgccggtatcgacccgaaggaggtcgaggacgtggtgatgggcgcggcgatgcagcagggcgccaccggcggcaacatcgcccgcaaggcgctgctgcgcgccggcctgccggtgactaccgccggcaccaccatcgatcggcagtgcgcctccggcctgcaggcgatcgcgctcgccgctcgctcggtgctgttcgacggcgtcgagatcgcggtcggcggtggcggcgagtcgatctcgctcgtccagaacgacaagatgaacaccttccacgccgtcgatccggcgctcgaggcgatcaagggcgacgtctacatggcgatgctcgacaccgccgaaaccgtggcgaagcgctacggcatctcgcgcgagcgccaggacgagtattcgctggaaagccagcgccgcaccgcggctgcgcagcagggcggcaagttcaacgacgagatcgcgccgatctcgaccaagatgggcgtcgtcgacaaggccaccggcgcggtgtcgttcaaggatatcacgctgtcgcaggacgaaggcccgcggccggaaaccaccgctgaaggtctcgccggtcttaaggccgtgcgtggtgaaggcttcaccatcactgccggcaatgccagccagctgtcggacggcgcctcggccacggtgatcatgagcgacaagacggcggccgcgaagggcctcaagccgctcggcatcttccgcggcatggtctcctacggctgcgagccggacgagatgggcatcggcccggtgttcgcggtgccgcgcctgttgaagcgccatggtctcagcgtcgacgacatcggtctgtgggagctgaacgaagccttcgccgtgcaggtgctgtactgccgcgacaagctcggcatcgatccggagaagctcaatgtcaacggcggcgcgatctcggtcggccacccctacggcatgtcgggtgcacgcctcgccggccacgcgctgatcgaaggccgtcgccgcaaggcgaagtacgcggtggtcacgatgtgcgtcggcggcggcatgggctccgccggcctgttcgagatc

SEQ ID NO: 44547 - DNA, 1542 bp, Rhodopseudomonas palustris
ctggcgcaggccgcgaaggactatgcgtcgcggccggcgttggagtttcgtgatcggcagatcacctacaccaagctcgaagcgatggccgagaccgcggcagccgcgctgctcgcagcaggctatggccgcgactcctcggtcgcgctgtatatcggcaacacgccggaccatccgatcaatttcttcggggcgctgaaggccggcgcccgcgtcgtgcatctgtcgccgctcgatggcgagcgggcgctatcgcacaagctcagcgactccggcgcgcgggtgctgatcacaaccgattccgccgcgctgctgccgatggccgagaggtttctcgccaaggggctgctcgatcgcctgatcgtgtgcagcgatgcgagctggggcgagtccgcgacgccactggcgccgctgcccagcgatccgcgggtgattacttacgccgacttcatcaagggcgcctccaagcccatggcctggccggcgattgtgccggacgatatcgcgctgttgcagtacaccggcggcaccaccggcctgccgaagggcgcgatgctaacccattcgaatctgacctcggcggtggcgatctacgacgtctggggtctggtgcgcgccaacagcggcggcattcatcgcgtgatctgcgtgctgccgctgttccacatctacgcgctcaccgtcatcctgctgcgctgcctgaagcagggcgacctgatctcgctgcatcagcgcttcgacgtcgccgcagtgttccgtgacatcgaggaaaagcgcgccaccgtgtttcccggcgtgccgacgatgtggatcgcgctcgccaacgatccgtcgctggagaagcgtgacctgtcgtcgctgacgatggccggctccggcggcgcgccgctgccggtcgaggttgcgcggctattcgagcgcaaaaccaatctgaagctgaagagcggctggggcatgaccgagacctgctcgcccggcaccggccatccgccggaagggccggataagccgggctcgatcggcctgatgctgccgggcatcgaactggacgtcgtcgcactcgatgatccgaagcgcgtgctaccgccgggcgaagtcggcgagctccgcgttcgcggtcccaatgtcaccaagggctattggaatcggccggaggagtccgcccacagttttgtcggcgatcgttttctgaccggcgacatcggctatatggaccaggatggctacttcttcctggtcgaccgcaagaaggacatgatcatctccggcggcttcaacgtctatccgcagatgatcgagcaggcgatctatgagcacccggcggtgcaggaagtgatcgtgatcggcgtgccggacgattaccgcggcgaggcggcgaaagcgttcgtcaagctgcgcgagggcgccaagccgttcagcatcgacgagctgcgcgccttcctcaccggcaagctcggcaagcacgaactgccgaccgcggtggagtttctcgacgaactgccgcgtaccacggtgggtaaactgtcccgccacgaactgcgc

SEQ ID NO: 44548 - DNA, 1587 bp, Rhodopseudomonas palustris
ttcgacaccatcgtggtgggcgcgggcaccgcaggttgtatcgttgccaaccgcctatccgccgatccgagccggaaggtgctgctgctcgaagccggcggccgcgacaactggatctggtttcacattccggtcggctatctgttcgcgatcggcaatccgcgctccgactggatgttcaagaccgagcccgagccgggcctgaatggtcggtcattggcctatccgcgcggcaaggtgatcggcggctcctcggcgatcaacgcgatgatctcgatgcgcggccaggccgccgattacgaccattggcggcagctcggcctcaccggctggggctgggacgacgtccgcaaggtgttccgccggctcgaagaccacttcctgggcgacagcgagcatcatggcgccggcggcggctggcggatcgaggcggcgcggctgtcatggccgatcctcgatgcggtggcgaacgccgcctgcgagatggggatcccgcgcagcgccgacttcaacaccggcgacaacgagggcgtcggctatttccacgtcaaccagaagcgcggccggcgctggtcgtcggcgcgcggctttctcaagcccgcactgcatcgttccaacctgcggctcgaaaccaatgtcgtggtcgaccgcgtgctggtcgagaacggccgcgcggtcggcgtccgcttcctgcagaacggcgtgccgatcgaagcccgcgcccgccgcgaggtggtgctgtgcgctggcgcgatcggctcgatccaggtgctgcatcgctccggcatcggcccggccgaatggctgaagccgctcggcatcgagccggtgctcgatcgccccggcgtcgggcgcaacctgcaggaccatctgcagcagcgcgcgatctacaaggtcagcggcggccgcaccctcaacgagatctatcactcgctgccgcgccgcgcctggatggggctggactacgcgctgcgccggcgcgggccgctcaccatggcgccgtcgcagctcggcatcttcacccgctccgattcgcatcaggagcgcgccaacatccagttccacgtgcagccgctgtcgctcgacaagttcggcgatccgctgcatcgcttcccggcgatcaccgtcagcgcctgcaacctgcggccgacctcgcgcggcgagatcaagctaaaatccaccgcgctcgacgccgcgccgtcgatcgcgccgcactatctgtcgacggcggacgactgccgcgtcgcggccgatgcgatccgtgtgacgcggcggctgatgaagcagcacgcgctggcgacgtatcacccggaggagtatctgcccggcccatcggtcggcgacgacgacgcctcgctcgccaaggccgccggtgacatcggcaccacgatcttccatcccgtcggcaccgccaagatgggccgcgccgacgatccgctcgcggtcgtcgatgaaagacttcgcttccacggcctcgaagccttgcgcgtcgtcgacgcctcgatcatgccgacgatcacgtccggcaacaccaacacccccaccgcgatgatcgccgagaagggcgcgacgatgattttggaggat

SEQ ID NO: 44549 - DNA, 1362 bp, Rhodopseudomonas palustris
ttagaccttgccgagatgtttgcggcgcgcgaagcgaaccgcagttcgatgcacgcccggcatctcaacgagcagctcgtccgcgtcctcaaaaccatcggctacgacgtcggcttccagaagggcaccggtcagtacctctacgaccgcgacggcgcccgctatctcgacctgctcagcggctttggcgtattcgcgctcggccgcaaccacccggtggtgcgcaaggcgttgcagagcgtgctcgatgccgacctgcccaatctggtgcaactcgacgtctcgacgctcgccggtatcctggctgagcggctgcttgagcaggtgccgtatctcgacaaggtgttcttcgccaattccggcgccgagagcgtcgaggcggcgatcaagttcgcgcgcggcgcaaccggtcgcaacggcatcgtcaattgcgaccacagctaccacggcctgacctacggcgcgctgtcgctgaccgacgaccagaatttccagggtggctttgggcctctgctgccgggcgtcaccaccatcccgttcaacgatctcgaagcgctggagaaggtgctgtcgacccgtgaggtcgccgccttcatcgtcgagccgatccagggcaagggcgtcaacatgcccaccgacgagttcctgccgggcgccgccgcgctgtgcaaacgctatggcacgctgttcgtcgccgacgaaatccagaccggcatgggccgcaccggccgcttcctcgcggtcgagcactggaatgtcgaacccgacatggtgctgctctccaaggcgctgtcgggcggccacgtgccggttggcgcggtgctgacccgcaagtcgatcttcgacaagatcttcaaccgcatggaccgcgccgtggtgcacggctcgaccttcgccaagaacgatctggcgatggctgccggcattgcgacgctggaagttctcaaagccgagaagctggttgaggccgccgccaagcgcggcgccgagctgcggctggcgctcacgcgcatggtccccggctacgaactgctcaaggaagtgcgtggcaagggcctgatgatcggcgtcgaattcggcccgccgcaatcgctccgcctgaaggcgtcgtggacgatgctcgagaccgccaacaagggcctgttcgtccagctgatcactgtgccgctgttcaaggatcacaagatcctgacccaggtcgcgggccatggcctgcacaccatcaaactgctgccgccgctgaccatcaccgaagacgactgcgcctggatcgaacgcgccttcgacgacaccatcgctgccagccacaaggtgccgggcgcgatctggtcgctcggcaagaccctggtcgacaacgcggtg

SEQ ID NO: 44550 - DNA, 1959 bp, Rhodopseudomonas palustris
atggattccggcagctacacgactggtgtggagcgcaacgcgctcgaagcttcgatcgatgcggcgcgcagcgcgctgctgaattatcgtcgcgacgatggccattgggtgttcgaactcgaggccgattgcaccattcctgccgaatacgtgctgctgcggcattacctcggcgagccggtggatgccgagctcgaagccaagatcgcggtttatctgcgccgcatccagggtgcccatggcggctggccgctggtgcacgacggcgacttcgacatgagcgccagcgtgaaggggtacttcgcgctgaagatgatcggcgacagcatcgatgccccgcatatggtgcgggcgcgcgaggcgatccgttcgcgcggcggcgcgatccactccaacgtcttcacccggtttctgctcacgttgtacggcgtgacgacttggcgcgcggttccggtgctgccggtcgagatcatgctgctgccgagctggtcgccgttcacgctgaccaagatctcgtattgggcgcgtaccacgatggtgccgctcttggtgctgtgcgcgctgaagccgcgggccaagaatccgaagggcgtcgacatcgacgaactgttccttcaggacccgaagacgatcgggatgccggtcaaggcgccgcatcagaactgggcgctgttcaagctgttcggttcgatcgacgcggtgctgcgcgtgatcgagccggtgatgccgaaaagcatccgcaagcgggcgatcgacaaggcgctcgccttcatcgaggagcggctcaacggcgaagacggcatgggcgcgatcttcccgccgatggccaacgccgtgatgatgtacgaggcgctcggctatcccgaggactatccgccgcgcgccagccagcgccgcggcatcgacctgctgctggtcgatcgcggcgacgaagcctattgccagccctgcgtgtcgccggtgtgggacactgcactcgccagccacgcggtgctcgaggcggacggtcacgagggcgccaagtcggtgcggccggcgctcgactggctgctcccgcgtcaggtgctcgacctcaagggcgactgggccgtgaaggccccgaacgtccgccccggcggctgggcgttccaatacaacaacgcccactatccggatctcgacgataccgcggtggtggtgatggcgctcgaccgcgcccgcaaggaccagccgaatcccgcctacgacgccgcgatcgcccgcgcccgcgagtggatcgaagggatgcagagcgacgatggcggctggggtgccttcgacatcaacaacactgagtactatttgaacaacatcccgttttcggaccacggcgcgatgctcgatccgccgaccgaggacgtcaccgcgcgctgcgtctcgatgctggctcagcttggtgagaccatggacagcagcccggcgctggcccgcgccctcggctatctgcgcgacacccagctcgccgagggctcctggtacggccgctggggcatgaattacatctacggcacctggtcggtgctgtgcgccctgaacgccgccggcgttccccatgccgatccgatgatccgcaaggcggtcgcttggctggagtcggtgcagaaccgcgacggcggctggggcgaggacgcggtcagctaccgactggattaccgcggctacgaaagtgctccctcgacagcctctcagacggcatgggccttgcttgctctgatggctgcgggtgaggtcgatcatcccgccgtggcacggggcatcgagtacctgaaaagcacacagaccgaaaaaggactgtgggacgagcagcgttacacggcgacgggcttcccgcgggtgttttatctgcggtatcatggctattcgaagttcttcccactctgggcgctcgcccggtatcggaacttgcaggccacgaacagcaaggtggtaggggtcggaatg

SEQ ID NO: 44551 - DNA, 1050 bp, Rhodopseudomonas palustris
ttgatcgatttcgtcgcccaggtgtttgagcgtgcgggctcgtccaaggaagaggcgcggcggatcgcctcgtatctcaccaccgccaatctcacaggccacgacagccacggcgtgatccgcgtgccggtctacatccgctggcgcaacgccggcgcggtgcatccggaccagaccgtcgatgtcccggtcgatctgccgtcgctcgcagtggtcgacggcaagttcggctatggccagactgtgggcccgcaggcggtgcggatcggcatcgacaagtgcaaggcgcaggggctgtcggcggtggcgctgaagaacgccggtcacatcggccggatcggagactgggccgagatggccgccgctgaaggtttggtgtcgattcacttcgtcaccgcggcgggctcgatcctggtcgcgccgttcggcggcgttgaacgccgattgtccactgcgccttattgcgtcggcattccgcggccggacgcgcccccggtggtgctcgatcttgccacctcgattgtcgccgaaggcaaggtgctggtcgcggcgcgcggcggcaagaagctgccgcaaggcgcgctgatcaatgccgacggctctttgagcgaagatccggcgacgctgtacggtccgcacgagaaggacggcccgatcaaccacgccaacggccgaggggcgatccgcgccttcggcgaacacaagggctcggggctggcgctgatctgcgaactgctcggcggcgcgctcaccggcaacggcgccaccggcccggaccggccattcgccaacggcatgttctcgatctacgtcgatccgaagcgcatcgatccggcgcacgtcttcgatgccgaagtcacccgctacatcgacttcttcaaaagctccaagacggtcgccggcgtcgatcaggtgttgatccccggcgatcctgaaaccgccactcgcgccgagcggaccaggaacggcgttccgctgcccgacgacacctgggccgccatcgtcgccaccgcgcgcgaagtcggcgtcgacgaagccgcgatccaggcg

SEQ ID NO: 44552 - DNA, 1401 bp, Rhodopseudomonas palustris
catctgatcggcggcgagatcgtcgcagcctcatccggcgaagtgttcgagacggcctcgccgatcgacaattcggtgctggcgcaggtggcgcgcggcacggcggcggacatcgaccgcgccgccaaggcagctaaggctgcgtttccggcgtggcgtgacatggcgccggccaagcggcgcaagctgctacacacaatcgccgatgcgatcgaggcgcgcgccgacgacatcgccgtgctggaatgcatcgacaccggacaggcgcatcgcttcatggccaaggcggcgatccgcgccgcagagaacttccggttcttcgccgacaaatgcgctgaggcgcgcgacgggctgaacacgccgagcgacgagcattggaacgtctcgacccgggtgccgatcggcccggtcggcgtgatcacgccgtggaatacgccgttcatgctgtcgacctggaaaatcgcccccgcgcttgcggccggctgcaccgtggtgcacaagccggccgagtggtcgccggtgaccgccgacatgctggcgcgcatctgcaaggacgccggactgccggacggcgtgctcaacaccgtgcacggcttcggcgaagaggccggcaaagcgctgaccgaacatccggccatcaaggcgatcgccttcgtcggcgagaccgcgaccggcgccgccatcatggcgcagggcgcgccgacgctgaagcgggtgcatttcgagctcggcggcaagaacccggtgatcgtgtttggcgacgccgacctcgatcgcgcgctcgatgccgtggtattcatgatctactcgctgaacggcgagcgctgcacctcgtcgagccggctgctggtgcaatcctcgatcgccgacagcttcatcgaaaagctggccgcgcgggtgcgcgccctcaaggtcggccatccgctcgatccggccaccgaagtcggtccgctgatccatcagcgccatctcgacaaggtctgctcctatgtcgacgtcgcccgaaaagacggcgccaccatcgcggtcggcggcgcgcccttcgacggcccaggcggcggccactatgtgcagccgacgctggtgaccaatgcgcgcagcgacatgcaggtggcacaggacgaggtgttcggaccgttcctcaccgtgatcccgttcaaggatgaagccgaggcgattcaaatcgccaacgacgtccgctacggactcaccggctatgtctggaccgccgacatgggccgcgccttgcgcgtcgccgatgcgctcgaagccgggatgatctggctgaactcggaaaacgtccgccatttgccgaccccgttcggaggcatgaaacaatccggcatcggccgcgacggcggcgactactcgttcgacttctacatggagaccaagcacgtc

SEQ ID NO: 44553 - DNA, 997 bp, SYNECHOCOCCUS SP. WH 8102
atggggaaggtgaaggtcggagtcaacggatttggtcgtatgggcgcctggtcaccaggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatgcctcca

SEQ ID NO: 44554 - DNA, 780 bp, SYNECHOCOCCUS SP. WH 8102
caaatgctcgatatgtctaatcgagccagtcttattacaggtggagcagggcatattggtgttgagatggccctttctcttgctgagctgggttcaaatattattttaatagataaagactttaatggcctccagttggcaaaggagtcgattctaaatgtttttaatgctcaagttgtgacaattgcggctgatctagaagatgagcaatccccttcgaaaatagcttctattgttgataataaatttggtaaagtcgatgtactcattaacaacgcggcgttcggcgggactacagttcttgaggggtggactactacatttgctcatcaatctctcagcacctggcggagagcattggaagttaacttgacatctgcatttgcgttgtcacaagcatgtatttcgctactcaatcaatctaaaagtgcttctattattaatatcggttctatctatggattccttggtccagatctttccctttacgagggaactgcgatgaataatccagccgcttacgccgcgagcaaggggggcttactgcaactaactcgttggatggcgacggtgcttggtcctgatattcgtgtcaacgcgatttctcctggaggtgtggcacgcgggcagcctcaagcttttgttgatcgctatgtttcacgcactcctttgaagcgaatggggcgtgaagaggactttaaaggggctatcgtctatctggcttcagatatgtctgcttgggtcaccggccaaaatttagtggttgacggtggctggtca

SEQ ID NO: 44555 - DNA, 1314 bp, SYNECHOCOCCUS SP. WH 8102
tcaaaaattgcaattgttgattatggaatgtgtaatctttggtccattaagtctgccattcaattcataggttatgattcgattttgacttctgatcccaaagatattttaaactcgtctgctataatattacctggtgttggttcatttaagactggaatggataatcttttatctttaggtctatcacaagcaattattgatgcttgtatgtttaggtcaattccaatcttaggaatatgcttaggttttcaattattgtgctgtagcagtgaagagccttcgtatacgaaagggctttcactattaccaatccagattgttccactgtgccgacatattgatgcttcatttgttcttccacatgtaggttttacttcagtttatacatcaaagaatgatcctctcttcaagaatattgctaacaaatcagatttttattttgttcattcatatggggcgtttaatgttccccatgactttactacctactcatattgtaattatgatgcaaaaatcatctcttcagccaatgttaatcacataatgggtgttcagtttcatcccgaaaagagtcagaccaatggccttattctattagataacttcttgtctttttccaatgtctaaaaagcgtattatcttgttcttctttattgtgatggtttcttttgtttaagtagaaactttaagcttcaacgcataggggattttcgatggctccagcgcaactataatttcaattattcagccacttttattgacgagcttatcattcttgacatctcaagaaagtctcgagatataaataagttgccaccctatgtataattgtccgaaaatatatttgttcccattactgcaggtggcggtataagatccttcgaagatgccaaagttttatttgaaaatggtgctgataaggtctgcttaaatacttcattaattcaatgccctcatgtttccgagaaaatctcttctgtttatgggcagcagtctttagtggcatctattgactttaagcatgatcatggcgattttaagttttttattgacaatggtttgatagaagtccagtacaatatacaagagctaatatctttcctagatccattaccattttgtgagatccttctacaatctgttgatagggatggaactggtacaggttttgatcttaccttagcaaatacatttagagatcagttgtctaaaccaattatattgcttggtggagcaggccactctgatcaccttgttgagggtttactacatcagtcaacagatgccgttgccacagctcatctattgaat

SEQ ID NO: 44556 - DNA, 522 bp, SYNECHOCOCCUS SP. WH 8102
ctcgccaccccctacgccgaagccttgcttcaggtcactgaagcccgtggcgaatcccagacggtcgctgaccagtgcaagcaactgcttgagatctgggacagttccgctgatttccgcaatgcaatggtgtcgccggtgctcgagcccgatgccaagaaaatggcactgcaggcgctcgtcggcgagcaagtcacgccgtccatgctgaacttgctcaaggttctggctgatcgccagcggctgctggccttcgacgccgtgatgctgcgctacctcgagctctaccgagagcagcagggcatcactcttgctgaagtccgctcagcgcagaccctcaccgaggatcagcaggcggccctctccaaaaaggtgcaggcgatggccggcaccaacatggtcgacatcgacctcagtgttgatccctcactcatcggcggcttcgtcgtgagtcttggatcccaggtgatcgacgccagcctggctggccaggttcgtcgcctcggtctggcgctcgccaaa

SEQ ID NO: 44557 - DNA, 1506 bp, SYNECHOCOCCUS SP. WH 8102
atggtttccatccgtcccgacgagatcagcgccatcctcaaacaacagattgaggactacgacaagtcggtttccgtcagcaacgtcggctccgtcctgacggtgggcgacggcatcgcccgcgtctacggcctgcagcaggccatggccggtgagctcctcgagttcgaggacggcaccgaaggcatcgctctgaatctggaagacgacaacgtcggcgcggtgctgatgggcgagggcctgggcattcaggaaggcagcacggtgaaggccaccggcaagatcgcctccgtgcccgttggcgaggccatgctcggtcgcgtcgtcaactccctgggccgcgccatcgacggcaagggtgaaatcgccaccagcgagacgcgcctgatcgaatccatggcgcctggcatcatccagcgcaagtcggtgcacgagccgatgcagaccggcatcaccgccatcgacgcgatgatccccgtcggccgtggccagcgcgagctgatcatcggtgaccgccagaccggtaagaccgccatcgcgatcgacacgatcctgaaccagaaggatcaggacatgatctgcgtttacgtggccgtcggtcagaaggctgcttctgtggccaacgttgtggaggtgttgcgtgagcgcggtgccctcgattactccgtgatcgtggccgccaacgcttctgagcccgcagctttgcagtacctggctccctacaccggcgcctccatcgccgagtacttcatgtacaaaggcaaggcaactctggtgatctacgacgacctgtccaagcaggctgccgcttaccgccagatgtcactgctgctccgtcgtccgcccggtcgtgaggcctatcccggcgacgttttctactgccacagccgtctgctggagcgtgcagccaagctctctgatgccatgggcaaagggtccatgacggctctaccgatcatcgaaacccaggccggtgacgtgtcggcttacatccccaccaacgtgatctcgatcacggacggtcagatcttcctcagctccgacctgttcaactccggcctgcgtcccgccatcaacgtgggtatctccgtgagccgggtgggtggtgccgcccagaccaaagccatcaagaagattgccggcaccctgaagctggaactggctcagttcgctgagctggccgccttctcccagttcgcatccgacctcgatgcgtccacccagcagcagctggagcgcggcaagcgcctacgggaactgctgaagcagccccagttcagcccgctgatcctggctgagcaggtcgccatcgtttatgccggcgtcaagggcctcatcgatgcggtccccgtcgacaaggtggtcgacttctcccgcgaattgcgtgagtacctcaagtccaacaagcctgagttcatcaccgaaatccaggagaagaagttgatgagccctgaagctgaggcgatcctcaaggacgccatcagcgaagtcgtgtccaccctcgtc

SEQ ID NO: 44558 - DNA, 945 bp, SYNECHOCOCCUS SP. WH 8102
atggcgaatctcaaggaaatccgcgaccggattaaatcggtcaaaaacacccgcaagatcaccgaggccatgcgcctcgtggctgcggccaaggtgcgtcgcgctcaggagcaagtgctccgcagccgtcctttcgcggaccggctggcgcggatcctggaaaacctccagtcccgcatgcgcttcgaggatgcgtcgtctcctttgatggagcaacgcgacgtggagaccatcaccctggtgtccgtcaccggtgaccgtggtctttgcggcggctacaacgccaacatcatcaagcgcactgaacagcgcttcgctgagctgacgggcaaaggcttcaaggtgaagctggtgctgatcggcaacaaggccatcggttatttcaccaagcgtgattacccggtgcaggccaccttctccggtctggagcaggtgcctacagcggatgaagccaacaccatctccaccgatgtgctggccgaattcatcggtgctggcaccgaccgcgtcgagctgatcttcaccaagttcatcaacctggtgagctgcaaaccggtggtgcagaccctgctgcccttggatcctcaggacattgctgatcctgaggatgagatcttccgtctcaccaccaaggacggccgtctgacggtggaacccggagctggccctgccaacaccgaaccgaagatcccttcggacatcgtgttcgagcagacccctgagcagctgctcaacgccctgctgcccctttatctgcagaaccagctgctgcgttcgttgcaggagtccgcggcctctgaactggccagccggatgaccgccatgaacaacgccagcgacaacgccaaggagctggccaagaccctgacccttgactacaacaaggcccgccaggccgccatcacccaggaaatcctggaagtggccggtggtgctgccgctgtg

SEQ ID NO: 44559 - DNA, 1305 bp, SYNECHOCOCCUS SP. WH 8102
tccagcatccacgccagccggcgtcagcgcttcctcgaccagctcggtgcggctgcggcggtgattccggcggccccgctggccacccatcacgccgattgcgagtggcccttccggcaggacagcgacttcttctatctcaccggtttcgatgaaccggatgcagtggccctgttgctgccccatcggcccgagggggaacggtttgtgttgttcgtgcagcccaaggacccggcggcggaggtgtggaccggcttccgctggggcaccgaaggggccgtggagcgctacggcgcagacatcgccctgcccctagatcagctcagtgcccgattgccggagttcctcgatggggccgaggcgatcgccttccgcgtcggccgccatcccgcggtggaaccgctggttctgtcggcctgggggcggcagctggacagttatgcccgctgcggtgcagcggccctggggctggtggcgccgacgccgatcctgcatcggctgcgcctgcgcaaggagccccatgaactcgaccggatgcggctggcttgccggatttctgcggaggcccatgagctggcgcggggtatgacccgtccagggatgaatgaatcggaggtgcaggcagcgatcgaggcccacttccgggccgccggagcccgcggaccggcctacggctcgatcgtggctggaggcgacaacgcctgcgtgctgcactacaccgccaacaccgctgggctgcaggacggtgacctgctactgatcgatgccggctgctcgatcgccgattactacaacggcgacatcacccgcaccttcccgatcaacggtcgcttcagcgccgagcagcgcgatctctacagcctggtgctggcggcgcaggaggcggccattgccgtcgtgggccccggcggtacggcagaacaggtccatgccaccgctctgcgggtgctagtggagggcctggtggatctgggtctcttggtcggggaacccgacggcatcattgaacagggtgattaccgccacctctacatgcaccgcactggccattggttagggcttgatgtgcacgatgtgggggcctatcgcctgggtgagcagcccgccagcctggagccaggcatggtgctgaccgtggaaccgggcctttacatcagtgatcgcctggccgttcctgagggccagccgcagatcgatgaccgctggaaggggatcggcattcgcattgaggacgacgtggccgtcacaaacggcggccatgaagtgctcacggccgcggcgcagaaaagcctggcggcgatggaa

SEQ ID NO: 44560 - DNA, 1632 bp, SYNECHOCOCCUS SP. WH 8102
atggctaagcgcatcatttacaacgagaacgcccgccgcgctctcgaaaaaggcatcgacatcctggccgagtccgtggccgtgaccctgggaccaaagggccgcaacgtggtgctcgagaaaaagttcggtgctcctcagatcattaatgacggtgtcaccatcgccaaggagatcgagctcgaggatcacatcgagaacaccggtgttgctctgatccgtcaggccgcctccaagaccaacgacgctgccggtgacggcacaaccaccgccaccgtcctggcccacgccatggtcaaggccggtctgcgcaacgtggccgccggtgccaacgccatcaccctgaagaaaggcatcgacaaggcctccgacttcctggtcagcaagatcaaggagcaggccaagcccatcgccgacagcaacgccatcgcccaggtgggcaccatctccgccggcaacgacgaagaagtcggcaagatgattgccgatgccatggacaaggttggcaaggaaggcgtgatttccctggaagagggcaagtccatggagaccgaactagaggtcaccgagggcatgcgcttcgacaagggctacatctccccgtatttcgccaccgacaccgagcggatggaagcggtgctcgacgagccctacatcctgctgaccgacaagaagatcggtctggtgcaggacctggtgcccgtgctcgagcagatcgcccgcaccggcaagcctctgatgatcatcgctgaggacatcgagaaggaagccctggccaccctggtggtgaaccgcctgcgcggtgtgctgaacgtggccgccgtcaaggctcctggcttcggtgaccgccgcaaggccatgctcgaagacatggctgtgctgaccaacggtcagctgatcaccgaggacgctggtctcaagctggagaacgccaagctggagatgttgggcaccgcccgtcgcgtcaccatcaacaaggacaccaccaccatcgttgccgaaggcaatgaggcggctgtcggcgctcgctgcgagcagatcaagaagcagatggacgagaccgactccacctatgacaaggagaagctgcaggagcgtctggccaagctggccggtggcgttgctgtggtgaaagtgggtgcggccaccgaaaccgagatgaaggacaagaagcttcgtctcgaggacgccatcaacgccaccaaggctgcggtggaagagggcatcgtccctggcggcggcaccaccctggcccacctggctccttcccttgaggagtgggccaacggcaacctgtccggtgaagagctgatcggcgccaacatcgtggctgctgccctgacggcaccgctgatgcgcatcgctgaaaacgctggtgccaacggcgctgttgtggctgagaacgtcaagtcccgcgccatcagcgagggctacaacgctgccaccggcgattacgtcgacatgctggctgccggcatcgtcgatcccgccaaggtgactcgctccggtctgcagaatgccgcctccatcgctggcatggtgctgaccaccgagtgcatcgtggctgatctgcccgagaagaaggacgcagctcctgccggcggcggcatgggcggtggcgacttcgactac

SEQ ID NO: 44561 - DNA, 1533 bp, SYNECHOCOCCUS SP. WH 8102
gtagccccagtcgttctcaccattctggatggctggggacaccgcaacgacagcgaacacaacgccatccgccagggcgacacgccggtgatggaagcgttgtggcatgcctatccccatgccctgattcaggccagtggttcccatgtggggctgccggatcatcagatgggcaactccgaggtgggccacctcaccatcggtgccggtcggatcatccgccaggaattggtgcggatcagcgacacggtgcgtgacgaccagttgaataacacccccgcgctagtggagctggcggagcatctacagaacgacactggcaccctccaccttctgggactctgctccgatggcggcgttcacagccacgtcaaccatctctgcggactgatccactgggcagcggcggccggcatcaaaaaagtggctgttcatgccatcaccgatggccgggacacgcccacccagagcgcgatgggttccatcaccctggtgcaaagggcaatggaggaagctggcgtcggtcatctggccagcctctgcggccgttactgggcgatggatcgcgacaagcgctgggatcgcacagaaaaggcctacgacctctacaccgaccccacacgctccatcagcgaccagagcccgcagcaactgttggccgagagctatgccgctggcatcaccgatgaattcctgaagcccgtgcgcctcagcgatgacgtgatgcaggacggcgacagtgtgctggtgttcaacttccgtcccgatcgggctcgccagatcgtgcagaccctttgcctggacgatttcgacggctttgagcgccggaccactcccaagctggatgtggtcaccttcacccaggtggaacaggacctgccggtgtcggtggcgttcccaccggaaccgctggacgacctgctgggtcaggtggtggccgaagccggattgcgtcagtaccgcacggcggaaaccgagaagtacccccacgtcacctacttcatgaacggtggcatcgagcaaccgttgcctggggaggagcgtcacctggtgccctcaccgcgggtggccacttacgacctctcacccgccatgtcggcggaccagctcacggacagctgcatcgatgcgattgaccagggcacgtacagcctgatcgtgatcaactacgccaaccccgacatggtggggcacaccggcgtgatggacgcggccaccgaagccattgccaccgtcgatcgctgcatcggacggttgctggacgccgtcggtcgccgaggcggcaccatgctgatcaccgcggaccacggcaacgccgaactgatgcaaggccccgatggtcaggcctggacggcccacaccaccaatcctgtgccctgcatcctggtggagggtgaacaacgcaagctgccgggccatggcaacgacatcagcctgcgagaggacggtggtttggctgacattgcaccgaccctgctgcagatcctcaaccttgagcaaccggcggcgatgacgggccgtagcctgatcgag

SEQ ID NO: 44562 - DNA, 471 bp, SYNECHOCOCCUS SP. WH 8102
cctgtgactgattcccccgcctcggacgccgctcagtcctccgtggtgctgaccagtgaacagatcgctggactgctgccccatcgctatccgtttgctctggtggaccgggtcatcgcccatgagcctggggtgtcggcgaccgggatcaagaacgtgacggtcaatgagccgcagtttcaaggccatttccctggacgcccgttgatgccgggggtgctgattgttgaggcgatggctcaggtcggggggttgatcgtgacccagatgcccgatctaccgaagggtctgttcgtttttgccgggattgacggggtacgcttccgccgccccgtggttcctggagatcagctggtgatccactgcgaactgctcagcctcaagcgcaaacgcttcggcaaggtgaaggctgaagccaaagttgatggcgagctggtctgttccggcgagctgatgttctccctggtggac

SEQ ID NO: 44563 - DNA, 2065 bp, SYNECHOCOCCUS SP. WH 8102
cctttggccttgagcggcatccaccccggcacgccctggcccctgggcagcagcatcacaccccggggggtgaacttctcggtagcggcaccggcagccgaccggatcgagctgctgatcttcaaacgggcatcagcatcgacaccagagcgggtgatcgaattggatgcccgccgccaccgctccggcgattactggcatgtggagctggaaggcgttggcgagggctgctgctacggctaccgggtgttcgggcccctggcacccgggggccacggctttcaaccggcgaaggtgctggtcgaccccgccgcccgcgccatcagcggctgggacgtctacgaccgggtgttggccaccgggccaaccccgaacgcccatgcctgcctcaaggcggtggtgaccgagcgggagctctttgattttcaacgccatccaaggccccgccacagctggcagcgctcagtgatttatgagctgcatgtgggcggcttcaccggccgagacgattccggcgtctccccggagcagcggggtacctacctggggctgatcgacaagctgccttatttgaaggagctcggcatcacggcgatcgaactgctgccggtgttctgcttcgaccctgccgatgccccgcccggtcgcgacaacgtgtggggctacagcccgctgagctggttcaccccccaccacggctacggctgtggcgatgatccactgcaactgcgccatcaagtgcgtcagcttgtagccgcctgccatgacgccaacatcgaagtgttgctggatgtggtctacaaccacaccacggagggcacccggctgggtccaaccctgagctggcgcggctttgccgatcgcacttattaccaccaaaccagcagtggcgactatctggatgtgagcggctgcggcaactccatcgccgccaaccaaccgatcagcacgcaattaattcttgagtcgatgcgctgctgggcgctggagctcggggtggatggcttccgcttcgatctgggcatcgccctcagccgcggcaaccagctcaaaccactggatcagccaccactgtttcgggcgatcgaagccgacccgcaactcagcgatctcaagctggtgagcgagccctgggattgcggcggcctgtaccggctggaggacttcccggcccagcgcatcggaacctggaatgggcacttccgcgatggcttgcgccgcttctggaagggtgatgagcacagcacctggacgctggcccagcggttcaagggcagtccggatttgtacaacgacaaaccggtggccttgggacgctcggtgaacctgatcaccgcccacgacggcttcaccctggcggatctggtggcctacaaccgcaaacacaacctggccaacggcgaggacaaccgcgatggcgaaaaccacaacaacagctggaaccacggcgtggaaggtccaacgaccgacccgcaggtgctggcgctgcggcgccgccagcaacgcaacctgctgagcaccctgctgctggcccgcggcgtgccgatgctgctgatgggcgatgaggtgggccgcagccaggggggcaacaacaacagctggtgccaggacagccccctcagctggatggtctggaacgacgaccactgcgatctggagctgaaactgtttctgcagcggttgctgaagctgcggcaggccctgccgcaactgttcaatccgctggtgccgccaccggaaaccagccgcaagcaaccccagaacccccacagacctgtggcggcaatggcacggcgtggaactgagcaagccggactgggcagcctggagccgcaccaccgccaccagcctgcacatgggcagccgcggcgccctgttgtggatgggcttcaacgcctacaacgagccgctcaacttcgagctgccggtgccggcatccccctggatgcagttgatcgatacctccctgcccgccggggaggacctgccggcgcaagcggtgccgtacgacgccgtggacattcccctggccagccgcagcctggtgctgctgctggcccgagaa

SEQ ID NO: 44564 - DNA, 777 bp, SYNECHOCOCCUS SP. WH 8102
acctaccgcggtcgctacgccccctcgccgacgggcgccttgcatctcggcaatctccagaccgccctgttgtcctggttgcaggcgcgccaggccggtggtgtctggctgttgcgcatcgatgatctcgacaccccccgcaaccggcccggtgccgttgaggcgatccaggccgatctgcactggctcgggctcgactgggacggggagccgattctgcagagctgccgccgtgggctttatgcctcctggctctcctggttccgccgcagcggcgccctgttcccctgccgttgctcacgacgggagctggcaggtctggcgcgttaccccggcacctgccgtgatggcggcgctggctgggggtggcgtgatcgccggttgccgagctggcggttgcgggttcccagccgtgatccagatggcagcggtgatgtggtggtgcgccgtgccgacgggttcatcgcttaccagttggccaccgtgatcgatgaactggccctgggcatcactgatgtagtgcgcggtgaggacctgcgcgaggccttgcccgctcagcggagtgtgtatcgggccctgcagcagcaacccccccgctttcaccacggtccgttgcgttgtgacgccgagggaaggaagctgtcgaaacgtgaagccagcagcggactgatggccttgcgtgagctgggtctggatgcccctgcagtggttggtcttctggcctctggtctgggttatgggccgcctggggccaggctctcggcgatcgaattactg

SEQ ID NO: 44565 - DNA, 1800 bp, SYNECHOCOCCUS SP. WH 8102
gtgctggtggtgggcaccggcctggcgggtgcctctgccgccgccaccctggcccagcagggctaccgggtgacggtgctgaacttccacgacagcccgcggcgggcccattcggtggcggcccagggcggcatcaatgcggcgcgatcgttggccgtggatggcgacagcgtcagccgcctgttcaccgacacgctcaagggaggtgacttcagagcccgggaaagcggctgccagcggctggcggaaatcagcagcggcatcattgatcaatgcgtggcccagggcgtgcccttcgcccgggaatacggcggcagcctggccacccgcagtttcggcggcgccctggtgagccgtaccttctacgcccgcggccagaccggtcagcagttgctctatggcgcttaccaggcgttgatgcgtcaggtggagcttggccgggtccgaatgctcacccgccgtgatgtgctcgagctgatcaccgttgatggtgtcgcgcggggcgtggtggcccgccatctgctcagcggtgcgttggaagttcacaccgcccgcacggtactgctctgcaccgggggctacagcaacgtctacttcctctcgacgaatgcgctgaaatccaacgccagcgccatctggcgggcccaccgcaagggcgccctgttcgccaacccctgcttcacccagatccaccccacctgcattcccagcggtgatgccttccagagcaagctgacgctgatgagcgaaagcctgcgcaacgacggccgcatctggctgccgctcgaaactggcgacaagcggtccgccgaggccatcccggaacaggagcgcgactatttcctggagcggctttatcccagctacggcaacatggcgccacgggatgtggcctcccgccgggcgcgggagctgtgcaatgcagggcggggcgttggccccggtggccgctcggtgtatctggatctcaccgatgcgatcaagacggaaggccgcgaggccatcgctgcccgctacggcaacttgatgacgatgtacgagcggatcagcggcgacgatccctaccgcaaaccgatgcggatttaccccgccccccattacacgatgggcggcctgtgggtggactaccagttgatgagctcgatcccggggttgttcgtgctgggggaggcgaactactccgaacacggcgccaaccgcctgggggccagtgcgttgatgcagggattggccgacgggtatttcatagccccgtccacggtgaccgcctggctggctggcaacgcggccccggacgtcacacctgataatccagcctgctgcgaagccctggagagcacccgccgtcggatcgagacgatgctggccagtggaggcacaactcccgtggacagcttccaccgggaacttggggccgtgatgatcgatcgctgcggcatcagccgcgatgccgaaggtctccgggacggactcagccaggtggaggccttggagaagcgcttccacggtgaagtgcgggtgccgggagaagcggcagggcccaacgcggaactggagaaagcgctgcgggtgagtgatttcttcgggttggcacagctgatgctgcgcgatgccctggcgcgagaggaatcttgcggtgcccacttccgtgaggagcaccagagcccggagggtgaagcccggcgtgatgacgtcaacttcgcccacatcgcagcctgggaacaccaggatggtgcggagccgatccgccacagcgaaacgttgcagttcaccgccctgcaaccgagcacccgcagctac

SEQ ID NO: 44566 - DNA, 1263 bp, SYNECHOCOCCUS SP. WH 8102
cgggatcgacagcaggctgaggctgagttgcaacggttaacgcgccggacccagaccagccaacaaaaggatgttcagggccgggtcgacgtcattctcaaggcggttcgtgaacggggcgatgctgccgtgtgcgacttcacggaacgcttcgacggattccggcccgatccagtcgcggtccccaaacaccagctcgaacaagcctggaaggccctgccggagaacctgcgcgatgcgctggaactggcccatcgccgcatcagcgagtttcaccagcggcagcgtccggaggacatccggatggaaggggctcacggcgagcagttgggacggcgctggcgaccggtgcagcgggcaggtctctacgtgcccggtggacgggctgcttaccccagcaccgttctgatgaatgctgtcccggcccgtgtggcgggcgttgaacaggttgtgatctgctcccccgccgggtccaatggtcaagtgaatcccgtcgtgctcgcagccgcgcatctggccggcgttcacacggtgatgcgcatcggtggcgctcaggccattgctgcgatggctttcggcactgaaagcgttcccaaggtggacgtgatcagcggcccgggcaacatctacgtcaccctggccaagcaggcggtctacggccaggtgggcatcgattcgctggctggtcccagcgaagttctcgtaatcgctgaccagagcgcccaaccggagcaggtggcggccgatctgctagctcaggcggagcatgatccccttgcctcctccgtgctgatcaccacctcacaccagctcgctgatgggatcagcagcgctatcgcacaacagctggaggatcatccccgccgcgagatctgcgaagcctcgcttcgagattgggggttggtggtggtctgtgacgacctcgagacctgcgcccagctcagtgacagctttgctcccgagcacctggagctgctggttgagcgtccggaggccctggccgatcggatccaacatgccggagccatctttctgggcccctggtcaccggaggccgttggcgattacctggctgggccaaaccacacgttgcccacatgcgccgcggcccggttcagcggtgccctcagcgtggagacgttcatgcgccacacctcgatgatccagttcaaccgtgcagctctggatgccaccgcctcagcggtgtgtgaactggcggaaagcgaaggactgcacagccatgcggagtccgtccgcaagcgg

SEQ ID NO: 44567 - DNA, 1239 bp, SYNECHOCOCCUS SP. WH 8102
ctctggccgccgttcacgcaaatcgaatcggcaccgctgccgcaacgggtcatcgccggggatggagccctgttgctgcgggaacagggcattcccctgatcgatgccatcagcagctggtgggtgacgctgcacggccatggtcacccggtgatggccaaggccattgccgatcaggccgcccgcctcgaacaggtgatttttgctgatttcacccatgaaccggcggaacgtctgggggagcggctcagcaagctcacgggacttgatcggctgtttttctccgacaacggttccacagctgtggaggtggcgctgaagatcgcctgtcagtggtgggtgaaccgtggcgaaccgcggcaccagatcgtggcctttgacggcgcttatcacggcgacactttcggtgccatggccgtgggcgaacgcaacctgttcagcgaacccttcgacgacaagctgttccccgttgcccgttgtccatggcccgccacctggtgggatgaccccgatgtggacgccagggaacaggcggccctggccgtgctggagaccacgctgcagcaaccgaccgccgcggtgatcctggagccgttgctccagggtgccggcgggatggcgatggtgcgtggcaccttcctcaggcaggtggagatgttggtacggcaggcaggcgccctgctgatcgccgatgaagtgttgaccggattcggccgttgcggcgactggttcgcctgccaccgagccgggattcagccagatctgatggccctctcaaaaggcctgaccggcggttgtctgcccatgggcgtgaccatggccagtgaacgggtcttctcagcttttgttggggcagaccccagcctgaccctctggcacggccacagtttcaccgccaatccgctgggttgcgcagcggccaacgccagccttgatctgctgcagcaggaccccgaccagttccgagggttcgaagcacggcatcgcccccatctggaacaactgcgggcccatccgaacgtgacgcgctgccggctgaccggcacggtggcggccttcgacctgagcgtcagcggcgatgccggctatctcaatccagccgggcccaccatcaaacggatcgccctggagcatggggtgttcctgcgccccctgggacaggtggtgtacctgctgccaccgctgtgcatcagcaacgatcagctgggccagtgctacaaggccatcgccacggctctg

SEQ ID NO: 44568 - DNA, 1137 bp, SYNECHOCOCCUS SP. WH 8102
gtgaccgcccagactgatgccatggcatctcaggatccagcacgccgccgcacgctgcacacctggagcagcgctgatcttccctggactctgcagcgggccgagaccgagcaacaacccctgctggatctggccagcaatgattacctcggtctcagccgtcatccggcggtgatcgacgccgctaccgaagccctccatcgcgacggcgttggggctggtgcgtcacggctggtcaccggcagccggccgtgtcacgcgcgtttcgaggcagacctggccgactggcttggacgaagctgcgtcttgctgtttcccagtggcttccaggcgaacctcgctgccgtctgcatcctggctgaccggcacaccacggttctggccgatcgactgattcaccactcgcttctggtgggcgtgcgggccagcggtgcccgtctgcagcgcttccagcacaacgatctgacggatctcgagcggcggttgcaggccatggcagggcagccgggatccctggtggtgctcagcgaaagcctgttcagcatggagggcaccagcccggatgtggcagctctggctgcagtgtgccaacgatttggggccgatctgctgatggatgaagcccatgccctcggggtactgggagcggagggtcgcggcctctgctttggcatcgaaccggtgcgactgatcagtgggaccttcggcaaagccttcggcagcggcggcgccttcctggcctgtgatgccgatctcggcgacgccttgctgcagaccagtggcgccttccgttacaccactgccttggccccacccctggtggccggtgcacagacggcactggacctgatccgatcccatccgcactggagtcaacagctgcagcagcgggcgagccactggcgggatgccctggagggccaaggctggtcacgacctgcgggggtgggacccgtgctgcccttgctgctgggcagcgataccgcggccctcgccgctcaggcggttctggaagagcacgggttgctgagtgtggcgatccggccgccctccgttccggaggggacggctcggctgcggctggtgctgcgccgggacctgcctaatgagacggtggaacagctgctcaaggccctc

SEQ ID NO: 44569 - DNA, 2646 bp, SYNECHOCOCCUS SP. WH 8102
gacccatcgaagatctttccgttcccactggatgacttccagttggaggcgattgatgcgttgaatcagggccactcggtggtggtcagtgcaccgacgggatccggcaagaccctggtgggggagtacgccatccatcgggccctcgcccatggccagaaggtgttttacacaacgccactcaaggcgctgtccaaccagaagctgcgtgatttccgcgaggcctacggcgacgacaacgtcggtctgatgaccggtgacctcagcgtcaaccgtgaggcgtcaatcgtggtgatgactacggagatcttccgcaacatgctctatgcggaagccagcgaacaggacgacccactggcggatgtggaagccgtggtgctggatgagtgccattacatgaacgactcccagcgcggcacggtctgggaggagtcgatcattcactgcccgccttcggtgcagctggtggccctgtcggcaacggtcgccaatgccgggcagctcaccgattggatccagaaggtgcatggtccaaccaccctggtgctcagtgactatcggcctgtgccgctgcagttcagcttctgcagtgccaagggattgcatccgcttctgaatgatgccggaaccggactgcatcccaactgcaaggtctggcgggcgccgaaggggcacaaacgcaagggacgctccgctaaacctcctcagccggagccgccgccgatcagttttgtggtggcgcagatggcggaacgggacatgctccccgccatctatttcatcttcagtcgccgcggttgcgacaaggctgttcgcgatctcggcattcagtgcctggtcaacaaagaggaacaggcccggatccgcgcgcggcttaaggcctacagcagtgagaaccctgaggcggtgcgggatggcatccatgctgatgctctgctcaggggcatcgcggcgcaccatgccggtgtgcttccggcttggaaggagttgatcgaagagctgttccagcagggcctggtcaaggtggtcttcgccacggagaccctggccgccggtatcaacatgccggctcgcaccaccgtgattgcggccctgtccaagcgcacggaacggggtcatcgtccgctgatgggcagcgagtttctgcagatggccggtcgcgctgggcgtcgcggccttgattcaaggggctatgtcgtcaccgttcagagccggtttgagggcgttcgggaagccggtcagctggccaccagcccggctgatccgttggtcagccagttcacgcccagttacggcatggtgctcaacctgctgcaacgccatgacctcaacaaggcacgggagttggtggagcgcagcttcgggcgctatctcgccagcctggatctggtggaggaggaggacgtgctgtcccagctgaggctgcagctcggacagctcgagggggtggccggggacatcccttgggaagacttcgaggagtacgaaaagctcagaggacgcctgcgggaggagcggcgcctgctgcggattcttcaacagcaggctgaagagaccctggccaacgaactcaccctggctcttcagttcgccagcactggaacgctggtgagcctcaagtcaccgcagctgcgcggacgggttactcctgcggtgattgtcgacaagattgagggcccaggccagttccctctgctgctctgcttgagcgatgagaacctctggctgttgttgccatgccagtccgtcgtcagcatccatgctgaattgagctgtctgcaggtggatggggtcacggcccctgatttgcacaaggcaggcgaactccgccatggcgatcaggccagtggaggactggccctggcggtggcgcacgtggcccggcgccacgacatgacaatgcctcaatacgacctggcgggggaagtgctgacccaggccaggacggtgcaggccctggaacaggagcaggaagcccatcccgcccatcgctggggtgatcgcaagcagctgaagaagcatcggcgccggatggaggagttggagcaggagattgaggagcggcagcggttgctgcaccatcgctccaaccgccactgggaaactttcctggccctgctcgagattcttcagcagttcggctgccttgatgagctgacacccacggagatcgggcggaccgtggcggccttacgtggtgacaacgagctttggcttggactggccttgatgagtggacatctcgatgacctctcagcgccggatctggcggcggtgtttgaagcgatcagtaccgaggtcaaccggcctgatctctggagtggcttccctccccctcccgcagcggaggaggcactgcatgatctctctggattacgcagggagttgttgcgggcccaggagcgtctcggtgtggtgttgccggcctggtgggagcctgagctgatggggctggtggagtcatgggccagaggcactgactggtccgatctgatcgccaacacctcgctggatgaaggggatgtggtgcggatcatgcgccgcacggtggatctgctggcccaggtgccttattgcgaagcgatcagtgagcagttgcgcagccatgcccgtcaggccctgcgagcgatcaaccgcttcccggtg

SEQ ID NO: 44570 - DNA, 1368 bp, SYNECHOCOCCUS SP. WH 8102
atgaggcaggagcacgacagcattggaggtgtcgacgtccccgctgcagcgctctggggagcccaaacccagcgatctctcaacaacttcgccattggtcatcaaaagattccagcggagctgattcatgccctggcacggatcaaacagtgctgcgccgcggtgaacggtcgccatggtctgttgaacgaccaacaggtggccttgatcgaacgggcgggccaggcaatccaaacaggccagcaagatgatcactttcctctgagtgtctggcaaaccggcagcggcacgcagacgaacatgaacgtgaatgaggtgatcagcaacctcgctgctcaggaatccggagagaacctcggctcgcaccgtcccctccaccccaacgaccacatcaaccggtctcagtccacaaatgacgttttcccggcagcgatccatgtagctgcggctctgcagctgcagcaggagctgctgccagagctgaagcggctgatcgcgagtctcgatgccaaggccgttgcctggcaggacatcatcaagatcgggcggacccatctgcaggacgcagtgccgcttcgccttggagatgaagtcagcgcctggcgcgaccgactcagcgacggcgcccattggctgaccacagcccatcaagacctactggctctgccgctcggaggcacagccgtcggcagtggattgaacacgccggaccgatttgcccacgaggtttgtgctgaactcgccagccgaacgggatccgactttcagccggcggacaacctgtttgctgtcatggcgggccatgactccctggtgcagaccatggctcagctgcggcgcctggccgtgacgctgctcaccatcgctaatgacatccgcctgctggcttgcggacccagggctgggctgggggaactgctgttgccggccaatgaaccgggcagctcgatcatgccaggaaaggtgaatcccacccagtgcgaggccatggcgatggtctgcacccaggtgatcggcatggatgcagccgtcgcggcagctggtgctggggggcatctccagatgaacgtgtataaacccctgatcggctacaacctgatcgagggcatccgtctgctgcaagacgcctgccgctgtttccggctgaatctgttgaccgggatggaagcagaccgtgaccggatcgcattttacgtggagcgatccctgatgctggtgacggctttgacgccggagatcggctacgaaaaagcctgtgcgatcgcccagcacgcccaccgagacggactgacgcttcgagaggccgccatgcaatccggagcgatcacagacgaacgctttgaccagttgatcgatccagccgcgatg

SEQ ID NO: 44571 - DNA, 861 bp, SYNECHOCOCCUS SP. WH 8102
cgcaagggaatcatcctggccgggggcagtggcacgcggctgcatccgatcacccaggcggtgagtaaacaattgctgccggtgtacgacaagccgatgatctactacccgctcagcaccctgatgctggcggggatccgtgagatgttgatcatcaccacaccccatgatcaggaggcctttcagcggttgcttggcgatggcagtcgctggggcatgaccattcaatacgccgtgcagcccagcccggatgggttggcgcaggctttcctcatcggcgctgatttcctggatggggcacccgcagctcttgtgttgggagacaacctgtttcacggtcacgaccttgtgccacagctggtgagcagtgacgggcgagcggaaggtgcaacggtgtttgcctacccagtgagcgacccggagcgttacggcgtcgcggaatttgacgcagatggacgtgtgctgagcattgaagaaaagcccaaacaacccaagagccgttacgccgtgaccggcctttacttctacgacgcaacggtggtggaacgggcccggcaggtgaagccctcagcccgcggtgagctggagatcaccgatctcaaccagatgtatctggatgacggcaagctcaaggtggaattgatgggtcggggcatggcctggctggataccggcacctgcgactccctcaacgatgccggtggctacatccgcacgctggagcaccgccagggcctgaaggtgggctgcccggaagaggtggcctggcgacaaggctggatcagcggtgagcaacttgagtccctggcgcagccgctcaagaaaagcggctacggcacctacttattgcagctgctggag

SEQ ID NO: 44572 - DNA, 795 bp, SYNECHOCOCCUS SP. WH 8102
ctcggtgtgataggcctgggccgaatggcccaggcgttggtggaaccactgctgagcagcaaggcgttctcggctgagcaggtgttggcggttgtgggcactgtcgccactgcacagcgtctgcgacaaggggccttcgcgggcgtttcgatccagtcctcccgcagcgctgaagctgcgcgggtctggacggcgcccatccaattgttggcagttaagcagcagcagatcgatgggatcgccgcagcggcccccgtcgccgaaaaccagcctctgctggtgtccgttttggccggcgtcagcctggaccgcttgcagcgcctgttccccggccatcgtgtagtgcgtgcggtcccgaacaccccggcgctggtgggagaaggactcacggctctggcctggggagaggcgatcagctctgagcagcgcctcaaggttcgtgagatgtttgccggcgtcagcgaggtgctggagctgcctgaagacaagctcgatgcctttcttgccctcacctcctccggcccggcgtttgtggctctgatggctgaagcgatggcagatggtgcggttgcggctggcctgccgcgggatctgtcccatcgtctggcccatcgcaccctggctggaaccgccgcgttgctggatcagcgtcagttgcaccccgccaccttgaaagacatggtgacgtcccccggtggcaccaccatcgcaggtgtgcgcgccctggaacgggcgggagcccgctccgccttgatggaggccgtcatcgccgccgccgagcgcagccgcgagctc

SEQ ID NO: 44573 - DNA, 1839 bp, SYNECHOCOCCUS SP. WH 8102
gagctggagcgggttgatgcggtctggccttggctggcggaacgacatggcaccatcaccgccgtcgatgccccccatgcggcccatgcggagcgtttcagcttcgccgaactggcccagcggattgccacggcggcggctgcctttcagcgccagggagtgcaggaaggagatgtggtggccctgtttgcagaaaacagcccccgctggctggtggcggatcagggcctgatgcgttgcggggccgccgatgcggtgcgtggcgcctcggctccggttgaggaacttcgctacatccttgacgactgcaacgccactgccctggtggtgcagaacgccgatctctggcgtcgcctggacctgacggcgtcccagcgccaaggtctgcgattggtgctgcagttggagggggaaccggagcagggcgtgctcggttgggaggcatttctcgcctccggggccgggcagcagtccgtgacaccaaccagcgctcgcacggccatcgccactgttctgtacacctctggcaccacaggccagcccaagggcgttcccctcacgcacgccaacctgctgcatcaaatgcagtccctggcctgtgtggctcatccccagccgggtgcaccggtgttgagcgtgctgccgatctggcatgcctacgagcgcagtgccagctactacttcctctcctgcgcctgcacgcagacttacacgaatatcaaacagctgaagaaggacctgcctcgggtgcgaccgattgccatggccaccgtgccgcggttgtgggagtcggtgcaggcggggttcgaggatgtggtgaaaaccttcccgccgtcccgtcagcggctgctgcgggctgccctggccaacagcgcggctcatcgcaaagctgtgcgaacggctcgaaatctgctgctccaaccggtggctctgcccggccgcatgacagctgcagctgttgccgccctgcgctggcccctgcatgccctggcgtcagccttgatctggccaaaactgcggctgcagctcagtggtggccggctggcctatccgatcagcggcggtggtgccattgcaccccacatcgatgcgttcttcgaggcggtgggcatcgagctgctggtggggtacggccttaccgagaccagtccggtggtgagctgccgcaggccatggcgcaacatccgcggcagttccggtctgccaatgccggacacggagttccgcatcgtcgatcaagaatccggggcctcacttggtttccgggaacggggcagggtgctggtgcgcggccctcaggtgatggggggctatctgggcaaaccggaggcgagtgccaaggtgctcagcgccgacggctggttcgacaccggtgatctgggcatgcttctgcccgatggttcggtggcgctcaccggtcgggccaaggacaccattgtgttgagcagtggcgagaacatcgaaccgggtcccctggaggaagcccttgtggccagtccgctgatcgagcaggtgatgctggtgggtcaggacgaacgtcagctcggggcgctgctcgttccgcgagtggagccgatccgggcctgggccagcgagcagggcctgtccgtgggggaggacctcggcgggcgacctggtgattcagtactgctgaacctgctgatgcgggagtgcaacctcgtgctgcggctgcggcctggagcccgtggtgatgagcgcctgtgcggtgttggcctggtggagccgttcagcatcgagaacggtctcctgacccagaccctgaaacaacggcgtgatcgcatcagccggcgtgatgctgctgtgatcgagcggatctat

SEQ ID NO: 44574 - DNA, 1314 bp, SYNECHOCOCCUS SP. WH 8102
cacgacatcttcatgcctgccctcagctccaccatgactgagggcaagatcgtggaatggctgaagcaaccgggcgacaaggtcggtcggggtgagtctgtgcttgtcgtcgagtccgacaaggccgacatggacgttgagtccttccaggatggctatctcgctgcagtgctgatgccggccggcagtacagcgcccgttggtgaaaccatcggcctgatcgtggagaccgaggcggagatcgctgacgcccaggccaaggccaccagtgctgcgcccgccgcctcagcccctgcccccacaccggcccccgcagctgtgcaggctccggccccgacaccagctccgactcaggccccagcagctccggcaccggtggctgcctcagcagcgccggtggcgaacggacgggtggtggccagtcctcgggccaagaagttggcctcccagatgggcgtggacctcagcaccgtgcgcggcagcggcccccacggccgcattcaggctgaggacgtggaacaagctggtggtcagcccatctctgtgccccgggttgctgagggcactgcagctgctgttgccgccagcgcagccccgtcggcggcggcccccagtgcgccggcgggcaacagcttcgggcgtcccggcgacaccgtcgccttcaacaccctccagggtgcggtgaaccggaacatggaggccagcctcgctgtgccgtgtttccgtgtcggatacaccatcaccaccgacaagctggatgcgttctccaagctggtgaaacccaagggcgtcacgatgacggcgctgctggccaaggccgttgccgtcaccctggctcgccatccccaggtgaatgccgccaccaccgcggcaggcatgacctatcccgctgaagtgaacgtggccattgctgtggcgatggaagacggcggcttgatcaccccggtgctgcgcaatgccgaccgcacggatctctacgagatgtcgcgccagtggaaagatctggtgaagcggtcccgcagcaagcagcttcagcctgaggaatacagcaccggaaccttcaccctctcgaacctgggaatgttcggtgtggaccgcttcgatgcgattcttccccccggtaccggagcgatcctggcggtggcagcctcccgccccacggttgtggcgggcaaggatggttccatcgccgtgaaacggcagatgcaggtgaacctcaccgctgatcaccgggtgatttacggcgctgatggtgcggcattcctcaaggatctggcggagttgatcgaacatcgccccgagagcctggcgctc

SEQ ID NO: 44575 - DNA, 1116 bp, SYNECHOCOCCUS SP. WH 8102
cttagcacccgggtgatccaccacggcgagagctttgccggggacaccggcaccgtgatgccgccgatcttccccaccagcacctttgcccatggcaatgcgggcggatttgattacacccgctcgggcaaccccaacttccgcatcctcgacagcgttctggcttcggtggaaggctgcgcccacgccaccgtgttcgcctccggcgtcagcgctatcaccgctgtggtctcccaactaaaacagggtgatctggtgctctgcgaggagaacctctacggctgcaccgtgcggctgttcgagcaggtgttcgccaagttcgggttgaagaccgcttgggtggacttcacccagccagccgcactggagcagatccaagctcagacgccggcaatggtgtggctggagagccccaccaaccctttgctcaaggtgatcgacctggaggcggtctgtgccatcacccaacccctgggtatccccgtggtggtcgacaacaccttcgccaccgccctggtgcagcgccccctcgatctgggcgccaccctctcgctcaccagcaccaccaaatacatcaacggccactccgatgccctcggtggagcggtctgcaccaacgatcacgagtggcaccaaaagatggtgttctcccagaaggccctggggctgcagccctccccctttgattgctggttgatcacgcggggcatcaagaccctgccattgcgactcaagcagcagatggccaatgcagcggccctggccgatcagttagctgatcacgccaaggtgaactgggtgcgttacccccaccgcagcgatcaccctcagcatcaggtggcgacccgtcagatgcgcgccggcggagccatcgtgacggtgagcttcaacgcctgccaggagcagacctatgccctctgcaaacaactgcgctggttcaccatggccgaaagtctgggcggcatcgaaagcctgatctgccacccagccaccatgacccacgccgctgtctctgccgaggtgaaggccaagctgggcattgacgatggcctggtgcgcttctcagtgggctgtgaagacctcgccgatctgcaggccgatctggagcaggccctg

SEQ ID NO: 44576 - DNA, 954 bp, SYNECHOCOCCUS SP. WH 8102
ctggtcatgtccgccagcctctcgattgcagccgtttgcgtcggcacaagcattccgctcacgcttgcagctcttccgctctggatcctctacggagccgttacgggaaccatcgccatgggctgctgggtgctggcccacgaatgtggccacaacgcctttcatcccaacaggcgagttgaaggggtggtgggatttgttctgcacagcgcgctactggttccctattacagctgggctcgtagccatgccgttcaccacgcccattgcaatcatcttgaagggggtgaaacccatgttccaccccgtgaaagctctcctcaagggcaagcaacagaaaagctgaaacgaaagctcaacacaagactgtttggcctgatttctctgttcaaccatttgatcattggctggcagctttacctgttccttggtgccacgggtggagaagattatggcttccccacctcacacttctggaacgatgcaccattcagaaacggcaaacgtgccctattccctagttcgttccgcaaatacatggtgcgttcgaacctcggtttgatcgcaatgatgacccttctgattggggcttccattcacttctcgttcgctcgtattgcctgcctatatggattgccctacatcgtgatcaatatctggctcacctcttacacctggcttcaacatacagaccgcaacatccctcatttctcgaatgaaacatgggattgggctaaaggtgcacttcaaaccgttgatcgtccctacggtcctgtgctgaactttttacaccacggcattggttcaacccacgtttgccatcacattaattctgccattcctcactacaacgcctggcggggaacagtcatattgaggcaacgctttccagatcttgtgcgctacgactcaacaccaattcaccgtgccctgtggcgtgtcgctacagcctgt

SEQ ID NO: 44577 - DNA, 1263 bp, SYNECHOCOCCUS SP. WH 8102
atcggcgtaggtcttttggggctgggcaccgttggcggcggggtggctgaaattctgttgaatccagaggagcgtcatcctttggttgccgatctggacctgattcgtgtggccgtccggaacgtcaaccgccctcgcacggttgagttgtccgatgccgtgctgaccaccgatcccagcgaggtggtcaacgacccgaatgtggatgtggtggtggaggtgatcggtggcattgaaccggcccgcagcttgatccttcaggccatcgccaatggcaagtcagtggtgaccgccaacaaagcggtgatcgcgcgccatggccccgaaattgccagcgctgccaaagcagcaggggtctacgtgctgattgaagcggcagtcggcggtggcatcccgatcatcgaacccctgaagcaatccctcggcggcaacaggatcaatcgggtgagcggcatcatcaacggcaccaccaactacatcctcacgcgaatggcgaatgagggggctgcctacgccgatgtgctggctgaagcccagcgactcggctatgcggaagccgaccctgcggccgatgtggatggtctcgatgccgcagacaagatctccatcttgtccgccctcgcctttggcggaaccgtggaccgcgatgccctccccacgactggcatcagtgcactgcagggccgtgatgtggagtacgcgcgacaactgggctatggcgtgaaattgcttgctgttgccgaacgccttgctggccagggtgatcccttaccgctgtccctgcgagtgcaaccgaccctggtacccagcgatcacccactggccggagtcaatggcgtcaacaacgccatccttgtggagggggaccccatcggacgggtgatgttctacggccccggagcaggggccggaccaacggcatcggctgttgtggccgacatcctcaacatcgccggcatccgccaggccagtggcgatcaggggccagtggacccgctgttggcggcaggcagctggagaccgtgcgttctggcggacagcggagacatccggcagcgccactatgtgcggttcaacacggaagatgctcccggcgtgatcggcaaggtgggtggccgtttcggcgacgcgggcgtttccattcaatcgattgttcaattcaacgccagtgaggccggcgcagaaatcgttgtgatcacccatgaagtcagtcagcgcaaggtgatcgcagccctcgatgccatcacttctctcgatgaagtc

SEQ ID NO: 44578 - DNA, 1041 bp, SYNECHOCOCCUS SP. WH 8102
tcggccgtgacagcaccccggaagcgcagggtttttccgtttaccgctgtgatcggtcaggaagagatgaagcttgcgcttctgctcaatgtgatcgatccccgcatcggcggcgtgatgatcatgggtgacaggggcacaggcaaatccaccacgatccgagcgctggcggacctcctgccggacatcgaggtggtggctggagacccttacaacagttcatccacagatcccgatctgcagagcagcgaggtgcgggaacggatggaacgcggcgactccatctcaacagaaccacgccaggtgcccatggtggatttgccgctgggagccacggaggatcgtctctgcggaacgattgacatcgagaaggccctcagcgagggcgtgcgtgcctttgagcccggcctgctggccaaggccaaccgcggcctgctttatgtggatgaggtgaacctgctggatgaccatctggtggatgttctgctcgattccgctgcttcgggttggaacacggtggaacgtgagggcgtgtccgtgcgccatccagcccgcttcgtgctgatcggctccggcaaccctgaggagggcgaactgcggccgcagctgctcgatcgtttcggcatgagtgtggaggtgagcacggtgcgtgatcctgaactacgggtccaagtggtggatcaacgcacagccttcgacagcgaccccgacgggttcagtacggcggtggaagccaaccaggacgccctgcagcagcgggtcgtggaggcccagcagcgcctgggacaggtgagcatcgatgacgacctgcgcctgcggatctccgctgtctgcggcgagctggatgtggatggactgcggggtgacatagtcaccaaccgcgccgctcgagccttggccgcgtttgagggccgcacggaggtcagcgaagaggatgtcgccagggtggcctcctgctgcctgcgccaccgcctgcgtaaggatcctttggagcaggtggattccggcgatcgggtggtgaaggtcttctgcaaggtgttc

SEQ ID NO: 44579 - DNA, 861 bp, SYNECHOCOCCUS SP. WH 8102
gttcctggcatggccctgcggctggatggaaaagcgctggcagcaacggtggagcgtcgtctgaccagtgtcgttgacgcacactcgaaaacagttggtcaaccacctggactggccgtcttacgggttggtgatgaccccgccagtgccgtgtatgtggccaataaagagaaagcctgcgcccgcgtgggtatcgccagctatggagcgcacctggcggctgacacacccgctgatcaggtgctcagcacgatccagtcgctcaatgcggatcctcgcgttgatggaattttgcttcagttgccgttaccgaaggggctggatgaacgtcccctgttggaggccattgatccagagaaggatgccgatggtcttcacaccttgaatctgggccgtttgttgaaaggcgaacccggtccgcgcagctgcacaccggcaggggtgatggctctcctgcgaagcaatggcatcgaccctgccggccaacgggccgtggtcatcgggcgcagcattctcgtcgggcagccgatggcgctgatgttgcaggctgccaatgccaccgtcaccgtcgcgcattcccgaaccgctgatctggccgcccatacccgtgaggccgacatcgtggtggtcgctgctggacgtccgggaatggttggggcagagcacgtgcggccaggtgctgcggtggtggatgtcggcattcatcgcaagcccgaaggtggactgtgcggcgatgttgtggcggaggaggtggaaccgatcgctgcagccctgtcccctgtgcccgggggagttggaccgatgacggtgaccatgcttctggtgaacaccgtggtggcctggtgccgacgtcatggcatc

SEQ ID NO: 44580 - DNA, 870 bp, SYNECHOCOCCUS SP. WH 8102
tttgatttcaaggcctatctcgccaaagccaaggcgacggtggagcaagccttggatcagtccttggtgccggagcggccggagtcgctgcgtgaagccatgcgctactcactgctggcaggaggaaagcgtctgcggccaatcctctgcctggccgcctgcgagctggcgggtggggatgctgcccaggccatgccaacggcagtggcgctggagatgattcacaccatgtcgttgatccatgacgaccttccggccatggatgacgacgacctgcggcgtggacgccccacaaaccacaaggtctatggcgaggctgttgcgatccttgccggtgacgcattgctgacccgtgcctttgagatggtggcgctgcgtagtcctggggttccgcccgaacggctgctcaaggtggtgggagagctgtcgttggtggcgggggcccctggcctggtgggcggtcaggtggttgatctggaaagcgagggcaaggaggttgatcttgaaaccctcgagtacatccacctccacaaaaccggcgcgttgttgagcgcctgtgtgatcaccggcgcgatgatcggtggcgctgatgatgagctgattgctgcgttacgggtctacgcccgggggatcggcctggcgttccagatcattgacgacatcctggacatcacggccagcagcgaggtgcttgggaaaacagccggtaaggacctgatcgctgacaaaacgacgtatcccaaacttctcgggctcgaggaatcccgcaaacgggccgctgatctggtgcaggaggccaaaggggtgctcaagccatgggcaagcaaagcccaaccgctgctggccctggcggattacatcaccagccgt

SEQ ID NO: 44581 - DNA, 255 bp, SYNECHOCOCCUS SP. WH 8102
cgctggcggctgctgatccacgggcgggtccagggggtcggctttcgagccagctgcaatcggcgcgcactggacctcggactgcggggctggatccgcaacctgcgagacggcagtgttgaagtgcaggccgaggggccgcccctggcgatttcagagctgcgggcctggtgcgagcaggggccccctggagcacaggtgctgagagttcagctgagtcagttgccggtgaccggtgatgattggtttgaggtg

SEQ ID NO: 44582 - DNA, 1518 bp, SYNECHOCOCCUS SP. WH 8102
atggtcgccaccgccaccaatcccctgcgggtcggtctccgacaggaacgggtcatcgcaccgcaatgtctggtaattttcggcgccagtggtgacctgacccaccgcaagctggtccccgcgctgttcgaactgttcaagcagaggcgacttcccagtgaattcgcccttctcggctgcgcccgccggccctggagcgacgacgagtttcgcggaaaaatggccgaggccctggccagcaagatcgccgagaaccaggaagcctgggatcagttcgtctcgaagttgttctacgaacccgtcgatctgcagcaaccggaggatgtggttcgcctggggaaacgcctggaaaccgttgatcaacagtgcgccacccgcggcaaccgcaccttctatctctcggtgtcaccgaagttctacggcagtggctgtcgcgcgctagcggatgccggtctgctgaaggatcctcaacgcagccgcgtggtgatcgagaagcctttcggtcgtgactacggcagcgctcaagccctgaaccgtgttgtaaaaagctgcgggcaagagaatcagatcttcaggatcgaccattacctaggcaaggaaacggtccagaacatcatggtgctgcgctttgccaacaccattttcgaaccgatctggaaccggaactacatctccagtgttcagatcactgccgccgagaccgttggagtcgaggagcgggccgggtattacgagacctccggtgccctgcgggacatggtgcagaaccacctgacccagatgctggccatcacagccatggaaccgccaggtcgctttgacccggaggcgatccgcaacgaaaaggccaaggtgttgcaagcggcacgactggctgacgagcaggagccatggaactgctgcatccgcggtcagtacggccccggcggcagccatgacgctcccctggccggataccgccaggaacccggcgtcgatcccaacagcaccacggagacctacgtcgccatgaagctgttcgtcgacaactggcgttggcagggggtccccttctacgtccgcacaggcaagcggctggccaaacgcctcagcgaggtggtgctcaccttccgcgaagcaccagtgcatctcttcgatgcagccaccggcggccccacggccaaccagttgattctgcgcatccagcccgacgaaggggcggaattccgcttcgaagtgaaatcccccgggtccggcatgcgcagccgtccgatcgacatggagttctcctacgacgagtccttcggggagccctccgatgagggctatgtccgcctgctggcggacgccatgctcagcgatccgaccctgttcacccgcagtgacgaggtggaagcggcctggcgtctgtacaccccgctgctggagctgatcgaagacagcccttggcagctgccgatccatccctacgaatcccgcacctggggacctgccgccgctgatgccctgctggcccgtgacggactgctctggcgtcgt

SEQ ID NO: 44583 - DNA, 2616 bp, SYNECHOCOCCUS SP. WH 8102
atcagctctcagtcagctgccagcgccatggtttccgccgctcctgtccgccttgcggactacagcccatggccattcgcactgccggcaatccatctggctgtcgacatcagaccgggcgatgtcctggtgacaagccgactggatctggagccgagaggaggtgctgaagctcttcagctccgtggggtggatcttgagatctgcagcatcaagctgaatggcgacgatgttgccggtgatgactacagctatagggatcagctgctgaccatccactcaccgccgagcaagccgtttgttctggagacctgttgccgcattgatccctacaacaacagttctctcgagggcttgtacgtcagtggagggctactgagtacccaatgcgaagcggaaggattccggcgcatcacctttcatcccgatcgccctgatgtactcagccgttggacggtgaggatcgaggcgtcacgtgccagctgccccgtgctgctgagcaatggcaatgccatctccgaggaggagctgacggatgggcgtcatgccgtgacttggaaggaccccttcccgaagccgtcttatctgttcgccctggtggcgggcgaattgcgcgaaattcgcgatttgtacaccacggcatcaggtcgtgcggtcacgcttcgcttgcatgtggaggagggggatgagccttactccacccacgcgatggagtcgctgaagcgttccatggcctgggatgagcaggtgtatcagctcgaatacgacctcgacgaatacaacatcgtcgcggtgcgccacttcaacatgggcgcgatggagaacaagagtctcaatatcttcaattcgaagttggtgctggctgatgccgaaacggcaacggatgcagagttggagcggatcgagagcgtgatcgcccacgagtacttccacaactggagcggtaaccgcatcacctgtcgcgactggtttcagctctcgttgaaggaaggtctcaccgtgttccgtgatcagagtttcacggcggatctgcactctgcagccgtgaaacggattgaagatgtggcgatgctgcgcaacacccagttccgtgaagatgccggcccgacagcgcatccggtgaaacctgctgaatatcaggcgatcgacaacttctatacgacaacgatctatgaaaaaggggcggaattgatccgcatgctgcacaccctgttggggcaggagcggtttatgcgcggtatggcgacctatgtgagccgttttgatggaaccgccgcgaccacagaggattttgtgcaatccatcgtcgatggtgctgcgcaagacggtcagcccctcggctttgattcggagcggttcaagcgttggtatcaccaggctggaacgccggagctcacggtgcaacggcagtgggatgcggtcaaaggggagttgacccttgaactgcgtcagtccacgccgccaaccccaggacaaaccgagaagcaacccctggtgttgccaatcgccgtggcgctggtgggggagaagggccgcatcggcgaagaacagctgctggtgatggacggagatcaggccagcctgacgctccagggtgaccccggcagcgcagcaccggccctgtcgctgttacgccgtttctcggcaccagtgaatgtgcagctggagcagtcgctgcaggaatctctgcaattgttggcccacgacgatgaccccttcagccgttgggacgcgggccaacggctggcccgccaggtgctgctggcccgcgccagcggtgagccagacgcgacagtggaagcggccttgattcaggccctgcgccaacggctgaacgccttcgacggtggtggcggccaggacctggcggtccttctggctttgcccggtaccgcggaactggaagctctgcagaacccggtggatcccccggctctgtacgcggcgcgacgggagtggatcgcggagctgggtcgtcagctcgccgatccgctgaatcagcttctcgatgtctgtcgcggggagtggccgcaggcctggcctgctggacagggcgggcgttcgctgacgggtctggcttggagttggctggcggccgcaggagacgcggaagcccgcaaccaagctctcgaggcggtgtcgggtccgtcgatgaccctggcgcgggcagccctgcgggccttacaacccatggaggtggacgagcgggatctggccctggatcgcttctatcagcgttggcaggataagccggtgatcctcgatgcctggtttgccctggaggcatcagccccgagaaccgacggattgcaacgagtccaagcactgctggaacatccccgcttcgacccactggcaccaaactccctgcgtgcggtgctggggggattcacggccaacgttccggtgttccacgccatcgatggcagtggttatcgcttcatggccgatcagatcgctgcggtggatcgccgcaatccgattacggcttcgcgcatggccaaggtgttcagccgctggagcagttacggcgttgatcgacagtcagccatgcgtcaagccatcgaccagttggcagctggtgagttgtcttccaacacggctgaagtggtggcc

SEQ ID NO: 44584 - DNA, 1062 bp, SYNECHOCOCCUS SP. WH 8102
caccgcgtcgtcctgcttcctggagatggcattggcccggagatcacggctgtggcgcgccagttgctcgaggcggtgagccagcggcatggttttgaactgtgttttgacgggcagttgatcggtggcagtgccattgatgcctgcggtgagcccctgcccgccagcacgctcgacgcctgcaaggctgctgatgcggttttgctggccgccatcggcagcccccgcttcgacaaccttccccgcgacaaacgaccggaaaccggtttgctcgggctgaggtcaggcatggctctgttcgccaacctgcgccctgtgaagatcgttccggcgctcatcggtgccagcagcctgcgtccggaggtgatcgagggtgtggacctgatggtggtgcgagaactcaccggcgggatctacttcgggcagcccaagggacggatccaggccgacggagaggagcgtggcttcaacacgatgacctactcctctagcgaggtggatcgcatcgccagggtggccttcgacctggcccgggaacgtcgcggcaacctctgctccgtggacaaggccaacgtgctggatgtgagccagctgtggcgggaccgggtggatgcgatggctcccgcctacagcgatgtggaggtcagccacatgtatgtggacaacgccgcgatgcagctggtgcgcagtccacgccaattcgacgtgctgcttacggggaacctgttcggagatatcctcagcgatgaggccgccatgctcaccggctcgatcggcatgcttccatcggcctcccttggcagcgactgtcctggcctgttcgagccggtgcatggctctgcgccggacatcgccggccaggacaaggccaatccaatggcgatggtgctctcggccgcgatgatgctgcgaatcggtcttaagcagacggaggctgccgctgatctcgaggcggctgtggacaaggtgttggcggctggcttccgcaccggagatctgatggcagagggctgcaccgcgctgggatgccgtgccatgggcgacgcattgttgaaggctctc

SEQ ID NO: 44585 - DNA, 1071 bp, SYNECHOCOCCUS SP. WH 8102
atggcgctcgttccgcttcggcttctgctcgaccacgccgccgagaacggctacggcatccctgcgttcaacgtgaacaacctggagcaggtgcaggcgatcatggaagcggctgacgagacagacagccccgtgatcctgcaggcttcccgtggcgcccgtaactacgccggtgagatcttcctgcgtcacctgatcctggccgccactgagacctatccccacattcccgtggtgatgcaccaggaccacggcaacgctcctgacacctgctattccgctgccattaacggcttcacctccgtgatgatggatggctccctggaagccgacgccaagactcccgccagctacgagtacaacgtggcagtcacgaagcaagtggtggatttcgcccactccgtgggtgtgagcgttgaaggtgagctgggctgcctgggctccctggaaaccggcaagggtgaagccgaggacggccacggtttcgagggtgaactgtccaaggacatgctcctcaccgatcccgctgaagcagctgacttcgttgccaagaccaagtgcgacgccctggccatcgccatcggcaccagccacggcgcttacaagttcacccgcaagcccaccggtgaagtgctggccatcagccgcatcgccgagatccacaaagccatccccaacacccacctggtgatgcacggctcctcctccgttccccaggaatggctggagatgatcaacaagcacggtggtgccatccccgagacctacggcgttcccgtcgaggagatccaggaaggcatccgcaatggtgtgcgcaaggtgaacatcgacaccgataaccgcctcgccttcaccgctgctgtgcgtgaagcggccatggccgatcccgccaacttcgaccctcgccacttcaacaagccggctcgtaagtacatgaagcaggtctgcctcgaccgctatcagcagttctgggccgccggcaatgccagcaagatccagcagcagaccatcaactactacgccggtctgtacgccaagggtgcactcgatcccaaggccgccgtcgccgct

SEQ ID NO: 44586 - DNA, 1005 bp, SYNECHOCOCCUS SP. WH 8102
atgcgcattggtatcaacggcttcgggcggatcggacgcctcgtgttccgagcgctctgggggcggcccggcatcgagctggtgcatgtgaatgaccccgcgggcgacgctgcaacggccgcccatctgctggagtttgattccgttcacggtcgctgggatcgcggcatcagcagtgatgcggacggtttctccgtggagggatcaccactgacctggtcgagcgagaaagaccccacagcagtgccctggacagcgcgcggggtggaaatggtgctcgaggccagcggcaagatcaaaacacccgagaccctcagtccctatttcgagcaggtggggctgaaacgggtggtggtggcctgtccggtgaagggtgatgtggccggcgaggaggcactcaacatcgtttacggcatcaatcacgacctttatgagccagaccggcacaagttggtgacggccgcttcgtgcaccaccaactgcctcgctcccgtggtgaaggttgtgcacgagagcttcggcatcgagcacggaatgatcaccaccattcacgacatcaccaacacccaggtgccgatcgatgccttcaagagcgatctgcgccgggcccgctccggcctcacatccctgatcccgaccaccacgggctccgccaaggcaatcgccatgattttccctgagctcaagggcaaactcaacggccatgccgtgcgggtaccactcctgaatggatcgctcaccgatgcggtgttcgagctcaagcagagcgtcacggtggaacaggtgaatgatgcgttcaaggccgcctcagagggcgcgctgaagggaatcctgggctacgaagagcgccccttggtgtcgtgcgattacaccaacgacaaccgcagttcgatcatcgatgccctctcgacgatggtggtcgacgacaaccagttgaaagtgttcgcctggtacgacaacgaatggggctacagctgccggatggctgacctcacctgtcacgtg

SEQ ID NO: 44587 - DNA, 513 bp, SYNECHOCOCCUS SP. WH 8102
ttggatttacagacttatatccgctcaattccggactttcccaagccgggcatcctgtttcgggacatcaatccattgctgcgaaatcccgctgcgatggtggaggtgatgcggcgtcttggcgcgatctgcgatgcggtgcagccggatctcattgttggcattgaatccagaggcttcatcgttggcacgccgctggccctgcagcgctcccttggatttgtccccgttcgtaaaccgggaaaactgcccggagcagtgatcggggtggattatgccctggagtacggcactgatcgactcgaaatccagagcgatgccctgaccggcaatccccgggtgctggtggtggatgacctgctcgccacgggtggaacggccgcggccacaggctcgttggtgcgtgctgcaggcggtgagctggtgggatttgcctttgtgattgaactggagccgcttggaggacgttccgccctgcctgatgaggttcttgcggagtcgttaatccgttac

SEQ ID NO: 44588 - DNA, 819 bp, SYNECHOCOCCUS SP. WH 8102
atacccgtcgtggtggccggtgcccttggtcgcatgggtgccgaagtgatcaaggcagtggtgggatctgcggattgcatgctggtgggggccatcgacaacacccccggcaaagaggggagtgacatcggccttgaactgggactgggcgagctggaggttgcggtgacagccgatttcgaaggctgcctctgcgccgtgagccagtcggtgcgggatgcggaagccggggcggtgctggtggatttcacccatccgtcggtcgtctatgagcacacccgggcagcaatcgcctacggcgtacatccagtgattggcaccacagggctctccccggagcaattaagtgatctttgtcagttcgctgccaaggcctccatcggaggcgccgtgattccaaatttttccgtcggcatggtcctgttgcagcaggccgctgcagcagcagcacgcttttacgaccacgctgagctcaccgaactgcatcacaactgcaaggcggatgcccccagtggcacctgcatcaaaaccgccgaactgatggaggagctcggcaagagcttcaaccctgccgaagtggatgagcatgaatcgctggcaggctcccgaggtggtcgtcgtgagagcgggcttcggctccattccctgcgcttaccgggcctagtggcccatcaggaagtgatgttcggtgcaccgggcgagacttacacgctgcgccacgacacgattgatcgttccgcctatatgccgggtgtccttctcaccgtgcgcaaggtgcgttcactgcaaacgttggtctacggccttgaacggctgatc

SEQ ID NO: 44589 - DNA, 4047 bp, SYNECHOCOCCUS SP. WH 8102
caagcggcgactcgccgtaaggttcttcacattgctcaagacgcgcagatgttcacacaggtccgctccgccgatcgccgcgttgctcctgtagagggacagagccacaagtccgtgatgaaggcggtttatgtggtgcttgagccccagtaccagaacgcgctgactcaggcggcaacagctctcaatgcgtccggcagtgaacttggaatcgagctgagcggctatttgatcgaagagctccgtgacgaggagaactacgccggtttctgtgaggacgtggcacaggcggatgtgttcgtcgcctcgttgatcttcatcgaagatctggcacagaaggtggtggatgccgttgcaccccatcgcgaccggctcaaagcggcagttgtgttcccctccatgccggaggtgatgcgtctgaacaagctcggcagcttttccatggctcagttgggccagagcaagagcgcgatcgccggtttcatgaaaaagcggaaggaggccggtggtgctggtttccaggacgccatgctcaagcttctgaacacgcttccgactgttctcaagtacctgccggttgagaaggcgcaggatgcccgcagtttcatgctcagcttccagtactggctcgggggaacgccagacaacctgaagaacttcctgctgatgctggcggacaagtacgtcttccctcctgcagaaggcgaggagcgtccagcgatggaggttgccgagcctgaagtgttcccggatctggggatctggcaccccttggctcccatgatgtttgaggacctcaaggagtacctcaactggaccgccagccgcaccgatctctccgaagaagcccgcaaaggtccggtgatcggtttagtgctgcagcgcagccacatcgtcaccggtgatgacgcccattacgtggccacaattcaggagctggaattccgcggtgcccgcgtgattccgatcttctgcggcggcctggacttctccaagcccgtcaacgccttcttctacgacccgctcaaccctgagcagcctctggtggatggcatcgtttccctgacgggctttgcactggtgggtggcccggcccgacaggatcatcccaaggcgatcgagtcgctgaagaagctcaaccgcccttacatggtggctttgcctcttgtctttcagaccacccaggaatgggaagacagcgacctgggtctgcacccagttcaggttgcacttcagatcgccatccctgagctcgatggtgcgatcgaacccatcgtgctctcaggccgtgatgacgccacaggtaaggcacacaccctgcaggaccgagtggatgccatcgcagagcgcgccatccgctggtcgtccctgcggatcaagccccgcatcgacaagaagctggcgatcaccgtgttcagcttcccgccggacaaaggcaatgtcggcacagcggcttacctcgatgttttcggctccatccatcgggtgatggaggagatgaaggccaagggctacgacgttcaaggtctgccctccacaccaagagctttgctcgaggctgtcatcaacgacgccgatgccatgcagggagcccccgagctctcgatcgcacaccgtatgagcgtggaggagtacgagcgcctgacgccttactccgaacgactggaagagaactggggcaagccccccggcaacctcaacagcgatggccagaacctgctggtgtttggtcgccatttcggcaacgtctttgttggcgttcaacccaccttcggctacgaaggcgacccaatgcgcctgctctattcccgtagtgcaagcccccaccacggttttgccgcttactacacctatttgcagaagatctggaaggctgacgcggtgctgcacttcggcactcacggctccctcgagttcatgcccggtaagcagatggggatgagcgaaacctgctatcccgattcactgatcggtgcactgcccaacctctattactacgccgccaacaacccctccgaggccaccattgccaagcggcgtggttatgcctcaaccatcagctacctcacccctccggccgaaaacgcaggcctctatcgaggtttgaaggaactgggtgagctggtgggctcctaccagcagctgcgcgaaggtggccgcggcattcagattgtcaacacgatcatcgagacggcacgtcagtgcaatctcgataaggacgtcgatcttcctgaggatgatgcttcgacccttgaactagacggacgtgatgccctggtgggtgccgtttaccgccagttgatggagatcgaaagtcgactgcttccttgcggtctgcacaccatcggcaaaccaccaacagctgaagaagctgttgccacccttgtgaacatcgctgctcttgagcgcgaagaagatggcctgcgctcacttcccggcctgttggctgaggccatgggtcgttccattgaagacatctacaaaggcaatgactacggtgtgctcgccgatgtggagctgaaccgcacgatcacggagacatccagggccgccatcggcgccatggttcgctccctgaccggccttgatggtcgcgtcagcatgcgaaacagcttcggttggttctacgacctgctggcgaagttcggactcaagctcccttctccctggctgcgggcctgttgcggggctggttttgtccagattgatgccactgaactcgacaaactgtttgcctatctgcgcttctgtttggagcaggtgtgtgccgatatggaaatggagagtctgctcaaggctcttgacggtgactacatcctcccggggcccggtggtgatccgatccgtaatcctggcgtcctgcccagcggcaagaacattcacgccctggacccccaggccattccgaccagggctgctgtcgccgcagcgaagagtgttgttgacaagttgattgagcgtcagcgcgaggagcagggcacctggcccgaaacgattgcctgcgtgctctggggcacggacaacatcaagacttacggcgaatccctggctcagatcctttggttcgtcggtgtcaagccgatgcctgattccgtgggtcgggtgaacaagcttgagctgattcccctggaagagctgggtcgcccccgggtggatgtggtggtgaactgctccggtgtattccgtgatctgttcatcaaccagatggctttgattgatcaggccgtgaaaatggcggccgaggcggatgagcccctcgagctgaatttcgtgcgcaagcacgctctggagcaggcagagaaagagggcacctcccttcgggatgccgcctgccgcgtgttctccaatgccagcggcagctacagctccaacgtgaacctggcggtggagaacagcacctgggaggaagagggcgagcttcaggagatgtatctctcccgcaagacctttgccttcaatgctgataaccctggtgagatgaaccagaagcgtgaggtgttcgagaacgtgatgaagacggcggatgtcaccttccagaacctcgactccgcggagatctccctcacggatgtcagtcactactttgactccgaccccaccaaactgatcgccggcctgcgggatgacggcaaagctcccaccagctacatcgctgacaccacgacggccaacgcgcaggttcgttcgctgagtgaaacgattcgcctggattcacgcaccaagttgctgaatcccaagtggtacgagggcatgctcgactctggttatgaaggtgtgcgtgaagtggcaaagcgcctcaacttcacccttggctggagtgccaccagtggtgccgtggacaacttcgtgtacgaggaagccaatgacaccttcatcaatgatccggagatgcgcaaacgcctcctggaactgaatcccaacagcttccgtcagatcgttggaactctgctggaggttcatggccgtggctattgggagacgtccgatgagaacatcgaacaactccaggagctgtaccaagaggttgaggatcgcattgaaggcgtc

SEQ ID NO: 44590 - DNA, 723 bp, SYNECHOCOCCUS SP. WH 8102
gtgcgtagaccggtgattgctggcaactggaagatgcacatgacctgtgcccaggccagggattacatggcagcattccttccgcaaattgaacgtgccccccaggaccgcgagatcgtcctggctccgcccttcactgcgctctccaccatggcggcagcagctgaacactccgttgtgggactcgccagtcagaacgtccattggcaggaccatggtgcattcacagccgaaatttcggccgagatgctgttagagcacggcgttgcatacacaatcgttgggcacagcgagccccgcaaatacttcagcgaaagtgatgagcagatcaaccacagggcccgctgctcccaggccaaggggttgatccccatcgtctgtgttggagaaagtgatgagcagcgcgaacggggtgaagcggagcgggtgatccgccgacagatcgagcagggacttgaagggttggacgccaacaaacttgttgtggcctatgaaccgatctgggccatcggcacgggtaaaacctgcgaagcagccgaagccaacaggatctgcggactgatccgaagctgggtgggagccaccgatctgatcattcagtacggcggatccgtgaagcccaccaacatcgatgaactcatggccatgagtgatatcgacggcgtcttggtcggtggtgcatcgctcaaacccgacagtttcgcccggattgccaactaccag

SEQ ID NO: 44591 - DNA, 1701 bp, SYNECHOCOCCUS SP. WH 8102
cgcctccttccgctgttgcgaccacacctccgtcagctgatgacgggtggtctgtgcatggtggtttatgtcggcagctttccagttttggtcagtctggcgggagagttgttccctgcgctcggctcaaaggacctcagccgcgtcctgcagttgattgcccaggcagtgctgatctttgctgttcaaaagctggctcagttcggccaggactcgctgctggcggagccagcgttgctcgtgagtcagcgtctgcgcagagaactgttcagcactcttcaacgtgttgagctcggtgctttggaaaagctctcagcgggcgatctgacctaccgcttaacagaggatgctgatcgcgtcagtgaggtgctctacaagacgatccacgacaccgtccccagcgtgctgcaactcctggtggtgctggggaccatgctctggcttgactggaagctcaccattgccatccttttgctggcgccggtgatcgtttggttgatcagccttttcggtgcgcaggtgatgcgggctaccgagcggagtcagaaaaaggtaagcgagctggcagggcttctcggtgaggcgatcgagggcttgcctctggtgcgagcctttgcggcggaaccctggttgcaggatcgcttcgaacaggaaatctcccagcaccgtcaagctcgtcagcgcacctacttgctggtggctttgcagcaccctgtggtggggatcattgaggtgatcggtttatttgctgttcttgggctagctgcctggaggattgaaagcggagatctgacgatccccggtctcagcagctatctcaccggtttgatcgtgctgatcgatccaatcgctcatgtcacgaacaacttcaatgagtttcagcagggccaggcctctttgcggcgcttgcgcgaaattgagcaggagccacttgagcccagcgatccggctgactccgtatcgcttggggacgtaaaaggcgccctaagccttgagtcactgagtttccactacgttaagggtcagactgttcttgatcgtctagaccttcaggtgccggctggttcagtgctggcggttgtggggccttccggtgctggtaaaagcaccctgttctccttgctgttgcgtttcaacactgcacaacagggaagtattttgcttgatggtgttgacatcagctccatgcgatcccgggagctgcgtcaacgggtggctctggttccccagcgaacaactgttttctccggatcgatcgctgaagccattcgctttggacgtcgtgccacccatgaacagatggtcagtgctgcccggctggccaacgccgatgattttattcaggcgcttcctgatggctacaacacgaagttggaggagcgtggaagcaatctctccggaggccagctgcagcgcattgcgattgcccgagcggtcctgggcgatcctgcaatcttgctcctggatgaagcaacaagtgcactggatgctgaggcggaggcggctgtgcaactaggcctcaatcgggccatggcggatcgcacggtgattgtgattgcccatcgccttgccacggttcaggaggctgacaagatcgttgtcctggagcatgggcggatcgtcgagttgggatcccatgcagagctcatgaacgcctatggccgttatcgtgatctttgtgaacgccaaatcattcgcgga

SEQ ID NO: 44592 - DNA, 3318 bp, SYNECHOCOCCUS SP. WH 8102
ctgcccatgcctcggaggaccgatctgcggcgcatccttctgctgggctccggtccgatcgtgatcggacaagcctgtgaattcgactattccggaacccaggcctgcaaagcattgcggtctgaggggtacgaggtgatcctcgtgaactccaatccggcttcaatcatgaccgatccggagatggcggatcggacctacatcgaaccactgacgcctgatgtcgtcacccgtgtgatcgaacgggagcgtccggatgcactgctgccaaccatgggcgggcagaccgctctgaaccttgccgtcaccctggcggaaaacggcaccctggagcgttacggggttgagctgatcggagccgatctccaggccatccagaaggcggaggaccgtctgctgttcaagcaggcgatggaacgcatcggagtgcaggtctgcccatccggcatcgcctccaccctggaagaagctgaagctgtgggagccgccatcggcagcttcccgagaatcatccgaccggccttcaccctggggggtagtggaggagggatcgcatacaaccctgaggagtacgccgccatctgcaaaagcggtctggaagccagtccggtctcccagatcctgatcgaacagtccttgctgggttggaaggaatttgaactcgaggtgatgcgcgatcaggcggacaacgtcgtgatcctctgcagcatcgaaaacctggatccgatgggcgtccatacgggcgactccatcacggtggctccggcacagacgctgacggatcgggagtaccagcgactgcgggaccaatcgatcgcgatcatccgcgaaatcggcgttgccaccggaggcagcaacatccagttcgccatcaaccccgacaacggcgatgtggtggtgatcgaaatgaatccaagggtgagccggtcctcggccttggccagcaaagccaccggattcccgatcgccaaaatcgccgctcggttggccatcggcttcacgcttgacgagatcctcaacgacatcaccggtaagacaccggcctgttttgagcccaccattgattacgtggtcaccaagattccacggttcgcttttgaaaaattcaggggcagcccggcggtgctcaccacatcgatgaagtcggtgggagaagcgatggccatcggccgcagcttcgaggaatccttccagaaagcgatgcgttccctggaaaccggttattccggatggggtggggacagaccggaaccggagctcagtgaagccgatatcgatcgcctgctgcgcaccccgtcaccggagcggattctctgcgtccgcagcgccatgctgcgtggccgtagcgatgctgagattcaccggatcagcagcattgatccctggttcctggccaagctgcgaagcatcgtcgacgctgagcaacagctgttgcgcggtcggcagctgggcgacctttccgctccgaagttgctcgaactcaagcaactcggcttttcggatcgccagatcgcctggcagaccgatagcgatgaattgagtgtgcggcgtcatcgccatgaccacgggatccgagccgtgttcaagaccgttgacacctgtgcggctgaattcgcatccaccacgccatatcactactcgacctacgagcgctcgatccaacagctgaacagcgacggaagcctcacaacgctgtccccagccagcgaagtgagtaatagcagcagcgggcgcaaggtgatgatccttgggggcgggcccaaccgaattggccaggggatcgaattcgactactgctgctgccatgcctccttcgccgctcaggacgcaggcatcacatcggtgatggtgaacagcaacccggagaccgtctcgacggactacgacaccagcgacagcctttatttcgaacccctcaccctcgaggatgtcctcaatgtgatcgaggtcgagcaaccggacggcgtggtggtccagttcggggggcagaccccattgaaactggcgattcccctgctgaactggctcaactccgaggaaggtcgcgccacagggacccagatctggggcacgtctccggagtcgatcgaccgtgctgaagatcgcgagcagttcgaagcgatcctgagccaactggagattcgccagccccggcatggcctggcccgcagtgagacggaagcccgggatgtggcgacccgcgtgggctatccggtggtggtccgcccgtcctatgtgctgggtggtcgcgccatggaggtggtcttcgacgaacaggagctgaatcgctacatgctggaggcggttcaggtggaacccgaccatccggtgctgatcgaccagtacctggaaaatgcggttgaggtggacgtcgatgcgctctgcgaccacgaaggcaacgtggtcatcggcggcctgatggaacacatcgaaccggcgggcatccattccggtgattccgcctgctgccttcccgccgtctctcttggagagggagccctcggcacgatccgtgagtggagccgcggcctggccctcgcgttgaaggtgcaggggctgatcaacctccagttcgccgttcaacggaacgccgagggtgaggaagtcgtttacatcatcgaggccaatccgcgggcgtcccgcacggtgccgttcgtggccaaggccaccggtcagcccctggctcgcatcgcgacccgtctgatggctggcgaaacgctgcaacaggtgggattgacgacagaacctcaaccaccactgcaaacgatcaaggaagccgtgctgccgttcagacgcttcccaggtgcagacacggtgctaggcccggaaatgcgctccaccggtgaggtgatggggtctgccgacagtttcgggatggcctacgccaaggctgaactgggcgccggcgaagcactccccaccaccggcacggtgttcctgtcgacccataaccgtgacaagcccgctctggttcctgtggccgaacgacttgccaaattgggcttcgatctgatcgccacctcaggcaccgctgatgttctgaccaaggcggggctgacggtgaacgctgtgctgaaggtgcatgagggtcgccccaacatcgaggacatgatccggtccaatcaggtgcagctggtgattaacacccccatcggccgccaggctgcccatgacgacaagtacctgcgccgggcagccctggactatgccgttcccactgtcaccaccctggctggtgcccgcgctgcggtggaggccatcgccacacttcagagccagcccaccctcagcatcaatgctctgcaggacgtccatggc

SEQ ID NO: 44593 - DNA, 1323 bp, SYNECHOCOCCUS SP. WH 8102
tccggcccgatgtctcagcgtttcgaaaccctccagctgcatgccggccagtctccagactcggccaccaatgccagagcggtgccgatttatcagaccagctcctacgtcttcaacgacgccgagcacggcgccaacctgtttggactgaaggaattcggcaacatctacacccgtctgatgaacccgacgacggatgtgttcgagaagcgggtggcggccctggaagggggtgtggccgcgctggccacagcctccggtcagtcggctcagttcctggcgatcacgaattgcatgcaggcaggggataactttgtgtccacgtcgttcctttacggcggcacctacaaccagttcaaagtgcaattcccccggctgggcatcgacgtgcgcttcgctgatggcgacgacgtggagagctttgctgcgcagatcgacgacaaaaccaaaggcctctacgtcgaagcgatgggcaatccacgcttcaacatccccgatttcgagggcctctcagccctggctaaagagcgcggcatcccattgatcgtggacaacaccttgggagcttgcggtgccctgatgcgtccgatcgatcatggcgcggatgtggtggtggaaagcgccaccaagtggattggcggccatggcaccagcctcggtggcgtgatcgttgatgccggcacatttaactggggcaatggcaaattcccgctgctgagccaacccagtgcggcttatcacggccttgtgcactgggatgccttcggcttcggcagcgacgtctgcaagatgctgggagtgccggacaaccgcaacgtcgcctttgccctgcgagcccgggtcgagggtctacgggactggggtccggcggttagtcccttcaatagcttcctgctgctgcaaggtctagaaaccctcagcctgcgggtggagcgccacacggagaacgccatggcgctggccacctggctagcaacgcaccccaatgtggagcatgtgagctacccaggcctgagcagcgatccgtatcacgcagctgccaagaaatacctgacgggccggggcatgggatgcatgctgatgttctcgctcaagggcggttacgacgatgcagtccgtttcatcaacagccttcaactggccagtcacctcgccaatgtgggggatgccaaaaccctggtgatccatccggcatcaacaacccaccagcagctcagtgaagacgaacaggcatcggcgggcgtgacacccaccatggtccgcgtctccgtgggacttgagcacatcgacgacatcaaagccgactttgaacaggcccttgcc

SEQ ID NO: 44594 - DNA, 1535 bp, SYNECHOCOCCUS SP. WH 8102
atgagcgatcagcagcactgggatgccgtggtgatcggctccggcatcggcgggttggtcaccgccagccagctggcggccaagggagctcgcaccttggtgctggagcgctacctgatccccggcggcagtggcggtgccttcaagcgcgagggctatacctttgatgtgggcgcctcgatgattttcggcttcggtgagaagggctacaccaacctgctcaccagggctctcgctgatgtgggcgagcactgcgagaccattccggatcaggcccaactcgagtaccacatgcctggggggctcaacatcgccgttgaccgcgattatgagacgttcatcgctgatctgtccgcccgtttcccccacgaggccactggcgtccgccgcttctacgacacctgttggcaggtgttcaactgtctggatgcgatgccgttgctgtcgctggaagatccggcatacctcaccaaggtgttcttcaaggcaccactggcctgtctggggttggcccgctggctgcccttcaatgtgggtgcggtcgcccgccagcacatcaatgatgagcagctgctgaagttcatcgacatcgaatgcttctgctggtcggtgatgccagccgatcgcaccccgatgatcaatgccggcatggtgttttccgatcgccatgccggtggcatcaactacccccgtggtggtgtgggtgtgatcgctgaaaagctggttcatggtcttgaacgccatggcggcgccattcgctacaaagcgcgggtcaccaaggtgctgctcgagaacggtgaggcggttggtgtgaagctggccgatggcgagaccatccgggccaagcgggtgatctccaatgccacccgctgggacaccttttcggggcaggacgatggctccacgcgggccgggcaggcgctggtggatgaagccaacactccgaagaaggaggccttctggcgtcgccgctatgtgccgtcgccctcgtttctctccctgcatctgggggttcgtgccgatctgattccagccggtacccactgccatcacctgctgctcgaagactggaaccggatggaggacgagcagggggtgatctttgtgtcgatgccgtcgttgctggatcctgatctggcaccggccgggcatcacattgttcacaccttcacaccgtcgtcgatggaggcatggcaggggctctcccccactgattaccgggccaagaaggaggcggatgcggctcgcttgattcagcggcttgaggcgatcctgcctggcctcagtgaagccatcacccacaaggagatcggcaccccccgcagccaccggcggttcctgggtcgcttccagggcagctacggccgattccggcgatgcaactccccggcctcctgccgatgccgttcaaccgcaccggtgtacccaacctctattgcgtcggcgattcctgcttcccgggtcaggggctcaatgccgtggccttcagtggctttgcctgtgcccatcgggtgggtgcggatttgggcctcaac

SEQ ID NO: 44595 - DNA, 1647 bp, SYNECHOCOCCUS SP. WH 8102
ttcgatggtttcggattcagtgaggcattgctgaagacgctggcggataaggggtacagcgagccttcaccgattcagaaggcggccttccctgaattgatgctggggcgtgacctggtgggccaggcccagaccggtaccggaaaaacggcggccttcgcgttgccattgctcgaacggctcgccagtggccagaaaactccgcaggccctcgtgctggcacccacccgcgaactggccatgcaggtggctgattcgttcaaggcctattccgctgggcatccgcatctgaaggtgctggcggtttacgggggcaccgacttccgttctcagatcaacaccctgcgccgtggcgtggacgttgtggtggggacaccgggccgggtgatggatcacatgcggcagggcaccttggacacctccggcctacgcagcctggtgctggatgaggccgacgaaatgctgcggatgggcttcatcgacgatgtcgagtggatcctggagcaactgccgcaggaacggcaggtggtgctgttctccgcgaccatgccaccggagatccgtcgcctgtcgaagcgctatctgaaggatccagccgaggtcacgatccgcaccaaggatcaggaaggcaaacggattcgccagcgttcgatcaccgtgccgatgccccacaagctggaggctctgcagcgggtgctcgatgcctgcggtggtgaaggagtcattatttttgcccgcaccaaggccatcaccctcaccgtggccgagacgcttgaggcgggcgggcatcaggtggccgtgctcaacggtgatgtgccgcagaaccagcgggagcggacggtggaacggctgcgcagtggttccgtcgacatccttgtggccaccgatgtggccgctcggggcctggatgttgatcgcatcgggttggtgatcaactacgacatgccgttcgacagcgaggcctacgtccaccgcatcggtcgtaccggccgggccggtcgcacgggggaggccgtgctgtttgtcaccccgcgcgagcgtcgcttcatcaacaaccttgagcgggcaacaggccagccgatcgaggcgatggaggtgccaggcaactccgcgattaaccagggtcgactcgatcgtttgcacaaacgcctcagcgaagcagcccacaacgagcggtcctatgaggaagaagcggcgctgctgaaagagctgttgcaacgcatcggcacggaactggagctcagccctgagcaactggcctacgccgccctcagcatggccatcggcccagaccctttgctgcgccagaagggcgacgacgagtggattcacaacaaccagcgccgcgatcgtgatcgtgaccgtgatcggggcggcgaacggagagagcgccgctccgatcgtccggcccgtgccccggaggagaacatgcagcgctaccgcgtcgaggttgggcaccgtgatcgggtcaagcccggaaaccttgtcggggccatcgccggagaaaccggtctgcagggccgtgcgatcggccggattcagattttcgacaaccacagctttgtggatctgcctaaaggcatgccggaggatgtctttaacagcttgcggcggcttcgggtgatgaaccgggagctacagatcact

SEQ ID NO: 44596 - DNA, 1749 bp, SYNECHOCOCCUS SP. WH 8102
cccctggttcggttgctgcgtcatctggcgccccagcgccgtcttgtgatcacggcggtgatctgttcgctgctcaacaagctctttgacctcgctcctccggccttgatcggcttggccgtggatgtggtggtgcgtggtcagcagtccctgctggcgagcttcggcatccagagcgtctcccaacagctgtgggtgctggcgctgctcacctttgtgatctgggcggcggagtccctgttcgagtacttgtacgacgttctctggcgcaacctggcccagacaacccagcatcgcctgcggcttgaggcctacgaccacctccaacggctggagctggcttttttcgagcaggacagcagcggccgcctgatggcggtgctgaacgatgacatcaaccagctggaacgctttctcgatcgtggcgccaaccagatcctgcaactgatcaccacggtgctgatcgtgggcatcggcatggccgtggtggctcctgaggtggccctgttcgcctatctgccgatccccgtcattctgctggggtcgctgcggtttcaacggcaactggccccccgttatcgcgaggtgcgagcccgcgccggtgaccttgcctcccgcctggccaacaacctcggtggcatgctcacgatcaagagcttcaccgccgagccgttggaagcgcaacggcttgaagcggaaagccttgcctatttggagagcaacggccgggcgatccgcctgtcggcggccttcattcccctaatccgttttgccattctcttcgccttcgtggccatcctgctggtaggtggtttccaggctctgagtggtcagttggcggtgggcacctacagcgttctggtgttcatcacccagcggctgctgtggccgctcacggccctcggccgcacgcttgatgagtaccagcggtccatggcctccacccagcgggtgttggatctgatcgacaccccagtcacgatccgcagcggccagaccccgctggaccgacggctggtgcgaggagagattcgctttgagcaggtggatttcgcttacccggggcgggcttctctgctgcagggcttcgatctggtggtgccgtccggggcaacggtcggcatcgtcggatccaccggctccggcaagagcaccgtggtgaaactgctgctgcgcctctatgagcgtcagggggggcgaatccttctggacggtcgtccgatcgaacagctgcagcttcctgatctgcggggtgcgatcgcgctggtgagccaggacgtctacctcttccacggcacggtggctgagaacatcgcctatagcgttgccaaccctgatcctttggctatcgagcaggccgcccgtctggcggaggccgctggtttcatcgaagcgctgccggatcgctacgacaccctcgttggcgagcgtggccaacgcctttccggtggccagcgtcagcgcatcgctctggcccgggcgatcctcaaggatgccccggtgctggtgctggatgaggccacggccgccgttgacaacgacaccgaagcggcgattcagcgctcactggaccagatcacccgcaaccgcaccaccgtggtgatcgcccatcgcctgagcacggtgcgccacgctgatcggattgtggtgatggagcagggacggatcgtggaacagggccgccatgaccagctgctggcccacggtggcgtttacgccaatctctggcaggtgcaggccggcgaacgg

SEQ ID NO: 44597 - DNA, 1317 bp, SYNECHOCOCCUS SP. WH 8102
acggccagtcccaaccgcaacctggcgccggtcaccacctgtctggacgagcgtgatcggctgatggtggggggttgcctgctcagcgaccttgcccagcgctacggcacgccgctttacgtgctggatgaggacacggtgcgcggcacctgtcgtgcctacagggacgctctgaaacagcattaccccgggccctccctgccgatctacgcctccaaagccaacagctcactgctggtgagcagcatcgccgcctccgaaggccttggccttgatgcggtctccgccggtgaattgctgacggctttccagggggggatgcccggcgagcggatggtgctgcacggcaacaacaagaacgacgaggagctcctgctcgcttacaacaacgacgtcacgatcgtcgttgataaccagcacgatctggaacgcctggcggaactggtacctgccggcggcgcaccggcccgtctgatgctgcgcttcacccccggcatcgagtgccacacccacgagtacatccaaaccggccacttagacagcaagttcggcttcgaccccgacctgctggagtcggtgcttcggcagctggtgggcaagccctgggcgaagctcaccggtcttcatgcccatatcggctcccagatctttgaactggagccgcatcgggacctggcggcagtgatggccgatgccctcaagctggcccgaagcctgggtcatcccgtggaggacctcaatgttggtggcggcctcgggatccgttatgtggcctcggatgatccgccaaccatcgagcagtgggtgaaggtggtggccgatgccgtcacggccgcctgccgggatcgtcaactggagctgccacggttgctctgcgagccgggccgttccctggtggccaccgccggagtgacgctgtacgccgtgggctcccgcaagaccattcctggtgtgcgcacctacgtcgccatcgacggcggcatgagcgacaaccccagaccgatcacctatcagtcgctttacacctgctgcctggccgaccgaccgctggccccagcggaagagaccgtgaatctggtgggcaagcactgcgaatccggtgatgtgctgctgaaggatttaccgctccccaccactcaaagcggagacatcgtcgccgtgttcgcaaccggtgcctacaacgcatcgatgagctccaactacaaccgaattccacggcccgctgctgtggtggttcaaagcggctcttcggagctttttcagaagcgcgagcagccggatgatttgctgcgctacgacgtgcttccagagaggttc

SEQ ID NO: 44598 - DNA, 2487 bp, SYNECHOCOCCUS SP. WH 8102
atgttcgaacgttttactgagaaggccatcaaggtgatcatgctggcccaggaagaggctcggcgacttggtcacaacttcgttggcaccgaacagattcttctgggtttgatcggagagggcacgggtgtcgccgcgaaggttctgaagtcgatgggtgtcaacctcaaggacgcccgggttgaagttgagaagatcatcggccgaggttctggctttgtggccgttgagatccccttcacgccaagggctaagcgggtgctcgaactctccctggaagaagccagacagttggggcacaactacatcggtaccgagcatctgctgctcggtttgatacgggaaggcgaaggcgttgcggcccgtgtgctcgagaatctgggtgtggatctggccaaggtcagaacccaggtcattcgcatgctgggtgaaaccgccgaagtgtccggcggtggcggtggtggtggagcaaaaggttccaccaagacacccaccctggatgaattcggcagcaacctcacccagatggccaacgaggccaagttggaccccgtggtgggtcgccacaacgagattgaacgggtcatccagatcctgggtcgccgaaccaagaacaatccggtgttgatcggcgagccgggtgtgggcaagacggctatcgccgaaggtcttgctcagcgcatccagcagggtgaaattccggacatcctggaagacaagcgcgtcctcacccttgatattggactgctcgtcgcagggaccaaataccgcggtgagtttgaggagcgcctcaagaagatcatggaggagatcaaggcggccgggaacgtgatcctggtgatcgacgaggttcacaccctgatcggtgctggtgctgctgagggcgccatcgatgcggccaacattctcaagccggctctcgccaggggcgagctgcagtgcatcggtgccacaaccctggatgagtatcgcaagcacatcgagcgtgatgctgcgctggaacggcgtttccagcccgtcaacgtcggtgagccctccatcgatgacaccatcgaaatcctgcggggcctgcgcgagcgctacgagcagcaccaccgcctcaagatcaccgacgatgctcttgtggctgcggcaaccctcggtgatcgctacatctcggaccgcttcctccccgacaaggcgatcgacctgattgatgaggccggttcacgggttcggctgctcaattccaagctcccacccgaggccaaggaggtggacaaggagttgcgcggcgtccagaaacagaaagaggacgccgtacgcgaccaggacttcactaaagccggtgaacttcgtgaaaaggaggttgagctgcgcgatcagattcgctctctgctgcaagccaaccgcaccgatgccaccgccgttgctgaagcgtccgcagaccagagcgatgcgcctgcggcagagtccgccgagtcctcgcccatggtgaatgaggaggacattgcccagatcgttgcctcctggaccggtgtgccggtgcagaagctcaccgagagcgaatcggtgaagctgctgaacatggaggagacgctgcaccagcgtctgatcggtcaggacgaagcggtcaaggcggtgtccaaagccatccgtcgggcccgtgtcggtctgaagaacccgaatcgtcccatcgccagcttcatcttctccggccccaccggtgtcggtaagaccgagctcaccaaggctctggccacctacttcttcggcagtgaggaggcgatgatccgcctcgacatgtcggagttcatggagcgccacacggtcagcaagctgatcggctcgcctccgggctatgtgggcttcaacgaaggcggtcagctcaccgaagcggtgcgacgccgcccctacaccgtggtgctgttcgatgaaatcgagaaagcgcaccctgatgtgttcaacctgctactgcagctacttgaagatggccgtctgaccgattccaagggccgcacggtcgacttcaagaacaccctggtgatcatgacctcgaacatcggttcgaaggttattgagaagggtggcggtggccttggtttcgagttctctggtgagagtgctgaggagtctcaatacacccgcatccgctcgctcgtgaatgaggagctgaagcagtacttccgccctgaattcctcaaccggctcgacgagatcatcgtgttccgtcagctcagccgcgatgaggtgaaggagatcgccgaaatcatgctgaaggaagtcttcggccggatgggcgagaaaggcatcaccctcaccgtgtccgatgcgttcaaggagcggttggtggaagagggatacaacccggcctatggagctcgccccctgcgtcgcgctgtgatgcggttgctggaggattccctggcagaggaagtgctctccggccggatcaaggatggtgaccatgccgaggtggatgtcgacgacgacaagaaagttgtcgtc

SEQ ID NO: 44599 - DNA, 1050 bp, SYNECHOCOCCUS SP. WH 8102
tcccacgccatcgccccggcggtggtgctgcggggggagggtgcctgggcagaggcgctgtccaagatcagtgccctttgttcccgccctctcctgttgggccgcagtcaggccacggtgagcctgcggtcagcccttgtttcggatctcgttcacagttgtctgacgccgcaaccagctgagctcagctacgactgttgcgaggaggatctacagcgtctggccgctgaggcagccgactgtgatgccgttctcgccgccggtggtgggaaggttcttgatgctggcaagttgctcgcccatcgccttcagctgccctgcatcacagtgccgttgagtgctgccacctgcgcgggttggacagctctctccaatctttattcgatgcatggagcctttgagggcgatgtggccctgacgcgctgccctgagctgctggtgtttgaccatggcctggttcgccaggctcctgctcgcaccctggccagcggcatcgccgatgccctggcgaagtggtacgaagcttcggtcagcagcggcgacagcagcgatgggctggtgcagcaggcggtgcagatggcccgtgtgctgcgggatcaattgatgattgatggtcccctggccctgcaggatccccacagtgcggcctgggcccgcacggccgaggcctgtgcacttactgccggtgtgatcggcggcttggggggtgcccgctgcagaaccgttgcagctcacgccgtgcacaacggtctcacccaactgcaggcctgccaagacgtgctgcatggcgagaaggtgggcttcgggatcctggtgcagctccgcctggaagaacgtctgggtggcaaccgcctggccggccaggcccaccgccagttgcttcccctgctgcggcagttgcagcttcctgtgagcctgcaggatcttgggctgtccaacgccagtcttagtgatcttcaacaggtctgtgccttcgcctgccgtgaaggatcagacctgcacaaccttccatttgcggtgacaccgggggcgttgcttgaggcattggtg

SEQ ID NO: 44600 - DNA, 2979 bp, SYNECHOCOCCUS SP. WH 8102
cctttctcaaaactatcaacagagcaaaaggcaaaactagcagaaacaattcaaccattacgattacgtccgggtcaaaaattatatgatttttcagaccttcctccagggatagccctcatagcagagggtcagatgagattgcttgcattagatgaaagagaagaacctttcacactatatagattagctccaggagatcaagctggacatattggaatcctcaggggggtaactggttatgcattagccgcatcgcagccaagcttgctatggctgcttcctcaaactggatttctgcaagtaatagcggaaaacgcagaatttgcaaatgaatttcttgaacctaacattgaagaattgtatggagttagtatattaacaaattcgcctctaaataacacgaaaaacgagataaaagactgggcaagcaacaaaatagcagaatcaaaaggagatcacaaaatattattactacctccaggtgaacactttgttgattctaaatgggggccgtggttggtaagcagttcaaacatttctggatgcaagccaggtgaagaattacttggaccaatgaagttaatagttcaagggaaagttcctgcaagattaatctctaaaagtggagctacacctccaatcaatgtcccacaagtattagtcgtaagcccagactctagcgaggctgcacctctccaaattgaggctgaagtcgtagaacctgactggcaagaaagcagcacagcaatagttgcagtagaaaaacagcaggaggctcttgaagattggtatggaaagcttggcgatgacgggagctttccacagttggatgggtctggacctgtagggattccaatggctgcattaagaatgcttgcgagatactttgatataccttttagaaaagatgtaatacagagaataattgaagatcaattgatgagaaatgaattatcagaaacgggagaaagatcaatggtttgattcaacttgctgctactgctgacttaattggccttagagcaacacaaataaatgtaacggaaaaccagatagggcgtttacaattacctgcaatagcaatacgtaagaataaaccaataatattatggtcagcggacatggttggccaagcactgatcagtgccccgaagaaggacaaataaaagtttcaacaaaagacttaggtgctagaaacgatgatggaacaatacaggttttaacgattcaaagaagcaaagtatcacctaagaaacgattgggttgggatggtttataccagctttaaaagaacataaagcagtccttattcaggttctagtcgccagtttttttgtacaactatttggattattaaatccacttttgatacaacaaataatagatgctgtgatcagccaaggaaatgttagcagccttaatgtgcttggaacattgttaataggcatgagtctagctcaagcggtattatcttcgctaaggacatacctatttgcagatactacaaatcgaatcgatatctcattaggttcatcaatcatcgatcacctacttaggcttccattaggttacttttcagatcgaccagtcggtgaagtaagcagcagaatcaatgaactacaaaaaataagacagtttttgaccggaacagcgctaacggtagtgttagatgcaatttttgcaatcatctacattgctgttatgttactttactcagtccaattaacagtatggtcattagtagtagttccattatttgtggggttgacattagtatcagcaccaatcatacgaaagcaacttagagaacaggctgaagctaacgctcgggtacaaagtcacttagttgagaccgttggaggaatggaaaccattaagggccagagtatggaaattcatagtcggtggcgatggcaacagctctacggaggtcagataacatcgggttttaggaacaccgtaacaagcacagcggccggatcagcaagtcagtttcttgaacagctttcaggacttattgttttgtggattggagcctcactagtattaaaaggtgaactaacacttggacaattaattgccttcagaatcctagcaagttacgtgacaagtcctttgcttaggatggcaaacttatggcaaaattttcaagaaactgcattatcgttagagagactggctgatatcgtagatcatccccaagaattagaaattactggagaacaaaagccaccaatacctcccatagtaggaacagtggaatataaaggtgttaactttagatttgggaaggaaggagcacttaatctatcaaacattaatttcaaaattgaacaaggttcattcattggggtcgtgggaagtagtggctctggcaaaagcacaatgttgaaaatgctaacaaggttatacgaaataaacgatggccaaattctcatagacgataatgacattagcaaagtagatctctactccttaagatcgcaaatcggtgtagtaccacaagatagtctgttgttcgacgggtcagtaatgtcaaatattgcgttagcaaggcctgatgcatcatttgaggaagttgtagtagcagcacaaattgcctgtgcacacgaatttattcaagctatgcccgccggctacaacagctccgtaggggaaagaggagctggaatgagtggaggacaaagacaaagaatggcaatagcaagaatgataatcaggagaccaagattactagtactagatgaagcaacaagtgctcttgatgtagacactgaaagaagattaacggcaaatctgatagaattgtataaggatagcaccgttttctttataactcatagattggcatctctcaaatttgctgatgttattcttgtaatggatcaaggggcattagttgaaaaaggtactcatgaagaacttatggcattggatggccgctatgcaacactttaccaccaacaagaatcctaa

SEQ ID NO: 44601 - DNA, 945 bp, SYNECHOCOCCUS SP. WH 8102
ccggacacgcgccggttgcgcttgttcagcggtacctccaatcctgggctggccagggagatcgccgcatatctgggtgttcctgatggcccccgggtgtgcaaacgcttcgccgatggcgagctctacgtgcagatccaggagtccatccggggctgcgatgtgtttctgatccagcccacctgcgctccggtgaatgatcacctgatggagctgctgatcatggtggatgcctgccgtcgggcctcggcgcgtcagatcaccgcagtggtgccgtattacggctacgcccgcgccgaccgcaagacggcggggcgtgaatcgatcactgccaagctcaccgccaacctgctggtgaaatccggcgtggatcgggtgctggcgatggatctgcactcagctcagattcagggttacttcgacattccctgtgatcacatctacggctcaccggtgttggtggattacctctccacgcagaacctcgacgacattgtcgtggtgtcaccggatgtgggcggtgtggccagggcccgggccttcgccaaacagatgaacgatgcgccattggcgatcatcgataagcgccgcacgggccacaatctggccgaaagtctcacggtgatcggcgacgtctccggccgtacggcgatcctgatcgacgacatgatcgacaccggtggcaccatctgcgccggtgccaggcttcttcgccagcagggtgcaaaacgggtgatcgcctgtgccactcatgcggtgttttcgcccccggccagtgaacgcctctcggccgatggactgttcgagcaggtggtcgtgaccaacagcatcccgattcagcaggagcgaaccttccctcagcttcaggtgctctcagttgccaacatgctgggcgaagccatctggcgcatccacgaggagagttccgtcagttcgatgttccgt

SEQ ID NO: 44602 - DNA, 1086 bp, SYNECHOCOCCUS SP. WH 8102
agttcctaaaccatgcctctcatccttcatggcattggtactgcggtgccatctcggcgactgagccaggcagatgccgtgcaggtggcacatcgcatcaatgccgaaacccctgagcaggtaaggctgatgacacgcatctatcagaaaaccaaggtgctcagccgtggaagtgtgctgctggagaaggatggagacgatggcacgatccaggagcgtctcagtttctacggcgaagaaagccctggtaccgccgaacggatgcaggcgtttgaggatcatgccggtgagctggctcttgaggccgctgcaaaggcgctaagcgatagcgatatctcagccacggcgatcacgcatctcgtcactgtcagttgcaccggttttcagtcaccaggtgttgaccttttcttgattgaaaagcttgatctatcgccgagtgttcagcgaacccatatcggattcatgggatgccacgctgcgctgaatggcttgcgtgttgcccacgcctttgcggagatggatcccaaggctgttgttctgctgtgcgctgtagagctttgcagcctccatatggcttatggctggcacccagagcaggttgttgccaacgctttgtttgccgatggggcggctgccgttgtcgcctccgtcaatccttcccctacacatcagaccttggcgttgcgacgcagtggctcgatggtgattccaaacagctcagatctgatgcactgggagattggcgaccatggttttgcgatgggcttgtcgccccttgttccggaaacggttggcgctgccttgttgccctggttgcgagattggctcaaagagcaggccattgatcttgaggcggtgacgagctgggctgttcatccagggggccccaagattctctcgacctgtgccgaggttttgtcgctggacccaggcctactgcacgagtccagaggaatacttcaggatcacggcaacatgtcatccgcaacgatcctgttcatccttgaaaggttgaggcggcgggaatgttccggtccttgtcttgcactggcctttggccctgggctgagtgctgaggtagcactt

SEQ ID NO: 44603 - DNA, 1383 bp, SYNECHOCOCCUS SP. WH 8102
atgcgcatcctcttcgctgccgcggaatgcgccccgatgatcaaggtcggtggcatgggggatgtggtgggatcgctgcctccggctctggccaagcttggccacgacgtgcggctgatcatgccgggctactccaagctctggaccaagctgacgatctcggacgaacccatctggcgcgcccagacgatgggtacggaattcgcggtttacgagacgaagcatccaggcaatgggatgaccatctacctggtgggacatccggtgttcgatcccgagcggatctatggcggtgaagatgaggactggcgcttcaccttctttgccagtgccgccgctgaattcgcctggaatgtctggaagccgaatgttcttcactgccacgactggcacaccggcatgattccggtctggatgcaccaggacccggagatcagcacggtcttcaccatccacaacctcaagtaccagggcccctggcgttggaagctggatcgcatcacctggtgcccctggtacatgcagggagatcacaccatggcggcggcacttctgtacgccgaccgggtcaacgccgtctcccccacctacgccgaggaaatccgtacggcggagtacggcgaaaagctggatggtttgctcaatttcgtctccggcaagctgcgcggcatcctcaatggcattgacctcgaggcctggaacccccagaccgatggggctctgccggccaccttcagcgccgacgacctctccggtaaagcggtctgcaagcgggtgttgcaggagcgcatgggtcttgaggtgcgtgacgacgcctttgtcctcggcatggtcagccgactcgtcgatcagaagggcgtcgatctgcttctgcaggtggcggaccgtttgctcgcctacaccgacacgcagatcgtggtgctcggcaccggtgaccgtggcctggaatccggcctgtggcagctggcctcccgccatgccggccgttgcgccgtcttcctcacctacgacgacgacctctcccgactgatctatgccggcagtgacgccttcctgatgcccagtcgcttcgagccctgcggcatcagccagctgtacgccatgcgttacggctccgttcctgtggtgcgcaaggtgggcggcctggtggacaccgttcctccccacagtccagctgatgccagcgggaccggcttctgcttcgatcgttttgagccggtcgacttctacaccgcattggtgcgtgcctgggaggcctaccgccatcgcgacagctggcaggagttgcagaagcgcggcatgcagcaggactacagctgggaccgttcggccatcgattacgacgtcatgtaccgcgatgtctgcggtctgaaggaacccacc

SEQ ID NO: 44604 - DNA, 1272 bp, SYNECHOCOCCUS SP. WH 8102
ggcgggtccttgtccggtcatgtgaaggtgccgggagacaagtcgatctcccaccgatccctgctgttcggtgccatcgcggagggcaccaccaccatcgacggtctgctgccggcggaagaccccatcagcaccgccgcttgcctgcgggcaatgggtgtgctgatcagcccgatcgaggccgccggcctcgtcaccgttgagggggtgggcctggacggacttcaggaacccgctgaaattctcgattgcggcaactccggcaccaccatgcgcctgatgctggggttgctggctggacgggccggccgtcacttcgtgctggatggtgatgcctccctgcgtcgccggccgatgcggcgggtgggtcagcccctggcctcgatgggggcggatgtgcggggccgtgacggaggcaacctcgctccattggcggtgcaggggcagagcctgcgtggcacggtgatcggaacgcctgtagccagcgctcaggtgaagtcggccctgctgctggcggccctgacggccgacggaaccaccaccgtgatcgaaccggcccagtcccgcgaccacagcgagcggatgctgcgggcctttggtgctgatctccaggtgggtggcgagatggggcgtcacatcaccgttcgccccggcaacaccctgaagggccaacaggtggtcgtcccgggggacatcagctcagcagccttctggctggtggccggtgccctggtgcctggcgcggacctcaccattgagaacgtcggcctcaatcccacccgaacaggcattctcgaggtgctcgagcagatgaatgcacagatcgaggtgctgaaccgtcgcgatgtggccggtgaaccggtgggcgacctgaggatcacccatgggccgttgcaaccgttttctatcggagaagaaatcatgccccgcctcgtggatgaggttccgatcctcagcgtcgccgcctgcttctgcgacggcgaaagcaggatcagcggcgcctcggagctgcgggtgaaggaaaccgatcgcctggcggtgatggcacgccagctcaaggccatgggtgctgagatcgaggagcatgaggacggcatgaccatccacggcggacgcccgttgaagggcgctgctctggacagcgaaaccgaccaccgggtggcgatgagcctggcggtggcctcattgctggcgtctggggattcgaccctgcagcgcagcgatgctgcagccgtgagctaccccagtttctgggacgaccttgaccggctc

SEQ ID NO: 44605 - DNA, 969 bp, SYNECHOCOCCUS SP. WH 8102
atgatcaccgtcaccgagctgctgcaaccggtcgaaaccgatctcgaaactctgctcggagatctgcgcagcctgatcggtgccggacatccaatcctccaggccgctgccgagcatctgttcagcgctggtggcaaacggcttcgtcccggcattgttctactgctgtcccgcgcactgtccgctgatggccagctgactccacggcatcgacgcctggccgagatcaccgagatgatccatacggcttcgctcgtgcacgatgacgtggtcgatgaggcgtccacccgtcgtggtgtggacaccgttcacagccgctttgatgcgcgtgttgccgttctggctggtgattttctctttgcgcaggccagctggcatctcgccaacctcgatgaccttgaggtggtgaagctgctcagccgcgtgatcatggatcttgcggatggtgaggtgaagcagggtctcttccgcttcgacaccgcgcagagcttcgagacttacctcgaaaagagctactgcaaaaccgcatcgttgatcgccaacagcgccagggccgcaggggttctcagtgattgctccccatctgagctggatgggttgtatcgcttcggccgtcagttgggcctggcgttccaggtggtggacgacatccttgatttcaccggcagtgatcagcagctcggcaagcccgctgccagcgacctggccagcggctatctgacggcccccaccttctatgccatggaggagcagcccggcctgcaggccttgattgcccgtgagtttgcagagcccggggatcttgaccaggcccttgagatggtgcgctcctcccgcgccattcctcgtactcgggaactggcggaaaccttcgctcgggaatcccgcgacgccatctcctggatgagcgactccccctgcaagcgggcgctgcttgagcttcctgattttgtgctcagccgtctgtac

SEQ ID NO: 44606 - DNA, 582 bp, SYNECHOCOCCUS SP. WH 8102
ctgttcgatctggatggagtgctgctcgatacggagcccttgcacagccgcggctggtccgaagccgccagccacttcggagcgcagctcagcaacgaccagttgctgcaactcaaggggcgtcgtcgtctcgactgcgccgccctggtgagcagctggctgccgcgtcctgtggaatcagacgacttgctggcagttcagcagccgatcgtgcgggcgctgcttcccaacgccaaggccatgcccttcgctcaagagctcttggagcactgcgatcaccgaggaattccgatggccttggtcaccagcagcagccttgaagccgtgagctttaaagccgcaccccatccctggctgaagcggatccaactcagggtccacggagatgatccagacctcaaagccggcaagccagaccctgcaccatttcttctggccgcgtcacggcttggcttggatcccaagacctgttgggccctggaggattctcaagccggaacagcggctgcggtgacagccggttgccacgtctgggtgctgaatgaacacggacccacccaaacaatggaaatgaatccaagg

SEQ ID NO: 44607 - DNA, 1971 bp, SYNECHOCOCCUS SP. WH 8102
gtgaccgagtccaatacgtcgatcgaaagtgtcctgcaggagcagcgggtatttcagccgccggcggagatggcggctgcagcacgcatcggcagtctggagagttaccgcgccatggcggcggcggcgaccaaggatcccgatgggttctggggggaggcagcccgtcgtgagctgcattggttcgagccgttccacacggttctcgattggtcggaacctcctttcgcccgctggtttgaagggggcaccaccaacctgtcgtacaactgtctcgaccgacatctcgagggggccaaggccgagaagaccgcgctgatctgggaaggggagcccggagacgtgcgccgtttcagctaccgcgagctccatgccgaggtgtgcaaagccgccaacgctctgaaggccatgggcattggcaaaggcgatctggtcgccctctacatgccgatgattccagaggccgccattgcgatgctcgcctgcgctcgcatcggtgccccccattccgttgtgttcggtggtttctctgccgaggccttgcgcgatcgcctcaaggacggtgaggcgaaggccgtgatcacagcggatgggggattcagaaaggacaagcccgtttccctcaaacctgctgttgatgcagctctagcggagggcgcctgtccttcggtgaccggcgtgctcgtggtgcagcgcaccaagcagcccgtggagatggttgccggccgcgatcagtggtggcacgacctcgtggatgcccagggcagcgattgccctgcggagccgatggccagtgaagatcgactgttcgtgctctacacctcaggttccaccggcaaacccaagggtgtagtgcacaccactgccggttacaacctctgggcccatctcaccttccagtggattttcgacatccgcgataacgacgtctactggtgcacagcggatgttggctggatcactggccacagctacatcgtgtacggcccgctgtccaacggtgcgaccaccgtgatgtacgagggggcgccgcgcccctccaaacccggtgcgttctgggagttgatccagaagcacggcatcacgatcttttacaccgcgccgactgcgattcgagccttcatgaagagtggccgccaggtgccggatcaattcgacatgagcagccttcgcctgctgggcaccgttggtgaaccgatcaatccggaggcctggatgtggtaccgcgacgtgattggcggcaaccgctgtccgattgtcgacacttggtggcagaccgaaaccggtggcgtgatgatcagtccgctgcctggagccactcccaccaaaccgggatccgccacgctgccgctgccgggcattcaggccgacatcgttgatggagaaggcaacagctgcgggcccgatgaaggtggatacctggctgtccgagccccctggcctggaatgatgcgcacggtccatggcaacccccagcgctttcgtgagagctattgggagcacatccgtcctgccgatggctcgtacctctatttcgctggggatggcgcccgccgtgatgccgatggatatttctgggtgatgggccgggtggatgacgtgatcaacgtctccggtcaccgcctcggcacgatggaaattgagtcggctctggtgagccatcccgcggtggcggaagctgctgtggtgggtcgtcccgatgacctcaaaggtgaaggcatcgttgcgttcgtcacccttgagtcggggcgtgagtcgtcggatgatctgatcaagcaactcagggcccatgtgggcacggagataggaccgatcgctcggccggatgagattcgttgcagtgatgcactgcccaagacccgcagcggcaagatcatgcgccggatcctgagggccctggccgccggtcaggaggtcagcggcgacaccagcaccctggaggatcgttcggtcctcgatcggctgcgggct

SEQ ID NO: 44608 - DNA, 516 bp, SYNECHOCOCCUS SP. WH 8102
catgccgttcttggcaccccgctgcgggcaccgctgatgagcgaccaggaggaagccctttttgcctgtggatgtttctggggcgctgaaaaggggttctggcgtcttccgggtgtggtgagcacggccgtgggttacgccggtggtcagcgcaccaacccgacctatcaagaggtgtgcacagggacaacaggccataccgaagtggtgcgggtggtctggagcaccccagccgtggatttcagtgatctgctgaaactgttctgggaatgccatgaccccacccaggggaaccgccagggcaacgacacaggaacccagtaccgctcagcgatttacaccacgacgaatcagcagatgagcctggctcaggccagcagaacctcatatcaggacgccctgaatcaaagggggtatggaccgatcaccacggagatcctggcggatcaggcctttaccttcgctgagccgtatcaccagcagtacctcgccaaacccggcagtcgtccctactgc

SEQ ID NO: 44609 - DNA, 1722 bp, SYNECHOCOCCUS SP. WH 8102
atggcggccatgcgcctggacctgatcggccgttacctgcgccctcatcgcaaaaccgtcatcttcggcgcgatcgccctggtggtggtcaatgtcctcagcgtcacgatcccgatggaggtgcgccgggtcatcgatgagttgcaggtcggcttcgcctatgaccgcgtcctgagccaggccgcctggatcgtgctgctggccaccaccatgggtgccgtgcggttgctgtcgcggcagcttgtgttcggtgtcggccgccaggtggaggtcgaactccgccagagcctgttcgaccacatgcttcggcaggaaccggcctgggtgcagaccacggggagtggtgatgtgaacaaccgggccaccagcgatgtggagaacatccgccgcctgctgggcttcgccattctcagcctgaccaacaccctgctggcctacagcctgacgctgccggcgatgttgacgattgatccatcgctgaccctggctgccattggtccctatcccgtgatgctgacggtggtgcgcctgttcggcggccgaatgatgaagcagcaacgccgtcaacaggaggacctgtctgggttgagcgatctgatccaggaggacctctccggcatcggagcgatcaagatctacggccaggaagcatcggagcagcaggcgttttcccagcgcaaccgcagttaccgaaacagcgccatccgtctggcacggactcgaagcacgctcttccctttgttggaggggctttcctccatctccctgctgttgctgctggccctaggcagcggcaagctcagcgacggcagcctcacgaccggcgggcttgtcgccctggtcttctatgtgcagcagctggtttttcccactgcgttgttgggcttcacgctcaacacgttccaaaccggccaggtgagtctggaacgggtggaggagctgctccagcgacaacctgccattcgtgatggcaacgatccgatcaacgttgaacagccgcggcgcggacgactcgaagctcgcggcttgcgcatccgttacgacggagccgagcgcgacaccctgaacggccttgatttctgcattgaacccggcgaactggtggccgtggttggtgctgtgggctgcggcaaaacaaccctggcccgtgccttcggtcggatggtgccggttccggacggccaattgttcctggatggcgtggacatcaaccgcctgcccctgaaggatttgcgaggcgaagtggccatggttccccaggagggatttctgttcaccagcaccctcgccgacaaccttcgctacggcgaacccagggcaggagatgaccgggtcgagcaagcggccgaacgtgcccgactgtcggatgacgtcaaagggttcccggatggattcagcaccatcgtcggcgaacggggcatcacgctcagcggcgggcaacgtcaacgcactgccctggggcgcgccctgctggtgtcggctccggtgcttgttctcgacgatgccctggccagcgtggacaacaacaccgccgccgccatcctgaactcgatccgatcccaggagggacgcaccattgtgatgatcagccaccaactctcggcagctgcagcctgcgaccggatcttggtgatggacaacgggcggatcgtgcaacagggccaccacaacgccttgatcgccacggccggggtttaccgaagactgtgggaacggcaacag

SEQ ID NO: 44610 - DNA, 1254 bp, SYNECHOCOCCUS SP. WH 8102
cgccgaagccctggatcaaggccttccctggacccggctggagaccctgcgccagcacctggccagctgaaatggacaatgaagggtgatgaccgtcagcttttcggcctgatgccccacccttcgtcacgtcaggctcatctcgtgctggccgatggcacggttctcacgggtgacgcgttcgggcaccgcggctccgtggtgggtgaggtggtgttcaacaccggaatgaccggataccaggaggtcctgacggacccgtcctatgccgggcagctggtcaccttcacctaccccgaactgggaaacaccggcgtgaatggggatgatcaggaggccgaccatccccatgccaggggagtgatcgcccgccagctcgccccatgtgccagcaactggcgctgttcggaatccctggacaactggatggaacgccacggtcttgtgggcatctgcggtgtcgacacccgtgccttggtgcgtcgacttcgagacggcggagccatcaatggtgtgatcagcagcgatggacgttcgcccgctgacctgctggccgaggtccgtcacgccccgagcatggagggtctgaatctggccagccaggtcagtaccactgagccctacgaatggtcgtcgccatgccgtgtcggtttcgatcagcggctgaaacagcatcccgacctcccctaccgcgtggtcgcgattgacttcggcattaagcgggcgatcctcgaccgtctggtcgcccatggctgtgcggtcaccgttctgccctcggatgccgatctggacacggtgatgtcccatcagccagagggggttttcctctctaatggccctggcgatccggctgcggtggacagcggcatcgacctggcccgatccctgctggagcgggccaacctgccgttgttcgggatctgcctcggccatcagattcttggccttgccttgggagggaagaccttcaagctcggctacggccaccgtggtctgaaccatccctgcggcacgagcggtcaggtggagatcaccagccagaaccacggctttgccatttccgctgactcactgccggagccgatggttgaggtcacccatctcaatctcaacgaccgcaccgttgcggcgtttcagcatcgccatcaaccggtgtttggcatccagtaccacccggaggccagccccggaccccacgacgcggatcaccattttggtcgcttcgttgcgttgatggcggatcgtcgggacgtc

SEQ ID NO: 44611 - DNA, 969 bp, SYNECHOCOCCUS SP. WH 8102
gtggcaggaacccttctcttcaacgccctgcgggaagccatcgacgaggagatggcccgcgacccttacgtctgcgtgatgggtgaggacgtcggtcactacggcggcagctacaaggtcaccaaggatctctgcgagaagtacggcgacctaagggtgctggataccccgattgcagagaacggcttcaccggcatggcggtcggtgcggccatgaccggcctgcggccgatcgtggaaggcatgaacatgggctttctgctgctcgcctttaaccagatctccaacaacatggggatgctgaggtacaccagcggaggcaatttcacgatccccacggtggtgcgcggcccaggtggtgtgggccgtcagctcggagctgagcacagccagcgcctggaggcctatttccacgctgtccccgggatcaagatcgtggcatgcagcacgccgaccaatgccaagggtttgatgaaggcagcaatccgggacaacaacccggttctgttcttcgagcatgtgctgctttacaacctcagcgaggaactccctgagggtgagttcacctgtgctctcgatcaggcggatttggtgcaggaagggagcgacgtgacgatcctcacgtactcccgcatgcgtcaccactgcctcaaggcggtggaacaactggaggccgatggcatcagtgtggagctgatcgatctgatcagcctcaaaccgttcgacatggagaccatcggtcggtccatccgcaagacccatcgggtcatcgttgtggaggagtgcatgaagaccggtggcatcggtgccgagttgatcgccctgatcaccgagcagtgcttcgatgatctcgatgcccgccctgtgcggctctccagtcaggacatccccacgccctacaacggctcccttgagaacctgaccatcattcagccccatcagatcgtcgaagctgcccagcagatggtc

SEQ ID NO: 44612 - DNA, 1365 bp, SYNECHOCOCCUS SP. WH 8102
ctgcaccgcttggaccccttcgcttcgcctgatcaagcggatccagtgctacgggacttcctccatcgggccagtgatctgctctgcgactggatcggtacggcgtccaaaggggtgcccttgccgaccgtgcgcccgcagccggccgtcgcccccaccgcggcaggcctcggcatggaccggttgctcaaggatctgcagcttgtgatggagggtgcctatcagccgtcccatcccggagctctggcccatctcgatccaccgccgctcacggcatcgatcgccgccgacctgatctgtgccgggcttaacaacaacctgctggcggaggaactgtccccagggctcaccgacctcgaacagcagctctgcagttggttctgtcagcgactgggactgccggatcaaagcggtggtgtgctcgccagcggcggcaccctcagcaacctgatggggttggtggtggcccgtacccatgccggagttcgcgatggcgtcgtgctctgcagccgtgatgcccacgtttcgcttcagaaggcagccactgtgatggggttgccggatcaggctctccagcagcttccggtggacagcgatggtggcctggacctggcagctttggatgcagccctgtcagctctgcggcgcgatggccgatgctgtctggcggttgtggcgacggctggcaccactgtgcgaggtgcggtggatccgctagatgcgatcgccaggctttgccgccgtgaacgggtctggttgcatgtggatgccgcaatcggtggcgtttttgccctctgggagcccttggcgcccttgatggaggggctgcatcaggcggactcgatcacgctcaatccgcagaagcttctggggatcaccaaaacctcgtccatgctcctcttgcgggaccgttccaagctgcgggatgccttttccaccgggcttccgtacatggagtcgccctgcagtgttgatcatggtggcgaagtgggcctgcaagggacccgaccggcagaggtgctcaagctctggctgggtctgcggcaactcggcatcgagggcattggtgctgtcctcgagtccgccctcgagcgaaaggcggtgttgaaacggctgttggcagatgatcgcctcctggtgctggatggcggccttcatctgctggccctgcgcccccggcaggacgatcccgctgggtccgccagttggaccgagcagacacgccagctgctgatgcgcgagggctttctcctgtcccgccccagctacgacggccattactggctgaaggtggttctgggtaatccccacaccaccagctcacacctgcagcaattggctgggttgatcagccagcagctgcag

SEQ ID NO: 44613 - DNA, 669 bp, SYNECHOCOCCUS SP. WH 8102
gttggtttcagcaagcccatgcgtccctggagtgatcgtccgattcacgacaacggggagccccttgtggcgctgccgccaaccctgttgcgactcgaaccacacccgtacgtcgcggctggtgccccctatggccctagcgcagatccctttcagttgcgctccggtgtggtggatcgcctcctggcagcgcaacaggaccttcaggcaaggcaatccgacctgctgctggccatttttgatgcctggcggccgctggccgttcaggcctacatggtggagcaggcggtgacggctgaaatcaatcgacgcggcatcgatcgggctgaccgcgaacaagtcgctgctgtgcgtcaagcggtcggtcgcttctgggcgccaccgagccctgatccctccacaccgcctccccgtagcaccggtgccgccgtggatctcaccctcgccagccaaagcgatggaggtccattggcgatggggggcgagatcgacgccgttgatgtcatctcagaacctgaccattacgccgctgctgcgccggattcggaagaggcgctctggcatcagaggcggaagcttctggcgtctgtgatgcagtcagccggttttgctcagcatcccaatgagtggtggcacttcagccacggagatcagctctgggcgtggcgc

SEQ ID NO: 44614 - DNA, 1695 bp, SYNECHOCOCCUS SP. WH 8102
cttccgaaagcggaacaacgcaagctggacagcgactacctgcgggagccgctgctgagcgaactggcgaatgatctacccaatttcagcgaagacgctctgcagatcctcaagttccacggcagctatcagcaggacgaccgcgataaacgcgagaaggggaaagacaagacctggcagatgatgctgcggctgcgcagccctggtggccgcatcccggcccagttatttttagctctcgacgagctttccgatcggctgggggacggcaccctgcgggcgaccacccggcaggccttccagatgcacggcattcccaaggccgacctgaaagaggtgatcggcaccatcgttcgcaacctgggttccaccctggctgcctgtggtgacatcaaccgcaacgtgatggccccggcggccccgttcgaaaaaggtggctacccagctgcacggcggttggccgacgagattgccgatctgctgagtccggaagcggctgaaggttcttacctcgacctctgggttgacggcgacctcagctatcgcttcagcccgccagccgcggttcgccgggcccgcaagcgccaactggagccaggcgtgttctccggcagtgaagctgaaccgctctacggcgacacctacctgccccgaaaattcaaggtggccgtcaccgtccccggtgacaactcggtggatctgctgacccaggacatcgggctggtggccttcaccgacccctccggcgatctacggggctgcaacgtctatgtggggggcggcatgggccgcacccacaacaaagaggaaacgttcgcgcgcatcgccgatccccttggctacgtggacgccgctgacgtcttcgaccttctccaggcaattgtggcgctgcagcgggatcacggcgatcgccgcatccgtcgtcatgcccgtatgaaatatctgctggaggatcgcggtatcgcctggttccgcaatgagctcaaggcgaactacttctccagaccgctgaagggtttccgcaacgaagccaaacccaagttgctcgactacctgggctggcaccgacagaaagctggcctgtggttcgtcggtctgccgcttctctgtggtcggttgaagggcacgatgaagcagggcctgcgcgccatcgtcgacacctaccaactggagatccgcctcacggcgaatcaggatctactgctctgcaacatcggcacggcccagcgggccacgatcaaggctgagctggcggctctcgggttcgatctgcccgatgctccccctccactggcccgccatgccattgcctgcccggctctgcccacctgcgggctggccatcacagaatcggagcgcatcctgcccagcgtgctggagcgcctcgatgcccagctgcgtcgcctcgagatcgacaaatcggtgctgatccggatgaccgggtgccccaacggctgtgcacgcccttacatggcggaactggccctagtgggcagcggtgtgaatcagtaccagctgtggctcggcggcagtgccaatttgcagcggctggcccagcccttcctgcaacgcatgcctctggacgagctcgagcagaccatcgaacctctgctgatcagctggaagcaagccggcggtcgccgcagcctcggcgatcacgttgaaaaacttggtgatcaggcggtgagtgagctg

SEQ ID NO: 44615 - DNA, 1230 bp, SYNECHOCOCCUS SP. WH 8102
atgttgcgtgttgcggttatcggcggcggtcctagcggatcctgcgctgccgaaattcttgccaaagctggaatccaaacctggctgtttgaacgcaagctggacaacgccaagccctgtggtggtgcgattcctctttgcatggtcgaggaatttgacctgccggacgacatcatcgaccgcaaggtccgcaacatgaagatgatttccccttccaatcgggaggtggacatcaaactcgatccccttggttacgacgacaacgcctacatcggcatgtgccgtcgtgaggtgtttgacgcctacctgcgcaaccgtgccgctgaccttggcaccacgctggtgaatggactggttcagaaaatcgacaccggcagcaaccgccagggtccgtacacgcttcattacgccgactacagcggcggtggaccaaccggtgaccagaaaaccctcgacgtggatctgatcatcggcgccgatggggccaactcccgggtcgccaaggccatggatgccggtgactacaacgtggccatcgccttccaggagcggatcaaactgccggctgaggagatgacctactacgaagatctggccgagatgtatgtcggcaccgacgtttcaccagacttctacgcctgggtcttccccaaatacgaccacgtggccgtgggcaccggcaccatgcagcagaaccagagcctgatcaaaggtctgcagaagggcattcgggagcgggcgaacaagcgcctgttcaaaggcgaagtgatcaaggtcgaagcccatccgatccccgagcacccccgtccccgccgtgtggtgggacggatggctcttgtgggtgacgccgccggctacgtcaccaagagttccggtgagggcatttatttcgccgccaagagtggacggatgtgcgcggaggccatcgttgagatctccaagaacggcacggtgattcccaccgagaagcaaatcaaatccacctatctcaagcggtgggaccgcaagtacggggctacgtacgccgttctcgacatccttcagcgcatcttttaccgcaacgacgcagctcgggaggccttcgtcgaaatgtgcgacgacagggacgttcagaagctcaccttcgacagctacctctacaagcgcgtggtgctgatgaacccttggcagcagatgaagctgacgctccgcaccctcggcagcctgctgcgcggtgaagcgctggcaccg

SEQ ID NO: 44616 - DNA, 684 bp, SYNECHOCOCCUS SP. WH 8102
cggcagttggtcaaccgggtaagcctcgatctttcggccggtgaggtggtcggtctgctggggcccaacggtgctggtaagaccaccacgttcaatctggtgatcgggttgctgcgccctgatgccggagtgatcagcctggatggtcaggtggtgtcgaccctgtcgatgccgaaacgggctcggcttggactcggttatctgccgcaggagcccagtgtctttcgtcagttgacggttcgccagaatctcgaaattgctcttgaccagacggatctcagtccgcaacaccgtcgtgatcgccgcgaccagttgatcgaggactttcatctcgtggcgtttgttgaccgttgcggttatcagctttcaggtggtgagcgacgccgctgtgaagtggcccgggccctggctgttggagcggaaggcccccgctacctgctcctggatgaacccttcgcaggggtggatccccttgcggtggctgatctccaggacctgatccaggcgctgcgctctcgggggatggggatcctggtgaccgatcacaacgtccgggaaaccctggcgatcacggatcgcgcgtacatcctcaacgacggcgcgattctggccagcggtcaatcccagaccgtggccgatgaccctctggtgcgtcgctactacctcggggaggccttccagctg

SEQ ID NO: 44617 - DNA, 1287 bp, SYNECHOCOCCUS SP. WH 8102
atgcacattgccgtcgtcggcctcagtcatcgcacggcaccggtggagatccgggaacggctcagcatccctgagcagaccatggagacctctcttcaatcgcttcgaggtcatgagcaggtgttggaggcttcgatcctcagcacctgcaatcgccttgagatctatacccttgttcgtcatcccgatctcggtgtttcggccgtcagcgaatttttgagcggccattccgggcttgccaccggggaactgaccccccatctgttcaactatcaccacgaggacgcggtcgatcacctgatgcgggttgccgctggtctcgacagccttgttctgggcgaaggccagatcctctcccaggtgaagaagatgatgcgcctgggccaggagcacaagtccctgggtccgatcctcaatcgcctgctgactcaggccgtcagcaccggtaaacgggtgcgtagcgaaaccaacctcggcaccggtgcggtctcgatcagttcggctgctgtggagttggcgcaattgaaactgggccagtcccgtggtctcgatcagctggtcacgctggagagcgagcagatcgccgtcgtaggagccgggcgcatgagccgccttctgcttcagcatctgcaagcgaaaggagcctccggggtggtgttgctcaaccgcactgttcaacgtgctgagttgctggcggcggacttcccagacctacccgtgcagtgtcgccccctcacagacctcgaccagtgtctgagcacttgttctctggtgttcaccagcacggctgcagacgatccgatcatcgatgcagcgaggcttgaacctcttaatcgacgcagcaaactgcgtctgatcgacatcggtgtgccgcgcaacattgctgccgatgctgccgctgtggacggcgtggaatcccacgatgtggatgatcttcaggaggttgtggcccgcaaccaggaggctcgtcaggccatggcccgcgaagccgagcagctcctgcagcaggaggctcagcagtttctggaatggtgggacagcctcgaagccgttcccaccatcaaccgcctgcgctcgtcgatggagaccatccgcgttgaggaactgcagaaggctctcagcaggatgggaccggacttctccgcgcgggagcgcaaggtggtcgaagccctcagcaagggcatcatcaacaaaatcctgcataccccggtcacctcgctgcgtgcacctcaaggcagacaggagcgtcagcaggccctgcgcacggttgagcggttgttttcactg

SEQ ID NO: 44618 - DNA, 1293 bp, SYNECHOCOCCUS SP. WH 8102
atgaagcgggttttggccatcattctcggcggcggtgccgggactcgtctctacccgctcaccaagatgcgcgccaagccggccgtccccttggccggtaagtatcgactgattgatatccccatcagcaactgcatcaactcgaacatcaacaagatgtacgtgatgacgcagttcaacagtgcgtctctcaatcgtcacctcagccagacgttcaacctgagcgcatccttcggtcagggattcgtcgaggtgcttgctgcccagcagacgcctgacagtccatcctggtttgaaggcactgccgacgctgtgcggaagtaccagtggctgttccaggaatgggatgtcgatgaatacctgatcctgtccggtgaccagctgtaccggatggattacagcctgttcgttgaacatcaccgcagcactggtgctgacctcaccgttgcagcccttcctgtggacccgaaacaggccgaggcgttcggcttgatgcgcacggatggtgacggagacatcaaggagttccgcgaaaagcccaagggtgattctttgcttgagatggcggttgacaccagccgatttggactcagtgcgaattcggccaaggagcgtccctacctggcgtcgatggggatttatgtcttcagcagagacactctgttcgacctgctcgattccaatcctggttataaggacttcggcaaggaagtcattcctgaggccctcaagcgtggcgacaagctgaagagctatgtctttgacgattattgggaagatatcggaacgatcggagcgttctacgaggccaacctggcgctcacccagcaacccacaccccccttcagcttctacgacgagaagttcccgatctacactcgtccccgctatttacccccgagcaaactggttgatgctcagatcaccaattcgatcgttggcgaaggctcaattttgaagtcatgcagcattcatcactgcgttttgggtgttcgcagtcgcattgaaaccgatgtggtgctgcaagacaccttggtgatgggcgctgacttctttgaatccagtgatgagcgtgccgtgcttcgcgagcgtggtggtattccggtcggggtgggccaaggtacgactgtgaagcgcgccatcctcgataaaaacgctcgcatcggatccaacgtcaccatcgtcaacaaggatcacgtcgaggaagctgatcgttccgatcagggcttctatattcgtaatggcattgttgttgttgtcaagaacgccaccatccaggacggaactgtgatc

SEQ ID NO: 44619 - DNA, 1413 bp, SYNECHOCOCCUS SP. WH 8102
atgtcccagtcgcacttcggtttaatcggtctcggcgtgatgggggagaacctcgtcctcaatgccgagcgcaatgggttctcgagcgttgtctacaaccgcacctacgccaagactgaggagttcctcaacggtcgcggtcaagggcggaacattcagggggcgacggatctgcaggatttcgttggcaagctggaacgtcctcgccggatcctgatgatggtcaaggcaggtccagctgtggatgctgtcgttgaccagatctccccatatctcgaggaaggcgatctgctaatcgatggtggcaactcggattatcacgacaccgagcgccgggtgaaggagctcgagagcaagagcttcggcttcatcggcatgggtgtgtccggtggtgctaagggggctctggagggccccagcatgatgcccggcggcaccaaagcctcctacgacgccattgagagcctggtgaacaagatggcggctcaggtggatgacggcccctgcgtcacttacatcggtcccggtggatctggccaccttgtgaagaccgtccacaacggcattgagtacggcatcgagcagatcctggcggagggctatgacctgatgaagcgggtcaagggcatgaacggggagcagatggccgatgtgcttgcccagtggaatgccactgaggagctctcctcctatctggtggagattacagaggtttgcctgcgcacgaaggatcctgaagacggcgcagatctcgtcgagaaaatcatggatcaggctggccagaagggcaccggtctgtggaccgtggtcaccgccctgcagatgggtgcatccgttcccaccatctacgcatcactcaatggtcgggtgatgagttccctcaagcctgagcgggtggcagccgaatccatcctcaaaggaccagtcatcaaggatttcgacctcggcacccccgacgacgccatggctcccctgatggatgccacggtgctcagctgcatcgccagctatgcccagggcatggaactgctgcgcatcgcctcccgggatctggactacagcttgcagatgccctccatcgcccagatctggaaaggcggctgcatcatccgtgcccgcctgctccagcggattcaggatgccttcgctgccaatcctgatctgaccaacctgatgttggatccctggtttgccgatcagatcaaccggcgtctgcccggtttggccaaggtggtggccggcgccgctgaatccggcattcccgtgccctgcttcagcagcaccctggactacatcaacagctaccgcaccggtcgccttcctcagaacctggtgcaggccatgcgcgactgcttcgggtcccacacgtaccagagggtggacaaagagggcgccttccacaccgagtggctc

SEQ ID NO: 44620 - DNA, 909 bp, SYNECHOCOCCUS SP. WH 8102
ctgatcaccggagccagcagcggtatcggccgtctcgccgccgaacggctgcaacagcaggggcaccggctcaccgtgatctgccgcagtcagcagcgagctgatcagaccctcggctggctgacgggagaaagccgcgtgctgctggcggatctggccgaccttgatcaggttcaagccatcggacatgcgcttcttgaaaaggatgaagccctggatggcctgctgctcaacgccggtttgcaatacgccggccatcggcaggtgcgctggagtgcccagggtctggaactcaccatcgccgtcaaccatctggcgcatcagcggctggtgatggatctgctgccactgctgctgcgatcccatgctccaaggctggtcatcacagcgtcggaggtgcacaacccggccagtggcggcggacgggtgggacgccccgccggcctcggcgatctctccggactgaagaagcattcagagatggtgaacggtgaacggccctttgatgcggacaaggcctacaaggacagcaagctctgcaacctgttgatgggcaggcatctggcagagcggcatccgcagttgcccgtgatctgctggagtcccggcctggtgattccgcggggtcgtgatggtttcttccgcaacagccgcgaggccaaccccctgggccaggcgttgtttggcttcgtggcacgtgatctgttacgactcaccgaacatccccagcgggcagctgaactgttggagcggttggtgctggatcccgccatgccatcgggattcagctactggagcaacacgctgcttgctcctgggcgtcatcggttcgaacgcgccgaaacctcggcagaagccgccgatgaggccaaggcagcgcggctctggcaggtgagtgaacagcttgtt

SEQ ID NO: 44621 - DNA, 1149 bp, SYNECHOCOCCUS SP. WH 8102
ctctccgcacgggccgtgggcctgaagccgtctctgacgctagccattggagcccaggccaaggcgttgcagcaagccgggcgagacatctgcagcctcagtgcaggtgagccggatttcgacacgcctgacttcattgttgaggccacacggcaagccctgcgtgatggcatcacccgctacgggccggcggctggtgaccccgagctccgggcagccgtggcggagaagttgtccagcggcaatggaatcgcaatcacccccgagcaggtcctgatcaccaacggcggcaaacaggcgatctacaacctgtttcaagtgctgctaaatcctgacgatgaggtgttgctgcccgctccttactggctgagctacccggagatggcggcactggccggtgccaaggtcaagctcattcccacccaggccgaggagggattccgtctcgatctcgcagctgtggaggcagcgatcagccctcgcagtcgccttctgctgctgaactcccccggcaaccccacagggcgggtgatgaagcgccaggagctggaggacgtggcggagctggtgcgccgtcatccccagttgctggtgatgagtgatgagatctacgagttcctgctggcggagggggaacagcaccacagcttcgcggcgatcgccccggatctcgccgatcgctgtttcaccgtcaatggcttcgccaaaggctgggccatgacgggctggcggctgggctacctcgccggacaccaggacgtgatcaaggctgccgctgcgctgcagagccagagcaccagcaatgtctgcagctttgctcaacgaggggcccttgcggccattcagggcccgcgtgcttgcgtttcagcgatggcggagagctacaaccgccgccggcagctgctcacggaggggttgcaagcgattgaaggaatcaccctcgttgaaccaaggggtgctttctatgccttcccgcagttgccggaatcggctggtggttcgatggacttctgcagtcgcgcccttgagcaggcgggcctcgccgtcgtccccggtctggccttcggaaacgaccgctgcattcgtctgtcctgcgctgtgtcccgtgagacgatcagggatggcctgtcacggctaacgcaactgcta

SEQ ID NO: 44622 - DNA, 1704 bp, SYNECHOCOCCUS SP. WH 8102
aaaccgaagtccgtcagttactcgagcttgctggaacagatccgcaacggtgatgtcagcacgcttgaactggttccagcacgccgcgaagtgcgggtgacctaccccgatggaactaaatccaccgtcagcatttttgttaacgatcagcagatcctcagggccgccgaggcttcggccacacctctcacggtgcgagacatccgcggtgaacaggccatggccggtctgctggggaaccttggactcgtcctgctcctggtggtagggctgtcgttcctgttgcgtcgatccgcccagatggccaaccgtgcccttggtttcggccgcagtcagccacggctgaagccacaggaggatcttcaggtgcgctttgaggacgttgccggcatcaacgacgccaaggaggagctcgaggaggtggtcaccttccttaagcagccggaatcgttcaccggtcttggcgccaagattccccgtggcgtgctgctcgtgggtccccctggcactggaaaaacactcctggcccgtgccatcgccggtgaagcggaggtgccgttcttttcgatggccgcctccgaattcgttgagttgtttgtcggggtcggggccagtcgggtccgtgatctgttccgtcaggcgaaggagaagtccccatgcatcgtgttcatcgatgagattgacgccgtcggtcgtcagcgcggtgccggaatcggtggagggaatgacgagcgggagcagaccctgaaccagctgctcacggaaatggatggttttgccgacaattctggggtgattctgctggcagccaccaaccgagctgatgtgttggatgcagccctcacccgtccaggacgctttgatcggcgcatcgacgtgtctctgccggatcgccgcggccgtgaggagattcttggcgttcatgcgcgaacgcgacctctggatcccgagatcgatctgacggcatgggctcgccgaacaccgggtttctccggtgctgagctggccaacctgatcaacgaggcagccatcctcacggcccgtgaacagcaacccttcatcagcgatcgccagctggaaggggccttggaacgcatcaccatgggcctcagtgccaagccccttcaggacagtgccaaaaaacgactgatcgcttatcacgaagtcggtcatgccctcgtggcagccctgctgccggctgccaacaaattggacaaggtcacgattcttcccaggggagcggcaggtggttacacccgtttcatgccagatgaggagaagctggactcgggcctgatcacccgagcgtcctgtctggccgacctcgtggtttctctcggcggccgtgctgcggagctggtggtcttcggaccactggagatcacccaaggagccagtggtgatctgcagatggtgtcccagttggccagggagatggtcacacggttcggattttcgtctctgggccctgttgccctggaaggtcccggcaccgaggtgttcctggggcgtgactggttcagccagcgccccggttatgccgaaagtaccggtcaggccattgacacccgtgtgcgggatcttgccaagcaatccctggaccaggctgtggccctgctggaatcacgacgcgacgtgatggatcgcctcgtcgatgccctgatggaggaagagacgctccaccacgatcgcttcatggagctc

SEQ ID NO: 44623 - DNA, 579 bp, SYNECHOCOCCUS SP. WH 8102
tgccttcgtgtgggccagcaggcccccgatttcactgccactgcagtggtggaccaggaattcaaggaaatctccctgtcccagtaccgcggcaagtacgtggtgctcttcttctatcccctggatttcaccttcgtctgccccacagaaatcacggccttcagcgaccgctacgccgatttctccagcaagaacaccgaagtcctcggcgtttccgttgacagccagttcagccatctggcctggattcagactccccgcaatcagggcggtctgggcgacatcaactatcccctggtcgctgacctcaagaaggaaatcgccaccgcatacaacgtgctggacgacgccgaaggcgttgctttgcgtggactgttcatcatcgatcccgatggcgtgatcatgcactccacgatcaacaacctgcctgttggccggaatgtggacgaaaccctgcgtgtgcttcaggccttccagtacgtgcagtccaaccccgatgaagtctgccccgccaactggacgcccggcgaaaagaccatgaagcccgatccgaaaggttccaaggagtatttctccgcc

SEQ ID NO: 44624 - DNA, 3642 bp, SYNECHOCOCCUS SP. WH 8102
atgcatcgtcttgccagttgcccgggcattgatcctcccgaggatttggtgctcgttgagcaacccccggcggatgttctgcttctctccagtgcagggaccgacctcagctgccttgaagcagtggtgcaggcctccccggattggaacagccgaatcagggctctccatctcgacaacctcagtcatccggcccagctcgaccactacctcgcttccaccgcgacccaggctcgtttgatcgtggtgcgcctgctcggcagccgcggccactggagttatgggttggagcagctccagcgctggagtgaagaagtcgccgatcggcaattgctggtgctggcgggaacggttgatcagcagggggatctacgtgggatcggcaccgtggtgcccgcacttgcggatcgtcttgcggccctgctgcgggaagggggcgagaccaacatggccaggctgctcgatgccattcaggcactgctagacggaacgccaccggacagcgaggagatcgaggtggcacccctggccgatcccttcccctgggactggcaggacgatcctggtgccaccgttggagtggttctctaccgcgcccagttacaggccggggacaccgctcttgcgcagcacctgaatcaagccctgcgggagcgtggccttcggcctcgcctgatctgggtgagcagcctgagggaccctgccgtccaggccggagtcctcgatctgctccgcagccagggcgctcaggtggtgatctccggaacggccttcgcctccgtcaccacggagcaagccggcctcggcagtgccctttgggacagcctggaccgaccggtgctgcagctgctgaccgccggcaccagccgggagcgttggcagcagtccagccgtggcctggaacccctggacctgtcgctgcaggtggtgatgcctgaactggacgcccgggtcaccacccgcccatgcgcattccggcaggcacgcccccccctcagcggtctcgctacggcgatcacgacgcagcaaccggatcgggacggcatcaactggctggtggagcacgcagcctgctggattgatctccaggacacacctgccaagcatcggcggatggccatggtgttggccaactatccggtgcgggatgggcgtgtggccaacggggttgggctggatactccggccagcgtggtcaacatcatcggttggctggccgacgcgggttatcaactcggcgagcaccccataccctccaatggcgatcgattgattgcgtcgttgctggcgggacgcaccaactcagccgagggccgttaccgccccccccttgatcacctgccgctggagacctaccaagcctggtgggacaccattccaagcgaggccaaagcacggatcgtcagccgctggggagagccgcagcaggcctgtgatctcgatggggagcgtgggtttgccattcatggtttgcgctatggccatctggtggtgctgctgcagccggatcggggctatgacccggatcagatcgctgatctgcattcgccggacctgccgccaccgcaccgctacttggctcagtacctgtggttgcgagaggtccatggcagccaggtgatggtgcatgtgggcaagcacggcagtgctgaatggttgccgggcaaaggggtgggtctcagtgcggcctgtggccccaatctcgcccttggtgccttgccgcatctctaccccttcatcgtcaacgacccaggggagggatcccaggccaaacgccggggccatgcggtggtgctggatcacctcaccccacccttaggccgcgccggtctgcacggaggccttcagaaacttgagggactgctggatgaactggtggaggcccgacagctcggtggtgagcgcacccaggtgttggaaacccaggtgctcagcacccttcaggatctggactggccagagatcccgagccgacgagagctgaagaagaacccggaccgactcaacagttgtcttgaccaggcggaaacctatctctgcgagttgaaggagtcgcagatccgcacgggtctgcatcgctatggccagtgcccagacgacgctgccatgactgagctgctgatggccttggcgcgtccaccgttgcagggtcagcctggcctgacgcaattgatggcccgggaagctggcttggaattcgacccctggtctcaggacgacggagagtccctcgatccagccgaccgcgcgcgattggcagcgctcggttgccagcgctgccgccgggtgggggatggcagcgcgtggttggagcagcagggcttgttgatcctcagacagctcgtgctccacgagcaggccgtggatctggcaacaccgtttcgatcactggtggagacatcagcgcccctgaggcaacgctgcctggagctgtggaaacgcttgcaggcttgtgacgaggcagaacgtcagggactgatgcggggtctggagggccgccgcatcgctgctggtccctctggggcccccagtcgtggccggccggatgtgctgcccaccggtcgtaatttctattccgtggatctccgtgggctgccgacggaggcggcatgggaccttggccgccgctccgccgaacgcttgctggatctgcatcttcaggatgaaggtgaacccctgcgccacctggctctttcggtttgggggaccgccacgatgcgcaatggcggtgaagatatcgcccagctgctggcgctgatcggcgtccgccccgtctgggatggccccagcaggcgtctggtggatctagaggtgatccctgccgatctcctggggcgacctcgggtggatgtggtgttgcggatctccggtttgttccgggatgcgttcccgcagctggtgagctgggtgaaccaggcacaacagatggtggccttgctggaggaaccagaggagatcaaccctctggccagcctcacccgtcgtgatggcccacaaggacgaatctatggatccgcccccggcgcctatggcgctgggttgcaggccttgatcgacagtggtgcatgggagtcgcgcagggatctgggtgaggcctttctgtgctggagccagtggcgctacgacggttcagcggagcccgttgccgatcgctccggtctggagcaggccctgtcgtctgttcaggttgtgctccacaaccaggacaaccgcgagcatgatctgctcgattccgacgattactaccagtttcacggtggcctcagtgctgcagccgagcaggtgtccggtcagcgtccccagttgtggttcggtgatcattcacgccgcgagcgcccccgactgcatcggcttgagaaggaactggacaaggtgatgcgcagccgcatgctcaatccccgttggatcgaagggatgcagcaacacgggtacaagggtgcgtttgagatgggggcgagcctggattacctgttcgcctacgacgcggcaaccgaccgcgtcccggactggtgctacggagcggtgtgcgatcgctggctggcggatcccgtgaaccagacctttctcagcgatcgcaacccctgggtactgcgggacatgtcagaacgactgctcgaagcgtccaatcgaggtctatggacg

SEQ ID NO: 44625 - DNA, 831 bp, SYNECHOCOCCUS SP. WH 8102
ctgcagttcagcaaatatcagggacttggcaatgacttcctgatcctggaagggcggcaagggcagttgccgcaatcggtcgttgagccggaccccgtctgggtgaggcagctctgcgaccgacgcttcggaatcggtggtgacggcgtgattcttgcgctgccgccccaggggcagggtgatctgcgcatgcggattttcaacgccgacggcagcgaggcagagatgtgtggcaatggcatccgctgcctggcacgttttcttgccgacagcgacggtgacgctcctggaaaacgctgggcgatcgaaacaccggcgggcctgatccgtccggagctgcaaagcgatggtcagttgcgcgtcgacatgggtgctcccttcctggaaccctcaagcattcccacaactctcccgctggtggacgggttggcgaggggatcggccgatcttgcggatcgagcgctggaggtggcagcggttgggatgggaaatccccacgtcgtggtgccggtggaggacctcaacgcgattcccttcgacgcatggggggcggccctggaggttcaccatctgttcccggccaaaaccaacgtgcatttcctgcaggtgcacgcccgcaaccgtctggagatccgtgtgtgggaacgcggtgctggaccgacgctggcctgtgggacaggtgcctgcgccacccttgttgctgctgtcctgcttggactggctgacgaccatgccgaggtgatgctgcccggcggtccactccagattgcctggcctggacgccatggtgctgttctgatgacgggtccggccgtggcggtgttcgatggg

SEQ ID NO: 44626 - DNA, 1557 bp, SYNECHOCOCCUS SP. WH 8102
gacgctcagattcaatggcagcgcttctgtgacctgctctggtatcacgaagatctcggcatctggttggacatcagccgcatgcatgtcaacccatcccatctcgagcagctgcaaccgggattcgataaagccttcgcggccatggccgagctcgaagctggtgccattgccaaccctgatgagcagcgtcaggtgggtcactattggctgaggaccccgcagttggcgcctaatgaggcggtccgagaccaaatcgccacagaaatcgatcagatcgatcagttcggtcgggatgtgatcagcggcgtgatcaaagctcccggaggacagccctttacggatgttctctggatcggcatcggcggtagcggtctggggcccctgttgatgatcagagcgctgcagggccacggctccggtctgccgtttcacttcttcgacaacgtcgatccaaatggcatgagtgccgttttggctgagctggacgatcgactggcgacaacccttgtggtcaccgtgagcaagtccggcggcacgccggagccccatctgggtatggagcaggctcgccatcgtgtggagtcccgtggtggccgctgggccgatcaggctgtggctatcaccatggtcgacagcaaactcgatcgggaagcccaacaagacggctggcttaaaagcttttcgatgttcgattgggtgggaggacgcaccagcatcaccagtgccgttggcttgctgcctggtgctctgatcggagctgacatccgcgattttctcgctggtgctgcccagatggacgatgccactcgtctggcggatctccggcgcaatccagcagcactgatggcggcctcatggttcgttgctggggacggcaagggacgtcgcgacatggtggtgcttccctatcgcgatcgcctcgaggtgttcagccgctacctccagcagctggtgatggagtccctgggcaagcgactagaccgtgacggcaacgaggtgaatcagggcatcgccgtctacggcaacaagggatccacagaccagcacgcctacgtacagcagctccgagacggtgttgacaacttttttgccactttcatcgaggtgcttgaggatgtttctgatatccctgtgatcaaggatgaatgtccaggcgattttcttgatggtttcctacaaggaacgcggtcagcgttgactgaaggaggtcgccagagcctcagcatcagcatgcgtcgctttgatgcgcgtcgtcttggtgcgttgattgctctgttcgaacgtgccgtgggcttctacggcgatctggtcaatatcaatgcttatcaccagcctggcgtggaagccggcaagaaagctgccgcggcaatcctcgacctgcagagccgggttgaagctgttctcaaagacggcgcaccacgcaccgtcagtgaaatcaggcaggccgttggtgacgggagcgatgaggcgatcttctggatcatgcgtcatctcgctggcaatgaccggggctaccgggccgagggggattgggccaacccggccagcatccgg

SEQ ID NO: 44627 - DNA, 1071 bp, SYNECHOCOCCUS SP. WH 8102
atggccggtggtgggcagggtcgtgtcgcggtgatcggtgcatcgggctatggcgggctgcagaccatcaggcttctgcaggaccatccgtcattgaccgtgacgttcctcggcggagaacggagtgcaggacggcgctggagctcgatctgctcatttctgccgcttccggaagaccccgttgttcagtccgctgatgctgagcgcatcgctgcggccgcggattacgccgtcctcagcctccccaatggattggcctgtcaactcgcaccggagcttctgcagcgaggtgtgcgggtggtggatctctcggccgactttcgctaccgatcgctggagcagtggagtcaggtgtatgcccaggaggccaaccgtctctcacgggaggattcggaactctgccaacaggcggtgtatggattgccggagtggcatggtcctgccatcgctgaggccaggttggtggcagcgcccggttgtttcccgaccgcaagcctgcttccgttgcttcccttcctgaagcagggcctgatcgacaccgacggcatcgtcatcgatgccaaaacaggcacatccggcggcggtcgtgttcctaaggaggcgatgttgctggcagaggcctcagagtcgattgctccttacggcgtgatcggacatcggcacacctcggaaatcgaacagatggcccgggaggttgccggtcaggatgttcggttgcagttcactccccatctcgtgccgatggtgcgtggcctgttatccaccgtgtacgcacgcctgcgggatcctggtctgacggctgaggactgcacaacggttctcgaagcggtgtatcgccaccacccctgcgtttccgtgctgccggtgggcacctatccagccaccaagtgggcgcggcacaccaatcgcgcgttggtctccgttcaggtggacacaagaaccgggcagatgatcctgatgagcgccatcgacaacctgatcaaaggtcaggctggacagggggtgcaatgcctgaacctgatgcatggcctgccgccggagacagggcttcccttgcagagtttttatccc

SEQ ID NO: 44628 - DNA, 2320 bp, SYNECHOCOCCUS SP. WH 8102
atggggcggatcgtcgggatcgatctggggaccacgaactcggttgttgccgttctggaggcaggccgccctcacgtgattgccaacgctgagggtggcaggaccaccccatcggtggttggttacagcaaagaccaggaactgctggtgggacagctggcgagacgtcagcttgtgctgagccctcgcaacacgttctccaacctcaagcgtttcgtgggacgcgactgggaagaactggaggacagcagccttgccgtgccttacacggtccgtgccaatgaccgaggtcaggtgcgcgttccttgtcccgtgacggaacgggagtatgcgccagaggagctggtggccagcatcatccgcaagcttgtggacgatgccagcacttacctgggcgaatccgttgaagcggcagtcgtcactgttccggcttatttcaacgacgcccagcgccaagccacccgcgatgccggtcgtttggccggcatcgccgttgagcgcattctcaatgaacctactgctgccgccctggcctatggcttcgatcgcagtgccgttcgtcgcgttcttgtgtttgatcttggtggtggcacattcgatgtgtcgttgctccggattgcgaacggagtgttcgacgtcaaggccaccaatggggatacacaactgggcggcaatgattttgatcagcggatcgtggactggatcgctgatgcctttcaggctgagcatggggtggatctgcggcgggaccgacaggcccttcaacgcctgaccgaagcggctgaaaaggccaaacaggaactgtccggcgttctcacaacaccgatctccctgccgttcatcgcaacgggtgagaacggcccactgcacgtggagaccaatcttgatcgcagcacgtttgaaggtctctgcccagacctgctcgatcgtctgttgatgcccgtccagtccgcgttgcgcgactccggctgggctgcggatgacatcgatgatgtggtgcttgtgggaggcgccacccgcatgcccatggttcagcaactggtgcgcaccctggtgccgcttgatccctgccaatcggtgaaccccgatgaagtggtggccatcggcgccgccgttcaggccggcatcctcaccggggaactgcgggatctgttgctgaacgacgtcacacctctttccctggggctggagacggtcggtggtctgatgagggtgttgatccctcgcaacaccccgattcctgtgcgtcagtccgatgtgttcagcacgtcggaaccgaatcagtcctcggtggagatccacgtctggcaaggcgaacggcagatggcttcagacaacaagtcgctcggacgtttccgactgtccggaattccgccagctccccgtggtgtcccgcaggttcaggtggcgtttgacatcgatgccaacgggctactgcaggtgagtgccacggaccgcaccaccggcagaaagcagtcggtgtcgattcaaggcggatccaacctcaacgaggatgaagtcaccgcactgcttgctgaagcggaggcgcgggcggatgaggaccgccgcaagcgcaaccagattgaacgccgcaaccgtgcccagacgcttgttgcccaggcggaacgtcgcctgcgcgatgccgccctggaactggggccctatggggcggaacgtcagcagcgcgctgtggagatggcaatgcgcgatgtgcaggattgtcttgctcaggacgatttgcaggaactggatctgtgcctcagtggccttgaggaagccttgttcggcttgaaccggcgcctgtctgctgagcgtcagtccgatggacgcccgcttcagggcttacgcaacacgcttggctcacttaaggacgagttgttcgctgatgactgggacgatgatccctgggcagccccgagtggtccaccacggggacgcagcctgaaccgccgggatcgtgatccctgggacgatgacttctaccgctgatcctgattactggtcgctgcttggtttaggtccggaggcggatgccgaccagttgaaacgggccttccgtcgggaagcgcgccgttggcatccggacctcaacggcaacgatcccgttgccgaggagcggttcaagctggtcaatgaggcctatgcggtgctcagtgatccccgccgccgccgggcctgggagcatggcgatcgagaaggacggcgtgatcgagatccgtttgaacaagggttccctgatttcgaggactatctcgaggtggtgcttggcgaatcgtcgcgtcgatctgaatcgccccctcccgagcgaaacgatcccgct

SEQ ID NO: 44629 - DNA, 1881 bp, SYNECHOCOCCUS SP. WH 8102
gaacagggtcaaattcagatccacaccgagaacatcttcccgatcatcaagaaggccgtttactccggccatgaggtgtttctccgcgagctggtcagcaacggtgtcgacgccatcagcaagcggcgtatggcggccatggcgggcgactgcagcgaaggcgaagacggggttatccgcatcaccgttgaccgagaagctaaaacgctcaccattgctgacaacggcatcggcatgaccgccgatgaggtgaagcgctacatcaaccaggttgccttctccagtgccgaggattttctggagaagtacaaacaggagggagacgcgatcatcggccacttcggcctgggcttctactccagtttcatggtggcggagcaggtggaattggtgacgcgatcggcgcggccggacagcgaagcggtgcgatggagctgtgatggatcccccaacttcagcctcagttccgccgagcgtgatcagccaggcaccgatgtgattctcaccttgatggaggaggaactggagtacatcgaaccagctcggatccgcaccctgatcaacacctactgcgatttcatggcagtgccagtgcagctggagggggaaacagtcaacaagatgaatgccccgtggcgaaagagcgcccgggagctcaccgacaaggactacatcgatctctacaactacctgtacccattccagggtgacccactgctctgggttcacctgaacaccgattatccctacaacctgcagggaattctgttcttccccaagcagaccggtcgtgcggactgggagaaaggcgaaatcaagctctactgcaatcaggtgttcgtcagtgattccatcaaggaggtggtgccgcgttatctgcttcccctgcgtggcgttctcgattcacccgacatcccgctgaacgtcagccgcagtgccctgcagaccgaccgacgtgtgcgatccattggcaatttcgttgccaaaaaggtggctgaccgcttgcgcaacgtcaagaaagacgaccccaccgcctatgcagaggcctgggagtccttggcacccttcgtgaagatcggagccatggaggacgacaagttcgccgaccaggtggcggagctgattctgttcgccaccagcgcctctgcagcagatggcgacacccctgatccaatcagcaccggtgatcgtgccttcaccactctggagggctaccgcagccgactggacagcaacaacgacaagcgcatcctgtacagcaccgacgacgtggcccaggccggcgcactcaacctctggacctcacagggaatggaagtgctgaagctggagacggtgatcgacacccagttcatcccatggctcgaacagcgccatgaggatctgacctttcagcgtgtcgatgccgagcttgatgacagcctcaaggacatcgacgcggaaatcaccgaccaggacggcacaacggaatcagatcgactgagagatctgatcaagaccgcgctgtccaacgacaaggtgaccgtgcaagtgcaggctttgaaggctgagggtgcaccgcctgcgatgatcctgctgccggagcagatgcggcgcctcaatgacatgggagccctgatggaacagcggcttcccggtctgccagaccatcacgttcttctggtgaacaagcgacatcccttagttgaggggatgctgaagctgaaggccggcagcgtgctcatcggcgatgctcagagttcaccgacggaggccctggcccaggacattgcccgccacgtctacgacatggctcgactgggtgtcggcggcctggagcccaatgaactcagtggctttcagacccgcagcgctgaactgatgggaacgctgatgcagaga

SEQ ID NO: 44630 - DNA, 1448 bp, SYNECHOCOCCUS SP. WH 8102
agttcgttcgtcatcctttatcaccgaacgccttttgatgaggcaaaagatgcccaaggcaaccaagtctgggttgatcagaaaagtccaaacggcattatcccaaccctaagaaatctcttcaggtcacggaatgacggcacctggattgcatggcgtcatgttgatcatcctgaagagatggatgttgagcgacttgagatgaccaacccctctcccttcgcgttgtgcaggattccgctagccgacgaacagatatccagtttctatcacatcacctcaaaggaatgcttctggccaatacttcacacctttccgactcatttcaatgtcaacaatgccaatggggcatttttgaggaagtcaacaagcgcttcgctgacgcagcctgtaatgaagccgctgaaggtgccacagtctgggtccatgattacaacctttggctggcgccgggttacatccggcaacagcggccggatttaaaaattgccttctttcatcacactccctttcctggtaacgacgtcttcgccatccttccctggcgcgaacagattttggaaagtctgctctgttgtgatgtcgttggctttcatatcccccgctacaccgagaatttcgcccgtgctgcgagcaccttggtgggcgccaaacgagggccgaagatctctgttgaccagaagttcatctcagtcggcacggctctttcagaaggaacggtgaccagccatctggatcacaacggtcgacgcattcaattgctgagttccccggttgggacctcacccgatgtgatccaggagttgtcctggagtgcatccgttgaaagttatggagagatgatcgtccaggacaccaagaaaggacgcaaactgatcctttctgcaagccgggttgattacaccaaaggcaatgaagagttgctgcttgcctttgaacgcctcctcgaacgccgagaggatcttcatggggaagtagtgctgatgctggcctgcgtggcggccgccagcgggatgaagatttacgaggagacgcagcgctccattgaggaaatggccggacgcatcaatggtcgtttcagtcaggttgattggatcccagtgcgcttctccacgcggcgtattccttacgaagagatggtggcctggttctgccatgcagatgtctgctggatcacaccgcttcgggatggcttgaatcttgtcgccaaggaatacgcagctgcacgtcgccatcgtggcggtgtcctcgtgctttcggaattcaccggtgcgtcggtggtcctggaaggggctgtcctgacaaatccttattccaaccgtcggatggatgaggccatcgaggccgccctggccatgccggaacacgaacaacgccaacgcatggagaccatgtcagccgctgttgaggcttacaccgtgcaggactgggccgaagaacaactggcg

SEQ ID NO: 44631 - DNA, 1140 bp, SYNECHOCOCCUS SP. WH 8102
gttctgatcgctggggcaggcccggctggcgccagcctggctgttcaactcgctgaagtgggctgggaggtaaccctggctgatgccttgccgtctcctgagcgcaatgcttattcgagcgccgcgctaccccttgccgatgccgatcgtctgggcattcctggggcgtgtcgctccgccagctggtggggatggcagctgttggatcccgatggtcttgaacaccagtggtgggcggctgatccgcagggggtggtgctcgacttcgccgtcttcagacgacatctctgggaccaggcccggcagaccggcgttgagctgttgaacggttgtcaggtgcagctagatcgtctggaggcacggtcggccgacctgatcctgacctcaactgatcaacagcagcatcgaacggtcgacctcgtggtggatgccacagggccaggtcgacatctgctgaagcaggctggcgtccctgttgagaccacagacgatccgttgctcaagggagacggtgtggagtggctgcttcagggagaccgtggcaacacagcacgttggcgtgagcgggtcagtttcatgctgggccgtgagtggatgccccatgggtacggctgggtgttcccgatggcccaggatcgcctcaaggtgggggtttgccgtttggcacctcccgatcagcccaaggttcccctcgggacatctctgcgacggttgttgaaacgttgtgatcttgaccgcctgccggtgctggatcgtcacggtggacgtgtcgccagcacgatcagacagcaacaaccccatggcacaggcgcactctgggccgttggcgacgccgccggaaccgccaatctgctcggaggcgaggggattcgccatgccatcgacagcgcatccgtcttgagcgaatgcctgctcttgggtcgttcccaccggggctatcaggctgctctgagacagcgatatggatggcgatgggcggtgtccaatcgtttggctcgtcggacctggtggggcctcaacacgccaaaggcagatcaccgcatgcaacggctcatccatggtttgtccggacaggcctctgccgaagacctgtccgaacttttttttgggtatcgatttgagcggtacggctggcgattg

SEQ ID NO: 44632 - DNA, 1911 bp, SYNECHOCOCCUS SP. WH 8102
atgcatctcggagatttgactcatccgaatgagctgcacggcctcaagctgtctgagcttgaggatgtcgcccgtcagattcgagaccgtcatcttcaggtggtctccaccagtggtggccatctcggccctggtctgggggtggtggagctaaccctggcgctgtaccagaccctcgatctggacagggatcgggtcatctgggatgtcgggcaccaggcttatccccacaaattgatcaccggtcgtttcaacgacttccacacccttcgccagcagaatggtgttgcggggtacctcaaacgctcagaaagcaactttgatcatttcggtgctggccatgccagcacgtcgatttcggcagcgctgggcatggcgatggcccgggataatcgtggtgaggacttcaagtgcgtcgccgtgatcggcgatggtgctcttaccggtgggatggctctggaagcgatcaaccacgccggacatctccccgaaacccccttactcgttgtcctcaacgacaacgacatgtcgatttcaccaccagtgggtgccctatcgaacgttctgaaccgcgcaaggctcagtccgccgatgcagttcctctccggcagcgttgaggaaagcgttcgccatcttcccttcatgggtggcgagctcccagccgagttgaaccgcctgaagggaagtatgcgtcgtctcgcggttcccaaggtgggtgctgtgtttgaagagctgggcttcacctacatggggccgattgatggccatgacatcggtgaaatgatgcggaccttccaggctgcccaccgtgatggtgggcccgtgctggttcatgtcgttaccaagaagggcaagggttacccctatgccgaggcggatcaggtcggttaccacgcccagtccgccttcgatctgaccaccggcaaggccattccgtcgaagaaaccgaaacctgccagttacagcaaggtgttcggccagaccctggtcaagctctgcgaacagaacagtcgcgtggtgggcatcaccgctgccatggccactggaaccggtctggatctgctgcagaaagctgttcccaatcagtatgtggatgtcggcatcgccgaacaacacgctgtcaccttggcggcgggcatggcctgtgaaggtcttcggcctgtcgtggccatctacagcacattcctgcagcgggcctacgaccaactcatccacgacgtcggcatccagaatctgccggtgacctttgttctcgatcgggctggcatcgtcggtgccgacggaccgacgcatcagggtcagtacgacatcagctacatgcgatccatccccaacttcacggtgatggcgcctaaggatgaggcggaactccagcggatgctggtgacctgtctgaaccacgacggacccacagctctgcgcattccccgcggatcgggcgttggcatgcctttgatggaggagggctgggaagctctccccatcggtcgcggtgagctgttgcgggaaggggatgatctgctgatcgtggcctacggctcgatggtgcatccggctctggacaccgccacactgcttgaggaggctggcctctccaccacggtgatcaacgcccgtttcctgcggcccctggatcaggctttgattcatccgttggcacggcgcatccgtcgcgtggtcaccatggaagagggcgctctggccggtggatttggtgcagcagtcctcgagtcgttgtccgatcaggacatcagtattccgctgttgcgtatcggtattcccgacaaaatggtcgaccacgccacgccgcagcagagcaaggagtcgctggagatgatacctgttcaaatggctgagcgcatccgtcgccgttttgatctgggcggacgcgacttcgccggtgctgcatcg

SEQ ID NO: 44633 - DNA, 1407 bp, SYNECHOCOCCUS SP. WH 8102
cgtcggaccaagatcgtggccaccatcggtccagccacggaaagttccgagcgaatcaaggaactggttcaggctggagccaccacctttcggttgaatttctcccacggcgaccacagcgagcatgcggcgcggatttcgaccatccgccaggtgtctgaagagctcgggatcaacatcggcatccttcaagacctgcagggaccaaaaatccgcctgggccgttttgctgagggaccgatcacccttgccaatggcgacagcttctccctgacgtccaggccggtgagttgcaaccaatccatcgccaccgtcacctacgacaaactcgctgacgaagtcaccgcaggaagccgcatccttctcgacgacggccgcgttgagatgaaagtcgagcaggtggatcaggctgaacagaccctgcactgcaccgtcaccgttggcggtgttctctccaacaacaaaggagtgaacttccccgacgtgcagctgtccgtccgcgctctgacggacaaggacaaggtggatctggaattcggtctctcccagggggtcgactgggtggccctgagcttcgtacgcaacccctccgacatggaggaaatccgtggtctgatccgtgagcatggccacgagacccccgtcgtcgccaagattgagaagtttgaggccatcgaccagatcgatgccatccttcccctgtgcgatggcgtgatggtcgccaggggtgacctgggggtagagatgcccgctgaggaggttcctcttctgcagaaggaattgatccggaaagccaacagcctgggcattccgatcatcacggccacccagatgctggattcgatggcctccagcccgcgacccacccgcgctgaagtgagcgatgtggccaacgccattttggatggcaccgatgcagtgatgctctccaacgaaacggccgtcggcgatttcccggtggaagccgttcaaacgatggcgaccatcgcctgccggatcgaaaaggattatccccagcgttccgttgacagccatctggccagcacggtgccgaatgccctgagtggcgccgtcagcaccatcgccagtcagctgaacgcctcggcgatccttcctctcaccaaaagcggagcgacggctaagaacgtcagcaagttccgtcccgcatcgccgattctggccattacccctgatccaaccgtggcctgccgtctgcaactggtttggggagtgaagccgctggtgatcccgcagcacgaactcaccactcacacgttccttgccgcgatgacccaggccaaaacaatggggcttctgaaggaaggtgatctggtcgttcagacggccgggacccacacgggtgtctccggttccaccgatctggtcaaggtgggcatcgtcagttca

SEQ ID NO: 44634 - DNA, 1866 bp, SYNECHOCOCCUS SP. WH 8102
atgaatcagcgttggcgccttgtcgccctctggcttctgcccatcggcgtcgtgctcctgatcggttggcaggtgatcagtaacggtggtctgaacagtcagaacgccgggggcaccaccgtggcgcctcgcaatgcagcggtggcccgcatgagctatggccgcttcctcgactacgtggaagccggtcgcgtgacagctgtcgacatctacgacggtggtcgcaacgctgtaatcgaagccgttgatcctgacctggacaaccgtgtccagcgtctgcgggtggatcttcccggtctcgctccggaactggtcaacaccctgaaggaagaagggatcagctttgacatccatcccccacggacagcacctccagcccttggcctgttgggcaatctgctgttcccgttgctgttgatcggatcattgattttcctggcccgtcgcaacagcggcatgccaggaggtcccggtcaggccatgcagttcggtaagagcaaggctcgcttcatgatggaagccgaaaccggtgtgatgttcgatgacgtcgccggtgttgcagaggccaaacaggagctccaggaagtagtgaccttcctgaagcaacccgagcgtttcacgtctgttggtgctcagattccccgcggactcctactagtcggccctcctggaactggcaagacactgctcgccaaggcgatcgctggtgaagctggtgttccgttcttctccctctccggttctgaattcgtcgaaatgttcgtgggtgtcggtgcaagccgagtccgcgacctgttcaagaaagcgaaggaaaacagcccttgcttaatcttcatcgacgaaatcgatgccgttggacgtcaacggggcgctggcattggtggtggtaatgacgagcgtgagcagaccctcaaccagctgctcaccgaaatggatggtttcgagggcaacagcggcatcatcatcattgcggcaaccaaccggccggacgtgttggactcagccctgatgcgtcccggtcgcttcgaccgtcaggtcaccgtcgatgcccctgacatcaagggtcgactctccatccttgaagttcactgccgcaacaaaaagcttgaagaggagctttccctcgaaagcattgcccgacgcacccccggattcacgggtgctgacctggccaacctgatgaatgaggcagccatcctcacggcccgtcgccgcaaagaagccattggcctgagcgagatcgatgatgcggttgaccggatcattgccggcatggaaggccgtccattaaccgatggccgcagcaagcgtttgatcgcgtaccacgaggtgggccatgcgttgatcggcaccctggtgaaggaccatgacccggtccagaaggtcacactgattccccgagggcaagcacagggcctcacctggttctcaccggacgaagagcagacccttgtgacccgatctcagctcaaagcaagaatcatgggagcacttggtggacgagccgctgaagatgtggtgtttggccatgaggaagtgaccaccggtgctggtggtgacattcagcaagttgcgtccatggctcgccagatggtgacccgcctcgggatgagcgacctgggtcctgttgcacttgaaggcggaggtcaggaggtgttccttggccgagacttgatgtcccgcaacgacatctcggaatcaatctcccagcagattgatgctcaagtccgtcaaatggtgaagcgctgctatgaggaaactgtcgacattgtcgcggccaaccgtgaggcaatggatcgtctcgtggaactgttgattgaaaaagaaaccatggatggcggcgagttcgcagctgtggtggctgaa

SEQ ID NO: 44635 - DNA, 1062 bp, SYNECHOCOCCUS SP. WH 8102
atcgccgtcgccttggaacgcaacccctatgaggtggtgatcggcgccggtggcctgagccgccttggggacgaactcctgaaggccggaattcagcccggccgacggatcctggtggtcagcaacccggacgtcgccgccccctatggagaggggtgcctgcaaagcctgcgtcaacagggcttccacgccgaccttctggtgattgatgcgggagaagagcgcaaaactccagccacggtggccgccatccatgattccgcctttgagcagcgtctggagcgcagctcgttgatgctggccttgggtggaggggttgtcggagacatgaccggatttgcagcagccacctggctgcgcgggatccaggtgattcaggtccccacgacccttctggccatggtcgatgccgccatcggcggcaaaacaggggtgaaccatcccggcggcaagaacctgatcggcgcctttcaccagccgagcctggtgctgatcgatcccgaaacgctcaacacattgcccgagcgggagttcagggccggcatggcggaggtgatcaagtacggaattcttggcgatcccgcgctgttccagtgcctggaggaggggccagaacccaactcagctgctggccttggcaacagccggctcgaaaccattctggaacgatcggcagcggccaaagcacgggtggttgctgcggacgaacgggaaggggggctgcgggccgtgctgaattacggccataccttcggtcatgtggtggaaaccctctgtggttacggcacctggctgcacggcgaggcagtggccatcgggatggtggcggtcgggcagttagccgtgaaccgcggcagctggacggcggacgaggccgggcgccagacgcagctgatccagcgctgtgggctaccgacggcctggccggatctggaccctgacgccgtgctgcgcacccttcagggagataagaaagtgaaagacggtcgcttgcgcttcgtgctgcccatggccatcggccgcgtggagatccgcgatgacatcagccgggatgaaatcctg

SEQ ID NO: 44636 - DNA, 1143 bp, SYNECHOCOCCUS SP. WH 8102
cccagcgaaggcactcaggcgctcgagaaggaacgcaagctgcccctcaccggctggcagcaggaagttgatcaggccaagcgcctgggtcttgaagcggccgaaagcatcgtggaccgcaacatctccacgttctcccgcggcgagctgccccacttcgcgggcatcaacaccttcatgaaggcgccctacctggaggatgtgaaccaggtgggcaactacgacgtggccatcgtcggggtgccccacgactgcggcaccacctaccgccccggcacccgcttcgggccacagggcatccgccgcatctcggccctctacaccccctacaactacgaaatgggggtggatctgcgcgaacagatcaccctctgcgatgtcggcgacatcttcaccattccggccaacaacgagaagagcttcgatcagatctctaagggcatcgcccacgtgttcgccagcggcgcattcccgatcattctcggcggcgatcactccatcggcttccccacagtgcgcggcgtctgccgccatctgggtgacaagaaagtgggcatcatccacttcgaccgccacgtcgacacccaggagatcgacctggacgagcggatgcacacctgcccctggttccatgccaccaacatggccaatgctccggctgagaacctggtgcagctcggcatcggcggctggcaggtgccgcgcgagggcgtgaaggtctgccacgaacgcggcaccaacgtgctcaccgtcacggacatcaccgaaatggggttggaggcggcagcccagtacgcgatcgaacgggccactgacggcaccgactgcgtttacatctcctttgacatcgactgcatcgatgccggcttcgttcccggcaccggctggcccgaacccggcggtctgctgccgcgcgaagcactcaagctgctcgagctgatcgtgcgcaatgtgccggtgtgcggtctcgaaatcgtggaggtgtcgccgccgtacgacatcagcgacatgacctcactgatggccacccgcgtgatctgcgatgccatggcccacctggtggtcagcggccagctgccccgcaaggacaagccggcctggatcagcgatgtctgcaacatgaacgtcgatcagaagtggaga

SEQ ID NO: 44637 - DNA, 1299 bp, SYNECHOCOCCUS SP. WH 8102
atgaccactgtcccggagccttcagcagagctgttgcagagggccggagctgtccgtctggcggcggtagacctggggcagacggacgaccaacagcgggccgatgcgcttcaggcgatggcggatgccttggcggagcgggctgaggtgatcgttgccgcaaaccgtgaagatctggagcgttccgcggctgaggggctggccccggcactgatggcccggttgaagctggatgccggcaagctccgcggtgccatcgatggggtgcgaaaactggcctctctgcccgatccgcttggcagacggcagctgcatcgagagctggatcaaggcctggtgttggagcgcatctccgttcctcttggcgtggtgggggtgatcttcgaagcccgcccggatgctgtggtgcagattgcctcgctcgccatccgctccggcaatggcgccatgctcaaaggcggcagcgaagcgcgttgcaccaatgaagcggtgatggaggccctcaagctgggcctgggccgcagtgccgtggcaccggatgcgttaacgctgttgaccacccgccaggaaagcctggcgttgctgaggctggatggcctggtggatctgatcatcccccggggcagcaacgagctggtgcgattcattcaggacaacacccgcattcctgtgctgggtcatgcggacggcatctgccatctctacgtggatgcggctgctgacgtggaccaggcggtacgcatcgccatcgacagcaagacccagtacccggccgcctgcaatgcgatcgagaccctgctggtgcatgcctcgattgcaccggcgtttctggcgtctgccgtgccggcctttcaagctgccggtgtcaccctgcggggcgatgaacacagccgccagcacggcatcagtgacgctgccaccgatgaggactggcgaacggaatacctcgacatgatcctggcggtgcgggtggtgccttccatggatgccgcgctcgaacacatccgtcgccatggatcccgccacaccgaagccatcgccaccaccgatgaccaggcggcggaacgattcctgggggctgttgacagtgctggcgtatatctgaactgttccacccgttttgcggatggcttccgttacgggtttggagctgaggtgggcatcagcacccaaaccctgccgccgcgcggaccagtgggactcgatggtttggtgacctatcgctatcggctccggggtgacggacacatcgccgctgatttcgcagacggaacccgcagcttcacccacaccgatctg

SEQ ID NO: 44638 - DNA, 2268 bp, SYNECHOCOCCUS SP. WH 8102
tcgcgcccacttcacagctcttccatgggtggcgcggcagtcctcgactggatggttcaggacggcgaacgtctcgcgaattgtcggcacgatcacccgttagcgatcctcggcccgcaaccaagcgatgcgggctggactgttcgggtgtggatgccggaagcccacagcgtgacgctgctggagggcggtcgggaagcattgatgaccgcacccaatcacccctgggtgtttgaaacaacgctcagccacgaccccggcagcaactacaaggtgcgggtcgagcgcggcggcatcactcacgaacaacacgacccctgggcgttcagggacgaatggatgggcgacatggatcgccatttgtttgcccagggcaatcaccaccacatctggcaacggatgggcgcccacctcacgcagcgtgatggcatctccggggtgatgttctgcctttgggcaccgcatgccctgagcgtgtcgatcctgggtgatctcaactcctgggatggtcgtcaccaccccatgcagcagcgcttgggtgggatctgggaattgtttattccagggcttgctgaaggttctctctacaagtacgaaatccgcacccaggacgggcactgttatcagaaagccgacccctacggcttccaacacgaggttcgcccggacaacagttcagtggtggctcgcctggatggcttccaatggtcggacggctcctggatgcagcgacgcgatagcagcaatccgctggagcagcccatctccgtgtatgagatgcatctcggcagctggatccatgccagcgccgaagaaccctggattcagcccgacggcagcccgcgagctccggtgcccgctgccgacatgaaacccggcgctcggctgctcacctacgccgagttggcggctcgcctgatcccttacgtcaaggaacggggattcacccacatcgaactgatgccgatcaccgagcatccctttgatggctcctggggttatcaagtcaccggctggtacgcccccaccagccgctacggcactccggatgaattccgggcctttgtggatcgctgccacgccgaaggcatcggcgtcatcatcgactgggtgcctggccacttccccaaggatgcccatggcctggccttctttgacggcacacacctctacgaacacggagatccgcgcatcggtgagcacaaagagtggggaacgctgatcttcaactacagccgcaacgaggttcgtaacttcctggttgccaatctggtgttctggttcgaacagttccacatcgacggcattcgcgttgatgcggtggcctcaatgctgtatcgcgactatctgcgtccagatggcgaatggctggctaacgagcatggcggtagagagaacacggaagccgttcaattcctgcagcaggccaaccatgtgctcttccagcacttccccggggcgttgtcgatcgcggaagaatccacaacctggccgatggtgacccaacccacagaaatcggtggcctgggcttcaacctgaaatggaacatgggttggatgcacgacatgctcgattacttcgagctggatccctggttccgtcagttccaccagaacaacatcaccttctcgatctggtacacctacaccgaaaacttcatgctggcgctcagccacgacgaagtggtgcatgggaaaagccatcttctccacaagatgccaggtgacgactggcagaaatacgccaacacccgagcactgctcgcctacatgtggacccatcccggcaagaaaaccatcttcatggggatggaattcggccagcgcgctgaatggaatgtctggggagatctgcaatgggatctgctgaattacgaaccccacaaaggcatccagctgctggtggatgacctcaacacgctgtacaaagctgagccggccctctggcgcgacgacttcgaccagttcggattccagtggattgattgcaatgacaaccgtcattccgtgatcagtttcatgcggcgtgaaagcagcagtggcacctggcttgtggtggtggccaacttcacaccacagagccattcccattaccgggtgggtgttccgctggcgggcttctacgaggagatcttcaacaccgatgcagcccgttacggcggcagcaaccttggcaacatgggcggcaagccaacggatgaatggagcatccacggctacgagaactccctggatctctgcctacctcccctcagtctcctggtgttc

SEQ ID NO: 44639 - DNA, 1029 bp, SYNECHOCOCCUS SP. WH 8102
agcgacactctgcccctgcttctgcgtgcagcccgcggtgaagcggtggagcgtcctccggtctggatgatgcgtcaggctgggcgttacatgaagatctaccgggatctgcgcgacaagtaccccagctttcgcgaacgctccgaaaaccctgatctctcctatgagatctccatgcaaccgtttcacgccttcaagccggacggcgtgatcctgttctccgacatcctcacgccgctgccggggatgggcatcgatttcgacatcatcgaaagcaagggtccgcagatcggtgatccgatccgctccatggatcaggtgaacgccctgcgcccgctgaaccccagcgagtcgatgccatttgttggtgaggtgctgggacgtctacgcgaaagcgtcggcaacgaggccgctgtgcttggttttgtcggcgcaccctggaccttggcggcctacgtcgtggaaggcaagagcagcaagaactacgcggtgatcaaggccatggccttccgcgaaccagagctgctgcacaaactgctcgaccacttcgccgagtcgatcgccaactacctgcgctttcagattgattccggcgctcaggtcgtccagatgttcgactcctgggccggacaactcagtcctgccgattacgacaccttcgccgcgccttatcagaagaaggtggtggatctggtcaagcagacccatcccgatacccccttcatcctgtacatctccggcagtgctggcgtcctcgaacggatggccactacaggggtggacatcatttctctggactggaccgtggacatgggcgaagctctggcccgcttgccggagcacatcggtgtacaaggcaacgttgatccgggtctgctgttcggaacgccggacgcgatcgaggcccgcattgatgactgcgtgcgcaaggcccgcggcaggaagcacatcctcaacctcggccatggaatcctgccggggacgcctgaggaaaacggtgctgctttcttccgctcaggcaagagcgtg

SEQ ID NO: 44640 - DNA, 2588 bp, SYNECHOCOCCUS SP. WH 8102
atgcaacccacagccgaacagttcaccgaacaggcctgggccgccatcgtcgcggcccagcaactcgcccaggcctccaggcaccagcagctggaaaccgaacatctgctgctggcgctgcttcgacagaacggactggccgggcgaatcctcagcaaaaccggcgttgacgtcaccaccttcgaggccagtgttgaaggccatctgcaacggcttcccagccttggctcggcacccgactcggtgtttcttggccgatccctcaacaaggccctcgaccgagccgagcagcggcgggatggattcggcgacagcttcatcgccatcgagcatctgcttctggccctggcggaggatgatcgctgcggccggcaactgctcagccaggccggggtgaccaccaacacactcaaggaggcgatcacggcggtgcgcggcaaccaaacggtgacagaccagaaccctgaggccacctacgaatccctggcgaaatacggccgcgatctcacagcagcggcccgcgatggtcagctggatccggtgatcggacgggatgaagagatccgccgcaccattcagatactcagccgccgcaccaagaacaaccccgtgctgatcggtgaacccggggtcggcaaaacagcaatcgtcgagggcttggcacagcggatcgtcaatggtgatgtgccccaggccctgcagaaccgacagctcattaccctcgacatgggtgccctgatcgccggggcgaaataccggggtgagttcgaagaacggctcaaagcggtgctgaaggaggtcaccacctccgatggacagattgtgctgttcatcgatgagatccacacggtggtgggcgctggcgccagcggtggtgccatggacgccagcaatctgctgaaaccgatgctggcccggggtgaactgcgctgcatcggggccaccacccttgatgagcaccgtcagcacatcgaaaaggatcccgccctggagcgacgctttcagcaggtgctggtggatcagcccacagtgccggacacgatttcaatcctgcggggcctgaaggagcgctacgaggtacaccacggcgtacgcattgccgacagcgctttggtggccgccgccatgctcagcagcagatacatcaccgatcgcttcctgccggacaaggccatcgacctggtggatgaatccgccgcccggctgaaaatggagatcacctccaaaccggagcagatcgacgagatcgatcgcaaaattctgcagctggagatggaaaaactctccctcggccgtgagtccgacagtgccagccaggagcggttgcaacggattgaacgggaattggcggaactgggtgaacaacagagcagcctcaatgcccagtggcagagcgaaaaaggtgccattgatcagctctcggctctcaaggaggagatcgaacgggtgcagctgcaggtggagcaggccaaacgcaattacgacctcaacaaggcagctgaactcgaatacggaactctcgccacgctgcaacgccagctgcaggagcaggaagacctcttggaagacgaggacggaacagacaaaacctgctgcgggaggaggtcaccgaagacgacatcgctgaagtgattgccaagtggaccggcatccccgtggctcgcctggtgcagagcgaaatggagaaactgctgcagctggaggacgacctgcatcaacgggtgatcggacagaaccaggcggtcactgccgttgccgacgcgattcaacgctcaagggcaggcctcagcgatcccaaccggcccatcgcgagctttctgttcctcgggccgacgggtgtcggcaagacggaactgtccaaggcgctggccaatcgcctgttcgacagcgacgacgccatggtgcgcatcgacatgtcggagtacatggagaaacacaccgtgagccgactgatcggtgcccctccgggctatgtgggttatgaagccggcggccagctcacggaagcggtacggcgacggccttacgccgtgatcctgttcgacgaggtggagaaagcccaccccgatgtgttcaatgtgatgctgcagatcctcgatgacggccgcgttaccgacggccagggccgcacggtggatttcaccaacaccgtgttgatcctcaccagcaacatcggcagccaatcgattcttgagctggctggggatccggagcaacacacggcgatggagcaacgggtcaacgaggcgctcaaggccaaattccgtcccgaatttctcaacaggctcgacgatcagatcatcttccgcagccttgaaaaagaggagctgcgccggatcgtgtcactgcaggtggagcgtctgcggtcgcgactggagcaacgcaagctggaccttcagctcagcgacatcgcagccgattggctggccaccattggctttgacccggtttacggagcaagacccctcaaacgcgccatccagcgggagctggaaacaccaatcgccaaagcgatcctggcgggacagctcagtgagggacagacggtgcaggttgatgcaggtgacgacaaactctcaatcagttga

SEQ ID NO: 44641 - DNA, 642 bp, SYNECHOCOCCUS SP. WH 8102
cccctcagccccgccttcatcgaccaactccgttttaacgaagcggggttgatcccagcgatcgcccaggactggctggacggggccgttctgatggtggcctggatgaacagggaatcgatccaacaaaccctgaacagcggcgaggcccattactggagtcgttcacgacaggagctgtggcacaaaggagccaccagtggtcacacccagaccctgcgttccatccgctacgactgcgatgctgatgtgctgctgctgaccatcgaacaacgtggcgacatcgcttgccacaccggtgcccgcagctgcttctacgaaggcggcgatcaacgttccgatgggggctcaaatgccttgtctccccctgcggacgcttgcaccgagctgtttcgcgtgatcgagtctcggcgagacaacccggaggaaggcagctacacaaacaagctgctggaggggggtgacaacaagattctcaagaaaatcggcgaggagagtgctgaattcgtgatggcctgcaaggacgacaatcctgaggagatcgcaggagaagccgccgacatcctcttccacatgcaagtggccttggcgcaccacggcgtgagctggcgtcaggttcaggaggtgctggccgcacgacga

SEQ ID NO: 44642 - DNA, 1807 bp, SYNECHOCOCCUS SP. WH 8102
aggcggtccgcacggcttcagccgctgccggagccgccggatgagcgtcatcagtgattggaaacgagtgcgtcggctgggccgttatctcgttcatgaccgccgccgtctgctgctgaccctggtgctgctcgtgccgttagcggtggcgggagcgattcagcccctgttggtgggccaggccatcagtgtgttgcgcaacgaacccagccttccctggctggagggtctgacgaccggggccgccatccgcctgatcgtgtcgctgctgctcgtgtcggtgctgttgcgtctagcgctgcagggggttcagctgttcaacatccaggctgtgggtcagcgacttaccgcacggatccgggatgatctgtttcgtcatgccctgtcgctgtcgctgcggttccacgacggcatgcctgtgggcaagttgctcacacggctcaccagtgatgtcgatgccttgtcggaggtcttcggcagcggagccgttggtgttcttggcgatctggtgagcctggtggtgatcgccagctcgatgctgctgatcgaatggcggcttggcctgttgctgctttgcacacagatccccgtgaccttgatggtgatctggttgcagggccgttaccgcaaggcgaattaccgagttcgagaggagctctcccagctcaatgctgattttcaggagaacctgcagggcctggaggtggtccagatgtttcggcgcgagcaggtcaacggcgagcgcttccagcgcaccggttccgcttacaggcgcgctgtgaatggaacgattttcttcgacagcagcatctctgccttcctcgaatgggtgtccctcggagctgttgccctggtgttggctcttgggggatggatggtgacatcaggttccatgggccttggaatcctcaccaccttcatcctctattcccagcgtctgtttgatccgctgcgtcagctggcggaacggttcacccagattcagggtggtctgacggccgtggagcgcatcggtgagctgatggagcagcccctggagatcgtggaggatcccaacgccactccgctgcgttcggccggcctgggggaggtgattttcgagaacgtcagcttcagctatcggccggatgagccgatcctgcgcaacctctccttccgcattgctcctggcgagcacgtggccctggtgggaccgacggggtctggaaaaaccaccgtcatccggctgctctgccggctgtatgaacctcagcagggccggattcttctggatggtcgtgacattcgttcgatttcgatcgccgatctgcgacgtcagctgggggtggtgttgcaggacaccttcctgttcagcggcaacgtggccgataaccttcggctcaatgccgagatcagcgatcaggagctggctggaatctgccgtgatctgggcctgaacgacctgttgcaacggctgcctaatgggttggagacagagttgcgggagcgtggcggcaatctctcgtccggtgaacgtcagctgctggcggtggcacgggttgcgatccgtaaccccacggtgctggtgatggacgaggccaccgccttcatggatccctccacagaggccaccctgcaacgcgacctggatcggttgctgcagaaacgcacggctgtggtgatcgcccatcgcctggccacggtggaagcctcggatcggattctggtgctgcgccgcggtgagttgatcgaacagggcacgcacctggagttgcgagcccggggtgggctctacgcccagctggcggagctgcaggaaaaggggttg

SEQ ID NO: 44643 - DNA, 915 bp, SYNECHOCOCCUS SP. WH 8102
ctttcccccctcagcggccgtgactacctttcctccgctgattgttcggcggaggaaacctcagctgtgctcgatctggccgctcaactgaagagcggcgaccgtcgcatcgacctcggcaaccgggtcctggggttgatatttaccaaggcctccacccgcacccgcgtcagcttccaggtggcgatggcccgccttggtgggcaaacggtggatctcaatcccaaagtgacgcagttgggtcgtggtgagcctctggaagacaccgcgcgggtgctcagtcgctattgcgatgtgctggccgtgcgcaccttcgcccagcaggagttggtggattacgcccactgggccactgtgccggtgatcaatgccctcaccgatctcgaacacccctgccagtccctggccgacttcctcacgatgcgcgaggcccatggtgatctgcccggacagacgttggcgtacatcggtgatggcaacaacgtggcccattccctgatgctctgcggtgcgttgttgggggtgaatgtgcgcatcggctgtccgcagggtttcgaacccctgcccggggtgctcgagcaggcccgttctctggctgttcagggagcttcgatcgaggtcatccacgatccgcgtgaagcggtccgtggtgcccaggcggtgtacaccgatgtgtgggcctccatgggtcaggaggacgagcaatcggaacgggaacaggcttttgccggtttctgcgtcgacgaagcgttaatggaggcagctgatacggaggcgatcgttctgcattgcttgccggcccatcgcggtgaggagatcagcccaggagtgatggaaagctccgccagccgcatctttgatcaggctgaaaatcggctacacgctcagcaggcactgctggcggcattgatgggt

SEQ ID NO: 44644 - DNA, 1842 bp, SYNECHOCOCCUS SP. WH 8102
cgaccgaaccgtcgcttcggaatcatcaacctagtgttgatcggcttcggggtgctgctcctgttgagcagcttcgtgccgaataacgcgatgcaacaggtgcccaaggtgccttattcgctgttcctcgatcaggtgaatgatggcgccgtgaagcgcgcctacatcacccaggaacagatccgctacgagctcagcgacccggatgagggcacgccgccggtgctggcgaccacgccgatcttcgacatggatctgccccagcggttggaaaccaagggtgttgagttcgccgctgccccgccgaagaagcccaacatctttaccaccatcctcagctgggtggtgccgccgctgatcttcatcctggtgctgcagttcttcgcccgccgttcgatgggcggcggcgcccaaggggcgttgagcttcaccaagagcaaggccaaggtttatgtgccggacgaggaatcccgcgtcaccttcgctgatgtggcgggcgtcgatgaggccaagcaggaactcaccgaaatcgttgatttcctcaagacccctgagcgctatgccgaaatcggagcgcggattcccaagggtgtgttgcttgtgggccctcctggcaccggcaagaccttgctgtcgaaggccgttgcgggagaagcgggtgtgccctttttcattatctcaggctcggaattcgttgaattgttcgttggtgccggtgccgcccgtgttcgggatctgttcgaagaagccaaaaagaaagccccttgcatcattttcatcgacgagctcgacgccatcggcaagagccgttccggctctatgggcgtggtcggcggcaacgacgagcgggaacagaccctgaaccagctcctcaccgagatggatggcttcaccgctcaggacaaaccggtgatcgtgttggcagccaccaaccagcctgaagtgctggatgctgccctgctgcgcccgggccgctttgaccgccaggtgttggtggatcgcccggatctgtccggccgtaagaccatcctcgagatttacgccaagaaggtgaaacttgctgatgctgtggatctggacagcgtggcgcaggccaccagcggctttgccggcgccgatctggccaacctggtgaacgaagcggccctgctcgctgcccgtgcttacagaaccaaggttgagcaacaggatctgggagaagccatcgagcgggtggtggcgggccttgagaagaagagccgcgtgctgcaggacgacgagaagaaagtggtggcgtaccacgaagtaggtcacgcgatcgtcggtcacttgatgccaggcggaagcaaggtggccaagatctcgatcgtgccccggggcatgagcgccctcggctacacccttcaattgcctactgaagaacggttcctcaattccaaggaggaactgcaagggcagatcgccacgctgctagggggccgctcggctgaggagatcgtgttcggcaagatcaccacgggtgccgccaatgatctgcagcgggccaccgaccttgctgaacaaatggttggcacctatggcatgagcgacaccctgggacctctggcttacgacaaacaggggggcggacgcttcctcggcggcaacaacaacccccgccgttcggtgagtgatgccaccgctcaggcgatcgacaaggaagtgcgtggcctggtggacagagcacacgacgacgccctggcaatcctgcgtcagaacatggccttgctggagaccattgcccagaagatcctcgaaaaagaggtgatcgagggggatgacctcaagcagatgcttgaggccagcgtgctgcccgagaccgtc

SEQ ID NO: 44645 - DNA, 978 bp, SYNECHOCOCCUS SP. WH 8102
ctcaccgatcagctggatgcgctcgagcagcaggccacaaccgaaatctccgaggcctccgatgccgcagccctcgaacaattgcgggtaggtctgctgggcaaaaagggacggatctcgggggtgctctgggccatgggcaagctgccgggcagtgaacgaccgctggtgggtcagcgggccaatgtgctcaaaacccaggtgcagagcctgctggctgagcgtcttgcggcggtgaagcaggcggcgatggcggaacgcatcgcccgcgaaagcattgatgtgacggcgccggcgtcggggatcccgatggggcatcgccaccccttgatcaccaccaccgaggagatcgtcgatctgtttctcggcctcggatacagcgttgccgaagggcccgaggtggagaaggactactacaacttcacggcgctgaacattcccgaggatcatccagcccgggacatgcaggacaccttctacctgcagggtgatctgctgctgcggacccacacctcaccggtgcagatccgccacttggaacagaaccccccaccggtgcgcatcgtcgcccctggacgggtgtatcgacgcgatgccgtcgatgccacccactcgccggtcttccatcaggtggaggtgctggccattgatgagggactcgacttcagccacctgcgcggcacggtgatggccttcctcaaggctttcttcggtgatctgccggtgcgtttccgggccagttacttcccgttcacggagccttcagccgaggtggacgtgcaatggaggggacgatggctggaggtaatgggctgcggcatggttgatcccgctgtgctggaaggtctcggcctcgatcccgagcgctacagcggctttgctgcaggtctcggcgttgaacgcttctgcatggtgcgtcacggcattgatgacatccgccggctttacacaagcgatctgcgcttcctcgaacagttc

SEQ ID NO: 44646 - DNA, 972 bp, SYNECHOCOCCUS SP. WH 8102
gtggaccgggagacgggtctggagctgttccgcgatatgaccctcggccgtcgcttcgaggacaagtgcgcggagatgtactaccgcggcaagatgttcgggttcgttcatctctacaacggtcaggaggccgtgagtacaggggtgatcggcgccatgaagcgccagcacgattggttctgcagcacctatcgagaccacgtgcatgccctgagcgccggtgttccagcgcgggaggtgatgagtgagctgttcggcaaagaaacaggatgcagcaaggggcggggtggttccatgcacctcttctccaaggagcaccacctgctggggggcttcgccttcatcgcagagggcatccccgttgctctggggtcagccttcaccagccgctacaagcgtgatgccctgggggacgcctccagcaacgccgtcacagcagcgttcttcggtgatggcacctgcaacaacggccaattcttcgagtgcatgaacatggcgcagctatggaagctgccgatcctgttcgtggtggaaaacaacaaatgggccatcggcatggcccatgaccgtgccaccagtgatccggagatctggcgcaaagcggcgtcgttcggcatggccggcgaagaggtggacggcatggacgtgctagcggtccgcgccgcagcccaacgagccgtggaacgggcgcgcgccggggaaggtcccaccctgctggagtgcctgacctatcgattccgtggtcactccctggcggaccccgatgaactccgcgctgaacaggagaaacagttctgggcccagcgcgacccgctcaaggctcttgagcgcgacctctgcgaggccaatctggtgagcagcgacgaactgcgaagcatcgagaaagagatcgatgccatcgttcaggattgtgtggagttcgccctctcggcgcctgagcccgatccaacggagctcacccgctacatctgg

SEQ ID NO: 44647 - DNA, 1380 bp, SYNECHOCOCCUS SP. WH 8102
gacttcgacgtcatcgtcatcggcgccggttacggcggcttcgatgccgccaaacatgccgcagaacacggccttaaaaccgccatcattgaatcgcgggacatgggaggcacctgtgtcaatcgcggctgtgtgccgtccaaggcgctgctggcagccagtggcaaggtgcgggaactggccgatgatcagcacctggccagtttcgggatccacgcggcacctgtgcggttcgaacggcagaagatcgctgatcacgccaaccagttggtgcagactattcgcaccaacttgaccaagactctcgagagagcgggcgtcacaatcctgcgggggcatggccgtcttgagggatcccagcgggttggattgcgcgaacccagtggtgtcgaccgggtcctcagcgcaagagatgtgatcgtggcgaccggctccgatccatttgtgccgcctgggatcgaaaccgatggccgcacggtgttcaccagtgacgaagccatcaacctcgagtggctgccgcgctggatcgccattgtcggcagcggctacatcggtctcgagttcgctgacgtctacaccgcccttggttgcgaggtgacgatgatcgaggcgcttgatcgggtgatgcccacctttgaccccgacattgccaagatcgctggacgtcacctgatcgatggccgggatattgacgcccgttcaggtgttctggctagcaaggtgacccctggctgccctgtgcggatcgatctggcggacttcaacagccgtgaactggtggagacgcttgaagtggatgccgtgctggtggccaccggccgtgtgcccagcagcaaaggcttgaacctggagtcgctcaacatcgagaccaaccgcggctttgtgcccatcgacgacagcatgcgggttctggtcaacggtcagccggtgccgcatctctgggccgttggcgacgtcaccggaaagctgatgctggcccacacggctgcggctcagggcaccgttgcggtggacaacatccttggccagaaccgcaccatcgattaccgcagcatccctgctgccaccttcacccatccggagatcagttcggtgggactcacggaggcggaggccaagcagctcgctgaaaccgatggttttcagttggggtctgttcgcagctatttcaaggccaattccaaggcactggcggagcttgaaagcgacggcctgatgaagctgctgttcaacaagagcagtggtgaagtgctgggcgctcatatttatgggctgcatgccgctgatctgattcaggaggtcgccaatgccgtggcccgtcgtcagagcgtgcggcagttgtccacggaggtgcacacccatcccactctcagtgaagtg

SEQ ID NO: 44648 - DNA, 1245 bp, SYNECHOCOCCUS SP. WH 8102
cttgcaattgaagggcaacgtcgtcttcagggtgtgttgaaggtcagcggagcgaagaattcagccctggtgctgatgaccgccagtcttctcactgaagagcttgtggaactgatcaacgttcccaacctcactgatatcgcagggatgggcaggatcctgtcagccctcggcgtccaggttgagcactccggcaacggcgtcgcattgaacgctgggaatctcaccagtcatgagcccccctacgaactggtcaacagcctgcgcgccagtttcttttgcatcggttcactgctgggacgtcttggtcacgcaagggtgcccctgcccgggggttgtcgcatcggggctcgtcctgttgttgaacacatccgaggattgaaagccctgggggcgcacgtcagtgttgaacacggcatcgtttcggcgtgcgtcaaaggcagcaagaagcgactgacaggcgcacccatcgttctggattgcccgagcgttggagctaccgaaacattgctgatggcagcagtgctggccaccggcaccaccacgattgaaaacgccgcccacgaacccgaggttcaggatctggccaacctgctgatccagatgggtgcggacatcagcggcgccggcggaccggtgatcaccatccatggtgtcgagcgtcttgcaggagtgagcaactacccggtcatccccgacaggatcgaagcgggcacttttttgatcgccgcagcaatcacccgatcaccattgcgggtggaaccggtgattcctgagcacctcagtgctgttctgcaaaagctgcgggactgtggctgccagctggagatcgatcagacaggaatctccatcacccccggtgacatccaggcggtcgacatcaccacccaaccgttccctggcttcccgaccgatcttcaggccccgttcatggcgttgatggccaccgcacaggggaccagcgtaatcagcgaaaagatttatgagaacaggcttcagcacgtcgctgaacttcagcgcatgggggcctccatccgcgtggacggcagcaccgccatcgttgaaggtgttgcacagctcagtgcggcgcctgtcacgggcagtgacctgagagccgcagcagccatggtgctggcaggtcttgcggcgaatggcaccaccaaggtgtctggcctcaagcatctctatcgcggctacgacaaggttgaagccaagctgaacgccgttggtgcgcaactcgaacgg

SEQ ID NO: 44649 - DNA, 1182 bp, SYNECHOCOCCUS SP. WH 8102
gtgatgaacacctacaaccgcttccccctcaccttggtgcggggacgtggttgctgggtctgggatgaccaaggccgacgccatctcgatgccgttgcaggcattgccaccgacacccttggccatagcgaccgtgccctgcgccgcagcctcggtcgtcaactccgccgtctccagcacgtttccaacctctatcggattcccgagcaggacgctctggccacctggttggtgcagcacagctgtgctgacagcgtttttttctgcaactccggcgctgaagccaatgaagcggccatcaagctcgctcgaaagcacggccatctgaagcgcggcatcgacaggccgcggattctcaccgcttcagccagcttccatggccgcaccctggcagccgtgagcgccaccggccagccgcgctaccaccagggcttcgaaccgatggttgagggcttcgattacttcccttacaacgacatccatgctttcgagtcgttgctcgaacgccatgaagccaacggaccggcggtggcggccgtgctgcttgaacctctgcagggtgaagggggggttcaccccggcgatgccggcttcttccagcgcctgcgacacctctgcagcgagcgcaacatcctgctgatcctggatgaggtgcaggtgggcatgggccgcagcggtcggctctggggctacgaacagctcggcatcgaaccggacgccttcaccctggccaagggactggggggcggccatgccatcggcgccctgctggtgaacgccaaagcggatgtgttcgagcccggtgatcacgccagcacattcggtggcaacccctttgcctgcaccgctggactgaccgtggcgcaggaaattcagcgcaggggattgctgcgcaatgtggaggaacgtgggcagcagctgcagcagggaatccagggtctcgtcgcgcgttacccccagctgttgcagggagtgcgcggctggggcctgcttcagggcctggtgctgcatcaggactgtggtgtcacagctccacagctggcgaaggccgcgattgagcagcggcttctgctggtggcagctggagcgactgtgctgcggatggtgcctcctctggtgatctccgccaacgaggtgcggcaattgctcagacgactggacgcgaccctcgctgagctggtc

SEQ ID NO: 44650 - DNA, 762 bp, SYNECHOCOCCUS SP. WH 8102
gttgctctccgcttgattccctgcctggatgtcgcccgcggacgggtggtgaagggcgtcaacttcgtcggtctgcgagacgccggtgatcctgtggaactggcctgtcgctacagcggcgccggggcggacgagctggtctttcttgacatcgcggccagccacgaaggccgcggcaccctgatcgacatggtgcatcgcaccgccgaatcggtcacgattcctttcactgtgggtggtgggatctccacggtggagggcatcaccgatctgctgagggccggggccgacaaggtgagcttgaactcctctgcagtgcgacggcctgagttggtgcgtgagggggctgagcgttttggctgtcagtgcatcgttgtggcgatcgatgcccgcaggcgggatggggatggctgggacgtttttgtgaagggtgggcgcgagaacaccggtctggatgcggtggattgggcacgacgggtggcggagctcggtgctggcgaaattctgctgacctccatggacggcgatggcacccaggccggctacgaccttgccctgacccgtgcagtggccgatgcggtcccggtgcccgtgatcgcatccggtggggccggttgcatcgaccacatcgcccaggccctggagacaggaccggacggtggacatgcctccgctgcgctgctggcctccctgttgcatgacggtgttctcacggtcgaggagatcaagcaggatctgctggcgcgaggtctatcgattcgt

SEQ ID NO: 44651 - DNA, 924 bp, SYNECHOCOCCUS SP. WH 8102
gcacgtcagctgctgggcatgaaaggtgcctccggcacctccaacatctggaagctgcggctgcagctgatgaaaccggtcacctggatccccttgatctggggtgtgatctgcggtgctgccgctagtggcaactaccagtggaagctggaccacgtgctcgcggctttcgcatgcatgttgatgagcggccccctgctggcgggcttcacccaaaccatcaacgactattacgaccgcgatatcgacgcgatcaacgagccgtatcggccgattccatccggagccattccgttgggacaggtgaagcttcagatctggctgctgctgatcgctggcttggcggtgtcctacggcctcgacatctgggccaaccacagcactccggtggtgttcctgctggccctcggagggtctttcgtcagttacatctattcagctccaccgctgaagctgaagcagaacggttggcttgggaattacgcccttggtgccagctacatcgctctgccttggtgggcaggccaggccctgttcggccaactgacctggagcacggctctgctgacccttgcctacagcctcgccggactgggcattgccgtagtgaatgatttcaagagcgttgagggggaccgggaactggggcttcagtccttacccgttgtgttcgggatcaaaacggccagttggatcagcgctgggatgatcgacatcttccagttggccatggttgccgttctcattgccatcggtcagcatttcgctgctgttctgctggtgctgttgatcgtgccccagatcaccttccaggacatctggctgctgcgggacccagttgaatttgacgtcaaataccaagccagcgctcaaccctttctcgtgctcggcatgctggtgacggcgctggccgtgggccacagc

SEQ ID NO: 44652 - DNA, 1221 bp, SYNECHOCOCCUS SP. WH 8102
ccaaccctgctgaaggaaagcggaccgcgggaggtgttctgcggtctcacctcgattgtgtggctgcaccggcgcatgccggatgccttttttcttgttgtcggatcacggacctgcgcacacctgatccagagcgccgccggcgtgatgatctttgccgaaccccgttttggcaccgccattctcagcgagcgggatctggcgggcttggcggacgcccatgaggaactggaccgtgtggcccgggaactgctgcagcggcgaccagagatccgcaccctgtttttggtggggtcctgccccagtgaggtgatcaagctggacctcgccagggcggcagagcggctcaacgacgaactgcagggccgtgtgcgggtggtgaattactccggcagcggcatcgaaaccaccttcacccaaggcgaggatggagcgctagcggcactggtgccgctgctgcccagcagcgctgaacggcagctgctgttggtgggcaccctcgccgacgctgtggaggatcgcctgatccacttgttcggacgcctggggatcgacagggtccgcagcctgccgccgcgccagtcgaccgcgttgccaccggttggccccggaaccaccgtgctgctaacccagccgttcctcaccgacacggcccgcctgctgcgcaaccgcggcgccacggtgctcaccgcccccttcccgctgggagctgagggcagtcgacgctggatggaggcggccgcccaagccttcgaggtggcacccagccacgtggcaactgtgctggatcccctgatggagcgggcgcgcattgccctggaaccccatcgggaggtgctggcaggcaagcgcatcttcctgttgcccgaatcacagctggagcttcccctggcccgttttctgcagcgggaatgcggcatggagctggtggaagtgggcacgccctacctgaaccgcgaacagatggccgaggagctggccctgctgcctgagggcacccccgtcatggagggacagcacgtggagctgcagctcgaccgggtgcgtgacagcgctccggatctggtggtctgcggcatggggctggccaatccgctggaggccgagggcatcgccaccaagtggtcgatcgagctggtgttcagcccgattcacggcatcgaccaggccggagacctggcggaactcttctccaggccattgcggcgccgccaactgatt

SEQ ID NO: 44653 - DNA, 1572 bp, SYNECHOCOCCUS SP. WH 8102
atggatctcacgctttggacctacgaaggaccaccccatgtgggggctatgcgcatcgccgcttccatgcaaggggtgcactatgtgttgcatgcaccgcagggcgacacctacgccgacctgctattcacgatgatcgagcggcgcggccagcgccctccggtgacttacaccacctttcaagcccgggacctggggggcgacacggccgagctggtgaagcgccatgtgcgggaagcggtggaccgcttccaacccgatgcactgctggtgggggaaagctgcacggctgaactgatccaggaccaacccggtgccttggcgcagggcatggggctgaccatgccggtagtgagccttgaattgccggcttacagcaaaaaggagaactggggcgccgcagaaactctctatcagttggtgcggggtctgctgaaacaacaggtgccggctgagccgaagcatgatcccaagcgctggcaacaacaggggcgtcgaccacgggtgaatctgctaggtccttccttactcgggttccgctgccgcgatgacgtgctggaggtgcagacgctgctcacgatgcacggcatcgatgtggcggtcgtcgcccccctgggagctggcgtagaggacgtgcaccgtctgccggaggccgacctgaacatctgcctctacccggaggtggctgaatccacctgcctctggctggaacgcaacttcggcatgcccttcagccgcacggtgccgatcggtgtcggcgccacccacgacttcctggttgaagtgcacaccgctctgggactggaaccaccctcgccgcaggagggttatcgccgctcacgcctgccttggtattccgaatccgttgactccacttacctcaccggcaagcgggtgttcatctttggcgatggcagccatgccatcgccgccgcccgcatctgcagtgaggaactgggctttcaggtggtggggctgggcacctacagccgcgagatggctcggccggtgagggccgctgcgaagggcctggggctggaggccctgatctgcgacgactatctagcggtggaggcggccatggccgaagcggcacctgaactggtgctgggcacccagatggaacgccacagcgccaaacggctggggattccctgcgcggtgatcagcacgccgatgcatgttcaggacgtgccagcccggatgagcccgcagatgggctgggaaggggcgaatgtgatcttcgacagctgggtgcacccgctgatgatgggtctggaggagcacctgatcggcatgttccgccacgatttcgaattcgtggacggtcatcagagccatctgggccatgccggtggatccggagcgtcccaggagagcgcgttaagcgacgttcccgaggctgacgagggctacgtggtgtggaccgctgatggcgaggcggaactgaagaagatcccctttttcgtgcgcgggaaagtccgccgcaatgccgaggcctatgcccgacaagtgggctgccgggaaatcagcagcgagacgctttatgacgccaaagcccacttcaaggca

SEQ ID NO: 44654 - DNA, 933 bp, SYNECHOCOCCUS SP. WH 8102
accgttctgatcaccggcaccacgtcaggtgtgggcctcaatgccacctgtgctctagtgaagcggggctggacggtgatcaccgccaaccgcagcccccagcgggccgcggcggcggctgacgacatggacctgcccaaggagcggcttcagcatgtgttgatggatctgggtgatctcgacagcgtgcggcgtgcggttgatgccttgccggatcgattggatgccgtggtttgcaatgccgcggtgtacaaaccaaagctgaagcagccggagcgttcgccccagggctacgaaatctcgatggccaccaaccacctcggccatttcctgttggtgcagctgctgttggggcgcctccagaactccagccacccctccaggcgggtggtaatcctgggcacggtgacagcgaattccaaggaacttgggggcaagattcccatcccggcgccggcggatctgggggatctctctggttttgaggccggtttcaaataccccgttgccatggccagcggcaagccgttcaagcccggcaaggcctacaaagacagcaagctctgcaacatgatctccacccaggagctgcaccgccgcctgcacggagagtcggggatcaccttcacctcgctctacccgggctgtgtggccgacacgccgttgttccgcaacactcccaaggcgttccagacgatttttccctggttccagaagaacatcaccggcggttacgtctcccaggccttagctggagaacgggtggcggatgtggtggcccatccagacttcgccgaatccggcgtccattggagctggggcaaccgccagaagaaggatggccagcagttcagccaggagctgtcggacaaggccaccgacccggacaccgctcgacgggtctgggacctgtcgatgcagctggtcggcctc

SEQ ID NO: 44655 - DNA, 702 bp, SYNECHOCOCCUS SP. WH 8102
ccaacggctctgattacgggtgcaagtcgtggcattggccgccgaactgctgaactgttagcccgcaagggttgggatctcaagattgttgcccgcagtggcgatcaacttgagcaattggcggctgaattgctgccgatgggtattcaggtggatgtccgctccattgacctgaccgatccccacgccattcagccagcgctgacaggccttctggagcagggctctcctcctgcggtgttgatcaacaacgcaggtgctgcttataagggagatttgctggccatgccgttggagcgttggcagtggttgatgcagctgaatgtcaccagcgtcatgcaggtttgtgcggccgtggttcctgccatgcgcgctactggaggtttggtaatcaacgtcaacagccacgccgctcgcaatgccttcccgcaatggggggcgtattgcgtcagcaaagcggctctggccagcttcacccgttgtctggcggaagaggagcgagcccatggaatccgcgcctgcaccctcaccctcggtgccgttaacacccccctgtgggacacggaaaccgtacaaagcgatttcgatcgtcgtgccatgctctccgtcgaccaggcagcggaggctttggtgaacctggccgaacaacccgtcaaccaggtgatcgaagatttaaccctcatgccggctgccggcgccttc

SEQ ID NO: 44656 - DNA, 1173 bp, SYNECHOCOCCUS SP. WH 8102
atgtcccgcgtcggcgtcgtcctgctgaatctggggggacccgaacgcattcaggatgtcggaccgtttctctacaacctgtttgctgatccggagatcatccggctaccgagcccagcgctgcaaaagcccctggcctggttgatcagcacccttcgcagcggtaaatcccaggaggcctatcgctccatcggcggcggatcaccactgcgccgcatcaccgaacagcaggcccgggaactgcagagtctgctgcggcagcgtggactagatgccaccacctacgtcgcgatgcggtactggcatccattcacggagtccgccgtggctgatatgaaggcggatggcatggatgaagtggtggtgctgccgctctatccccacttctccatcagcaccagcggttccagcttcagggaactacagcggctacgtcagggcgatgcagccttcgaacagcttccgatccgctgcatccgcagttggtttgaccaccccggctacatcaaggcgatggctgagctgatcgccgaagaggtgcgcaatagcgacgacccggaaaaggctcatgtctttttcagtgcccatggcgtgcccaagagctacgtggaggaagccggcgatccatatcagcagcagatcgaggcctgcaccgatctgatcatgaaatccctggcggaacacatgggccattccaacccccacaccctcgcgtatcagagccgagtgggtcctgtggaatggctgaagccctacaccgaggaggcgctcgagcaactgggggaggccaagaccaacgatctagtggtggtgcccatcagctttgtcagcgagcacatcgaaaccctcgaggagatcgacatcgaataccgggagctggccaccgaagccggtgtggtcaatttccgcagggtgcgtgcccttgatacctaccctcccttcatcgaggggttggcggatctggtgaccaccagcctggaggggcctgaagtgagcctcgacgcagcggcagaactgcccaccaaagtgaagctctacccccaggaaaagtgggaatggggttggaataacagttccgaggtctggaacggacgcctggccatgctcggtttttccgcgtttctgttggagctgatcagtggccatggcccgctgcacgccctcggtttgctc

SEQ ID NO: 44657 - DNA, 1086 bp, SYNECHOCOCCUS SP. WH 8102
gacacattgatcgtcggatcaggggccgccggtggagccgcagcagcccacctggcggcagctgggcacaacgtgctggtactagaacgcgatgccaagccgcggatcaaaccctgtggtggcggcatggccgcatcagtgcagcaatggtttcccttctcgctcgagccggcggtggagcaggtcatcgggcgcgtggatttcagctggtgtctggaggatccggtggtggccaacctgccgggggatgcgccgttttggatcgtgcggcgcgaaaagctcgatcaactcttggtggatcaggccattggggcaggcgcggaacggctcacaggcgttgaagtcgtcgatatctgccgcagcagagatgtgtgggaagtaacggcaagcgatggtcgccgttggcaagccaaggcagtggtgattgccgatgggtcgaattcgccttggccccaacggctcggccttggagccaagcatccacagttggcaaccaccatgtcggtacgactggagggtcagggcaatgtggccgatggaagtacccgctttgaattcggactggtgaagcagggctttgcctgggcgtttccgatcgccgatggagtgaacatcggtgtcggcagcttcatcggcaaacaagacgctgacccagatcaagttttggctcagctcttaccagatctaggcttccctgccgatgccggtatccgtcagcggggcaagctgcgcgtttggagtggccatcatcgcctcgatggcaacggcattgtggtcgtcggcgatgcagcgtcgctttgcgatccatttttggcagaaggattacgtcccgccctgatgagtggctgcgaggctgctcggcatctgaaccaatggctcaagggcgacagtaaggatctgcagggctacagccgcacgatgcgaaagcgctggggggagtcgatggcttggggccggcgtatttcgcaggttttttacagattcccaggagtgggctatcagcttggaatcaagcggcccaccgcgccacggcgcattgcccagatcctgtcgggagagctgggctacggcgacatcgcccagcgg

SEQ ID NO: 44658 - DNA, 1158 bp, SYNECHOCOCCUS SP. WH 8102
ctgctcgaccagctctctgcgatgaccgtcgtggtggcggataccggtgatctcgaggcaatccgtaagttcacgccgcgtgacgccacgaccaacccgtcgttgatcctggcggctgcacaaatacctgcttatcaaagtttgattgatgaggcgctgcgttcctcacgcaagctcatcggtgatgcagctcctgttgaagacgtagtgcatgaagccctggacgaaatcagtgtgattttcggtaaggaaatcctcaagattgttccccgtcgtgtgtctactgaagtcgatgcacgcttgagctacgacaccgatgcgacgatcgagaaaggtcgcaagctgatacgcctttacaacgatgctggcatcagcaatgaccgcgttctgatcaagatcgcgtctacctgggagggcatcaaggcggccgaagtgctggagaaggagggaatccactgcaacctcacccttttgttcggtttcggtcaggccgtggcctgtgctgaagctggcgtgaccttggtttctcccttcgtgggacgtatcctcgattggtataaagctgacaccggtcgtgattcctatccaggcccagaagatcccggcgtgatctcagtgacccggatcttcaactactacaagacatacggctacaaaactgaagtcatgggagccagcttccgcaacctcgatgagatcacggaactggctggctgtgatttgctgaccatctcacccaagttgttggatcagcttcgcgagagcgatgcatccttaagccagaagttggatgcgactaatcccagcggcggtgaagaacaaatccatgtggatcgcgaacgcttcgacgcgatgatggcggcggatcgcatggcgacggacaagctcggcgaagggattaaaggcttcagcaaagccatcgaaacccttgagcatcaactggcgcatcgccttgctgaactcgaagggggtgaagccttccgtcatgcggttcaagagattttcatgcttaatgacatgaatggtgatggctgcatcacccgtgatgagtggctggggagtgatgccgtcttcgatgcccttgatctcgaccatgacgggcgtctgacccctgaagaggtgcgtaagggtttcggtgcagcactgaccctgaccacg

SEQ ID NO: 44659 - DNA, 1227 bp, SYNECHOCOCCUS SP. WH 8102
gtggtcgttcgctaccagggtggtgtgaatgcaggccacacgatcgtcgtggacgaccgtgtgctgaagctgcatctgatcccttccggaatcctttatccggaaacgatctgcctgatcgggtccggcacggtcgtagatcccaaggtgatgctcggtgagctggacatgctcatcgccaacgacatcgatatctctggcctgcagttggcctccacggcccacgtgaccatgccgtaccaccgcctgctggatctggcgatggagaagcagcgcggcgaccggcggatcggcaccaccggccgcggcatcggacccacctacgccgataaatcccagcgcagcggcatccgtgtgatcgacttgctggatgaagcacggctgagggaacgtcttgagggaccccttcaggaaaaaaaccaactgctggagacgatctacggcgtcgagcccctcgatgcggagaccgtgatcaaggagtacctgggctacggcaagcgcctggccccccacgtggtggagtgcacccaggccatccaccaggcggcaagagcccgcaagaacatcctgttcgaaggcgcccagggcaccctgctggatctcgatcacggcacctatccctacgtcacctcctccaatccggtgtccggtggggcctgcatcggtgccggcgtgggaccgacgttgatcgaccgggtgatcggcgtggccaaggcttacaccacccgtgtcggcgaaggccccttcccgacggagctcagtggccgactgaacgaccagctcaccgagcgtggcggcgaattcggcaccaccaccggccgtcggcgtcgctgcggttggttcgacggggtgatcggccgttatgcggttcaggtgaacggcctcgactgcctcgcggtgaccaagctcgatgtgctggatgagctggatgccatccaggtgtgcgtggcctacgaactggatggggaacgcatcgaacatttccccagcagcgccgaggacttcgcccgctgcaacccgcttttcgagacccttcccggctggcagtgctccaccgaggactgccgcaagctcgaggatctgccggacgctgccatggcctacctgcgcttcctcgctgatctgatggaggtgccgatcgcgattgtctccctgggtgccagccgggatcagaccatcgttgtggaagatccgatccacggccccaaacgggctctgctcagcgcc

SEQ ID NO: 44660 - DNA, 930 bp, SYNECHOCOCCUS SP. WH 8102
gatgtggtgggcatcggcaacgcaatcgtggacgttctggttcagaccgatgacgcctttctggcgcaacacggactccagaagggcgggatggcgctgatcgatgaacagcaggcggagaccctgtacaccgccagtgggccaggtctggaaacctccggaggttccgtggccaacaccatggtgggaattgcccagctggggggacgggccggcttcatcggacgggtgcgagatgaccagctcggtggcatcttcagccacgacatccgcgccgtcggtgcccgcttcgacacacctgctgccacaacgggagccaccacagcccgctgcctgatctacgtcaccccggatgcggaacgcacgatgtgcacgttccttggcgcctccacccagctggagccagaagacctggacctctcgatggtgcgtgacaccaaggtgctgtacctcgagggctacctctgggacagtccggcggccaagcgggcctttattgccgcggcggacgtttgccgtgaggccggcggtcaagtcgccctttcactgtccgacggcttctgcgtggaccggcaccgcgagagctttctcgaacttgtgaacggtcatgtggatgtgctgttcgccaacgaggtggagatcaaatccctctacgaaaccgacgacttcgacaccgctctgaagaaggtaggcggctgctgctcggtgatcgccgtcacccgtggtggggagggatccgtggtgctcagcggtgatcaacgctgggacattggcattttcggcctgggcgagctggtcgacaccaccggggccggagacctctacgccggcggttttctgcacggctacacccagggagaatccctgggacgctgtggtcaactgggggccctctgtgccgggcagatcgtcacccagctgggggctcgt

SEQ ID NO: 44661 - DNA, 849 bp, SYNECHOCOCCUS SP. WH 8102
gccctgagggtgtcggtactcagtgaagcgctgccgtacatccagagattctctgggcgccgcatcgtgatcaagtacggcggtgccgccatggcccatgccgagctgcgcgaggcggtgttccgtgatctcgccctgctggcttgtgttggggtgcagccggtggtggttcatggcggagggccggaaatcaaccaatggctcaaacgcttagagatccctgccgaattccgcgacggcctgcgggtcaccgatgccgacacgatggatgtggtggagatggtgctggtcgggcgggtcaacaagcagatcgtcaacggactcaatcaactcggaacgcgggccgttggtctgagtggcagcgacggcagcctggtggaggcacgcccctggggcgacggcagccatggactggttggagatgttgcccgggtcaacccggatgtgctggagccgctgctggaacgtggttatgtgccagtgatctccagcgttgccgccaccccgggtgacggccgcgcccacaacatcaacgctgacaccgtggccggcgagctggcggcagccctcgaggccgagaagttgatcctgctgaccgatacccccggaattctcagggatcgggacaatcccaactcgctgattcgcaaactgcgtctctcagaggcgcgtcaactcatcgatgatggtgttgtggccggtgggatgacccctaagaccgaatgctgcatccgggccctggcgcaaggcgtttcagcggctcacatcgttgatggacgggtgccccatgctctgctgctggaagtgttcaccgatgctggcatcggcaccatggtggtgggacgcggc

SEQ ID NO: 44662 - DNA, 948 bp, SYNECHOCOCCUS SP. WH 8102
ttagcactctccatggctctcaccgaactgcgcatcgcctcacgtcgcagtcagctggcgatggtgcagaccaactgggtgaaggcggaattggagaaggcccaccctggactcaccatcacggtggaggcgatggccacgcagggggacaagatcctggatgtggccctggccaagattggcgacaagggcttattcaccaaggaactggaagcgcagatgctggtgggacgcgcggagatcgccgtccattctctgaaggatctgcccaccaacctgcctgaaggcctgatgctgggctgcatcactgaacgggaagatccagctgatgctctggtggtgaatgcgaaaaatgccaaccacaaactcgacaccctgccggagggtgccgtggtgggcaccagctccctgcgccggctggcccagctgcggcatcactacccacatctgagcttcaaggacgttcgcggcaacgtgatcacgcgcctggagaagctcgactcaggcgattacgactgcttgatcctggcggcagcaggcttggagcgcctgggattcggcaaccggatccaccagatcatcccgggtgacatctctcttcatgccgttggccagggcgccctcggcatcgaatgcgtggaagacaagccagaggttctggaaatcatcaaggtgctggagcacaccaccacctcacgccgctgtctggcggaacgcgccttcctgcgagagctggaggggggctgccaggtgccgatcggtgtcaacagccagatcaacaatgaagaactcaccctcacgggcatggtggccagcctggatggcaagcgcctgatccgcgatgaggccagtggttccgctgctgaccccgagtccattggcatcgagctggctggcaaactcaagcaccagggtgcgggagccatcctcaaggaaatctttgatgag

SEQ ID NO: 44663 - DNA, 783 bp, SYNECHOCOCCUS SP. WH 8102
attgccacctggaacgtcaattcagtgcgcacccgccttgagcaagtgttgtgctggcttgagcaaaccaagccagatctgctctgcctgcaggagaccaaggtcgacgatcctctgtttcctatgcaggccttcgagaacgctgggtggcaggtcagcatccatggccagaagtcgtacaacggagtggcgttggtcagccgcgagcccctcgaagatgtccgctgcggtttcgttggtgagctccctgacgatgccgaagccgcaaccctgggggaacagaggcgcgtgatcagtggcctgctggatggggtgcgggtgctgaatctctacgtaccgaatggttcgagcttgtcttcagaaaaatatccctacaagttgacctggcttggatgcctgaagcgctacttggacgcccaggccgaacgaggggaaccgctgtgcatggtgggggacttcaacatcgccctcgaggcaagggacatccacgaccccgatcgcctcagcggctcggtcatggcgagcgatgcggaacgggatgccttgcgcgaagccctggggaaccgcctccaagacgccttcagaatgttcgagcccgacgccggccactggagctggtgggactaccgcaccggggcctgggatcgagatcgtggctggcgcatcgatcacatctacctctgtgaggagctgatggggctcgcccgcagctgcagcatccacaaacagctgcgtggcaacgttcaacccagtgatcatgcgccagtaagcgttgatctggac

SEQ ID NO: 44664 - DNA, 1377 bp, SYNECHOCOCCUS SP. WH 8102
ctccgccgttctttaccccagcgtgctgtggtgacgaaacgtcaggaactgctgagttacgactgtgacggcctgaccatggatcgtcatgcaccgcccttggcggtgctgcccgaggacaccgggcaggtggcggcggtgctgcgctgctgccatgcccacgggattccttttgtggctcggggcagcggcacgggcctttccggcggggcccttgttgaccagcaggcgttgctggtgatcaccagtcgcatgcgcaaggtgttggaggtcgacctggacaatcagcggctcacggtgcaacccggcgtcatcaacagctgggtgacccgcgctgtggcaggcgatgggttttattacgccccggatccctccagccaggtggtctgcagcatcggcggcaatgtggctgagagctccggtggggtccattgcctcaagtacggcgtcaccagcaaccacgtgcttggccttgaggtagtgcttccggatggcacggtgacccagctcggcaacggtctggcggagtccccggagctggatctgcgcggagctttcatcggcagtgaaggcactctcggcatcgcgacggccatcaccctgcgtctgttgagagctccggagtgcgtgaatgtgcttctggctgatttcgcaacgatggccgcggccggtgaagccgtgcgttctattactgccgctggtctgttgcccgcaggcatggaaatcatggacaatgtcacgatcaatgccgttgatgatttctttgggtacgacgagtacccaagggacgcagctgccgttctgctgatcgagctcgatggtcaggcagcggaggtgcaggagtccgctgagcaggccgagttgctctgccgtcaggccggggccagggggctccgccgggctgaggatccaggcgaatgtgcagtgttgtggaagggccgcaagtccgctttttctgcagtgggcaagatcacacccacgtattacgtgcaggacggggttgttccccgcagcacactgcccgcggtgctggcggagattgagcggctcagccaggagcacggtctgccggtggccaatgtcttccacgccggtgacggcaatctgcatccgctgattctttactcagctgccgatcccgaggcggaacgaaaagtcaaggaacttggtgcggcgattctgagggtctgcctcgatgcaggcggcagcatcagcggtgagcatggtgtcggtgccgacaagcgctgctatctcgactggatgttcggtcccgatgacctcgacaccatgtcgctgttgcgtcaggccttcgaccctgagcagcgggcgaaccccggcaaggtgctcccaaccccgcgcacctgtggtgaatcagcc

SEQ ID NO: 44665 - DNA, 1278 bp, SYNECHOCOCCUS SP. WH 8102
gtgacagcacccgcgttgaacaccagccgctcccaggccatcttcggcgcagcgcaggggctgatgcccggtggcgtgagctcccctgtacgggcgttcaagtcggttggcggccagccgatcgtgttcgaccgggtgaagggtccctacgcctgggatgtcgacggcaataaatacatcgactacatcggcagctggggcccggccatctgcggccatgcccatcccgaggtgatcagcgccctgcaagaggcgatcgaaaagggcaccagcttcggcgccccctgcgctctcgagaacactctggccgagatggtgatcgacgccgtccccagtgtggagatggtgcgcttcgtcaacagcggcaccgaggcttgcatggcagtgctgcgcctgatgcgagccttcaccggtcgcgacaaggtgatcaagttcgagggctgttatcacggccatgcggatatgttcttggtgaaggcaggctccggggtggccaccctcggcctcccggattctcctggcgttccgcggagcaccaccgccaacacgctcacggcgccttacaacgatctggaggccgtcaaagcgctgttcgccgagaaccctgatgccattgccggcgtgattctcgaacccatcgtcggcaacgccggattcatacagcctgagcctgggttcttggaaggcctgcgggaactcaccaaggaacatggcgcgctgctggtgttcgatgaggtgatgacgggcttccgcatcagttatggcggcgcccaggcccacttcggcgtcacgccggatctcaccacgatgggcaaggtgatcggtggcggcctgcccgtgggtgcctacggcggccgcgccgacatcatgggcatggtggctccagcagggccgatgtatcaggccggcacactcagcggtaacccactggcgatgaccgctggcatcaaaacgctggaactgctgaaacagcccggcagttacgagaaactcaccgcgacgaccgaaaaactgatcgcgggcatcaaggaggcggctacagcggctggacttcccttcacgggtggcagtgtcagcgccatgttcggatttttcctatgtgaaggccctgttcgcaacttcgaagacgccaaagccaccgattccgaacggtttggcaaactgcatcgcgccatgctcgagcggggcgtgtatctggccccatcggcctttgaggcgggattcacctccctggcccactccgaagcagacattgaggccaccgttaatgctttccgc

SEQ ID NO: 44666 - DNA, 1428 bp, SYNECHOCOCCUS SP. WH 8102
gtgcgcgttcgtctggctcccagccccacgggcacgcttcacatcggtactgcgcggacagccgtcttcaattggttgtatgcacggcgccagcaggggtcgttcctgctgagaatcgaagacaccgataaagaacgatccaagcctgaatacacccaaaacattctggagggtttgcgctggcttgggatcgactgggatgaagagccgttgatccagagcgaacaggtgcagcagcaccgggccgcgatcgaaacgctcttgcagaagggtctggcctaccgctgctatgccaacgaggctgaactggacgccatgcgcgaggcccaaaaggccagcaaccaggcgccgcgttacgacaaccgtcaccgcaatctcaccccagaacaggaagcggccttccagtcggaaggacgggaagccgtgatccgtttccggatcgatgacaacgctgagatccgctggaacgacatggtgcgtggcgccatgtcctggcgtggtgcagacctcggcggtgacatggtcgtggcccgcagggctcccgccgatcagatcggagatcccctctacaacctcgtggtggtggtggatgacgccgccatggccatcagccacgtgatccgcggcgaagaccacatcgccaacaccgccaagcaactgctgctctacgaggccctcgacctgccggcaccgaccttcgcccatgcccccctgatcctgaatgccgaaggccgcaagctctctaaacgggatggtgtgacctcaatcaatgacttccgcacgatggggtacaccgcagaagcaatcgctaactacatgaccctgctgggctggtcggtgcccgaagggatggaggagcgcttcaccctgcctgaagcggcagcggtgttcagcttcgatcgggtgaacaaggccggcgctcgctttgattgggacaaactcaactggctcaacgggcaggtgctgcacgccctgccagcgcagcagctcctggatgaccttcgtccgctctgggccgagcaaggttggacgctaccggacgacagcagctgggggctggagctttgcgagttgctaggaccatccctgaccctgctcaaggaaggcgtggagcaggcgacgccattttttaaatgtcctgatcttgaagacgatggtgtgcgccagctggaagctgacggagctcggaccgctgtagctcaactgctgcagatcctcgaggccgagccctgggatggcaaggacaccgatcgcgccaaacagcttctggcggatgccgccaagggggccggcgtcaagaagggcgtggtgatgaaatctcttcgcgcagcactgctcggacggctgcagggtcctgatctgatcaccacctggtgtctattggcccggatcggggaggacctccccaggttgcagcgttgcctcgcc

SEQ ID NO: 44667 - DNA, 732 bp, SYNECHOCOCCUS SP. WH 8102
tccctcgacggtcagaccgcattggtgacaggaggcggacgtggcatcggcaaagccatcgccctggccctcgccgaagccggtgctgaggtggtggtgaactacgccaattccgctggcgccgccgacgaggtggtggccagcatcaacgctgccggtgggaaggcctacgccctgaaggccaacgtctccatcgaagaggaggtggacggactgatcaaggcagtgctggagcgcagcggccgcctggacgttctggtgaacaacgccggcatcaccagagacggcttgctgatgcggatgaagaccagcgactggcaagcggtgatcgacctgaacctcagcggagtgtttttgtgcagccgcgctgtcgcacggccgatgttgaagcagaaaagcggccgcatcatcaacatcacctccgtggtggggctgatggggaatgccggtcaggccaattacgccgctgccaaggccggtgtgatcggcctgaccaaaagcaccgccaaggaactggccagccggggcatcaccgttaatgccgtcgcccctggcttcatcgccacggacatgaccaaggatctggacgccgacgccatcctcaaagacattcccctgggccagttcggcacccaggaacaagtggccggagccgtgcgctttcttgcggcggatccagctgctgcctacatcaccggtcaggtgctgcaggtggatggcggcatggtgatg

SEQ ID NO: 44668 - DNA, 1332 bp, SYNECHOCOCCUS SP. WH 8102
ggcgacggcacaaccacggccacggtgctggcccaggcgatggtgagggaaggtctgcgcaacacagctgcaggcgccagcccggtggagctacgccgtggcatggaaaaagctgtcgcacaggtggtggatggcctccagcagcgcagtcagcccgtagcgggagatgccatccgtcaggtggccaccgtcagttccggtggtgacgacgaagtgggtcggatgattgccgaagccatggatcgcgtcagcgcagatggggtgatcaccgttgaggaatccaaatccctggccacggagcttgaggtcactgaaggcatggccttcgatcgcggctacagctctccctatttcgtaactgacgccgatcgtcagatctgtgagttcgaaaatccgctgatcctgctcaccgatcgcaagatcagcgccattgctgatctggttcccgtgcttgaggcggttcagaagagtggttctcctttgcttgtcctggccgaggaagtggatggtgaagccctggcgaccctcgtggtgaatcgcaaccgcggcgtgctgcaggtggcggccgtccgtgccccatccttcggcgaacgtcgcaaagcggccctggccgacatcgccatcctcaccggtggaacactgatcagcgaagacagggccttgaccctggacaaggtccagctgtctgacctcggcaaggcccgtcgcgtcaccattagtaaggagaacaccacgatcgtggccacggatgatcaccgtgccgccgtcgcagaccgcgtcgcagcgatcaagcgggaactcgatgccaccgactccgactatgaccgcgaaaagctgaacgagcgcatcgccaaactcgccggcggcgttgctgttatcaaggtcggtgccccaacggaaacggaactcaagaaccgcaagctgcggattgaggatgccctgaacgccacgcgtgcagcgatcgaagaaggcattgttcccggtggtggaacaacactcctgcaactggccgatgggttgaacggccttgtcgagcagctggagggcgatcagcgcaccggggttgagatcctgcagcgtgccctggtggcaccggtgcatcacatcgccacaaatgccggacacaatggcgacgtggtgatcgaagccatgcgcaacagcggtcaggggttcaatgccctcacgggcacctacgaggatctgatggccgccggcattgtcgatgccgccaaggtggtgcgtctcgccgttcaggatgctgtttcgatcgcctcgctgctgatcaccacggaagtggtgatcgccgataagcctgagccagaggctccccct

SEQ ID NO: 44669 - DNA, 942 bp, SYNECHOCOCCUS SP. WH 8102
attgaacttcggcacctgcacaaggcttacggctctgttgtggcgcttgaggacctcaaccttgaggtgcctgaggcctgtctgtatggccttctggggccgaatggcgcagggaaaacatcaacacttcgcatcctggccacgctgctggaacccgatgcggggtctgtccaggtggctggtattgatgctctgaagcatcccagagctgtgcgacggcatctcggctacgtggctcaggaggtggctatcgacaaaatcctcaccgggcgtgaacttctccagctgcagggtgatctttatcacctgcaacgcgccgatcgtgatcagcggatggctgatctgatcgagctgttggccatgggggattgggtggaccgacgctgcggcacctattccggaggaatgcggcgccgcctggatctggcggcgggtctgctgcatcggccacgccttctggtgctggatgagcccaccgtgggcctggatatcgagagccgatcggccatctgggatctgctacgccggctggtcagtcagggcaccagcgtgttgctcagcagccactacctcgaggaggtcgaagcccttgcggatcgaatggcgatcatcgattccggacgggtgatcgcagaaggcaccccggatgggttgaaacagcagcttgggggcgatcgcgtgacgctgcgggtgcgggagttcagtgatgccgcagaagcggaccgtgtgagcgcactgctgcggcccctggacggggtccgtcaggtggtggtgaaccgtgctcaggggttttcgctcaacctggtgatcgatggggaagctgtgatcaacagtgttcgccaatgccttgaccatcagggagtgccggtattcgcccttgctcaaagccgtcccagccttgatgacgtctaccttcaagcgacgggccggaccctgatggat

SEQ ID NO: 44670 - DNA, 477 bp, SYNECHOCOCCUS SP. WH 8102
tgggatcgattgatcgactggaatgcacgggctgaagcggagggtgatttctttatccgtctgcttaaggagcacggtgctcgttcggtgctcgatgtagccaccggaactggttttcactccatccgattgttggaggaaggatttgatgtggtcagtgcggatggcagccccaacatgctggcccgggcgtttcgcaatgctcgtaacagagatcagctgctgaggacatcgcaggcggattggcgttttctcaaccgtgacattcacggtgagtttgatgctgtgatctgtcttggtaattcattcacccacctgttcaaggagcgggaccggcgtaaagctctggctgagtattacgccgtgttgaagcacaatggcatcttgattcttgatcaccgcaattacgaccggctgctggagggtggatcggccgttcgacagggcaaaggcaatgtctattgcggaaaagatgtg

SEQ ID NO: 44671 - DNA, 981 bp, SYNECHOCOCCUS SP. WH 8102
atggagctcacctaccgcccccgtcgtttacgccgcacaccggccctgcgcgccatggtgcgggagcaccagttgtcctcagcggatttcatctatccactgtttgtccatgaggggaccgacgtcgaacccatcggtgccatgccaggtgcgagtcggtggagtctggcggccctgaccggagaagttcagcgcgcctggaacctgggggtccgctgcatcgttctgttccccaaggttgccgaggggctgaaaactgaagacggcgctgagtgcttcaacgccaatggcctgattcccagagcaattcgtcagatcaagcaggaggtgcctgggatggcgatcatgactgacgtggcactcgatccctattcctgcgacggccacgatggcatcgtcagcccagcgggggtcgtcctcaacgacgagacgatcgaattgctctgtaaacaggctgtggttcaagccgaagccggtgccgatctgatcggccccagcgacatgatggacggacgagtcggggccattcgtgaggccttggacgacgaaggctttgagcacgtcggaatcatcagctacaccgcgaagtactcctctgcctattacgggccattccgtgaggccctggattcagccccccgtgctgccggcagcaagccgattccaaccaacaaggacacatatcagatggaccccgccaatgcccgggaagccatcacggaagcccagctggatgagcaggaaggcgccgacatcatgatggtgaagccgggtttggcctacctggacatcattcaccgactgcgcaatgagtcggagctgcccattgctgcttacaacgtcagtggtgagtattcgatggtgaaggccgccgccgaacgcggttggatcgacgagcgtgctgtggttctcgaaaccctgctcagcttcaagcgggccggtgcggatctgatcctcacgtatcacgcctgtgatgccgcg

SEQ ID NO: 44672 - DNA, 438 bp, SYNECHOCOCCUS SP. WH 8102
ctgctgctgctgaacggacccaacctcaatctgctgggccagcgtgagccagggatctacggcagtggaacgctggcatcgatcgaagacggcctgaggcaggaggccactgccgcgggggcggtgctggagtgcttccagagcaacttcgaaggggctcttgtggaacggatccatcaggccattggggctagccaggggatcctgatcaatgccggcgcattcacccacacctccattgcgctgagggatgctctgctgggggtagcgattccctacgtggagctgcacctcagcaacacccatgcccgggagccgtttcgacatcgctcttacctggctgatcgcgctgttggcgtggtttccggtttcggggcaatgagctactcactggccctgcaaggcctcattgatcaccttcggcagaacggatgaccg

SEQ ID NO: 44673 - DNA, 1215 bp, SYNECHOCOCCUS SP. WH 8102
tcctccacgcccttccacgacccaccggcctgggtggcggatgccgtggtgtatcagatctttccggatcgattccgccgcagtggtcaggtgaaggctcagcaacatcttgagctgaagccctggggcagtgatccccgtgagcagggctttcaagggggggatctctacggggtgatcgaggcgttggatcagctgcaggccatgggcatcagctgcctgtacctcacgccgatcttcagctccgccgccaatcaccgctatcacgcctacgactatttcgaggtggatcccctgctgggggggaatgacgctctggatacgttgatcgcagccttacaccagcggggcatgcggctggtgctcgatggtgtgttcaaccactgcggccgtggcttctgggcctttcatcacctggtggaaaacggccaggactccccctaccgggattggttcaatgtgcaccgctggcctgtaaagccgtatccggccgagggcgaggactgcggctacgattgctggtgggctgtgcctgatctgcccaagttcaaccatgccaatcccgcagtgcgggaccatctgttggaggtgggtcgtttctggctggaacggggcatcgatggttggcgtctggatgtgcccgcggaagtgccagccgagttctgggtggatttccgtcgcgtggtgcgggaggtcaaccctgacgcctggatcgtgggtgagatctggggtgatgcccgggagtggctgcggggcgagcactttgatggggtgatgaattaccgcctcggctggagcagcctcggctgggtggcaggagatcggttgaggcagggataccgcaatccggagtacccactgaatcccctcagtagcgaggatttgatcgaaatctggagcaccacgtccggttggtaccgcccagccgtgaatcgagctcagatgaacctgctcgatagccacgatgttcctcgggcactccacagcctcgatggagatgtgaaggctctgaagctcgccctgctgctgatctttctgcagcaaggggccccatgcgtgtactacggcaccgaatctggattgtgcggtggcccggaacccgcctgtcgtgaagcctttccctggggtgaaccctggcctgcggatctgagctcaaccattgcggccttggctgatctccggcgaaatcaacccaatctcattcgcggcgatctg

SEQ ID NO: 44674 - DNA, 1479 bp, SYNECHOCOCCUS SP. WH 8102
ctgttggcgctggatcaaggcaccagcagttcccgagcagcggtgtttgacgccaagggcgaccttgtggccagtgcgacggcgcccctaccaatccaataccccgccgatggctgggtggaacaacaccccggcgacatctggaacagccaaaggcaggcactgcaggatctgcaccaacagctcgatgaggagcaacgtcgggccgtggtgagctgcggcatcaccaatcaacgcgaaaccacggtgctctggcgtcgcagcagcggcagcccctgcggaccggccctggtctggcaggacggccgtacagcagacatctgccaagcctggaaagcagacggcctcgaatccgcgtggtgccagcgcaccggcttgctgctggatccgtacttcagcgccagcaagatccgttggatgctcgagcatcaccccgaggcggcagccgctgcggcccagggcgatctgtgcttcggcacggtggagtcgtggctgctctggaacctcacgggaggacagcgccacggcagtgacatgagcaatgccagccgcacgctgctgatggatctcgagcagcgctgttggatggatgaattccgcgaacagacgggtcttcctgcgaacgctctaccggagctgttgccctgtcgtggggagttcggccacatcgcagcgaagcttcccttcgccggattgcccatccaggccctcctcggtgatcaacaggccgcgacccttggtcagctctgtctgcagcctggcgaagccaaatgcacctatggcactggggcctttctggtgatcaataccggcgacagcatccgccgctccagcgacggtctactcagcacccttggctggaccgatgccagcggcacacccacctactgcctggagggcagcctgttcaatgcaggaactgtggtgcagtggctgagggacggcttgcagatcatcgagcaggctgatgaggtgaatgccctggcgcaatcggtgccggacagcggcggggtgatgctggtgcccgccttcaccggttgggggaccccccactgggacccccaggcccgcggtgtgctggtggggctcacgcgggacagcaaccgcggccacatcgcccgagccgccctggagggcatcgccctgtcggtggccaccctggtggagctggcgggagaggccctcgggcgtggcctgggggaactggcggtggatgggggggctgccgcctccgatcccttgttgcaggcgcaggcggacagcaccggcctgacggtgcgccgcccccggaacctggaaagcacagcccgcggcatcgctctgtttgccggtgtgcaatgcggcctgatccccgacctgtccgccatcgccgcccaccggcaggacgatgtacagcgcttcgaaccgcagatcaacaccgagcggcgcaggcttcaacgtgaccgctggaatgacgccgtgaaccgcagcctgggctgg

SEQ ID NO: 44675 - DNA, 1488 bp, SYNECHOCOCCUS SP. WH 8102
gacctactggtgatcggtgccggtgccagcggtgcttcggtggccatggaggccgtgcgccggggactgacggtggcgttgctggatgccggcgacatcggcggtggcaccagctgccgcagcaccaagcttctccatggcggagtccgctacctggaactggcgttcaagaccttcgacctggcccagctgcagctcgtccgagaagcactgctggagcgtggtcactggctggagcaggcgccgtttcttgcccaccggcttgagctggtgttgcccacagacacgctgtggggtcagctgtactaccaggctgggctgggtctctacgacctactggccggccagcaacgcatcggtcgcagccgtggcatcagccgtgacgccttgcaggagtccctgccgatgctgaaacccggccgaggaggggtcgcctacagcgatgggcagttcgatgacgcccggttgaatctgctgctggcacgcaccgccgaacagggaggagccagcctgcgcacccgctgccgagtggtgggatttgagcgatcagcggatgggcgtctgagcgctgccatcagcgaaaccgacacggggatgcaggagcactgggccgctggcgtgatcgtcaatgccaccggaatccaggctgattcgatccgccaactggccgacccacaagcagccccgcgcatgctcaccagccgtggctgccaccttgtgctgaagcagaacctctgtcctggaggtcaggggctgctggtgccatccaccgcggatggacgcgtgttgttcatgctgccgttccacggccgcaccttggtgggcacaaccgatgccccctgcgccatcgatgcagccaccacccccaccaacgaggaggaggcctacctgcttggctatgtgcgccagtggttcccggccgtgtccgatcccacggtgacgagccgctgggccggaggtcggccgttgctccgccctgcaggggacagcctcaacagcagccgcgtagtgcgggagcacgaggtggagcaactgccctgtggtctggtcagcgtgatgggggggaagtggaccacctgccgacccatggccgacgacaccctgcaggcggttgctgcccaaatgggtcgtccccttggagcgccgcaacaactcaatctgctcgggagcgcagacacaccgtcagaaacgcgacagctgctgatggagcaggccggccaactgaaggatctgctgccggacgggcctttgagggatcagcagatcacccatctgcagagcaaccatgggctgcaggctttgccgatgatcagtcgggtcgatccgactctgcgccaaccgctcagcagcgtgatccccctctgccagggagagattgatcacgccatccaacgagaacattcgcgcagtgccagcgatgtgctatcccggcgctgccggcttgccatggtggatctggcggaggcccgccggctgcaacccctggtg

SEQ ID NO: 44676 - DNA, 1635 bp, SYNECHOCOCCUS SP. WH 8102
tggtggaccggcacggtcatctatcaactgatcgtgcgcagcttcgccgatggcaacggtgatggcatcggcgatttcaagggtctggcttcgcgcttgccctatctgcgctggctcggggtgaagacgctctggctgacacccacgtacccatctcccttacgggatggtggctacgacatcaccgacttcaaggacattcaccctgatctgggcgatctggcgtcgttccatcggtttctgacggcagcccacagccagggcatgcgcgtgattctcgatctggtgctgaaccacaccagcgaccttcacccctggttccagcgagcccgctgggcccccaagggcagcactgaacgggatgtgtacgtctggagcgacgacccatcccgctacagcgacgccccggtgctgttccggcactttgaagcgtccaactgggagtgggacccagtggcggagcagtactacctgcaccgtttcctgagccatcagcccgacctcaactacgccaacccgtgggtgcaggaggccatgctcgaggtggttgacttctggctggagcgtggggtcgacggctttcgccttgatgcggtgccgtttctgtttgaggaggagggcacccggtgtgaagggttgccggagacccatgccttcctgcggcgtctgcgggcccgtgtggatgccatgggacgagaggtgctgttgctgggggaagcgatccaacccgtgcaggaggcagccccctatctggcgaaggacgaactgcacggagccttcaacttcgtgctcacagcccatctgttcgctgctgtggcctccggcagcactcgccagctcggggactgtctcaacgaggcggaacacgcggttgatggcccgcgctgggccctgccgctccgcaaccacgacgagctctggctgggggatgggcacctgatccccgacgaggtgatccagtcgatccgggtgggcttgccccaggggcaggggcattggctcaactggggcatcaaccgtcgattggcaccgctgctcaatggcgacccccgctccaaccgactgcttcacggactgatttacagccttccaggcatgccctgcctgtattacggcgacgagctggggatgggggattggccggggttacgggatcgggatccgaaccgcacacccatggcctggacacctgcccgcaacggtggcttctcctcggctcccgaccctttgctggtgcttccgccgatcacagctcctgggtacgactaccgagtcgtgaacgttgaggtacagaaacagctgccgggttccttgctgaactggcaccgccgcatgctcacttgccggcgtttgctgccggccctcgcccatggatcattgcagctgttgccgtgcagccatcccggtgccttggtttacgtccgcgcgactgaggccatgacggtgttggtggcgggcaatgtcacggccgccggagcctccttcagcctggatctcacggcctgggagggcttgcggactcgcgaggtgatgtggggctgtgaattcccgctggccagccgcgaatggtttgtgaatctgtctccttacggcatcaactggtggttgatcggcgaggtggataccgctgtgccc

SEQ ID NO: 44677 - DNA, 1356 bp, SYNECHOCOCCUS SP. WH 8102
gacgaactccgccgcatgcaggacagcgtggggcgtggtctcactcgagcggcgacctggcgacaggagcaacttcagcgcctcagcgagctggtcgagcagcacgaacaggaggtgctggcagccctggcagcggatctgggcaaaccgcccaccgaggccttcttcgaaatcgttgcgctgcgccaggaactcaagctggcccagcgccaactgcgccgatggatgcgtccgaggcgcgtcacggtgcctctggcccagcgccctggccgagcggatgtcatcccagagcccctgggctgcgtcctgatcatcggtccgtggaactatcccttctcgttgacccttcagcccctgatctgcgcccttgcggccggaaacacggcggtgctgaagccatccgaacacgcaccagccgtcgcggccttgatcagccgtctgattgcggagcacttcgagcctgaggtggttcgggtggacctgggggatggagccgtcgcagcagcgctggtggccctgccgttcgatcacatctttttcacaggcggtggcgccatcggccgcaaggtgctcgagggggccgctgcccatctcaccccggtgacactggaactcggcggcaagagtcctgccctggtgctggagggggcggatctgacggtgagcgcacgacggctgatctggggcaagggcctcaatgccggccagacctgcatcgcgccggatcacctgatcgtgcagcccgggctgaaggcagaactcctgaaggccatggactcagcccgcaccgagatgtacggaaccgcccccctggcgtcggagcaactggcctgcatcgtcaatgaccgccaatttcaacgtctggaggctctgctggaccaggcgcaacaggcgggtcgcgtcctgatcggcggagagatcaaccgtgatcagcggcgcatcgctcccacagtgattcgtgttgacgaccgtcaggatcccctgatggccgatgaactgttcggtcccctgctgccggtgctggagctggcggacctccctcagaccctggccgagatccgccagggtccaaagcccttggctctgtacctctttggaggcaatgaggcgcagcagcagcaggtgctggagaccaccagttccggtggggtctgcctcaacgatgtggtgatgcaggcaggcgtgccggacctgcccttcgggggcgtgggcggcagcggcatgggcagttaccacggccaggctggcttcgacaccttcagccatgccaaggctgtgctgcgccgccccttccgcctggatttcaagctgcgctaccccccttacggcattgatctcaacctgttgaggcggctg

SEQ ID NO: 44678 - DNA, 1560 bp, SYNECHOCOCCUS SP. WH 8102
tgggatgttgtggtggtgggtgctggggcagcgggtttgatgacctgccttgagttgccagaggggttgtcggtgttgctgctgaaccgcaacaccggacgccgctcctccagccgctgggcccaggggggcatcgccgccgtgacccgccctgaagactcagcgggcagccatgccgacgacaccctgaacgccggcgctggcctatgtgacggcgatgccgtgcggtttttggtggacgccgcaccgcgttgtgtggatcgcctccagcagctggggatggcctttgaccgcgacggccatggcctggccacgaccctggaagcagcccacagccatcgacgtgtgcttcatgtgcaggaccgcaccggacgcgccctggtggatgtcctgcgtgagcgggtcgaacgacggcccggcttgctgcaccggcggggcgtgcgggtcaccaggcttgatgtgcagaacggccgctgttgtggggtgcaagtgctggatggccgccacctgcaacacatccaggcccgcgccgtggtgctggccagcggcggcggtggacatctgtttgccaacaccaccaatccggcccaggcctgcggagagggcattgccctggcctggcaagccggtgcagcggtagaagatctggaattcgtgcagttccatcccacggccctgcggctggacgatgccccctgcttcctgatttcagaggcagtgcgcggggaaggcggggtgttggtggatgcccaggggggaagtccggtggaccacctgctgcaacgtgacctggcccccagggatcaggtgagtcgggccctggtgcagcgcatgtgggagcagggcgtggcccagatgtggcttgatttttccgccattccccgtgcccaggcggaagcgcgtttccccacgattctcgaccgctgcagcgaattcggactcaaccccctcgaacggccaatccctgttgcgcctgcggcgcattactggatgggcggtgtcgcaacggatctgcaagccgcgacagaccttcccggcctctacgccgttggcgaggtggcctgcactggggtccatggcgccaaccggctggccagcaactccctgatggaatgcctcgtgttcgcccatcgcctggcggagatcgacctggggcctgccatcaagccgtcgaaccctgccccgccgcaggcttacgggcaagcactggagggagcgatcaccagcgcggggttgatggagcagatcgagcagctgcgcctgttctgctggcaacgggctggcgtggaccgcagtggacgccggctcaacgccggcctggatcacttgcgctgcgagctggaacgcctggatcaacaacccttgctgaactgtctgcagcgggatgctttgttgctggatgacagcagtcgccgcgatctgaatctgttgctggatctccgccaccgactggtgaccagcaagctgatgctggaggcctgcctgttccgccaagagagcaggggaggacatttccgcacggatgccccctcatcgcagccccaatggcaatgccactcg

SEQ ID NO: 44679 - DNA, 414 bp, SYNECHOCOCCUS SP. WH 8102
gccttcctcaccatccgcacccatttcgccgctgctcaccgactggcccgcccagaactgagtcaggaggagaacgaagccatctacggcaagtgcgccaggccccatggacatggtcacaactacctcgtggatgtgaccgtgcgtggtgcaatcgatccccgcacgggcatggtttgcgatctttccgccttgcagcgtctggtggacgatctggtggtggagcccttcgatcacaccttcctcaacaaggacgttgccttttttgccgaatgtgtaccgacggccgagaacatcgccctccacatcgcagatcggctgagcacaccggtgaaggcgattggagcccatctacacaagatccgcttgcaggaaagccccaacaacgccgctgaggtctatgccgagacccct

SEQ ID NO: 44680 - DNA, 375 bp, SYNECHOCOCCUS SP. WH 8102
ggccagggtcgcggctgtgtgatcacacggcgggcctgtttcagtgccagtcatcgttattggctgcctgagctgtccgctgacgacaacgcggctcgcttcgggccctgtgccatcgcccctggccatggccacaactacgagctgatcgtgtccatggccggcggcctcgatgccgatgggatggtgctcaacctttcagaggtgaagcacgccatccgccaggaagtaacgggtcagctggacttccgcttcctcaacgaggcctggccggaattcgatgtgtctggcccctctggctgtctgcccaccaccgaagccctggtgcgggtgatctggcagcgcctcagcccgcatctgccgatcacggcattg

SEQ ID NO: 44681 - DNA, 528 bp, SYNECHOCOCCUS SP. WH 8102
ttgaagcagcgcctgggcggccgcagcctgtacctggtgggaatgatgggcagcggtaaaaccagcaccggtcgccccctggcggaacaactgggttacggctttgtggatgccgatgccgtgatcgagcaggccgcaggctgcagcattcctgagatttttgagcgggacggtgaagcaggattccgggccctggaaagccaggtgctcaacgccatcggccaacgtcactccctagtggtggccaccggcggcggtgtggtgacgcaacaggagaactgggggctactgcacagcggcatcgtggtctggctggatgtggtgccagagcagctcatgcaacgcctcagagcggacagcacggtgcggccactgctccaaaccgaagatccagacgctgcgctcaacgcgctgctcaaccaacgcaggcccctttatgccgaggccgatctcacggtggtgattaatcaagaaacacccctcgccgtcgccgacgggatcctgcaacttctgccaagcctgctgaag

SEQ ID NO: 44682 - DNA, 780 bp, SYNECHOCOCCUS SP. WH 8102
cagcctctgcagaactgcacggtggtggtgacccgcgccgccgaccaactgggggaagccaggcgactgttggaaacccaaggcgcacaggtgctcgacctccccgccttggtgatcggccctcccgacgactggggaccgctggatgatgccctctcagagctggaggacttccactggctggtggtgtcgagcgccaatggcgtgcaggcggtggagcagcggttgcaacgcctcggccgcagcctgctgcggcgtcccgccaacctgcgcatcgccgctgtgggtcgcaaaaccgccagagccctggaagaccttggcgccacagccgatttcgtgccgccaagcttcgtcgccgacagcctgatcgaccactttcccgtctccggctatggcctgaggatgcttctgccacgggtgcagagcggcggcagaaccgtgctggcggaagccttcggggaagctggggtgagggtggtggaggtggcggcctacgagtcccgctgtcccgacgccatgcccgagcgcaccgccgaagcccttgaggctggaacggtggacgccattttgttcagcagcggtaagacggccgcccacacggcacaactgctgctgcagcgcttcggtcctggctgggagcaacggctggagactctgaaattggtgtccatcggcccccaaaccagccgcagctgccgcgaatggttcggccgcatcgatgcggaagctgacccccatgacctggagggcctggtgagcgcttgtcgctcgctactgcgc

SEQ ID NO: 44683 - DNA, 1428 bp, SYNECHOCOCCUS SP. WH 8102
gtgcgggtcgcgattgtcggttccggtctcgcgggcctctccgctgcggtggacctggtggatgctggccatgaggtgaacctctacgaggcccgtccgttcatgggcggcaaggtgggcagctgggtggatgacggcggcaaccacatcgaaatggggttgcacgtgtttttcttcaactacgccaatctcttcgcgctgatgcggaaagtgggtgcgtttgagaatctgttgcccaagcagcacacccatctgtttgtgaatgagggcggtgatctgcgggaactggatttccgcttcccgatcggagccccgttcaatggcctcaaggcgttcttcaccacgccgcagctgagctggatcgataagttgcgcaatgccctggccctgggcaccagtccgatcgtgcggggtctggtggattacgaaggggcgatgcgcaccatccgcgccctggactccgtcagtttccaggattggtttgtgggccatggcggcagcccggaaagcatccgccgcatgtggaatcccatcgcctatgcgctgggattcattgattgcgaggccatttcggcccgctgcatgctcaccattttcatgatgtttgcggccaagaccgaggcctcgaaactcaatctgttgaagggatcaccgcatcgctggctcactggcccgatcctggagtacatccagcagcgcggcggcagattgcacctgcgccaccgggtgaagcaggtggaattcagcgatggcgagtcccccgaagtgacgggcctgcatctgggcacgccggagggggacatccgcgttgaagcggatgcctatctcgccgcctgtgatgtgcccgggattcagaagttgttgccggaggactggcgccgtttcccccagttcgatgccatccaccaactggaggcggttcctgtggcgactgtgcagctgcgttacgacggctgggtgacggagctgggtgagtcccaggacgcgcagcgccgggatgtggcgacgcctacggggctgaacaacctgctttacaccgccgatgccgatttcagctgttttgcggatctggccttggcaagcccggaggactaccgcaaggagggagaaggttccttgctgcagtgcgtgctgacgcccggtgatccctggattcccaaatccgttgacgagatcgtggcccacaccgatcgccaggtgcgtgccttgttcccgtcagcccgggatctcaagctcacctggagcaatgtggtgaagctggctcaatcgctgtaccgcgaggctcccggcatggagccctacaggccggatcaacgcaccccgatccagaacttcttcctggccggcagttacacccgtcaggactacatcgattcgatggaaggcgccacgatgagtggtcatttggcggcggccgccatcctggat

SEQ ID NO: 44684 - DNA, 2394 bp, SYNECHOCOCCUS SP. WH 8102
tactgcggggcacggcgctccggcggaaggcccccatcctgacgggaacagcacccgacctagccttgccgtaacgaacaagcgccagtgagtcctgcggttcagaccgtcgtcctcgatgtggaggggatgaaatgcggaggctgtgtacgagccgtggagcgcaccttgctcgagcagccgggggtgcagcgcgctgatgtgaacctggtgagccgtgcggcatggctagatctcagcgaagccgatggcgatgtcgacgccgtactcggggccttggccagtcgtggatttccggcccgtgaacgctccctggagccatcgtccgctcggcttgcgactggagcttccggattgacctggtggcagcagtggcgccaacttatggtggccctcacactgctgctgctgtcggtgcttggtcacctcagcgaggccggccatctgtcgttgcccctgatcggcagcctgccgttccatgccgcgctggccaccgtggccttgctgggtcccggtcggccgattctgctgggtggattcgcggctgcccgggcggctgcgccaagcatggacaccctggtgggtctgggggtcggcagcgcctatctggccagtcttgtggcactgatctggccccaggtgggctggccctgttttttcaacgagccggtgatgctgctgggtttcgtgttgcttgggcgcttcctggaggaacgggcccgcttccgcaccggtcaggcgctgcatcagttggcccagctgcaacccgatacggcccgtctggtactgccggatggcgccatccgggatgttcgggtcggggccttgcgccccggggagcggctgcagctgctggcgggggaccgtgtgcccgtggatggtgttgtggtggaggggtattcggcggtggatgcctccagcctcaccggtgaaccgctgccctggcaggcagaacccggacttgagctgtccgccggcagcctcaacctcgatgcaccgctcgtgctggaggtcacgcgggttggagcggaaacggcgctggcgcgtatcatacgcctggtggagcaggcccaggcgcgtcgggccccgattcaggggctggcggatcgcgtagccggacgcttctgctacggcgtgatcgctcttgccctggccaccttcctgttctggtggctgttcggcgcttctcaatggcctcaggtgatgcaggcgtcagcacctggcatgccccaggggcatctgatgaccagtggccatgcgatgcatcacggcggcctcggcagtggtgccacctccccggtcgggttggcgttgcagttgtcgatcgctgtgctggtggtggcctgtccctgtgcccttggtctggccacccccaccgtgatcaccgtggccactggtctggcagcgcagcggggctggttgttccgcggcggcgatgtgatcgaaaccgccgccggcctcgatcacgttgtgttcgacaagaccggcaccctcaccctcggacgcccgctggtgaccagcgtgtgggccaaggacgcggctctgctgctgcagctggccgcaagcctcgagcagagcagtcgtcaccccctggcccatgccctgctgcaggaggcgcagcgacgggacctgaccctgctggaaccagtgcaggtcaccaccgtgtccgggcagggtctggtgggcgaggtggagggttggcctcaaccgatccgggtgggacgtcccgattggctgggttcattcggcgttgccctcagcgatgaagccaggacctggcttgctcaggccgatggctccgtggtggcggtggcccatggcagtgcgttgctgggattggttcagatcgaagaccagctgcgtgccgatgtggtgccggcgctggaacgcttgcgtcagcagggccttgccctggcgatcttcagcggtgaccgcgagccggccgtgcgtgccttgggtcagcagctgggctttgaggcggctgatctgggctggcagatgctgccggagcagaaactgcagcgtctggaggagctgcgccaacgggggcgggtcgccatggtgggagatggcatcaacgatgcgccggctttggccgcggctgatctgggcatcgccatcggcaccggcacacagatcgcccaggacaccgccggcatggtgttgatgggagatcgtctggacaacctgccggaagcgttgaccctagcccgccgcaccctggccaaggttcggcagaacctgttctgggcattcggttacaacctgatcgccctgccccttgccgccggtgccctgctgccgagtcagggggtgctgctgtccccgcccctggcggccttgctgatggccatcagttcgatcacggtggtgctcaatgccctgctgctgcgg

SEQ ID NO: 44685 - DNA, 975 bp, SYNECHOCOCCUS SP. WH 8102
ggtgtgatgttccgtggcagcggtagcgctactccacagcgttccatcagcaacactgagctgggacaacgggtggaaaccagcgatgactggatccgcagtcgcaccggcatcgcagcccgacgtgtcatcggggccgacgaaagcctgggtgaactgagcggccttgcggcagaacgtgcactggccatggcgggatggtcggcggacagcctggatctgatcctgctggccacctccacacccgatgatctgttcggatccgcaccgcggctgcaggcccgcatcggtgcggtgaacgccgcggccttcgatctcactgccgcctgcagcggttttctgttcgcagtggtcacggcggcccagtacctgcgcagcggggcgatgcaacggatcctggtggtgggcgccgaccagctcagtcgctgggtcgactgggacgaccgccgctcctgtgtgctgttcggggatgccgccggtgccgtggtgatggaagcctccgatgagcaggacgacctccaggggttcctgctgcgctccgatggcggccgcggtgcggtgttgcagctgccccagagcagcgaacgagcacctctggtgggcgatgccagccatcagcgcggtggctttgagccaattcagatgaacggacaggaggtctacaaattcgccgtacgggaagtgccggcgattttggaagcgctgctgcagaaaaccgagacccaagcggattccctcgactggctgttgttgcatcaggccaaccaacgcatcctcgatgccgtggctgagcggttctcgattccgaacgaaaaggtcctgagcaacctggcccactacggcaacacgtcagccgccaccatccccttgatgctggatgaagcggtgcgggacggacggatcgaaccgggccaccgcatcgccagcagcggcttcggcgcaggactgagctggggtgcagccctgctgcgttgg

SEQ ID NO: 44686 - DNA, 888 bp, SYNECHOCOCCUS SP. WH 8102
atggcgatcgcctgggtttttcccggccagggctcacagaagctgggtatggcggatccggtgctcagcctcagcggcgccagccaacgctttgccatggcctccgagctgctgggccgtgatctgctggccatctgccagggcaacagcgttggcggcagcggtcccgacgacctcaacgacacccgcaacacgcaaccagccctgttcgtcgtggagtccctgctggtggacaacctgatcgagcaggggcgcgacgcagcgcttgtggctggccacagccttggggaactggtggcgctctatgccgccggcgtgttcgacctggaaacgggcctcaagctgatgcagacccgatcggaactgatggcagccgccggtggcggcgcgatgaccgccgtgatcggcttcgaccgcagccagctcgaagcattagtgaacgacaccgaaagggtgagcatcgccaacgacaacagcgacgcccaggtggtgatctcggggcagccggacgctgttcagagcgtgagcgagaagcttaagtgcaaacgggctattcccttggcggtttccggagcatttcactccccgttcatggccgaggcggcagaggccttcgccacaacgctggatggcgtcagcttccgcgatgcccggatcccggtcttgagcaacagcgatcccagcggttgcagcgatgcagccctgctcaagcaacgcttgaagcaacagatgaccaccggcgtccgctggcgggaaaccatggcctcgatggcggagcacggcatcgacaccctggtggagatcggtccgggcaatgtgctcagtggcctggccaaacgcagcatgaacggggtgaccaccgcgcagatcgccagctctggcgatctc

SEQ ID NO: 44687 - DNA, 582 bp, SYNECHOCOCCUS SP. WH 8102
aacatcgcctggcaccaggcttcggtggatcgggctgcacgggctgagcagcgcggtcatcgcagcgccatcctctggttcaccgggctctccgggtccggcaaaagcaccctggccaatgccgtcaacgccgctctgttccaacggggcctggcgacctacgtgctggatggtgacaacgtccgccacggcctctgcaaggacctgggcttttccgatgccgatcgcgaagagaacatccgtcgcatcggcgaggtggccaagttgttcctggactcgggcgtcatcgtgctgacggccttcgtgtcccccttccgcgccgaccgggacaaggcccgcgccttggtggacgacggtgattttatcgaaatccactgcgccgcggatctggaggtctgcgaatcccgcgatcccaagggtctctacgccaaggctcgtgccggccagatcaaggaattcaccggcatctccagcccctacgaagcgccacaggccgcagaactgaagatcgacaccggcagccaggagctggctgaatcggttgacctggtgatcaaggccctgcaggaacggggggtgatt

SEQ ID NO: 44688 - DNA, 1005 bp, SYNECHOCOCCUS SP. WH 8102
atgctgcggcttgatttcaacgagaacacgattggccccagccccctggtggcccaggcgctgcgcaacttcagcaccgaagaaattgccgtttatccggagtacgacggcctgcgggaggcgctgctccagaacctggtggagaccggctgccgtccggggttgaagcctgctcaggtgggcctgttcaacggtgtggatgccgccatccatgcggtattgcaggcctatggcgatgccggtgaaacgttgctgaccacagcgcccaccttcgggtattacagcccctgcgctgggatgcagggcatgacgatcaaggcgatctcctacgagggggagacgtttgacttccccctggcggccattcaggaggcgttggcggctcgcacgccgcggttgctgttgatctgcaaccccaacaaccccaccggcacgcgcttgccagcggatcaggtgattgctttggcggcctcagccccgggcaccttggtggtggtggatgagctctacgaggccttcaccggggacagcgtgctgccgagcgcggatttcacggccacaccgaatctgctggtgttccgctccttggccaaaacagctggattggcggggttgcggattggctttgccattggtcatgccgatgtggtcgatcgggtgagccgcgtcacggggccttacgacgtcaacagcgtggccgtggctgcggcgtttgctgccttggccgatcagtcgtatgtggacgcctatgtggccgaggtgctgcgtgctcgcgattggaccgttgaggcactgctacaggctgatgtgcgccatcactgcgacggaggcaactacctcttgatctggccccggcgctccgtggaagagatcgatgcggccttgcgcagtgagggcatcctgatccgttccatggcgggcaaaccgctgattgatgggtgtttccgcgtcagcatcggcaccaccagccagatgcagcgctttatggaggcctatctgagcatc

SEQ ID NO: 44689 - DNA, 846 bp, SYNECHOCOCCUS SP. WH 8102
attcagtggtaccccggccacatcgccaaggcggagcagcagctcagtcgccacctcgacaaggtggatctggtgatcgaagtgcgcgatgccaggattcccctggccaccgggcacccccacctggaccgttggctgaaggggaagcagcacctgctggtgatcaaccggcgtgacatggtgacacccgcggctcgggaggcctgggaggcctggttcaaaggacgcggccagcgcacggtgtggtgcgatgccaaggcgggcaccggtgtgaagcaggtgcagcaggcggctattcgggctggtgatcagttgaatgaacggcgacgcaaccgcggcatgcggccccggcctgtgcgggccctcacgctgggcttccccaacgtcggtaagtccgcgctgatcaatcgcctggtgaagcagaaagtggtggccagtgcccggcgggctggcgtgactcgtacgttgcgttgggtgcggctggggcaggacctcgatctgctggatgctcctggggtgttgccgccccggctggatgatcagcaggcggcgctccacctggctctctgcgacgacatcggccaggccgcctatgacggcgagcttgtggcccaggccttcctgcaattgctgattgatcttcagcagcagcaggcctcgggcgtggccatccctgtgctggaaagccgctacggcattccagtgcagggggaaacggcggatcccccctattggctggaggcggcggcgcagcgccacacctctggcgacacggcccggatggcccagcgcctgttggatgacttccgcaaatccgcccttggcagcattgccctggagctgccg

SEQ ID NO: 44690 - DNA, 1403 bp, SYNECHOCOCCUS SP. WH 8102
tcaggcaccaaatccagcaatctgagcagcacgaggcggctgtcgtagacctgaacgagctccagggccttgaccgctgtgtccagagcctgggggttggcgtccaggggcaggaggacggtctcaaacatcgccgatcagagacgcgaaaacacgggttaacctcctcccgttttcctaccgcacgacacaaccccatggcgaagcgttccctggccagccttaacgccggcgacctgagcggcaaacgcgttctcgtgcgggttgatttcaacgtgcccctgaacgaggccggtgcgatcaccgacgacacccgcatccgcgccgccctgcccacgatcaacgacctgatcggcaagggcgccaaggtcattctttctgctcacttcggccgccccaagggtcaggtgaacgacgccatgcgactcacccccgtggccgcccgcctgagcgaactgctgggcaagcccgtggccaagaccgacagctgcatcggccctgatgctgaagccaaggtgaacgccatggccgatggcgatgtggtgctgctggagaacgtgcgcttcttcgccgaggaggagaagaacgacgctgggttcgccgagaagcttgctggcttggctgaggtgtacgtgaacgatgccttcggcgccgcccaccgcgcccacgcctccaccgagggcgtgaccaagttcctcaagcccgcagtcgctggcttcctgatggaaaaggagcttcagtacctgcagggtgctgtggatgagcccaagcgtcctctcgctgccatcgtcggtggctccaaggtgagctccaagatcggcgtgctcgaggccctgatcgacaagtgcgacaaggtgctgatcggcggtggcatgatcttcaccttctacaaagcccgtggcctctcggtgggcaagagcctggtggaagaggacaagcttgaactggccaaggagctggaagccaaggccaaggccaagggcgttgagctgctgctgcccaccgatgtggtgctggccgacaacttcgcccccgatgccaacagccaggtggctgatgtcaccgccatccccgacggctggatgggtctggacatcggccctgatgcggtgaaggtgttccaggacgcccttggcgattgtcagaccgtgatctggaacggccccatgggcgtgttcgaattcgagaagttcgccaccggcaccaacgccatcgccacaaccctggcggagctcagcggcaagggctgctgcacgatcatcggcggtggtgactccgtggctgctgtggagaaggctggtctggccgacaagatgtcccacatctccaccggtggcggcgccagccttgaacttctagaaggcaaggtgctgcctggtgttgccgccctcaacgacgccgcc

SEQ ID NO: 44691 - DNA, 954 bp, SYNECHOCOCCUS SP. WH 8102
gatctgcggctcgagcaggtgttgttcggttgccgtttccctaatcctgtgggtcttgcggctggtttcgacaagaacggggtggcagctggactgtgggatcgctttggctttggctttgctgaggtgggcacggtcacctggcatggtcagcccggcaatccccgcccgcggttgtttcgcttggctcaggaacaggccgctctcaatcggatggggttcaacaacgacggtgcccaggcgttgcgcagaaccctggaacgtcaacggctggccccccccggtcgtcgcccggctgtcctgggaatcaacgtcggtaaatccaaggtcacagcgttggaacaggcccctgaggattacgcctcctcgctggaactgctggctcccctggcggattacgccgtgatcaatgtgagttctcccaatacccctgggctgcgggatctgcaggattccagccagttgcggcggctggtggagcggctgcgtcgcttgccggcctgtccgccgttgctggtgaagattgcaccggatcttgaggatgaggcgattgatggcattgcccggctggccttcgaggaggggctggcgggggtgattgcggtgaacaccagcctggatcgcctggggttggagcagcgtcggctgttgcagaccggccgcaccttggcggaggaggctggtggtctcagtggtgcgcccttgcggcaacgggcgctggaggtgattcgccggctgcgggccagcgccggtccggccttgacgctgatcggtgttggaggcattgattcggcagagattgcctgggagcggatcaccgccggagcgtcgttgattcagctgtacaccggctggattttccagggtcccgagctggtgccacgcatccttgaagggcttcagctgcagttggaccgccatggcttgcgcagcattgctgaagcggtgggaagt

SEQ ID NO: 44692 - DNA, 2619 bp, SYNECHOCOCCUS SP. WH 8102
gagcctgaccgtttttccgatcccgcctgggagctgctgctggctggtcaggacatggcccgtcgctggcgccacgatcagctggatgtggagcatctgatccaggtgctgttcagcgattcatccttccgtcgctgggtggagccgctgccgttgcgctctgacgatcttctcgatcgcttggaggatgtgctggcggatcagcctccggcgcggggtgatcagttgttcatcggtgaggacctcgagcagctgttggagaccgccgatcaagtgcgaggtcgctggggcgatcgctcgattgatgtgccccagctgatcgtcgccgtcggcgctgatccccgcatcggtgccgagttgtttgcagcccagggtctggctgttgatcggctggagagtctgttgcgtcagccgtcggtttctccggccccagcaccaccaccagtcccaaccgcagcatcggccccagccccaacgcctcgatcagctcctgccccccgcgtgatggcaccggagccggagccgatggttgaactggagcgggagccgtcagcgcttgaggcctatggccgggatctgactgaggaggctgaagcggggtcgcttgatccggtgatcggtcgcgacagcgagatccgcaacctgatcaaggtgctctcccgccgcagcaaaaacaacccggtgctgatcggggaacccggcgtcggcaagacggccatcgccgagcttctggcccagcggattgtggctggagaggtgccggattccctgcaggggctgcgactgattgcccttgaccttggcgccctgatcgccggggccaaattccgcggtcagttcgaggaacgcctgcgctcagtgttggaggaggtgagtcgctcggattcgggggtggtgctgttcatcgacgagctccataccgtggtgggcagtgaccgcagcagcaccgatgcgggcagcctgctcaaacccgccctggcgcgaggggatctgcgttgcatcggtgcgacgacgccggaggaataccggcggacggtggaaaaggatcccgcccttaaccggcgctttcagcaggtgctgattcgcgagccggacctcgagctcagcctggagatcctgcgcggcctgcgggagcgctacgagctacaccacggcgtcacgatcaccgatgaggcgattcagaccgccaatcggctggcggatcgctacatcagcgaccgttgcctgccggacaaggcgattgatctgattgatgaggcggcggcccagctgaagatcgaagtcacctccaaaccccaagtggtggaggaggctgaagcggatcttcggcgggtggaactggcgctgctggcggcggaagaggcaccggaagaggagcggattcagctgcagcgtcaacgtttggaggtgtcctcccgcctggacgacctacgccgccgatggcaggaagagcgcacgcagttggaggagcttggccagttgctgcagcaggacgaagacctgcgtcacgccatcgctgaagcggaacgggagggcgctctcgaggaggcggctcggttgcagtacgaccagctgcacactgttcaacagcggcgggaggcgttggaagccagtcaggctgaggcgcagtcagcgggtacagcgctgctgcgggaacaggtggaagcgggagacatcgctgatctggtggcccgttggaccggtattccggtgcagcgcctcttggcgggcgaacgccgcaagctgctggccctggaaagtcacctgtccgagcgggtcatcggccaggtggaagcggtggccgccgtcgcggcagcgatccggcgggcgcgggccgggatgaaggatccccgccgtcctgtgggttcgttcctgttccttggcccgacgggggtcggcaaaacggagttggccaaagcgctggccacctccctgttcgatgaggaggaggcgctggtgcgcctcgacatgagcgagttcatggagcgcaacgcctccgcgcgtttgatcggtgcaccaccgggctatgtcggatacgaggagggggggcagctcacggaggcggtgcgtcggcgcccctacgccgtgctgctgctggatgaggtggaaaaggctcacccggatgtgttcaatctgctgttgcaggttctcgacgatggccgcctcaccgattcccagggactgaccgttgatttccgccacaccgtggtggtgatgaccagcaacctggccagtccggtgatccttgaacacgcccgttccggctccagcgatgacgcccagctgcagcagcaggtggatgcggccctgtccagtcagttccgccccgaattcctcaaccgcattgatgaagtgatccgtttccgacccttaaaggtgaaggatctggtgcggatcgtgcggctgcagctggctgatctctccaccctcatggctgaacaaggtctgtcgctggaggtggatgatgcagtggcggactccctggcccgtcagggccatgaaccggagtacggcgcccgaccgttgcgacgggtgttgcggcgtcagctggagaacccattggccacgcaattgcttgaggagcgtttccgctcggcgcatggcatccgtgttcgttgc

SEQ ID NO: 44693 - DNA, 1281 bp, SYNECHOCOCCUS SP. WH 8102
gtgatcgattcgctcgacctcgtcatcgacaccatcgtggcccgcgaagttctcgattcccgcggcaacccaaccgttgaagccgaagtgctgctcgaaggtggtgccatgggccgggccatcgtgcccagcggcgccagcacaggtgcccacgaggcccacgaactgcgggacggcggcgaccgttacatgggtaaaggcgtcagccaggccgtcacccacatcgaagagcgcatcgcgccaaccctgtgcggactctccgccctggatcaggccgccgtggatgcagcgatgctcgagttggacggcagcgacaacaaatccagcctgggagccaatgcgattctcgcggtgagcatggccaccgcccgcgctgcggccaacggactgggactacccctgtaccgctaccttggcggaccgatggccaacctgctgccggtgccgttgatgaacgtgatcaacggtggcgcccatgcggccaacagcctggatttccaggaattcatgctggtgccccacggagcccccagcttccgcgaggctctgcgcatgggcaccgaggtcttccacaccctcaagggtctgctcaaagccaagggcatgagcacctctgtgggggatgagggtggtttcgcccccgacctgggcaatgtggaagccggggagatcctggtggaggcgatcacgaaggccggctacaaacctggcgagcagatttccctggcgctggatgtcgccagcaccgaattcttcgagaacggccgctatgcctttgatggcggcaactacgacagcgccgaaatggtcggccagctggagcagctggtggagaaattcccgatcgtgtcgatcgaggacggcctggcggaagacgactgggagggttggaagctgctcaccgaacggcttggcggcaaggtgcagctggtgggtgatgacctgttcgtgaccaacaccaagcgcctgcagcagggcatcgacaacagcacggcgaactcgatcctgatcaaggtgaaccagatcggatctctcaccgaaaccctgcaggcgatcgatctggctgggcgttccgggtacaccagcgtgatcagccaccgcagtggcgaaaccgaggacaccaccatcgccgacctctccgtcgccacccgcgccggtcagatcaagaccggttcgctcagccgcagcgagcgcgtcgccaagtacaaccagctcctacggatcgaggacgaactgggcagccaggcggtttacgccggagctgtgggccagggtccccgg

SEQ ID NO: 44694 - DNA, 1188 bp, SYNECHOCOCCUS SP. WH 8102
tggcaattggtctcgggaggtgtcacctccccccagggcttccaggcttcggggattgctgcgggtctgaaaccctccggcaagttggacatggcgctgttgctggcgccggagcaggcggtctgcgctggcagcttcaccacctccgttgtgcgtgcggcgtgcgttgatctctgcgctgagcgtctggctgccaatgggggccaggccagggctgtactgattaattcggggcaggcgaatgcctgtactggtgatcgaggtctaatcgacagtcagcgggctactcaggcccttgctgatcagcttggactcgatgcagaggctctgctgatttgttccaccggtgtgatcggggtgccgatccccatgccgaagctgttggcggggttggatccccttgtcgccgcgttgtcggccaccggcggtgaagccgcggcaacggcgattctcaccaccgatctcgtcagcaagcaggtggcgctggaggccgagctggggggccgccgcgtccgcattggcggcatagccaaggggtcaggaatgattcaccccgacatggccacaatgctgggttttttcagttgtgacgctggccttgatccgtcgatctggaaggcgatggtggggcaggcggttcagcgctccttcaacgccatcaccgtcgatggcgacaccagcacgaacgacacagtgctggcctttgccgctggagatcccttggattctgtgcaccatgcggccttggagcagggattgaccgaggcgatgcagcacctggccaaggccattgcccgtgatggcgagggggcgacctgtctgattgaggtgcaggtggagggagccctcgatgagccgtcagcgcagcgggtagcccgcaccatcgttggttcctcgttggtgaagacggccgtgcacgggcgggatcccaactggggccggatcgtcgctgccgctggtcgttccggtgttccgttcgatccggagcaggttgcgctctggattggtccgcatcagctgatgcagtcggggcagccgctttcctttgatcctgaggcggcgagccgtgtgcttcgtagcgagacggtgcaaatcaggatccagctgggggatggaccaggcaacggtcttgcctggggctgcgatttgtccgatcaatatgtgcggatcaacgccgattacaccacc

SEQ ID NO: 44695 - DNA, 444 bp, SYNECHOCOCCUS SP. WH 8102
gaacgcacgttcatcgccatcaagcccgacggcgtccagcgcggtctggtaggcgagatcctcggccgctttgagcgcaagggattcaagctggtgggtctgaagcagatcaccccaagccgcgccctcgccgagcagcactacggcgtccataaggagcgtcccttctttgccggtctggtcgatttcatcacctccggtcctgtggtggcgatggtgtgggaaggcgatggtgttatcgccagcgctcgcaagctgatcggtgccaccaagcccctcgaggctgagcccggcaccatccgtggtgatctggccgtcaacatcggccgcaacgtcatccacggttctgacgcaccggaaaccgctgagttcgaaattggtctgtggttcgacgctgctgaattaaacgattggacgccttctgatcagacctggcgcgttgaa

SEQ ID NO: 44696 - DNA, 1923 bp, SYNECHOCOCCUS SP. WH 8102
gtggctgacagcgaaggctggtcgatccaagacagcgcagcgctctatgggctggaccgctggggcgagccttacttcaccatcaatggacgtggccatatcagcgttcaaccgcaaggcgaacgcggcggcagcctggatttggtcgaactggtgtcagaactgcgaggtcgcaacctcggactgccgctgctgatccgtttcgacgacatcctggaagaccgtctcgagcggctgcatgcagcgttcgaacgggcaatcgctcagtacagctacacgggtcgctaccagggggtcttcccagtgaagtgcaaccaacaacgccatgtggtggaagagttggtgatctgtggcaagcgctggaacttcggactggaagctggcagcaaggcggagctactgatcgctctctcgctgctggatgacccggaggcgttgttgatctgcaacggctacaaggatcggctgtacatcgaaaccgcaatcctggcgcgacgtctgggacggcagccggtggtggtgattgaacagccggacgaagtcgaccggattattgaagccagcaagagcctgggagcagccccatacatcggcgtgcgggccaagctctccagccgcagcacagggcgttggggcagttccgttggcgacaaggccaaattcggtctctccattcccgagttattggcaaccgtggagcggctgcgggagagcaacctgctccccgatctacgtctgctgcacttccacatcggcagccagatcaacgacatcgccgttctcaaggacgctctccaggaggcggggcagatctatgtggagctcacccgactgggggccccgatggggttcctggatgtgggcggtggactcggcatcgattacgacggcagccgtaccgcatcggcggcctccaccaactattcgctgcagaactacgccaacgacgtggtggccacggtgcgggaatgctgtgagcccaatgctgttgccgtacccacgctggtgagcgaaagcggccgcgccattgccagccatttctccttgctggtgttcgacgtcctgggcagcagcgcactctcggcatcaattcccaacgccagtggagacgaaccactcactgttcgcaacctgcgggacaccctcgtcaccattcaagagttatcggggacggcagacgcgcagttggtgcggctgcaggaagcctggaacgatgccttgaagttcaagcaggatgcgctcgccgcgttccggctcgggtacatgggtctccccgaccgcgcctcagcagaacaactgacgtgggcctgcgctgatgccatcgcccaacggctcccgaaggaacaagccatcccggaagaactggcagcacttagcaaagcgctggcgggaacctattacgccaacttgtcgatctttcgctcagcacccgacacctgggccatcgatcagctgtttccggtggtgcccatccagaagctgaatcaacggcccacccgactggccaacctcgccgatctcacatgcgattccgatggacgactggatcgcttcatcggagatggacaacccaaacagttgctggagctccacgagctcgacgacaacaacccttatctgatcggcctgtttctcagcggggcataccaagaggtgatgggcaatctgcacaacctgttcggcaccaccaatgccgtgcacattcgcctcagcccgggcggtagctatcgcattgatcacgtcgtgcggggtgacaccaatgccgatgtgctggaggccatggagcacgacccccgggttttgctggagcggttgcgggtggcggcggaggcggccatcaacgacggccagctccgcatcgacgaatcacgacggctgctggaccacctcgaaagcagcctgcgccaaaccacgtaccttcaa

SEQ ID NO: 44697 - DNA, 783 bp, SYNECHOCOCCUS SP. WH 8102
accaccagcttcatggtggtgatgcatgtgctggccaccgtggcactgctgccgcggttctggagctggcagggtcttgtggccttcggagttctgtactgggtgaccgtccttggcgtcaccttgggcctgcaccggttggtcgcccaccgcagcctggtggttccggtctgggtggagcgcatgctggtgatcatgggcaccttggcctgccagagcggaccgatcgaatgggttggcctacaccgccatcaccaccgcttctccgatcaaccgatcgatcaccatgatgccggacgcggtttgtggtggagccacagcgagtggatgttgcatgacattcctgcgctgaaggaactcgatcgctacgccggtgatctccaggttgacccgttctatcgctggctggaccgctggttcctgttgctgcagatccccctggggcttggtctgtactggatcggtgaagccgctcaagtgcatggtggtggaatcggactggtgctttgggccatccccctgcgtttggtaatcgtctatcacgtgacttggctggtcaattccgccacccacgcctttggctaccgcaactttgactgcccggatctgtcgcggaactgctggtgggtagcgctgctctccttcggtgagggttggcacaacaaccatcacgcccacccagcgagcgcccgccatggtctgcgctggtttgagtttgacctcacctggcaacacgttcgcctgctcaagcgccttggccttgcgagccgcgtgagaacggct

SEQ ID NO: 44698 - DNA, 900 bp, SYNECHOCOCCUS SP. WH 8102
aagcagcctgggctggccggcaccctgcgccatttcatccgccgccggacgcgggatgtgatggcggtgcaggacgtgtccttccggatcgagcccggcgagatggtgggttttcttggcgctaacggcgctggcaaaaccaccaccttgaagatgctctgcggcttgatccaccccagcgctggggaggtgcaggtggcgggcttcagtccgcagcggcgccaggcggagttcctgcgccggatcaccctggtgatgggccagaagcagcagctgctctgggacctgcctccgatggattcgttgcgggtgaatgcggcggtgtacggcatccccgatggcgtggcccgccgacggatctgcgagctggctgatctgctcgagctgggggaggagctcgctcggccagtgcgcaagctctccctcggtcagcggatgaaggccgaactcttggcggcgctgctgcacgagccgcaggtgctgttcctcgatgagcccacgctggggctggatgtgaatgcccaggccagggtgcgcacattcctggcggactacaaccgccgcacgggggcgacgttgttgctcaccagccattacatggctgacatcaccgccctctgtccccgggtgctgctgatccaccaggggcgactgttccacgacggccctctggaagctttggccgatcaattggccccggagcgggaggtgcggctggagctggaggcgccgattgagcctggagctctggcagggctggggcggttggagcagatcgagggttgtgaggtacggctgctggtgccgcgcgaccagctcacagcggtggtggcgcagctgctcgaacgcttccccgtgcgcgacctggatgtgaccgatccaccgattgaagaactcatt

SEQ ID NO: 44699 - DNA, 909 bp, SYNECHOCOCCUS SP. WH 8102
aacccagccatggtctggaccgttgacgacatcccctcccaggaggagagagttgcgcttgtcacaggagcgaatagcggtctgggcctggccaccgcccgcgccatgagcgctcgcggggcgacggtgatcatggcttgccgctgccggcgcaaagctgaaacggcacggacgcagctgctggaagcggggctcaccggcctggatctgctggatcttgacctggcggacctcaacagcgtgcgtcgtgccgcagccgaggtgagtgatcgctatggccatctggatctgctgttcaacaacgccggggtgatggccccaccgcgtcagctgaccgttcagggccatgaactgcaactgggcgtgaaccacctgggccatatggccctcaccctgcaactgctgccgctgatgcagggccgcaacgatgcccgcgtggtgacggtgacctccggcgcccagtacttcggccgcattcgctgggacgacccaagctgggcacagggctacgaccgttacggcgcctacagccagagcaagctggccaatgtgatgttcgccctggaactggaggcacggcagcaggagcaaggcggcggcatccgctctctggcagcccaccccggcctggcccgtacggatctgcagccaacagcgatcgccagtggtggcaaccgtctggaggctgtggcctaccgcttgatggatcccttgttccaaagcgctgccatgggcgccttacctcagctgcatgccgccacagcagcgacagcgcaggggggagagcactacggcccagaccaactggggggaatgcgcggccacccaacccgctgccgcatcgctccggccgccctcgaccgtgagcagcgtcaacggctctggcaactcagcgaagaattggctggt

SEQ ID NO: 44700 - DNA, 819 bp, SYNECHOCOCCUS SP. WH 8102
ggcggcatcttcatgggatcccggcgcgacccagccggctgccgcgtcggcctgttcggcgttccctacgacggcaccacctcctttcggccaggcacccgtttcggacctgcagcgatccgtgaggtcagccaaggcctggaaacctattgcccgcagcttgatctggatctagaggatctggcctatgccgatctcggtgctgttgatatccccttcggtgcaccggaaccggtcgtgaacgccgtgcagcaggccacgacggctgtgctcgatctgggtctgaaacctctgatgctgggcggtgagcattcgatcagctccggcgctgtggccgccgttgccaaccaacatcccgatctggtgctggtgcagctggatgcccatgccgatctcagagaggagtggctcggtacccgccacagccacgcctgcgccatgcggcgctgcctggaggtgctgcccagtggcgacctgctgcagctggcgattcgcagcggcacccgcagcgaattccatgagctgcacagcagtggtcgacgcatggatgacgtccaggccctgagggatgccatggctccctggaccggccgcccgatttatctcaccgtggatctggactggtttgatccagccgttctgcctggaacgggtacccccgagccagggggcttcctatggggggatttcgcggccgtagttgatgtgctgagtggccatcggcttgtggctggcgacgtggtggaactggcaccgcaactcgacagcagtggggtcagctccgttctggccgccaaagtgacacgcagcctgattttg

SEQ ID NO: 44701 - DNA, 945 bp, SYNECHOCOCCUS SP. WH 8102
caacacgtggtgtcgattcaggcatttcgtgctgaaaccctgctccagttgtttcgactggcggcgaaattcgagagcaacccagaccgttactgccggcacaacacgccgctcaccggcaagatcctgatcaacgcgttctacgagcccagcacgcgcacacgcctttccttcgacagcgcctggcatcgcctcggcggtgattcgatcaacatcaccgatcgcagcaccaccggcatcgccaagggggagtcgctcgaggacgtggcgcacatgttcaacaactacggcgactgcgtggtgctacgcgacagcaatccggaggccgtgtacgccatgagttccaccctgcggattccgatcatcaatgccggtaatggcattgatgagcatccgacacaggcgatggcggatctctacacgatgttcaaatggcgtccaagccttgcttcgaaagaggtctccccgaaggatcggatccgcatcggggtgatcggtttgccgtcgcggatgcgcaccgtgcgttcgctgctgcggatcctcagcaaattcccccagatcctggaggaggtggtggtgatccatgcgcccgagatggagtcggaagcgcctttgtttgatccaggccagctggaggaactggaagcaagcgggatgtccatccgctgcagttcagatctggctgctgagattcccgatctggatgtcgtctacatcaatgcgattgcctgggttggcgacagctacgaggtgcacggcggtggatttcgtctcacccgggatctgccgttcaagccggaggcgatcgtgttgcatcccctggcccggggtcccgagctgagcacctgtctcgatgacacgccgcacaactggtatttcagccaggcgcgtggggcggtgtttgtgcgcatggcactgctcacctgcatggtgaatcgtgccgag

SEQ ID NO: 44702 - DNA, 2130 bp, SYNECHOCOCCUS SP. WH 8102
agtgttcgcagccagtgcccctactgcggtgtgggctgcggtcttgagctgctgcctccggccgtgaagggtcaagccgtgaagcgggatgcagaaggcaacccgatgtggaccgcccgcggcgaccgcgaacacccctccagccttggccaggtgtgcatcaagggggccaccgtcggcgaaaccctggccaggggacgactgcgacaaccgttgttccgcagcaagctcacggacgcctttgcgccgatcagctgggacgacgccctcgacaaaatcaccggacagatcaaggcgagcttggcccggcgcggcaatgccgatggcatcgccatgtacggctcagggcagttccacaccgaggattactacctggcccagaaactgctgaaaggcgccttgggcaccaacaatttcgatgccaactcgcggctgtgcatgagctcagcggtggccggctacacccgcagcctgggttccgatggcccgccctgcagctacgaggatctggatcactgcacggtggcctttctaatcggcaccaacaccgccgaatgccacccggtgctgttccagcggctgctgaagcggaaacgcaagaacccgggcagcgtcaagatcgtggtggtggacccacgccgcaccgacaccgcaaaggcggctgatattcacttgccgattgctccgggcagcgacctggccctgctacacggcatcgcccacctggtgctgcgggacaacggccaggatccagccttcatcgacaaccacaccgagaactacgacgcgttcttcgacgtggccgcccgctggacccccagacgggtggccctgttctgcaacatccccgagaaacgtctgcgggacgtggcggctctgtttcaccggcgccaaaaggtgctgagtttgtggtcgatgggggtgaaccagcgccgtgaaggaacggccgtggtgcaaggcctgatcaatctgcatctgctcaccggccagatcggcaacgaaggagcgggcccgttttccctgaccggccaacccaatgccatgggcggccgcgaagccggggggctcgcccacctgctgccgggctatcggttggtggccaaccctgagcaccgcgccgaggtggaacaggcctggaagctcccggctggccaaatcgccgccaagccggggcttgcagcgtggcagcaggtggaagcgatggaacgcggtgaccttgatctctggtgggtagccgccaccaacccgctggtgagcatgccggacctggatcgggtcaaacaggccatgggcaactgcccgttggtggtggtgagcgaggcctacgccgactcagaaacgtcccactacgcccacctgctgctgccagccgcccaatggagtgagaaggccggcgccatgaccaattccgagcggcgtgtgaccttctgtcctgcctaccgcctccgcttcggggaaagccgtccggactgggaagtgttcgcggacgtgggtcgccggttgggttacaccgagcagttccgcttcgactcggctgccgaggtgtacgccgaattcacccgactcacccagggacgcctctgtgacgtcagtggcctcagccacgaactgcttgagcaagcggggcctcagcaatggccttatcccatgggcagcatccccagcacagcagccaaacgcctctacgaaaaccatctgttcgcgacccccagcggccgggcgcgtttcagcaccgaccagcctttaggcctggcagaacccccctgcgacacctacccattggtgctgaccgtcggtcgatacctggggcagtggcacacgatgacccggaccgggaaagtggagcggctgatgaaacagcaccctgagccattgctggagattcatccaagcgatgcccaggaactacaactgcgcaacggcgagctggctgcgatcagctcgcgccgcggccacctcacagccacggtgaaggtgaccgatcgcatccgctgcggaactgtgttcctgccgatgcactggggattcacccaggagaaggcttgcgaagccaacacgctgatgcatgacgatgcctgcccggtgtccaagcaaccggaactgaaagcctgcgctgtgatcgtggcgccg

SEQ ID NO: 44703 - DNA, 1477 bp, SYNECHOCOCCUS SP. WH 8102
aaattgaataagattgaaaaaagtaagttggaaaaagatgggcttttagtaggaagcgaaatcgaaaagtttgcaaaaattgggtgggaaaatatggatgaaaccgacttaaaactccgtctgaaatggtatggaatgttctggcgtccgaaaacacccggaaaattcatgctaagacttagaataccaaatggtgtattgacatccaatcaaatacgagttgtagcttcaatagttgaacgttatggagaaaatggaagctgcgacatcaccacaaggcaaaacctgcaacttagaggaatactattatgcgatcttcccgagatccttagaagactgcgtgaagccggactaagtagcatccagtcgggctttgataatccacgaaacgtaaccggcaatccactcgcaggaatagatccgaacgaaatcgtcgatacgagaccttacacaactaaattgcagaactttctcacaaataattgtgagggaaattcggaatattccaacctaccgagaaaatggaacacagcagttgcaggatctaaagacaatttccttcttcacaacgacatagtgtttcatcccgttgagaataacggcgtgatgggttttagcatctggattggagggattttatctccacagatgaacgcatatgcatttcccatgaatgtatgggtattacctgacgagatctgcaacattttggatactgtgattcgtctctggagagacaatggagaaagagagaagagaaccaagggacgtttccgcatgtatctcgatgagatagggcacgaggaattccgcagccaagtggaaaaactgtacggaacactcactcccgatccaggctcaatattcgaaaactctccacgctctcacttcggcattaatcagcagaaacaagccggactttattttgctggcatacacgtgccggtcggtcgcctcacggcagaggatctacaagatatcgcaacagcgagtctcaaatatggaaatggagaaattagactcacagaagaccaaaatataattatcacaggtcttacgagtgaaaaagttgaagaattaaagactgatacattattgcagcgtttccccctagcacctagcaatatttcagcaggaacagtgtcctgcacgggaaatacttactgtagttttgcgcttaccaacactaaagaccaagccttaaaagcagcaaaggaacttgacgaggagttgaatctacctgaagagataaaagttcactggactggctgcccaaatacatgtggacaggcttatatgggagcaataggtttaacaggtacaaggctaaaaatgctgaaggagtaatgggtgaaggctacacaatgactattggtggttcacagggtcgcaacccaactattggtcaaatctatcgcaagctatacctgcggctgaaatcaaacagcccttaaggaagtacttatttcaaatttgg

SEQ ID NO: 44704 - DNA, 1032 bp, SYNECHOCOCCUS SP. WH 8102
gatttgcatgtggtggagacccgtccgctggtggctccggctctgctgcacggagatctgccgattgatgccgccgccacggagacggtcgcatcggcccgtcgtcggatccaggccattttgcgcggcgatgatcagcgtcagctggtggtggtgggcccctgctcggtccacgatgtgaaggcggcgcgggagtacgccgaacggctggccccgatccgggaacggctgaaggatcagctggaggtggtgatgcgggtttatttcgaaaagccgcgtacgacggttggttggaaaggcctcatcaatgacccccacctcgatggctcgtacgacatcaacacaggcctgaggcgggctcgtggcttactgctggacctgtccagggagggcatgccggcagcgacggaactgctggatccggtggttccccagtacatcgctgatctgatcagctggactgcgatcggagcccgcaccacggaaagccagacccatcgggagatggcttcaggcttgtcgatgccgatcggctacaagaacagtaccgatggcagcgcctgcatcgccatcaatgcgatgcaggcggcatcgaaacctcatcattttctgggaatcaaccacgacggccatgcctcgatcgtgagcacgactggcaacccggatggtcatctagtgctgcgtggcggtcatcagggcagcaactaccacctggaggccgttcaggctgctgcagcggaactgagcaaggcgggcctgaaggatcgtctgatggtggactgcagccatgccaactcgaacaaggatttccgccgccaggccgatgtactcgccacggtggctgatcagttgaaggctggttccggccatgtgatgggcgtgatgatcgaaagtcatctggtggaaggcaatcagaaactgaccgctggtctctcccagctcacctatggccagagcattacggatgcctgcatcagcctggagaccacggatgcgctgctgtcccagctggctgcagccgtggccgatcgc

SEQ ID NO: 44705 - DNA, 1911 bp, SYNECHOCOCCUS SP. WH 8102
atgggcaaggttgtcggcattgaccttggcaccacgaacagttgcgtgtccgtgatggaaggtggcaaacccaccgtcatcgcgaacgccgagggtttccggaccacgccctccgtcgtggcttacaccaagaaccaggaccagttggtcggtcagatcgccaagcgtcaggcggtgatgaatccggacaacaccttttattccgtcaagcgcttcatcggccgtcgtgttgatgaggtgaacgaggaatccaaggaagtgagctacggcgtcgagaaggccggctccaacgtgaaggtgaagtgcccggttctcgacaagcaattcgctcctgaggaagtttccgcccaggtgctacgcaagctggccgaggacgccggtaaatatctcggtgagaccgtcacccaggcggtgatcactgttcccgcctacttcaacgattcccagcgtcaggccaccaaggacgccggcaagatcgccggcctcgaggtgctgcggatcatcaacgagcccaccgcggcggctctggcctatggcctcgacaagaagagcaacgagcgcatccttgttttcgatctgggcggcggcaccttcgacgtgtctgtgctcgaggtgggtgacggagtatttgaggtgctctccacctccggtgatacgcacctgggtggcgatgacttcgacaaagtgatcgtcgatcacttggctgagaccttcaagtcgaacgaaggcattgacctgcgtcaggacaagcaggctctgcagcgtctgactgaggcggccgaaaaggccaagatcgagctgtccagcgccacgcagagtgagatcaacctgccgttcatcacggcaacgcccgagggtcccaagcatctggacctcaccctcacccgcgccaagttcgaggagttggccgccaacctgatcgaccgctgccgcatccctgtggagcaggcgctcaaggacgccaagctctcctccagtgagctggacgagatcgtgatggtgggtggttccacccgtatcccggccgtgctggagctggtgaagcgcaccaccagcaaggaccccaaccagaccgtcaaccccgacgaggtggtggccgtcggcgccgccattcagggcggtgtgctggccggtgaggtcaaagacatcctgctgctcgacgtcacaccgctgtccctgggtgtcgagaccctcggtggtgtgatgaccaagatgatcacccgcaacaccacggttcccaccaagaaaaccgagacctactccacggcggtggatggtcagacgaacgtggagattcacgtgctccagggtgagcgcgagatggcctccgacaacaagtccctgggaaccttccgtctcgatggcattcctccggctccccggggtgtgcctcagatcgaggtgaccttcgacatcgacgccaacggcatcctgagcgtcaccgccaaggacaagggcagcggcaaggagcagtcgatctcgatcaccggtgcgtcgaccctctcggattccgaggtggacaagatggtgaaggacgctgaggccaacgccagcgccgacaaggagaagcgcgaaaagatcgacctgaagaaccaggccgaaacccttgtttatcaggctgaaaagcagatgggcgaactcggcgacaaggtcgaggctgatgccaaggccaaggtcgacgagaagcgcacgaagcttcaggaggccatcaacgctgaggactacgacgcgatgaagaccctgctggaggaattgcagcaggagctctacaccgtgggtgcctccgtttatcagcaggagggtgctgctgctggtggtgcagctcccggtggcgacgctggagcaagcgcggcctccggcggtggtgacgccagcgatgacgtcatcgacgcggagttcacggaaaccaag

SEQ ID NO: 44706 - DNA, 843 bp, SYNECHOCOCCUS SP. WH 8102
atcaacggcagcactggtttggtggggctgctcggcaacccggtgcagcactcgctctctcctgcgatgcagaacgcggcactgcaggcgctgggactgaactggcgttacctggcactgccctgtgaggagaacgctctccctcaagtgatggaggggctcagggcggtgggctgccatggcctgaatgtgaccatcccccacaaacaggcggtgaccagcctctgcagccaactcagcacagctgcccgtcggcttcaggcggtcaacacgctgatccccgatggtgagaatggctggtgcggcaccaacacagatgtggaggggtttttggcacccctcggcggcagcgaacgctggagagatcaacgggccgtggtgctcggctgcggcggttccgcccgagctgtggtggctggtttacagacccttggcttggcatcgattcaggtgatcggacgacgtccgaaggcgctgttgaacttcattgctgacctgcagctggaggacgcccctctgagcagctgcctcgaaacagatcccgccgcggctgatcttctggccacagctgatctggtggtgaacacaacgccggtgggcatggccctgcacggcgacgcctccgccatgcccctgggctctgatctctgggacaggcttgcgaagcaggccaccctttatgacctgatttacaccccacgtcccaccgcctggctgcgttggggtcaggggcgggggcaccgttgcatcgatgggctggaaatgctggtccagcagggcgccgcatctctgagactttggagcggcttcaatgacgttcccgtggacaccatgcgccacgcg

SEQ ID NO: 44707 - DNA, 1200 bp, SYNECHOCOCCUS SP. WH 8102
atgggccgcgccaacaaggtggttctcgcctactccggcggggtggataccagcgtctgcattccctatttgaagcaggaatggggtgttgaagaggtcatcaccttcgccgctgatctcggccagggcgatgagctggaaccgattcgtcaaaaggccctggatgcgggcgcaagtcagtcgttggtgggggatctgattcagcccttcatcgaagagttcgccttccctgccatccgcgctaacgcgctgtacgaggggcgctaccccctctccacagcattggcgcggccgttgatcgctcgccgattggtggaggtggcccgtgaggtgggtgctgatgcagtggcccatggctgcactggcaagggcaacgaccaggtgcgcttcgatgtggcgattgctgctcttgctcccgatctgaaggtgctgacccccgcgagggagtgggggatgagccgtgaggagaccattgcctatggcgagcgctgcggaatcccggcgccggtgagcaagaagtcgccctactcgatcgatctcaaccttctgggtcgcagcatcgaggcgggaccgcttgaagatccgatggtggcgcctccggaggaggtgttcgccatgacctcaccgatgtcggatacgcctgatgcggcggaggagatcgagattgccttcgaagccggcaaccccgtcgccatcaatggccaggttctggatccggtggcgatgatccgcgaagccaaccgtctggcgggcagtcacggcatcggccgtctcgacatgatcgagaaccgggtggtggggattaaatccagggagatctacgaaacaccgggcttgctgctgttgattcaggcccatcaggaactggagagtttgacgttggccgcggatgttctgcgcagcaaacgtcagctggagatgcagtgggctgacctggtgtatcaggggctgtggttcgggccgctgaaggatgcattggacggtttcatggaccggacccagcagcatgtcaacggcgtcgtgcgcctgcgtctgtacaagggcaatgccacggtcatcggccgcggttcaacccagagcagcctgtatgtgcctgcgatggcgtcctacggcagtgaagacgccttcgaccatcgcgccgctgagggattcatctacgtctggggattgccaacccgtctctgggctgcttcccaacgg

SEQ ID NO: 44708 - DNA, 2100 bp, SYNECHOCOCCUS SP. WH 8102
gtccttcatctgcacttgtacggtctgttccgttcccgggatctggagcttggtcgtgatgcggacaccggcggccagaccctctacgtgctggatctcgtgcgcagcctggcccagcgtcccgaggttgatcgggtcgatgtggtgacacgtcttgtgcaggaccgtcgggttgccgcggactatgagcgcccactcgaggtgattgctcccggtgctcgaatcctgcgctttccgtttggtccgaagcgttatctgcgcaaggaacagctttggccgcatctggaagatcttgccgatcagctggtgcatcacctcacccagcccggccacgaggtggattggattcacgcccattacgccgatgccggtttcgtcggggctctggtgagccaacggcttggtttacccctggtattcaccggtcattcccttggccgcgaaaagcaacgtcgtcttctcgccggcggtggcgatcgtcaacagatcgaacaggcctacgccatgagccgtcggattgaagcggaggagcaggcactcacccaggcggatctggtgatcaccagcacgcagcaggaagctgacctgcaatacgcccgctattcgcagtttcgtcgtgatcgcgtccaggtgatcccgcccggcgtggatgccggacgctttcaccccgtttcttccgccgctgaaggggatgctctcgatcagttgctcagcccctttcttcgcgatcccagcaagcctcccttgttggcgatttcccgtgctgtccgccgcaagaacatcccggctctgttggaagccttcggatcctcatcggtgctgcgggaccgccacaatctcgtgttggtgctggggtgccgtgaagatccccgacagatggagaagcagcaacgggatgtgttccagcaggtgttcgatctcgtcgatcgttacgacctctacggctcggtcgcctatccgaaacagcatcgccgctcgcaggtgccggccttctatcgctgggcagttcaacggggaggtctgtttgttaaccctgcgctgacggaaccattcggtctcacgttgctggaggccgcggcctgtggtctgccgatggtcgctaccgatgacggtggtcctcgcgatattcaggcccgctgtgagaacggcctgttggtggatgtaatcgatgccggtgccttgcaggaggcgctggaacgggctggcaaggatgccagtcgctggcggcgctggagtgacaacggcgtggaggcggtgtcgcgacatttcagttgggatgcccatgtctgtcgctatctgggactgatgcaagcccatctgcatcagctgccatcagtcggtccaaggcctcagggttccccggcctcatcgcatcggccggatcatctgttgttgctggatctcgacagcaccctcgattgtcccgatggcccgtcgctcaccgctttgcgcagccagcttgaacgcgatggtcagcgctacggcttggggatcctgaccggtcgatcattggcggcggcgcggcagcgctacggcgatctgcatctgccctcgccgttggtctggatcagccgggcaggcagtgagattcacctgggcgaggatcttcagcccgatcacatctgggcgcagcacatcgataccgattggcagcgtgaatccgtggaggctgtgatggaggatctccacgaccttttagaacttcaaagcgaagagcatcaggggccctggaagctgagttacctgcaacgtcagccggatgaatcggtgttgagccacgtgcgtcagcggctgaggcgggagggtctatcggctcggcctcaacggcgctgccactggtatctggacgtccttcctcggctggcgtcccgcagtgaggcgattcgtcacctagctctgcattggcagctgcccctcgagagggtcatggtgatggccagtcagcagggtgatggtgagttgctccgggggctgccggccacggtggtaccggcagatcatgatccctgcctcgtgcgccatcctcaacagaaacgggtgctgctttcaggtcgccccagccttgcggccgtgctggatggattaagtcattaccggttt

SEQ ID NO: 44709 - DNA, 1047 bp, SYNECHOCOCCUS SP. WH 8102
tggcccggtctgatcgaggcctacagagcttggctaccggtgacctccaccacgcccgtgatcaccctcagggagggggcgactccactgatccctgtacccgcaatcgaggagcggatcggcaagggtgtgaaggtcttcgtcaagtacgacggtctcaacccgaccggatccttcaaggatcggggcatgaccatggccatcagcaaggccaaggaagccggctgcgaggctgtgatctgcgccagtaccggcaacaccagtgcagcagccgcggcctacgcccgtcgcggtggcatgcgggccttcgtgctgatccccgacggatacgtcgcccagggaaaactggcgcaggccctcgtctacggcgctgaggttctggcgattcgcggcaatttcgaccgcgctctggacatcgttcgcgaagcagcggagaagtaccccgtgacgctggtgaactcagtgaacccctaccgacttcagggccagaaaaccgctgcctttgaagtcgtcgatgcccttggtgatgcccccgattggctgtgcatccccatgggcaacgccggcaacatcacggcctactggatggggttccaggaataccgacaagccggtcacagccgcacactgccgcgcatgatgggcttccaggccagcggctccgcaccgttggtcaacgacaccaccgtgagcgatccggacacgattgcaaccgcgattcgcatcggcaatccggtgaaccgcgccaaagcgatcgccgctcgtcaagccagcaacggtgccttcctcgacgtcaccgatgccgaaatcattgaggcctacaagcttctgggtggccaggaaggcatcttctgcgaaccggccagtgcagcctccgtcgcaggtctgttaaagcggaaagatgaggtcccggcgggagcgaccgtggtctgcgtgctcaccggcaatggcctgaaggatccggattgcgccatcaacaacaacgatgccgccttccatacagacctgaaccccgatctcgccacggtggcgggagtcatgggtttt

SEQ ID NO: 44710 - DNA, 1368 bp, SYNECHOCOCCUS SP. WH 8102
tggagtgatcgtttcgaacagggactgcatcccttcgtcgaagcgttcaatgcgtccatcggttttgatctgacgctgcttcaggaggacctggacggctccattgcccatgcccggatgctggcgagttgcggggtgattgcagaggaagaggccgttcagctggtggacggtctggagttgatccgaacggaggcagccgacggtcgcttcaatccaggcctggaggatgaggacgttcatttcgccgtggagcggcggttgatcgctttggtgggttccgtgggcaaaaagctccacacggggcgcagccgcaatgatcaagtggggacggatcttcggctgtggctccggcgcaggctcgatgagatcgatggcgatctgcaacggcttcaaagggctttgctggatcaggcggatcggcaccagtccacgatgattcccggttacacccatctccagcgtgctcagccgctgtgtctggcgcatcatctgctcgcttacatcgagatgctccaacgggatcgtcagcgtcttggcgacgtccgtgggcgcgtcaatatttgtccgctaggggctgcagctctggcgggtacaccggtaccgattgatcgccgccggacggctgaggatcttggcttcacagcgatttacgccaacagcctcgatgccgtcagtgaccgtgatttttgtgttgaattttcagcggctgcatccctggtgatggctcatctgagccgtctggcagaggaggtgatcgcctgggcgtcggaggaatttggttttgtgcggctgagcgatcgctgtgccacgggcagcagcttgatgccgcagaagaagaaccccgatgtgccggagttggtcaggggtaaatgcggccgtgtctttggccatctgcagggactgctgacgatgatcaaaggccttcctttggcttacaacaaggatttccaggaagacaaggaagcgctgtttgatgcctatcggaccacacgtgactgtgtggaagcgatggcgatcttgtttgaggaggggttggagttccgcatcgaccgtctcaatcaggcggtggaaagcgatttttccaatgccactgatgttgccgattatctcgtggctcgtggtgttccctttcgcgaggcatatcaattggtcggggctgttgttcgccgttgccttgagcaggattgtctactgcgggaactcagcctcgagcaatggaaggagatccaccctgcctttgaggccgatctgcacgaggcactcgctccacgggcggtggtgtcggcccgtcgcagtgaaggaggaacgggatttgatcgggttcatgagcaggtcatgctttggcaagaacgcctcaaagaatct

SEQ ID NO: 44711 - DNA, 1050 bp, SYNECHOCOCCUS SP. WH 8102
gactactacgacctgctgggggtcggacgtgatgctgatgccgatacgttgaagcgtgcctatcgcagcaaggcacgcaaataccacccggacatcaataaggagcctggggcggaagaccgcttcaaggagatcggtcgtgcctacgaggtgctgagcgaccctcagacccgtgcccgttacgaccaattcggtgaagctggtctcgggggtgcggccggtgcttcggatatgggggacatgggcggcttcgccgacctgttcgaaaccttcttccagggcttcggaggtcccggaggggccgccgccggtcgctccggacgtcgcggtccccagcagggcgatgaccttcgctacgacctcacgattgattttgagcaggcggtcttcggtcaggaacaggagatcaagatcccccacctcgaaacctgtgatacctgcggtggcagcggagccaaggcgggcagcggtcccaccacttgcggcacctgcggaggagccggtcaggtgcggcgggcgacccggactcccttcggaagcttcacgcaggtggcggaatgccccaattgcggcggaaccgggcaggtgatcgctgatccctgcaacgcctgcggtggacagggcgtgcgtcaggtgcgcaagaaactgcgcatcaacattcccgccggagtggacaccggaacccggcttcgggtttccggagaaggcaatgctggtcagcgtggggggccgtccggcgatctttacgtcttcctcacggtcaagtctcatccacggctgcgcagagacggtctcaacatcctgtcgaccgtgaacgtcagttatctgcaggcgatcctgggggacacgattgaagtggaaaccgttgatggcgacacagttctggagattcccccgggcactcaacccggtaccgttctgaccctggccaacaagggcatacccaagttggggaacccggtggcccgtggggatcaaagggtgcaagtgatggtgcagcttcccacgcgtctgtcggatcccgaacgaacgctgctggaggagttggcg

SEQ ID NO: 44712 - DNA, 1147 bp, SYNECHOCOCCUS SP. WH 8102
tctggactgagacggatcggatccactttgaggttgatccagaaaagaaaaaactcagatttttggccaatttctgtatgatcggcggccaaatcccttacgcggcaaccccgctcctgtcatgaccctgcgcgttgcgatcaatggattcggccgaattggtcgcaatgtgatgcggggttggatcagccgtggtgctgatacgggcctggagatcgtgggtatgaactccacgtccgatcccaagaccagcgctcacctgctgacctacgactcgatccttggcaagctcgatcccagcgtcaagatcgaaaccaccgacgacaccatgctggtcaacggcaaggagatcaagttcttcgctgaccgcaaccccctgaactgcccttggaaggactggggtgtcgatctggtgatcgaatccactggtgtgttcaacaccgacgaaaaagccagcatgcacctcgaggcaggcgccagcaaggtgatcctgactgcccctggcaaaggtgatggcgtcggcactttcgtggtgggagtcaatgacgaccagtaccgccatgaggactggaacatcctctccaacgccagctgcaccaccaactgcctggcccccatcgtcaaggttctggatcagaacttcggcctcgactggggtctgatgaccaccatccacagctacaccggcgaccagcggatcctggacaacagccaccgcgacctgcgtcgcgcccgtgctgctgctctgaacatggtccccaccaccaccggtgcggccaaggctgtggccctggtataccccgaggtgaagggcaagctcaccggtttcgccatgcgcgttcccacccccaacgtatctgccgttgacctcaccttcggaccgtcccgtgccaccagcgttgatgaggtgaaggctgtgatcaaggccgcttctgagaacggcatgaagggcatcatcaagtacagcgacctgcccctggtctccaccgattacgccggcaccaacgaatccacaatctttgatgccgacctcacctacgcgatgggcgacaaggctgtgaagatcctggcctggtacgacaacgagtggggttacagccagcgcgttgttgatctggctgaagtggtggcccgcaactggaagtga

SEQ ID NO: 44713 - DNA, 1182 bp, SYNECHOCOCCUS SP. WH 8102
gtgaaagttctcgttctcggcggtgacggcttttgcggctggccctgtgcggtgaacctggcggatcagggccatgacgtgctgatcgtggacaacctcagtcgccggaagatcgacatcgatctggaggttgagtcgctcacgccgatcgtcagcattggtgaacggctgaaggcctgggaggagatcggcggcaagccgatgcgcttcgtgcacatggatatcgcccacgaatatcagaggctgctggatctgctgctggaggagaagccggactcgattgttcatttcgccgaacagcgggccgcgccctattcgatgaaaagcagcgccaccaagcgctacaccgtcgacaacaacgtcaacggcacccacaacctgctggccgccatcgtggaaagcgggcaggacatccatgtggtgcacctgggcaccatgggcgtctacggctacggctcccaccgcggtgccaccatccccgagggctacctcaaggtggaagttccccagccggacggcagccgtttcgaggaggagatccttcaccccgccagcccggggagcgtctatcacatgacgaagacgctggatcagcttctcttcctttactacaacaagaacgacaaggtccggatcacagatctgcatcagggcatcgtttggggcaccaacaccgacgccaccgatcgcgacccacgcctgaccaaccgcttcgattacgacggcgactacggcacggtgctgaaccgcttcttgatgcaagcggccatcggttaccccctcacggtgcatggcaccggcggccagacccgtgccttcattcacatccgcgattcggtgcggtgcgtccagttggctatggagaacccccccacccagggcgagcgggtgaagatcttcaaccagatgacggaaagccaccaggtgggcgaactggccaagaaggtggccgccctcaccggtgcgcaggtgaacaacctgcccaacccccgcaatgaggccgtcgaaaacgacctgatcgtggacaaccgctgctttatcgagctgggtctcaatcccaccaccctcgatgacggactgctgaaggaagtggtggaaatcgccacccgcttcgccgaccgctgcgaccgcaaccgcatcctctgcacctctgcctggactaagacccaggcacaagccatc

SEQ ID NO: 44714 - DNA, 825 bp, SYNECHOCOCCUS SP. WH 8102
gtgaacgctgcggcgtttgagggagtggatcttgtgctggcctccgctggcgggtcggtgtcgcggcagtggcgtgacgcgatcaccgccgcgggtgcagtgatggtggataactccagtgccttccgcatggaagagggtgttcctctggtggtgccggaggtcaatcccgatgcagcgttggcccacaacggggtgatcgccaaccccaactgcaccacgatcctgctcaccctcgccctggcgcctctggccgctagacgcccgatgcgacgggttgtggtgagtacctatcagtccgccagcggtgccggcgcccgggcgatggaggagctcaaaaccctgtcgcagaccgtgctcgatggaggcaccccccaaggagaggtgctgccctactcactggccttcaatctgttcctgcacaactctccgctgcaggccaacagctactgcgaggaggagatgaagatggtgaacgagacccgcaagatcatggatctgccggatctccgtttcacggccacctgcgtgcgtgttccggtgctgcgggcccattccgaggccgtcaacatcgaatttgagcagccgttcccggtggaggaggcgcgttctctgttgagcgcggcccctggcgttgagttgatcgaggatccggccaccaaccgcttccccatgcccaccgatgtcacgggccgggatccggttgctgtggggcgcatccgtcaggacatcagcgatccgaacgctctggagttgtggctctgcggtgatcagatccgcaagggagcggccctgaatgccgttcagctcgccgaactgctgctg

SEQ ID NO: 44715 - DNA, 906 bp, SYNECHOCOCCUS SP. WH 8102
atgacttcccccgctgccctgtctcccacaccctttggccgcgttgtcacggcgatggtcacgccgtttgatgattcgggtgcggtggatcttcccctggcgggacgcttggctcgtcatcttgtggagcagggttccgatggcctggtggtgagcggtaccaccggtgaatctcccaccctgagctggcaggagcagttgcagttgctgcaggccgtgcgtgaggcggtgggttcggatgcccaggtgctggctggcaccggcagcaactgcaccgctgaggcggtcgaggccacccggcaagctgccgccgccggtgccgatggcgcgctggtggtggttccgtattacaacaaaccccctcaggacggcctggctgctcatttccgtgccatcgccgaggcagcaccagaactgccactgatgctctacaacattcctgggcggacgggatgcagcatggcgccggagacggtggcgcagctgatggactgccccaacgtcgtcagtttcaaggccgccagtggcaccaccgaggaggtcacggccctgcggctggcctgcagttcgaagcttgcgatctacagcggtgacgacggcctcaccctgccgatgatctccgttggagccgtgggtgtggtgagtgtggccagtcatgtggtcggcccccagatccgcgccatgattgatgcctacatgcagggcgacgcagccgtcgcccttgcccttcacgaacagctgcagcctgtgttcaaggccctgttcgccaccaccaatccgattccggtcaaagccgcgcttcaactcaacggctggtccgtcggcgatccccgtccacccttgtctcccttacctgacgacatgagatcaacccttgcccaaaccatggctgcccttcgtcagacc

SEQ ID NO: 44716 - DNA, 1755 bp, SYNECHOCOCCUS SP. WH 8102
atggccctcctggtgcagaagttcggcggcacctccgtcggcagtgtcgagcgcatccaggcggtcgccgagcggatcagccgcagccgcgaggagggccacgacgtggtggtggtggtgtcggccatgggccacaccaccgatgaactcaccggactggcggccgccatcaccgacaccccacagcaacgggagatggacatgctgctggccagcggcgagcaggtgtccattgccctgctggccatggccctgaaccaacaaggggttgctgctgtctcgatgacagggccccaggtgggcatcgtgaccgaatccactcacggccgggcccgcatcctcgagatccgcaccgatcgcatccgcggccacttggccgatggccgtgtggtggtggtggccggcttccagggcaccagcagcggcattggcggtgtggcggagatcaccaccttgggccgcggcggctccgacacctccgccgtcgccctggcggcagccttgaacgccgatgcctgtgagatctacaccgatgtgccgggggtgctcagcaccgatccccgcaaggtggctgatgcccagctgatggatgagatcagctgcgatgaaatgctcgagctggccagcctcggtgcttctgtgctgcatccccgggcggtggagatcgcccgcaattacggcgtgctgatggtggtgcgctccagctggagcgaagcccccggcacccgcctcaccagccgccgcggccggccgctcaaccagaccgggctcgaactgggcagccctgtcgatggcgtggagcagatggaccatcaagcggtgatcgcgctgtcgcacatccccgatcaacccggcattgccgcccgcctgttcgaaaccctctcgggtgctggcatcaacgtggatctgatcatccagtccacccacgagggcagcagcaacgacatcaccttcaccgtggcggaagctgatctggaggccgcccgcagcgtcagccagaccgtgctggacagccttggtggcgagctggccgctgaaggcggcatgaccaagctgagcatcagtggcgccggaatcatggggcgcccaggcatcgccgccggcttattccactgcctctcacagcagggcatcaacctgcgcctgatcgccacgagcgaagtgaaggtgagctgcgtgatcgatgccgactccggccgcaaggcgcttcaggcggtgcaggaggccttcgatgtggcggacgcgcaggtggagctcaaccccgatctgagcattagcgacgtgccagaagtgcgcggggttgccctcgatcgtgaccaggcccagctatctgtccggcacgtaccagaccgccccggcaccgccgctgccctttgttccgccctggcggaacggggaatcagcctcgatgccatcgtccaatcggagcgtcaacacacggacggctcgcgtgacatcagtttcatcctgcgcaaggaggaccgcagccgcgctgatgtggccctggcaccgctgctggcgcaatggcccggagcggcattggaagagggcgaatcaatcgcccgggtgagcgccgtcggcgccggcatgcccgccaccccgggaacagccggccggatgttccgtgccctggccgatgccggcatcaacatcgccttgatcgccaccagcgagatccgcaccagctgcgtggtggccgaacaggacggtgtggcagccctgcaggccgttcacgccggcttcggcttggggggc

SEQ ID NO: 44717 - DNA, 2433 bp, SYNECHOCOCCUS SP. WH 8102
gttgatccgcagcagctcacacccatgctgcgtcactacgtggagctcaaggccgcccatcccgaacgggtgctgctctaccggctgggggatttctttgagtgcttctttgaagacgccatcaccctgtcgcggctgctggaactcaccctcaccggcaaggagggcggcaaggccgttggtcgtgtaccgatggccggcattccccaccatgccgctgagcgctattgcggagagctgatccgccgcggcttcagtgtggccctctgcgaccagctggaaaccaccccggcaaagggggctctgctcaagcgcgacatcactcgggtgctcacccccggcaccgtgctggaggagggcatgctcagctcccgccgcaacaactggctggcggcggtggtgatcgagccagcccacagagatgagccattccgctggggcctggccagcgctgatgtgagcaccggcgaggtgcaggtgatgcagcggcaggacagcgacgccttgcaccagcaactggctcagctaggggctgccgaactgctcagcagcacacccgagagcaaccccgcctggtgccccgaccagctgcggctgacttcagtcgccagtacccctttcagccgccctgcagccgaagcggccctgctgcgccactacaaactcgccaacctggatggcctggggctgccggagctaccccttgccctacgggcgatggggggtctactggcctatctgcgcgacacccagccgctggaggagaacgccagcgtgccgctggaggtgcctgcgatcgtgcaacggggcgatgccctggtgctcgatgcccagacccgccgcaacctggaactaaccgccacccagcgtgatgggtccctgcagggatcactgctctgggcgatcgaccgcaccctcaccgccatggggggccgctgcctgcgccgctggctcgaagcaccactgatggatctcgatgccatccgtcaacgccagcagctggtgagcaccctggtggaacaacgcaacctgcgccaggcgctgcggcggttgctgcggccgatgggggatctggaacggctggcgggacgggccggcgccggccatgccggcgcccgtgacctggtggccattgccgacggcctggagcgactgccgcaactggccgcccgcctggagggcaccatcatcagaggtcccgactggctcgacgacctgctgcagcccgacccagcactgcaggatcttgccagcagcatccgtcacaccctgctggagagcccacccctgtcgctcagtgaagggggactgatccacgacggtgttgacccgctgctcgatggtctgcgcaaccagctggatgaccaggacgcctggctcagtcagcaggagaaacaggagcgccagcgttccggcaacagcaacctgcggctgcagtaccaccgcaccttcggctacttcctggcggtgagcaaagccaaggccagcgccgtgcctgaccactggatccgtcgccagaccctggccaacgaagagcgcttcatcaccccggccctgaaagaacgggaggggcgcatcttccagctgcgggcccgcgcctgccaacgcgaatacgaactgttctgcaccttgcgggagcaggtgggtgccctggcggcatcgatccgccgcgctgcccgggccgttgccggccttgatgccctgaccggccttgcggatacggccgccagcggggcttactgcgcaccggagttggtggagggccgtgcgttatccctcagcgaggcccgccacccggtggtggagcagctgctggtggagacccgcttcaccgccaacgacgtccatctcggcagtggcactgatctggtggtgctcaccggccccaacgccagcggcaagagctgctatctgcgacagatcggcctgattcaactgctggcccagatcggcagctgggtaccagcggccaaggcccgcatcggcatcgctgatcggatcttcacccgcgttggcgccgtggacgacctagccgccggccagtccaccttcatggtggaaatggccgaaaccgccaacatccttcaccacgccacggaactctccctggtgctgctggatgagatcggccggggcaccgccaccttcgacggcctctcgatcgcctgggcggtgagcgaacacctggccggcgatttacgggcacgcaccgtgttcgccacccattaccacgagctcaacaacctggcgaacgaacgcgccaacgtggccaacttccaggtgctggtggaggaaaccggcgacgacctcctcttcctgcaccgggtgagccaaggcggtgccagccgcagctacggcattgaagcggcccgcctggccggggtgcccacccccgtcgtgcagcgggcccggcaagtgctggatcagatcgag

SEQ ID NO: 44718 - DNA, 888 bp, SYNECHOCOCCUS SP. WH 8102
gtggtttgccttggggaagccttgatcgatcggttggggcccccaggaggtgatccggccatcgatggtccgctcgacgatcgtctcggcggggcacccgccaacgtggcctgtgggttggcgcgattgggaacaagcgtcgcttttctgggccggctgggtgctgacgccattggcgatcgtttcgcaacgttgtttcttcaacgaggtgtcgatgtcgactcagtgcagtgggatgcacagcgtccctctcgcattgtgctggtgcgtcgcagcgctgatggtgagcggcagtttcgagggtttgccggcgatgaagggctgggctttgccgatcaggccctcgcatcagtggaattgcccaagcaagcccgatggttgctcacaggcaccctccctttggctgctcatgcctctgcagattccctgcgcggagctgtagctcagtccaaggcacgaggcattgctctcgctgtggatgtgaactggcgccccaccttttgggacagtgcggcccgcccggacgctgggccttctcagcaggccatcgagctgatccgacccctgctggagcaggcggccctgatcaagctggcccgtgaggaggcgatctggttgtttggttcaacggacccgcgggccatctgtacccagctcccccaggagccggatgtggtggtgacggacggtgctgaaccggtgcgttggtggatggatggtgcatctggcacgcagcctgcttttcacccgccgcaggtggtcgacaccaccggcgctggtgatgccttcaccgcaggcttgttgcatcgttggtccgcgtcccctgctgaacgggttcgattcgcctccgcctgcggtgctctggtctgcgctggtgccggtgggatt

SEQ ID NO: 44719 - DNA, 1383 bp, SYNECHOCOCCUS SP. WH 8102
gattgcgttattgccgacatcaatcaggccgccttcggccgtaaggagctcgacatcgccgagaccgaaatgcccggtctgatggcgctgcgcgagaagtacggcacggagaagccgctgaagggcgcccgcatcgcaggctctctgcacatgacgatccagaccgcctgtctgattgagaccctggtggagctgggcgccgaggtgcgctgggcctcctgcaacatcttctctacccaggatcacgccgctgctgccattgcagcccaaaacattccggtgttcgcagttaagggtgaaacccttgaggagtactgggagtacacccaccgcatcctcgagtggggcgacggtggttcccccaacatgatcctggacgacggtggtgatgccaccggtctggtgatgctgggcagcaaggccgagcaggacatcaccgttctggacaacccctccaacgaagaggagaccttcctgttcgcgtcgatcaagaagaagctggcccaggaccccaccttctattcacggaccaaagccgagatccagggcgtcacggaagagaccaccacgggtgtggctcgcctttacaagatgcagaagagcggtgaactgcccttccccgctatcaacgtcaacgactccgtcaccaagagcaagttcgacaacctctacggctgccgcgagtcgctggtggacagcatcaagcgtgccaccgatgtgatggtggccggcaagcaggccctggtgatgggctacggcgatgtgggtaagggctcagcccagtccctgcgcggtcttggtgccaccgtctgcatcgccgaagtggatcccatctgtgccctgcaggccgctatggagggttaccgcgttgtccgtcttgaggacgtggtcgaggagatggacatcttcgtgaccgccaccggcaactaccaggtgatccgcaacgagcacctggagaagatgaaggacgaggccatcgtctgcaatatcggccatttcgacaacgagatcgatgttgcctccctcaagggctacgagtgggacaacatcaagccccaggtcgaccacatcaccttgcccagcggcaaccgcatcatcctgctggcggaaggccgcctggtgaacctgggctgcgccaccggccaccccagcttcgtgatgagcaactccttcaccaaccaggtgctggctcagatcgagctgttcaccaagggcaacgagtacggaaaagaggtgtacgtgctgcccaagcacctcgatgagatggtggcccgtctccacctggatcgcatcggcgccaagctcaccgagctgagcaaagaccaggccgattacatcaacgtgcccgttgaaggtccctataagcccgaccactaccgctat

SEQ ID NO: 44720 - DNA, 2007 bp, SYNECHOCOCCUS SP. WH 8102
atggtcgctgcgcccgcgtctctcgacacgctctgcatcaacagcatccggatgctggccgtcgatgccatcaacaagtccaagagcggccaccccggcctgccgatgggctgcgcacccatgggttacgcgctgtgggacaagttcctgaagcacaaccccaagaaccccaagtggttcaaccgcgaccgctttgtgctgtcggctggtcacggctgcatgctgctgtacgcgctgctgcacctcaccggctacgactcggtgtcgatcgacgacatcaagcagttccgtcagtggggctccaagacgcccggccaccccgaaacctttgaaactcctggcgtggaagtgaccaccggccccctgggcgctggcatctccaacgccgtgggtctggcgatcgctgaatcccacctggccgccaagttcaacaagcccggcgccaccctcgtggatcactacacctatgtggtgatgggtgatggctgcaaccaggagggcatcgcttcggaagcctgctccctggccggccacctgaaactgggcaagctgatcgccttctacgacgacaaccacatcaccatcgacggccgcacggacgtgtccttcaccgaggacgtgctcaagcgctacgaggcctacggctggcatgtgcagcacgtggccgacggcaacaccgatgtggacgccatcgccaaggcgatcgaagccgccaaggccgtgaccgacaagccgtcgatcatcaaggtgaccaccaccatcggctacggctcccccaacaagggcgacaccgccggcgtgcacggtgcacccctgggtgaagacgaaaccgttctcacccgccagcagctgggctgggagtacggccccttcgaggtgccccaggaggcttacgaccagttccgtcaggcgatcgagcgtggcgccagcctcgaagccgagtggaaccagaccctggccacctatcgcacccaattccccgctgaagcggctgagttcgagcggatgctccgcggtgaactgcccgagggatgggacaaggatctgcccaccgctggccctgacgagaagggtctggccacccgcaagcactcccagatctgcctgggtgccctcggccccaacctgcccgaactgatcggcggctcggctgacctcacccactccaattacaccgatatcaagggtgagaccggctcctaccagcctgaaacccctgagaagcgttacctgcacttcggcgtgcgtgagcacgccatggcggccatcctcaacggcatcgcatatcacgacagcggcctgatcccctacggcggcaccttcttggtgttcgccgactacatgcgcggctcgatgcgcctgtcggccctgagcgagctgggtgtgatctacgtgcttacccacgactccatcggcgtcggtgaagacggccccacccaccagccgatcgagaccatcccctccctgcgcgctatgcccgggatgctggtgttccgtcctggcgatgccaacgagaccagcggcgcctacaagctggcgattcaaaaccgcaagcgccccagcgctctctgcctcagccgccagggcatggccaaccaggccaactcctcgatcgacaaggtcgccaaaggtggttacgtgctggaggattgcgacggcacccctgagctgatcctgatcggcaccggcaccgagctcgacctctgcgtccaggctgccaagcaactgacggaagccggcaaaaaggttcgcgtggtgtccatgccatgcgtagagctgttcgacgagcagagcgacgcctacaaagaaaaggtgctccccaacgccgtacgaaagcgcatggtggtggaagccgctgaatccttcggctggcaccgcttcatcggcctcgacggcgacagcgtgaccatgaaccgctttggtgcttccgcccccggtggcacctgtctgaaggagttcggtttcaccgtggagaacttggtggccaaggccagcgccctattggcc

SEQ ID NO: 44721 - DNA, 1221 bp, SYNECHOCOCCUS SP. WH 8102
cgcgtcgtcgttacgggcctcggcgcggtcacaccgatcggcaatacggttcaggactactggagcggcctgatctccggacgcaacggggttgatgccatcaccctgtttgatgcgtcagcccatgcctgtcgtttcgcagcggaagtcaaggacttcgaccctgctgggttgattgaaccgaaggaagccaaacgctgggatcgcttctgcaagttcggtgtcgtggccgccaaacaggccatcgctgatgccggtctcacgatttccgacgccaacgccgatcgcatcggcacgatgattggttccggcgtgggcggtctgctcaccatggagacccaggctcacgtgctggagggcaaaggaccgggacgggtgagtccgttcacggtgccgatgatgattcccaacatggcgacgggtcttgccgccattgccttaggcaccaaggggccgagctccgccgtggccaccgcttgtgccgccggctccaatgccatcggagatgccttccggctgctccagctgggcaaagccgacgccatggtgtgcggtggtgccgaatcggcaatcacccctttgggggttgccggcttcgccagcgccaaggccctgtcgttccgcaacgacgaccccgccaccgctagtcgcccgttcgacaaggaacgcgacggcttcgtaatcggcgaaggtgccggtgtgctggtgctcgaaacgctggagcacgcccaagcccgcggcgccacgatcctcggtgaagtggtgggctacggcatgacttgcgatgcccaccacatcacctcacccacaccgggcggtgtcggcggcgctgaagcgatgcgactggccctggctgatggcggcatcgatccttcggagatcgattacgtgaacgcccacggcaccagcacccccgccaacgacaaaaacgagacctcggccatcaagagtgctctgggggatcgtgcgctgcagatcccagtgagctccaccaaatcgatgaccggccacctgctgggtggatcgggcggcatcgaggcggtggcctgcgtgctggccctccagcatggggtcgtgcccccgaccatcaaccacaccaacccggatcctgactgtgatctggatgtcgtgcccaatcaggcgcgggatcagacactgggaacggtgttgtccaactccttcggcttcggcggccacaacgtctgcctggctttcaaacgc

SEQ ID NO: 44722 - DNA, 225 bp, SYNECHOCOCCUS SP. WH 8102
gcgatcctcgagaaagtccgttccatcgtcgcggagcaactcagcgttgatgccggtgaggtgaaacccgagtccaacttccagaacgacctgggcgcggattccctcgacacggtggaactggtgatggccctggaagaggccttcgacatcgaaattcctgacgaagccgctgagggcattaccaccgtgggtgacgccgtcaaatacatcgaagacaagcag

SEQ ID NO: 44723 - DNA, 1887 bp, SYNECHOCOCCUS SP. WH 8102
atgtgtggaatcgtcgccctcgtgggatcccagcctgcagcaccacagttgctcgaaggtttgcggcaactggagtaccggggttacgactcggctggcttggcgacggtgaccagccagggacagctcacctgcctgcgggccaaaggcaagctcgtcaacctcagtcagcgagtggaggctctgggggcccccgggcagtgcggcatcggccacacgcgttgggccacccatggcaagcctgaggagcgcaatgcccaccctcaccgaagtgtcgatggcggggtggcggtggtgcagaacggcatcatcgaaaaccaccggcagctccgggatggtcttgaagcctccggggtggaattccagtcggagaccgacaccgaggtgattccccatctggtgtccgctgaactccaccgacgccttcagaacggtgaacagcccagcggttccaccctgcttcaggccgtgcagacggtgctgcctcagttgcagggtgcctatgcccttgcagtgatctgggagaaggctcccggcgctttggtggtcgcccgccgggctgcccccttgttgatcggcctgggcgagggtgaattcctctgtgccagcgatacaccggctctggctggtttcacccgcacgatcctgccgatggaggacggcgaggtggctttgttgtcgcccctgggagtggagctctacgacggcgagggcgtgcgtcaacagcggatgccgaccctgctgacggggacggatcacgtggcggacaagcgggagttccgccatttcatgctcaaggagatccacgagcagcccgagacggcggcgttgtgggtgtcacgccatctgcctgaggggctgccggcatcgatgcctgtggccttgccgtttgacgaagccttctacgccggtatcgaacggatcgagatcctggcttgcggcaccagtcgccatgcggctctggtgggtgcccatctgctggagcaattcgcaggattgcccacggccgttcactacgccagtgaattccgatacgcgccgccgccgctggcccccaacaccctcaccattggtgtcacccaatccggggaaacggccgacaccctggcggctttggcgatggaggcccagcgccgttgcgcccaccccgacccggcctatgcctcgcgccagctgggggtgaccaaccgtccggagagttcactctcccgtcaagttcctcacatcctggacatcggtgccggagttgaagtgggcgtggcggccactaaaactttcacgggacagctgttggctttctatggtctggcgatggccttcgcgacgcgcagtggcagtcgttcagccgctgaaatccagacgctggcggatgaattgcggatgcttcctcagcagctgcaggagctggtgtcacttcatgaccagcgctcggaagccctggcccatcgctttgccgaaacccaggacgtgatcttcctcggtcggggcatcaactaccccatcgcgctggagggagccctcaagctgaaagaaatcagctacatccatgccgagggctatccggccggtgaaatgaagcacggtccgattgctctgttggatgcccacgtgccggtcgtgtcgatcgcggtgccgggaacggtgttcgagaaagtgctcagcaacgcccaggaggccaaggcccgcgatgcacgcttgatcggtgtggcgcctgagggacctgacacggcgctgtttgatgacctcttgcctgtgcccgaggtgagcgagtggctgagcccgttgctgacggtggtgcccatgcagctgttgagttatcacatcgcagcccatcggggcctggatgtggaccaacctcgcaatctggctaagagtgtgaccgtggag

SEQ ID NO: 44724 - DNA, 2490 bp, SYNECHOCOCCUS SP. WH 8102
cctctcgatctgcgcctgccgacccccggctgttacaacgatcccgaacgggccggtctggacgccaagagcgtcttcgacggcatgaccgagcacctgttcttcaccctcggcaagcttgctcccaccgccagccgccatgacctttacatggcgctgagctatgcggtgcgcgatcgcctgatgatgcgctacctcgccacaaccgaggcgatgagagcccatccccagaagtctgtcgcttacctctctgcggagttcctgatcgggccccagctgaacaacaacctgctgaacctcggtattcaacaggaagccgaagcagcgcttcggaacttcggcatcgaatccctccagcagatcctggatgtggaggaagaaccgggcctcggcaacggtggtttgggacgcctggcggcctgctacatggagtccctcgccagcttgaaaatccccgctacgggctatggaatccgctacgagttcggcatcttcgaccagctgatccgcgatggctggcaggtggagatcaccgacaagtggctgaagggcggctggccctgggaactgccccagcctgatgaagcctgcttcgttggcttcggtggacgcaccgagagctacatcgatgacaagggcagctaccgctcccgctggattcccgccgagcacgccatcggcatcccccatgacgtccccgtgctgggctatcgcgtcaacatctgcgatcggctgcgcctctggcgcgccgatgccaccgaaagtttcgacttctatgccttcaacatcggcgactactacggcgccgttgaggagaaggtgggcagcgaaaccctctccaaggtgctgtaccccaacgacggcactgacgaaggtcgccgtctgcgtctgaagcagcagcacttcttcgtgagctgctccctgcaggacatgctgcgcagcctcgacaatcgcggattacccgttgaggacttccccaagtactggaccgttcagctcaacgacacccaccccgccatcgccgtggcggagctaatgcgtctgctgatcgacgaccgccacatggattgggacaaggcctgggacatcacctcccgttccgtcgcttacaccaaccacacccttctgccggaggccctggaaaagtgggatctgaatttgttcagcagcctgctgccccgccacctggagctgatctacgagatcaaccgtcggttcctccagcagctgcgtctgcgttaccccggcaacgacgccatccagcgcaagctgtcgatcatcgatgaagacggcagcaaggctgtgcgcatggcccacctggccaccatcggtgcccaccacgtgaatggcgtggcggcgctgcactccgatctggtcaagaccgacctgctgccggaatttgctgaactctggcccgagaagttcaccaacgtgaccaacggcgtcaccccccgtcgctgggtggccctggccaaccccgagctgtccaccctgctcaacgagcacatcggcgaggactggatctccaacatggagaacctgcgcaagctggaggaacgccagaacgaccagggcttccttgagcactggggcaacaccaagctgtccgtgaagcgcaagctggccagctacatccatcgcaacaccggtgtgctggtggatccctccacattgttcgacgtgcaggtgaagcgcatccacgagtacaagcgccagcacctcaacgtgctgcaggtgatcacccagtacctgcggatcaagaacggccaggccgacggcatggcaccccgcaccgtgatcttcggcggcaaggcagctcccggctactacatggccaaactgatcatccgcttcatcaacggcatcgccgagaccgtcaacgccgaccccgatatggacggccgcctgcgggtggtgttcctcccggattacaacgtgaagctcggcgagcaggtctaccccgcctccgacctctccgagcagatctccaccgccggcaaagaagcttccggcaccggcaacatgaagttcgccatgaacggcgccctcaccatcgggacgctggatggggccaacgtggagatccgcgagctggtgggagcggagaacttcttcctgttcggcaagaccgtggaggagatcaacgatctcaagcgaagcggctacaaccccggcgcattcatcaacgccatgccagagctgcaggaagcactgcgcttgatcgagatgggccacttcagcaatggcgacagcgaactgttccgtccgctgctggacaacctcaccggtcacgatccgttcttcgtgatggctgacttcgccgactacctgcgggcccaggaggccgtcagcctcgcctggaccgatcgcatgcactggaaccgcatgtcgctgctgaacaccgcccgcactgggttcttctcctctgaccgatccatcggcgaatactgcgagaacatctggaacgtcggtcccctcaacgtcgacatc

SEQ ID NO: 44725 - DNA, 1401 bp, SYNECHOCOCCUS SP. WH 8102
aagctcaccgcccccagccagggcacaccgattcgcttcgagaacggccaacctgtcgtggccgacaatccgatcattcccttcatccgcggtgatgggaccggcgtagacatctggcctgccacccagaaggtattggatgccgccgtggcaaaggcctatggcggagttaaaaccatcgagtggttcaaggtgtatgccggcgatgaggcctgcgacctctacggcacctatcagtacctgcccgaagacaccctcgaagcgatccgcacctacggcgtggccatcaagggccccctcaccacccccgtgggtggcggcatccgttcgctgaacgtggccctgcgccagatcttcgatctttactcctgcgtgcgcccttgccgttattacgagggcacccccagtcctcacaagcgtccccaggatctggacgtgatcgtctaccgggagaacaccgaagacatctacatgggagttgagtgggaggccgatgacgcggttggtcaggagctgcgcaagcacctcaacgaggtggtgattcctgccaacggcaagctgggcaaacgacagatcccggaaggctccggcatcggcatcaaaccggtgagcaaacacggcagccagcgccacatccgcaaagcgatccagcacgccctacgcctggagggcaacaagcgccacgtgaccctggtgcacaagggcaacatcatgaaattcaccgaaggtgcgtttcgcgactggggctacgaactggccaccacggagttccgcgacgtgtgcatcaccgagcgggagagctggatcctcggcaacctcgagaaggattcaggactgagtgtgcaggccaacgcccggatgattgaaccgggctacgacagcctcacccccgagaagaaagcggacatcgatgctgaagtgcaggccgtgatcgatgccatcggcagcagccatgggggcggcaagtggaggtcgatggtgctggtggatgaccgcatcgccgacagcatcttccagcagatccagacccgccctcaggagtattcgatcctggccaccctcaacctcaatggcgactacatctccgatgcagccgcggccatggtgggcggtctgggcatggcccccggcgccaatatcggcgaaaccgccgccatcttcgaagccacccacggcaccgccccgaaacatgccggtctcgaccgcatcaaccccggttcagtgatcctcagcggcgtgatgatgctggaattcctgggttggcaggaggctgcagacctggtgaccaaaggcctgagtgccgccattaccgacaaacaaatcacctacgacctggccaggctgatggaaccgcaggtggaccctgtgagctgcagcggcttcgctgaagcgattatccag

SEQ ID NO: 44726 - DNA, 1380 bp, SYNECHOCOCCUS SP. WH 8102
gttttgaatcgtgtctctaattctgtgattgtgcctcttcttgctgtggcaggcaacgccttgtcgatcatcgtcctcctggttggagtggtcttcgcaattggttggtcggccgtatggatgtttgccctaatgttcgcagcatatgttgtggcatcggcaattgttactccttacatcaggcgtgcttccaagcagcgagtccgttattcacggcggattaatatgattttgatggagtcgctgcgctcgatgcgtgatgttcatctttactcggctgatagatattttttaggaagcttttctagaaatggaattgtggccaagcgttatgaacgtcttgtcaagcttctccccgatgtcccccgcttcctgatcgagcctgcggcaatcacaattttgttcgcggcaggtttggcgccagtagttttgtcgggggacgtctctgacgttcgtgattcagtgccctctatcgtggcagtattaatcactttgacgagaatttctgcgccacttcagagtacattccggaatttgaataaattgcgtggtgggttgcctgatataaaagattccttggagctgttgtctcttaagcccaagagacttctgttggatactgatagtgttcctactccttcaggagttatgcctcggcgctcgatccaattggatgacgtcacattcaagtttaagagcggaacggcagaaattttgcgctcaatctcgatttcaattcccgttggatctcgcgttgctttggttgggcgtacgggaagtggtaaaacaaccttggctcacatcttgcttggcttatatcagccgacctcaggagtgttgcgacttgatggtgtggctgtttctcctgaggagatgccggcatggcaggccaactgtgcactcgtgcctcaggatattcgcttgctagatagcagcctgcgagaaaatgttgcttttggtgttagccctgaacacatcgatgatgtacgagtctggtctgctctcgaatcagctcaatttgatgaatctgtggcggagatgcctcacgggctttatagcgttattggcgaggatggggtaaagctgtccggcggccaacgccaacgactttctctggcgagggctttctaccgcgaagccaaagttttggttttggatgaagcaacgagcgctttggataatcgcactgaacacgatgtgatgcaagctctcgacttgattggacgtcgatgtacaactatcgtgatcgcacatcggctttcaactgttcgtaagtgtgatcggatttatgaagttgacggcggtgtgataaaggctcaaggtgatttcgaatacctttgctccgcttcggaaagttttagggatatgaatagattggag

SEQ ID NO: 44727 - DNA, 2370 bp, SYNECHOCOCCUS SP. WH 8102
tttctggccggcctcaacgacgcccagcgcagggcggtggaccaccacgaagggcccctgctggtggtggccggtgccggcagcggcaagacccgcgccctcacccatcgcatcgcccatctgatcggtgagcacggtgctgatcccgcccagatcctggcggtgaccttcaccaacaaggccgcccgcgagatgaaggagcggctggaggtgctgctggctcagaagctggcccagagccagtacggccagccctggagcaccttgccgccggttgatcaacggcagctgcgctctcggatttaccgcgaggtcagcaaggagttgtggatcggcaccttccacgccctgttcgcgcggatgctccgctatgacatcgacaagttcaaggacgctgaggggctgagctggaccaagcagttctcgatctacgacgaggccgatgcccagagcctggtgaaggagatcgtcacccaggaactgcagctggatcccaagcggttcgagccgaagaagacccgctgggccatcagcaacgccaagaaccagggctggctgccggatcaactggaagccaatgctgaaggtcagcggggcaagctaaccgccaatgtgtaccgccgctaccgcagggcgctggcggcgaacaatgcgctggattttgatgatctgctgttgctgccggtgcagctgcttcagcagaacgagcaggtgcgtagctactggcaccgccgctttgcccatgtgttggtggatgagtatcaagacaccaaccgcacccagtacgacctgatcaagctgctggtcaccgatggcaaagacccgcagacctacaacaactggagtgggcgctcggtgttcgtggtgggagatgccgaccagagcatctacagcttccgcgccgccgacttcacgatcctgatgggttttcaggaggacttcggtgatcaggcgccggacgacgccacccgcacgatggtgaagttggaggagaactaccgctccaccgccacgatcctcgcggcggccaatgccctgatcgccaacaacagcgagcggatcgacaaggtgctgcgacccacccgcggcgacggggagttgatcaccctcacccgttgtgatgacgaaattgccgaggccgaggcggtggtgcatcggctgcggacgatggaggcggccaaccccgagctgagctggggagatatggccgtgctgtatcgcaccaatgcccagtctcgctcgatcgaggaatcgctggtgcgctggggtatcccctacatcgttgtagggggtctgcgcttctacgaccggcgggagatcaaggatctgctggcctatctgaggctgttggtgaatccggcggacaccgtcagcctgctgcgggtgatcaatgtgcccaaacggggcatcggcaagaccacgattcagcggctcaccgatgccgccaatcaactggggatcccgctctgggatgtggtgagtgatgccgaagccgtgcgatccctggggggacggtcggcccgtggtctgctgcagttctgcgagctgctccatgacctgcggcgtcaggtgcaggaggtggctccgtccgagctgatccagcaggtgatggagaaaagcggctacatcagcgaactgatcgcggaaggcaccgatgaagcggaggaacgccgccgcaacctgcaggaattggtcaatgccgctcttcagtaccaggaggagaacgaggagggggatctcgaaggcttcctggctacggcagcgttgtccagcgatgccgacagcaaggacaccgcagcggatcgggtcaccctgatgactttgcacagcagcaagggcctggagttcccggtggtgtgtctggtgggtttggagcagggcctgttccccagctaccgctccctcgatgatccggcctccctggaggaggagcgtcgcctctgctatgtcggcatcactcgcgccaaggagcgcctgtttctctcccatgccagtgagcgtcggctctggggtggcatgcgcgaagccgccgtgccgtcggtatttctttcagagctgccggaggccctggtgcagggggatctcccccagagcggtggagcggccctgcgccgcgaacggcggctggagcggctcacccgtgtggatcgtgatcgtcccagctcggcgccggccaatgcggtgcgccgccgccaggcgggtccggcccccgggcgcagctggagcgttggtgatcgcgtcacccatgccagcttcggggtcggcgagatcactcacaccttcggtagtggtgagaaggtgtcgatcgcggtgaagttcgctgggatgggcccgaagatcctcgatccgcggttggcgccgatcgagccg

SEQ ID NO: 44728 - DNA, 1776 bp, SYNECHOCOCCUS SP. WH 8102
gaaagtttccctgaggggatcgagctgcttctgatggagcgctccaatgccacccctgatcagaagttcggtcctggctggttctggcctgcgctcaagcgctaccgcggggtgctgattcaggtgttggccgccagttttgtggtgcagctgttcaccctggccaaccccctgctgatccaggtgatcatcgacaaggtgatcagccaacgcagtctggacacgttgcaagtgctgggcattgccctggtgatggtgaccatcctggaaggggtgctgggcagcctaaaaacgttcctcttcgccgaaaccaccaaccgcattgatcagcgcctcggtgccgaagtgatcgatcacctgctgcgtcttccccttggctatttcgatcgccgcccggtgggtgagctcggcacccgggtggctgagctggaaaagatccgcaacttcctcacgggtcaggcgctcaccacgatcctggatgccgccttctcggtgatctacatcatggtgatggtgatctacagctggttgctgaccttgatcgccctatctgtgttgccgattcagatcggtctcaccgtgctgggagctccgctgttccgccggcagttccgtgctgctgctgaagaaaatgccaaaacccagagccatctggttgaggttctcactggtattcagaccgttaaggctcagaacgtggaaatggtcagccgttggcgctggcaagagttctactcgcaatacatcgctcgcacgtttgagaagacgattaccggtacggctctgaatcaaaccagccaggttctgcagaagatttcgcagctgatggtgctgtggatcggagcctcgatggtgttgagcggtgacctcaccctgggccagttgatcgccttccggatcatttctggctacgtgactcagccactgctgcggttgtcgacgatctggcagaacatccaggaactacgggtgagtttcgagcgtcttgctgacgtgatcgacaccccggaggaatccgatgaggtggataagtcaaaggtgatgttgccgccgttgcacggggaggtgcggttcgagggtctttccttccggttccgacctggtcaacctgaggtgttgaaggacatcaacctcgagatcaaggccggcacgttcgttggaatcgttggccagagcggcagtggcaagagcaccctgatgaagctcctgccgcgtctttatgagccgggagaaggcaggattttgatcgatggctacgacatcgccaaggttgagctttattcactgcgccgacagattggaatcgttccccaggacccactcctgttcagcggaacggtgagcgagaacattgctctcaccaatccggaagcgtccagtgaggagattgttcgggcagcccgcctggccaatgcccacgacttcatcatggatctgcccagtggctacagcactcctgtgggtgaacggggggcttccctcagtggcggccaacgtcaacgggtggcgatcgcgcggaccttgctgagcaatcccaagttgctggtgatggacgaagccacgagcgcccttgattacgaaacggagagaaaggtctgcgacaacctgctcgagaatctggatgaccagacggtgtttttcattacgcaccgcctgtccacgatccgtcaggccgatgtgatcgtgatgcttcaccaaggtgccgtggtcgaagtcggcacccatgaggacctgatgaagcatcgaggtcgctactacgccctttatcgccagcag

SEQ ID NO: 44729 - DNA, 1344 bp, SYNECHOCOCCUS SP. WH 8102
gtgacgattcaacggatctgctgcatcggcgccggctatgtgggcggcccgaccatggctgtgatcgcagaccgctgcccagagatcgaggtgacggtggtggacatcaaccaggcgcggatcgacgcctggaatgatgctgatctgagtcggctgccggtgtacgagccagggctggatgccgtggtgggccgtgcccggggacggaatttgacgttctccacagcggttgaagccaccgtcgcgtcagcagacatggtgttcatttccgtgaacacgccgacgaaaacgaaggggctgggggcgggtcaggccagtgacctgcgctgggtggaggcctgtgcacgcacggtggcgaaggcagccaccggccacacaatcgtggtggagaagagcacgctgccggtgcgcacggctgcagcgatcaaaacgatcctggaggccgcgcaggaggacgatcagcagcgctgcttttcggtgctttccaatcctgagttcctggcggagggcacagcgatccgggatctggaggcgcccgaccgggtgctgatcggtggcgaggacgcggcatcgatcgaggcgctggcggcggtttacagccactgggtggacgaggcgaagatcctgcgcaccaacctctggagcagtgagctgtcgaagctcacggccaatgcatttctggcgcagcggatcagttcgatcaactccgtcgcggcactctgcgaggccaccggcgcggatgtgcgggaggtggcccgggcgatcggcaccgacagccgcatcggcccgaagtttctcaatgccggcccgggttttggcggtagctgcttccagaaggacatcctgaacctggtgtatctgtgccggcacttcggcttgccggaggtggccgactactgggagagcgtggtggcgttgaacacctggcagcagcaccggatcgcacagctggtggtgcagaagctgttcggcacggtgaccggcaagcgcctggccatttttgggtttgccttcaaggccgacaccaacgacacccgcgaggcgccggcgatccgcatctgcggcgatctgctggaggagggggcgcagctggccatccacgatcccaaggtggagccagcccagatggcccgcgacctgaagcaggaggcggcagcggcggctgatgtcctcagcggaaccggcagctgggctttggctgagtccgttgaggaggccgtcagtggtgcggatgcggtgctgatcctgacggaatggaacgtctacaggaatttgaactgggcggagctggcgggacggatgcgcaaaccggcctggctgtttgatgccagggccgtggcggat

SEQ ID NO: 44730 - DNA, 2052 bp, SYNECHOCOCCUS SP. WH 8102
gcctttcccctggccgccatcacaggccacggcaccctcaagctggcgctgttgctggcggcggttgatccaggcctcggcggcgtggtgatcgccggcgggcgcggcaccggtaaatccgttctggcccgtggcctccatgcgctgttgccgcccatcgacatcctcgatgtcgacaacggcgtcggtcgcaacctcgatccgcagaaccctgaggagtgggatgacaccacccgggagcgcatcagcggtgagcccccctccaaggtgatcccagcaccttttgtgcagatccctctggggattaccgaagacaggttggtgggtgcgctggatgtggccgcgtccttggccagcggcagcgccgtgttccagccgggtttgctggcggatgcccaccgcggcgtgctctatgtcgatgaactgaacctgctggacgacggcatcgtcaatttgatgctggcggccgtgggcagcggcgaaaaccgggtagaacgggaaggcctcagcctcagccacccctgccggcccctgttgatcgccacgtacaacccggaggaaggcaacgttcgcgatcacctgctcgatcgcttcgccattgcgctctcggccaaccaagtggtgagcaccgagcagcgggtggagatcaccggcgccgtgctcagccacggccaatgcagccgcagctttgctcagaagtggggcgaggagaccgatgccctggccacccagctgctgctggctcgccagtggctgccggatgtgttgatcagtcgcgagcagatcgaatacctcgtcaccgaggcgatccgcggcggtgtggagggacatcgctccgagctttacgcggttcgggtggcccgggcccatgccgccctctccggccgcgacaccgtggaggccgacgatctgcaggtggccgtggctctggtgatcgcaccgcgggcctcccagatgccgccaccggaccagcaaatggaaccaccgccgccgcaggaccaggagcctccaccaccgccccaggaccagggcgatcaacagcaagacaacccgcccccaccaccggagggctccgatgaggaggacagcgatcctcctgaggacagcaacgacgacaacgacacggaagacgacgacggtgacggcgaagaggatcaggcccctccagccgttcccgaagagttcattctcgacccggaggcgatcgaggtggatcccgatctgctgctgtttaatgccgccaaggccaagagcggcaacagcggcagccgatcggtggtgctcagcgacagccgcggccgctacgtgaaaccgatgctgccgcgcggaccggtgcgccgcatcgccgtggacgccaccctgcgggcggctgcgccataccagaagatccgtcgagagcgagaaccaggccgttcggtgatcgtggaagaaggcgacctccgcgccaagttgctgcagcgcaaggccggcgccctggtggtgttcctggtggatgccagcggttcgatggccctgaatcggatgcaaagcgccaagggtgccgtgattcgactgctcactgaggcctacgaaaaccgcgacgaggtggccctgatccccttccgcggcgatcaggccgaggtgttgctgccccccacccgctcgatcacagccgcccgccggcggctggaatcgatgccctgtggcggtggttcaccgctggcccatggcctcacccaggcggcccgcgtcggcgccaatgcactggccacaggggatctcggccaggtggtggtggtggccatcacggacggccgaggcaacgtgcccctgagcacctccctgggccaacccgagctggagggcgaggagaaacccgacctgaagcaggaggtgctggacgtggccagccgctaccggatgctcggcatcaagctgctggtgatcgacaccgagcgcaagttcatcggcagcggcatgggcaaggacctcgccgaagcggctggaggcaaatacgtgcaactgcccaaggccagcgatcaggcgattgcggcggtggcgatgaatgccatc

SEQ ID NO: 44731 - DNA, 777 bp, SYNECHOCOCCUS SP. WH 8102
ctgcttgatctcaccggcaagaagatcctcgtcaccggcatcgctaacaaccgttcgatcgcctgggggattgctcagcagctcaaggcggccggtgctgagctcggcatcacctatctgcctgatgacaaaggccgcttcgaggccaaggtgcgcgaactcactgctcccctggagcccagcctgttcctgcctctgaatgttcaggacgccgaccagatggctgaggttttcggcgagatcaaggcgaagtggggcgttcttgatggtctggtgcactgcctggcctttgccggcaaggaggagttgatcggcgactacagcgccaccacggcggaaggttttgcccgctcactggatataagcgcctattccctggccccgctctgtgcccatgccaagccgttgttcagcgagaaggccggcgtgatcacgctgtcctatctcggcgctgagcgggcgattcccaactacaacgtaatgggcgtcgccaaggcggctcttgaggcttccgttcgctatctggccgcagagctgggtcccgagaagcaggtgcgcgtcaacgccatcagcgccggccctatccgcaccctggccagctctgccattggcggcattctcgacatgatccacaacgtggaggaaaaggctcccctgcgccgcaccgtgactcagatggaggtgggtggcaccgctgccttcctgctcagtgatctggccagcggcatctccggtcagaccatctacgtcgatgcgggctactgcgtcaccggcatg

SEQ ID NO: 44732 - DNA, 582 bp, SYNECHOCOCCUS SP. WH 8102
cgtcagggagacatccatcgggtcaccggtgaaaccgacgtgaaggtgcggctggacctggacggctccggccaatgccaggccagcaccggtgtgccgttccttgaccacatgcttcatcagatcagcagccacggcctgatcgacctggagatcaatgcggtgggagacacccacattgacgatcaccacaccaatgaagatgtgggcatcgctgtgggtcaggccctggcccaggccctgggggaccgccgcggcatccaccgcttcggtcactttgcggcaccgctggatgaggccctggtgcaggtcgccctggattgttccggacgcccccatctgagctacagcctcagcattcccagtcagaagatcggcagctacgacaccgagttggtgaaggagttcttcgtggcggtggtgaacaacagcggcctcacgttgcacatccgccagctcgatggcgtgaactctcaccacatcgtggaggcctgtttcaaggccttttccagggcgttgcgcatggccacggaaatcgatccccgtcgtgcgggtgccattcccagtagcaaaggggtgctt

SEQ ID NO: 44733 - DNA, 1428 bp, SYNECHOCOCCUS SP. WH 8102
agtcctgcgccgatcaagttcggcaccgatggctggcgcggcgtcctgggggtggacatcaccgttgagcggttgctgccagtcgcagctgcagcggcccaggagctggcccatcgcgcaccagacggtctgaacagccgcacggtgatcatcggcttcgatcgccgcttcctggcaccggaactggcggaagccatcgccaatgccgtgcgtggctgcgagcttgagccactgctcaccgagacgcccgtgccgacacctgcctgcagctgggcggtggtggaacgcaaagcgctgggagccctggtgatcaccgccagccataacccccctgaatggctgggcctgaaaatcaaaggtcccttcgggggctcggtggagggggacttcaccgcagcggtggagcgacgcctggcggctggcggcatcacaccacccattgcagcgaccaccagccgtttcgacgggcggggtgagcaccttgagggattgcgtcgcaaattggacctcaccgctttggtgacgggcctgaaggcgatgaacctgaaggtgttcgtcgacccgatgcatggatcggcagccggctgtgtcagcgatctgctcggccctgaagcctctgagctggtggacgagatccgcagcacgcgtgaccccctgttcggcggcaatccgccggaacccctggccccatacctcagcgacctgatcacagcggttcagcactccacggcagcgggtactccagcggtgggtctggtgttcgatggggatggtgatcgcatcgccgccgtggatgagaacggtcggttctgcagcactcagctgctgatgcccctgctcatcgaccatctcgcccgggcccgccagctgcctggaacggtggtgaagactgtgagcggttccgatctgatgcgcctggtggcagaagcccagggccgtgaggtcctggaactggccgtcgggttcaaatacatcgccagcgagatgctggcgggtgaggtgctgatcggcggggaggagtcagggggggtgggcttcggcatgcatctgccggaacgggatgccctgttcgccgcgatgctcgtgctggaagcgctggtggaaggcggtcaacccctcggcagccgacttgacgctctgcagcaacgccatggtggtgccagccattacgaccggctggacctgcggctgcaggacatggaggcccgacggcgtctggagaccctgctggcgagctccacaccccagcaggtggctggggacgcggtggttgaggtgaacaccacagacggcatcaagctgcgcatgggcgccagccattggctgatgctgcgcttctccggcacggagcccctgctgcgcctgtactgcgaagccccggatcgcgatcgggtcgatgctgtgctggcctgggcaaagcgttacgcc

SEQ ID NO: 44734 - DNA, 2922 bp, SYNECHOCOCCUS SP. WH 8102
cggctcgatcgatcgattgagcaggtggtgctggaacgtcaggacccaatcagtggtttgctgcccgccagcaccgcccacacggttcacggcaactacggcgatgcctgggtgcgggactgtgtctactccgtgcagtgtgtctgggctctggccatggcccaccgtcgccgccatggagcccacgacaggcgggcctgggagcttgagcaacgggtgatctccctgatgcgggggttgctgcgagccatgctgcgccaggccgggaaggtggagcgcttcaaagtcagcctcgatcctctcgacgctctgcacgcgaagtacgacagcagcagcggcgatccggtggtggcggatgacgcctggggacatctgcaactcgatgccacttccctgtttctgctccagctggctcaactcacccgcggtggctgcaccgtgatccagagccgggatgaggtggatttcattcagaacctcgtgtactacgtcgcccgggcgtatcgaacccctgattacggcatctgggaacggggcgacaaaggcaacaacggcttgcccgaacgcaattccagctccatcggcatggcgaaagccgctctggaggccctggaaggcctcgacctcttcggggtccacggtgatgggtcgtgccaactgctcatcccccagggagctgtggttcgtctgcggcgggccctcgaaagcctgttgccgcgggaatccgccagcaaggaagccgacagcgcttgcctgtcggtggtgggcttccctgcctgggccatcgaaaaccaggacctggtgcagcggaccctgcgccgggtacggcgggaactgggcggcacctatggctacaaacgctttcttcgtgatggccatcaaaccgccgtggaagacgtcaatcgtcttcattacgagccggaggagctcgcccagttcgaagggattgaatcggagtggccgctgtttctggcctttgaactggtcaccgcctgctgcgaggaacgctggcaggacgcccgctcctggcaggacaagctggcagccctggccgtgcatcgggatggggaagcgctctaccccgagctgtatcaggtggctgctgatcgggtcgaagcggaacggagacagccaggcagccagcctcgccaggccaacagcaatctccccctgatctggacacaaagcctggcctggctgggcgaaatgctgctggagggattgatcacaccagaggatctcgacccctgcgagcggcgacacgccatggggctcggagctgacggcatgctcgtggccttcgctgcagagacaacctccgtcaggcaggccctgatcgacgccggtttgccgctggacagtggtgatgggatcacaatccagccctcggatgccctggcagcccggtggagctccatcggggccaatccaagactcggcctgagtggcaaaccggtgcagcgcatcgaaaccgaggacaccgcacggctgtaccgtctcggggaacagaccctggccttcacgacagcggtgctggaggacggcatcagctacctggccgatgacccgcttcagttagaggacagcgtggtggatgaactccatctgctgaggcgtcactggcgtggtccagggctgccactgctgttgatccccgtcagcgctgaatccttccagcatcatcccgaggtcttcctgcagctgggacaaacgctgctcaccggccgcatcggggacatccctgtgcagttcgaccagctgaaacagctggccagtcaggccagttgggtgactctgcgagagggggggggcgacattgagccgacggccctggaacggagccgaccctctctgctgcaggacgccacagacctccgcgatctcacggccgctgaagaacaggagctcgacgaaaccgacgctgaccttctgcggagaaggttgtggaacacccagtcgctgcatgaacaggccgacgttctggacctgctgcaacgacgcttcggagccaaggcccttgaaaccaatccgcacggccgcagcgtgacgattcagcagttgctggaggaggtgtaccaccgcggactgcgctgccaggactggagtgtggtgcggcgctgcgccggtgcgatgggcatggtccatccccaactggaagatgccctgaccgatctgctggtgcgtcagaaacaagtggtcgtgggccgcaactacaccgccgatgcacggctcagccaccccctggacagcagcgccatcgccgaacggatcgcacgcaccagcggggtggacgggcgcgagcgcatgcttgaacaggagctgctgctggccctggatggcgtggcccggcgcgatcccggactgctgaaagggatccttaccctgcagctcagtcaactgctgttgctgctcacctctgaactggcggcagaggatcagctcagccaggacgaggcctttgaagcgttgtgcagcagctcaccgcatcggatccgggatcggctgcgacaactcctcagcgatgttgaacatgccagggcggccctgcagcgcggtgagcagctgcatgtcaccggcagggtgcagtggaaggtgccggatcccattgaccagccccccagcggcggcgactggctgcagcaccgcatccgtcttggttcactgcagaaggtgcccagggatttctatgccggcatctggtcgttgttgcagcactgccgcggcctggtggtcggcgacaagctggaacgccgcaatcgactgaacagccgcctgatcctcgagaaaacagcgggggaaaagaacttcgccacgttggtggagcatctgctcagccgaatccaggcgccggaatatcgacagctctgtacggagtgcctcttgtctctgatggccttcgtggaagccaacccggaggtgcac

SEQ ID NO: 44735 - DNA, 2661 bp, SYNECHOCOCCUS SP. WH 8102
attgaaacgtttcgcagccgctcgcgccgtgatctgcgctctggttggaggcgttcccacgcgctggagcgcgagccattcatccttgagtcctgggggaagaacaaccgccctgactgggctgcccgtggattactgatctggccgcgggggcgtgcttggttgcggctggagcagaccgtggttcggccggaggcctggccggatgcaagccatcaccgggctcggttgtgcctgagctggtgggcggagtcggcacgtctctgggttgatggggtgctggtgcatcaaggagatctattcgacaccgcctgtcgctggacgctgccggaggcttttcttgccggacatgttcacaggattcagctggagctctgcagtcccctccatgacgacggagcgttgatcagcagctggctggatctcgaacccaaccgtcccggcgaggacccggctggggtgttgttgccagaagctttgctattgcacctcgaggcaggaggtgacttgccgttcggttgggagcagatggatcccaacagtgaggcggcgcttaaggcggttgcgcagcagctgaaagcgcagcccacacctcagggcgctgtgcactggttcggccatgcccatctggatctggcctggctctggacggtggcggacacctggcaggcggcggagcggacctttcgctccgccctcgcgctgatgaaacgctggcctgatcttcgcttcgctcactccacgccggcgctctatgcctggatggagcaccacagacccgagctgttttcagcgatctgcaaggccagtcgggccggccgctgggaaccgatcaacggcccctgggtggagacggattgtgtgctggtgagcacggcgtcgctttggcagcagttcgccatcggtcaggcctacagccgcgaaatatttcccgaatggcgccatcacctggcctggctgccggacagcttcgggtttgcagcaggcctccctgccgtcgcgcaggccacaggtgtgcgctggttctgcacccacaagttggcttggaatgccagcaattcattcccacatcgtttgttccggtggcgcagccgcggtgggggggatgtgatgagcctgatgctccccccgatcggacggcgtggggatccatcggacatcctcaaggagcagcgccggtggcagcaatgcagcggtgtttcggagttgctctggatccctggggtcggcgaccacgggggcggacccaccgaggagatgctggagcagatgcagctgtgggatccggaaccctcggcgctgcccaggcaggcggggtcactgcgccagtacctcgacaggcttgagcccatggcagggcagttgccggtctggcgggatgagctgtacctcgagctgcatcgcggctgtgccaccagccgtccggatcagaaacgtcacaaccgcagcctggagcgcctgctgcgggagagcgacacggtggcagcgcttcttgctttcgcaggccgcccatccgttggcagcgattggcgtccactgctgtttcagcaattccacgacatccttcccggaacctccattccggaggtgtttgaccaggcggagccgatctggcgccgggcccgccgtcaagcccggcatcagcgtgatcagggcctgcgtcagttgctgggtgttgactctggatctggtgccagcagcacttggctgtggatgggctggcagccactggctcgctggtctccactactgaaattgccgcatggggcctggcataccgatggtgcggcgctgccacagcagcccagcgtgcagggcggcacgtgggtgcagctgcccgagcagcgcgggatctgttctgtggcgctgagcgatggtcctgtggacagcggggagatcgcgcccaggcatccggtcagcgtggtgcaggtgtcgccagagatctggcgtgtcagcaatggcttagtggagtttgagtgctcccctgtagggctgttgcagctgcgggatgctcagggggttgatcagctttcggcacctttgtgcccctgccgttaccgggaccggggtgagttctgggatgcctgggacatcgctgcggagtaccggaggcatccgctggagctggagcccgtcggatctgttcagctgctcgagtccggtccgctggtggcccagctcgtggtgacctatcgggtgggtgccagccggatgcgcctggatctgcgcctcaaagcggattgcccctggttggagctgatcgtgtctgtggactggtgtcagcgccatgagctgctgcggttggacatccccctcgcatcagcggcggtgcgtcttgcggcagataccagtggcggggtgatcgaacggccggcgcatccccagacgccccgtgaacaagagcgatgggaagtgccggcgatctcctggctggcctctcaggccaaggctcccggcgggggcattgcggttctcttggatggtccgcagggggtggatggggccacggatcgattgggtgtttcgctgctgcgtggtgccacctggccggatccatcggcggatcagggtcagcagcggatgcgattggcgctgatgccgtttcaaggcagctgggcccatgcagcggtgccccaggcagccatcgcctttcgcgaacct

SEQ ID NO: 44736 - DNA, 1362 bp, SYNECHOCOCCUS SP. WH 8102
gtcccgtcgatcgggccctcgctcgggtcttcagcgccaggtttcggcacggacggcatccggggacgtgccggcaccgagctctcaccggccctctgtctgcaggtgggttactggatcggtcgcgtgctcaaggccgatggtccggtgttgatcgggatggattcccgcagcagcggcagcatgctggtggcggctttgaccgcaggactgacggcggcgggtcgagatgtctgggagcttggcctctgtgccacgccggcggttcccctgctgatccgtgaggtgggtgccgccggtggattgatggtctcggccagtcacaacccccccgccgacaacggcatcaaggtgtttggtgccgatggcacgaagctgagcgccgagcgtcaggcccgggtggagaccggcctgcggggtgaggtcgaggacgatggccccagccgctgtggtcgctcggttcagcggcaggacctgctcaggtcgtatcaggacaagttgctgagttcggtgggggatcggcggctcaatggtgtcccgatcgttcttgatctctgctggggttcagcgacggcctgtgccgctgaggtgtttcaaaccctcggcgcagacctgacggtgctgcatggccagccggatggggaacggatcaatgtggcttgtggttcaactcagctggatcccctgcgccaggccgtggtggcccaaggggcggtgatgggcttcgcctttgacggtgacgccgatcggatgctggcggtcgatgcccgcggtcgggtggttgatggagaccatgtgttgtacctctggggatcggtgctccaggaccagaaggcgcttcccggcgatcgactggttgccacggtgatgtccaacctgggatttgagcgggcctgggagcgtcgcggcggtgaacttgagcgcacgcccgtcggcgaccagcatgttcatgccgcgatggtggccaacggtgcagcccttgggggtgagcagtctggccacatcttggcggcatcccatgggctctgcggtgatggggtgctgacggcgctgcagctggcgacgctgtgccatggccaggacatcgccttgagcgactggttggatcgcagtttcaaggcctatccccagaagctggtgaatgtgacggttccggaccgagcccgccgcaagggatggtccagttgcatgccgcttcaggaggcggtgctacaggcggaggcgagcatgggtgcagctgggcgggtgctggtgcgggccagcggcaccgaaccggtactgcgggtgatggtggaatcagaagaccagtcgctggtggaccgctggacccagcatctagctgccatggccgacgagcacctc

SEQ ID NO: 44737 - DNA, 1014 bp, SYNECHOCOCCUS SP. WH 8102
ctgatgagcggttggcaccatcgccacattctcgatctggcggccttctccagggaggattacgccgccgtgctcgatctggctgagcggtttcgttccctgcctgtcaccggtgcccgcaaactcccggctttgcagggccgtttggtggcgaccctgttcttcgagcccagcacccgcacccgcagcagctttgagctggccgccaagcgcctctccgctgatgtgcagagtttttcgccctccagcagctctctgagtaaaggggaaagcgtgctggatactgcccgcacctatgtggcgatgggcgcggatgtgttggtggtccgtcatcgttccaccggggttccccagcaattggcggaggatctggagtcggcaggggagcgcacggtggtgctgaacggcggtgatggcctgcacagccatcccagccagggattgctggatctgcacaccctggcccgtcacttcgcaccgcagcatccgatgccggaagccttgcaggggcgacggatcgtgattgtcggcgacatcctgcactcccgggtggcccgctccaatctctgggccctcaccgcctgcggtgctgatgtggtgctctgcggcccgccgagtttggtgcctgacgccttccgtgcgttcgtggaggctccgccgccagggcagtctgcggatccggttccacagcgcggatcggtgcgggtggagcggcgtctggagcgtgccttgcccggcgcggatgcggtgatgacgctgcgtctgcagaaggaacggatgacacagcagctgctgacggggttggagcgctaccaccgcgatttcgggctgagccatgagcggctcagcctgtgcggccagccagtgccggtgcttcatcccggtccggtcaaccgtggcgttgagatgaccggagcgctgctggatgatccgtcgatctgtctggtggaggagcaggtgcggaacggtgtcccgatccgcatggccttgctttacctaatggctgcggctgaa

SEQ ID NO: 44738 - DNA, 1282 bp, SYNECHOCOCCUS SP. WH 8102
ctgattccaacgatcagtcgtttcaacgtcatcaagggggcttcggcccccttttttgatgcctggtgacaaatcgcgatgatctgggagaatcgcccggacttcaggccttgccatgaccgccagcgcacctgcttctgcccagcgatccggtgtgattgctccctacggcgggtccctggtggatctgatggtgcctcaggaggagcgggaggccgtcaaggccacgaccaccaagtcgctggaatgctccgatcgcaatgcctgcgatgtggaactgctggtggtgggtggtttctcccccctccgcggcttcatgcatcaggaggactacgacgctgtggtgagcggccatcgcctggtggccggtcagctgttcgggctgccgatcgtgatggacaccgaccgtgaggacgtggtggtcggcgacacagtgctactgacgtacaagggtcagaacttggctgtcctgcaggtggaagccaaatgggaacccaacaaggtggtcgaggccaagggttgttacggcaccacatcgatcgaacacccagcggtgcggatgatcaccatggagcgcaagcgcttctacctgggtggcagtcttaatggtcttgaactgccccagcgtgtcttcccctgcaaaacaccggcagaggtgcgcgccggcctgcccgacggtgaagacgtggtggccttccagtgccgcaacccgatccaccgtgcccactacgagctgttcacccgcgccctgcacgctcagaacgtgagcgagaacgccgtggtgctggtgcatcccacctgtggccccacccagcaggacgacattcccggtgcagtgcgcttccagacctatgaacgtctggcggctgaagtgaataacgatcggatccgctgggcctatctgccctatgcgatgcacatggcgggtcctcgcgaggccctgcagcacatgatcatccgccgcaactacggctgcacccacttcatcatcggccgcgacatggcgggatgtaagtcctccctgactggtgacgacttctacggcccctatgacgcccagaacttcgccaaggaatgcgctcctgagctgaccatggaaacggtgccctccttgaacctcgtttataccgaggaagagggatacgtcaccgccgagcacgccgaagcccgtggcctgcatgtgaagaagctcagcggtacgcaattccgcaagatgctgcgcggcggcgaggaaatccccgagtggttcgccttcaagagcgtggttgaggtgctgcgcgcc

SEQ ID NO: 44739 - DNA, 1833 bp, SYNECHOCOCCUS SP. WH 8102
aacaagcgttggcgcaacatcggcctaacagccctactagtcctggcgatcgtggtgatcgccccggccttcctcggcggtggtaacacccagcaggaagcgcggaccatgcgctacagcgatttcgttgaagcggttgaggacaaccagatcagtcgtgtgctgatctccccggatcggggcacagctcaggtggtggaaaacgacggccgccgcgcccaggtgaacctggctcccgataaggagctgctgggtctgctgacgcagcacgacgtggacatcgctgtgcagcccacccgccaggctccggcctggcagcaggccgctggaagcctgatcttcccgctgctgttgctgggtgggttgttcttcctcttccgccgtgcccagggcggtggcggtggcaatcccgccatgcagttcggcaagagcaaggccagggtgcagatggagccctccacccaggtcaccttcaccgatgtcgccggcatcgaaggcgccaagctcgaactcaccgaggtcgtcgactttctcaagaatcctgatcgattcacagccgttggcgccaagatccccaagggtgtgttgctggtgggccccccaggcaccggtaagactctgcttgctaaggccgttgcaggtgaggcgggtgttcccttcttctcaatctccggctctgagttcgtcgagatgttcgtgggcgtcggtgccagccgtgtccgtgacctattcgaacaggccaagaagaatgccccttgcatcgtctttatcgacgaaatcgatgctgtcggccgtcaacgtggagcaggccttggtggcggtaacgatgagcgggaacaaaccctcaaccagctcctgacggagatggatggtttcgagggcaacaccggcatcatcattgtcgcggcgaccaatcgccctgacgtcctggatgctgcgctgatgcgccccggccgtttcgatcgacaggtcaccgttgatcggcccgattacgccggtcgcctccagatcctcaatgtccacgcccgcggtaagacgttgtccaaggacgtcgacctggacaaagtggcgcgccggacccccggctataccggtgctgatctggccaacctgctgaatgaggctgccatcctggctgcccgtcgcgaactgaccgaggtcagcaacgacgagatcagtgatgcgattgagcgcgtcatggccggtcctgagaaaaaggatcgcgtcatgagcgaacgccgcaagcgtttggtggcgtatcacgaggctggtcacgctctggtcggtgctctgatgcccgactacgaccccgtccagaagatctcaatcattccccgcggaaatgccggtggtctcaccttcttcacgcccagcgaggaacgaatggagtccggtttgtactccagggcttatctgcagaaccagatggcggtcgccctgggtggccgtgtcgctgaggagattgtctacggcgaggacgaagtcaccacaggtgcctccaacgacctgcagcaggtggcctcaacggcccgtcagatgatcacccgcttcggcatgagcgataccctcggccccgtggcccttggccgcgcccagggcggaatgttcctcggccgcgatattgcagcagagcgtgacttctctgaagacactgccgccaccatcgaccaggaggtgtctgagctggtggacgtggcttacaagagggccaccaaagtgttggtcgataaccgggctgtgctggatgaactagccgacatgctggtggaacaggagactgttgacgccgaggagttgcaggaactcctgattacccgcgacgtccgcgttgcc

SEQ ID NO: 44740 - DNA, 1080 bp, SYNECHOCOCCUS SP. WH 8102
atgggcagcagcttcggcgatctgtttcggatcagcaccttcggtgagtcccacggcggtggcgtgggcgtgatcgtggagggctgccctccacgcctggatctggatgttgacgccatccaggcggagttggatcggcgacggccgggtcagagccacatcaccaccccacgcaaagaagccgatcaggtggaggtgctcagcggccttctcgatgggcagaccaccctgggaacaccgatcgccatgttggtgcgcaacaaggaccagcgccccggcgactacaaggacatggccgtggcgtttcggccttctcatgccgatgccacctaccaggtgaaatacggcgtgcaggcccgcagtggtggcgggcgggcctcagcccgcgaaacaattgggcgcgtggccgccggtgcaatcgccaagcaactgctggcaaaggccgcaggcacggaggttctggcctgggtcaaacgcatccacaccatcgaggcgaatgtggatccccaggcggtaacgctggacgccatcgagagcaacatcgttcgctgcccggatgcctccacagccgctcagatggtggaacggatcgaggcgatcgggcgcgacggcgactcatgtggtggcgtgatcgaatgcgtggtgcgtaaccctgctccggggctgggtatgcctgtgttcgacaagctggaggccgatctggccaaggcggtgatgtctctccccgccaccaagggctttgagatcggttctggcttcagcggaaccctgctcaagggcagcgagcacaacgatgcctttgtgcccaccgatgatggacggctgcagacggccaccaacaactcaggtggcatccagggcggcatcagcaacggcgagccgattgtgatccgggtggcgttcaagcccaccgccacgatccgcaaggaacagcagaccattgattccgacggcaaggccaccaccctggccggcaagggtcgacacgacccctgtgtgctgccgagggccgtgccgatggtggaggcgatggtggcgctggtgctggcggatcacctgctgcggcagcagggtcagtgc

SEQ ID NO: 44741 - DNA, 1361 bp, SYNECHOCOCCUS SP. WH 8102
cgccatcaggcctgaactgctgcgggatgcccatcggcaaagtgctgatcgccaaccgcggcgaaattgccctccggatcttgcgcagctgccgcgaactcggcatcgccaccgtggccgtttacagcacggttgataaagacgcgctccatgttcagctggccgatgaagcggtctgcgtcggcgacgccctgagcagcaagagctatctcaatgttcccaacatcctggccgccgccacctcccgcggggtcgacgcgatccatcccggttacggcttcctggctgaaaacgacaaattcgccgagatgtgcggcgaccacggcctgaccttcatcggtccctccccccacgcgatccgctccatgggggacaaatccaccgccaaggccaccatgcaggccgtgggcgttccaaccgttcccggcagcgagggattgctggcgggaccacaggatgccgccgtgctggcggagcagatggggtatcccgtgatgatcaaagccaccgccggaggcggcggccgtggcatgcgtctggtgcagagcccggaccagctgaacaatctgttcaaggccgcccagggagaggcggaggccgccttcggtaatcccgggctgtacatggagaaattcatcgatcgcccccggcacgtggaagtgcaggtgctggcggaccgccacggcaatgtcgttcacctcggcgaacgggactgctcgattcagcgacgccatcagaaactgctggaggaagcccccagcccggccctggatcctgatctacgccgtcgcatgggtgaagcggccgtggccgcagcccgcagcattaactacgagggcgctggcactgtcgagttcctgctcgaccgcagcggtgggttctatttcatggagatgaacacccgcatccaggtggagcatccggtgacggagatggtgaccgggatcgacctgatcgccgagcaactgcgcattgccggtggagagcccatcagcgttcagcagggggagatcaacctctccggccatgcgatcgaatgccggatcaacgccgaagacgccacccacaatttccgaccagcacctgggcgcatcaccggctggcttccaccgggcggtcctggtgtccgtgtcgatagccatgtgtacaccggctacgacatcccgccgttctacgactctctgatcggaaaggtgatcgtctggggtcgcaaccgcgacgtggcgttatcgcggatgaaacgcgccctgaatgaatgcgccgtcactgggattcccaccacggtggaatttcatctagccctgctggatcgcccggagttcatcaacggcgacgttcacaccaagttcgtcgagcaggac

SEQ ID NO: 44742 - DNA, 3597 bp, SYNECHOCOCCUS SP. WH 8102
ttggttcacatcaatcaggtcgggctgacgcagttcaagtcgttcggtggggcgatgacgatccccctcgagcaggggttcaccgtggtgacgggaccgaatggctcgggcaagagcaacattcttgatggcgtcctgttctgccttggcctggccaccagccgggggatgcgagcagaccgcctgccggatctaatcaacagcgccgtgcttaaggcgggcaaggccgccgagacgacggtgtgcgtccgcttcgacctcagcgactggcagccggatgctgctgaagacggtctcgaggcgccggaggagggtccctggatcaaaccggggcagaccgaatggaccgtgagccgcaagctgcgggtgatgcctggggggtcctacagctccagctacagcgccgatggggtggcctgcaacctgcagcaactgcagacccagttgaggcggctacgcatcgaccccgaaggcagcaatgtggtgatgcagggcgatgtgacccgcatcgtctcgatgagcaaccgcgaccgccgcggcctcatcgacgaactggccggtgttgccctgttcgacagccgcatcgagcagacccgccgcaagctcgacgacgtgcaggagcggcaggaccgctgccggatcatcgaacaggaactgctggccagtcgccagcgcctggaaaaagactgcgccaaggctcgccagtaccagcaactgcgggaacggctgcagctgggccgccgtcaggagatggtgctggccttcgaagcggcaggccaagcactcagggatctggccagccgtcagcaggcccttgaagcccaggagcaacgggatgctgcggcaatcgccagcggcaaggagagtctcagcaaggccagcgccgaactgcaaaccctgcaggagcaggtgaaagccctgggggaagatcagctgttggcggttcaggcggagctgaagggtctggagaccagcgctcgggagctggaacggcaggccggccgccatcaggaggaaggacagcggctgcaggggttgcgccatgacctggccaaccgccgccaggactggctgcaccagtcccgcgagcttgagcaggatccccatcaaaattctctggctgctgccgaggccacctgtcggggggcggaagcagcggtggaggtctccaggcggcgccttggtgatgtcgccggccgctccggtgcctggctggaggagcagaaacgacgcagcggccgtcgccaggagctgcaggtcgccctggcaccgctgctggaggaacagcagcaactgcaggagcggctgcggcaggacgcggaacggctgacggaactgcagcaggagcaacagcaggacggcaacgacgagcaggcggtgcagcagcgactggagcagctggagcaggactggcaggccctgctccagagcctctcgtccggaaaacaggcgctgcagcagaccgcagactccctggcgatccaacagcgcacccgatcgcgactggagcaggagcagacccggctggaacgggagatcgctcggttggaaagccgccgcgacgcactgcaggagacccgcggcaccggcgccctgcgcctgctgctggaggccggtctcaacggcattcatggcccggtggcgcaattgggggaggtggaggactgtcaccgactcgcccttgaagtggccgccggcgcccgtctcggtcaggtggtggtcgatgacgaccgcatcgccgcccaggccatcgcgttgctcaaaagccgccgcgccggccggctcaccttcctgcccctcaataagatccgcgccccaggcggtggcaacagcggtgctgccttcgcccgggggccccgcgccggcggaggcgagaacagcgatggcttggtgggccgcgccgtcgacctggtgcggtttgagcccgtctacgaccaggtgtttgcctacgtcttcggtgacacgctggtgttcagcgatctcagcagtgcccgtcagcagctcggccgcagccgcgccgtcaccatcgatggtgagctgctggagaaaagtggcgccatgaccggcggcagcctgtccccccgcagcggtggactgagttttggccgcagcagcgatcaagacgaagcagagccattgcggaggcgcctgctggaactgggggaaaccctggccgcctgccgccgggaggaatcaaagctggcccagaccctggagcagcagaaaccacaactgcgggagctggaacaacgccaggccgccctggtggccgaacgcaatgccgcccgccgcaaccatggccccctgctggaacgcagccggcagcgagctgaacgcctgagccgcctgtcacaggagcagagcgatcagcagcaacggctggcggtgatcggacaggagctgacgccactacaggaggaactgcaccagctggaagccgctgaacgcaacagcgacggccatgacgatgccggcgcctggcagcaactgcagcaggatctggaggcggctgatggccgcctggacagcgcccgcaaggaacgggacgcgctgctgcaatcccaacgcgaacggcagctggcgatcgaacgtctgggggaccagcgccagacccttgaggaggaggagcgccggctgcaggaggctgttcaggccctggccgcaacccacaccagttggcgcgagcaacagctacagctgcaacaacagcgcagttccctgcagcaacaacagtcggatctacaggaacggttcggcgagcagcgccgcgccagggatgccgctgaagcggaggtgggccgccaacggcaggcgttgcagcaggccgaatggaacctggagcggctgaaggaggaacgcgagggactgatcgaggagcaacgcagtggcgccgtgaggctgcaggagatggagcaggccctgccggatccccaacctgagattcccgaggagctacgacttgcagggctggaagccctgcaggccgacctgcagacgattcagcaacgcatggaggcgctggagccggtgaacatgctggcgctggaggaactggaggccctcgagcaacggctggccgaactcaacgaacgactggaggtgctcaacagcgaacgggaagagctgctgctgcggatcgaaaccgtcgccaccctgcgccaggaggccttcatggaggccttcaccgccgtggatggtcatttcagggagatttttgcctccctctccgatggcgacggccaactgcaactggagaatcccgacgaccccctcgagggaggcctgaccctggtggcccatcccaaggggaaagcggtgcggcggctggcggcaatgtctggaggggagaaatccctcaccgccctcagcttcctgtttgcgctgcagcgcttccgcccctcccccttctatgccctggatgaggtggacagctttcttgatggcgtgaacgtggaacgcctggccgcactgattgccacgcaggccgagcaggcccagttcatggtggtgagccaccgccgaccgatgattgcggcggcggaacggaccatcggtgtgacccaagcccgcggcgcccacacccaggtggtcggactt

SEQ ID NO: 44743 - DNA, 335 bp, SYNECHOCOCCUS SP. WH 8102
atgccgttcattagtgtcaagaccaatattaccgatgtacagactccaaatggccttttaaagaagctttctgctgctcttgccactgccacgggtaagcctgagtcgtatgtaatgacgcttttggactctggtgttccaatgacattcgcaggtagtgaagagccttgcgcttatgtagaggtcaaatcatcggagctttgacgcctcctgcaatgtctgatcaattttgcgaattgatcaagtcgtctttaggcattccgaaggatcgtatttatattgggtttgacgatgtcaatgcttctaactgggggtggaatgggcgtacttttggc

SEQ ID NO: 44744 - DNA, 1236 bp, SYNECHOCOCCUS SP. WH 8102
atggctctcagagctgaaccagcagcagtggtggggtggggttccctcaacccccttggagccgatgcaaacagcacctgggatgcggtgatcgccggccacagtggcattcagaccctgcaggctccctggagcgaggatttacccgtgcgactggccggttgcgtcccaacgggtgccctcgacagcctgccgcccctgctccgccgccgctccgatcgctgtgcccagctcgccctggtggccgcccggcaggcctgggccatgaccggtcccatcacccaagggctcgatcccagtcgcatcgccgtggtcatcggcaccggcatcggcggactcgccaccatgcacgatcagcacacgcaactcagcacgggtggaccaagccgggtgaaccccctcaccgtgccgatgctgattccggatgccgccgctggccaggttgccattgagctgggtctgctcggcggtgcccacaccccggtgtcagcctgcgcctccggcgccgaagcattgatgctgggccagatgctgctcaacgacgaccgcgccgatctggtgctggccgggggcagcgaagcaccggtgaatcgactggggctggtgggctttgccgccatgcgcgccctctccagccgcaacgatgcccccgatcaggcctcccggccctacggcctcggtcgagatggcttcgtgctctccgaaggtgccggggtcctggccctgatgcgccagcgggatacgccagcaggagctgatctgggttggttgctggccagcggcagcagcagcgatgcccatcacatcgtcgcccccgaaccccaggggctgcaggccagccgtgccattgatgatgccctgcgccgggcggatgtgagcccctcggacctctgtggcgttcaggcccatgccaccggcaccagcctcggcgatctggcggaggccagagcattgcggcgcagcctcggcagcgccgccgatcatctgccggtctgcgcccccaaaggccagctcggccatctgctggggggcgccggagcggtggaaaccatcctggccctgcaggctctgcgcctcggcgtactgcccggcagcctcaacgccgatcccctggatccggaggtggagctggcggtggccaaccagggccctgtgcagctgtcttcagatcaaggccaacggctcttgctcaaaaacgccttcggctttggcggtcacaacatcagtcttgtgctt

SEQ ID NO: 44745 - DNA, 2784 bp, SYNECHOCOCCUS SP. WH 8102
gctggagagctaaggcgctatggaacgggcaagcaattggtcgccgccggcgagcgccccgacggcgtctggttaatcaccaagggaggtgttcgcagcatggcgcagctgccccccaaaggggactggcgaacggtgcaacgccatggcgtcggcgaccttgtgggttggctcgggcttgttcagggtcaacccctcgagcacctgcgcacctccgatctcaccgaaacccagttcatccccgctgatcagtttctgcagctctgggatgagcaaccgaagctgagccaatggtgtgcccagcagatgcccgccatcgaagtggtggatctgatgatccgtctcgcccaagccaaccccgccagggcacgccaactggaggaatggcgtaacgcactaagcctccattccatggcacgggaagcgagtggtcacgacaacgacgatccgcagaccgtgggcggtggccagtggcactggcccgatggaacgatctggccagccaggccgagcaacgaagggctgcagcaacggttgatctggctgccagatccgaaacttcaggccctggacaactactttgccgccgagattgttccgacggacgcgtcccccagcaccaatttgacaccggaggtgctcagcctgccgcgcgccagtgggccccgcgacattcccatggccctctgccaagcactggctcagcatttcggcgtgccgttctggcgcgacaacgtgcgtgacgaagtggaggccctgctggcaaggcagccccagctcaacctattcaacatcggccagctgctgaacaaccttgatctatcggtgtcgttggcggagattcccctcgctcagcttcggcgcacgccggctcccgccgtgctggagcatgacggccgcatcgccatcctcgaaggtgtggaccccgatgggcaacttcgcttgctggagccggagatcggcccggtccgtgtgccgctcgaggctgtgctcagcgaagaggccgatcgcctcagcctgctgctgctgcgccgccgtccggacagcaaaacccagcgtttcagctggggctggtatggcccgttcctgcgcccccaccgccgcgaactgattgaggtgatcgccacctcagcggtggtgaacgtgctggccctggtgaccccccttgggatcatgcggctgatcaacgcccggtcgggaggcagcgattccctcgatggtgtgatcagcatcggcgtgatcctgatcggcgccacggtggttgaggccattgcatcggccttgagaagtctgatcttcacgggcatcgctaaccgggtggacatggacacccgcgaaacgatcctggatcgccttgtccgcctgccgcaggctttcttcgatgagcggccggtcggccggatcacctactacttcacccagctcgatcgcctgcgtgattttctgatcagcaaggcgctcaccaccatccttgatttcagcttcagcctcctgtacgtggcagtgctgtttgccctgaatcctctgctgactctggtcaccctcagcaccctgccgctgttcatcgtgctggccatcatcgtgaatccggtcgtggagacccagatcgagcgcacgatcgaggagggggtcaacaccaacagctatctgaccgaagccctcaccggcatccagaccatcaagtcccagaacgccgaactgaagacgcgctgggaatttcaggaccgttatagccgtttcatcggtgaagacttcaagctcaaggtgtcgggggaaaccatcggcgccctggccaagttcctgggagaactgtccagcatctccacgatggttgtcggcgtctggctggtgtcacgcaacgagctcagcatcggtgccctgttcgccttccggatcatcggcggcaaggtcaccggtccgatggtgcagttggtccagacctggcagcaattcaagattcaaagccgcaatctgaccctggcggcggatgtggtggaccgtcccaccgagcaaagcgatcttcaggccagcaacatcccgatgcccctgattcagggcagcgttcatatcgactccgtcgacttccgctacagcctgaacggccctccgatcctcaacaacgtctctttggacgttccgatgggcacatttgttggcatggtcggcggctccggctccggcaaatccaccctgctgaagctgctgcctcgcttctacgaacctgaacagggtcggattcagatcgatggcctggacgtgagcaaagttgagctttattccctgcgacgccagatcggtgtcgtcccccaggactccctgctatttgacggcacgatcaaggacaacctgctgatggtgaaaccggatgccaccagtcaggagctgatccgagccaccaccatcgcctgcgcccatgacttcatcatggagcttcctcagggttacaacgcatcggtgggggaacggggagccgggctctccggcggtcagcgtcaacgcatggccctggcccgtgccgtgctccagaacccacgcatgctgatcctcgatgaggccaccagtgccctggatgcgcggacggaacgtcaggtgtgtcgcaacctgttcgaagccttccgcggtcgaaccgtgttcttcatcacccaccgcctctccacggtgcggccggcggacatgatcgtgctgatggatcagggcgccgtgatggaggtgggccagcaccaggagctgatggagcgacagggttggtactacgccctgtatcagagccagagccaggaaggt

SEQ ID NO: 44746 - DNA, 1092 bp, SYNECHOCOCCUS SP. WH 8102
gccaaaactgccctgatcacaggcattacaggccaagacggcagttacctggcggagcttctgctggagaagggctatttggtgcacgggatcaagcgccgggccagcagcttcaacaccactcggatcgatcacctgtatcaggatccgcacgagagcgatcctcgactggtgctgcactacggcgatctcaccgacagcaccaacctgatccggatcatccagcaggagcaaccggacgagatctacaaccttggtgctcaaagccatgtggccgtgagctttgaggcgccggaatacacggcaaacagcgatgcccttggcaccctgcgcatcctcgaggcggtgcggatgctcgggctcataggaaaaacccggatctatcaggccagcactagcgagctctacggcctagtgcaggaggtgccgcagaaggagtcgacacccttttatccgcgcagcccctacggcgtcgccaagctttacgcctactggatcacggtcaattaccgcgaggcctacgggatgtatgcctgcaacggcatcctgttcaaccatgagagtccgcggcgcggcgagacgtttgtgacccgcaagatcacccggggtctggcgcggatcgatgcggggctggagcagtgcctgttcatgggcaacctcgattccctacgcgactggggccatgcgcgcgactacgtggagatgcagtggcggatgctccagcaggaaggtccgccggaagacttcgtgatcgccaccggccggcaggagtcggtgcggcgctttattgagctagcagcatccgaactcggttggggcagcatccagtggcagggcagaggcttgcaggaaactggatctcgcgccgacaccggcgatgtggtggtgcgtattgatccgcgctatttccgcccggcagaggttgaaacgctgcttggtgatcccaccagagcaaaagagaagcttggctggatccccaccaccaccctggaggaacttgtggccgagatggttgccacggatcgggaggacgccaagaaagatgcacacctcaaacgcaagggttttgcggttgttggttcgatggagaac

SEQ ID NO: 44747 - DNA, 2478 bp, SYNECHOCOCCUS SP. WH 8102
gcctatccgatcgatgcgctcctgcctgagctgtgcgcccgattccagccagggcgcacgttgttgctccaagctccgcctggcgcaggaaaaaccacccgggttccgcttgccctgatcggtgccctgggggaccaggtccgcagggacgggcggatctggatgattgaaccccgccggctggcggctcgggccgctgcagaccgcctggcctccagcctcgaggaaccggttggacagcggattggcttcgccgtgcgcggtgagcagcggcgatccgcccgaacccaggtggaagtcatcaccgacggcctctttctgcgacggctgcaggcggatccctctctggacggggtgagctgtgtgctgtttgacgaatttcacgaacggcgccgcgatgccgacctcgccttcgccctgctgcgggaagccgccgctttgctgcggccggacctgagcctgatgctaatgtcagccaccttggacatcgccgacctgcgctcacggctgcccgaggccacgctgctgaccagccaaggccgggcccaccctgtcgacaccctgcaccaacccccacgggcggacgaaccactgccccagcaagtgctccgtgccgtggagacccatggccttgatctcccgacaggcagtggagtgttggtgtttctgcctggactggcagagatcgagcgctgccgggaacggctggagcacgccgatgccctcaggcactggcagatctgccccctccatggccagctgcctctggagcgccagagcgatgcgctgaaacgctgccctgcaaaccgcgacggcaagctggtgctggccagtggtattgccgaaagctcggtcaccattgatggcgtgcgcctcgtgatcgacagcggcctgagccggcagctgcgcttcgatccgaacaccggcatggagggtctcgagaccgtgcccgccagccttgcgagtgcggatcaacgacgcggcagggcgggtcgccagggacctggctgctgcgtccggttgtggtcgccagccgagcaacaacgacgcccatccttcagcccaccggaactgctgctggcggacccccaaccggtggtgatggagctggcgggatggggcgcagggctgggggatgcgcttccctggctggatccaccaccccaagcggccctgcgggaggggcaaggggagctgaaaagcctcggcatccttgacagagacggccgattaaccgccatcggccttcagctgacgcagctgggggtccacccacgccttggtctgctgatggtggaagctcagcgccatggccgcagccggcttggctgcgatctggccgccctcctgagtgaccgggatcccctgtctgcagcggaggtgggctgcgaccttgaagcccgcctcgaggccatgggcgagcagaagcgttgcaaacccctacgggagctgagccgtcaactggagcggcaactggaacgcctggggatcgatcccgatgccgagggcacgggcatcgacagcgcccagttgatcctcaccgccttcccaaaatggctcgctttacaacggcccggacaaacggggcgctaccgactgcgccagggtcgtggggccatccttcgtccaacagacccccttgccggctctgaggccctggcggtggccaggctggacatgggccaacgggacaccaggatccagctggcggtgcccctcagccgtcaacgggtggagcagctggccctgcagcaaggggaatggctggatcaggtcagctgggatgacaaatcagagcggattcgagccgaacgtcagctgaagctgggggcgctggtgcttcgccaggaggcgcaaccggctccaccggccgagcagtgccgagatcttctgctcggccgcttcagggaatccggccggctggagctgctgccctggtcagacagctgtgaacaactgcgtcgacgtctggcgctggcgcaccgccaccgagggtctccatggccgaaccgggatcgcatcccactgattgagcatcccgagcagtggctggggccctgcctggagggctgtctcagctggcgagacctggatgaactcagcctgcaggaggccctctggggtgagctgagctgggagcatcgccagcagctgaatcggctgctgcccctgcgtttgagcatcccctccggccgggaagcaacgctccgctacgaggatgaggaggtagtgcttgctgtgaaattgcaagagatgttcggctgccaggaagggccgaccgttcttgacaaccggctggcggtgaccgtcgaattgctctctcctgccggtcgtcctctgcaacggacccgcgatctcagaggcttctggcagggcagctacaacgacgtacgccgcgagatgcgcggccgctatcccaaacatccctggcccgacaacccgctcgaggcgatcgcaacagccttcaccaagcgacga

SEQ ID NO: 44748 - DNA, 630 bp, SYNECHOCOCCUS SP. WH 8102
ctggcttgggcacaccagcgcttcggatccggatttgctctcaccaccagcttcggcatccaatcggcggtgctgctgcacatgctcagtcaactgccggagggtgacgccgttcctgtgatctgggtggacactggctatctgccggaggagacctaccgctatggcgcccagctcacgaagctgctcagcatccgcctggtggtggctcaaagcgccatgtcgccggctcggatggaggctctgcatggccgcctctgggacaccggacagctcgatgatcttgagaaataccaccagatccgcaaggtggagcccctggatcgggctttggcgcaactggaggtgagctgctgggccagtggcgtgcgtcgcggccagactgaccaccgccgcgcgatgaccgtgctggacccgatccgagagcggctgtctctgcgtccgctgttggattggacccagaaggacatctactactacatgcaggacaacaacctgccgcaacacccgttgttcgagcagggatactcaaccgtgggggattggcactccagtgctccggatggcgctgagctcagcggacgtaacacccgtttcgggggcctgaaacaggaatgtgggatccacgtt

SEQ ID NO: 44749 - DNA, 1602 bp, SYNECHOCOCCUS SP. WH 8102
cctttcacggatcagaaacccggcacatccggtttgcgcaaaagcagccagcagttcgagcaagcgaactatctggagagctttgtggaagccgtattccgcaccttgcccggtgttcaagggggcacgctggtgttgggaggtgacggccgttacggcaaccgccgtgccatcgacgtgatcctgcgcatgggcgcggcccacggcctcagcaaggtgatcgtcaccaccggcggcatcctctccaccccggcggcctcgaacctgattcgccagcgtcaggccatcggcggcatcatcctctcggcaagccacaaccctggcggccccaatggagacttcggcgtcaaggtgaatggcgccaacggtggcccgaccccggcctcgttcaccgatgcggtgttcgagtgcaccaagaccttggagcaatacacgatcgttgatgccgcggccatcgccatcgatacccccggcagctacagcatcggcgccatgcaggtggaggtgatcgacggcgtcgacgacttcgtggctctgatgcaacagctgttcgactttgatcggatccgggagctgatccgcagcgacttcccgctggcgtttgatgcgatgcatgcggtcactggcccctacgccactcgcctgttggaagagatcctcggcgctcctgccggcagcgtccgcaacggcgttcctctggaggacttcggcggcggccaccccgaccccaacctcacctacgcccacgagctggccgaacttctgctcgacggggaggagttccgcttcggggccgcctgcgacggcgatggtgaccgcaacatgatcctggggcagcactgcttcgtaaaccccagcgacagcctggcggtgctcacagccaacgccacggtggcaccggcctatgccgatggtttggctggcgtggcccgctcgatgcccaccagctctgccgtggatgtggtggccaaggaactgggcatcgactgctacgagacccccaccggctggaagttcttcggcaatctgctggatgccggcaaaatcacgctctgcggtgaagagagcttcggcaccggcagcaaccacgtgcgtgaaaaggatggcctctgggctgttctgttctggctgcagatcctggccgagcgccgctgcagcgtcgccgagatcatggctgagcattggaagcgcttcggccgccactactactctcgccacgactacgaagccgtcgccagcgacgcagcccatgggctgttccaccgcctcgagggcatgctccctggtctggtggggcagagcttcgctggccgcagcgtcagcgcagccgacaacttcagctacaccgatcccgttgatggctctgtgaccaagggccagggcctgcgcatcctgctggaggatggcagccgcgtgatggtgcgcctctcgggcaccggcaccaagggcgccacgatccgcgtctatctggagagttatgtaccgagcagcggtgatctcaaccaggatccccaggtcgctctggccgacatgatcagcgccatcaatgaactggcggagatcaagcagcgcaccggcatggatcggcccaccgtgatcacc

SEQ ID NO: 44750 - DNA, 813 bp, SYNECHOCOCCUS SP. WH 8102
atggcaatccgtaacttccgcccctacacccccggtaccagaacccgggtggtcaccgacttcagtgaggtcaccggccgcaagccggaacggtccctggtggtgtccaaacaccgccgcaagggccgcaacaaccgtggtgtgatcacctgccgccatcgcggtggcggtcacaaacggctgtaccgcgtggtggacttccgccgtaacaagcacggcatcaccgccaaggtggctgccatccactacgacccccatcgcaacgcccgtctggcgctgctcttctacgccgacggcgagaagcgctacatccttgccccggcaggggttcaggtggggcagaccgtggtctccggacccgacgccccgatcgagaacggcaacgccatgccgctgtcggccgtgcccctgggttccagcgttcactgcgttgagctctatgccggccgcggtggccagatggtccgcaccgctggtgccagcgctcaggttatggccaaagaaggcgactacgtcgccctcaagctgccttccaccgaggtgcgcctggtccgccgtgagtgctacgccaccctcggtgaagtgggcaactcagaagtccgcaacaccagccttggcaaggccggtcgtcgccgctggctggggcgtcgtccccaggttcgaggcagtgtgatgaacccctgcgaccacccccacggtggtggtgagggtcgggcaccgattggccgctcaggcccggtgaccccttggggcaaacccgccctcggtctcaagacccgcaagcggaacaagcccagcaaccgatacgtgctc

SEQ ID NO: 44751 - DNA, 2919 bp, SYNECHOCOCCUS SP. WH 8102
ctgctgcagcatcgcctcgagctggtggaagacctgtggcagaccgtgctgcgcagcgaatgccccccggaacaaagcgagcgactgcttcgcctcaagcagctgagtgatccggtggccctggaaggccgcgacggtgagagcagcagcgaggcgatcgttgagctgatccgcagcatggatctctccgaggccatcgcagcagcccgtgctttctcgctgtatttccagctgatcaacatcctcgagcagcgcatcgaagaagacagctatctcgacagccttcgtcccagccgcagccaggacgacgagaccgcggcgccctttgatcccttcgcgccgcccctggccagccagaccgaccccgccacattcggcgaggtgttcgagcggctgcggcggatgaacgttccccccgcgcaggtggagacgctcctgcgggaacttgacatccgactggtgttcaccgcccacccgacggaaatcgtgcggcacaccgtgcggcacaaacagcggaaggtggcctccctgctgcagcggttgcagtcagagccagcgctgccccgctacgacgaagaggaattgcgacgccagctggaggaggagatccgcctctggtggcgcaccgatgagctgcaccagttcaaaccgacggtgctggatgaggtggattcaaccctgcactacttccagcaggtgctgttcgaggcgatgccgcagctgcggaggcggctggtgtcatccctgagccggcactaccccgatgtgcagttcccccaggcgtccttctgcaccttcgggtcctgggtggggtccgaccgcgacggcaacccctcggtcaccccggagatcacctggcggaccgcctgttatcagcgccagctgatgctggagctctacatcggctcggtgcaatccctgcgcaaccagctgagcatctcgatgcagtggagccaggtggccccaccactgctggaatcgctggaaatggaccggctgcgcttcccggaaatctatgagcgccgggccgcccgctatcggctggagccctaccggctcaagctcagctacatcctcgaacggctggagctcacgctgcagcgcaaccatcagatgtcggaggctggctggcagtcgccgcccgaacccgccgccacagcgccaaccgatgggatcccgggccatgaggcgctgcactacaccgccatcgatcagttccgcagtgatctggaactgatccgcaacagcctcgtcagcaccgagctgagctgcgaacagctcgacaccctgctcaatcaggtccacatcttcgggttctccctggcgagcctggacatccggcaggagagcacccgccacagcgacgccatcgatgagctgaccacccacctgcagcttccaaaggcctacggcgccatggaggaatccgagcgggtggcctggctgctggaggaactgcagacccgccggccgctgatccccgcggcggtcgaatggtccgaagccaccgcccagacctttgcggtgttccagatgctgcatcgcctgcagcaggaattcggtcagcggatctgccactcctacgtgatctccatgagtcacaccgcctccgacctgctggaggtgatgctgctggcgaaggagatcggccttgtggacccgcaggccggcaaggcatcgctgttggtggtgcccctgttcgaaacggtggaagacctgcagcgggccccagcggtgatggacggcctgttccagacaccgatctaccggaatctgctccccagtgtcggcgtccagcgacagcccctgcaggagctgatgctcgggtactccgacagcaacaaggactcgggcttcctctccagcaactgggagattcaccaggcgcagatcgccctgcaaaccctggccagcagccacggtgtggccctacggctgttccacggccggggtggatcggtgagccgcggcggcggcccggcctaccaggccatccttgcccagcccagcggcacactgcagggccggatcaagatcaccgaacagggtgaggtgctggcctccaagtacggcctgccggaacttgccctctacaacctggaaaccgtcacgacggcggtggtgcagaacagcttggtgaccaaccagctggatgccaccccgagctggaaccagttgatgagccgcgtggccaagcgctcccgcgagcattaccgggccctggtccacgataaccccgatctggtggcgtttttccagcaggtcaccccgatcgaggagatcagcaagctgcagatctccagccgtccggctcgccgcaagaccggcgcccgggatctctccagtctgcgggcaatcccctgggtgttcggctggacccaaagccggttcctgctgccgagctggttcggtgtgggcaccgccctggcggaggaggtcaacgacgaccctgagcaactggacctgctgcggcgactgcatcagcgctggccgtttttccggatgctgatttccaaggtggagatgacgctgtccaaggtcgatctcgacctggcgcaccactacatgagcagcctcggcaacccggagcagcgcgatgcctttgaaggcatcttcaaggtgatcgccgatgaatacggccgcaccctgaagctggtgctcgaaatcaccggtcagagccgcctgctgggggccgatcagaacctgcagctgtcggtggatctgcgcaaccgcaccattgttcccctgggcttcctgcaggtggccctgctgcggcgactgcgggatcagaaccgccagcctcccatgagcgaatcccctggaacgccggaggaccgccgcacctacagccgcagtgaactgctgcggggcgcattgctcaccctcaacggcatcgccgccggcatgcgcaacaccggc

SEQ ID NO: 44752 - DNA, 969 bp, SYNECHOCOCCUS SP. WH 8102
ctgccgcctgaggattcccgggcccgggctcgggccatggtgatgggattgcaggatgagatctgcgcaggtctggagtccctcgatggtgaagggacattcgtcgaagagagctgggagcggcctgagggaggcggcgggcgatcccgggtgatgcgcgagggccttgtcttcgagcagggcggcgtgaacttctcggaagtgcagggtcaggagctgccaccgtcaatcctcaagcaacgtcctgaggccaagggacatccgtggtttgccacgggcacctcgatggtgctgcacccgcacaacccttacatccctacggttcatctcaattaccgctacttcgaggctggtccggtgtggtggttcggcggtggggcagacctcacgccctactacccctttctggaggatgcccgtcacttccatcgcacccatcaggcggcctgcgattcggtccatccagacctgcacaaggtgttcaagccctggtgcgatgagtacttcttcttgaagcaccgcggtgagacccgcggcgtcggtggcatcttctacgactatcaggattccagcggtgtgctctacaaaggacaggacccttcaggtcccgcggcaggggtatcggctcagctgggggctcgccccctgggctgggagcaactgttcgccctggggcaggccaatggccgggcctttcttccgtcctatgcgccgatcgtggagaagcgccatccgatggcctatggcgatcgcgagcgtcaattccagctctatcgccgtggccggtacgtggaattcaacctcgtgtgggatcggggaacgatctttggccttcagaccaacggccgtaccgagtccatcctgatgtcgctgccgccgttggtgcgctgggaatacggctacaaggccgaggccggctccagagaagctctgctgacggagctgttcaccaaaccccaggactggctt

SEQ ID NO: 44753 - DNA, 945 bp, SYNECHOCOCCUS SP. WH 8102
atcggattcggcacctgggcctggggcaatcaactgttgtgggggtacgacgccgaacgggatgaccgccttctggaggagacctttcgccaggcccttgcatcgggtcttggcctgatcgataccgctgattcctacggcaccgggcggctcaatggtcgtagtgaacagctgctggggcggttcgcagcacgactgccagcgacgcgacgggcggatctctgcatcgccaccaaattggcgcccttcccctggcggctcgggcggcggggcctggatcaggcgcttcaggcgagtcgtcagcggcttcagggccatctacgacgcgtgcagctgcactggagcactgctcgctacgccccctggcaggaggtgcagcttctcgatggtctggcagatcgcgttctggatggctccatcagcgaaatcggggtatccaacatcggcccgaaacggctggcctggatgcagcaacgcctggcggagcgaggagttcccctgcgcagtgtgcaggtgcagtattcgctgctctcatcgggggacgccaaggttgatgcattgcgacagctctgccgtgagcgtggcatcgaggtgctggcctacagcccgcttgctttcggtgtgctgaccatgccgccagacggtgagcgacgaccgagaaccgtcctgcaacggcagctgctcgccaggttgcaaccagccagccgctcacttcgcgccgttgtggcgaccattgccggccagcgcagtgtttcgatggcccaggtggccctcaactggtgtcgagcccaggggaccacgccgatcccgggccttagaaccccaaagcaagctagggatgttgccggaaccctcaaatggtcactgacctctgaagaactggatcagctgaccgtggcgcggcagcaatgcacggtgcgcacaccgtccaacccatttcaaagc

SEQ ID NO: 44754 - DNA, 1224 bp, SYNECHOCOCCUS SP. WH 8102
gaaacatcgctggcgctcggcatcgacctgggcaccagcggtgttcgcattgcggtgctgaatcagcagggcacgctgattcattcgtcgtccgctgagtacgccacgggattaacagcccccttggactgggctgaggcgtgccgcgacttgatcacccatttgcccgctcagatcagaggtcaactggccgctgttgcggtcgatggcacctcgggcacgcttctggcttgtcgggaggatggcacccccatggggcctgcactgagctacgccaccgcgttccccgagcagaacagtgcactcaaacggctggtgccagatggctgcgcggcatccagcagcggcggcagcttggcgcgagccctgcagttgctgaagcaccatggccacattgatcgcctgcgacatcaagccgactggatcagcggttggttcctgcagaactggcaatggggcgaagagggcaacaacctcaagcttggatgggaccttgagcaagccacctggcagggctgcatcgctgatcagtcctggagttcggccttgcctgaggtgaagccaagcggttccgtgctgggacgcatcgcaatcgatcaggccaggaatcttggcgtgccagaggatctgctcgtggtggccggtacaaccgattccaacgcggcggtgttggccgcgaaccccggcgacaacgacgggatcaccgtgctgggcaccactctggtgatgaagcgattcacgccagtaccgatccaaggagccggcatcacgcggcatcggatcgggcagcgatggttgtgtggcggggcttccaacgctggggccggcgtgctgcggcgttatttcaccgatgctgagctggcggaactcagccgccagatcgacccagaccaagacagcggcctgagttaccagccccttccggcccgtggcgagcgatttcccgtggacgatcccaacctcgagccggtgctggagccacggccggtgagtgatgccctgtttctgcatgggctgctggaaggtctggcggagattgaggccaagggttgggagcgactgacggaactcggggcggatccaccgcaacgggtgatcagcctcggcggtggtgcccgaaacccccagtggcgcaagatccggcagcggcggcttggccttcccgtggtgagttgcaaccaaccaccggccgcaggtgttgccctgctggccctgagtcggcag

SEQ ID NO: 44755 - DNA, 1158 bp, SYNECHOCOCCUS SP. WH 8102
gtcacggagggacatcccgacaagatctgtgatcaggtcagcgatgcggtgctggatgctctgctggcccaggaccccagcagtcgggtggcctgcgaaacggtggtgaacaccgggctgtgcatgatcaccggcgaggtgacctccaaagcgcaggtggatttcattcacctggtgcgcaacgtgatcaaagaaatcggttacagcggagctcgagccggtggcttcgatgccaacagctgcgcggtgctggtggccctcgaccagcagtctccagacattgcccagggtgtggacgaagccgatgaccacgagggcgatcccctcgaccgtgtcggcgccggcgaccagggcatcatgttcggctacgcctgcaacgagaccccggagctgatgccactgcccatcagcctggcccaccgtctcgcgaagcgtctggccgaggtccgtcacaacggcagcctcgagtacctgctgcccgacggcaagacccaggtgagtgtggtttacgagaacgacaagcccgtcgccatcgacacgatcctgatctccacgcagcacacggccgaagtggccggcatcagcgatgagcagggcatccgtgagcgcatcaccgaagacctgtggacccatgtggtggaaccagccaccgccgatctggccctgaaacccagccgcgaggccacgaaatatctggtgaaccccaccggcaagtttgtggtgggtggtccccagggtgatgccggcctcaccggccgcaaaatcatcgtggacacctacggcggctatgcccgccacggcggtggcgccttctccggcaaagatcccaccaaggtggatcgctccgccgcctatgccgcccgctacgtggccaagtgcctggtggcctccggcctggctgaacgcgctgaagtgcagctgagctacgccatcggcgtcgccaagcctgtgtcgatcctggtggagtccttcgggactgggaaggtgtcgaatgctgagctcaccgaactggtgcaggagcatttcgacctgcgccccggcgccatcatcgaaaccttcggactgcgcaacctgccccagcagcgcggtggtcgcttctaccaagacacagccgcctacggccacttcggtcgtaacgacctcaaagccccctgggag

SEQ ID NO: 44756 - DNA, 506 bp, Xenorhabdus nematophilus
atgaattgcttactgctttattccactcaggatggacagactaagaaaattattacttatatcgctgaaaatctccgtcgcgcgggggctgagtgtgacttaagagatctggcgacaataaagcacattaatttgaaaccttatcataaggtgatgataggggcgtcgatacgctatggccattttaattccgtattacataagttcgctattcggcaccaaaaacaattgaatcaaatgccgacggcgttcttcggggtcaacctaacggcaagaaaactagaaaagaggacaccagaaaccaatgcttatttacgcaagttcttgatgaagagcccttggaagccaaatttatgtgatgtctttgctggcgcgttgctttatccccgctatcgttggctggatcgcatcatgattcagtttattatgcggatgacaggtggagaaactgatacaacaaaagagattgaatacactattgggagcaggtcgatctcttttctggg

SEQ ID NO: 44757 - DNA, 732 bp, Xenorhabdus nematophilus
atgagctttgatggaaaaattgcactggtcactggcgctagccgtggcataggtcgctcgattgcagaattattggttgaacgtggtgctcgtgttatcggcacagcaaccagcgagaatggagccgaagcaattagtgcctaccttggtgataaaggcaaaggttttgtattgaatgtcacagattcagaatccgtagaaaaaacactctcgaatattcgtgctgaatttggtgaaatagacattctggtaaataatgcaggcatcactcgtgataacttgttgatgcgtatgaaagatggagagtggcaagacattattgacaccaatctttcttcgatttttcgtctgtcaaaagcagtaatgcgctctatgatgaaaaaacgttatggacgtattatttccattggatctgttgttggaacaatgggaaatgcagggcaggcgaattacgcggcagcgaaagcaggagtcattggtttcagtaaatcattggctcgtgaagtcgcttctcgtggcatcaccgtcaacgttgttgcacctggttttatcgaaacggatatgactagagcgttgacagacgaccaacgagtaggcattttatctgaaattcctgctagtcgtctcggtgatgcaaaggaaattgccagtgctgtagcgtttcttgcttctgacgaggccgcttacattacgggtgaaacattacatgtcaatggtggcatgtacatgatc

SEQ ID NO: 44758 - DNA, 645 bp, Xenorhabdus nematophilus
cttggcgaatactcggcgctggtttgtgctggtgtgattgaattccagcaggcgattaagctcgtcgaattacgcgggaaattgatgcaggaagctgtaccagaagggcaaggggcgatgtacgctattatcggattggataatgaatccattgcaaaggcatgtaaagagtctgcacagggtcaggttgtttcacctgtgaattttaattcgcctgggcaagtcgttattgcgggtgagaaagaggctgtagagcgtgccggtgctgcttgtaaagcggctggcgcaaaacgtgctctgcctttggctgtcagcgtcccttcacattgtgcactgatgaagtcggcagccgctcagttagctgttgcattgcaatcaattgtgtttaatcagccacagttccctgttgttaataatgtggatgtcaaagtagaagaatctgctgatgggattcgcgatgcactggttcgtcagttgtataatcctgtacgctggacggagtctgttgaatatatagcggcacaaggtactgaacaactgttggaaatggggccaggtaaggtattaaccggtttaacgaaacggattgttgatactttaaatgctgtagcagtaaatgatgtatcatcactcacagttgctctg

SEQ ID NO: 44759 - DNA, 1041 bp, Xenorhabdus nematophilus
ttggctcctaaagcagaaaccatccgcttgatgggggataaagtctccgccattaacgcgatgaaaacagccggtgttccctgtgttcccggttctgacggctcattagggaatgataccgagaaaaataaagccattgcgaaacgcattggctatccggtgatcatcaaggcatcaggtggtggtggtggtcgcggtatgcgcgttgtacgcagcgacaaagatctggaacaatccatcgctatgacccgtgcagaagccaaggccgctttcaacaatgacatggtatacatggagaaattccttgagaacccacgtcacgttgaaattcaggtactggcagatggtcagggtcatgctctctatctggctgaacgtgactgctccatgcagcgccgtcaccagaaagtggtagaggaagcacctgcaccgggtatttcagcagaattgcgtcgcactatcggcgagcgctgtgccaatgcctgtatcgaaatcggttatcgcggggcaggtacgtttgaattcctgtatgaaaatggtgagttctactttatcgagatgaacacccgtattcaggttgagcaccccgtcacagaaatgattactggcgttgacctgattaaagagcagttgcgcattgcctctggcctgccactgtccatcaaacaggaagatatcgtgatcgaaggtcatgcgatcgaatgccgtatcaatgcagaagatccaaaatccttcctgccaagcccgggcaaaattacccatttccactctccgggcgggttcggcgtgcgctgggaatcccatatctatgcaggatatactgtaccgccttactatgattccatgatcggtaagctgatcacgtacggcgaaacccgtgaagtggcaattgctcgcatgaagaatgcactggccgagttgatcatcgatggcatcaagaccaatatcgatctgcaagtagcgattatgaatgacgagaatttccagaaaggcggaaccaatatccactatctggagaagaaactgggtttgcaggagaag

SEQ ID NO: 44760 - DNA, 852 bp, Xenorhabdus nematophilus
atgtcagcaaaaattattgatgggaaaacgattgcgcagacaatcagaagcgaagttgcagaaaaagtcaggcaacgaatcgccgctggaagacgtgctccaggtcttgccgttgttttagtcggagaaaatccggcctcccaaatttatgtcgcgagcaaacgccgtgcctgtgaggaagtcggttttacttcccgctcttacgacttgccagacatcaccagcgaagccgaattactttccctaattgataacttgaacgaagatccggagatcgacggcattttagttcaacttcccctacctgccggcattgataatgtcaaagtactggaacgcattcatcctgataaagatgtggatggtttccacccttacaatattggccgcctgtgccagcgtgctccaaagctgcgcccctgcactcctcgcgggatcgtgacgctgcttgagcgctgcaatatcaatacctacgggctgcatgcggtcatcattggggcttccaatatcgttgggcgtccaatgagccttgaactgctgttggctggctgtactacgacggtgacgcatcgttttaccaaaaacttacgccagcatgttgaacaagctgatttactggtcgtagcggtcggtaaaccgaatttcattcccggcgaatggattaaacccggcgctattgtgattgatgtcggcatcaatcgtctggaaaatggtaaagtcattggcgatgtggatttcgatagtgcatccgaacgcgccagttggatttctcctgttccgggcggagttggcccgatgaccgtcgcgacattgattcaaaataccttgcaggcttgcgaggaatatcatgat

SEQ ID NO: 44761 - DNA, 872 bp, Xenorhabdus nematophilus
atggcttacatgctgaaatacattaaccatggccgcttaacggtactgttgaagttaaaaatggtcagctggttgttaacggcaagaccatccgcgttacatctgaaagagacccagctaacctgaaatggaacgaagtgggtgttgatgttgttgcggaagcaaccggtattttcctgaccgacgaaactgcacgtaagcacatcgctgctggcgcgaaaaaagttgttctgactggcccatccaaagacgacacgccaatgttcgttatgggtgtcaaccacaacgcctatgccggtcaagagatcgtttccaacgcatcttgcacaaccaactgccttgctccactggctaaagttatcaatgacaaattcggtatcgttgaaggtctgatgaccactgttcacgcaacaactgcaactcagaaaactgttgatggcccatcagcaaaagactggcgtggtggccgtggtgcagcacaaaacatcatcccatcttctactggtgccgcgaaagctgtaggtaaagttatcccagaactgaacggcaaactgacaggtatgtctttccgtgttcctactcctaacgtttctgttgttgacctgactgctcgtttggctaagccagcaacttacaaagaaatctgtgatgcaattaaagaagcctcagaaggcgaactgaaaggtattctgggttacaccgaagatgatgttgtttccactgatttcaacggcgaaaaactgacttctgtatttgatgcaaaagcaggtattgcgctgaacgataactttgtgaaactagtttcttggtatgataacgaaacgggttactctaacaaagttctggatctggttgctcatatctctaaataa

SEQ ID NO: 44762 - DNA, 1440 bp, Xenorhabdus nematophilus
atgtccagacggctcagaagaacgaaaatcgtcactacgctaggccctgcaacggatcgtgacggcaatttagagaaagtcatcagtgcgggtgccaacgttgtccgccttaatttctctcatggcactgcggaagatcatgttcaacgtgctaataaagtgcgggaaatcgcagcccgtttgggctaccacgtggctatcctcggcgatctccaagggcctaaaatacgcgtatccacttttaaggaaggcaaaattttcctgaatattggagataaattcctactggatgccaatcttggtaagggagagggagataaagaaaaagttggtatcgactataagggattgccgtctgatgttacaaccggtgatactctgttactggatgatggacgcgttcaattgagagtcctggatgttcagggcatgaaagttttcacggaagttactgtaggtggtccactttccaacaacaaaggcatcaataaacaaggtggcggtttgtcggctgaagcgctgacagaaaaagacaaacaagatatcattacagcagcaaaaattggggttgattaccttgcggtttctttcccccgctcaggtgaagatctgaattatgcccgtcgccttgcccgtgatgcaggttgtgaaacccaaattgtcgcaaaagttgaacgtgcggaagctgtcagcagtgacgatattatcgatgaaatcattttagcatctgatgtggtcatggtcgcccgtggtgatttgggcgttgagattggtgatcctgagctagttggtgtccagaaaaagctaattcgccgtgcccgtcaactgaatcgtgtcgtaattaccgccactcaaatgatggaatccatgatcactaaccctatgccaacgcgggcagaagtgatggatgttgccaatgcagtgcttgatggcactgatgccgttatgctttcagccgaaactgccgcgggtcaatatcctgcggaaactgttgcagcaatggcgcaagtttgtctgggcgcagaaaaaatgccaagcattaatgtgtccaaacatcgattagatattacattcgacagcattgaagaggccatttcaatgtcagccatgtatgctgccaatcatctgaaaggtgtcaaggcgatcattgccatgacggaatcaggtcgcacagcacgcatgatgtcacgcatcagttccggtctgcctatattctccatgtcacgccatgaatccaccctgaaccgcaccgctctctaccgtggtgttacaccggtttattgcagcacccacactgatgggatctccgccgcaaacgaagccgtcaatcgcctgcgcgataagggttatctgacttctggtgatgtggtgctggttactcagggcgatcagatggaaacgattggtagtaccaatacctgtcgagtgcttgaagtagag

SEQ ID NO: 44763 - DNA, 2251 bp, Xenorhabdus nematophilus
atgctcaatcaagaactggagcttagtctcaacattgcttttgccaaagcaagggataacagacatgaatttatgactgtagagcacctattgctggcgttgttaagcaatacatcagcgcgaggagcactggaggcttgtaaagtcgatctggtgatgttacgccaggaattggaaaattttatcgcacaaacaacccctttgttatcagagaatgatgacagagatacacaacctacgttgagtttccaacgtgtattacagcgtgcagtgtttcatgttcagtcttcggggcgttcagaagtttctgggtcgaatgtcttggttgctattttcagtgaacaggagtcccaggctgcttatttactgcgaaagcatgatgtgagccgtctggatatcgtgaatttcatttcacatggaacgcgcaaagatgagtctgataatgagtctcatcacagtgtcaatccgattcaggaggaacaggtgataaatgaagatcgactggaaaatttcactaccaacctgaatcaattggcacaaaaagggcagattgatccgcttgtcggacgtcagcatgaattggaaagaacggttcaggtattatgccgccgccgtaaaaacaaccctttatttgtgggggagtcaggtgttggcaagaccgccattgctgaggggcttgcatggcgtattgtgcaaaaagatgttcctgaggttattaaggattgcacaatctattcgttggatattggttcattgctggcgggtactaagtatcgaggtgattttgagaagcgcttcaaatctttgttaaaaacgttagagcaagacagcaaaagtattctctttatcgacgaaatccataccattattggtgcaggtgctgcttcgggggggcaggtggatgcggctaacctgattaagccgctgttgtccagtggtcgcattcgggtgattggctcaacgacttatcacgaattcagtaatatttttgagaaagatcgagcgctggctcgccgattccagaagatagacattcttgaaccttcttctgaggaaacggtgcagattatcaatggattgcgtactaaatatgaggcgcaccatgatgttcgttatactgcaaaagccattcgtgctgcggttgagctgtctgtgaaatatattacagatcgccacctgccggataaagccattgatgttattgatgaagcgggagcgagaacaagattggtgccggctagtcgtcgcaaaaaaacgattaacgttgccgacattgaatctgtagtggctcgtattgcccgtattccagaaaaaacggtttcagccagtgacaaagatgtattgagaacactggatgatcgtttgaagatgctggttttcggtcaggataaagcaatcggggtactgacggaagccattaagatgagccgtgccggattggggcaggaacataaaccagtggggtctttcctgtttgcaggacccacgggggtcggtaagacggaagttactctccagctcgctaaaatgcttaatataaaattactgcggtttgatatgtctgaatatatggaacgccataccgtcagtcgtttgattggtgcaccaccaggttatgtgggatacgatcagggcggtttattgacagatgctattatcaaacatccacattcagtgttgttgctggatgagattgagaaggctcatcctgacgtgttcaacttgctgctacaggtcatggataatggcacattgacagataacaatggccgcaaggctgatttccgcaatgtcattctggtgatgacaaccaacgcaggggtacgtgagatacagcgtaagtccattggttttactgagcagtataacagcatagatggaatggaagagatcacacggatcttcacacctgaattccgtaaccgtctcgatggtatcatatggtttcatgcactttccgctgaagtcattcaactggttgttgataaattcatcgttgaactgcaagcacaactggatgaaaaaggtgtttctctggaagtaagtgcagatgcccgtcagtggttatgtgataaaggctatgacagagcgatgggcgcacgtccaatgactcgggtgattcaggacaatctcaagaaaccattggcgaatgaactgttgtttggttcgttgatacataggttcggttaggattaatcttgataaagacaaacgggcactgatatacgatttcaaaagtgcacaaaagtcg

SEQ ID NO: 44764 - DNA, 1407 bp, Xenorhabdus nematophilus
atgaaaaaaaccaaaattgtttgtactatcgggccaaaaacagaatccgaaacaaaactgaccgaattgcttaatgcaggcatgaatgtcatgcgcctaaatttttctcacggtgactacgaagaacatggccaacgtattaaaaaccttcgtgcagtcactgcgaaaacaggcaaaaaagcagctatcctactggataccaaaggccctgaaattcgtaccataaagctggaaggtggtaatgatgtctctctcactgcgggtcagactttcacttttacaactgataaatcggttgttggtaatcaagaatgtgtcgccgtcacttatgctggtctgccagcagacctgaaaccgggtaataccattttggttgatgatggtttgatcgccatgacagtaaaaaacatcaccgagactgaagtcatctgtgaggtattgaacaacggtgatttaggcgaaaacaaaggcgtcaatctgccaaatgtcgccatcaacttgcctgcactggcagaaaaagataaacaggatcttattttcggttgcgagcaaggtgttgatttcgtcgcagcatctttcatccgtaagcgttctgatgtactggaaatccgtgatcacctgaaagctcacggtggagagcacatccaaatcatctccaaaattgaaaatcaggaaggcctgaataattttgatgaaattatggaagcttcagacggtatcatggttgcccgtggtgatttgggtgttgagatcccagtagaagaagttatcttcgctcagaagatgatgatcgaaaaatgtaatgcagcacgcaaagttgtcatcactgcaacccaaatgctggattccatgatcaaaaatccacgccctacccgcgctgaagcaggtgacgttgccaatgctatcttggatggcactgatgccgtgatgctttccggtgaaagtgcaaaagggaaataccctatcgaagcggtttctatcatggcaaccatctgtgaacgtacagatcgcatcatgaacagcagaattgaaaatatcaaaacccagaagctgcgcgttactgaagcaatctgccgtggtgcagttgaaattgcagaaaaactggaagcccccctgattgtcgttgcaacctatggtggaaaatctgcaagatctatccgtaaatatttccctaacgcgcctattctcgctctgactaccaatgaaatcactgcccgacaattgctgttggtcaaaggtgtttccacacaaattgtcaaagaaatcgcctctaccgatgatttctatcggattggtaaagaagcagcactggcaagtggtatcgccaataaaggtgatgccgttgtaatgatatctggtgcgttagtaccaagtggtacaacaaatacttcttcagtccacgttcta

SEQ ID NO: 44765 - DNA, 945 bp, Xenorhabdus nematophilus
gtgcccgatatgaagctttttgctggtaatgccacccctgaactagcacaacgtgttgccaaccgcctgtacactagccttggagacgctgccgtcggtcgttttagcgacggtgaagtcagtgttcaaatcaatgaaaatgtacgcggtggtgatgtattcatcatccagtccacctgtgcaccaaccaatgacaacctgatggaattggtcgttatggtcgatgcgcttcgtcgcgcttctgccggacgtattactgccgttattccttacttcggttatgcccgtcaggatcgccgtgtccgttcagcacgtgtgcctatcactgctaaagtcgttgcggactttttgtccagcgttggggtagatcgcgttcttacggttgacctacacgccgagcagatccaaggtttctttgatgttccggttgataatgtatttggtagcccaatccttctggaagatatgcttcagaaaggcctggaaaacccaattgttgtctctccagacattggtggtgttgttcgcgcccgtgcaatcgccaagctgttgaacgatacggatatggccatcattgataaacgtcgcccacgtgcaaacgtttctcaagtcatgcatatcattggtgacgtcgctggccgtgactgcgtcctggttgatgacatgatcgacacgggtggcacgctgtgtaaagctgctgaggcattgaaagagcgtggagcgaaacgggtgtttgcttatgcaacccaccctatcttttctggtaatgcagtagaaaacatcaagaactcagtgatagatgaatttatcgtttgtgacaccattcctctgtctgctgagatcaaagcgttgaataaagttcgcactctgacactgtctggcatgcttgctgaagctatccgtcgtatcagcaatgaagagtcaatctctgcgatgtttgagcac

SEQ ID NO: 44766 - DNA, 840 bp, Xenorhabdus nematophilus
atgacgttgacttggccttccccggcaaaattgaatttattcttgtatattactggccaacggtctgatggctaccacgaactgcaaacgctgttccagtttcttgactatggcgacgagatcacgattaccccccgtcaggataatcaaatccacctgctgacgcccgttgaaggcgtagctcatgacaataatctgatcgtccgggctgcccgattattgcaggatcatttattacagaataataataagggaacccaacatctgggcgccgatatccacatcgacaaatgcctgccaatggggggaggtctgggtggtggttcttctaatgccgcgacagtactgattgccttgaattaccactggcaagccaacttgtccgatgatgaacttgcacagcttggtatcagccttggtgcggacgttcccgtatttattaaaggccatgccgcttttgccgaaggcattggggaaaaactccggccggcatcaccggaagaaaagtggtttctggttgctcatcccggaattgagatttcaacgccgacgatcttcacagatcctgaattaaaaagaaattctccgattcgttctctacccgcattattacaggcaccatttacaaatgattgtgaatcaatcgcaagaaaacgttttcgtaaggttgaacagcttctttcatggctgctagaatacgcaccgtcgcgcctgaccggaaccggtgcgtgtgttttcggcgagttcgaatcagaagcatcggcccgtaaggtgttaaatcaatccccagagtggatgcagggctttgttgcgcgtggagtcaacatttcaccattgcat

SEQ ID NO: 44767 - DNA, 600 bp, Xenorhabdus nematophilus
ctttttcgcttacttcccctctctgcggttttgctgacagcctgtaccgtcacacagcctcctacaggtacaggttccgccaattctccgcaatggcatatccgtgaacagcaactgcaaaaactgaaaaattaccagacccgaggttcttttgcttatctggcaaatgaaaagaaagtctatgcccgctttttctggcaacagtattcgcctgataactataaactgttgttgcttaatccactaggtacaacagaattggaattatttgtccagccgaatatgattcagcttactgataataatggtaaaaaatacctcagtgatactcctgagtcactaatttaccagcttaccaatatgaatattcctctggataatctgaaaaactggattattggcttacccggcgatgccaaagattttcagttagatgagaattacctgctcaaatcggtgagtagcaagaaaaatggtgagatctggaaagtcaattatcagggttatgatgcttcgaccatgccagtgttgcctaatcgattggaactcactcagggcaagaaccgcataaaattaaaaatggataactggacaacccaa

SEQ ID NO: 44768 - DNA, 888 bp, Xenorhabdus nematophilus
atgactttattagcactcggtatcaatcataaaaccgcgcctgtttccttacgtgagcgggtggcattttctcctgacacaatcgggcttgcgcttgataacttgctccagcagcggctggtgcgaggtggcgttgtgctgtcaacctgcaaccgcaccgaactttatctcagtgtcgagccgcaggataatttaaaagaccaattaatcagttggttgtgtgagtatcatcagctcaatcctgacgatctgaaagccagcctttattggcatttggataatgatgccgtcagccacttgatgcgagtggcgagtggtctcgattcgctggtacttggggagccacagattctggggcaggtaaagaaagcctttgccgaatcgcagaattatcaatccctgtcaggggagctggagcgcctgttccagaaatctttttcagttgccaagcgggtcagaacagaaacggaaattggcgcaaatgcagtttctgtggcttttgctgcctgtacgcttgcccgacagattttcgaatctctgtctaaattgaatattctgctggtgggggcgggggaaacgattgaattggttgcccgccatctcaaggaacaccgtgtgcgtcacatgatgattgccaaccgcacgaaagagcgggcgcagacactcgccagtcaagtgaatgcggaggttatttccttgtctgaaattgatacccggctggcagaagccgatattgtgatcagttctaccgccagcccactgccgattatcggtaaaggcatggtcgaacgggcattgaaagtccgccgcaaccagccgatgttgctgattgatatcgctgttcctcgcgatattgaaccggacgttgaaaaattgagcaatgcttat

SEQ ID NO: 44769 - DNA, 876 bp, Xenorhabdus nematophilus
tttacgggcagtatggttgcaatggtaacgccaatgaattcaaacggtcagattgataaaaccagtttgaaaaaattaattgattatcatgtcgccagtggtacatcttcaattatttctgttgggacaacgggtgaatgcgcaacactcaaccaagatgagcatgtggatgttgtactgacaacactggaattggctgatggccgcattccggtgattgccggaacaggggcaaatgcgacggcagaagccatttcgctgactcgtcgttttgaaaatacgggtattgctggttgcctgtctgtgacaccttattataatagaccatcacaggaaggtttatatcagcattataaagcgatagctgacaatactgacttaccgcaaattctgtataatgtaccctctcggaccgcatgtgatttactgccatcgactgttgcccgtctggcaaaactggaaaatattgttgcgattaaggaagcgactgggaacttaggtcgtgtcagtcagatccaagaattggttaatgatgaaaatttcattttgctgagtggtgatgatgcaagttttctcgattttgtgcagcttggtggaaaaggggttatttctgtgacagcgaatgtagcggctgcggagatggcacaaatatacgaactggctcagaagggtgaatttgtgaaggcgcgtagcctgaacaaccgactgatggaattgcatcatcaattatttgttgaacctagcccgacgccagccaagtgggcctgtcgtaaactggggttgattgccgatgacacgctgcgcctgccaatgattccgttgacgcaggcgggacaagtttcggtcaataatgccttgaaattggctggattactg

SEQ ID NO: 44770 - DNA, 1989 bp, Xenorhabdus nematophilus
atgaccactcgtaaaacccttgctaatgctgtccgcttcttgagcatggatgctgtgcagaaagcaaaatcagggcatcctggcgcaccaatgggaatggctgacattgccgaagtgctgtggcgcgactatttgaatcataacccggtgaaccctaactgggctgatcgtgaccgtttcgtattatccaacggccacggctctatgctgatttacagcttgctgcacctgactggctatgatgtttctatcgatgatctgaaaaacttccgtcaactgcattccaaaacccctggacacccagaatatggctatactgcgggcgtagaaacaacaactgggccactgggtcagggcgtcgccaatgccgtgggttttgcaattgcggaacgtacactggcagcacagttcaaccgtccgggtcatgatatcgtcgatcaccacacttatgtattcatgggtgacggctgtatgatggaagggatctctcatgaagtctgctctttggcaggtacactgaaactgggcaaactgattgcgttctatgatgacaatggtatctccattgatggtgaagtagaaggttggttcactgatgacaccgccgcgcgctttgatgcgtatggctggcacgttatccgtggcgtagatggtcatgactcagacgctatcaaagccgcaatcgaagaagcacaaaaagaaacaggcaaaccttctctgctgatgtgtaaaaccatcatcggttttggctcaccaaacaaagcaggcaaagaagagtgtcacggttctccgctgggtgatgcggaaatcgaagcgacccgcaaagcgttgggctgggaacatcctgcgtttgacgttcctcaggatatttacgctggatgggatgctaaagcagcaggtaaagctaaggaagcgacatgggaagaaaaatttgccgcttacgcaaaagcacatccagaactggcagcagaatttaaccgccgtacccgtggcgagctgcctgcaaactgggaagcagaatccaaagcattcattgagaatctgcaacagaacccagcttctattgccagccgcaaagcatcacaaaatgcgctggaagcattcggtaaagttctgcctgaatttatgggcggctccgctgacttggctccaagtaacctgaccatgtggtcaggctctaaacccctgaatgaagttcaggacggcaactatattcactacggtgtccgtgaattcggtatgtctgccatcatgaacggtatcgctctgcatggcggttttgtgccttatggcgcgacattcctgatgttcgttgaatatgcccgtaacgcggtgcgtatggctgcgctgatgaaaatccgcagcattttcgtatatacccatgactccattggtctgggcgaagatggcccgacccatcagccggttgagcaaattgccagcctgcgtgtgacgccaaatatgagcacatggcgtccatgtgaccaggtggaatcagcggttgcgtggaaatatgcgattgaacgtcaaaatggcccgactgccctgatcttctcccgtcagaatctggcacagcaggcgcgtacggctgaacaactggcgaatattgagaaaggggcttatatcctgaaagattgtgcaggccagcctgaactgctcctgattgctaccggctctgaagttgaactggcggtgaaagcggctgaccaactgagcgcagcaggccgccaggttcgtgttgtctctatgccatctactgatgcatttgacaaacaggatgccgcataccgtgaagctgtattgccagccgcagtttctgcccgtgttgccatcgaagctggtatcgctgattactggttcaaatacgttggcctcaacggtgctatcgtgggtatggaaacattcggtgaatctgcaccagctgatcttctgttcaaagagtttggtttcaccgtcgaaaacgtggttgccaaagcaacatctctgttg

SEQ ID NO: 44771 - DNA, 679 bp, Xenorhabdus nematophilus
  unsure (1)..(679): unsure at all n locations
atgacaatcaggatagcgattaacggttttgggagaatcgggcgcagtatcttacgtgctctctacgaatccgggcgtcaaactgaaatttcggtgatcgctattaatgagctggctgatgcggaaggtatcgctcacttattgaaatacgattccagtcatgggcgttttgcatgggatgtacgcctgaacaacaacctcttgctagtgggggatgacagcatccggctgtttcatcaaccggatatttcagcgttgccgtggaaagagttgggtattgatatcgtacttgactgtacgggcaaatatggcgaccgggcggatggtgaagcacatattgccagcggcgccaaaaaagttctgttttcccatccgggagggaatgatctggatgcgaccgtagtctatggtgtgaatcaccatgagctggtggcggaggattgtatcgtttccaatgcatcctgtacgacaaactgcattattccaatcatcaaattattggatgatgcattcaatattgaatctggcacggtgacaactattcatgcttctatgaatgatcaacccgtgattgatgcttatcacagtgatttacgtcgaacccgggcagccagtcaatccattattcctgtcgatacaaaactgtctgcggggattancacgatatcttccccaaatt

SEQ ID NO: 44772 - DNA, 732 bp, Xenorhabdus nematophilus
attttagaattgaataatattacggttgacaagagactgaccacattgtctgaatctgttatagcaaaagagcaaattcatctggtcgggctgaatggttcagggaaaagcacgctgctttcagcaattgcaggaattttaccttacagtggcaagattcatctgaacggcagaaacctgcgtgattatcgacagtacgagttggcgaaatatcgggcatggttttctcaatcagtttctgttcctatcatgccagtttaccagtatctggatatgtatcgtcctgattcagcgccattggatcagagtgaaagtgtgttatatgaactttgtcggcagctaaaactcacttcattgctgtcttcttcaattgggcagctatcaggaggtgaatggcagcgtgtcaggctggcaggagtctttttgcagatatggccagagttgaatccgaatggaaaattattactccttgatgaaccgacaaacaacctcgatattacacagcaaacagttttggatcagttaatcaaacaattttgttcactgggcggctcggtcttaatgagcagccatgatcttaatcacacttatgaacaagctaccagtgtatggttattgtcgcatggaaaattgttagtatctggaataccacaaaatgttatgactaatcaaaatttatcagaaatttttgaagtaaatattagacatatccaaaataccagctataaacta

SEQ ID NO: 44773 - DNA, 1491 bp, Xenorhabdus nematophilus
gtcggtgacactatcactgaagaacagtctctgatcactgtagaaggcgacaaggcttctatggaagttccggctccattcgcgggtactgtgaaagaaatcaagattgcggctggcgataaagtcaaaacgggttctctgatcatggtattcgaagttgcaggttctggcgcagcgccagcagcagctccggctccggtagcagcggctcctgcggcatcagcagcaaaagaagtcaacgtacctgacatcggtggcgatgaagttgaagtgaccgaaatcatggtaaaagtcggtgacaccatcactgaagagcagtccctgatcaccgttgaaggtgacaaagcttcaatggaagtccctgctccatttgcgggtactgtgaaagaaatcaagattgccgttggcgacaaagtcaaaacgggttctttgattatggtattcgaagtggtgggcgcagctcctgctgtagcactggcagcggcaccatctcttgcggttgaatcggtaaaagcagctccagctgcaagtcagccagcagaaggtaagaacgaattcgcagaaaatgacgcttacgtccatgcgactcccgtcattcgtcgtctggcgcgtgaatttggtgtgaatctggcgaaagtgaaaggaacaggtcgcaaaggccgtattctgcgcgaagacattcaggcttacgtaaaagatgcgattaaacgcgcagaagcggctcctactgctgctgcgggtggtggcatgccaggtatgctgccttggccgaaaattgatttcagcaagtttggtgaaatcgaagaagttgaaatgagccgcatccagaaaatttccggtgctaatctgagccgtaactgggtcatgatccctcatgttaacttgttcgatgaagcggatatcactgaagttgaagagttccgtaaacagcagaacaaagaagctgagaagaaacagctgggcgtgaagatcactccgctcgtattcgtgatgaaagcggctgcgaaagcactggaagcgatgcctcgttttaacagctctatctctgaagatggccagaagctgatcctgaaaaaatacatcaacatcggtatcgcggttgatacacctaatggtctggttgttcctgtgttcaaagatgtcaataagaaaggcatcatggaactgtcaagagaactggctgaagtatccaagaaagcgcgtgctggtaagctgacggcttccgacatgcagggagggtgcttcactatctccagcttaggtggtattggtactaccggctttgcacctatcgtgaatgcaccagaagtggcaatcatggggctgtcccgttcttctatgaaacccgtctggaatggcaaggaattcgttcctcgtctgattctgcctatgtctctgtctttcgaccaccgagtgattgatggagcagatggtgcgcgctttatcacttatattaatgaagtgatgagcgatatccgccgtctggcgatg

SEQ ID NO: 44774 - DNA, 1422 bp, Xenorhabdus nematophilus
atgagtactgaaattaaagcccaggtagtggtgcttggcgcaggccctgctgggtattctgctgctttccgttgtgcggacttaggtttggataccgttctggtggagcgctactctactctgggtggtgtttgccttaacgtcggttgtatcccatccaaagcgctgcttcatgttgcaaaagtgattgaagaagcaaaagcactggcacaacacggtattgtgtttggtgagccacaaactgatatcgataaaatccgtctctggaaagaaaaagtgatttcccagctgacaggtggtctgggcggtatggctaagggccgtaaagttaatgttgttaacggcattggtaaatttacaggcgctaacactttggtagtagaaggcgagaaaggcgcaacaacgattaattttgataatgccattatcgctgcgggttcacgcccaattcaactgccattcattccacatgatgatcctcgcgtatgggattctaccgatgcactggaactgaaaactgttccggaacgtctgctggttatgggcggcggtattatcggtctggaaatgggaacagtttaccatgcactgggctctcagattgacgtggtagaaatgttcgatcaggttattcctgctgcggacaaagatattgttaaagtgttcactaaacgcatcagcaagaaattcaacctgatgctggaaaccaaagtgaccgcagtagaagctaaagaagatggcatctatgtaacgatggaaggcaagaaagcgccagcagaaccacagcgttatgatgcagttctggttgctatcggccgtgtacccaatggtaagtcgctcgacgcgggtcaagcgggtgttgcagttgatgagcgtggctttatccatgtggataagcaaatgcgtactaacgtgcctcatatttttgccatcggtgatatcgttggtcagccaatgctggcacacaaaggtgttcacgaaggtcacgttgcggctgaagtgatctctggtaagaaacattacttcgatccaaaagtgattccatcgattgcctacactgaaccagaagtggcttgggttggtctgactgagaaagaagcgaaagagaaaggcatcagctatgaaaccgccactttcccatgggctgcgtcaggccgtgcaatcgcatctgattgtgcagagggtatgaccaaactgattttcgacaaagaaagcaaccgtattatcggtggtgctattgtcggtactaacggtggtgagctgttgggtgaaattggtctggctattgaaatgggttgtgatgcggaagatatcgctctgactatccacgctcacccaacgctgtatgaatcaatcggtatggctgcggaaatgtatgaaggcagtattactgatttgccaaatcctaaggcaaagaaaaag

SEQ ID NO: 44775 - DNA, 654 bp, Xenorhabdus nematophilus
gccgtatcgcacttgaatgcagaaattcaagggggatcggtcaccggtcttgtcgggccggacggtgccggaaaaaccacgctgattcggatgctggcagggctattgaagcccgataacggcaatattaaaattatggggcttgatcccatcaaagacagcgttaaagtacgttctgaactgggctatatgccgcagaagttcggtctgtatgaagatttaaccgtgctggaaaatctcaatttatacgcagagctgcggggtgtgcttcgcgaagagcgcaaggccacttttcaaaaactactgactttcacagagttaacccatttcacggggcggctggcgggaaaattgtccggcggtatgaaacagaaactggggcttgcctgtacgctattaggaagcccgaaagttttgctgcttgatgagccgggagtaggtgttgatcccattgcccgtcaggaattatggcagatggtgcacgaactcgcttccgacggaatgttgattctgtggagcacgtcttatttagatgaagcagagctgtgccgtgatgttttgctgctgaaccgtggtaaattgctctatcgcggccagccgcagaaattgacccagaatattgtcggacgatcttttctacttgatgtcaaacaa

SEQ ID NO: 44776 - DNA, 1365 bp, Xenorhabdus nematophilus
atgaattttgagtcactcggcttgaaggctgatattttacgtgccgttgaagaacaaggttacgtggaacccacccctattcagcagcaagccatacctgttgtgttgtccggtaaagatcttttggctagtgcccagacgggaacggggaaaacggcagggtttactttgccaattttgcaattactgagtgaatctccggctcaggcaaaaggtcgtcgtccggtcagggcgctgattttgacaccaacccgtgagctggcggctcaagtgggtgaaaatgtatgcaattacagtaaatatctcagattgcgttcattggttgtatttggtggtgtcagcattaatccacaaatgatgaaattacgtggtggtgtcgatattctcgtggcaactccggggcgtctgttggatttagaacaccagaatgcggtggacttatcccatgttgaaatccttattttggatgaagccgaccgcatgttggatatgggctttattcatgacattcgtcgggtattgagcaaattgcctgcaaaacgccagaatttactgttttcggcgactttttccgatgatatcaagagccttgccaataaactgctgcgtgatccggtgagcatagaagttgcccgtcgtaactcggcttctgaacaaattgatcaagctgttcattttgtggataaaaaacgtaagggagaattgctctcttatatgataggcaaccagaactggcagcaggtattggtctttacccgtaccaaacatggcgcaaaccgtctggcggaacagctcagtcaagatggtgtcactgctgccgcgattcatggtaataaaagccagggagccagaacccgtgcgctggccgatttcaagtcaggccggatacgtgcgctggtggcgacagatattgctgcccgtggattggatatcgatcagctgccccacgtcgttaactttgaattgcctaatgttgcggaagattacgtgcatcgtattggtcgtacaggccgtgcggaagcgacaggacaggcaatatctctggtttgtgtcgatgagcacaaactcctgcacgatattgaacgactgctgaagcgtgaaattccacgtattgcgatttcgggttatgaccctgatccttccattaaagctgagccaattctgaatggaagtaattcccgtggcagtcagcgtggtaacggtaggcaaagcccttctaaccaaggcagcagcaaaccgaaccgctccaaccagagtcgttctaaccaaggcagtaccaaacaacacagtgatcgtccgcgcagcaaaggaaccccatcgggtcagcgtcggcaacgtacttcatccaaaacatcaaatgtagcc

SEQ ID NO: 44777 - DNA, 834 bp, Xenorhabdus nematophilus
atgaaaaatgaatattttgttagtccgcaatggctaaacgaccatctccatgatgagaatgtcgtcattgttgacgccagcgcccccatgcctacccaaactatcgattatcaccagttatggctggataaccatattccgggtgcccagttttttaacctggataaaatcgccaatctccagactaacctgccacatatgctgccagaaccggaggttttccgtcaggccgttagcgcgatggggatcagtgaaaaccatctggtaataatttacgatcagggaaatatgttctctgccccacgagcatggtggactttcaagatctttggcactcgcaatatccgtattcttgaaggggggttacagggttggcagcaaatgggttatccaacggaatcaggtgaagttacccgtcagccccaaattttcaatagccaattcacccctgaaaaagtctgttctcaggaacagatccttgatgctctccatcataaagcaccaatacagtttattgatgccagagccgaagaccgttttcaggccaaagtaccagaacctcgccccggtttgagaatggggcatatccccggctcaaaaaatgtcccgtggacaacattgattgataatggaagttataagtcaccagacgaaattgcagctatattcaaaaagcaaggcgttgatttaaaacagccaataatgactagctgtggttctggaatgaccgccgcagttttagtattagggctggatatgattggtcacaaagaagtgggattatacgatggctcttgggctgaatggggtgccgatgattctcttccgttagaa

SEQ ID NO: 44778 - DNA, 864 bp, Xenorhabdus nematophilus
atgtctattttaatcgataaaaacaccaaagtgatctgtcaggggtttactggcagtcagggtactttccattcagaacaagcgattgcttacggtactcaaatggttggcggtgtaacaccaggcaaaggtggtactgagcatctggggctgcctgtattcaataccgtacgtgaagcagtggaagcgactggtgcgacagcctcggttatttatgttcctgctccattctgtaaagactccattctggaagcgattgatgcaggcatcaaattgatcattactataacagaaggtattccaacgctggatatgctgacagtgaaagtaaaactggatcaagcaggtgttcgtatgatcggtcctaactgtccgggtgttattacgccggatgcgtgtaagatcggtatcatgcccggacatatccacaaggcgggtaaagtgggtattgtatcccgctctggtacattgacttatgaagccgttaaacagacgacggatgcaggattaggccaatctacctgtgttggtatcggcggtgacccaattccaggctcaaactttattgatattctgaaactgttccaagaagacccgcagactgaagctatcgtcatgatcggagaaattggtggtacagcagaagaagaagcggccgcttacattaaagagcatgtaactaaacctgtcgtcgcttacattgccggtgtgactgcacctaaaggcaaacgtatgggtcatgctggtgcgattattgcgggtggtaaaggaaccgcagatgaaaaatttgctgcactggaagcggctggagtgaagacggttcgtagtcttgctgacatcggtgatgcagtaaaagttttatta

SEQ ID NO: 44779 - DNA, 1014 bp, Xenorhabdus nematophilus
gcagggggtcgcggtaaggctggtggcgtgaaagtcgtcaacagcaaggaagatatccgtgcttttgctgaacaatggctgggtaaacgactggtaacttaccagactgatgcacagggtcagcctgttcatcagatcttggtagaaggagcaaccgatattgccaaggagctctatctcggtgctgttgttgaccgtggtacacgtcgtgtagtgtttatggcctctaccgaaggtggtgtcgaaatagaaaaagtggcggaagaaacgcccgaactgattcataaagcaatcatcgacccactggctggccctatgccgtatcaaggccgtgaactagcgtttaaactgggtttaaccagtaaacaagttggtcagttcactaaaattttcatgggattggcaaagctgttccttgagcgtgatctggctatggtcgaaattaaccctctggttatcacaactcaaggtgatcttatctgtctggatgggaaactgggtgcagatggtaacgcgatgttccgtcaggctgaattgcgtgaaatgcatgatccttcacaggaagatccgcgtgaagctcaggctgcacaatgggaactgaactatgttgctcttgatggcaccatcccccccatggtgaatggtgctggtttgacaatgggaaccatggacattgtcaaactgcacggtggtgccccggcaaacttccttaatgtgggtggtggtgcgacaaaagaacgtgttactgaagcattcaaaattatcctgtcagatgaaaatgttaaagctgtttttgtgaatatttttggtggcattgtccgctgtgacttgattgctgacgggattattggtgctgtggaagaagttggtgttcacgtaccggtagtggttcgtctggaaggaaacaatgctgagttgggcgcgaagaaactggcagacagtggtttgaacatcattgcagccagcagtttgacagacgcagctaaacaggcagttgcagcagcggggaataaa

SEQ ID NO: 44780 - DNA, 840 bp, Xenorhabdus nematophilus
cttaaaatagctgtggttggtggcggaaatattggttctagtcttgctttcgattgtgcgttgcacgggcatgatgttgttgttatcgaaaaagatgttcttgcctgcgaacagagcagggaacgcgtcacggaaacggcgggttatgcacctttgttcagtccgctcgctaaaggaaaaacaaccgaggagatactgctcaacatcgtctggtcgcaggatttgcaagctgtgtcggattgtgggtttgtggtggaaaacatcacggaaaatatcgagcttaaacaggcattatatgcccgtatgtctgagtttattgcaccccacgcggtattggcggcgaacacttcctgcatccctatcacaaaactgggatcgtttcataaaacgccttctcaagtgattggtgtgcattttatgaacccggtttatctgaagcataccgtcgaagtgattgtcggtctgaatacttctgagcaaaccaaagcgcgatgtctggaaatcttggggatgttgggtaaaaacgccgtcgtagtgaaagatggtcccggtttcgtctctaaccggatttcccatttatttatgaatgaagccgctttcaccatacaggatggcgttgctcaacctgcggatgtggacgctatctttaaacaatgcttcggccataaaatggggccgcttgaaacagcggatctgatcggtattgacacagtggttaattccctcgatgtactttaccagatgtttcaggattcaaaatatcgggtctgtccgctgatgcggacaatggttgatgcgggacgtttgggacgaaaatccggccggggtttttacacttat

SEQ ID NO: 44781 - DNA, 2673 bp, Xenorhabdus nematophilus
atgtcgtttaaattgaaaacggactgtgcatcaacactctccattggcagtaaaatatatcattattacagtttatccctgttatctgaacgattgggtgagatagcccgtttgcctaagtccatgaaagtcctgcttgaaaatctcctgcgcaatattgatggcgattctgttgtggaagaagatttgaaggcattagtggaatggcagaaaaacggtcatgcagacagggaaatcgcttatcgtcctgcccgtgtgttaatgcaggattttaccggcgttccggctgtagtggatcttgcagctatgcgggaagcggttctgcggcttggcggtaatgttgaacaagttaatccattgtctcccgttgatctcgtgattgaccactcagtcatggtagataaattcggtacagagcaggcgtttgaagaaaacgttcagattgagatggaacgtaactatgaacgttatctatttttacgttgggggcaaaaagcctttaatcgtttccgcgttgtgcctcccggaacaggaatttgccatcaggttaaccttgaatatcttggtaaatcggtttggtatgaaaaccagaatggtaaggattttgcctatcctgatacgttggtagggacggattctcatacaaccatgattaacggactcggtgtattaggttggggtgttgggggaattgaagccgaagctgcgatgttggggcagcctgtctccatgctgatcccagatgtcgttggttttaaactgaccgggaaattgcgggaagggatcacggcaaccgaccttgttttgacggtgacacagatgctgcgcaagcatggcgtggttggcaagtttgtcgaattctatggtgatgggctgtctgatttgccattggcagatagagcaactattgccaatatggcgcctgaatatggcgcaacctgcggtttcttccccgttgatgatattacactgggctatttgcgcttaactggacgcaataaagatgaaatcgccttagttgaagcctactgtaagaagcagggattatggcgtaacgcaggggatgaacccattttcaccaacaaccttgaactggatatgtacacggttgaagtgagcttggcagggccgaaacgccctcaggatagagtagcacttggcgatgtaccacatgcattccaagctgccatggaactggacatccataaaatacaggagcatcgggcggacacgccagtcactcttgataatcagacttttgcactgcaagatggcgctgtagttattgctgccattacttcctgtacaaatacatctaatcccagtgtcttgatgacagcaggtttactggccaaaaaagcgattgaaaaaggtttgcaacgtcacccgtgggttaaaacctcgctggcacccggctctaaggtagtaacgggttatcttgaactggcaggactcatgccatatctggaaaaattgggtttcaatctagtgggatacggttgtaccacttgtatcggtaactcaggcccattgccagagccgattgaagtagcgattaagcaatctgatctgatggttggcgcagtgctttccggtaaccggaattttgaagggcgtattcatcctctggtgaaaactaactggctagcatctccaccactagtggttgcctatgcactttctggcaatatgaaaaaggatctcactagggagccattggggcaagaccaacaaggccatgatatctatctgcaagatatctggccggatagccaagaagttgctgaagctgttggtaaagttaggacagagatgttccacaaagagtacaatgccgtttttgatggtgatgaaaattggcaatcgttggaagtggaaagctcagaaacttattcttggcagcagaattcaacctatattcgccttcccccttttttcagcgatatgacgattgagcccaaaccgataactgatatccatcaagccaatatacttgtgattttgggggattcagtcacaacggatcatatttctccggcgggaaacataaaagctgacagcccagcagggcggtacttgcaggagcatggcgttttgccgaaagattttaactcttacggttcaaggcgtggcaatcatgaagttatgatgcgtgggacatttgccaatatccgtatctgcaacgaaatggtgcctggtgtggaaggaggatacactcgccatattccatctcaggctcagttggcgatttatgacgcggccatgctttatcaggaagataagacaccactggctattattgcaggtaaagaatatggttccggctcaagccgtgattgggctgcgaaaggaactaggctgttgggagcgagggttgtgattgcggaatctttcgaacgaatccaccgttctaatctgattgggatgggcgtgttaccactggaattcccacaaggtgtcagccgtaagacgctaaacctgactggtgatgaacgaatcgatattgtaggattggggcatatcgagccagggcagatcattgcggtgaaaatcaactatgccaatggaaaagaaactgtcattgatgcccgttgtcgcatcgataccaatacggaactggcgtatttttataatgacggcatcttgcactatgtgatccgtaatatgctgaaa

SEQ ID NO: 44782 - DNA, 3269 bp, Xenorhabdus nematophilus
atctgtggcaaggttgtacgccaacaaatccgcagtatggttttggataaactggcacaattggggccggtttgggtcaaaggaaaacccgccggaagctgggctacgattatcttggaacaaattgaagatatgcaggatttttattcccgctatctgccccaaatggcgcttgcaacgattatccctctcttaatcctgatgactgtctttcctgtcaactgggctgcagggttaattttactcgtcacagccccattaattcccctttttatgacattggttggattaggggccgctgacgccaatcgacgcaattttgtcgcgctcagtcgtttaagcggcaatttccttgatcgtttacggggtctggaaactctacgcgtgttccatcgcggggaagccgaagttaagcaacttaccgaatcgacagacaatttccgtcacagaacgatggaagtactgcgcatggcatttttatcgtctgctgtgctggagttttttgctgcggtttccattgcggttgttgccgtttattttggtttttcttatttgggagaattacattttggtagttatggtctgggtgtcacgttgtttgcaggcttcctcgctctgatcctcgctcctgaattctttcagccactgcgcgatttgggtacgttttatcatgcaaaagcccaggctgtcggtgccgcagagtcactttttaccctgctcagcagtgagggagaacactctgtattcaacggcgaaagaatgctgccagatacaaaatcagtgactattgaagcaaacgaactggaaatccggtcacacgatggtcatcgtcttgcgggtcccttgagcttcacgattgaccaacatcagcggattgcattggttgggaaaagtggtgcagggaaaagctcactgatcaatctattactcggattcctaccctatcgcggctctttgaaaatcaatggaatcgagctacgtgagctgaatctaaccaaatggcgtgagcaattaagctgggttggacaaaatccacacctgccagaacagacgctgctcgataatatccgtcttggtcaatttgacgcaacacaagaccagattaatgatgttatggaacaggcttatgtcagcgagtttatttatgctcttcctgacggcgtgaatacagtcattggtgacaatgctgcccgtttatctgttggacaagctcaacgcatcgccgtagcacgggcattattgaatccctgtcagttattgttgttggatgagccagcagccagtcttgacgcccatagcgaacaacgtgtgatgatggcattaaatcaggcatctagtcagcaaaccacactgctggtcactcacctgttagaagaaacactggaatatgaccagatttgggtaatggaaaacgggttaatcattgagaaaggccattatcagagtttaagccaatctcaaggggcattttcccgtctgttgtctcatcgcagcgtggagctttaatcatgcgtatattactcccatttctcgcactctatcgccgccactggtttctcatcagcttaggcatggtattagcgattgtaaccctgttagccagtattggcttgctgacgctttccggctggtttcttgccggtacagccttggcaggattcgcggggttatatacgttcaattatatgctgccagccgctggcgtccgtggtgcagctattttccgtactgctggccgttatggtgaacgactggtcagtcatgatgctacttttcgcgtattagcccatctacgcgtttttgcctttcagaaaattttaccgctttctccgggaggcatcgcccgttttcgtcaaggcgagctgctgaatagaatcgttgcggatgtcgaaacgcttgatcacctctatctgcgagttatctcccctgtcctttcagcgttggttgtgattgttgttctgacttttggcttgagttttcttgatgtcaccctcgcatataccctaggcgggattatgctggggctactgataatattgccttttgggttttatcatgcaggaaagccttatggcagagacatcaccctactacgcggtcaatatcgtacattactcactagcgcgttgcagggacaggcggagttaacagtgtttggcgcactcgggcgttttcgacaatcaatgacagacgttgaatccgattggctgaaatgccaacaacagcaagccaacctgacggggctttctcaagccgttatgattttcgctacaggcataacagtgactctgctactttggctggcagcagcaggtgtaggggaacatagccaacccggagcactgatagctctatttgcgttctgtgctctcgctgctttcgaagctcttggacccgtcacagtagcatttcagcatatgggacaggttatctcatctgcaacccgtgtttctcagttaatgcatcaggagccagaagtcactttccctgctcatgggccacaaacgactgatagcctcaatcttgagataaaaaatattgatttcacctatcctgaacaacctctgccagtattgaagaatatttcactgtccctggcatctggcgagcatatcgcactattggggaaaacagggtgcggtaaatcgacacttttacagttactgagccgtgcatggaatgttgatcacggcgaaattcagctcaatcaacaacctatttcccagtatgatgaaaccacgctgcgatcaatgatgtctatcgttcctcagcggatacatgtcttcagccataccctgcgtgaaaacctcttgctagccaaaccggatgccagcgatgatgagttagtaatcgtactcaaacaagtgggtttagggaacttgctagacaataatgaaaagctaaactgttggatgggtgaaggtgggcgccagctttccggtggggaacaacgccgtttggggattgccagagcgttgttacacaatgcaccattaatgctgctggatgagccgacagaggggctggatgccgatactgaacaacagattctgtctctgttacgccacagttgccagcacaagacactgattgtggttacccatcgattaacaggtttacagcatttggatcgtatctgtgttatggatgagggacgcatcattgagcaaggcaaacatgatgtgttgctggctcagcaggggcgttactatcaattctatcagcgacagagctatcctgagcaggagtaatcatttttatgacgatag

SEQ ID NO: 44783 - DNA, 1746 bp, Xenorhabdus nematophilus
ataatgaatgataaagacctttctacctggcagaccttccgccgattgtggccgctcatcacaccatttaagctaggcttggcagtggcggcgattgcgctggttataaatgctgccggtgatacattgatgctttctttgttgaaacctttacttgatgagggttttggcaaggcagacatgagcgtattggagtggatgccgctggttgttatcgggctgatgcttttgcgtggcatatcgggttttatatcaagttattgtatatcttgggtatctggcaaagttgtcatgcaggtgcgccgtcgtctgttcactcatatgatgggtatgccagtttccttttttgaccagcaatctacgggaacattgctttcccgcattacatacgattcagaacaggttgcttcttcttcttccggcgcgctggtgacagttgtcagggaaggagcatcaattattggcctgttcattctgatgttttattacagttgggagctttccctgatcttgattgtcattgctccgattgtcgctcttgttattcgtcttgtttcggtacgttttcgtaatatcagcaaaaatatgcagaacagcatgggaatggtgacaaccagcgcagaacagatgctgaaagggcacaaagaagttttgatctttggtggtcagaagattgagactaaacgttttaaccaagtcagtaaccatatgcgtcagcaaggcatgaaaatggtgtcggcgtcgtctatttctgaccccattattcagttaattgcctcttttgctttagcgtttgtcctctatgctgccagtttcccggaaattatgggcgcactgactgcgggtaaaatcaccgtggtattttcatccatgatcgccctgatgcgcccattgaaatcgctgactaatgttaacgcacaattccagcgtggtatggccgcttgccaaacattatttgcgattctggatatggaacaggaaaaagatgaaggtaagctggagctgaaaaaagcaaaaggtgatcttgaattccgtaatgtcacattctgctatccaaccaaagatcatcctgcgctgaaaagcatctcaatgaccattcctaaaggtaaaactgtcgcattggtggggcgttctggttcaggaaaatcgacgattgccaatcttctcactcgtttttacgatatcaatgaaggcggcatcatgttggatgggcatgatttgcgtgaatactcattgtcttcactacgcagccagatagcgctggtatcgcagaatgtccatttgttcaatgatacggttgctaataatatcgcttatgccagcgaaggaaaatttagccgtgaagaaattgaacgagctgcggaaatggcctatgcgatggattttatcaagaaactggatcagggtcttgataccatgattggtgaaaatggtgtcctgctttcaggcggacaacgtcagcgtattgccattgcccgtgcgttgctgcgtgattccccaattcttattctggatgaggcaacctcagcactggatactgaatctgagcgtgccatacaagcggcgctggatgaattgcagaaaaacagaacttctttggtcattgcccatcgcctttctaccattgaaaatgcggatgaaattatcgtcgttgaagacggttttatcgtcgaaaaaggtaatcattcggttctgttggaaaaagatggcgcatatgcccaattacatcggatgcaatttggtcaa

SEQ ID NO: 44784 - DNA, 1326 bp, Xenorhabdus nematophilus
atgagtagccgtaaatattttggtactgatggtattcgtggcaaagtgggtgatagcccaattacccctgattttgttttgaaactcggttgggctgcgggaaaagtactggcgcgtcatggttctcgcaagattatcattggtaaagatacgcgtatttccggctatatgctggagtctgctctagaagcagggttggcagcagcgggtctatcagcatcttttactggccccatgccaacaccagctgtggcctatttgacacgtactttccgcgcagaagcgggaattgtcatttcagcctctcacaatccttactatgacaacggtattaaattcttctctatcgatggaaccaaactgcctgataatgttgaagaagccattgaagctgaaatggaaaaaccactgacctgcgtagaatctgctgagttggggcgtgccaatcggattgttgatgcggctggtcgttatattgaattttgtaaaggcacattcccgagtgaacaaagcctgaatggattgaaagttgtattagattgtgccaatggtgcaacctatcatattgccccgaacgttctcagagagctgggtgcgaatgttgtgaccattggctgtgagccgaatggcatcaacattaatgaagagtgtggtgcaacagatgttcgcttgttacagaagcgggtacaggaagaacaggctgatgttggtctggcatttgatggtgatggtgatcgcattatcatggttgatcatctgggacagaaagtggatggagaccagatcctctatatcattgcacgtgaggcattgagacaggggcaactgcgcggtggtgcggttggtactctaatgagcaatatagggctggaattggctcttaaacagcttggcatcccatttgagcgagcaaaagtgggcgatcgctacgtactggaaaaattgcaagaaaaaggttggcgtctaggggcggaaaattccggtcatgtgattttgctggataaaactacgactggcgatggcattgtggcaggattgcagatactgagcgcgatggtacggaataatatgagcctgcatgacctttgcagcggcatgaaacttctgccacaaattttggtaaatgtccgttttgcaggtgacaacgatcctctgcaatcagaatctgtgctagaagccgttaaatcggttgaggctgaattgaacggccgtggtcgagtactgctacgtaaatcgggcacagagccacttatccgtgtgatggtggaaggtgaagatgaagaattggtcactgcattggcacaccgtattgctgatgccgtgaaa

SEQ ID NO: 44785 - DNA, 1890 bp, Xenorhabdus nematophilus
atggcgaaaaacctgattctctggttagtcatcgcagttgtcttgatggtattgttccagagttttggtcctggcgactctagcggtcgtagggtagattactctaatttcatcagtgagttatctcagaatcaagtgcgagaagtacgtatatcgggtcgtgatattgattacagtaagaaagacgacggtaaaaaatacagcacttacatgccaattcaggatgagaagctgctggatactctactgaataagcaggtgaaagttattggtgaaccaccagaacaacagggcctgctcgcgactctctttatttcctggttcccaatgctattgctgattggcgtctggatattctttatgcgccaaatgcaaggtggtggcggtaaaggggcgatgtcttttggtaagagcaaagcccgcatgttgacagaagatcagattaaaaccacgtttgcggatgttgctggctgcgacgaagcaaaagaagaagtgggagaactggtggaatatctgcgtgaacctggccgtttccagaaactgggtggtaagatcccgaaaggtatcttaatggttggtcctcctggtacaggtaaaacgttgctggcaaaagccatcgcaggtgaggctaaagtgcctttctttaccatttccggttctgacttcgttgaaatgttcgttggtgtgggagcttcccgtgttcgtgatatgtttgaacaggcgaaaaaatctgcgccttgtatcatcttcatcgacgaaattgatgctgtaggccgtcaacgtggtgctggtctgggtggtggacacgatgaacgtgaacagacactgaaccagatgctggttgaaatggatggtttcgaaggtaatgaaggcatcatcgttattgccgcaactaaccgtcctgatgtgctggaccctgcattgctgcgtccgggtcgcttcgaccgccaagtcgttgttggcctgccagatgttcgcggtcgtgagcagattttgaaagtgcatatgcgccgtatcccgctggataccgacgttgacgcttccatcattgctcgtggtacaccaggtttctctggtgcagatcttgcgaaccttgcgaacgaagctgccttgtttgccgctcgtggcaataagcgcgttgtttccatggtggagtttgaaaaagcaaaagataagatcatgatgggtgcagaacgccgttccatggtcatgacggaagagcagaaagaatccacggcttatcatgaagcaggacacgccatcattggccgtctagtgccagaacatgatcctgttcataaagtcacgattattcctcgcggtcgtgcattgggtgtgactttcttcctgccagaaggtgatcagatcagcgcgagccgccagaaactggaaagccagctttcaacattatacggtggccgtctggcagaagaaattatctacggtgtagacagtgtttctactggcgcatccaacgatattaaggtggcgacatccattgcccgtaacatggtgacacagtggggcttttcggaaaaactgggcccactgctgtatgcggaagaagaaggcgaaatcttccttggccgttcggttgctaaagcaaaacacatgtcggaagatactgcgcgtttaattgatcaggaagtgaaagctatcgtcgatcgtaactatcaacgcgcccgtaaaattctgatggataatctggatatcctgcattcgatgaaagatgcgttgatgaagtatgaaaccattgatgtatctcagattgatgacttgatgaatcgaacaacagtgcgttcaccagcaggttgggaaggtgacaacaataatggcggtaataaccgtcataatatgtcatctccgcagcagactgtgaaacctgcggat

SEQ ID NO: 44786 - DNA, 1929 bp, Xenorhabdus nematophilus
atgcgtctttttattgcagaaaaacccagcctcgcgcgagctattgcagatattttgccgaaaccccatcgtcggggggatgggtttatcgaatgcggtaacaaccaatttgtgacttggtgtgtaggccatctattagagcaggccgagccagatacctacgatagccgttatgcgcgttgggtcttgtctgatttaccgatcattcctgaaaaatggcggttgaagccacgggctgctgtggctaaacagctcaacacgattaaatcccttctggaaaaagcggacgaagttattcacgcaggtgaccctgatcgcgaagggcagttactggtggacgaagtgctggattttctgaatcttagggatgataaaaaacagaacgtccagcgctgtctgattaatgacctgaaccctcaggcggtaatcaaggcggttgaacgtctgagaagtaatcgggaattcattcccctgtgtgtttccgcactcgccagagccagagccgactggctctatggcattaacatgacccgtgcttatacattattggggcagaatgctggctatcagggagtgttatctgtcggacgtgtccagacaccggttttgggactggttgttcgtcgtgacgaagaaatagagcactttgtgccgaaagatttctttgaagttaaggcgtacattgttacgccaaacgaggaacaatttacggccttatggcagcctagtgaatcctgcattgattttcaagatgaagaaggacggctcatacaccagccattggcagagcatgtagtggctcgtattacgggccagcctgcttatgttactgcctatcaggataagcgggaatcagaaacggcaccgttgccattttctctttcttctttgcagattgaagcggccaagcgttttggtttaagtgctcagaatgtactggatatctgtcagcgactttatgaaacccataaactgatcacctatccgcgttctgattgccgttatttgcctgaagagcatttcgtcgggcgtcatgctgtcttgaatgccatttcgatacattcttctgatttacttccgcaggatgcactggagagtgataagaagaatcgttgctgggatgataagaaagttgatgcacaccatgcgattgttccgactgctcgaagcagccaagtcaatttgacagaaaatgaaaggcaaatttatggtttgattgccagacagtatctgatgcagtttttacctgatgcggtattccgtaaatgtacgattgaacttgatattgcgggtggcaaattcattgctaaagcgcgttttctggccgaagcaggttggagaactcttcttggcaacaaggagcgggatgaggaaaatgaaggcactccattgcctgttgttgccaagggggatgagcttttgtgtgaaaaaggggaagtggtggaaaggcagactcaaccgccgcgcccttttagcgatgcgactttactatctgctatgacaggtattgcacgatttgtacaggataagtcactgaagaaggtgctacgtgcgacggatggattaggtacagaggcaacaagagccggtattattgaactgctgttcaaacgggaattcttgtacaaaaaagggcgtaatattcatgcaacacctgctggacgagcacttattcatgtattgccggatatggcagtattaccggatatgactgcacattgggaatccaaattaacgcagatcagtgagaaacagtttcgttatcaggattttatgctgccccttcaggaaacattacagcagttaatctggcaggcgaagcagtatcggaacttgaaagcttttagggacttgcctcctgttcctatgaaaggcaaaaaagggaaaacaaaacaggtaaaaaagggcaaagaaaaagtgaataaaacg

SEQ ID NO: 44787 - DNA, 804 bp, Xenorhabdus nematophilus
atgaaatttgtctcattcaatattaatggcctgcgggcgcgtcctcaccaacttgctgccatcgttgaacagcaccaaccagatgttatcggattgcaggaaacaaaagttcatgatgaaatgtttcctttagaagaagttagcaaacttggttaccacatcttctatcacgggcaaaaatcccactacggtgttgccctgctcacccgtcagcaacccgttactgttcgtaaaggctttcctactgatgatgatgacgcacagaggcgcatcatcatggctgatatcgaaacgccgcaaggcttaatgaccataatcaacggttactttcctcaaggcgaaagccgtgaacatccggttaagtttccagcaaaagaaaaattttatcaggacctgaatcgctatctggaaaaaaaccaatctccagattcacatattctcattatgggtgatatgaatatcagcccaactgatctcgatattgggatcggagaaaataaccagaaacgctggttaaaaacggggaagtgttcctttttaccggaagaaagagaatggatgggacgtcttaaagactggggcttaatcgacacattccgggcacagcatccagaagccagtgaccagttctcttggtttgactatcgctcaaaagggtttgatgataatcgagggctgcgcattgatttgctgcttgccagccgcccattggcagaacggtgcctctcttctggcatagattacgctatccgcagcatggaaaaaccatctgatcatgcaccggtctgggcggagtttggaata

SEQ ID NO: 44788 - DNA, 10172 bp, Xenorhabdus nematophilus
ccaaaggacactatcctgaattgttgtattcatgaactgtttgagcggcaggtagaaaaaacaccggatgcggttgccgttcgattcggggagcagtcactctcttatgcagaattaaaccgcagagcgaaccaactggcccgattcctcagagacgatttgcacgttggcccggatacattggtcggtgtgtgtgtggagcgcagcatagaaatggtggttgcgttgctggcggtattgaaagccggaggagcctacgtacctcttgaccctcactatcctgctgaaaggctcgactacatgctgcatgacgctgccccccgtgctttgttgtctcatggcgcggtgccggctggggttcgcgcgctgctggatcaatacgcgatgagcacaaatgtcagcgtgatcgatttggaggccgatgtctcgcagtggtccgggcaaaacagtgataatttgcatccggcggataacgggctgacttcttcccatctggcgtatgttatctatacctctggctcaaccgggcggccaaagggtgtgatgaaccagcacgttggcgtcgtcaatcgtttggtatggatgcaaaaggcctatcggttgaatgcgagtgatgccgttctgcaaaaaacaccctttagtttcgatgtgtccgtctgggagttcttctggcccctgatgtacggcgcccgtctggtggtggcaaaacctgagggacataaagatccggcttatctgagcgcgttgattcaagaacatcggataactaccctgcattttgtaccgtcaatgttatccgcctttttggatcaggctccgtcagaagttgacgattgcctgcaacgcgtgttttgcagcggtgaagcactgccggcgcgcagtatgcatcggtttcgggagcgttttgctaaggtcgaattacataacctgtatgggccgaccgaagcggccattgacgtcaccgcctggaattgctgccttgatgaaacggatagcttgatcccggaaaatgtgatcccgataggtaaaccgattgataacattcagatttatatcctcgatgctgacggccaaccgtgcccggtcggtgtggcgggtgagcttcacattgccggtgtgggcgtggcgcgcggatatctgaaccagcccgaactaacagcggaaaaattcatcaaaaatccctttagtccggcattaaatggcgtcatgtaccgaacgggggatctggctcggtatttacccagcggcgacattgaatatctgggacgtaatgactttcaggtcaagttacgtggcttccgtattgaactgggtgaaattgaagcacgtctgatgaagcatccggccgtacgcgatgccgttgtgctggcgcagggcgagagtgcggaagataaacgcttggttggatttgtcattgccgcggaacgcgccttacagcgccagtccagagagagcgtgaaagagagtattcaacggcttatcaacgatacggtgcccgattacatgaggcttgccgctattgttattgtcagcggatttcctttatccgccagcggtaaaattgaccgcaagtcctttccggtgatcacttttgatgaattcacagcacaagacgttgaaccgccgaaaaatgcgttggagcaaaccttggttgaggtgtggagtgagctgctcggcgttaaaaacatcggcagaaacgcccacttttttaacttgggcggccactctctactgtctctgaaaatggtactggcgctgcgtcgtcgtggactctttgtggatggctacacgctgtatcagtatcccgtattgtccgaactggcgacacagttgcaggtgtccgatccacaggaaacccgctctgacatggcggaatgctctatggtggaagcgtccgcctgggcgcaactcagccaaaaagaaatcgacgttctgactgccgccattcccggaggcctcaccaatatccaagatatttatcctttgggggcattgcagcaggggatgctctatcactatctgacgaatttggcgggagatccctatgtgctttggcaggtcgtccgtttccgcaatgcagacttgctgcacgcttatgttaacgccctgcgcggcacgattgcccgtcacgatacgtttcgggtcagcgttcattataaaggacttagccagccggtgcaggtggtttggcgggacgctgaattgacggtggaagagctgaaacccacgatggattgcgatgatccgttggtcatcttgaaacagcattgcgatcccgccatgctgcgttttgatatcactaaagcacctttgcagcgttgtctttattgctatgacccgaaacgggacgaatgggtattgctgcatttgatccatcatatgacggtggatcacacgacggtagaaaagatgcagcaggaaatagaagcgcaactgagttcagaaccgcctgctccgattgtgcccatatcgttcaggcaggtgaacgcggatcttgtccgtgcaactggcgcggaagcgcaaaaagcattctttgacgctatgttgcgggattatgagccgactccggcaccgtttggtgccggtgaatacttagggggcaacgcggtggtggtggaagcctggcgaccgctgcaagaacgtttatgtagtcagatacgccaacaagccaaagcacacggtgtcagtgcggccgcagtttttcatctggcttgggcgaaagtgatcgcctgcctgaccggatgcaacgatgtcgttttcggtactgtcttactggggcgcatgtttgcaggtgaaaacgctgaaaacatcatggggccgtttatcaatacgctgccgatccggatacgtctggataaccttgctgtttttgagtgtctttggaatgctcaggatactctgacgcagctggtcaggcatgaacaggcgtcattagcgctggcacagaaatcagtacagacacagggaacagcgcctctgttcacttcattgctgaattatcgtcacagtgaagtgcgcaatattccttcggcagatccttttcaggcaatgaatccttcctccataaatggagtcagttattccggcagtatggagagaacccattatccggtttccgtcaatattgatgatttcaccaacgattttgttattaatgcacaggccgaacaggggcttgatcctgaacttatctgtgactacttgcagacagcgttacaggaaattgtcaccgcgctggaaagcgcaccagagagaagaattggtcggattcatgtcttgccggcgcaggaaaaagataaattgctgtggcaatggaatcagaccgaatctgattttccgcgacagacttgcctccataccctgattgaggatcaggtgcgtcggacgccggatgctattgcggtggtgttcgaagaccaagtgctgagttatgtgcaattgaaccagaaagcgaaccaactggcccgattcctcagagaagatttgcacgttggcccggatacattggtcggcgtgtgtatagaacgcagcatagaaatggtggttgcgctgctggcggtactgaaagccggaggagcctacgtacctcttgaccctcactatcctgctgaaaggctcgactacatgctgcatgacgccgctccccgtgcgttattgtctcatggtgcggtgccggctggggttcgcgctctgctggagaaatatgcgatgagcgcgaatatcagcgtgatcgacttgaaggcagatgcattgcaatggtccgggcaaaaagctgatgacttacatccaactgacagcggactgacttcttcccatctggcgtatgtgatctatacctctggatcaacgggacgaccaaagggcgtgatgaaccagcacgttggcgtcgtcaatcgtttggtctggatgcaaaaggcctatcggctgaatgcgaatgatgctgttctgcaaaaaacacccttcagtttcgatgtgtccgtctgggagttcttctggcccctgatgtacggtgcccgtctggtggtagcaaagcctgagggacataaagatccggcttatctgagcgccttaatccaagagcaccggataactaccctgcatttcgtgccgtcgatgctgtccgcctttttggatcaggcaccgccagaagtgggtgattgcctgcaacgcgtgttttgcagcggtgaagcactgccggctcgcagtgtgcatcggtttcgggagcgttttgccaaggtcgaattacataacctgtatgggccgaccgaagcggccattgacgtcaccgcctggaattgctgccttgatgaaacggatagcttgatcccggaaaatgtgatcccgataggtaagccgattgataacattcagctttatatcctcaatgcttacggtcagccgtgcccggtcggtgtggcgggtgagcttcacattgccggggtgggcgtggcgcgcggctatctgaaccagcccgaactgacagcggaaaaattcatcagagatccctttagtccggcattaaatggcgtcatgtaccgaacgggggatctggctcggtatttacccggcggcgacattgaatatctgggacgtaatgactttcaggtcaagttacgtggcttccgcattgaattgggtgaagtggaagcggcgttgttatcgcatgacagcgtgaaagagtgtgtggtgctggtgcgtgaggatgtgccgggcgatgctcgtctggttgcctatgcgacccctgcttccggctacgtcgatcaggttccggaggagcggagtcaaacgctgagaatgcacttacagacgaatctgcccctatttatggtgccgtctcacttgctttggcttgatgcgtttcctctcactgcgaatggaaaactggatcgtaaagcgttgccatctcctgctgatgccccgatggggcaaacaataaccgtacagcctccacaggaaggaacggaaactcaattagcccagttgtgggccgagttactcaatctcaatcccaatgcgatcggacgtcaatctcacttttttgaagccggagggcattcattactggctgtcgctcttatggcgcggatacagcaagcgttcagcgtgtcattgctgctgagtgcgatagtggaacacttggatttggcttcgcaggccgagcttatcgagactgaaatagaaaaaggaaacgcagcaagggaaaacggggagcgagcgcatttaaccgagccaatcgaaccgacgcctgtcgagcagatccgggcgttaccaacgcaaaaagccatatataaagcagtaaaacttaatcctcaagacttaagcaataacagttttctcgcgttgtcgttcgacgatgatgtggagccggatcttaaacaactgcgtaatctattgcagtcggtactttcccgtcatgaaagcctccgggcgcaatttgttcttacaggcgatgaactctatttgcgccctgccaagcgttttttattccggctggagaaacgtcaaactcttggcgctctggaagaagatctgcgcgattttatccgcccgttctcgctggaagatggtatgaatgttcgcggtcggtgggttgttgatgggcggcatccgcttttgctgttggatttttcccacgcctgtattgatggttctggtctgatgcaaatactcagcgagttagccactgaaaatgaccctgctccttcgggaacccgtctggcaacttattctgagcttttctacagccgtgaatttaccactctgcgacaagaacacgcggacttctggcgaacgcagttacaggagtggtcgccccttgtgcatgcgcaggacaccgagtcagtcacgcacacttgcctgattacgctcgacacagggcttaaagggcagattgaaacgctcacgtcacgattaaagatcagcgttcctgaattctttatggccgcattcttgttgtttaaagcccgtctggattatcagcccgctcaacgcaatccgcacgatcaactgacgtccatgatctttcatggtcgggacaggttggatcaacagacggtcatcgtgccattgatgtcggttctgcccgtgcgggtaaggttgcggggcgagacgatggaaccggagatgcttcatgaagtgagcatagcggtgcgcgcggcctgtcgtcattacctgtttgatgccgaagaattgacggtacggtatccggcgctggctaaacaggtattatcccccacgtcttttttcggttacttccagaaagagggctttgacggccgtattgcaggccggctctgccggcagctggaaacgcccaatgttgcaggcgggcaatcgcactggaatctgacctgcgaaattgccgagcataccacgggctttgacgttcatctggaagcgctctcgttcagtacaggaagcgacgcaggaaattgggaagcgctgtttaagtcgattgtgcaaagtgcgctgagtgtcgggtgatatgaaaataaagcaggaaattgcggaaatgcacactaatgatcccattgtgatgaatgcaagaaaacaagcattaaaagattatgttcgccaacaactggatgccggatatcagggatgtcccttttttgtgtctcggctggcggcctcggggatgaacacagaggttgtcacgacgtcattcactcttgccgaaccactgaacagcagaattttcactatggcggcgtctccgctgcatcgtttgtcgctgttttccgcctgcatcaagtatctcgcctttttgcacagccgggagccggaagggagcttgatttgggcgatcggggcgcaagataggtcgggcaacggaacaccggcggttttgtccaatgaccctcccgccggagtttatctcgtcccagctaaatggcatctgacggaaacggagctgacacaaccggtaaaacggctgtttggtgaggagcttgcgcaatggaagcgaatagccgcgttgacgtccggcatgcctttgcaatcggcgtcttctgttatgtcgcaatcgccgcaagtgttggtaggttactctgaaacacagacaccctttgagggaacagatacggcgcattattcactgagtatctggatcgaagcctgtccccaaaagacctgtctgcatatgagattcgattcgcagagggtggacgcagaactgacatcgcttctgatggatcgcttgaccttgttattgaacagcatggtattcgagccaaactccccgctcgcgtcgatgccctggatgccggtgcaagagcgggagagaatcgctgcgctgtccgcccccgtacccgcgcagccactgaggtacaaaaatgtggagcaggccatgaccgcctccatgcgcgacagagctgaaacccagtttctggaggtcggtgatcagaccgttaactttaaacagttggagcagtacacggctattttgttgaccgatcctaatttgccacaatgggaatcgttaggcgactgtgtgcttattgtcggcgccaagggagtggaaatcacactcgccgcaatggcatgtatgcgtatcggtaagccgttctgcctgcaatcccacagcgcgcctgaaagccagttattggacatcatcgagctgcataacaccaaggtggttctgctacaggaaagttgcggtgagatggccgaactctttcgcgctcagggctgtcaggtcgttatgctgccttattatgtaccggatgcgccagtcaggctgacgcatcgaacggagatgtctgttctggcggcgttgctgcgcaaaggtgaggcagtcaatcccgacgacccattgtgtgtggtgatgacctccggcagtgagggcaaaccgaaaggctgtatcaatactcacaaagccttacttaatctcagtgctgaaaaacaagccctgtatcacaccgccggctccagagttgcctccgtagcgaatcatacttttgattatttcgtactggaatgtgtgcagtgtctgactcaggacatcgtgctggtcatgccgccggaagaagcgcgttcagacgctggaaaatgcgtcagatttctgcgggaaagccgcatcgatttattgttcaccacgaccgtgctggcggaatacatcatggagcagggagatattcctaacttgcggcaattgtattttggcggcgaaagtctgagaacgtttcaaaaaaataattacgagctgtttaatgtatacggccccagtgaaaccggcgttctgacaacttatttatccatagtgcgtaatgaccagaaagtcactatcggtaaaccgttcggcggctgccagtgtgttgtggtatttcccgataccttagaaccctgtcctatcggtgtatcgggtgagttgttgataggaggagccggcgttggggcgggctacataaatcgccctgatctcactgaaaaggcgttcatagatctggatacggaatggttgaaggggaaatattatcgcagcggtgatctctgttgctggaatgttcagggtgagattgaaattgaaggaaggcgtgatcgccaactgaaagtgaacggtttccgcatcgaattggatgccattgaaaaaaacatcttagatctgccgacggtggctcaaacggcagtgattggcatagaagaccagcgggggcacactcacgtaggtgcttttatcgtaacgacggacagtggggtcacggaacaaaacgtcagagaggcgttattaagccggatgcccgcttatatggtgccaagtcaggtgattctggtagcggaattaccgctgacgcgcaatggcaaactgaatcgacaagggctaaaacaggcgtttggcaaggcgatgaacggtaaagttgtccggcctgacggggcaacccaagaatggctggcagcctgttgggcgcggtatttggagttggatgttgacaccttgtcggtagacaaaagttttttctctctggggggtcattcgttacgggctgcaagggttctggcggagattcaacatgaatttgggcaggctgtctctttgttggaattttttcaaaacgatacgattgaggcacttgcgaaaacaatcgacgccagacgaaccggcggtgacagcatggtgacggagagtttctcaaatctgctggaaaccgcacctcagtttgcggttgacgggcgtgggccgttatcggcacaagaagttcggctttatgcagaatatcgtctgcatccagaatcacaggcttatattttggcgctggagatcccgctatcccatgacctctttcctgatgcagtgaaacaagccctacaggctctaattgaccgccacgatattttgcgtacccgatatcgtattgatagtgaaggtattccctatgctgagatattaccgtctctgccggttgacagggtactgatcgatgatcggaatcagtggttgcagatgcggacgcaggctttcgagttgggagaagcccctttgttgagaggctgtctacaggaaataaacacagagcacgcctgtttgcagttacagatccaccatattttagtggacaaaccttcgttggagatcctacagcgtgagtttcagcaattgctggcgcacgaatcgttgtcttgcgtggcactgagttacaggcactacgcaatggcattagcggatgcccgtcaacgcccggtctggacacaggctgaggcattctgggtagactatcttgaagggctggaattcgatccgttcggacatggcgcggtggatgcaggtggcaaggtgaaaaccctatcctggcatctatcggccgcagatatggcagcagtgaaacatctttgcggagccgtcaacgtgactccggccatgtttttcctgtcggtgtgggggcttactgtggcgcgcgaagggggaagtcatgccttttccatttcagtggcgaatgcatttcgcccaaaaaatgcgctggagaccgtgggtatgttcgtctcgttatccccttgcgcgtttcgttttgataagccgacagcaacctttgaccgatttattaagaaattggccgatgagcagtggcgtatggtggatcagcttttttttccggttgaagaggcttttgcattgctcagccgtgatcccaggatgtttggcagcaatccactgcttaatgtcgcttattcctatcttg

SEQ ID NO: 44789 - DNA, 2114 bp, Xenorhabdus nematophilus
ttaatgcatcaccctgatattaatcttatttggcaacgggtgggcccggcatggtaaaagcagcctatagctcaggcaagcctgcaattggtgttggtgcgggtaatacgccagtggtgatcgatgaatctgcggatatcaaacgcgccgtagcatcgatcctgatgtccaaaactttcgataacggcgtaatttgtgcttctgagcaatctgtaattgtcgtcgataacgtttatgatcaagtccgtgaacgtttctcaacccacggtggttatctcctgcaaggagaggagcttcaagccgttcaagatatcattttaaaaaatggcagtctgaatgccgccatcgttggccaacctgcaaccaagattgctgaaatggcaggtatttgcgttcctgatgaaactaaaattcttatcggtgaagtcactttggtggacgaaacagaaccttttgcccatgaaaaactttcgccactgcttgctatgtaccgtggtaaaaactttgaagatgccgttgaaaaagcagaaaaactggttgaaatgggtggtattggtcacacctcctctctctatactgatcaggataatcaatccgaacgtatcgaatatttcggcgacaagatgaagactgcccgtattctgataaatacaccagcatctcaggggggaatcggcgatctttacaatttcaaactctccccttctctaacactgggttgcggctcttggggaggaaactccatttccgaaaacgtggggccaaaacacctgatcaatacgaaaactgtcgccaaaagagccgagaatatgttgtggcataaacttcccaaatcaatctattttcgccgtggctccctgcccgtagcactggaagaagttgctacagatggcgcgaaacgtgctttcatcgtgacagaccgtttcttgtttaataacggctacaccgatcaggttatcaacgtattgaaatctcacggaatagaaactgagattttcttcgaagttgaagccgaccctactttaggcatcgtccgcaagggcgccgaacaaatgcatctgtttaaacctgatgtcatcattgccctaggagggggttcacctatggatgcagccaaaattatgtgggttatgtatgagcatccagaaactcactttgaagaattggcactgcgttttatggatatccgcaaacgcatttataaattccccaaaatgggcgtgaaagcaaaaatggtagcgattacaaccacctctggaacaggttcagaggtaacaccttttgcggttgttaccgatgatatcactggacagaaatatccattggcagattatgcactgacacctgatatggcgattgtcgatgcaaaccttgttatgaatatgccaaagtcgctgtgtgcctttggtggattggatgccgttacccatgcactcgaagcttatgtctctgtcttggctaatgaatactctgatggtcaagcattgcaagcgctgaagctattgaaggattttctgcctgccagttaccatgaaggtgctaaaaacccagttgcccgcgaacgtgtccataatgcggcaaccattgccggaattgcctttgccaatgcttttctgggagtctgccattctatggctcataaactgggctctgagttccatatcccacatggattggcgaatgcgttgttgatctgtaacgttattcgctacaacgctaacgacaatccaacaaaacaaactgcattcagtcaatatgaccgtccacaggcacgacgccgctatgctgaaattgcagagcatctggggttgacggtatcaggggataacactgccgccaagattgaaaaattactggcttggctggaagagctaaaatctcaattaggtattccagtatcaattcgtgaaacaggcgttcaggaaaccgattttctaacgaaaatcgataaactcgcagaagacgcttttgatgatcaatgcacaggcgccaacccgcgttatccactaatttctgagttgaagcaattgatgctggattctttttacggtcgtgaattcacagaatatgccatatctcaggaagcagaaaaaccaaacagaaaaaataaataa

SEQ ID NO: 44790 - DNA, 1317 bp, Xenorhabdus nematophilus
atgaaagttactgtatttggtattggctacgtgggcttggttcaagcaactgtatttgctgaagtcgggcatgatgtactttgtgtcgatgttgatgcaaaaaaagtcgaaaacctgaaaaatggccagatccctatttttgagccaggtttagtaccgcttgtgaagaaaaattttacggaagggcgcctgaattttacaacggatgctaaagccggtgttgcacatggcaaattacagtttattgcagtaggaacgcctcctgatgaagatggatcagcagatcttcaatatgtcactgctgtagcccgtactattgcggaaaacatggatggctacaaagttgttgttgataaatcaacggtacctgtaggtacggctgataaagtcagagcagtgatgcaaacggcattaactcaacgcagcgcagattttccatttgatgttgtctccaaccccgagtttttgaaggaaggggcagcgatttctgactgtatgcgtcctgagcgtattattattggctgtgataatgacaatgtgattgatgtgatgcgcgaactgtatgagccatttaatcgtaatcatgatcgtatgattgtcatggacatccgcagtgcagagttgactaaatatgcagctaactgcatgttggcaactaagatcagttttatgaatgaaattgcaaacttggcagaaatgttaggggctgatattgagcatgtacgtcagggaataggttctgattcgcgtattggctatcatttcatttatccaggatgcggatatggtggttcatgtttcccgaaagatgttcaggcattgatccggacttccgagcagattggatatacacctaaaatacttcaggcggtggaactggttaacgaaaaacaaaagagtaagctgcctacttttgttaaacgccattttggtgatgatttatcaggtaaaacattcgcaatttggggattatcatttaaacctaatacggatgatatgcgtgaggcatcaagtcgcgtattgatggaagcattgtgggaaagcggtgctaaagtgcaggcatatgatccagaagctatgcaggaagctcaacgtatttatggccagcgtgatgatctttctcttatgggaacaaaagaagcggcattaaaagatgcggatgctttgattatctgtacagaatggcagaatttcagagcgcctgatttcgatatagtgaaggattcaatgaaatcgccaataatttttgatgggcgcaatctttacgatccagaacgcctgcaatcgcgtggattcacttactatggcattggtcgt

SEQ ID NO: 44791 - DNA, 888 bp, Xenorhabdus nematophilus
atgtcaattataaacaaaaagataaaaaaagctgttatccctgttgctggtttgggaacaagaatgttgccggcgaccaaagccattcctaaagaaatgctcccgctggttgataaaccacttattcagtatgtcgttaatgaatgtattaaggcgggtattaatgaaattattctggttacgcattcatccaaaaactctatagaaaaccattttgataccagttttgaattggaagcgatccttgaaaggagggtcaagcgccagttgctagatgaggtacaatcgatttgcccaaatcatgtgacaattatgcagacccgtcaggggatcgcaaaaggattgggccatgcggtgttatgtgctaagccactgattggtgatgaaccatttgctgttattctgccagatgtcattttggatgaatacagtacagatttgtcgaaatataatttgagtgaaatgttgtcacgctttaatagcagtggagcgagccagatattggttgaacccgttcctttggaaagcgtcgcagattatggtgttgttgattgccttggcgaaaatctgcaacctggtgacagcaagcctattgctcgtgttgttgaaaaacccaaaccggaagaagccccatcgaatctttccatcgttggtcgctatgtgttgtctgaaaaaatctggccattattggcgaaaactgcaccgggtgcaggagatgaaattcagctgacagatgccattgctatgctgatggaaaaagaacccgttgaagcttatcatttgcaaggccgcagtcatgattgtggtaataaattgggttatatgcaggcattcgtcgaatatggtatgaaacataaggacttaggtacagcattcaaggattggatc

SEQ ID NO: 44792 - DNA, 1329 bp, Xenorhabdus nematophilus
atgactgcgacaaacttttccgaattcgaacttgatgaatgcctgcttaatgcactgaacgaaaaaggctacgaacgcccgacagcaatccaggctgaagccattcctgctgccatggatggccgtgatgtacttggctccgcgccgactggcacaggcaaaaccgctgcgtacctgctaccagttctacagcatttactggattttccacgtaaaaaatccggcccgccacgtatcttgattttgacccctacccgcgaactggcaatgcaagttgcagaacaggcacaatcatttgcggctcatactaatctggatgtcgccacaatcactggcggtgttgcttacatgaatcacgcagaagtgttcagtgagaatcaggatattgttgtcgcaactacaggacgcctactgcaatacatcaaagaagaaaattttgattgccgtgcggtggaaacgctgatccttgatgaagcagaccgcatgctggacatggggtttgccaatgatgtcgagaccattgccggtgagacacgctggcgcaaacaaacgttgctattttccgcaacgttagaaggtgaaaccatccgtgattttgcagagcgtctgttaaccgatcctgttgaaatcgatgcagaaccttctcgccgtgaacgcaaaaaaattcagcaattctattatcgtgccgataatctggagcataaaacagctttactgtgtcaccttcttcagcaacctgatgtaacaaaatcgattgtttttgtgcgcaaacgtgagcgtgtgcgtgaaattgttgattatctacataaggcaggcattcaggcctgttttcttgaaggtgaaatggtgcagaccaaacgtacagatgccgtcaagcgactgaatgatggcagagtcaacgttatggttgcaactgatgttgcgtcccgtgggttggatattgaaaatatcagccatgtctttaactttgatttaccacgtactgccgatgtttatctgcatcggattggccgtactgcccgtgcaggccgtaagggaaccgctattgcactggttgagtctcacgatcatccactgcttggtaaagtcacccgttatctcaacgaaccattgaaagtacgggttgtcgatgaattgcgcccacaaactaaagcacccagtgagaaaaagagctataagccttctaagaaagttctggagaaacgtaaagagaagaaaaaggtagaagaagaagcgaagaaaacacgagtgaaagttcgtcatcgcgatagtaaaaacattggaaaacgccgcactccttccggtgatcccaaaccagaaacgtcagaa

SEQ ID NO: 44793 - DNA, 915 bp, Xenorhabdus nematophilus
ttacagggaagtccactacaacttcaatcgagttctccggccaaatcatcatctgacaaggctgatgtgactcactccacaacacaacccacaacagctccgctttcagaaaatacccagcaaaataataatctttatcaatcattgattcgcgatcgtcatctaagtgccatggcattacctgaattacatgccaatgatattgcaggaaaacattctaaacgcatcgattatgatctgtctctggtcacccgtgatgtttaccgtatgaatagcatgggaattggtgattatgtgcgtcttacgaaagatgaaatatcaaaagcgggcattgatcctgctatcttggaggatagttcaacaggatttcaggcaggcgtttatcgaaataagggtttatatatagtgtcatttactggctcgaacgaaatacaggatttcatggcaagtattcgtcaagggcttggatttaaagaagagcaatatggtcaggctgtaacgttggcacaagcagcgttaaaagcatttggtgaaaatgtcattttcacaggtcactcaatggggggaggattggcatctgtggcagcgctgacaacaggaaaacccgcagttatttttaatgctgcaggtgtgtcagattcgacattgagaagtatggggttatcaccggaagcaagtcgtgaagtggcagaaaatgggttaatccgaaattatattgttgaacatgactggcttgataacctgcaaaaaactttgccaattccccagcccatgggaaataaaattttgcttgaatatgagtacgaaccggaagggatattagattccatttttgcctatcggtatgcttttcactcattcaaggcgcattttatggaagccgtgcaggaattgctgaccgtccataaaccttgg

SEQ ID NO: 44794 - DNA, 675 bp, Xenorhabdus nematophilus
atgtccgcatctctcacatggcacgaagtcatcggccatgaaaagacacagccctatttcgttgacacattgacctatgttgccaatgaacgtaaggccggaaagacgatttatccgctacagcaggatgttttcaatgcattccgctataccgaactgtccgatgtaagagtcgtgattttggggcaagacccttaccacggcccaaatcaggcacacggtctggctttctcagtacagcctggtattcctgcaccaccttctcttgtcaacatgtataaggagctggaatcggatattactgggtttagccgccctaatcatggctgcttggtcagttgggcaaagcagggcgtattgctgctcaatacggtgctgaccgttgaacgtggcaatgcgcattcacatgcgaatttaggctgggaaaccttcactgacaaagtcattgcggcaatcaatgaacatcgtcacggcgtcattttcctactttggggttcccatgcccagaaaaaaggacacttcatcaatacccaacagcactatgttctaaaagcaccacacccttctcctttgtcagctcatcgcggttttctgggatgcaagcatttttcacaggcaaacagtctactggaagctcaaggattgacgccaattgattggtatcccacactgcct

SEQ ID NO: 44795 - DNA, 3978 bp, Xenorhabdus nematophilus
atgggtagtaccactatgggcgtgaagctcgatgaagcaacgcgtaatcgtataaaatctgctgcacaacgaattgaacgcacaccacactggctgattaagcaagccatttttaattatcttgaacgcctggaaaatgaggaaaagatcccagaaatatcagtgtttcaggataacaaagaagaaaagatttccgaagaagaatcacagattgaggcgacttctcaaccatttttggattttgccgagcatattttgccccaatcggtgaaacgttctgcaattacttcagcgtatcgtctgcccgaaacgcaggcagttcccatgttgctgcaacgtgctcaattatcaggagaacaagccaaagcgacccacaaactcgcttactccatcgctgaaaaactacgccagcaaaaacatggcactggccgcgccggtttagttcaagggttactgcaagagttctccctttcttcacaggaaggcgttgcgctgatgtgtcttgccgaagccctgctgcgtattcccgacaaagcgacccgtgatgcgctgatccgtgacaaaatcagcaacggtaattggcattctcatcttggccaaagcccatctatgttcgtcaatgccgcaacttggggtctgttgttcacgggcaagctggtatctacccataatgaagccaaattatccaagtccttgaaccgcattatcagcaagagcggtgaaccattggtgcgcaaaggtgttgatatggcgatgcgcctgatgggagaacaatttgtcacaggtgaaaccatcgcccaagccctcgccaacgctcgcaagctggaagaaaaaggcttccgctattcatatgacatgctgggtgaagctgcgctgacagaagaagatgcacaggcatacatggtttcttatcaacaggcaatccacgccattggtaaggcatcgaacggccgcggcatttatgaaggaccgggcatctccattaagctgtcagccctgcatccacgttatagccgtgctcaatatgaacgcgtcatagatgagctttatccacgcctgctttctctgactttacaggcttgtcaatatgacatcggtatcaatatcgatgcagaagaagcagatcgtctggaaatctctctcgatttgctggaaaaattgtgttttgaaccaaaactggaaggctggaacggtatcggttttgttattcaggcttaccaaaagcgctgtccttttgtgattgacagcattatcgacctggcgcaacgcagccgccatcgcttgatgatccgtctggtgaaaggagcttattgggatagtgaaatcaaacgtgcccaaattgatggtctggaaggctacccggtgtatacccgcaaagtgtataccgacgtttcttacatcgcctgcgcccgtaaactgctttccgtccccaatctgatctatccacagtttgcgacccacaacgcgcatactctatctgcggtttaccatctggctggacagaattattatccgggacaatatgagttccagtgtctgcacggcatgggtgaaccgctgtatgagcaggttgtcggcaagattgccgatggcaggctcaaccgcccatgtcgcatttatgcgcctgtcgggacacatgaaacactattggcttatctggttcgccgcctgttggaaaatggcgccaatacttcgttcgttaatcgcattgcagatacctccctgccccttgatgaacttgttgctgatccggtgaaagtagttcaggaactcgcacaatctgaaggacaaattggtctgccacatccgaaaattccactaccacatgatttatacggcaagaaccgcgtcaattcctcggggctggatctgtcgaatgagcaccgtttggcttcactctccagcgcattactgagctcttcgatggaaacatggaacagcgagccgctgctgggtggtgattatgcacataccggcgaattgccgacagctaaatccgtcaataatcctgcgcggccttccgatatcgtgggctatgtccgtgaagcgactgagcaagaagtcagccacgctctggacgttgccatcgatgcaggtactatttggtttgcaactcccccctcagaacgcgccgcgattttggtgcgtgcagcggaattgatggaaaataacctgcaatccctgctcggcattttggttcgtgaatccggtaaaaccttcaacaatgccatcgctgaagtgcgtgaagccgttgactttctctattattacgcaaatcaagttcggcaggatttcgccaatgacacccatcgcccactagggccagtagtttgtatcagtccgtggaacttcccgatggcgattttcactggccaaatcgccgcagcattggcggcaggtaatagtgtcttggcaaaaccagcggaacagacgccattaattgccgctgttgcagtcaaaatgctgcatcaggcaggtatcccgcgtgatgtgctgcaattgctgcctggtcaaggggaaactgtcggggctttgctggttggtgatgagcgtgtgcggggcgtgatgtttacaggctccaccgaagttgccagcctgttgcagcgcaatattgccggccgtcttgatgcacaggggcgcccaacgccattgatcgccgagacgggcggactgaatgccatgattgtcgattcctcagcactgacggaacaagttgtcaccgatgtggtcgcgtcggcctttgacagtgcgggtcagcgttgttccgctctgcgtattctgtgcgtacaagacgatgtggcagaaagaacccttactatgctgaaaggagccatggctgagtgtcggatagcaaatcctgaacacttatcaacggatatcggcccggtgattgatgccgaagcgaaggctggcattgagcgccatatccagaccatgcgcaccaaaggcaggccggtttatcaagcagtacataaaaatgaagccgatagtcaggaatcttcacaaggcacgtttgtcaaacccacgctgattgagctggaaaattttgatgaattaaagaaagaagttttcggccccgtactgcatgtagtgcgttttaaccgtaatgagctggataaactgctggaacaaatcaacgcttctggttacggattaacgctaggtgttcatacgcgcattgatgaaaccatcgcacaagtcacggccaacgctaaagtcggtaacttgtatgtcaaccgcaatatggtcggggctgtcgtcggtgtacagccatttggtggcgaaggtctgtcaggcaccgggccaaaagcgggtgggccgctttatctgtatcgtctgttatcacagcgtcccgtcaatgctgccagccagacactggaacgtcaggatgaggaatatcagcttgatgccagagcgcgtgtcgccctgcgctcccctttcaacaaattggctgaatgggtaacagcacaacataacgatgctttgagcaaattaattcagaaatacagcctgttagctcagggcggaaccattcgattactaccgggacctacaggggaacgcaatacttatacgctcttgccacgcggtgaagttttgtgtctggccgataatgagcaagatacgttggtacaattgtctgccgtgttgtctgtcggctgtcaggccatctgggagaaagacgatttgcatcagcaattactgcgtcaattgccggatgaggttcgccactcaattcgtctgatcaacgattggcaaaatgaagagacggaaatggaagccgttatttatcacggtgattgcgaccagctacgtcatgtctgcggtatcatcgctcaacgcaaagggccgattgtttcagtacagggttttgcccgtggtgaaacaaacctgctactggaacgtctattacatgaacgctcattaagtattaatactgccgccgcagggggtaatgccagtctaatgacaattggg

SEQ ID NO: 44796 - DNA, 1239 bp, Xenorhabdus nematophilus
attgctgtttacgatcttggtggcggaacattcgacgtttctgttctccgccttagccgtggtgtatttgaagttctggcaaccggtggtgataccgcactgggcggtgacgattttgacctgttgctggcgaattggatccgtgaacaggccgggatcagcgatagtgaccacgggttacagcgtcaactgttggatgtcgcgacgcaggctaaaattgctttgagtgatgcagatacggctgagatcaacattgcaggctggcagggcaatattactcgtaccgaatttaatgagttgatcgtatctctggtcaaacgcacattactggcctgtcgtcgagccctgaaagatgcgggtgtcacaacggatgaagttttgcaggtagtgatggtcggcggctcaacgcgcgtaccattggtacgcagcatggtgggcgaatttttcgaccgtgaaccactgacctctatcgatcctgacagagtcgttgctgttggggcagcgattcaggctgatattctggtcggtaataagcctgatagcgaaatgttactgctggatgttatcccgttatcactcggtctggagaccatgggtgggctgatcgaaaaagtcattccacgcaacaccaccattcctgtggcaagagcgcaggagtttaccacattcaaagacggccaaggtgcgatgagtatccatgtggttcagggagaaagggagttagtgaatgattgccgttcactggctcgtttcacgctgcgtggtattcctccattaccggctggtggtgcacatattcgcgtgacttttcaggtcgatgcggatggtttgctgagtgtcagcgccctggaaaaatccacgggcgttgaagcttccattcaggttaaaccttcctatggcctgtctgatgcggaaatcgcccgaatgctcagagactcaatgaccaatgcgcaggaagatattcaggcgcgtaaactggctgaacaaaaagtagaagcggcgcgggtgctggaaagtttaaccagcgcactggaaaaagatgccgacttactgagtcaggaagaacaggctgccattgatgctgccgtagaagtattaatcgagagcgcacagggaacctcttctgatgcgattgaaagtgcaattaaacaattggacaaacaaacgcaggagtttgcagcgcgtcgcatggacacatcaatccgccgggctttggcgggtcattctgtggatgagatt

SEQ ID NO: 44797 - DNA, 768 bp, Xenorhabdus nematophilus
cttgttgcttcacttttttttcaggccagtacaagaactcgcctcagttttgaaagcgcagccaaccgtcttggtgcaagagttataggttttgctgatggtgagtcaagccgttctggttcaagctggaatgaaaaatttacggatactgcacaaatgatcaatgcgtatgccgatattgccgttatacgccacgccgaagttgagcctgtgcataactattgtataaaaagtcgccttccagttataaatgcgggaaatggtgaaggattaaatgcagagcatccaacgcaggctttgcttgatatttttaccattcatcaatctttccctcttcataaatcattaactttattattatgctgccacccctcttcccgatcagcgcgttctcttctcttctgtatcgccctgtttcacaatataaaattattactttgcactgaagaaaattgtaagctttttcaagaagacgaagcgtaccttcgtcaagcgggtgtcacctactaatatctccataacatcaaagaggggttgtgtagtgcggatgttatttatatggcgggttatagagaaacagcagatcatttacccaattccaatttgatgctcactcctgatctactttcacacttacatccccgcgccataattatgcatcctcttcctcgaggttatgagcttccttatgagttagataattcagtacattgtgcttatttttctcaggctgagaacggagtttttgttagaatggcaattctccaa

SEQ ID NO: 44798 - DNA, 1308 bp, Xenorhabdus nematophilus
atgggtcgttcttcaacaaaagtggcacagcaaaaggagcgtgttgctattgtcagtgggttgcgccttccttttgcgaaacaggcaacgagttaccatggtatcccagctgtcgatttgggaaaagccgttgtcagtgaactggtcatcagaagcggattgtcgccagagaagatcgaccaactggtgtttggacaagtcgttcaaatgccggaagcaccaaatatcgcaagggaaattgtattaggcgcaggattaagtgttagcactgatgcttatagtgtttcccgtgcctgtgcaaccagctttcaggcgattgcgaatgtagctgaaagcattatggctggcacagtgaatgtaggcattgccggcggcgctgattcctcatctgtgttaccgattggggtaacaaaatcactggctcgcactttggtcgatatgaacaaagccaagagtttgtcacagcgcttaaaattaatcagtcgattgaaattgcgggatttactgccagtatctcctgcggttgctgaatattccaccggattgaggatgggcgatacggcggaacaaatggctaaaacctaccatatcagccgcgaagagcaggataagttggcacaccgttcccatatactggcagctaaagcctggcagcagggttgtttgaatgaggaagtggtagcggcgcattttccgccataccgagacacattgacagaagataataacatccgaaaaaattcagttctcacgtcttactccaaattgcggccggcctttgatcgtaagtacggaaccgtaaccgcggcgaatagtactccgttgactgatggtgctgccgcagtcatgttaatgcgcgaatcggtcgccaaagagcttggtatgactccgctgggttatttgcgtagttatgcgttttctgcgattgatgtctggcaggatatgctgttggggccatcctatgcgacgccgattgcgctggagcgggcgggtatcactttgaatgaactctcacttattgatatgcatgaagcgtttgccgctcaaacactggcgaacttgaaaatgtttgccagtgaaaagtttgcgcgtgaaaaactggggcgctctcaggcagtgggtgacgtagatatggataaattcaacgtattaggtggttcaatagcttatggtcatccatttgccgcgacaggtgccagaatggtcacccagacattgaacgaattgcgtcgtcgtggtggcgggtttgggctgacgacagcctgtgccgcaggtggattgggtgtagcgatggtattggaggtagaa

SEQ ID NO: 44799 - DNA, 660 bp, Xenorhabdus nematophilus
gatcctgaaaaattggctgaagcacagaacgtgctgagtgaagctgtctatgagtgtcaacaccagaacatgcgaacactcatttttggcggtgggcatgaaacggcatttgctcatggaatgggaatttaccgcgcgtttccgacacaacgcgtaggtattattaattttgatgcgcatctggatctgcgtaattcggcgcaacctacatcaggaactcctttccggcagcttgccgattattgccagcagcatcagcgtccgttcaattacacttgtattggagccagtttggcatcaaatactcaggctttgttggacgaagccaatcatcttgatgtcaccatcatttgggatactcaatgtattgagtcgatgctggataaagtaaaggaacaaattcaaaatgtgattaatcaagttgatataatttatatgaccatcgatttggatgtactgccaatctggcaaatgccgtcggtttctgctcccgctgctctgggagtgccgttagagcgtttgttgccgttaattcaactcatctgccaaagcaaaaagttacaggctgtcgatttggttgagcttaatcctttgtatgacattcaaggaatgggaggcaaagcagcggctcgccttacgtggcaattggtgcattggtgg

SEQ ID NO: 44800 - DNA, 1521 bp, Xenorhabdus nematophilus
atgaaacacattactattcatcccggaaaaatgacgcttgaagagttacgccacatttatcagtatccggtgcaaattaccttagatgagcaatgcgttcctgccattgaacgcagcgttgattgtgttaaccgtattatcaatgaaaacagaacagcctatggtatcaacacgggttttggcctgctggcgagtactcggattgccgagcaggatttagaagaactgcaacgttcccttgtgttgtcacatgctgctggtgtcggtgagcctttgccggatgagattgtccggttgattatggtattgaaaatcaatagccttgcccgtggttattccggtattcgtttagacgtcattcaagcgttgatcactttggttaatgcagaagtttatccctgtattccgagcaaaggttctgtgggcgcttcgggagatttggctccactggcgcatatgagcctgttattgctgggcgagagtaaagcgcgttaccgtggggaatggctgccagctaaagacgccttggagaaggcaaatcttaaaccgattcggttggcggcaaaagaaggtctggcgttgcttaatggcacacaaacctctactgcttttgccttgaaaggactttttgcagcagaagacttacttgcctcagcagtgatttgtggcgcgatgtctgttgaagcggcactgggttctcgtaaaccatttgatgcgcgtatccatgaagcacgaggccagcaggggcaaatcgatgtagctgctctgtatcgtctggtattggaagaacaaagtggtctatctgaatctcataaaaactgtccgaaagttcaagacccttattcattgcgttgccagccacaagtaatgggcgcttgccttacacagatccgtcatgctgccgacgtgattatgactgaagccaatgcggtttctgataatccgttggtctttaccgaccaagatgaagtgatctctggcggtaacttccatgctgaacctgttgctatggcatcggataatctggctattgcactggcggaaataggtgcactgtcagaacgccgtatctctttgctgatggatagcaacatgtcccagttaccgccgttcctcgtcaataacagcggggtgaactccggctttatgattgctcaggtgacagcggcagcgttggcgagtgaaaacaaagcattggcgcatccttccagcgttgacagcttgccgacatcagcgaatcaggaagaccatgtatctatggctccggcggcaggtcgtcgtttatgggaaatggctgacaacgtgcggggtattttagcgattgagtggctgactgcctgtcagggcatggatttccgtgacggattgaagagcagcccgatactggaaaaagcccgtcatatcctccgtaataaagtcgcttattacgataaagatcgcttttttgcaccagatattgacgcagctatccaactgttgattgaacaacaactttcagcactgctacctaccggaaaatta

SEQ ID NO: 44801 - DNA, 723 bp, Xenorhabdus nematophilus
aacttaaaggacaaaattgcgtttatttccggaggaacgaaaggtattggcaagggtattgctcaggtatttaagcgagcgggtgccattaccattatttccggtactaacagggcaagaggcgaggcgattgcaaaagagctggatattgattttattcctcttgatgtgacggatcaggcggcatgcaaaaatgtgattgatgagattgtcgaaaaatatggcaggcttgatattctgtgctccaatgctggtatttttccgcaacattatcttaaagacatgactgctgaagattgggatttagtgaatactgtcaacctcaaaggaacatttttattggttcaggctgcattgaatgttatggagaagcaacattatggccgggtcgtgcttacatcatcggtgacaggggagatgacaggtattccgggttacagccattatggtgccagtaaggcgggtcagttgggatttatgcgcagtgcggcgctggaatatgcaggtcagggtatcaccattaatgccattatgccgggtatgattatgacagaaggcttaaaggcatttggtgaagattatctacagcatgttcaatctacaacgccgatgcgcgttttagggttgccggaagatatcggctatacggcctgttttcttgcctccgacgaagcaaaatatattaccggacaggcgattgtggttgatggcgggcagatactg

SEQ ID NO: 44802 - DNA, 1647 bp, Xenorhabdus nematophilus
atgaaattttcgttcaaaacatcagcatgtgcccttgtcgtttctttgtcattgttgccgataagtgcagctgcttgggaaaagaataaaacttacgatattacaattctgcatactaacgatcatcatggccacttttggcagaacgatcatggcgagtatggtctggcagctcagaaaacgatggtagattctatccgtcaggaagttgccaagaaaggaggcagtgtgttgctgttatccgggggggacatcaatactggtgttcccgaatcggatatgcaggatgctgagccagattttaagggaatgaatttggtgggttatgatgcaatggcgctggggaatcatgagtttgataaacctttaaacgtgttgcatcagcaggaaaaatgggccaatttcccatttctgtctgctaacatttatcaaaccagtactggcaagcgtttatttaagccgtatgtgatgtttgataatcaaggcgtgaaaattgcggttattggtttgacaaccgatgatacggcaaaggtaggaaacccagccaacttccctgatgttgaattccgagtaccggcggaagaagcgaaaaaagttattgatgagctgaaaaagaatgaaaaaccggatgtgatcattgccgcaacccatatggggcactataacgatgggcatcatggcagcaatgctgcgggggatgttgaaatggcgcgcagtttgcctgcgggttatttaaatatgattgtgggggggcattcacaagatccggtctgtatgtcagcagagaataaaaactacaaacaaatggattatgtaccgggaacaccttgctcaccagatcgccagaatggaacatggattgtgcaggcacatgaatggggcaaatatgtcggccgtgctgatttccaatttcgtaacggtgaattcaaattggttcattatcaattgatccccatcaacttacagaaaaaagtaaaaaacgaagacggcagcacagggagagcttattacactcatcaaattactgagaatcctgcaatgctgaagctgttgacaccatatcaggataaaggcagccggaaattaaatgttcaggtgggcgtggtagatggaaaattagaaggtgatcgcagtaaagtgcgtttcatccagaccaatatggcgcatcttgtactggcagctcagatggaacggacaaatgctgattttgccgtgatgagtgggggagggattcgtgattctatcgaagcaggggatattacttacaaagatgtcctgaaagttcatccatttgccaaccaactggtttatgtggatttcaaaggtcgcgaagtcttgccatatttgacggctgcggcaaatatggagacggattcaggtgcttacgggcagttttataatgtcagttttgtggttgatggcaaaaagatccgtgatgtgaaaattggtggcaagccgttggatcttaataaaacttatcgtatggctacactgaactttaacgctatcggaggtgatggttatccacgtgtcgataacttacctgggtacgtggataccggtttcgttgatgctgaagtgttgaaaggctatatcgagaagcactctccgttgaaagctactgattatgagccgaaaggtgaaatt

SEQ ID NO: 44803 - DNA, 2526 bp, Xenorhabdus nematophilus
attgagttacaactttcaggcttaagttgtatgaaatgtgccggcaaaacccaaaaagcgctggagtcggtagaaggggttattgcggccaaagtcgatactcagactgcgaaaatttacggcaaagtagagagcaacgctttaattaaggccgtcgaacaagccggatatcacgccgagttggcggcaggtacacgcttcccaaaaactgagccgctgacaatatctgccccacaaacaccggagtttttggcagcggcagaaaacgcaactccggtcagaaatcccgaaaatacagtgagtcatgatactcccgataacgacaatgacagtattcagcttctgctggatggcatgacctgtgcaagttgtgtcagtaaggtacagaaagcgctgcaatccgtcgatggggtggaaaatgccagagtgaaccttgcagaaagaagtgcattagtcactggtgcggtatcccctaatgcgttagttgacgcagtcatcaaggcaggttacggcgcggaagtgattcaggatgaaaccgaacgtcgcgagcgtcagcagcaagttgcacaggccaatatgcgccgtttccgctggcaatcagcttttgccttggccgtcggggttccggtcatggtttggggtatgttgggtgacaatatggtgctcactccctcaaatcacgctatttggctgacgattggtttggtcacactggctgtcatggtgtttgcaggcggccatttttatcgcaatgcgtggcaaagtctgaaaaatggcagtgcaaccatggatacgctggtcgctctgggtacaggcgtcgcctggctctattctatcagcgtcaatttatggccggagatttttccatctcaagcccgtcacctttattatgaagccagcgcgatgattatcggtttaatcaacctcggccatgctctggaacaacgcgcccgtcaacgctcttccaaggcacttgaacgattgctggatttaacccctccgactgcacgggtgatcaccgaaaaaggtgaaaaaacgctgccattggcggatgtgaaacccaacatgatactgcgtctgaccaccggtgatcgcgtacctgtcgatggtgaaattattcagggcaccgtctggctggatgaagctatgctgacaggcgaaccgatcccccaacagaaatcaaccggcgatggcattcatgcaggcacagtcgttcaggatgggacggtgttgttcagagctgctgcggttggcagccagacgacactagcccggatcatcaaactagtgcgccaggcacagagcagtaaaccggaaatcggccaattagcagataaaatatcatcaatatttgttcccgtcgtcattgccatcgcactggtcgctggcgctatctggtatttcatcggccctgctccacaactcatgtactcgctggtcatcatcactaccgtcctgattatcgcctgtccctgcgcccttggattggcgacaccaatgtccattatttctggtgtgggacgagcggcagagttaggagtgctggtgcgtgatgccgatgccctgcaacaagccagtcaactggacacccttgttttcgacaaaacgggtactttgacagaaggcatgccacaagttactgaaataagtacttttaacggattcaccgaagaacaggtattgttatgggctggcgcgttggagagtggctcaaatcatcctctggcaaaggctattgcgctgaaagtggcagggcagaaattgccagaagtacagcaattccgcacattagccggattgggaatacgtggggtggttggagacacaacactgctactggggaatcagagtttgcttgagcaaaatcagattgaaactgcggaattaaaaaccttgatggcgacacaggcagaaaaaggcataactcccgtcatcttggcggctgatggcaaaatcgctgccctgttttccattcgtgatcctctgcgtcaagataccctttctgccctacaacgcttgcatcatcaaggttatcgtttagtcatgctgacgggagataatccggtaacagccaatgctatcgctaaagaagcagggattgatcaggtgattgccggtgtgttacctgatggtaaagcggcagccattcaaacactacaatctgaaggccggaaagtcgccatgatcggtgatggtatcaatgacgcacctgcgctggcacaggcagatgtaagcatcgcaatgggaggtggcagtgatatcgccattgaaacggcggcaattaccctgatgcgccatagcctcaacggtgttgctgatgctgttgcgctttccagaggaacattgcgcaatatgaagcagaacctgtttggcgcatttgtctacaatacattaggcatcccaattgcggcaggtgtcctgtatcccttcacaggaaccttgctaaatcctgtagttgcaggggcagcaatggcgttgtcttcaattacagtcgtcagtaacgctaatcggttattgcgctttaaa

SEQ ID NO: 44804 - DNA, 774 bp, Xenorhabdus nematophilus
ggtaaagttatgcaaaaagcggttcttattaccggatgctccagcggaatcgggctggtcgccgccaaaatccttcatcaacgtggctaccgagtatttgccgcttgtcgcaaatccgctgatttagcacatatgcgcgaattgggattggaacccatagaattggatttggatgataaagaaagcgtcgaacgtgccgccgagcaagtcattcaattaacccatggacgtttgttcgggttgtttaataatggaggatttggcgtttatggcccactagaaagcgtttcccgcgaactaatggaaaaacagttttcaactaatgtatttggtactcatcaattgacctccctattattgcccgccatacgcgcttatggtaaagggaggattgttcagaccagctccgtattgggattaatctctacaccaggccgtggggcatacgcagccagtaaattcgcccttgaagcatggtcagatgcgttgagaatagaactggcagacacgggaattaaagtcagtctgatagaacccggcccaatcacgacgcgttttacagaaaatgtgaatcaaacacagcgcgatcaccctgtcgaaaatccaggtcttgcagaccgtttcagactcacccccgaggatgtggtcacgaaattgattcacgctctggaagctcctaaccctaaaatacgttatccggtaacattattgtcccatgccatgacaattctccggcgtatattacccacgagattaattgataaaatcgtgaag

SEQ ID NO: 44805 - DNA, 678 bp, Xenorhabdus nematophilus
gtagaaagtattcttgaagttcatcatctcactaaacatgttggtcagggggaacaggtaattaatatattgcaaggtgttgagctggttgtcgagcctgcgcagacaattgccttgattggagaatcgggatcagggaaatcaacccttctgggtattattgcggggctggatgatggcagcggcggcgaagtccacttattggggcaaaacatcagtcgtatgaacgaagaacaaagggcgcagctacgggcaaaaaatgtaggttttgttttccagtcgtttatgttgatcccaactttaaacgcgctggaaaacgtccaattacccgcgctgcttcgcggtgaatcggaaaatcaaagtcgtcagaatgccattgaattacttaaacagttaggattagggcaacgcctgaaacacatgccagcccaactttcggggggagagcagcagcgggttgctctggcacgggcattcagtacccgccccaaaatcctgtttgccgatgagccgaccggtaatcttgatcgtcaaacgggtgatcgcatcgcggatctcttattttcccttaatcacgattacgccaccacgttgattttggtaacccatgacagccggcttgcagcccgttgccagcgtcgtttacgtctggtggatggaacattgcaggaggaagta

SEQ ID NO: 44806 - DNA, 1008 bp, Xenorhabdus nematophilus
atgtattattcgctactacggaaggcattgttccagcttgatcccgaacaggcacacgagcttacttttcgccagctcaaacttgttaccggtactcctttcgaatttcttatccgccagtcagttgccactaaacccgtcacttgtatgggcttatctttcaaaaatcctcttggtttggccgcaggccttgataaaaacggtgattgcattgacgcatttggtgcaatgggttttggttttgtggaaatcggaacggtaacaccgcgtccacaggttggaaatgacaaaccaagattgttccgcgttattgaagcggaaggcatcatcaatcgaatgggttttaataaccttggtgttgataatttagttgagaatgtcaaacgggcaaaatacgatgggattattgggatcaatattggcaaaaataaagataccccagtagagaatggcaaagacgattatttaatttgtatggataaaatttatcctcacgcaggttatattacgattaacatttcgtcccccaatactccaggtttgcgaacgttacagtatggtgaagcgttggatgatcttttatctgcgattaaaaataagcagagtgaacttcaacagaaattccaaaaatatgttccgattgctgtgaaaattgcaccagatctgacagaagaagaattaatacaagttgcagacagtttaatgcgccatcgcattgatggcgttattgctactaataccacattggacagaaagctcattgaagggttgaatcattgccagcaggctggtggattaagtggtcgtcctgtgcaacttcgcagtacagaaataattcgatgcctttctcaagaattaaaaggtaaaatacctattattggtgttgggggaattgattccctgattgcggccagagaaaaaatggaagcagggtcttctttggttcagatattctctggttttatctataaagggccaaaattaatcaaagatattgttaatcatatc

SEQ ID NO: 44807 - DNA, 1062 bp, Xenorhabdus nematophilus
atgcaaaaaggtgcacttaataacattcatattcttggtgaacagatttttatcacacctgaggaactgaaacagaaatacccattgagtcgcaacgatctgcataccatcacaaatgcccgtaataccatcgctgatattattcagcaccgtgatcctcgtttgttagtggtgtgtggcccctgctcaattcatgatgtggacgctgccctcgattatgcccgtcgcctgaaagtactttctgctgaattaagtgattgcctgtatattgttatgcgtgtctattttgaaaaaccccgtacgacagttggttggaaaggcttaatcagtgatccccatatggatggttcgtttgatatagatgctgggctgcatattgcccgcagtttattaatgaatttagttaaaatgggattaccactggccaatgaagcactagatattaataatcctcaatacttgggagacctattcagttggtcagctatcggggcgagaacgacagaatcacaaactcaccgcgaaatggcatcgggattgtctgtctccgttggattcaaaaatgggactgatggtaatttgaatactgcaattaacgccatgaaagcggctgccatgccacattgcttcatgggaataagtcagtcagggcaagtctgtctgctacaaactcaaggtaacccaaatgggcatgttatcctgcgtggtggtgctgaaccgaattacagttctgagcatgttgctgactgcgaaaaccaaatgatcaaggcaggtttaacgccatcgttaatgattgattgcagccatggtaattccaataaagattttcgtcgtcagagcatcgtagtggattctgttgctgaacagattatgtctggaaatcgatctatcattggtattatgttggaaagcaacattcacgaaggaaatcagccttcagaacagcttcgttctgagatgaaatatggtgtttcagtgactgatgcctgtattaactggcaaaccacggagcaggtattaagaaaattacaccaacaaatagccccacgttttgcaaaacgt

SEQ ID NO: 44808 - DNA, 2183 bp, Xenorhabdus nematophilus
  unsure (1)..(2183): unsure at all n locations
atgcgtctggatcgtcttactaataaattccagcttgctctcgctgacgcgcaatctcttgcattagggcgtgataatcaattcatcgaaccgatccacttgatgagcgcattgcttcatcaagaggggggctctgttcgtcccttactaacattggcaggggttgatacgagtagcatcaacaatcaacttaaccaagccttaggtcgattaccgaaagtagagggtaatggtggtgatgtacaggtatccaatgagctggggcgttatttaaacttgtgtgacaaacttgcgcaaaaagcaggtgacaattttatttcttctgaactctttgttctggcggcaatagaagaacgtggaacattaagtgacatacttaaagctgtgggaacaaccaaagataaaatcgctaaggcaatagaacagatgcgtggtggtgagaaagtgagtgatcaaggtgctgaagatcagcgtcaggcactaaaaaaatacacaatcgatctaactgaacgtgccgaacagggcaaattagatcccgtgattgggcgcgatgaagaaattcgccggacaattcaggtattacagcgtagaactaaaaataaccctgttcttattggtgaaccgggtgttgggaaaaccgccatagttgaaggtctggcgcagcgtattattaatgctgaagttccagaggggctgaaaaacaaacgcgttctgtcccttgatatgggagcgctagtggcgggtgcgaaataccgtggtgaatttgaagaacgtttgaaaggtgttttgaacgatctcgccaaacaggaaggctcagtcattctgttcattgatgaattgcatacggtggtaggagcaggtaaggctgatggcgcaatggatgccggtaacatgcttaaacccgccttggctcggggtgaactacactgtgttggtgcgacgacactggatgaatatcgtcagtacattgaaaaagatgctgctttggaacgtcgtttccagaaagtgtatgtggcggagccaactgttgaagataccattgctatcctgcgtgggcttaaagaacgctatgaattgcatcaccatgtacaaattactgatccagcaattgttgctgctgcgactttgtctcatcgctatatttcagatcgtatgttgccagacaaagccatcgatctaattgatgaagcaggagcaagtttgcgtatgcaaatggattctaaaccagaagcactggatcgtttggagcgtcgggttattcagttaaagcttgaacagcaggcactgaaaaaagaatcggacgatggcagtaaaaaacgactcgaaatgttgaatatggagctggtggagaaagaacgcgaatattctgagctggaagaagagtggaaagccgaaaaagcagagctgactggcactcagaacattaaagcagaattagagaatacgcgccttgaattagaaaaagcccgtcgtagtggtgatctagcgaagatgtctgaaatccagtacggaaaaattccagaattggaaaaacgtttggcaacggcagcaacggcagcaacggcagaaagccatcatatgaaactgctgcgtaacaaagtaactgatgccgaaattgccgaaattcttgctcgctggacggggattcctgtatccagaatgttggagagtgaaaaagataaacttctgagcatggagcatgaattacataaacgtgtcatcgggcaaaatgaggctgttgaggctgtatctaatgcaattcgtcgtagccgtgcgggattatccgatccaaatcgtccgattggttcttttatgtttttggggccgacgggggtaggtaaaaccgaattgtgcaaagcgttggccaatttcctattcgacagtgatgatgcgatggtgcgcctagacatgtcggaatttatggaaaaacatactgtttcaagactggtgggggctcctcctggatatgttggatatgaagagggggggtatctgacagaagcggtgcgtcgtcgcccttattcagtgattttactggatgagatagaaaaagctcatcctgatgtcttcaacattctgttacaggtattggatgatggtcgtctgacggatggacagggaagaacggttnttttcgcaatactgttataattatgactnctaanntaggtgcagatatgggt

SEQ ID NO: 44809 - DNA, 2271 bp, Xenorhabdus nematophilus
gtcatgaaagtattgatagcaaagaacgaagtaggtacacgatatcacagtcattatattgagaatgccgtacacaggttggcggataaattaaccgatcgaaatgttgaggtggttattgccgattcatttgatgatagttacacgataattgcatccaatgagtcgttcgattgcttaatggtcagttgcgcattgatggatgatgaattatatcgggaaatacagcaattattaaataaattgtttgaacgccaggaaaatgtaccagtatttttattaagtgatcgggaaaaaactgtatttctgctaaatcatgaattgctggaacagttgaccgaatttgcatggatacttgaagactctgccgatttcattgcaggcagagcaattgcggcaatgcggcgttaccgtcaacagttattaccgcctttaatggccgcactcatgaaatatagccaaacctatgaatattcttgggcagcgccagggcatcagggcggagtcgggtttaataaaacccctgtcggtcgcctttatcatgattattatggtgaaaatctctttcgtaccgatatgggaattgagcgcgcttcgttgggatcgctgttagatcactccggcgcatttggtgaaagtgaaaaaaatgcggccagagtctttggcgcggatcactcttattctgttgtggtaggaacatcaggctctaaccgcacgattatgcaagcctgtatgaccgaagacgatgtcgtcatcattgaccgtaactgccataaatccatcgagcaagggcttatcctgacaggcgcaaagcctgtctatctgctaccgagccgtaatcgttatggcatcattggtcccatttatccgcaggaaatgcagacagaaacactacagaaaaaactgaaacagaacccattgactcaaggtatggccagccgtaaacccgcctatagtgttgtgacaaactgcacttatgatggggtctgttataacgccaggcatgtgcaggaattgctggataaaagtgtcgataggatacattttgatgaagcatggtacggctacgcgcgctttaaccccatttaccatgatcattacgcgatgcgcggtaatccgaaggatcatgcggggccgactgtttttgccacccactcatcccataagttgctgaatgccctatcacaagcctctttcattcatgtgcgcgatggtcgaaattccgttgatttctcaagatttaaccaagcttatatgatgcatgcgacgacttcaccgctctatgcgatttgcgcctcaaacgatatcgcggtttccatgatggatggcaatagcggttattctttgacgcaagaagtgattgaggaagcagtggactttcgtcaggcattggcgcgcttgcatcgcgatttcaacgaaaagggcgattggttttttaaaccgtggaatcaggaaaaagtcctcgatcccgcgacaggcaaaaaaattgcgtttgaagatgcaccaagagatttactgaccaaagaacaaagttgctggactatgcgtccgggagacagttggcacggttttgaagacttgcccgatgactggagtatgcttgatccaatcaaagtcagtatcttggcgcccggcatgggagataatggtcaattgctgaagcagggcgtgccagcggcgctggtgacagcgtggttaagtcagcatggtatcgtacccacccgaactaccgattttcaaattatgttcttgttttcaatggggattaccaaaggaaaatggggaacactgctcaataccttactttctttcaaacatcattacgacgctaatacgccgctcaacaaagttttgcctgatctggtgaatcaatatcaggaagtatatggcaacttaggtttgcaagagttgggcgataaaatgttcgcttatttgcgtcagaataatccgggcgataagttaaatcacgcttattctggtctgccggaaatggcgatgatcccaagggcagcttatcaggccattgtgaccaacaacgtcgaaatggtagcgatcgacgatcttcctcaccgtatcgccgccaactccatcattccatatcctcccggcattccgatgctactttcaggggaaaacttcggagataaaaccagcccgcaaatgagttacttacatgccctgcaaaaatgggatcacgaatttcccggatttgagcatgaaacggaaggaacagagattatcaacggtgtttatcacgttatgtgcataaaa

SEQ ID NO: 44810 - DNA, 1662 bp, Xenorhabdus nematophilus
  unsure (1)..(1662): unsure at all n locations
ttggaaaaagtttggttaaaacattatccggcagatgttccggcagaaatcgatcccgaccgttatttgtcgttgattgaaatgtttgaaaatgctgtggcacgctatgccgatcaagtcgcattcatcaacatgggtgaggtgataactttccgtaaattggaagagcgtagccgcgcctttgccgcttatttacagaatggactggggctgaaaaaaggggatcgcgtggcattaatgatgccaaacttattacaatatcccgttgctctctttggcgtcctgcgtgcagggatggtggttgtcaatgtcaaccctttatataccccgcgcgagctggagcaccagcttactgatagcggaacatcagccatagttattgtttctaactttgcgcataccttagaaaagattgttttcaacactcaggttaagcacgttattctgacgcgcatgggggatcaattgtcccgtccgaaagggactcttgtagatttcgtcgtaaaatacgttaaacggcttgtaccgaaatatcacttaccggatgccatttcgtttcgcaacgtgatccacaagggttaccgtatgcagtatgttaaaccggatgtggacggtgatgctctggcatttttgcaatataccggcggaacaacgggggtggcgaaaggagcgatgctgacccaccggaatatgttggcgaaccttgagcagggaaaagctaattacgctccgctgatggctcctggacaagaattagtcgtcactgcgttgccgctttaccatatttttgctttgacggtcaattgcctattgttcattgaacttggtgggcaaaatctgttgattactaatcctcgggatatcaatggaacggtcaaagaattgtcgcgttacccattcactgccttgtcgggagtgaatacgttatttaatgcatggttgaataaccctgaatttcagaaactggacttctcctcattacgtttgtcggttggcggtggcatggccgtccaaagaatagtggccgaaaaatggcaaaatttaacggggtgtcatttacttgaaggttatgggttgacagagtgtgcacctctggtttcgggtaatccttataacctgactcattatagtggcagcattggtttcccggtaccttcgacagaaattaagctggttagcgatgatggtaatgaagttcctttggagcaagcaggggaaatgtgggttcgtggcccgcaggtgatgaaaggctattggaatcgccctgaagcaacggcggaagtattgaaagatggctggctggcgacaggggatattgccaatgtagatgaaaacgggtttttacatattgttgatcggaaaaaagacatgattttggtttccggtttcaacgtttatcccaatgaagtagaagatgttgtttcttcccatcctaaagtgttagagtcggcagcaataggtgttccaaacgataactcaggtgaaaccgtcaaaatatttgtggttcgtaaggatcagagcttaactgagaacgagcttaagacacattgccgtcgttatctgaccggatataaagtaccgaaactcattgagttccgagatgaattaccgaaatcaaatgtaggtanaattcttcgcaaggaactgcgtaacgaagaatta

SEQ ID NO: 44811 - DNA, 1473 bp, Xenorhabdus nematophilus
atggcggtgacatccgtagctcaggcttgtgatttggtgatttttggggcgaaaggagacttagcacgccggaaattaatgccttccctttaccagttggaaaaagcgggttatatccatccagacacccgaattatcggagttggtcgtgctgactgggataaaaaagcctacacaaaggtggttgaggaagcgttggcaacgtttatgtctgaaaaacttgatccagaattgtggaaaaaattcagttcacgtctggagttttgtaatttagatgtcaatgaaacggaacatttcacccgactggcgaaaatactcaagcaggacagcctgccagctattcattatttcgccatgccgccaaatacctttggctccgtgtgtcatgggttaggggctgcgggattgaataaagagcctaatcgcgtagtgatggaaaaaccactggggacagatcttgcatcttccagagcgattaatgatgaagtggcaaaatatttcaatgaaagccaaatctaccgcattgaccattatttaggtaaagaaaccgtactgaacctattagcgctgcgttttgccaattcactgtttgccaataattgggatcatcgtacgattgatcatgtgcaaattactgttgctgaagaagtgggtatcgaagggcgctgggggtattttgaccaggccggacagatgcgcgacatgatccagaaccatctgctgcaaatcctgaccatgattgccatgtctccaccatctgatttaaccgcagaccgcatccgtgacgagaaagttaaaatactgcgttcattgcgtcgcattgatcagaccaatgtgcgggaaaaaaccgttcgtgggcaatataccgcaggcttcgtgcatgggaagaaagtaccgggttatctggaagaagagggtgcgaataaaatcagtaaaactgaaacctttgtatcgattcgcgttgatattgatgattggcgttggtcaggtgttcctttctacctaagaacaggtaagcgcttaccggctaaatgctctgaagttgtcgtctattttaaagagccttcattgaatttatttgccaattcttatcagcaattgccacagaacaaactgacgatccgtttgcaacctgatgaaggtattgatattgaagtcctgaataaagcaccagggctggagcataagcatcgtttgcagactacaaaacttgacctgagtttctctcaaacattcaatcagacacatcttgcagatgcttatgagagattactgctggaagccatgcgtggtattcaggcgttgtttgtccgccgtgatgaagtagaagaagcatggaaatgggttgattccatcatggacgcttgggaagcagataacgaaccaccgaagccttatcaagcaggaacttgggggccagtggcttccattgctatgattacccgggatgggcgctcgtggaatgagtttgag

SEQ ID NO: 44812 - DNA, 1188 bp, Xenorhabdus nematophilus
atgtttgaaaaaattacagcagcacctgccgaccctattcttggtttagcggatagctttaaagctgatcctcgtgaaaataaaatcaatctgggtatcggtgtttacaaagacgaaactggtaaaacccctgtcctgaccaccgttaaaaaagcagaaaaattcctgctggaaaacgaaaccaccaaaaattatctggcaattagtgggttacctgaatttggccgcgtcactcaggaactactcttcggcaataccagcactatcattactgacaaacgcgcccgtactgtacaaagcccaggcggaaccggtgcactgcgcactgccgcagattttattgctaaacagaccaatgcaaaacgtgtctggatcagtaacccaacatggccaaaccataaaggcgttttctctagcgctgggttagaaatccgcgagtaccaatattacaatgcagaaaagcatgctctggattttgatggcatgttggctagcctgtctgaagctcaagcaggtgatgttgttctgcttcacggttgctgccataacccaaccggtatcgatccaacggctgaacagtggcagaaactggcagatttatctgcggcaaatggctggctgcctgtgtttgatttcgcttatcagggttttgccagaagtttagatgaagatgcagaaggcctgcgtatttttactaaaaaccataatgaactgatcgttgccagctcttactccaaaaattttggcctgtacaatgagcgtgtaggtgcctgcaccatcgttgcaactgacagcgataccgcagaaaaagcattcagtcaggcgaaatctattgttcgtactaactactctaacccaccggcacacggcgcttctgttgttactacaattctgtccaatgacgaatttaaagcagaatggattcaagaactggcgactatgcgtgaacgcattcgtcgtatgcgtcagctgtttgtgaacaccttgcaagaaaaaggtgcaaaacaagactttagctttattattagccaaaatggtatgttttcattcagtggtctgactaaagaacaagttgatcgtctgcgtgaagaattcggtatttatgcggtcagctctgggcgcattaacgtagcgggcttaacactggagaacatggttcctctgtgtgaagcgattgttgcagtactc

SEQ ID NO: 44813 - DNA, 1059 bp, Xenorhabdus nematophilus
agtgaacacggcggcaatatcatcgaagttgcccaacagttcggcattccggccaacgaactcatcgatttaagcgccaatatcaacccgctgggtgccccggaacgggtgaagacgctgattaaagataaccttgcctgcatcgaaaaatatcccgacgtagaatatcgccatttgcatcaggtactggctgacgcccatcagtgcgataccgcttcggtaatagcaggcaatggtgcaacagaactgatctacgccgttgtccgttacctcaacccgaaacgcgccctgctcctcacccccggatttgccgaataccgccgagctttgcagcacgttggggctgagatcatcgcgtatccattaacagaagacgcaggatttcaacccgatctacgcctgctggatacactgacaattcttcaacccgattgtgtctttatagctacgcccaataacccaaccggtttaatgccagacagccggtttctgcaatcgctggggcaacattgtgaagagcaccgcatagcgctgattgttgatgaagcctttattgattttctgcccgataaccgaggcctgatcccgcacattgccgccacccgccacctttatgtgctgcgttcactgacaaaattcttcgccattccggggttgcggctaggctatctggtcagcggggattgcgcaggggtggcgtggatgaaaaaccggcgtgaaccgtggtctattaatgcccttgcggcgcaggtgggtgaagtcttgttggatgatcaggcttatattaccgccacccatcaatggctaaaatcacaacaacattatctatggacgtacctttcctcctgccctgaactcaccgtctggccgccttccgcgaatttcctgttctttcgctgccatcagcccaatcttgatctatggcacactctgcttgagcaccgactgctgatccgccattgcaaaaactatgttggcttggacgagagttactatcgaatcgccgtacgcagcgaatgggaaaaccgacgcctgaccgccgccatacagcacgttttc

SEQ ID NO: 44814 - DNA, 753 bp, Xenorhabdus nematophilus
atggagcttatcaggatccctgccctttcagacaactacatttggttactttgtgatgaagacaaacattgtgtcattgtcgatccatctgagtcacagcccgtcattgatatcttagcggccaaccaactcattcctgcggctatcctgttgactcaccatcaccacgaccatgttggcggcgtggctggcctacttaaacaatatgccgacttacccgtatatggtccggaagagacccggagcaaaggcaccactcatattgtccatgaacatgacaccattgagacaggtcattattgtttccacattatggagttacccggccataccctgggtcacattgcattctatcaggctccctatttgttttgtggcgacactctgttttctggtggctgtggtcgattatttgaaggtacagcggaacaaatgttttcttctcttgagaaaatcatgtcattgccggatgagactttaatctgctgtgctcacgaatatactgccgccaatatgaaatttgcacgggcagttttgcctgagaatgaaactattcatgattattataataaaataataagtattcgcgaaaataataaaccaacagtaccaacaactttacaaatagagaaaaaagttaacgttttcctgaattgtcacaacattgatttacaaaaaaatatcggcattaaacctaattcaaaaccactttcttctgtttttcagcaattaagaatttataaagatcgattt

SEQ ID NO: 44815 - DNA, 897 bp, Xenorhabdus nematophilus
cctaacatatcccaagttaagaattttttcctctcattacaggatgaaatctgcaaacaacttgagcgacttgatggtcactccaattttatggaagagtgctggcagcgggaagaaggcggtggtggtcgcagtcgcgtattaaaggcaggcaacgtttttgaacaggctggcgtgaatttctcccatatcactggggcttcacttcctccatcagcaagcgcccaccgtcctgaattagcaggtcgtagctatcaagcactgggcgtttcccttgttatccacccactcaatccctatattccgactagtcatgccaatgttcgcttttttattgcggaaaaagaaggggaagcaccagtatggtggtttggtggtggttttgatctcactccttattacggcttcaaagaagatgccattcattggcataccgtcgccaaaacattatgccaaccttttggcaacaatgtttatcctgaatataaaaaatggtgtgatgattatttctttataaaacaccgtaatgaaccacgcggaattggtggattattttatgacgacttaaatacccctgattttgaaacttgttttaactttacgcaagctgtcggtaatggttttttggccgcgtatttgcctattgtagaaagaaggaaaaatataaactggggagaacgcgaaagagaattccaattatatcgacgtggccgttacgttgaatttaatttagtttgggacagaggaacattatttggcctgcaaagcggtggacgcactgaatcaatattaatgtccatgccgccattagtacgttgggaatataatcattctcctgagccaaactctccagaagctgaattttacacctcctttctaataaaaaaagattggata

SEQ ID NO: 44816 - DNA, 423 bp, Xenorhabdus nematophilus
atgacgattgaacgtactttttccattattaagcctaatgctgtgaagaaagatgctatcggttctatttatgcccgttttgaaagtgcagggtttaaaatcatcgcagccaaaatgctgtatttaacacgtgagcaggctgaaggtttttacgctgagcacaaaggccgtcctttctttgatggtctggtagaatttatgacttctggcccaattgtggtacaggttctggaaggtgaaaatgcggttcagcgccatcgtgatctgatgggtgctaccaacccggacaatgcactggccggtactctgcgtgcggactatgcagatagctttactgaaaatgcggttcacggttcagactccattgaatctgcaaaccgtgagattgcttattttttcagtgatgatgaaatcttcccccgc

SEQ ID NO: 44817 - DNA, 1845 bp, Xenorhabdus nematophilus
taccaatggtcactacaagatcctgaagcgttctggagtgagaaaggtaagatagtggattggattaaaccttatactcaggttaaaaacacctctttcgacccagggcatgtcagtatccgctggtttgaagatggcacactgaatttaagtgccaactgccttgaccgccatttgcaggaacgtggtgagcaaaccgctatcatctgggaaggagacaatcccgcagaatccaagcatgttacgtatcgcgagctatatcatgatgtctgccaattcgccaatgtattgaaaaaacttgatgtcaaaaaaggtgatgtcgttgcgatttatatgccaatggtacccgaagccgccgttgccatgctggcctgtacccgagttggtgcaatccattccgtgatttttggtggtttttctcctgatgccattgctggcagggttatcgattccaatgccaagctgattattaccgcagatgaagggatacgtgcaggccgcgttattccattgaaaaagaatgtcgatgaagcactgagtaatccagccgtaaccgacgttgttaatgtggtagtcttcaagcgtactggtaacaccaaaagctggcaggaaggtcgtgatttgtggtggcatgagttgatcgaaaatgtcagcacagattgccctgccgaagaaatgaatgccgaagatccacttttcatactttatacctctggctcaaccggcaaacctaaaggggttctacataccactggcggttatctggtctatgcttctttgactttcaaatacacgtttgattaccgccctggggagatctactggtgtacagccgatattggctgggtaaccggccacagctaccttctgtatgggcctctctcctgcggtgcaacatcattgatgtttgaaggtgtaccaaactaccccgatgtcaatcgcctctgtcagatcgttgataaacatcaggttaatattatctatactgcaccaaccgccattcgtgcattaatggctgaaggcgataaggcgattgaaggaaccaaacgtacgtcactacgtatcatgggctcggtaggtgagccaattaatcctgaagcatgggaatggtactaccggaagataggtaacagtaaatgtcctattgtcgatacttggtggcaaaccgaaacaggcgggttcatgatcacgcctttgcccggagcagtcgacctcaaaccaggttcggctactttgccattcttcggtatcagtccggcattggtgggcaactcaggtgagccattaactggcgaatgtgagggtaatcttgtcatcacggattcctggccgggacaagcgcgaactttatttggtgatcatgagcgttttgaacaaacctatttttccactttcaaaggtatgtatttcagcggagatggcgctcgacgtgatgaagacggctattactggatcactggccgtgtcgatgatgtcctgaatatttcaggtcatcggttgggaaccgcagaaattgagtctgcgctggtttcacatccaaaaattgccgaagctgctgttgttggcattccacaccatatcaaagggcaggcgatttatgcctatgtcacactgaatcatggtgaagaaccttccccggatctttataccgaagtcagaaattgggttcgcaaagaaatcggcccgattgcaacacccgatattcttcactggacggattctttgcccaaaacgcgttcagggaagatcatgcgccgtatcttgcgcaaaattgcttccggcgataccagtaacttaggtgatacctccacactagcagatccgggtgtcgttgaaaaactgctg

SEQ ID NO: 44818 - DNA, 798 bp, Xenorhabdus nematophilus
cgtgacacaacgcttatcgctctcggtggtggtgtaatcggtgatatgacagggtttgccgccgcttgctatcaacgcggcattcgcttcatccaaatacccaccacattactttctcaggttgactcttccgtcggtggaaaaaccggcgtcaaccatcccctcggcaaaaacatgataggggccttttatcagccagcatccgttattattgatatcaattgcctgaaaacattacctgctcaagaactgcatgcaggactggctgaagttatcaaatacggcatcattctggatggtgaattttttaactggctcgaaagcaatatcgaacaattactggctctcgataatcaggtaatagcttattgcattcgtcgctgctgtgaactcaaggcatgggttgtcgctgctgatgaacaagaacgcaatgggatgcgggcactattaaatctcggccatacctttgggcatgctattgaagctgaaatgggttatggtgtctggctgcatggtcaggcggttgctgcgggtatggtgatggcagcacggacatctgaacttatgggcacgttctcaaaacaggatactcagcgcattatcagtttgctggaacgggcaaaacttccagtcaacggcccagtggaaatgtctccagaaatctatttgccacatatgatgcgcgataaaaaagtctctgcgggaaaattgcatctggtactgcctacagcgattgggaaagcagagcttcgttctgatatcgggtctgatgttatattggacgccatccacctatgc

SEQ ID NO: 44819 - DNA, 1251 bp, Xenorhabdus nematophilus
atggaaagcaaagtagttgttccggcggaaggtaaaaaaattactattgatgccaaaggtaaattaaatgttccgaataacccgataatcccttatatcgaaggggatggcattggtattgatgtaacgccggtcatgctgaaagttgttgatgctgcagttcagaaagcttacagcggtgagcgcaaaatttcttggatggaaatctacaccggagagaaatctacgcaggtttatggcaaagatgtctggttaccagaggaaactctggatctgatccgtgactaccgtgttgctatcaaaggccctctgacgacacctgttggtggcggtatccgttctctgaacgtggctctgcgtcagcaattagatttatacgtctgtttacgtccggttcgttactatcaaggtactccaagcccggttaaacaacctgaattaactgatatggtcatcttccgagaaaatgctgaagacatttatgcgggtattgaatggaaagcaggttcagcggaagcggataaagtgatcaaattcttgcaggatgaaatgggtgtcactaagatccgtttccctcaggagtgtggtattggtgtgaaaccatgttcggaagaagggactaagcgtctggtacgtgctgcgattgaatatgccatcgataacgaccgtgaatcagtgactttggttcacaaaggcaacatcatgaaattcacggaaggcgctttcaaagactggggttatgaactagctcttacggaatttggtggtgaactactggatggtggtccatggatgaagatcaagaatcctaagagtgataaagacatcatcattaaagatgtgatcgcggatgctttcctgcaacaaatcctgctgcgtccggctgagtacgatgttatcgcttgtatgaacctgaacggtgactacatttctgatgcattggcggcacaggtaggcggtattggtattgcaccaggggcaaatatcggtgatgaatgcgcattgtttgaagcgacacacggtactgcacctaaatatgccggtcaggacaaagtgaacccaggctctgtaattctctctgctgagatgatgctgcgccacatgggatggtttgaagctgctgatcttattgttaagggaacggaaggggcgattgctgccaagaccgtaacttatgactttgaacgcctgatggaaggcgctaagctgctgaaatgtagtgagttcggtgatgcacttatctctcatatg

SEQ ID NO: 44820 - DNA, 711 bp, Xenorhabdus nematophilus
agtcgaggtattggagcggctaccgctatactggcagcaaataaaggatattctatatgtttaaattatttaaacgatgaaaagtctgcgtttaaagtccgtgatgagattctaaatctgggtgccaaatgtatcactgtacgtgctgacgtttccaatgagcatcaagtaaaaaaaatgttcgacgacattgatactcagttaggaagtattactcaccttgtcaataatgttgggatcttaaaacaaaaaatgcccttaattgatatggatggggaacgatttcaacaagtactattgaccaatgtaatgagtcatttttattgctcttctgaggcgattaagcgtatgtcgatttctagaggaggctctggaggttcaattgttaacgtttcatcaggtgcatcgaaaagtggctcacctttcgaatacattgattatgctgcgtcgaaaggtgcagttgatacctttactacaggattatctaaagaagtcgccgctgacggcatacgagtcaactgcgttcgtccgggaggcatttacaccgatatccatgctgatggaggcgaaccttctagagttgatcgtattgccaagaatttcccgatgcaaagaggtggaacgcctgaagaggttgcaaatgcgattctttggctacttagtgacgaagcttcattcgtgactggaagctttacagacttatgcggtggt

SEQ ID NO: 44821 - DNA, 1050 bp, Xenorhabdus nematophilus
atgaattaccagaatgacgatataagaattaaaaaaataacagaattattgccaccagttgcattactcgaaaaatttcctgcaacaagaaataccgctactaccgttcgtgaagcccgtgaagctattcataacgttttaactggtgaagatgatcgtctattggtagtaattggcccgtgttcaattcatgacccaaaggcagcactggaatatgcagaacgcctgaataagttacgtggagaattgaaagcagatttggaaattgtgatgcgggtttattttgaaaaaccccgtaccacgataggttggaaagggttaattaatgacccgaatatggattgtagctttgatattaatgatggcttacgtactgcccgcaagcttctgatcgatattaacgacatggggctgcctgctgcgggtgagttccttgatatgataacgcctcagtatcttgctgatctcatgagctggggcgcgataggggcgcgtacgacggaatctcaggttcaccgtgaactggcttcagggctttcttgtccggttggctttaaaaatggaactgacggcacaataaaagttgccattgatgctatcaacgcggccagctcacctcactgttttctttctgtaactaaatggggacactcagcgattgtcagcacaacgggtaatcaggattgccatattattctgcgtggtggcaaagagccgaattacagtgcggagcatgtcagtgtcgttaaagaggaattaatgaaagctggtttagcacctcgtgtgatgattgatttcagccatgcaaacagttcgaagcagttcaaaagacaaatggacgttaatgatgatgtttgtgatcagatcgcaaggggagaacgcgcgattattggcgtcatggtcgaaagccatctcgttgaaggaagccaaaatctcgatagtgataagcctttggtttatggacaaagtgtgacagatgcctgcattggctgggatgacacagaaatgttactgcgtcagttatctcagtctgtcaaagcccgaagggga

SEQ ID NO: 44822 - DNA, 750 bp, Xenorhabdus nematophilus
atggctgtaactaaactggttcttgtaaggcacggagagagcgagtggaacaaagagaaccgttttactggctggactgatgttgagttgtctgacaaaggccgtactgaagcacaacaggcgggtcaattactgaaacaagaaggtttcgcttttgatttcgcttacacttctgttttaaaacgtgctattcacactttgtggaacattctggaccaagtcgatcaacaatggctaccggttgagaaaaactggaaactgaatgaacgccactatggcgcactgcaaggtctggataaagctgaaactgccgctaagtacggggatgatcaagttaaattgtggcgccgtggcttcgcgattactccaccagatttggctaaagatgatgaacgttatcctggccacgatcctcgttacgcgaacttaaaaccagaagaacttcctgccacagaaagccttgcagccacgattgagcgtgttgttccttattgggaagacgttatcaaacctcgtgttgcaaatggtgaaaaaattatcatcgctgctcacggcaactctctgcgtgctttagtgaaatatttggatggtatgagtgaggaagaaattcttgagctgaatatcccaactgctgtgccgctggtttatgagtttgatgaaaacatgcgacctatcaagcactattatctgggcaatgctgacgagatcgctgcaaaagcagccgctgtagcaaaccaaggtaaagcgaaa

SEQ ID NO: 44823 - DNA, 1251 bp, Xenorhabdus nematophilus
atgaatccttccgatcttgaatttgacctacgccatatctggcacccatatacatcaatgacccatccactccccacttatcctgtggtttcagccgccggagttgaactggagctgtcagatggccgcaggctgatcgatggcatgtcttcatggtgggcggcgatccacggttataatcatcctgtgctcaatgaagcagcaaagtcgcagattgacaggatgtctcatgtgatgtttggcggtatcatccatcctcccgccattgaattatgtcagcaattagtcgcaatgacgcctgccgcactggagtgtgtttttctggcggattcaggatctgtcgctgtagaggttgccttgaaaatggcgctgcaatactggcaagccaaaggagaaaaacgccacagattcctgaccctgcgtcatggctatcatggtgatactttcggtgccatgtctgtctgtgatcccgacaattcgatgcataacctgtataaaggttatctccctaatcatctgtttgctgatgcaccacaatctcggtttgagggtgagtggcaacctgaggatatcacttcgttccggcagttattgctccaacaccacaatgaaatcgcggctgtcgttctggaaccgattgtgcagggcgcaggtgggatgcgtatttatcatcctgaatatctgcgtcaggttcgtaaactgtgtgatgaataccagatcttgctgattgccgatgaaatcgccactggatttgggcgaacgggcaaactattcgcctgcgagcatgcacagatcgagccggatattttgtgtctgggcaaggccttgacgggcggttatatgacattatcggcaacattagccactcgccatgtagctgaaactatcagtcaaggcgaagccggctgttttatgcacggcccgacgtttatgggaaatcctctggcttgcgccgttgccagcgccaatctgaaattgctctctgatagtcagtggcaaccgcgcattcaatccattgaggctcagttaaaagtagaattgctccctttgaaatcacacactaccgtcaaagatgttcgggtattgggtgcgattggggtcgtagagatgaaacagcccgttgatatggcttcgctacagcgccgctttgtacagcatggtgtctggatcaggccatttggccggttaatttatttaatgccaccttacattattcggtctgagcaattatctaaactgacaaatgcaatt

SEQ ID NO: 44824 - DNA, 2775 bp, Xenorhabdus nematophilus
ctttttcgggtgcttggctttatgctgtgggtattaggcgccttattaaccagtttttatctggtaaatatttttaatgaagtcaaatcagacattcgtcaagaatataatactaactacgatacaatgttctcttatattcggcatactaccaacaccttgcgggatatccaatatatgacggagaaacatttatcacaaaagaatgaaaaagatctaactattactctgccgtataataaccctgctttctcatatactcctctgaatatgaattcagattgtgatctcttacgtaaaagcacacatagttatttggactcattaaataatctgattttattttggaaagataatattgccgctccgcgaggcctgaatcagatctttctggttggtacacaaagtatgtgtatggtgagcttttcagttcgcagtaccataacagaacctgaaacactgaagaaaatggtctacgaaaatttccgtaaactaatcattttgaaagaacaaggaaaagaacggaatgtcttttgggtcatgcctaacacaagagctgacagcggtactttttatatccttgcgccgatctataccaatgggcaaatgacagcagtgataggtattgaacaagctatcaggttagactcatttctaccaacaagaaatcgacctatttctattacaatgctaaaccactataatcagcctgaattatattacccagtaaaaaatgataataaatttcgttatgctgactataatatacagaccccttattttggttatgatgaaggtttttccaatttattattaaaacgacgcttagcaccatcttcattcaacgttgttttttcattaccattaaaatatatctatagtgaattaaaggtaacaatcattaacagtatcgtattgaatcttatctttacgatcctgattattttttttgtctggttatttgaacgtaaaatattttctcctgctgaagaaaatgctattcgtcttgaagagcatgagcaatttaaccataaaattgttgcctctgcaccagttggcatcagtattttacggattaatgatggtgccaatattctcagtaatgaactggcacataattacaccagaatgctaacgtatgaagatcaaaaacgtatcgtcgatattatctgtgataaaaccagcagctatattgatgttgtcaccagtaacaacaatcacctgcaaattagctttgtacattcacgttatcgaaatgaagaagtagcaatctgtgtactagtagatatcagtacacgggtaaaaatggaacaatcattacaggaaatggcgtcagcagcagaacaggctaatcaggcaaaatccatgtttctggcaacagtcagccatgaattgagaacaccactgtatggcattattggcaatctggaactgctgcaatctcatacattgccatcagaatctgcacggctactatcagcaatgaataacgcatcatcattgttactaaaaatcatcagcgatattctcgatttttccaaaatagaatctaagcagctcaaaattgattccaagaaattctcttgtaaagaaattgtattgcatgtgatctcaaattatcttcccctcattgtgaaaaaagagttgggattatactgctatattgaaccggacattcccgatattatcaataatgatcccgtaaggttgcagcaaattatctccaatctgctgaataatgcaattaaattcacagaaactggcagtgttgtcattaccatttctataaagcatagttacctgtatatcagtatcaaagataccggggttggaatcgaagataaattacaaactcagttgtttgaaccattttttcaaatcaacgccaataaacaaaccttctcgcaaggtactggattgggattagctatttgcgaaaaattgatcaatttgatggatggtgatattgaatttatttcacaacagtatattggtagtatcttttctatccgccttccattgtatggagcaaagtatcataccaaagcgtattccaaaaaccgcactcaacaaaaaattgtactggctgttcgcaatgattatctagagaaatatctacagaattttcttacgaagaactattttcagattgccttatatgacaaaagtaaaatagatggcacagaattggtgatccttgaccagcctgatgtactagacattgctgtacgttactacatagagatatcagaaaaacatattgggccgccaaaacaaattcgagaacattactggttgcataacacttatcaactcatcgagcttgacagtgtgatcgataaactgctatcaaaaaataatcatatctcccctgccactatatcaatgtcaacatcaattcgggcagatagccgcttgagtaccattaagatcttggttgttgatgatcatcctttaaaccgacacttattgatcgaacaattaaatacaataggattcagaacagcctcggcgaatgatggtattgatgccatcgagcacctgaaaaataattcaacggatattattctgacagacgtgaatatgccaaatatggacggatatgagctcacgaaatacctgagggataaaggatataccagccccatcattggcatcactgctaatgccctggcagaagaaaaacaacgttgtgcggatgcaggaatggattattgtctatcaaaacccgtctcattggcaacattaagagatacattaatagaatacagtgat

SEQ ID NO: 44825 - DNA, 2289 bp, Xenorhabdus nematophilus
atgaaccagagtctgctagtaaccaagcgtgatggacataaagaacaaattgatctggataagatccacagggtcgttgcctgggctgccgaaggtctgaaaaatgtctcagtgtcacaagtagaactgcgttctcaaattcaattttacgatggcatcaaaacagccgatattcatgaaaccatgatcaaggcagcggctgatttgatttctggcgatgcgcctgattatcagtatctggcggctcgtttggccatcttccatctgcgcaaaaaggcttacggtcagttcgaaccacctgctctgcatgatcatgttgtacggatggtgaatttaggcaaatacgacaagcatttgctggaagactattccaaagaagaattcgagcaaatggacagttttattaaccatttgcgtgatatggacttctcctatgcagcagttaagcagcttgaagggaaatatctggtacagaaccgtgttaccggtgaaatttatgaaagtgctcaatttctctacattctggttgcagcgtgcctattttcaacttatccaaaagaaacgcgcctgagctacatccgtcgtttttacgatgcagtttcgacgtttaaaatttcgctgccaacgccaatcatggcgggggttcgcacaccaactcgccagttcagttcctgcgttctgattgagtgtggtgacagccttgactctatcaatgcaacatccagtgcgattgtaaaatacgtttcccagcgagcaggcattggcgtgaatgcaggccgcatccgtgctttgggtagccctatccgtgatggtgaagctttccatacgggctgtattccattctataaacattttcaaacagctgtgaaatcctgttcgcaggggggagtccgtggtggtgctgcgactttgttctacccgctgtggcatttggaagtagaaagcctgctggtactgaaaaacaaccgtggtgttgaaggtaaccgcgtgcgccatatggattatggtgtgcagctcaataaattgatgtatgaacgcctgatcaaaggggaagacattactctgttcagcccatctgatgtcccggggctgtatgatgctttctttgcggatcaagatgaatttgagcgtctgtacactcagtacgaaagtgacgtaactatccgtaaagagcgcattaaagccgtggagctgttctcactgatgatgcaggagcgtgcttcaaccggccgtatttacatccagaacgttgaccattgtaatacacacagcccatttgatccggcggttgcacctgtgcgtcagtcaaacttatgtttggaaattgcactgccaaccaagccaatgaataatatcaatgatgaaaatggtgagattgccctgtgtacactgtctgctttcaacctgggtgccattaataatctgacggaactggaagaattagcagaattggccgttcgagcactggattctttgctggattatcaagattatccaatcatcgcggctaaacaggggtcaatgggacgccgtacgctgggcattggtgtgattaacttcgcttattatctggcgaaaaacggtgtccgttattctgatggtagtgccaataacctgacacacaaaacatttgaagccattcagtattacctgctgaaagcctcgaatgggctggcgaaagagaagggtgcttgcccgtggtttggtgaaaccacttatgcacagggtattctgccaattgatacttacaaaaaaacactggatacactgacccgcgaacctctgcatatggattgggaaaccctgcgtaatgacatccggcagcatggcctgcgtaactcaacattgtcagcattgatgccgtcagagacttcttcgcagatctccaatgcgaccaacggtattgagccaccacgcggctatatcagtatcaaggcatcaaaagatggcatcttgcgtcaggttgtaccggaatataaccgtctgaaaggggcttatgagttgctgtggcaaatgccgggtaccgatggctacctacagctggtggggatcatgcagaaattcattgaccaatcgatttctgccaatactaactatgatcctgctcgtttcccgaacggcaaagttccgatgaatcagttgctgaaagatttactgctcgcttacaaatatggcgtgaaaacactgtattaccacaacacccgcgatggagcggaagatgttcagggtgatctggaagaggtcgttgagtctgctgattccgattgtgacggcggcgcgtgtaaaatt

SEQ ID NO: 44826 - DNA, 1128 bp, Xenorhabdus nematophilus
atgtcttataccactttttcacaagtaaaaaataatcaactacaggaaccgatgtttttcggccagcctgtgaacgtagcgcgttatgatcagcagaaatatcctatttttgagaaactgattgaaaaacagctttcgttcttctggcgtcctgaagaagttgatgtttcccgtgatcgcattgactacaatgcattgccggatcatgaaaaacacattttcattagtaatctgaaatatcaaacgctgttggattccattcagggccgtagtccgaatgtggcattcctgccgctgatttccattccagaattagaaacctggattgaaacatggtcgttttcagaaacgattcattcgcgctcctatacgcatattatccgtaatatcgtcaatgatcctgccattgtgtttgatgatatcgtagccaacgagcagattttaaagcgcgccaaagatatttcggggtattacgacgttctgatcgaaatgactaactactatcatcagctgggcgaaggtacatacaatgtggcgggtaaaaacattacagttagcctgcgcgcattgaaaaaacagctttacctgtgtttgatgagtgttaacgctctggaagctattcgtttctacgtcagttttgcgtgttcattcgctttcgcagaacgcgaattgatggaaggaaatgccaaaatcatcaaactgatcgcgcgtgatgaagctctgcatttaacgggaacccagcatatgctgaacttgctgcgctctggtcaggatgaccctgaaatggcggaaattgccagagaatgtgagcagcagtgttacgatctgtttgtacaggcggctgaacaagaaaaagagtgggcagattatttattcaaagatggttctatgattggcctgaataaagatattctgtgtcagtatgtcgaatacatcaccaatattcgcatgcaggcggtgggtttgaagctaccatttgaagctcgctctaacccaatcccatggatcaatgcatggctggtttctgataatgttcaggtggctccacaggaagttgaagtcagctcttacttagtcggtcagattgactcggaagtcaatgctgaggatctcagcggtttcgaactc

SEQ ID NO: 44827 - DNA, 255 bp, Xenorhabdus nematophilus
atgtcgcagaagaaaaactctgaagatttacgtactgaattgcaatcccttgcggatacgctggaagaagttctcaatagttccggtgacaaatccaaggctgaattggaaaaactacgtagtaaagcagaaaaaacgttgaaagatgcgcgagtcacgctcagtgatgccagcgataagttggtcgatcaaacaaaggaaatggcaggtcgtgcggataattatgttcgtgacaatccgtggacaggtgtagga

SEQ ID NO: 44828 - DNA, 849 bp, Xenorhabdus nematophilus
  unsure (1)..(849): unsure at all n locations
ccactattaacggtgaaagatctgaatgtcgcgttcagcacacccgatggcagtgtgatagccgtaaataaactgaactttgatttaaacgcgggagaaacgctgggcatagtgggagaatccggctccggtaaatcacagactgcttttgccctgatgggattattagccagtaatggtgttgtgagtggttctgctgcttttaatggaagagaaatactcaacctgaaagaaaaagatctgaaccgaatgcgggcggaagagatctcaatgatatttcaagatccaatgacttcccttaatccttatatgcgagtgggtgaacagctaactgaagtcttgatgttgcataagcgtatcagtaaaagtgaagctgtcgaagaatccattcgtatgctggatgctgtcaaaatgccagaagcgcgtaagcggatgaaaatgtacccgcatgaattctccggtggtatgcgtcaacgtgtcatgattgcaatggcattattatgccagcccaagctgttgattgcggatgaaccgacaacagcactggatgtcactgttcaggctcagatcatgacactgctcaacgagctgaaaaatgaatttaatacggccattatcctgattacccatgacctgngtgtcgttgcaggtatctgtgacaaagtactggttatgtatgcgggcagaaccatggaatatggttctgcgcgtgatatattttatcacccgacccatccatactcgattgggttacttgatgcggttcctcgactggatgacgatgaggaatcattgacgactattcagggcaacccacctaacttactgagactgccaaaagggtgccca

SEQ ID NO: 44829 - DNA, 1494 bp, Xenorhabdus nematophilus
atgatgagtgaaataaccttactaaagcccgttacggattttctgcaacgtcctcatggtaattatatcaatgggttatctcttcctggtcagggaaacagaaccttttctgttgttaaccccgcttctgatgaaatgatcgctaaagttaatcaaggagaggaagctgagataaatttggcaatggaagcagcctcgaaggcttttcatggttcatgggcacagacatcgcctatggagcggggtaagtgcctgaaccggctggctgatttattgcaaaaacacggtgaagagttagcccaactggaaagtttgtgttcaggtaaaccaatccaacttgctcgaatgttagatgtgggcgcttcggctgattacctgcgttattttgctggttggtcgagcaaaattagtggtgagacattgaatgtttcattgccatcactcaaaggggagaaatacaccgcctttacccgccgtgagccaattggcgtggtggttggcattattccgtggaatttttccattatgattgccatctggaaattgggagcggcactggcctgtggctgtactttagtactgaagcccagtgagtatacccctttgacgatgcttcgtgtggcagaattggcgaaagaagccgggatacctgatggcgtgattaatgttgtcaatggttctggcgctagagttgggtcagccctgctcgctcatccccattgtgccaaagtcacttttactggctcagtcccgactggcacgattatcggtaagtcggcgatagagtacggcttgtctcgtgcgacgctggaactcggaggcaagaatgctgctgctttcctgtctgatatgtcagttgaaaagattgttgagggtgtgctggaagccggttatttgaatcaggggcaaatctgtgcggcagcggaacgtttctatatcccatctgttcacatggatgcggtcttaaaattactttctgaacgtttgtcagcgatgaaaatcggctctcctcttgatgaatcaaccgaaatggggcctttggcaaacaaagagcattacgaaaaaatcctgtccctgtttgataaagcgcgtcaggatggcagtgaaatcgtatatggtggtcatgcactggaaggtgcaggtttttttgtcaccccaacgattatccgggccaagagtgctgaagacacattaatgcaagaagaaaccttcgggccgataggcactttcctcagctatgatgatgaagaagagttaattgtcatgatgaacgcgacgccatttggtctgtctgccagtttatggacgaatgatctcagtaaggcgatgcgtatgatcccccggattcaagtaggtactttgtggattaatatgcatacgtttctggatccagcgttgccttttggtggcgtgaagtcgtcgggcattggacgggagtttggtagtgcatttattgagcattacaccgaactgaaatcggttatggttcgttat

SEQ ID NO: 44830 - DNA, 1238 bp, Xenorhabdus nematophilus
atgaccactattaatcattggatcaacggcaagaacgttgccagtaacacctattttgaaaccaccaatcccgccaccggcgaagtgctggcgcaagtggcatccggtgggcagacagagattgatcaggcggttgcagcggcaaaagacgcttttcccaaatgggcggatacgccaatgaaagaacgtgcccgcctgatgcgccgtttaggggagttgattgaccagaatgtacccgatattgccgcgatggaaaccaaggataccggcctgcccatccaccagacgcaaaatgtgctgatcccgcgcgcttcccataatttcgatttcttcgctgagatttgccagcagatgaacgggcggacttatccggttgatgacaagatgctcaactatacgctgatccagcctgtcggggtttgtgcgctgatttctccgtggaatgtgcctttcatgactgcaacgtggaaagtggcaccgtgtctggcgctgggcaataccgccgtgctgaagatgtctgaactttccccattgaccgccaaccgtctgggcgaactggcgctggaagcgggtattccggctggtgtgctgaatgtggtgcagggatatggcaataccgccggcgatgcgctggtaaaacatcatgatgtgcgggcgatctcgtttacgggaggaaccgcaactggccgccggattatgcaaagtgcgggcctgaaaaaatattcgatggagctgggtggcaaatcccctgttctgatctttgaagatgcggatattgaacgtgcgctggattcagcgctgttcacgattttctccctcaatggcgaacgctgtaccgccggttcccgtattttcattcaagaaagtatctaccccgaattcgttaaacgctttgctgaacgcgccaatcgcctgcgtgtaggcgatccacaagatccgaatactcaggtcggtagcttaatcagtcagtcgcactgggaaaaagtctccggctatattcgtctcggtattgaagaaggagcaacgctgctggccggcggctctgataagcccgccgatctgcctgatcatctgaaaaagggtcattttctgcggccaaccgtgctggcagatgtgaataaccggatgcgcgtggcacaggaagagatcttcggccccgttgcctgtctgctgccttttaaaagtgaagaggacggcctgcgcatggccaatgatgggaatacggtttggcgtcttag

SEQ ID NO: 44831 - DNA, 1386 bp, Xenorhabdus nematophilus
atgaatttaccactcgtcattaatgtgctggtttttgtagcactacttatagtattagcaaaagcgagctcaaataagtggagcctgtccaaaaaagttgttgttgccctaatcatgggtgttgtttttgggctggcattgaacgtcatttatggtgcacacaatatcattgtgaaagaatcaattaaatggttcaatatcgtcggcaatggctacgtgcagttactgcaaatggtcattatgccattagttttcgcttctattctgagtgcagtcgcacgtttacataaagcgtccgctttaggaaaaattagtttcctgacaattggaaccttgttgttcaccactgctatttcggctttaatcggcatcattatcgccaatgtgtttggtctgactgctgcaggattaattcaaggcacacaagaaacggcgcgcctgtctgctattgaaacaagttatatcggcaaagtttcagatctgggtgtaccacagcttatcctctcttttattcctaaaaatccatttgctgaccttactggagcaagccctacttcaattatcggtgttgtaatttttgccgtgtttctaggtatcgctgcattacaaatgcttaaagatgaccatgaacgtggtgagcgagctcttattgccattgataccctgcaagcatgggcaatgaaactcgtcaggctggttatgcgcctaacaccatacggcgttatggctctgatgactaaagtcgttgccagctccaacattcacgatattgcacaattgggcaattttgtcgttgcttcctatattgcccttgggttgatgtttgtcgtacatggaggacttttggcacttactggcatcaacccgatcaaattcttcaagaaagccggccctgctctgacgtttgcatttaccagccgttcaagtgctgccagtattccgttgaatgttgaaacacaaacacgtcgccttggtataccagaatccattgccagtttttctgcttcttttggtgcgactatcggtcaaaatggctgtgccggtatttatccagctatgttagcggtaatgattgccccaaccgtcggtattgaccctttcgatcccctgtggattgcgactctcgtcggtattgtgacgatcagctctgcaggtgtcgctggtgttggtggaggtgcaacattcgcagcactgattgttttacctgctatggggctacctgtgactttagtcgcactactgatttctgttgaacctattatcgatatgggccgcacagcattaaacgtcaatggtgcaatgacagctggtacaatcactagtcaattgatgggtacaactaacaaagaaatattagagcaagatgaaacggtaggattaagtcag

SEQ ID NO: 44832 - DNA, 684 bp, Xenorhabdus nematophilus
cggttcgtgccagatatatatagttgcaatacaggttgatgtactgagataattttcccatctgatctcacattctcactcatgaggtttcagtttaggtcccgtggctaatctgattggcggggcgggttatcattaacaaatagtcttagtaataccaaaaacatggcagagaaacgcaatatctttctggttgggcctatgggtgccggcaaaagcactattggtcgtcagttagctcagcaactcaatatggagttttacgactctgatcaagaaattgagcgacgtaccggagctgacgtgggctgggtatttgatgtggaaggcgaagaaggcttccgcgatcgtgaagaaaaaataattaacgaattgactgaaaaacaaggcatcgtactggcaacgggtgggggttctgttaaatcaaaagaaacccgtaatcgtctgtctgcccgtggtgtggttgtctatttagaaacaaccatcgaaaaacagttagctcgtactcagcgtgataaaaaacgtcctttacttcaagtggatgcaccagcacgcgaagttttagaaaatttagctgatgagcgcaaccctctctacgaggaaattgctgatctgactatccgtacagatgagcaaagcgccaaagttgttgctaaccaaatcatcgaattactggaaaaaaac

SEQ ID NO: 44833 - DNA, 1396 bp, Xenorhabdus nematophilus
atggcagccactcgcattgaaaaagactcaatggggcctattgaagtacctgctgaccaattatggggagcgcaaactcagcgctcactggagcatttccgcatttctcaggaaaaaatgcctgttgcgctgattcatgctcttgcattgactaaacaggctgcggccagtgtcaatatggatctggggcttttgcctaaagaacgtagtgatgcaattattgctgcggcgaaagaggtgctggaaggcaaacacccaacagagttccctcttgctatctggcagactggttcgggaactcaaagcaacatgaatatgaatgaagtgttggcgaaccgtgggtagtgagatccttggcggtcagaggggtaatgaacgtctgattcatcccaatgatgatgttaacaaaagccaaagttccaatgacgtttttccaacagccatgcatgttgcagcagttattggattgagtgagcagctactgcctgagttgaaaacattacaaaaaaccctggcagataaagcggcagcatttaaagatatcgtaaaaattggtcgtactcacctgcaagatgcgactcctctgactctgggtcaggaagtttccggttgggcggcaatgttgactcataacctgaaacatattgaagatagtattcctcatgtatgtgaattggctcttggcggtacagcggtaggaacaggtctgaatacgcaccctgaatatgccgttcgcgttgcgaagaaaatttctgaattatctggccaacctttcgttacttccccaaataaatttgaagcactggcaacttgtgatgcattagttcattcacatggagcattgaaaggtttggctgcatctctgatgaaaattgctaatgatgttcgctggttagcttctggccctcgttgtggtattggtgaaatttccattcctgaaaatgagccaggtagctcaattatgccgggtaaagtgaatccgactcagtgcgaagctatgacaatgctgtgtgcacaagtgatgggtaacgatgtggcaattaatattggcggagcatctggtaactttgagctgaacgtattccgtccgatggtgatcgataatttcttgcaatcaattcgcttgttagcggatggtatgcgtagtttcaatgatcattgtgctgttggtattgaacctaaccatgatcgtattactcaattgctgaacgaatctctgatgctggtaacggctttgaatacccatattggttatgataaagccgcagagattgctaaaaaagcacataaagatggtctgacgctgaagcagtcagcgatgcaactgggttatttaaccgatgctgaatttgacgcatgggttcgtccagaagatatggtcggtagcatgaagtaa

SEQ ID NO: 44834 - DNA, 621 bp, Xenorhabdus nematophilus
ctgaaatgcagaggtttcttattcgatctggatggcacgttgattgattcactaccggtagttgagcgtgcatggtgccagtttgcagataaaatggacatcgatagagatgaagtgttgagttttgttcatggtactccggctatgatatcactacgtcattttatgcctgatgcaagtgaagaggagatcaatcgcacttttaagtggattgaaaaaattgaatcagaagatacagaaggggttactgctttacccggtgcgattgcactgattgataaactcaatgcgctggatattccgtgggcgatagtgacttcgtgtacggttccccttgcttctgtccgtcataaagtggcggagttgcctgagcccgctcattgggttactgctgagagtatcaaaaatgggaaaccgaaccctgagccttatctgttgggagccagtatgctggggctgtcgccagaggagtgtgtggtttttgaagatgctgctgctggtattcatgcgggtctggatgctggctgtcaggtggtggttgtccataattcgccgggtattccacgtcgtgatgaacttcatcttgtgctcaataatctggaagacattgaaattagcaaa

SEQ ID NO: 44835 - DNA, 1344 bp, Xenorhabdus nematophilus
gagcaatccgcaggtgcgcagaaacttcaccgcggattaggcaaacgtcatgttcaattaattgctattggaggggctattggtacagggttgtttatgggaacgggaaaaaccattgctgtatcaggcacttcaataatcctgacttacctgctgatcggtttttttgctttcatggtcatgcgggcgatgggagaactgttgctcacaaaactggattaccgaacctttgctgattttgtggcggattatctcggtgagaaagccagttattttcttggctggacatactggatgagctgggtagtcagctgtattgcggatgttgtagtgtgcggtggctatatccaatattggtttcctgatgtctcactctggttcacagctctgtcacttttggggctgatatgtttgtgtaacttcttttcggtacagttattcggcgaaactgaattctggttcgctatgatcaaagtcgtggcaatcgtagcactgattatcgtcggtgtcggcatggtgtttgtcggatggacatcgcctaatggcgtgacagcgtctgttcgtcatttgactgatcctgaagtgttcttgccgaacgggatgtttgggtttctggcaggctttcagattgccattttctcttttactggcattgagctggttggcaccgtgactgcggaaactaaagaaccagaaaaagttttaccgaaagccatcaacactattcccatcaggatcatcattttctatgtgctttctattatgtgcattatcgccgtgacttcgtggacgaatatttccccggaagtcagcccgtttgtgacgctgtttgcattggctgggttgcctgcggcggcggcagtgattaattttgtcgctctgacttcggcgatgtcttcggctaatagtggtttatacgcgtgtacccggatgctgtatggcttgtccacagaaaagctggcgcatggtaaattcgcacaactctcagtgagcagtgcggttcctatcttcagtttgatattttctgttatctgcatggcaagcggggtattcctgctgttcattgtccccaacgtgatgaaattatttactattgtctcaacggtggcggctattatggtcatttatagctggggaatgatattgattgcttacctggcttatcgtaaaaaacgtcctgatttgcataaaatttccatctataaaatgcctatgggcataccaatgacatggtgtaccttgatattctttgctttcacagtagtgattatggtgtttgattacgatacccgcgttgcattatatggcacaccgatatggtttgtgatattggaggttttgtgg

SEQ ID NO: 44836 - DNA, 1254 bp, Xenorhabdus nematophilus
aatcatcaagcaaattatatcggtagcgggtgggtagcagggcaaggcgaacccgtcatcaaatattcccctcttgatcagcggattttatggcaggcaaacagtgcttctgtcagtcaagtaaatgacgcgtgtcaatctgcccgcagggcgttcccggcatgggcgaaactgacggctgaaaaacgtatagctattattcaggcgtttgctgatttactcacacaggaaaaagaggccattgcccgtgtgatcagcgaagaaaccagtaagcctttgtgggaaacaaggacagaagttcagtctatgattggcaaagttgctatttccattgagggatggcaacagcggactggctattcagaaacgcctatgccagatggcaaggcgatattacagcaccgtccccacggcgtgatggcggttttcggcccttataattttcccggccatttacctaacggccatattgttccggcgttgattgccggtaatacactggtgtttaagccgagtgaactgacccccatgacggcggaaaaaaccgtgcaattatggatcaaagcggggttgcctgcgggtgtgttgaatctggttcaagggggaagggaaactggcggtgcattgctggatagccgtgagattgacggtgtgttgtttaccggcagtgcagcgacagggtttcatttccaccgcgtacttgcgggtcagcctgaaaaaatgctggcgctggaaatgggcggcaacaatgctctgattgtggatgattatgacgatcttgaggccgcggtttacaccatcatccaatctgcgtttatttctgctgggcagcgctgtacctgtgcccgcaggctgttggtaaaacgtggagagaagggggatgctctgattcaacggctacttgataccgcaggtcagattatcccgtctcgctgggatgccgatccccaaccgtttataggcggggtgatctcgttgcccgcagtagaaaatctgctggatgctcagtcacgattacaggcattgggcggcgtttcgctgctgactatgactcaacctgatcctgactcaacgtttatgacacccggcattatcgatctgaccgatgccaaagaggttcctgacgaagaatattttggacctctgttaaccttgaagcgttatgacacttttgaagaagccatctctatcgcaaatgatacgcgctttggtcttgcaacggggttaatttcgccggatgccgctctattcgag

SEQ ID NO: 44837 - DNA, 1200 bp, Xenorhabdus nematophilus
tcaaacacgattcagagaagctggtttgatcagtatatggtcccttgtttttcaccggctcaatttattcctgtccgcgccaaaggttctcgtgtatgggatcaggaagggaaagaatacgttgattttgccggtggtatcgcggtgaactcattgggacatgccaatgatgagttaaagaaagtattaacttctcaaatagaaagtatgtggcatgttggtaatggttatacgaatgaacctgttttgaaactggcaaaaacacttgtcgaaaatacctttgctgataaggtttttttctgtaattcgggtgctgaagcaaatgaagctgcactaaagattgcgagaaaatatgctttagataaatatggcagtcataaaaacgaaatcatttcatttgaaaattccttccacggtagaacattatttacggtgactgtgggcggccaacccaaatactcacaagatttcgcgccattgccgcaacaaattagccatcttccctataacaatattgacgctatcaaagcccacatttcggaaaatacttgcgctgtgattgtggaacctatcattggtgaaggcggtgtcattcctgctgatcctgccttcctgaaagctttgcgggaactgtgtgaccaacatcaggcattgttgatttttgatgaaatccagacaggagttggtcggacagggtatttttatgcttacgaagaaacaggtgttgagccagatatcctgactagcgccaaaggtcttggtggcggttttcctatcggagccatgctggttaaacagcctatagcagacgttttccagccgggttcacacggtacaacattcggcggtaatccgctggcggcggcggttgccaatcaggtagttgctttagttaaccaaccggagtttctggcgggagtacaagagcgtcatcataaatttatcaagcgtatgtcagatttgaaccaacgttatcacgtgttcagtgaattacgtggaaaaggcttgctgctgggagccgaactggagaaaaaatatcagggtaaggctaaaaccctgagcaatatcgctgcggaagaagggttgattgccttgattgccggtccaaatgtgttgcgttttgcccctgcgttaaatatcgaagagcaggacatcaatgacggtttcgcccgtcttgaaaacgccctcaagcgatttgtt

SEQ ID NO: 44838 - DNA, 918 bp, Xenorhabdus nematophilus
gtgattgagtttgaacaggtcaagaagcactacaaggactatcaagcgctaaaaggaatttccctggatgtctatcgcggagagttcctgggtctgcttggtccgaatggggcgggtaaaacgacactggtcgaaatactggaagggctgaaaacgccggattcaggctcggttcgggtattaggcaaaacatggcagcaggacgcgccttacctgcgtcagcacctcagcggtgtcttacagcagaccctgtttatcgataagctcagtgtagaagaaacacttaacctgtttggcagcttttatggttgttcacgtaaacgagcgcaggaggtgatggaactggtcgagctggaagaaaaacgcaaaacctatgtagaggggttatccggtggtcagcgtcagcgtctcgcattgggtgtgtccatcatcaatgagccggaaatcctgatcctggacgaacccaccacggggcttgacccgcgcattcgtcatgatacttgggatatcctgcgtaagctcaaccgtgaaaagcactcaactatgatcttaactacccactatatggaggaagctgagtatctctgtgatcgcatttgtatcatgaataagggagaaattatcacacagggcagtatggatgagttgttgaaaaaacactgcgatggcgatctcattgaattccgtacccattttcctgaccgcttgcaggtactgagtcaacatgctcaagtcttaaactatgagtacgatgaaaggaaagataagatctgtatgctgattgaagattccaccagttttgttgctcatctttttgagtttgccaaacaagtcgaggttgacatcattgaactgatggtcaggaagaaaacgctggatgacttgttcatgactttggccgggagaaggttacatgaa

SEQ ID NO: 44839 - DNA, 1041 bp, Xenorhabdus nematophilus
atgcacaaaacagatgaattaagaacccgttccattggtcgtttgattacacccaaagcacttgctgaacaatatcctatatcagaaaaaatccggcaaaatgtgacattgtcacgtaagcgaattgaatccattcttacaggcaatgacccgcgtttactggtcattattggcccttgttcaatacacgatgttgatgcggctcttgattatgccgcccgcctgcaagtattacgtgaaaaataccagcacagtctggaaatagtaatgagaacctatttcgagaaaccccgtactgttattggctggaaagggttaatttcagatcctttgttagatggctcctgtcaggttaataagggaatctctctcgcccgtaagctattaaatgatattaatgaactgggtatgccaacggccactgaatttttggatatggtcacagggcaatatattgccgatttaattagctggggtgccatcggagccagaacgacagaaagccaaattcatcgggaaatggcatctgctctgtcatgccccgttggatttaaaaatgggacagacggaaatacgcatatcgctatcgatgcgatacgcgcagcacgtgccaaacatatgttcttgtctcctgacaaagatgggcggatgactatttaccagaccaacggaaatccccatgggcatatcattatgcggggcggtaaaaagcctaattacaaagcagaagatattgctgccgcctgccagaaattacatgaatatcaattaactgaacgcctgattgtggattgtagccacggtaactgtcaaaagatccatcgccgccagctagatatcgcgaaagatatcggccagcaaattcaatcgggttcaacatctattgcgggtgtcatggctgaaagtttcttgatagaaggtactcaaaaagtagtacatggagaacctttaacctacgggcagtccattactgatccctgtcttagctggcaagataccgaacagtttatcaatattctgtccagagcggtcaaagatcgt

SEQ ID NO: 44840 - DNA, 747 bp, Xenorhabdus nematophilus
gaaaatttacttgaagccagaaatttaaactatttcattgggcatcgtcagattatcaaggatatttcactttcccttcagaaaggggaagttgttgcaattattggccccaatggggccgggaaatctacgctgttacgcttattaacaggctatattccgtccaattcaggcgaatgcctgttaaaaggcgttccaatctcccgttggccaacccagcaacttgcacgtattcgtgccgttatgcggcaatacagttctctttcttttcccttcagtgtggaagaaatcattgccatgggccgtgtgccacatgaaaatacccacagaaaaacggccattgatgaagcgattatgctgacagaatgtgaagagctaagacatcgaaattatcagcagttatctggaggggaacaacagcgggttcaactggcaagagtactgacacagctttggcatccagagccaacagaatcttgtctatttctggatgaacccacatcagcattggatctttaccaccagcaacatacattacggctggtacatcgcctgacacgtcagcgccctctggctgtttgctgtgtactgcatgatttaaatttggcttcactctatgcagacaaaattatcctgttacacaaaggaaaactggtggcgtctggttccccgcaggatgtgcttcgcgatgatattcttaaacaatggtatcgggctgatttaggggttactcagcatcctgaaacc

SEQ ID NO: 44841 - DNA, 1188 bp, Xenorhabdus nematophilus
gtgttccagaatattgatgcttatgcaggtgatcctattctttcgttgatggaagcctttaaaaaagatccccgtgcagaaaaaatcaacctgagcatcggcctgtattacgatgaacagggtataacaccccaattgcaggctgttgcaaccgcagaagaacaaatgagtgctttgccgcagtctgcttctctttatctcccgatggaaggattgcttgcctatcgatcggcaattcaggaattgttgtttggcaaagatcatcctttattagggcagaagcgcattgcaacgatccaaaccgttgggggctctggtgcgttaaaggtcggcgctgactttttacaccgttatttccctgattctgaagtgtggtgctgtgatccgacatgggaaaaccatgcatcgatttttgctggagcagggatcaacgtgaattattacccttattttgatgataaaactaaaggggtaaaattcgataaaatgttggcaacattcaaccaactgccggcaaaaagtattattttgatgcatccttgctgtcataatccaaccggttctgatttaaccaatgaccagtgggatcaagtggttcaggttgcaaaagagcgagagttgattccattccttgatattgcctatcagggatttgcggatggtgtagaagaagatgcttacgctatccgtgcgatggcgaatgcggaactgccatgtctggtctgtaattcattctcaaaaattttctccctgtatggtgagcgcgttggtggattgtcagtcgtttgtgatgatgcaaaagcaggtgaatgtgtcttagggcaattgaaagccagtgtgcgccgtatttattccagcccacctaattttggtgcgcaggtagttgccagggtattgagcgatcctgaattaaaagccctgtggttgaaagaagttgagcagatgcgtttgcgtattaaggaaatgcgaactgttttggttaatgctctgaaaagtgcgctgccagagaaaaattttgatcacttgttgaaacagcgtggtatgttcagttataccggattcagtcaggaacaggttgatcgcttgcgtgaagaatttggcgtctatctggtaatctctggtcgtatttgtatggcgggtgtgaatcaccaaaacgtacagaaaattgctgaggcgtttgcggcggtt

SEQ ID NO: 44842 - DNA, 1080 bp, Xenorhabdus nematophilus
gctggaaatagtattgggcaatttttccgtgttaccacattcggtgaatctcacggaattgcattgggatgtattgtcgatggcgttcctccaggaattgccattactgaagctgatctgcaaatcgatttggacaggcgacgtccgggaacctcccgttatacgacacagcgccgcgaacctgatcaagtccgtattctttcaggtgtctttgaaggagtaacaacgggcaccagcattggcctgatgattgaaaacaccgaccagcgttcacaagattacagtgcaattaaagatgtttttcgcccgggacatgctgattatacctacgaacaaaaatatgggctgcgtgattatcgcggaggcgggcgttcctctgcccgtgaaacagcgatgcgcgtcgcggctggcgcaattgctaaaaaatatctactggaaaaacacggtatccgaattcgtgcttgcctgactcagatgggggatattcattgcgaattgaaagattgggatctcgttgaacagaatccttttttctgccctgatgaaagtaaactgacccagcttgatgaattattgcgcaccctgaaaaaagaaggtgattctattggtgccaaagtgacccttgttgctgagaatgtgcctgtcggattgggtgagcctgtttttgaccgtctggatgcagatatcgcgcacgccttgatgagcattaatgcagtgaaaggcgttgaaatcggtgatggttttggtgttgtcaacttacgcggtagtgaaaaccgagacgaaattacctctcagggattcaccagtaatcatgctggcggcattctgggcgggatcagtagcagccagccgattatcgctcatatcgctctgaaaccgacgtccagtattatggtgtccggcaaaactattaatcgccagggtgaagaagtcgatatggtgacccgtggccgccacgatccttgtgtagggatacgtgctgtaccgattgcagaagcgatgatggcgattgtactgatggatcacttactgcgtcagcgggcgcaatgtgctgacgtcatctttccattgccacgctgg

SEQ ID NO: 44843 - DNA, 1212 bp, Xenorhabdus nematophilus
atgaaacgtgcagtaatcactggtctggggattgtttccagtattggtaataaccagaaagaggtgctggagtctctgagagaaggccgttccgggataactttttctgaagaattcaaagagatggggcttcgtagccacgtctggggtaatataaaactggatatatctggtctaattgatcgtaaaactcagcgttttatgagcgattcatctgtttatgcttatcttgcaatggatgaagcgattaaagattctggtttgtccgatgagcaagtttccaatttgcgcacgggtctggttgtgggttcaggtggcggttctccacgtaatcaggttagtggatcggatggtatgcgagccaaagggctgcgtggcgttgggccttatatggtgacgcgggcaatggcttctggtgtatcagcctgtctggcaacaccattcaaaatcaaaggggtgaactattccattagttctgcctgttcaacttctgcacactgtattggccacgcagttgaattgatccagcttggtaagcaggatgttatttttgccggcggcggtgaagaactgagctgggaaatggcctgtgagtttgatgcaatgggagcgctttctactaaatataacgaaacaccagaacttgcttcccgcacttatgatcaggggcgtgacggttttgtcatcgcaggcggtggcggtatcgttgtggttgaagaattagagcacgcattagctcgtggtgcgcacatatatgctgaaatcatcggttatggggcaaattctgatggcgcggatatggttgcaccttctggcgagggggctgttcgctgcatgaagctggctcttgatggtattgaaggtggcgtggattacatcaatacccacggaacatcaaccccgattggtgacttgaaggagttgggagctatccgcgaagtgtttggtgataacacccctgctatttcggccaccaaagcgatgacggggcactctttaggagcggctggtgcgcacgaagccatttacagtttattaatgctggaacatggtgttattgcaccaagtatcaatattgataacttggatgagaaagcgttaggcatgaatattatcactgaacctaccgaacgcgagctaagaacagtaatgtccaatagcttcgggttcggcggtacaaatgcatccctggtgatgcgcaaatattcgaac

SEQ ID NO: 44844 - DNA, 1008 bp, Xenorhabdus nematophilus
atgtcagaaggctggaatattgcgctcttgggtgcaacaggcgcagtaggtgaagcgatattggcgttattacaggagcgccagtttcaggttggtgaactgcatcttcttgccagtgagcaaaatgctgggaaaattcagcgttttaatggtaaaagcatcaccgtttatgatgccgcagaatttgattggtcacaggtgcagcttgcgttttttgctgcgacgaaagaagcaacggcacaatatgttgaaaaggcaacggaagcgggctgtctggtgatcgacagcagcggattgtttgccgcagagccggatgtacctctggtcgtaccgggagttaacccacacgctttggctgaatatcgcaaccgcaacattattgctgtggcggacagctcaacaagccaggttttgacggccattaagccattgatcgatctcgcaggtattgcacgtttaaatctgaccaatttattgccggtttccgtacatggcaaagccgccattaatgaattggcagggcaaagtgcccgtttattgagcggcgttccgccggatgaaagtctttttaacaaacaattagctttcaatctgctgcctttattgcctgatgccgaaggctcagtacgtgaagagcgtcgcattgtcgatcaaattcgcagaatattacaggacgaagggctacctatttcagtcagttgtgttcaatcttcggttttctacggaattgcccagatggtgagtgtggaaacactgcgtccagtcggcacagaagaagcgcgtgaagagcttgaacgttttgcagaaattcaggtctcagaagagggagattatcccactcaggtcacggatgcatccggtagtgacaggttgagtattggctgtctgcgtaataattatggtatgccggagatgctgcaattctggtcggttgccgacaatatccgttttggcggtgcgctgatggcggttgaaatcgcagaaaaactgatgcaggagcaattctac

SEQ ID NO: 44845 - DNA, 1157 bp, Xenorhabdus nematophilus
atattgcaaattcctcaagccacgtcgtcactgataacgtggctttcctatcttggaaatctacacgcaaaagccattgatatggggcttgaacgtgtgggagcactcgccgatcagttagatttgctgcatccggcgccgaaagtcatcaccgtgtccggcacgaatggcaaggggacgacttgtcatacccttgaatccattctactggccgctggcctgaaggtcggagtgtacagctccccgcatctggtgcgttataccgaacgggtacgtatacagggtaaagagccggcggaacaggatttctgccgtgtattcgcggacatcgaagctcaacgtggtgatatcacactaacctattttgaatacggtactttggctgcgttacagctttttaaagaagctgatcttgatgtcgtcattctggaagtggggctgggcgggcgtctggatgcgaccaatattgtggattcagatgttgcggcaatcaccagcattgcactcgatcatattgattggctgggtgcggatcgcgaacatattggccgtgaaaaagcaggtattttccgtcaggggcgttttgccgtggtgggggagcctgatatgccacataccatcgctgaagtggctgatgagctgggagcgaaattgtttcgtcgcggtgctgactgggatttctcacaggatgcgaacagttggtactggcgcacaggagatcaacagttcagtgaattacccgtccctaatctgcctctggcgaacgctgcaacagcgatgggagtgatttactgtctgttgcagcagaatgataacgtcagtcaggccattaatgaacaggcgatccgtgaagggttaagtaaggctcagttaccggggcgtttccaaatcgtcagggaaaacccgctggtgattttggatgtggcacataatccccatgcagcaggttatctagtacagaaactggcaaaattgccccgcgcaccagacagtaagatccgtggtgtcgttggcatgctggaagacaaggatatagcgggtacgcttgcttgtcttgcccagcaggttgacgaatggtactgcgcatcattgcatgaattccgtggggcagaagcaaacatattggccgagcacttggcgatgcccgaacatttggg

SEQ ID NO: 44846 - DNA, 816 bp, Xenorhabdus nematophilus
atggataaatttgcggtttttggtaaccctattgcacacagtaaatctccttacattcatcgattatttgctgatcagacggggattgatcatctatatgggcgggtgcttgctccgatagaacattttgaacaaactttggatcgtttttttgaacggggcggtctaggagcgaatattactgtaccttttaaagaaagggcttatcagcgctcagatgaattgactgagcgagcaagaattagtggtgcggttaacacattaaaattgattgaaggtaatcgtctccttggtgataatactgatggggtcgggttactggcagatttacagcggttaggtttcattactaagggccggcatattctgattattggggctggtggtgcagcaaaaggagtgttatctcctttattagaactaggatgtgccgtcactatcacgaaccgtacattcgcgcgtgcgcagataattgcagataaattttcccaattgggcgatattcagccaattgaaatggaatcccttctttccccagatttcgatatcatcatcaatgcgactgcttctggtattgatgggcagattcctgaggtatcaccgctgattttttgcaatgatattgcttgttacgatatgtattaccaacacggattaactccattccttgattttgcccggcaaaatggtatttcacgtttggctgatggattaggaatgttggtgtggcaagctgcgaatgcttttgaattgtggcatggagtattccctgaaatagaatcagttttaaccgctttgaggcgagagttacacgca

SEQ ID NO: 44847 - DNA, 1275 bp, Xenorhabdus nematophilus
atgcaatccctgacgttaaaacctatttcctgtatcaatggaactattaacctgcccggctccaaaagtgtttccaaccgcgcgctgctgcttgcagcctttgccaagggaactacttgcctgaccaatttgttggacagtgatgatatccgccatatgcttaatgctttgacaacactcgaaattccctaccgtctatcagacgatcgtacttgctgtgaaattgatggcattgggggaactatcaccggaaaaggtgcgctggagctgtttttgggcaatgcagggacggccatgcgtccgttggctgcggcactgtgtctgggagacaacaatgtcgtgctgacaggggaacctcggatgaaagagcgtccgataggtcacttggtggatgcattgcgtcaaggcggagcaaaaattgattatcttgaacaggaaaattatccgcccctgcatatcaaaggtggattctcgggggggaaagttgtcgttgatggcagtgtttccagccaatttctgacagctttgctgatggctgcaccactggcggcgaatgatacagacattcatattcaaggtgatttggtttctaaaccttatattgatattactctggcgctgatggaaagtttcggcgtgacggtagaaaatcaccaatatcaagtttttcatgttaaggggcagcagcaataccaatcgccgggacattatctggtggaaggggatgcttcatctgcctcttattttctggccgccgctgcgataaaaggtggcacggttcgcgtgacaggtatcggtaagaatagcctgcaaggcgatacaaaatttgctgatgtgctggaaaggatgggggcgacgattcgctggggtcatgattttgtggaatgtgaacgtggcacattgattggtgtcgatatggacatgaatgctattcctgatgccgctatgactattgcgacaacagcactgtttgctcaaggtgaaacggtcatccgcaatatttataactggcgggtaaaggaaacggatcgtctcaatgcaatggcggctgaattacgcaagattggggctgaggtggaagaagggcatgattacattcgtgtcgttccgccacaaaagctcaatcatgctgaaattgaaacttataatgatcatcgaatggcgatgtgtttctcactggttgcgctttcggatacaccagtgacgattcttgatccaggctgtacggccaaaacattcccggattatttcaatcagcttgaaaaactgagccaa

SEQ ID NO: 44848 - DNA, 1083 bp, Xenorhabdus nematophilus
atgagtcaggtatataatttcagcgctggtccagccatgttgccagcagaagtactacgccgtgcagaacaagagctttgcaactggcatggtctgggaacatctgttatggagatcagccaccgtagcaaagagttcatggatgttgcggctgaagcagaaaaagatcttcgggatttattagcaatacctgagaattataaagttttgttttgtcatggtggtgctcgtggtcagttttcggctttaccacagaatctacttggtgacaaaacgacagccgattatatcgtcagtggttattggtctgagtgtgcagcgaaagaagcagaaaaatattgcacaccaaacgtcataaatattacgacagaagttgatggcatcagaagcgtaaagccaatgagtgaatgggcgctgagcagtgatgccgcctatgtgcattattgtcctaacgaaactattgaaggtattgcaatttttgaagagccggattttggcgatgataagattgtgattgctgactactcttcagctattctttcagccccgattgatgtgagtcgttacggtgtgatttatgcgggagcccagaagaacatcgggccagcaggaattacagtggtgattgtccgtgaggacttattgggtagagcacatcagcatactccgtcaattctggattatactgtgcaggttaaatcagcctcgatgtacaacacgccaccaacatttgcctggtatctctctggcatggtattcaaatggctgaaagagcagggtggcttacaggaaatcagcaaacgtaatcaggcgaaagcagagctcctctatcgcaccattgataacagtaatctgtatatcaactgtgttgcgccacagaatcgttccatcatgaacataccattccaactggccaacccaatgctggatggtaaatttctggaagaagcctatgcacatgggttacacgctttgaaagggcataaagttgctggtggtgcgcgagcgtccatttataacgccatgccttatgaaggtgttcaggcattggttgagtttatggctgattttgaacgccgtaac

SEQ ID NO: 44849 - DNA, 927 bp, Xenorhabdus nematophilus
gtaatgagtatggcaaaacttgccgtgatgggcagcattaatgcagatcacatcttgaacctcgaatcttttcctcagcctggggaaaccgtgatgggaaaacagtatcaggttgcatttgggggaaagggagctaatcaggcggttgctgcaggtcgctgtggtgctgacattacatttattgcttgtgttggccaagatgatattggcgagcgtgtccgtcaacaattggtgaaagataatatcaatacctcggcaatcggagttattgaaggtgaaacaacgggtgtagcactgatttttgtgaatcagcaaggggaaaacgtcattggcattagcgcaggagcgaatggcgcactcacatctgaatatttccaccatcatgagcaggtggtcaaagaggctgatgtgttgttgttacagctcgaaacaccgttggaaactgtacagctggccgctgaaacggccagaaaacataacactaaagttatcttgaaccctgcgccagcacagaaactctctgaacaattgctttctttggtcgatattatcactcctaatgaaacagaagcggaatacttaactgggatcgctgtaaaagataatgtaggagcagaaaaagccgctcaggacttgcataaaaaaggtattgaaatcgttattatcacattgggcagccgtggcgtatggctgagtgaaaatggtaagcaaggtaaaattgttcctggatttaaagttaaggcaatcgatacgattgcggcgggcgatacatttaatggcgcactggtaacgggattattggaggggaaaggaatcgtatcggcaattcgttttgcccatgctgcggcagctattgctgtgacacgtcagggagcgcagccagctgttccgtggcgacgtgagattgatgcatttctggctgaacag

SEQ ID NO: 44850 - DNA, 531 bp, Xenorhabdus nematophilus
atgtctgaatttgctacggtagctcgcccctacgccaaagcagcttttgactttgctgtagagcaccaatctctcgaacattggcagaacatgctggcgttcgttgctgaggttactcgcaatgagcaggttggtgagctgctttccggttcattggcaccggaaacgttagccaataccttcatcaccctttgtggtgagcaggtagatgagcatgctcagaactttattcgtgtaatggcagaaaatggtcgcttgctggtactgccagaagtcttccagcaatttacccaattgcgtgcgtcacttgaatcaaccatcaatgttgaagtgatttctgcgtctgaattgaatgagcagcagcaggctaaaatttctgcggcgatggaaaaacgtctgtcacgcaaagtgaagctgaattgcaaaattgacaagtctgttatcgccggtgtggttatccgcgcaggtgatatggtgatcgatggcagcattcgcggccgtctggatcgtttaacagacgtcttgcagtct

SEQ ID NO: 44851 - DNA, 1476 bp, Xenorhabdus nematophilus
atgactcgttttggcttacaaaagctttatatccacggcacttacgttaatagcgttaatcccgataaaaatacttttgatgcgatcaatccagctaatggtgaggtcatcgctcaattacaatctgcgacagagcaggatgttgagctggccgtcaaaagtgctcagaaagggcagaaaatctgggcagcgatgactgctgtagagcgttcacggatcttactcaaagcggttgatatcctgcgcgaacgcaatgatgtactggctgagctagaaacactggatacgggcaagccactgtctgaaactcaatatgttgatattgtcactggtgcggatgtactggaatattacgctggcttgatccattctctcgaaggtcagcagattccactacgagaatcatctttcgtctatacgcgccgtgaaccacttggcgtcgttgcaggtatcggggcatggaactacccaattcaaattgccctctggaaatcagcaccagcactggcggccggtaatgctatgattttcaaacccagtgaagttacgtcactcaccgccctgaaattagccgagatttatactgaagcaggcgtgccagatggggtatttaacgttctgactggcgcaggtcatgaagtggggcacactctgacagtacatcctgaaatcgccaagatgtcgtttacgggtggcattgtcacaggcaaaaaagtcatggcaaatgcatctggatcaaacttgaaagaagtcacaatggagctgggtggaaaatccccgctgatcatttttgatgatgccgatctggatcgtgctgctgatatcgccatgatggcaaactttttcagctccggtcaggtctgtaccaatgggacacgagtttttgtcccgaaaacactggctccccaatttgaagccaaaatcgttgagcgcgttaaacgcattcgcataggctctcccctcgatccaaataccaactttggccctctggtgagctttccacatatggaatctgtattgcgttacatcgaaagcggtaagtcttcccatgcacgactactgtgtggcggtgaacgtctgctggaaggtgaattagcgaaaggtgcattcgttgcaccaacggtatttagcgactgtacagatgatatgctgattgtgcaggaagaaattttcggccctgtgatgtgtatcctgacctatgaaacggaagatgaagtgatcaaccgcgccaataacaccgattatggtctcgccgcaggattagtgacacaaaatttatcccgtgcacatcgcgtgatccatcaactggaagcagggatctgctggatcaacacatggggagaatctcaagcagccatgccagtaggtggctacaaacattctgggattggccgtgaaaatgggctggtcacattgcaaaattacacacaaaccaaatcaatacaggtggagctgggtcattttgaatccctattt

SEQ ID NO: 44852 - DNA, 1659 bp, Xenorhabdus nematophilus
atggtatttgattacattattatcggagctggttcagcaggtaatgtgcttgcaacccgtttaacggaagatagcgatgtcactgtcctgctgctcgaagctggcgggcctgattaccgattcgacttccgtacccaaatgccagctgcgctggcatatcccttgcagggaacccgttataattgggcatatgaaaccgaccctgaaccccatatgaacaaccgacgcatggagtgtggccgtggcaaagggctggggggttcttcactgatcaatggtatgtgctatatccgcggcaatgcgctggattttgacaactgggcaacgctatcaggtctggaagactgggcttatctcgattgtctgccctacttccgtaaagcggagactcgggacatgggggcaaatgactatcacggtgatgatggaccagtcagcgtcactacgcccaaaccggtcaataatgaactttttcatgtgatgatagaagccggtatccaagcaggatatccacgtactgacgatctgaatggctatcagcaagaaggttttggcccaatggatcgtactgtcacccctgaaggccgtcgtgccagcactgcccgtggttatctggatcaagcacggtcgcgctcaaacctcaccatcattacccacgccttgacagatacgctcgaatttgagggaaaaatggccgtcggcgtcaatttttatcaaggtaacacatcgactttaacgcaggcaaaagcacgtaaagaagtattactttgtgccggcgcgatcgcttccccacagattttgcaacgctcaggcattggccctgaagaaatcctgaacgagtttggcattccggtggtacagatattagcgggggttgggcaaaatcttcaggatcatcttgaaatgtatttgcagtatgaatgcctcaagccggtttctctctatccagccttgaaatggtacaaccagccaaagattggcgctgaatggttattcaaaggcacagggattggggcgagcaatcaatttgaagctggtggatttatccgtaccagtgaaaaatttacctggccaaatattcagtttcattttttgcctgttgccatcaattacaacggcagcaatgcagtcaatgaacatggctttcaagctcatgtcggctcgatgcgttctccgagccgtggtcgagtcaagatcacttcgcgtgatccacgccaacatcccagtattctgttcaactatatgtcaaccgcgcaggactggcaggaattccgtgatgccatccgcattacacgtgaaatcatggcacaacctgcactggcttcctactgtggccgtgaaatcagtcccggcactgacatccagacagatgaacaattaaatacctttattcgtgaacgagccgaaaccgcctttcatccatcctgtagctgtaagatgggtactgatgaaatggccgttgtggatggtcagggacgtgtgcatggtgtcaaaaacttacgtgtgattgatgcttcgatcatgccggaaattattaccggtaatttgaatgccacaacgattatgatcgcagaaaaaatcgccgataaaattcggggtcgtaatccactaccacgcagtcaggcaaaatattatgttgccaatggcgcaccagctcgc

SEQ ID NO: 44853 - DNA, 765 bp, Xenorhabdus nematophilus
atgcgacatccattagttatgggaaactggaaattaaatggcagtacccacatggttaacgacctgattgcaggcctgcgtaaagaactgagcaatgttgacggctgtggcgtcgctatcgcaccaccaacagtttatgtttctctggcaaaaaatgcactggctggcagccgtatcgctctgggtgcacaagatgttgacgttaacctttctggtgcattcaccggcgaaacatccgctgaaatgctgaaagatgtgggcgcgaaatatatcattatcggtcattctgagcgccggacttaccataaagaaagcgatgagctgattgcgaaaaaattcaccatcctgaaagaacaaggactgattcccgttctgtgcattggtgaaaccgaacaggaaaatgaagcaggccaaaccgaagccgtatgcgcacgccaaatcgatgctgttctgaatacactgggtgccgaagccttcaaagataccgttatcgcatacgagcccgtctgggcaattggtacgggtaaatcagcgactcctgcacaagcacaggctgttcataaatttatccgtgatcatatcgcgaagcaagatgcagctatcgctggacaggtcatcattcaatacggcggttccgtcaatgccggcaacgcggcagaactgttcacccagccagatatcgatggtgctctggttggtggtgcatccctgaaagccgatgctttcgccgttattgtgaaagccgctgccgaagcgaaaaaggca

SEQ ID NO: 44854 - DNA, 1500 bp, Xenorhabdus nematophilus
atcactgaaaaaaaatatatcgtcgccctcgatcaagggacaaccagttcacgagctgtcgtactcgatcacgatgccaatattgtctgtatttcacagcgtgaattcccgcaaatctaccccaaaccaggctgggtagagcacgacccaatggaaatctgggccagccaaagctcaacattggtcgaagtgctggcaaaatctgatatcagttcagatcaaattgccagcatagggatcactaaccagcgagaaacaacgattgtctgggaaaaagaaacaggtaggccagtttataacgcgattgtatggcaatgtcgccgaacagcagatatttgtaccaaattaaaacaaaaagaaggattagaagaatatatccgccacaatactggcttggttgtcgatccttacttctccggaacaaaaataaaatggattctggataatgtagaaggcatccgccatcgtgctgaaaatggcgaactgttattcggtacagtcgatacctggctcgtctggaaaatgactcagggtcgtgtgcatgtgaccgattacaccaatgcttcccgcaccatgctattcaatatccacaatctcgattgggatcagaaaatccttgatgagctggatattccccgcattatgctgccaaaagtgtcatcttcgtcagagatttatggtcagaccaatattggtggtaaaggtggcacacgcattcctatcgcgggtattgcaggcgaccagcaggcagccctgtacggccaattgtgtgttcatcccggcatggcaaaaaatacttacgggacaggctgcttcctgctgatgaatacaggaacagatgcagtacgttccagtcacggcctgctgaccactattgcctgcgggccacggggtgaagtgaactatgcactggaaggcgctgtcttcgttggcggcgcgtctatccaatggctacgtgatgaattgaaactcatcgccgatgcggcggattccgaatatttcgccactaaagtgaaggacagcaatggtgtgtacgttgtaccagcctttactggcctaggcgcaccttactgggacccttacgcccgtggcgctattttcggcctgactcgtggtgcgaacagcaaccatattattcgcgccacgctagaatctatcgcttaccagacccgtgatgtattggatgcaatgcaggctgactccggcacacgcctgaaatccctgcgtgtagatggtggggctgtcgctaacaatttcctgatgcaattccaggccgatattctgggtactcgtgtagaacgccctgacgtacgtgaaagtacagcgttgggtgccgccttcctcgctggcctggccgtcggtttctggaaagaccttgatgaagtgaagagcaaagcgacaatcgaaaaagagttccgtccgggcatcgaaaccactgagcgaaaccataaatataatggctggaaaaaagcggttgcccgcgctcaggaatgggaagac

SEQ ID NO: 44855 - DNA, 1239 bp, Xenorhabdus nematophilus
gtgtctaagcgtcgagtagtcgtgaccggactaggcatgttatctcctgtcggcaatacagtagagtcttcttggaacgctgtttgtgccggacagagtggtatcagccttatcgaacattttgacaccgctaaccatgcaactaagtttgctggtgtggtgaaaaattttaatcatgaagatttcaatatttcgcgcaaagatgcgcgaaaaatggatctgtttattcagtatggaattgctgctggtgtacaagctatcgaagatgcaggaatcgaagtaacagaagccaatgctagccgctttggtgctgctattggttctggtattggtggtttgggtcttattgaagaaaaccacagtacattgctttcggcgggacctcgcaaggtcagcccattctttgtaccttcgaccatcatcaatatggttgcaggccatctgagcatcctttatggtcttcgtggtcctagcatctccattgcaactgcttgtacctctggcgtgcacaatatcggtcatgcagctcgtattattgcgtacaatgatgctgatattatgctggcaggtggtactgagaaagccagtactacatttggcgttgcagggtttggtgctgctcgtgcattatcgacccgtaatgatgatcctcaaggtgcaagccgcccttgggataaagatcgagatgggtttgtgctgggtgatggtgccggtgtactggttcttgaagaatacgaacatgccaaaaaacgtggtgcaaaaatttacgctgaaatcgttggctttggtatgagcagtgatgcttatcatatgacatcaccacctgaagatggagcgggtgctgcgcttgcaatggagaatgccctgaaagatgcggatatttccccagaccaagtgggctacattaatgctcatgggacttcaacgccagttggtgatcttgcagaggctcgtgcggtagaatctgtttttggtgaaggcactaaagtattggtgagttcaaccaaatcaatgacaggtcatttgctgggtgctgcgggagcgattgaatcaattttcactattcttgctttacgtgagcagattgttcctccgaccattaatttggaaaatcaggatgaaaactgccgtttggatcttgttccaggcgaagcacgtaaagttgaagggatggaatacgcactgtgtaattctttcggtttcggtgggactaatgggtcactgattttccgtaagata

SEQ ID NO: 44856 - DNA, 630 bp, Xenorhabdus nematophilus
atgaacagcaaatttattgttattgaagggcttgagggggcagggaaaacgactgcaatccgaacagtggttgaaacattgaagcagtatggcatttctgatctgatttttacccgtgaaccgggtggaactccgttggcagaaaaattacgtcaacttatcaaacagggtgttgaaggtgaatcactgacgaataaggcagaagtattgatgctatatgcagccagagtccaattggtagaaaatgttatcaagccagcactggaaaaaggaacttgggtggttggagatcgtcatgatctttcctctcaggcatatcagggcggtggccgtggcattgatcagaaactgatgacatcattacgcgaatcggcactcggcgatttctacccggatttgactatttatctcgatttgccaccagaggttggtttacagcgcgctcgtgaacggggtgaattggatcgcattgaaaaagaatccttggattttttccaccgtacccgtgaaagatatctcgagcttgtggcacaagatgacaccatcaaaaaaatagatgcgacacaaccgctggaaaaagtgcagggtgctattcgtcagaccttattacagtggttgaaacaacaggac

SEQ ID NO: 44857 - DNA, 1107 bp, Xenorhabdus nematophilus
atgaaatcacgagccgctgttgcattcgggccgggccagccccttgaaattgttgaaattgatgttgcaccgcctcaggccggagaggttctggttaaaatcagccataccggtgtgtgtcatacagatgccttcaccctgtcaggggatgatccggaaggcgtatttcccgtcatactcgggcatgaaggcgcaggcgtagtcgttgaggtgggcgcaggcgttaccagcgtcaaacccggtgatcatgttatccctctttataccgcagaatgtggagagtgcctgttctgcaaatccgggaaaaccaacctgtgtgtcgccgtgcgggcaactcagggaaaaggtgtcatgccggatggcacaactcgtttttcctataatggacagcctatttatcattatatgggatgctccacattcagcgaatacaccgttgtcgccgaagtctcactggcaaaaatcaatccggaagccaaccatgaagaaatatgcctgctgggttgtggtgtcactaccggcattggcgctgtgcacaatactgcgaaagtgcaatctggtgactctgttgctgtctttgggctcggcggtattggccttgccgtgatccaaggtgctcgtcaggcaaaagcaggcagaatatttgctattgataccaatccggcaaaatttgaactggccaaacagttcggtgcaaccgactgcctgaacccgaatgattacgataaacctattcagcaggtcattatcgaaatgacagaatggggggtggatcataccttcgagtgtattggtaatgtcaatgtcatgcgtgccgcactcgaaagtgcgcaccggggctgggggcaatctgtcattattggtgtagcgggtgccggacaggaaatctccacccggccattccaactggtcaccggccgttcatggcgcggaactgcttttggcggagtcaaaggccgcagtcagttgcctaaaatggtggaagaggcaatgaaaggtgaaattgagttaaaaccttttgtgacccacaccttaccacttgagcgcatcaatgaagcattcaacctgatgcatgagggaaaatccattcgtaccgtcattcattac

SEQ ID NO: 44858 - DNA, 1151 bp, Xenorhabdus nematophilus
ccagtgcgggtcagttgccggaaggatttgaagttggtgatttatataacgcaaaccatcatccgcgcggtttacgtctgacagtctatggagcctcggatttactcagttcaattggcatttcatggccagatatcgccaaattggtggaacccgatcaaatttctgtttatgccagtagcgctctgggtcagatagaccgattttcattggcaggtttaattggcaacccacagaatggcacacgtattagttccaaaatgctagcgctttcccttgctgacatgccggcaaattttattaatagctatattatcaatagtatcggcaacacatcagctaatctaggtgcctgtgcaagctttctgtataacctcaaacagggcgtcaatgatatcaaacaaggtaaggcaaagatcagtttagtcggatgctctgaagcagctatcgtccctgaaattatcgaagggtttcgagttatgggcgctctcgcagaagaccatcaactatgtaaactggatggaaccgatattgttaacaaccgccgtgctacccgaccattttcaactaatgttggatttaccattgccgaatctgcgcaattcgtattactcatgagtgacgatcttgctttacagtgtggtgccaacatccttggcgctgtgcctgatgttttcgtcaatgcggatgccaataaaaaatcaatatcctcacccggaattggtaactacattaccatgatgaaagcagcctccctagctgaccatctactggatggcaaattacagtattcttacgttcaggcacatggtactggaacaccacagaaccgagtcactgaaagtcatatcattaatgaagttgccaaagtttttggactcaaatgctgggatgtcaccgccataaaatcgtatgtaggacattccatcgccgcctctgcgggcgatcaattagcctgtacattgggggtttggcagtacggatggatccctggtattaaaaccatcgatcacattgccgaggatgtacatgcaacaaatctgaatattttgatgcagaataagtttgcaggcgagcacggtgaggagatgcgtgccacaatcatcaataccaaaggattcggtggcaataacgccagtgcagttatttta

SEQ ID NO: 44859 - DNA, 1479 bp, Xenorhabdus nematophilus
tcaaagttaactcagttggatcctcgcagtgaagaatcttaccgtttagatcattttatttcggcaacagaaacaacaaaatttagttatacatctggaagagttgctttacccgtttataataaatataacgttaaaaataaacctaaggtcataggttattatactgattggtcacaatatgatagccgcctgcaaggtaatcaaactccttcagcgcggggaagaggtattgatttacaacacttgcttgataaccctttcgcctatgataaattaattatcggtttctgtgggatagtaggtgatcaaggtgagaaaaaagcgttaatttctcgggcagcaccgaagtttggtcgttacaataatggtgaagtcacatttaccgatgaatggggcgattgtcaatcttatgtaaactgtactttccctaggtggcaagacgttcaaatgcccagagatttcaagcaggacaaatctatgggagtgctaggtgggttggcaaaaatacaggatgcagcaagggcgcaaggccatgaactagtaatgtcattcagcgtcggtggttggaccatgagtaatggtttttacaatatggtcaggaacagccaattgaaatccaaatttatttccagtttgatcgatatctttaaacgcttccccatgttcactgaagtagatattgattgggaatatcctggagcgaaaggaaacgataacccgcacgacccgaaagacggtgagtattatattagcctaatccgagatttatcttctgcatttaagaatgcaggacgttctgatattaaaattagtatcgcttgctctgccgtaccagatattatggaaaaatccaaaatacctgaattattaaaggttggattatatggaattaatgtcatgacctatgatttctttggtactccgtgggctgataagttaaggcaccatactaatttgcgccgttatcctggtagtgaaaatagtgtggaaaaagcggttgagtatctactcagtgttggtgtgccatctcaagctatcaatattggttatgctggatattctcgtaatggcaaaaatactaatattaccagttattcaccattatcgggcagctatagccctgaaatgggtacgacgactgggacatttgagtccggttcaacagaatggtatgacacgatatataattatttgaatctagagtctcgtcaagatagaaatggttttaccctttatacagatgaagttgcggatgcagactatctttataaccaaaacagtaaattgtttatatcactggatacaccgcgtacagtgaaagccaaagcaaaatatgcattggaaaaaaatctaggtggagtatttacttggacagcagatcaggacagagggccattagtgaatgcagctcgtgaaggtctggggtgcccattgttgattaagaaaattgacatggagcctttctattataaaggc

SEQ ID NO: 44860 - DNA, 888 bp, Xenorhabdus nematophilus
tttgaagagcatttaagcgcttgtcagcaacatgtcaatgacaagctgatggcaacattttcttcattaccttttttggacagcccattagcgacagctatgctgcatggcgcggtactaggtggcaagcggttgcgcccatttttggtttacagcgtaggcgaaatgtttggcctttccagagagagtcttgatgctcctgctctcgccttagaatgcattcatgcctattcactgatccatgatgatttgccggcaatggacaacgacgatttacgccgtggtcaacctacctgccatatcaaatttggtgagagtctggcaattctggctggagatgcattacagtcattggcatttgagatactggcaaagcaagatatgccaaatattgccttatccgatcgccttgcaatggttgctgaactggcaacagcgagtggtcttgctggcatgtgcggagggcagtcactggatttggaagctgagggaaaacagatcgaccttgctactctggaacaaatccatcggcataaaacaggcgcattaatatgtacagccgtcaggcttggggcttacagtgctgggcaacgtggccgtgaagtactccctttgctggatcaatattctcaagccattggcctcgcatttcaggtacatgatgatattctggatgtcattggcaatacagacgttatcggcaaacggcaggggaacgatcagcaacttggtaaaagcacttatcctgcgctattgggtttggaacaagccaagaaaaaagcgagggatctctatgaagaagcgctcgccgcactcactgaactggaaaaacaatcctataacaccgtgatcttaaaaaaactggctggttttatcatcgaaagaaac

SEQ ID NO: 44861 - DNA, 1860 bp, Xenorhabdus nematophilus
atgagcattgatatagcgaaatatccaacattggcattggcggaaactcccgaagaacttcgcctgctacccaaagacactttgccaaagttatgcgacgaactgcgtcaatttttgctcaatagtgtcagtcgctccagcggtcactttgcttccggcctcggcactgtcgaattaacagtcgcacttcattatgtttataaaacaccgtttgacaatttagtttgggatgtcggtcatcaggcctatccgcacaaaatattgaccggacgccgtgatcacattaacactattcgtcagaaaaatgggctccaccccttcccttggcgagatgaaagtgaatatgacaccctgtgtgtcggccattcatccacttcaattagtgctggattgggcatggccattgcggcaaaacatgaagacaaaggccgcaagactgtctgcgtcattggtgatggagctatcactgctggcatggctttcgaagctatgaaccatgcaggggatatcgatcccgatatgctggttatcctcaatgacaatgaaatgtccatttctgaaaacgttggcgctttgaataaccatctggcgcatcttctttcaggcaaattgtatacaaccctgcgtgaagggggcaaaaaagtcttttccaacttgcctcccatcaaagagttactgaagaaaaccgaagaacacctcaaaggcatggtcgttcccggaactctgttcgaagagctagggtttaactacatcggccctgtcgatggccatgacgtattggcactgacccagaccctgaaaaatatgcgtgagctgaaagggccgcaattcctgcatatcatgaccaaaaaaggccgtggttatgcacctgcggaaaaagatcccatcggttggcatgctgtccccaaattcgatccggctacaggttccttgccgaaaagttcagatacccgcccgacattttccaagatcttcggtgattggctatgtgaagaagctgcccatgataaaaaactgatggcgatcacccctgccatgcgggaaggctcaggtatggttcgtttctcccgcgaataccctgaacaatactttgacgtggctattgccgaacaacactcggtcacttttgcggcagggctggctattggtggttacaaaccgattgtggcaatttactccaccttcctgcaacgtgcttatgatcaggtgatccatgacgtcgccatccagaatctgcccgtgctgtttgccatcgatcgtggcggcattgtcggcgcggacggacagacccatcaaggtgcattcgacctctcattcctgcgttgtatcccaaatatggtgatcatggcacccagtgatgaaaatgagtgccgtcagatgctgcatactggccatcactatcagggcggcccggtggttgttcgttatccccgaggaaccggaacaggtgctgaactccagccactggaagcattgccaatcggcaaaggtatcgttcgccgtcagggagaacgcattgccatcctgaacttcggaacactgctaccagacgcattgcaatccgccgaagccttgaacgcaaccgttgttgatatgcgctttattaaaccactggataaccaactagtgctagaaatagccgccagccatgatatgttggtcactctggaagaaaacgccatcatgggtggagcaggcagcggtgtcaatgaactgctgatgcaaacaagtcagcctgttcctgtattaaacctcggtttacctgatcactttatccctcagggaacacaagaagagatccgagctgatttagggttagatgccagaggaattcaacacgctatcgaaaaatatctggct

SEQ ID NO: 44862 - DNA, 1395 bp, Xenorhabdus nematophilus
atgcaatatactcattttgatgccattgtgattggctctggtcccggaggggaaggagcagcaatggggctggtgaaacaggaaaaaaacgttgcagttatagaacgttacaatagtgtcggtggtggctgtacccattggggtacaattccatcgaaagctctccgccatgctgtcagtcgtattatcgaatttaatcaaaaccccctctatagtgataactcccgcattcttcgttcctcattttctgaaatcctgcgccatgctgacgttgtcattagccagcaaaccaaaatgcgtcagggtttttatgaacgtaatcggtgccaaatgtttgcgggcgaggcagcattcattgatgaacatcgtgtgagtgtccgttatgctgatggtagtgttgatatattaagtgcagataagataatcattgccactggttcccgtccttactgccctcctgatgttgatttcactcactcccgtatttataacagcgacaccatcctgcaactggatcatgaaccacgccacgttatcatttacggcgcgggggtgattggctgtgaatatgcttctatcttccgagggctgggcgttaaggtggatttgatcaatacccgtgatcatctgctgtcttttcttgatcaagagatgtctgatgccctgtcctatcatttctggaatagtggcacggtcatccgccataacgaagaatatgaaaaaattgaaggtcttgatgatggcgtgattgttcatctgaaatccggcaaaaaggtcaaggcagactgtctactgtatgccaatggccgcaccggcaatacagataagctagggttggaaaatgtcggtctggaaacagacagccgtggtttactgaaagtgaatcgcgtctatcagagcagcaatgagaacatttacgccgttggcgatgtcatcggctatccgagtctggcttctgctgcgtatgatcaggggcgcattgccgcaaaagctatcatgaccggaagcgccaacctgcatctggtggaagatattccaacagggatttataccattcctgaaatcagttcaatcggtaaaaccgagcagcagctcactgcgatgaaaatcccgtatgaggtagggcgcgcccaattcaaacatctggcaagggcgcaaattgccggcatgaatgttggcagtataaagatcctgttccatcgtgaaacaaaacagattctgggcatccactgttttggtgaacgtgccgcagagatcatccatatcggccaagccattatggaacaaaaaggagaaggcaatactatcgaatatttcgttaatacaaccttcaactatccaacaatggcagaagcctaccgtgttgctgcactcaatgggttaaatcggttattt

SEQ ID NO: 44863 - DNA, 1368 bp, Xenorhabdus nematophilus
atggcactttggggcggacgtttcagtcaggaagccgatcagcgattcaaacaatttaacgattctctgcgttttgattatcgcttggcggagcaggatattattggttctgttgcatggtcaaaggcgctggttacggtgggagtattggtttccgaagaacagcaaaaactggaactggcgctgaatgagttactgggtgaagtgcgggccaaccccaaggccattttgaaaagcgatgtggaagatattcatagctgggtggaaggtcaacttatcgcgaaagtgggcgatttggggaaaaaacttcacacaggtcgtagccgtaatgatcaagtcgcaactgacctgaaactgtggtgtaaggatcagatagccgatattcagcaggcacttgtggaattgcaacaggcgctggtgattacggcggagaataatcaagatgcggtgatgcccggttatacccatttgcagagggcgcagccagtcactttcgctcattggtgcctcgcctatgccgaaatgctggatcgtgatgagagccgcctgcaagatgcactgaaacggctggatgtcagcccactgggctgtggcgcactggcgggaacagcctatgatatcgatcgtgaacaattagcatcatggctcggttttgcctcggcaacacgtaatagtctggatagcgtttccgatcgggatcatgttctggagctattgtcagatgccagtatcagcatgatccacctttcacgctttgctgaagacctgattttctttaacagtggagaagcgggttttattgagttatcagatcgggtaacttccggctcttccctgatgccgcaaaagaaaaaccctgatgcgctggagcttattcgtggcaaatgtggccgggttcagggcgcattgacgggcatgatgataacgctgaaagggcttcccctcgcttataacaaagatatgcaggaagataaagaaggtttgtttgatgcactggatacatggcgggattgcctgcatatggcggtgctggtgctggatggcattcaggtgaaacgcgggcgctgtgaggaagctgcaaaacagggttatgccaacgcgactgaactggcggattatttagtggtaaaaggagttccattccgtgaagcgcatcatattgttggtgaagtggtaattgcggccatagcggaaggtaaggcgctggaagaactgtctttgtttgaactgcaaaaattcagcgaagctatttcgctagatgtgtatgacgttttatcgctgcaatcctgtttggataaacggctggcaaaaggcggtgtatcacagcaacaggtggcacaggcgattgcagcggttaaacagcggtta

SEQ ID NO: 44864 - DNA, 1194 bp, Xenorhabdus nematophilus
attaaaaaaatcgttctagcatattctggtggtttagatacatctgcgattattccttggttgaaagaacattatgacaattgtgaagttgtcgcatttgttgctgacgttggtcaaagccgcgaagatttagaaggtgtggagcagaaagcgttgcgatctggtgcgtcggaatgtcacgttatcgacctgcgtgaagagttcatcaaagagtatgtttatcccgtactgaaaacgggcgcattgtatgaaggcagctatttgcttggtacatcaatggcacgcccaattattgccaaggcacaggtcgaactggcgctgaaagtgggcgctgattctgtagctcacggggcaacgggcaaaggtaacgatcaggttcggtttgaaagtacttatactgcgttagcgccgcatctgaaagtggttgctccgtggcgtgaatgggatctgcgttcccgtgaggctctgcttgattatctgaaagtccgcgatattcccaccaccgccacgctggaaaaaatttacagccgtgacgaaaacgcatggcatatctcaaccgaaggcggggtattggaaagtacatggaatgctgccaataaagattgctgggtgtggacagcagagccagaagatgcgcagaatgagccagaatatgtcaccgtcacggttgaaaaaggtgaggtggttggcgtgaatggtaaggggttgtcaccctatcaatgtcttaatgcattgaatgaactgggagccaaacatggtatcggccgtatcgacattgtggaaaaccgtttggtaggcatgaaatcccgtggttgttatgaaacaccgggtggaaccatcatgatggccgcattgcggggaattgaacagttggtgttggatcgcgacagcttcaaatggcgtcagcaattggggttggaaatgtcctatgtcgtctacgatggtcgttggtttgcaccattgcgccagtcgattcaggctgctgcggaaacgttggctgacagtgtcagtggggcagtggtcttaaaactgtataaaggccaggtgaccgctgaacagaaaaaatcgacatacagtctctattctgaagagttcgctacttttggagaagatgaagtctacgatcaccgccatgcagaagggttcattcgcctctattcgctttcttcacgtattcgtacactgaacagcaaa

SEQ ID NO: 44865 - DNA, 771 bp, Xenorhabdus nematophilus
atggaaccgttagttatcaaattgggtggtgtgttgttagacagcgaagaagcgctggcgcggttattttccacattgcagtcatatcggaagacgcataagcgcccgttagtcattgtacatggcggtggctgtttagttgatgaactgatgcagagattgcagttaccgattgtgaagatacagggcctgagggtaacgccagcagatcagattaatatcgtgacggggacattggcaggaactgctaataaggcactgctggcttgcgcgataaaataccgattgcctgcgattggattgtgtctgggagatggtggtgtggtgcaagtttcccagtttgatgaggaattcggccacactggaaaagctcatccgggtaaacccgatctcctgaaaattttgctggatgtcggttatatgccaattatcagttctattggtatcaccgaaaatggtgagctgatgaatgtgaatgcagatcaggcggcaaccgccattgcgcaggtgttaaatgcggatctggtctttctgtctgatgtcagcggtattttggatggaaaaggccagaaaatcccagagctaacagcggaaaaaatagaacagctcattgagcatggcatcataactgacggcatgattgtgaaagttaatgcggccttagaagcggcaaaaacgctgaagcatccggttgatattgcaagctggcgacataccgaacaattaattgcattatttaatggcatacccacaggtacgcgaatttcggcg

SEQ ID NO: 44866 - DNA, 1002 bp, Xenorhabdus nematophilus
atgttgaatacgctgatagttggtgccagtggctataccggagcagagttagcagcatatctacaacgtcatctccatgtccacctttctggcttaatggtttcgtctcaaagttcagatgcggggaaatgtttttcagatctctacccgcagtacaagggcattgttgatttacctttacagccgctgactgatgtggctgaagcagtgaatggtattgatgtcgtcttcctcgccactgcccatgaaatcagccatgatattgtgccgatatttctacaagcaggttgcacagtcttcgatttatccggagcctatcgcgtacaaaatacacaattttattcaaaatactatgggttcgagcataaaaatacggcttggcttgataaggcagtttacgggctggcggagtggcaggcggaaaaaatcaaaactgcccagttgatcgcggttcccggctgttatcccactgtttctcagctttcattgaagcctttgctggaaaaaaatctgctggatactgaacaatggcccgttatcaatgctgtgagtggtgtcagtggagcaggccggaaagcaaccattaacaacagcttctgtgaagttagtttgcagccttacgggatttttaatcatcgtcatcaacccgagatcgcgacacatttaggtactgaggtcatttttatccctcatctgggtaatttctcgcggggtattctcgctacgatcacctgcaagttgaaatcaggtgtaacagaaaagcaaattagggaagcctaccagctggcgtatcatgataaaccgttggtgcgtctatacacggaaggtatgccggcattgaaagccgtcgtgggtttgccattctgcgatattggttttgctgtgcaaggacagcacctgattattgtcggtgctgaggataatttgttgaaaggcgcggcagcacaagcagtacagtgcatgaatattcgttttgggtttgcagaaactcaggcattgctt

SEQ ID NO: 44867 - DNA, 2634 bp, Xenorhabdus nematophilus
atgaatcaacaatattctgcaatgcgcagtaatgtcagtatgcttggtaagttattgggtaacactatcaaagaagcactgggagaaagcattcttgataaagttgaaacgataaggaaattatccaaatcatcccgtgcaggaaatgaagctgaccggcagcaacttttatctacactgcaaaatttatccaatgatgagttattgccggttgctcgggcctttaaccagtttcttaatctggccaacgttgccgaacaatatcacagcatttcaccgcatggtgaagcggctagcaatcctgtagcgctagaggctttgttcaatcggctgaaagataaaaaattcagtaatgatgacttgatcaatgcagtcaatgaacttgccattgaattggtcttgacggcacaccctaccgaaattgcccgtcgtactctgattcataaactggtcgaagtgaatgcctgtctgtcacagcttgaccatgatgatctggcggattatgaacgcattaatatcatgcgccgtttacgccagttgattgcccaatcatggcataccgatgaaatccgcaaaattcgccccaccccgattgatgaagccaaatggggatttgcggtggtggaaaatagtttgtgggaaggtgttcctgcatttctgcgtgaattcaatgagcaattggaagaatccattggctatagcttacctgtggaagccgtaccgattcgtttcacttcttggatgggtggcgatcgtgatgggaaccccaacgttaccgcagaaattactcgccatgtattgttgctcagtcgctggaaagcagcggatctatttttgaaagatattcaggtgttagtttctgaactctctatgtcggagtgtacacctgaactgcgccagcttgcgggtggtgatggggtgctggaaccttaccgtgaaatcgccaaacaattgcggacgcaattaaatagcacactgacgtatctggagaaacaccttaaaggagagcgagtcctgccacctgtgggtttgctgctgcataacgaacaattgtggcaaccgctgtatgcctgctatcaatcactgaaaacctgcggtatggaaattatcgctaatggccaattgttggataccttgcgccgcattcgctgctttggtttgtcgttggtgcgtattgatatccgtcaggaaagcacccgccacaccgatgccattgcagagctgacccaatatctggagctcggagattatgcgagctggtcagaaacggagaaacaaacttttctgctgcgtgaattgaattcaaaacgtccgcttattccgcattgttggcagccgagtgaagaaaccctagaagtcttcgaaacctgtaaggtcattgccgaatcgccacaagatgcgattgcagcctatgtcatttctatggcgaaagttccctcggatgtactggccgtgaagttgctactgaaagaagcgggttgctcactgaaattgcctgttgcaccgttgtttgaaacccttgatgacctgaataatgcggaaagtgtgatccagcaattactgggaattggctggtatcgcgagctgattcaggataagcagatggtgatgattggctattccgactctgccaaagatgcgggagtgatggcggcatcatgggcgcaatatcgggcacaggatgcgttgatcaaagtgtgtgagcaggaaagcgtaacgctgacgctgttccacggacgtggtggtacgattggccgtggtggtgctccagcgcattccgctttgctttctcagccgccgggcagtctgaaaggtgggttacgtgtgacggagcagggcgaaatgatccgctttaagtttggtttaccacaggtgacgattagcagtctggcgttgtatgccagtgcaattttggaagcaaatttactgccgccgccagagccaaaaccggagtggaagcaagtcatggatacgctctctgatgtttcctgtgacatgtatcgtgattatgtccgtgagcagcccgaattcgtaccttacttccgagcggcgacgccagaacaggaattggcgaaattgcctttagggtcacggccagccaagcgtcgtccgaccggcggtgtagaaagcctgcgtgcgatcccttggatattcgcttggacgcaaaaccgcctgatgttgccagcatggttgggtgcgggagcagcgctgcaacatgtgattgatgcgggtaaactgtcggtgttagcagatatgtgtcgcgactggcctttctttaatacccgcattgccatgttagagatggtatttgccaaggccgatttatggctggcggaatattatgatcaacgcttggtggataaaaaactgtggccgttgggaataacgctgcgtaatcagttggcagaggatattaaaactgtgctgacgatttcgcaggatgagcaattaatggcggacttgccgtggattgcggaatccattgcgttgcgtaacgtctataccgacccgctgaatgtgctacaggcagaactattacagcgttcccgtcagcaggaacagccagatccgcaccttgaacaagcattaatggtgacgattgcgggggttgcggcagggatgcgcaataccggc

SEQ ID NO: 44868 - DNA, 2436 bp, Xenorhabdus nematophilus
atgagtgcactggcaacagcgggggcggaatttggccgccagttacataaatttggcggcagcagccttgccgatgtgaaatgctatcagcgggttgcagaaattatggcgaattatagccagccgggtgatttgatggtggtatcggcagcagggagtacaaccaatcagcttattgattggttgaaactgagccagagtgaccgcatctcagcacatcaagtacagcaatcattgaggcgttatcagcaggagctgatcagaggtttattgcctgaagtgattgcggaagaactcgtagcacattttatctcggacctggaaaaattaagtgtattgctggacaaaccgattactgacattacgtacgccgaggtggtcgggcatggtgaaatctggtcagcccgtttgatggcggctgtgcttgagcataagggtatttccagtgcatggctggatgcacgccaatttctgcgggcagaacgcgctgcccagccgcaggttgatgtgaacttgtcccagcctttactgagccaactgttgatccaaaatcccagtaagcgtttggtggtcacggggtttatctccagaaatcagaaaggagaaaccgtactgctgggacgtaatggcagtgattattctgccacacaggttggtgcactggcaggcgccaaaaaagtgacgatttggagcgacgtagcgggtgtttacagtgctgatccgcgtaaagtaaaggatgcgtgcctgttgcctttactgcgtttggatgaagccagtgaactggcgcgtctggcggcacccgtccttcatacccgcactttgcagcctgtttccgtcagtgatatcgacttgcaattgcgttgcagctaccagcctgaacaaggatctacccgcattgagcgggtgctggcaacaggtactggggcgaaaatcgtgaccagtcatgatgatgtctgtctgattgaactgcatatttcttctgcccatgatttcaagcagatttacaaggacattgattcattgctgaaacgcgcacaaattcggccgttggcgacaggtctgcacgctgactgtaatttgattcagctttgttatacctctgaagtcgtgaacagtgctctcgatgtgttgcaggatgcgtctttgccaggaaaattgtctttgcgagaaggattggcgctggtggctttggtcggggcgggagtgtgcaagaatccgttgcatagccaccgtttttatcagcagcttaaagaccagcccattgaatttatctggcatgcggaagagggtatcagccttgttgctgttctgcgcctgagccagacttcacatttgattcagggattgcaccaaagtctgttccgggcagaaaaacgcattggtctggtgctgtttggcaagggaaacattggctcacgttggctagaattgttcgctcgtgaacagaagaatatttctgcccgcagtggttttgaatttattttggcggggattgtggacagtcgtcggagcttgctgaattatcaggggcttgatgcgagtcgagcattggcattctttggtgatgaagccactcaacatgaagacgatgcgctgtttttgtggatgagagcgcacccttatgacgatttggtggtgttggatgtcactgcaagcgaggagttggctaaagactatattgatttcgccagctatggctttcatgtcatcagcgccaataaaattgcaggttcttcaaacagtaacacttatcgcatggttcgcgatgcttttgcaaaaaccggccgtcattggttatacaatgcgaccgttggtgcagggttgccgattaaccactccgtcagagatttgcgggaaagtggcgataccattctgtctatcagcggtattttttcagggacgttatcatggctgttcctgcaatttgatggctccgtacctttcagtgatttggtggagcaggcgtggcagcaaggattgacggagcctgatccccgtatcgatttgtccggtcaggatgtaatgcgcaagctgattattctggctcgcgaggcgggttatgagatagagcctgatcaggtgcgtgttgaatccctcgtgccagtagaggccagaaccggttccatcgaagacttctttgaaaatagtgccgttattaatgagcaaatgctccagcggttggaagcatcacaggaaatgggcatggtactgcgttatgtcgctcgctttgatgccaccagtggtaaagcaaaagttggtgtcgaagccgtgcgtgcagatcaccccttagcttcgttattaccgggggataatgtctttgcgatagaaagccgctggtatcgtgacaatccactggtgatccgtggtccaggcgctggacgggatgtgacggcaggagcgattcaatcagatttgaaccgtttgtcacagcttctt

SEQ ID NO: 44869 - DNA, 708 bp, Xenorhabdus nematophilus
aatcctctgctgcgcattgttgatattcaatatatctgtgggttggcgcataaagttggagcactggcggttgttgataacactttcttgagtcctgtattgcaaaagccattggatttgggcgctgatttagttgttcactcctgtacgaagtacctgaatgggcattccgatctgattgcgggggcgattatcgccaaagatcccgtgatcgcagaaaatctggcgtggtgggcaaacaatattggtatcacaggtgccgcctttgacagctacctgctgttgcggggtattcgtaccctgtctgcacgggtaatgctacagcagaataacgcagcggctattgctgagtacctgcaacaacagccacaagtgaaaaaactctactaccctgctttgaaaaatcatcccgggcatgaaattgcccttaaacaacaaacaggctttggggcgatgctgagttttgaacttgatggtgatgaacaaaccctacgccattttttatctgcgttaaaattatttactctggctgaatctctcggtggtgtagagtcgttgatttctcatactgcgacgatgacacatgcgggaatggcggcagaagcaagggcgcaggcagggatcacggattcacttcttcgtgtctctgtaggaattgaagatagtcaggatttaattgcggatctggacaaagcgtttcaggcagca

SEQ ID NO: 44870 - DNA, 1212 bp, Xenorhabdus nematophilus
atgagtagcgtagaaattctggttccagaccttcctgaatctgttgcagatgccactgttgcgacatggcataaaaaagcaggtgacactgtacaacgtgatgacgtgttggttgaaattgaaactgacaaagtcgttttggaagtacccgcgagtgaagccggtgttctggaagctattttggaagaagagggtgccaccgtactgtccaagcaactgctcggtcgtatccgtttgagcgatagcacgggtattcctgctgaagtaaaagaaaaaacagaatcaacaccagcgcagcgccagactgcttctttggaagaagaaagcaacgacgtattaagtccggcggttcgtcgtctgattgcagagcatgatttagatcctgctgcaattaaaggcagtggcgttggtggccgtatcgttcgcgaagatgtggaaaaatatatcgctgcgcataaaaaagagagtggcaaagtggctgaagctgcaccagcacaggcttctcagctgccacatcgtagtgagaaacgcgttccaatgactcgcctgcgtaaacgtgttgcagaacgcttgcttgaagcgaaaaacaatactgcaatgctaacgacgttcaacgaagttaacatgaagccaattcaagaattgcgcaagcagtacggtgacgcgtttgaaaaacgtcatggtatgcgtctgggcttcatgtccttttatgtgaaagcagtcgttgaagcactgaagcgctatccagaagttaacgcttctattgatggcacggacgtggtttaccacaactattttgatatcagcattgcggtatctacacctcgtggtctggttacaccagtactgcgtgatgcagatgcactgggcatggcggatattgagaagagcatcaaagagctggctattaaaggccgtgacggtaagttgaccgttgaagaactcactggtggtaacttcacaattaccaacggcggtgttttcggctctctgatgtctacaccgatcattaacccaccacaaagtgcgatccttggcatgcacgctatcaaagatcgcccaatggcagtgaatggccaggttgagatccttccgatgatgtatctggcgctgtcttatgatcaccgtctggttgatggacgtgagtctgtaggcttcctggtgaccatcaaagaaatgctggaagatccgacacgtttgttgctggatgta

SEQ ID NO: 44871 - DNA, 2781 bp, Xenorhabdus nematophilus
atgaaggactggctggactcgagctttctggctggtgcaaaccagtcttacatagagcaaatctatgaagactatataaccgatcctaactccgttgatgcaagttggagagaaatattccaacaattaccggatatagggcttagcggggaacaacttcactcacagacgcgcgattacttccgtcgtctggcaaaagatgccacgcgttatcacacttcagtcagcgatccagcaatggatgcaaaacaagttaaagttttgcagctcattaacgcattccgcttccgcggccatcaaagtgcgaatcttgacccattgggattatggaaacaggaacctgtacccgatctcgatcctgctttccataatttaacaaaagcggattttgaagaaacgttcaatgttggctcgtttgccattggcaaagaaacactgaaactggctgatctatatgacgccctgaaacgcatttactgtggttcaattggtgcggaatatatgcatatcaccaatacggaagaaaaacgctggattcagcagcgtctggaatccattgcggtaggttcacagttcagtgcggatgaaaaacatcgtttcttggcggaactgacagcagcggaagggttagaacgctatttgggggctaagttcccgggggcgaaacgtttttcccttgaaggtggtgatgcgcttatcccaatgctgaaagaactgatccgccatgcgggaaaacagggtacccgtgaagttgtgctgggaatggctcatcgtggccgcctcaacgttctggtcaatctctttggtaaaaaaccagctgatttgtttgacgaatttgcgggtaaacataaagagcatctcggtacaggtgacgtaaaataccatcagggcttttcctctgatttcgaaactgaagggggattggtacatttggcgttagctttcaacccatctcaccttgaaattgtcagccctgtcgttattggttcagtgcgtgctcgccgtgaccgtcttgatgaaggccgaagcaacatggttctgccagtaaccattcatggtgacgctgctgtaatagggcaggggattgttcaggaaaccctgaatatgtctcaggctcgaggctatgaagttggcggtactgttcgcatcgtgattaacaaccagattggtttcactacctctaatccgaaagatgcccgttcaacgcaatattgtactgatattgtgaaaatggtgcaggcaccgattttccacgttaacgcggatgatccggaagccgttgcctttgttactcgtctggcgcttgatttccgtaataccttcaaacgtgatgtgatgattgatctggtttgctaccgtcgccacggtcataacgaagctgatgagccaagtgcaactcagccactgatgtaccagaaaatcaaaaaacagccgacaccacgtaaaatctatgcagataaactcatagcagaaggcctgctggcagctaacgatgttactgaaatggccaatctgtatcgtgatgcgctggatcatggtgagtgcgttgtgaatgaatggcgtcctatggggttgcactcatttacgtgggagccttacctgaatcacgaatgggatgaggactacccacataaagtggatatgaaacgcctgcaagatctcggcaaacgtatcagcaccattcctgctgaagttgaaatgcattcacgggttgcgaaaatttacggcgaccgtgaagaaatggctaacggcaataagctgtttgactggggtggtgcggaaacattggcttacgctactctggttgatgaaggcatccctgtgcgcctatcgggtgaagatgcgggtcgtggtacatttttccaccgtcatgccgttatccataatcagccgaatgctgctgtttatgtccctctggaaaatgttcacagtagtcagggtgtattcaacgtatgggattctgtactgtcagaagaagcagtactggcgtttgaatacggttatgcaacgacagaacctcgcgctttgacgatttgggaagcccagttcggtgatttcgctaacgttgcgcaggttgtgattgaccagtttatcagctccggtgaacagaaatggggccgtatgtgtggtctggtcatgctgttgccgcacggttatgaaggtcaaggtccagaacactcatcagcacgtttggagcgctatctgcaattgtgtgcagaacagaatatgcaggtttgtgtaccatcaactccggctcaggtttatcacatgctgcgccgtcaggctctgcgtggtatgcgtcgtccgctgattgtcatgacacctaaatcactgttgcgtcatccattggcggtctccagtctggatgaactggctaacggtaaattcgagcctgtgattggtgaaattgacgccttggatccaaaaggtgttaaacgtgttgtgctttgttccggtaaagtttattacgatctgttggatcagcgtcgtaagaacgagcaggctgatgttgccattgtgcgtgttgaacagctatatccattcccgcgtcagaacttgcagtctctgcttgagcagtatgctcatgttcatgacttcgtctggtgtcaggaagaacctctgaaccaaggtgcttggtattgcagtcaacataatttccgtgaagtgatcccatttggggcttctttacgttatgcaggtcgtccagcatctgcttccccggcagtgggttatacgtctgttcaccagcagcagcagcaagcgctggttaatgatgccctg

SEQ ID NO: 44872 - DNA, 714 bp, Xenorhabdus nematophilus
atgaaacttgaattttcgatttatcgttataatccggatgtagataacgcaccccgtatgcaggattacacgctggaagccgaggaagggcgtgacatgatgctgctggatgcgcttatccagttaaaagagcaggacccgaccttatcattccgccgttcttgccgtgaaggtgtttgtggctctgacggtgtgaacatgaatggtaagaatggtctggcttgtgttactcccgtttcggtactgcgccggggtaataagaagattgtcattcggccgttgcctggtttgcctgttgttcgtgatctggttgttgatatgagccagttctacacgcaatatgagaaaatccgtccttatttgattaacgatggtaaaaacccaccagcgcgcgaacatctacaatcaccggaacagcgtgaaaaactggatggcctctatgaatgtatcctgtgtgcctgttgctcgacgtcttgtccatcgttctggtggaacccagataagtttattgggccggcaggtcttttggctgcgtaccgtttcctgattgacagtcgtgatactgaaacggcttcacgattggatggactgaatgatgcgttcagcgttttccgctgtcatagcatcatgaactgtgtcagcgtctgtcctaaagggttgaacccgacaaaagcgattggtcatattaagtcgatgctgctgaaacacagcgca

SEQ ID NO: 44873 - DNA, 1764 bp, Xenorhabdus nematophilus
atgaaattgccagtaagagagtttgacgcggttgttattggtgcgggtggcgcaggtatgcgtgctgcactgcaaatttcacaaatgggtttatcttgtgccttgatctccaaggtattcccaacccgttcacataccgtttcagcacagggcggaattacggttgctctgggcaatacccatgaggataactgggaatggcatatgtatgacacggtgaaaggctccgattatatcggtgaccaggatgccattgagtacatgtgtaaaactggccctgaagccattctggaattggaacacatggggctgccattttcccgtctggataatggtcgtatttatcaacgtccatttggtgggcaatccaagaattttggtggcgagcaggctgcccgcactgctgctgctgctgaccgtacgggtcacgctttgttacacactctgtatcagcaaaacctgaaaaataacacgacggttttctctgaatggtattcactggatctcgtcaaaaatcaggatggtgctatcgttggttgtactgccatctgtattgaaacgggcgaaatcgtctatttcaaatccaaggcaaccattctggcaactggtggcgctggtcgtatttaccaatccacaaccaatgctcatatcaatactggtgatggtgttggtatggcgctgcgtgccggcgttcctgtacaagatatggaaatgtggcaattccacccaacgggtattgcgggtgccggcgttctggtaacagagggctgccgtggtgaaggtggttatctgctgaataaagatggtgaacgcttcatggagcgttacgcacccaatgctaaagatctggcaggtcgtgatgtggttgcacgttccatcatgatcgaaatccgtgaaggccgtggctgtgaaggtccttggggacctcatgcgaaactgaaactggatcatctggggaaagacgtattggaaacccgtctgccgggcattcttgaattatcccgtacctttgctcacgttgatccggtgaaagagccgatcccggttattccaacctgtcactatatgatgggagggattccaaccaagatcacgggtcaagcgctgactgtcaacgaaaaaggtgaagatgtcatcattccaggcttgttcgctgtaggtgaaattgcctgtgtatctgtccacggagcaaaccgtctggggggtaactcattgctcgacctggtggtattcggccgttctgctggcttgcacctgaaagagtgcctgatggagcagggaaccagccgtgacgccagtgagtctgatgttgatgcagcactacaacgcctgaaccgctggaataatacccgttctggtgaagatccggttgaaatccgtaaggcactgcaagcgtgcatgcaaaacaacttctcggtcttccgtgaaggtgatgcgatggcaaaagggctggaagagctgaaagtgattcgtgaacgtctgcaaaatgcccgtctggatgatacttcatcagaattcaatacccagcgcatcgaatgtctggaactggacaacctgatggaaaccgcatactcgaccgcagtgtctgcgaattatcgtacagaaagccgtggtgctcacagtcgttttgactacccagagcgtgacgatgcgaactggctgtgccatagcttgtatttaccgcgaactgagagcatgactcggcgtgaagtaaacatgcagcctacgctgcgtgaagctttcccgccgaaagtgcgttcttac

SEQ ID NO: 44874 - DNA, 1281 bp, Xenorhabdus nematophilus
atggctgataaaaaagctacgttgaccataagtggtgcagctgctatcgaactagacgtactaacgccgaccctaggttctgaagtgattgacgttcgtaccctcggctcaaagagtttctatacctacgatcctggctttacttctacggcctcctgtgaatcaaaaatcacctatattgatggcgacgaaggcattttgctgcaccgtggtttcccgatcgatcagctcgcaacgggatcaaactatctggaagtctgttatatcctgctgtatggcgaaccacctacgcctgaagagtatgaaacattcaaaaaaacggtgattcgtcatacgatgatccacgaacagatcacccgtctgttccacggtttccgccgtgattctcaccctatggccgtactttgtggtgtgacaggtgcactggctgccttctaccatgatgcactggatgtccataaccctcaccaccgtgaaattaccgcttaccgtctgctgtccaaaatgccaaccgtagcggcaatgtgttacaaatattccatcgggcagcctttcgtttacccacgtaacgatctttcttatgcagccaatttcctgcacatgatgttctctacaccttgtgaagaatataaagtcaatccagtgctagaacgtgccatggatcgcattttcattctgcatgcggatcacgaacagaatgcttcaacttcaacggtacgtaccgcaggttcttctggtgctaacccattcgcctgtattgcagcgggcatcgcatccctgtgggggcctgcgcacggtggcgcaaacgaagcctgtctgcgtatgctggaagaaatccagactgtcaaacatattcctgaatttatcgctcgtgccaaagataaaaacgattctttccgcttgatgggctttggtcatcgcgtttataaaaactatgatccacgcgcgacagtaatgcgtgaaacctgccatgaagtactgaatgaacttggcctgaatgacagcctgctggaagtcgcgatggagttggaacgtatcgccctgaatgatccgtacttcattgagaagaaactgtacccgaatgtcgatttctattccggtattatcctgaaagcaatgggtatcccatcctccatgtttaccgtgattttcgccattgcccgtactattggctggattgcacactggactgaaatgcacgatgaaggcttgagaatcgctcgtccacgccagctttatactggccatacccaacgtgatttcaaaagtcagttagagaaa

SEQ ID NO: 44875 - DNA, 2056 bp, Xenorhabdus nematophilus
atgaaagacaaacatcaagcattatttgaacccgctttaatacgccatgcacttatcgacgcagtgaaaaaatgccatcccgctatccaatggcgtagatcccgtcatgtttgtcgtctatctgggaagctgcctgaccaccgtgttgtggcttgggatgttaacagaacagcttaccggtaatgcactttttaccggctccattgctttatggttatggttcactgtactgttcgctaattttgccgaagcactggcagaaggccgcagccaagcccaagcgtccagtctgaaaggcgtaaaaaaaaccacgtgggcgaccagactggcttccgccagccatgatgcagcaaaggaaaaagtcacttcagaccatctacgcaagggcgatattgtgttggtggaagtgggcgaaattatcccctgtgatggtgaagttcttgaaggaggggcttccgttgatgaaagcgccattacaggagaatcggctcccgtgatccgcgaatctggcggtgattttgcttcagtcactggcgggacacgggttttatcggattggctgattatcgaatgttcggtcaatccgggagaaacctttttagacagaatgatttcgatggtcgaaggtgccaaacggcgcaaaactcccaacgaaattgctctcactattttgctcacggcactgactattattttcctgctgtcctgtatcagtctactgcccttttccttgttcagcgttcaaaccaatcaatcaggcgatcccatcagcatcaccgtgctggttgccctgttagtctgcctgatccccaccaccatcggcggattactttcagccattggcgttgcaggtatgagccgcatgttgggtgccaatgtcattgctaccagtgggcgcgcgattgaagctgccggcgatgtggatgttttattactggataagacgggaaccattactctcggtaatcgtcaggcatcacagtttttacctgcaccgggtgtaaccgaagaacaactggccgatgctgcccaactttcctcactcgctgacaaaacaccggaaggacgcagcatcatgattttggcaaaacagcgcttcaatatgcgcgaacgcgatcttcgcgcactcaacgcgacattcattcctttctcagccatgacgcgcatgagcggcgtcaatataggcacccgtatgatccgcaaaggcgcagtagatgccatccgacgttatgttgaggccaatcacaatcaatttcccgatgccattgatctattggtgcagcaggtcgccagtaaaggtgcaacaccattggtcgttgcggagaatcagcgtgttttgggtgttgtcgctctgaaagatattgtgaaaggcggcatcaaagagcgtttcagtgaaatgcgcagaatgggaatcaaaacggtgatgattacaggtgacaatcacctaaccgccgctgcaattgcagcagaagccggtgttgatgattttctggcagaagctacgcccgaagcgaagctcgccctgatccggcaatatcagtctgaaggatgtctggttgctatgaccggtgacgggacaaacgacgcccctgcgctggctcaggcagatgttgccgttgccatgaattcagggacacaagccgcaaaagaagcgggaaatatggtggatttggactcgaatcctactaaattgattgaagtggtgcatatcggcaaacagatgctgatgacccgtggctccttgaccacatttagcatcgccaatgacattgctaaatattttgccatcattcccgccgcatttgcggtcacttatccccagcttaatgccctgaacatcatgcatcttcattcaccggaatcggcggtgctgtctgccgttattttcaacgcgataatcattatcgttctgcttcctttggcgctaaaaggcgtcagttaccgcgcgatgaacgcactgtcactcttgcgccgaaatctttggctatacggccttggtgggttgctcatcccctttgtcggcatcaagctcatcgacatgttgctcactgttctg

SEQ ID NO: 44876 - DNA, 2721 bp, Xenorhabdus nematophilus
gcttcagcacattgggtcgataaacggacgctattatggccagagggagcagataagcctcatgtccgtttatattacaatcggtataacaaagtagaggtgaatgacgaaggaaactttactgatagttatctggtgctgacaccgacgactctgagcaaaaagacagccgaaagattccctcatttagcggagctgcccgcattccaattgccagaaaacacggatgttgatcggctaatcaccggtgaactggtggcattggcgaccaatgaagaaggcttgttattatcggcgactcaagtacaaattgccggtgtgttggacgaccgctttgccggcactgcggaaacactggaatatggcgcactgataaacgacacagaggtgactttccgcttgtgggcgccgacggctcaaaatgtgggtctggttatttataatgaaaataaacaggccatcgccaatcatataatgaatcgtgatgcggcgagtggctcttggtcatggcagggtgatacaaatttgatcggggcttactaccgttatgctttaaccgtgtatcatccgtattcccgcaaggtggaacgctatgaggttaccgatccctattctcacagcctgtctacgaattcggaatatagccaggtcatcaatctggatgacgaagcactgaagccacaaaactgggatgatctgagcatgccgcatccgcagaagacaccggcagatattgcacgtatgaccctctatgaagcgcatatccgggatctctctgttgcggacaacacagtgccacaagcttggcgtggtaaatatctggctctcacggctaacagcagcgatatgttcaaacatctaaaggcactgagtcaggccggaatgacccatatagagctgttgcctgtgtttgatatcgcttctattgatgaatttagtcgtaatgtggctgatcttaatcagtccttcaatcggttatgtcaagtcaacacaacggtgaaaaatagccgcttcgctgattattgcaatcgttccatgaccgtgagggaagtattgcaggcgttacaacgcggtgatagtgccagcaatccgcaagtacaagagttaaataaaatgcttgcagaaactgattcttataactggggctacgatccgttccattactcagtaccggaaggctcttatgccactcatgcagaaggctcagtacgtattaaagagtttcgtaccatggttcaggccatcaagcagcaactggggatgaatgtgatcatggacgtcgcgtataaccataccaatgccgccggccccacacaccgaacttcagtactggataaagtcgtgccctggtattatcaccgtttggatgaaattacgggtaatgttgaaaataatacctgttgctctgataccgcaccagaacaccggatgtttgccaagctcatcgaagactcattagtgacttgggttaagcactacaaaatagatgcattccgatttgatttaatgggctaccatcctaaggctcagattgtctcggcactggcaaaagtccgtgcaattaatccatcggtctattttttcggagagggctggaattccgggcaggatgatcgatttgagacggcttcacagattaatcttaaaggctccggtatcggtactttctcggatcgattgcgagatgcagtacgcggtggtgggccgtttgattctgctgataatattcgtattaatcagggaatgggcaacggtgcgggaacattacctaacgaaattgcccgattagatgcgaatgaagctcgtcatttggcggatctgattcgtctagggatggcgggtaatctggctgactttgccatgatcgataaagatgggaaagtgaaagcgggtcgggaaattaactacaaaggtgtcgctgcgggttatgccgctgatcccattgaagtgattaattatgtttccaagcacgataaccagacattatgggacatcatcagctacaaagcggcatacgaggcagatctggcgacaaggctccgtatgcaggcaatctctctttccacagtactcctcgggcaagggctggctttcgatcagcaagggtcggaattactgcgctcaaaatcgtttactcgtgattcttataatgcaggggattggtttaaccgtgtcagttatacctacaaagataacaactatgatgtaggtatgccggggaaacgggatgacggtggaaattatgcgctgattcatcgagtgaaaaatcaggtgaaaaaaccaggccaaagtgagttattacagatgatggctttctatcaggaactgttacgtctgcgtcaattttcacccttgatgacccttggtaagggggaatccgtcaagcaacgtatcgattttcgtaatgtggggccacatcagcaactcggattactggtcatgactattgatgatggtaacactaccgatgatgatcgtgatttgcggtttgatggtttagtggtggtgattaatgctgcgtcaaaatccgtcactgtaagagatctcaatactcatggtttgaaattaaatgatattcaaagcagattagggaatgcatctttagctgccgggatcaaaataaccgaagatggcatggtgacaatgccagcttggtcagccgcggtgctggttttaccacagaaaggtatccgaggtacgggtttacctgtccgtagaaag

SEQ ID NO: 44877 - DNA, 1629 bp, Xenorhabdus nematophilus
gtggcaattcatccaagagccgggcagcctgcccagcagcatgatttaatcaatattgcacagctcacatcccagtattataccctacagccccatcccgaaaatccggctcatcaggtcaagtttggtacttccggtcatcgtggcagttctggccgcaacagttttaatgaagcgcatattctggcaatttctcaggcgatagtggaagtccgtgcacagcaggggattactggtccatgctatgtaggcaaagatacccacgcactttctgaagcggcctttatttctgtgctggaagtcctgatcgcgaatggtgtggacgtgattgtgcaggaaaataatggttttacgccgactcctgctatttcccatgctattttgtgctacaaccgtcaggggaaaaaccgggcggatgggattgtgattacgccatcccataatccgccagaagatggcggtattaaatataaccctcctaatggtgggcctgccgatactgatttaacttccatcattgaaaagcgtgccaacgcattactggcgaatgacctgaacggggttaagcgtctgccctatgagcgggtactgaaaagtgaatatctgcatccacagaatctggttgatccttatgtgacatccttgggggatgttgtggatatggcggccatacagcaggcagggctgaaaatcggtattgatccgctgggtggttcgggtattgcttattggcagcggatcggtgagtactacaatctcgatttaacgctggtcaatgataaggtcgatcagacattccgtttcatgacgctggatcatgacggtgtgatccgtatggattgctcatcacgctgggcgatggccggtctgctggagctgcgcggtaagtttgatttagcttttgctaatgaccctgattacgaccgccacgggattattactccagtcggtttgatgaatcccaaccattatctggcaacggctgtggattatttattccgccatcgtccacaatggtctgaaaaagttgctgtgggtaaaactttagtttccagtgccatgatcgatcgcgtagtcgcggatctgggacgcgagctgctggaagtgcctgtcggctttaaatggttcgtcgatgggttatatcgaggcgagctgggctttggtggtgaagagagtgctggcgcctccttcctgcgttttgacggtacgccgtggtcaacggataaagatggtattatcctctgcctgttagcggcggaaatgacggcgactaccggagagaatccgcagcagcgctatgacaaactggctgcacgtttcggtacgccaagttatagccgtattcaggctccggcgagccatcagcagaaagccctgctgtccaaactgtcaccggaaatggtcaaggcgaacacactggccggcgatcccatcactgcacgcctgactaccgcttccggtaatggtgcttctattggtggcttaaaggtgatgagcgacaacggctggtttgcagctcgcccttcaggtacagaagaagcctacaaaatttactgtgaaagtttcctcggcgcagaacatcgcgagaagattgagcaggaagcgctggaaattgtcaatcaggtgttt

SEQ ID NO: 44878 - DNA, 786 bp, Xenorhabdus nematophilus
atgggtttcatgaccggcaagcgcattctcattactggcgtagccagcaaactgtctatcgcttatggaattgccaaggcaatgcacgatcaaggagctgagctggcttttacctaccagaatgacaagttaaaacttcgtgtcgaagaattcgcggcatcattggattcgaacatcattctgccatgtgatgtggctgaagatgaaagtattgacgcattattcgctgaactaggtaaagtatggcctaagtttgacggctttgttcactctattggttatgctcctgctgagcagcttgatggtgattatgttaatgccgtcaaccgtgaaggtttcaaaattgcacatgatatcagtgcatacagcttcgtcgctatggcgaaatcatgccgcaacatgttgaatcctaactcagcccttctcactctgagctatctgggtgcagaacgtgcaatccctaattacaacgtaatgggtctggcaaaagcttctctggaagctaacgtgcgttatatggcgaatgcaatgggtgctgaaggtgttcgtgttaacggtatctccgcaggcccaattcgtacactggcagcatctggcatcaaagatttccgcaagatgctggcacactgcgaagcggtaacacctattcgccgtactgtaacaacagaagatgtaggtaatgcagcagcattcctgtgttctgatcttgctggtggtgtgacaggcgaaattatgcatgtcgatggcggtttcagtatcgctgccatgaatgagctggaattgaaa

SEQ ID NO: 44879 - DNA, 618 bp, Xenorhabdus nematophilus
aacgaaagccaacatgtttccacacaggatgcattactgggtagggcaatcccattaactgtatcaccctaccatgtcatcacacagcattcgataaacgacattcctgaaaacatggagatagcctatataggaatggggtgtttctggggagttgagcgcctgttctggcaacaggaaggtatctacacgacctctgtgggttacagtggtggtactacgccaaatccaacttatgaagaagtctgcacagggttaaccggacatgccgaagtagtcaggatcgtatttgatccaaccaaaatcacttatgggcagttattgacgcttttctgggaaaatcacgatcccgcccaaggtatgcgtcaacatggtgatatcggtacacagtaccgctctgccatttatactatttcatctcaacaatatgagcaggcactcgctacccgcgaacaattccagcaagcgatgaatgaaaatggcgaccagcgcacaatcaccacggagatccacgcagcgaagccattctattttgcggaagattatcaccagcagtatctcttcaaaaatcctgaagggtattgtggactcggtggtattggggtatgcctcctccct

SEQ ID NO: 44880 - DNA, 996 bp, Xenorhabdus nematophilus
atgaaaacattaggcgaattcatcgtcgagaaacagcaagactttcctcatgctacgggtgaactgaccgcactgctttctgccatcaaactgggtgccaaaatcattcatcgggacatcaataaagctggtctggtggatattttaggtaccagcggcgtatcgaatgttcagggcgaagttcagatgaagctggatttgtatgccaatgaaaaactgaaggctgcattgaaagcgcgcggtgaagtagcaggtattgcttctgaagaagaagatgagatcgttgtctttgatggcgaccgtgcagaaaatgcgaagtatgttgttttgatggacccactggatggttcttcgaatattgatgtaaacgtttccgtcgggactattttctcaatttaccatagaattacacctattgggcagccagttaccgaagacgatttcctgcaaccgggaaatcgtcaggttgcggcgggttatgtggtctatggctcatccactatgttggtttacaccacaggttacggagttcatacattcacttacgatccctcactcggcgtattctgcctgactcatgaaaaagttcaattccctgccaaaggcaatatgtactccatcaacgaaggaaactacatcaaattcccgatgggcgtgaaaaagtacatcaaatattgccaagagcaagacgaagccacccagcgcccttacaccacccgttatattggctcgctggttgcagatttccaccgcaacctgctgaaaggcggcatctatatttatccaagcaccgcaagtaatccaacaggaaaattgcgtctgctgtatgaatgcaacccgattgcttttttggctgagcaggctggcggcaaggccagtgatggcaaaaaccgaattctagatatcacaccaacccaactgcatcagcgtgttcctttcttcgtgggaacaaaatcaatggtggaaaaagccgaaagctttatggctgaatttcca

SEQ ID NO: 44881 - DNA, 933 bp, Xenorhabdus nematophilus
atgaaagttgcagttctcggtgcagccggtggtattggtcaggcacttgcccttctactcaagacccagcttccttcaggttcagaactttccttgtatgacattgctccggtgactccaggtgtggcagccgatcttagtcatatcccaacggaagtgaaagtcactggttttgctggtgaagatgcaacccctgcattggtaggcgcagatgttgtattaatctctgcaggtgtggcgcgtaaaccaggcatggatcgttcagatctgttcaatatcaatgcgggtatcatccgtaatctggttcagcaggtagctaaggcttgtccaaaagcattaatcggtattatcacgaaccctgtgaatactactgtggcgatagcggctgaggttctgaaaaaagaaggtgtttacgacagaaaccgtctgttcggtattacaacgctggatatcattcgttccaatacttttgttgcagaactgaaaggtaagaactctgaggaattggaagtgcctgttattggtgggcactctggtgtgactatcctgccattgctgtcgcaaattcagggcgtcagcttcactgatgaagaagttgaagcgttaaccaaacgtattcagaacgcaggtactgaagtggttgaagcgaaagcaggtggcggatctgcaactctgtctatggggcaggcagcggcacgtctgggtctttctttgatccgtggcttgcagggtgaaagcaatgtcatcgagtgcagttatgtagaaggtgatggtaaatatgcccgtttcttcgctcagcctgttcgtttaggtaaaaatggtatcgaagaacgtttagatatcggcaaacttagcgattttgaacagaagtcactggatagtatgttgggcgttctcaaaaaagatatcgaattaggcgagaaatttattaac

SEQ ID NO: 44882 - DNA, 921 bp, Xenorhabdus nematophilus
gcaatggttaatgaaaccattattaatcaattaaattctgatgttgcgctgatcaaccaacttggctactacattatcagcggcggtggtaagcgtattcgcccaatgattgcggtactggccggaaaagcacttcattgtgaaaaagaaaaacatatcaaagttgccgccttaatcgaatttattcacactgcaacgctattgcatgacgatgttgtcgatgaatccgacatgcgccgaggcaaagcgacagccaacgctatgtatggcaatgcggccagtgttctggttggtgatttcatctacacccgatcgtttcagatgatgactgatctcgattctatgcgggtactgaaattgatgtccgacgccacgaatgtcattgccgaaggtgaggtgatgcagttgatgaactgcaatgatcctgatacctcagaagatgattatatgcgtgtgatttacagtaaaaccgctcgcctgtttgaggtagcggcacactctgcggccattttatccggtgcgacaccagagcaggaagctgcactgcgtgactatggccgttatcttggcacggcgtttcaattgattgatgatctgctggattacgattcagatgacagcacactcggtaaaaacacaggggacgacttaaacgaaggcaaacctacactgccccttctgcatgccatgcatcatggagtcccggagcagtctgcactgatacgcagtgccattgagcaaggcaatggccgccatttgttagataccgtactagcaacaatgaaacagtgtggttcacttaagtacacccgccaacgggcggaagaagaagcagataaagccatttcagcgttacaagtactggatgagtctccatataaggcggcccttgtgggattagcccatgtcgcggtacagcga

SEQ ID NO: 44883 - DNA, 606 bp, Xenorhabdus nematophilus
atgatagacctatattatgctccaacgccaaacggctataaaatatcattgttccttgaagaagccggcctaccttacactatctacccaatcaatatcggcaccggagaacaattcaaacccgaatttctggccatttcgcctaataataaaattccggcaattgttgatcaccaacccgccgatggaggagaacccatttccatctttgagtcaggcgctattctactctatctggcgaataaaaccggtcaactgttaagcaaggatgtacgtgaacgcaatcagcaattgcaatggctattctggcaggttgccggctttggccctatgctcggccaaaatcaccatttcaatcattacgcttctgaagtcgtaccttatgccattaatcgctatatggaagaatcacggcgtttagtcaatgttctgaatacccaactggaaaaaacgccgtatcttggcggaaatgagtacagcatcgccgatatcgctacctatccgtgggctagatgtcatgaacatcaaaaaattaatctgaatgattaccctgcggttgaaaaatggcttaagaaaattgaacaacgccctgcaacacaagccgca

SEQ ID NO: 44884 - DNA, 525 bp, Xenorhabdus nematophilus
atggtggaagagaaatcagcaggtattgagtggattgatatcgtcaatgaaggcaatgaagtgatcgcgcaggcgactcggcagcagatgcgtagccaaaacttgaggcatcgtgcgacttacattgttgtgcatgatggtatgggcaaaattctggttcagcatcgtacagaaacgaaagatttttaccctggaagattggatgcaacggccggtggcgtggtcatggtgggagaaaacatgcttgattctgcccgccgggaagcagaagaagagctggggatcgcgggtgtgccttttgctgaacatggtatcttctattatgaagaaaaaacctgccggacatggggagggttattcagttgtgtcagccacgggccgtttgcattacaggaagaagaagtctcggctgtttactggttgtcgccagaagaaattactgcccgttgtgatgaatttacgccggattctctgaaagccctgtctttgtggctagcgcgtaacagacagagggaactgcctgaa

SEQ ID NO: 44885 - DNA, 1281 bp, Xenorhabdus nematophilus
ttggataattcaaaggacttttataaaaaatgttgggagctgatgcctggtggtacgcactacaactttggtgatcctgagcgcccgctggtgatccctttcaaccgtgggcgcaattcccgtgtatgggatttggatggtaatgaacatcttgatctgttctgtaaatttggtgcattactggttggacaccacaatgaggcttataaccaatccctgatcgaatatatgggtaaagtgacttcagttgatacctgcgatctggaagtgggtgtctgcgaaacgttggttaaacatattccctgtgcagaaatggtgcgtttctgcctgagcggaacagaagcagtacagaatgcgttgcgtcttgcccgtgcctttacgggcaaaaatcgctttattcgcttccacggccattaccacggtaacgccgacaatatcatgggctggcgtaaaaagcaggatctcacttaccccgtaccagagcagttcaacggggacctgctggatacactgggacgtgatcccaaaatcatggtagaccaaacgttcatgttgccctggaatgacattgatgttctgacggcgactattgaacgttatcacaatgaaatcggcgctgttctgatggaacctctctgcatcaatggtggcgggattttcccggaagaaggttatctggaaaaaaccaaagcattatgtgaaaaacataacattgtgttgatttttgatgaaatcatcacgggtgttcgtttaggactggggggagcacaaaaaatactgggcgtgacaccacatctggcgaccttcgggaaagctcttggcggcggctccatgccaatctctgctattgtcggtcgtagtgacatcatgaacctgtacacccgtggaaaagtgattcatgcaggcactttcaacggttacccactgggtctggcagcaattcagacgacctttaatttgattgaacaagatcccggctgctatgaccgtatggggaatatcatgcgtcagatctccgacgtgttcgtgaaagcggccaaagcggttgacctgccactcgtggtacagggaatgccaaccgcgctggtttatcactcccagagcatccccgtcagttctacggaaggctacagcgataaagtcaaattctgcgacatcatcattcgtgaaatatccaaacgctatggcattcagttctcaccattgtctcgcatgtactctaacctattgatgtcacaggatgacgtgcgtttcttcgaagagaggatctttgatgcgatg

SEQ ID NO: 44886 - DNA, 2112 bp, Xenorhabdus nematophilus
gatcacaccaataatcacgcactggattgtgtcgcctatctgggaacacaatttcataaggttgcctccgtcagacaattgcatcatgcgctgggtctggattccctgacgctgacagactggcagctacgcgaagctatcgatgccgtaggcctgcacagcaaatttgatcgtctgacagccgataccgcagccacgttgcctttaccggcactgattgaattgggtcaatgctggtgggtgctgctcgaagtcagcccagatcagtttaccgtgctcaatcccatcacggaaaaacaagaaatacgcccattgcacggcacacaggcgacacctgacgaagctaaacacagtgagtataaaatcctgctggtggcagataaatcgctgaccaaacagcaagtcaaattcggcttgagctggttttatccttcgattttcaggcagaaaaatcagttgcgggatattttcctgttcgccattgtgctgcaactttttgcgctggcatctcctttgctgtttgaaaatgtcatcgacaaagtactggtcggacgcagcttatccagcctgcatgttcttggtctggcgatgctggcgctggccgtggcagaacccctgtacggttttctgcgcaataccgtgttcggacatatggcaagccagatcaacgcggaactctccggcaggctttatcgccatctggtgggattacccctgccctatttcaagcaacgccaaaccggacaaattatcgcgcgcgtcagagaaatggcacaaatccgccaatttctgaccggctccaccctgatgttgctactcgacctgatcttcatcatcctgtttcttggcgtcatgttccattattccactctattgaccgggatcgtaatcagttcgctggcactctatttcctgctttggatcgctattggacctctcatccgacgcaaagtagaaaccgaatatgaagccgatgcccatgccaccagtttcctgacggaatccgtcatgggcatcgaaactatcaagaccaccgcaacagaaaaacgctttctgcgccagtggcaaaaagtgttaagccagcaattgatccggcgtttttccgcccagaaaagtgggcttgcggccggacaggggatcgcgttgatccagaaaatcgtagcggcattactgctatggtggggggtcagaagcgttcttaacggcgaattatcccccggagagttaattgccttcaatatgctggcaggacacgtcacccagccgatcttacggctggcgcaagtctggcaggatttccagcatactttgatcgctttgcgacgggtcggcgatattcttgatgagccaatggagagtagcaaacaggggctggcagcttcccctgaacttgccggccagattgagttcaggaatattcgcttccgctatcacgcagatacgcccgaagtactggcaaatctgtcactgaccatcaaagcgggcgaatttattggcataacggggccatcgggttcaggtaaaagtaccctgacccggttgttacagcgcctgtatgtgccgcagcatggtcaggttctggtcgatggtatggatttggcgatcgccgatcccgtatcactccgacgtaacatgagcgtggtattgcaggaaagcatactgttttccggcagcattgcggacaatatccgtctgtgtaaacccaatgccagcgatgaagaagtctaccgggcggcgactttggcgggtgcaactgacttcatcaatgaatttccgcataaatttgcccattctgtcggggagaaaggaagcaatctttccggtgggcaacggcagcgtatcgcattggcaagagccttgttgaatgatcccaaaatcctgattctggatgaagcgacttccgcgctggattatgaatccgaggcagccattatgagcaatctggacgagatccgccacaaccggacggttatcagcattgcccatcggctgaatacgatccgccatgcagataaaatttttgttttagatcaaggaacaatcgtcgaatctggctcccatgatgacctattgcaacaaaacggactgtatgcacaactttggcatcaacaa

SEQ ID NO: 44887 - DNA, 474 bp, Xenorhabdus nematophilus
atcagcttgattgctgcgatggctatggatcgagttattggtatggaaaatgccatgccgtggactctgccaggtgatttagcctggttcaaacgcaatacactcggaaaatcggttgtgatggggagggtaacttacgaatcgataggacgccctttaccgggacgcttgaatatcgtgataagcagtcagccagcacgtgatgatagtgtcacttgggttcgcactatcgaagaggctttggccgcagcgggtgatgttgatgaaattatggtaatggggggaggcaaaatttatgagcagtttattcctctggctcaccgtatgtatctgactcacattgatgcggaagtcattggtgacacccatttccccgattacgcacccgatgagtggaattcagtctttaccgaatatcatgatgcagacgagcacaactcacatggctattgcttcgaaattctagaacgccgt

SEQ ID NO: 44888 - DNA, 966 bp, Xenorhabdus nematophilus
atggctaacacttttgccttgatcttaacgttagcaacgttaatcactggtattatctggtgtatagatcggtttaaattcgcccctgaacgcaggaaaaaacttgctcagattcaggaacaaacagcaggtgcggaatctcaggaagctttggctacagagattaacaaaccttcatgggttgagacatttgcatctgtctttcctgtgttagccattgttttgcttctgcgttcttttgtttatgaacctttccagatcccttcaggttcaatgatgccaacgctgctgattggggatttcatcctagttgaaaaattcgcctatggtctgaaagatccaattacacagacaactttgattaaaacaggtaagcctaagcgtggagatattgcagtttttaaatatcctgttaatccgagtctggattttgtaaagcgtgtcattggcttgcctggagataaaattgtttacgatgacataaataaagaacttcaggtttttcctggttgtggttggaatacggtgtgtaagaatttacctgttacttatcgagatatgttcccaagtgaatggactatcaaagaggatattactcctgaaggcgcacgtgtgagaggagtttatccaattcctatcgaagaacaactggggtcaaacagtattcgccagggggaacgggttgagcatttaggtaatgtgtcacaccacattttgattgtccctggagcatcaaatatcccgtttttcagtcagccaggattgccacttggaacttgggttgtccctgaaggccattatttcatgatgggcgataaccgtgacaatagttcggatagccggatatgggggtttgtgccggagaaaaatctggtagggcgagcaacagccatctggataagttttgaaaaacaggaaggcgagtggcctactggcgtacgcctgagtcgaattggaagaattcac

SEQ ID NO: 44889 - DNA, 1725 bp, Xenorhabdus nematophilus
atgatttcaggcatcttagtatcaccaggcattgctttcggcaaggcattattgctgaaagaagaccccatcattatcaatcagaaaaaaattactacagaacaaaccgaacaagaaatttcccgttttaaacaaggtcgagacaagtcttccgtacagttagaaataattagaaaaacagccgaaaaaaatttaggtgcagaaaaggctgagatcttcgaaggccatattatgttgctggaagacgaagagctggaacaggaaattgttaccctgattaagaaaaatctggcaacagcagatgccgctgtttattccgttattgaagatcaggctaaggcactggaagaactagacgatgaatatttgaaagaacgtgcggccgatgttcgcgatattggtaaacgcctgctgaaaaatattctgggtatgccgattatcgatttaggcactattgaagaagaagctatcctcattgccaatgatttaactccatcggaaaccgcacaactcaatctggacaaagtgctaggtttcatcactgatttgggtggccgaacatcccatacctcgattatggcccgctctctcgaattacccgcaatagtcggtactaccaatgcaacaactcaaatcaaaaatggcagttacctgattctggatgcagttaataaccagatttatgtgaacccgtctaatgctgaaatcgatcaactgaaaaaggcaaaacacgagtatctgtcagaaaaaacagaactggcaaaactgaaagatttacctgctattacactggatggccatcaagttgaagtttgtgccaatatcggtacagttcgtgatgtcatgggtgcagagcgcaatggtgccgaaggtgtaggactataccgcaccgaattcctgtttatggatcgcgatacgctgcctactgaagacgagcagtttgaggcatataaagcggttgcagaagccgttggcaaccaagccatcattatccgtaccatggatatcggcggtgataaagatttgccttacatgaacctgccaaaagaagagaacccattccttggctggcgtgcaattcggatttgccttgatcgtaaagaaatcttacattctcaattgcgtgctatcctgcgagcctctgcatttggtaaactccgcattatgttcccaatgattatttcagttgaggaaattagggagctgaaagcagaactggcgttgctcaaaaaccagttacgtgatgaagacaaagcatttgatgaatctattgaagtcggcatcatggtggaaacacccgctgctgcaaccattgctcatcatcttgcaaaagaagttgacttttttagtattgggacaaacgatctaactcagtatactcttgcggtagaccgtggtaatgagctgatttctcatctttataacccaatgtcacccgcagtgttgagcctcatcaagcaggttattgatgcctcacacgcagaaggtaaatggacgggaatgtgtggagagctagctggtgatgaacgtgccgcgctgttactcttaggcatgggattggatgagttcagcatgagtgcgatatcaattccacgcatcaagaaaatcattcgtaatgccaattacgatgatgcgaaagcgctggcagagcaagccttatctcagccgactgcaaaggaattgatggatttggttgacacctttaccagagaaaaaacactctgc

SEQ ID NO: 44890 - DNA, 1394 bp, Xenorhabdus nematophilus
tttgcaccaagtcctactggctatctcacgttggtggtgcgcgtactgctctttattcctggttatacagtcgccacaacaaaggtgaatttgtactgcgcattgaagacaccgatctggagcgttccactcaagaagccatcgatgcaattatggacggaatgaactggttaaatctgaattgggatgaaggcccttattatcagaccaaacgttttgaccgttataaccacgttattgatgaaatgctggagcaaggtactgcttaccgctgctactgttccaaagagcatttggaacaactgcgcgaaacccagatggcgaatggcgaaaagccacgttatgatggctgctgccgtgatagcgaatgccagcacagccatgatgagccacacgttgtgcgtttccgcaatcctcaggaaggttccgtcatttttaatgacagcatccgtggcccaatcgagttcagcaaccaggagctggacgatttgatcattcgccgtaccgacggagcgccaacttataatttctgtgttgtaattgatgactgggatatggagattacgcacgttgtacgtggtgaagaccacatcaataacacgccacgccagattaatattctgaaagccctcggtgctcctgttccagaatatgcccacgtttccatgatcctgggtgatgatggtaaaaaactgtccaagcgtcatggcgcagtcagtgtgatgcaataccgtgatgatggctatctgccggaagcgctgttgaactatctggttcgtctgggttggtcacatggcgatcaggaaattttcagcgttgaagaaatggtcaatctgttcagccttgatgccatcagcaaatcagccagtgcattcaatactgaaaagctgcaatggttgaaccatcactacatcaataccctgccagctgaacaagtcgcggtgcatttggcatggcacattgagcagcagggtatcgatacccgtactggcccagaactggttgctctgatcaaactactgggtgaacgctgcaagacactaaaagaaatggcaggttcctgccgctacttctacgaagaatttgcagaatttgatgctgatgccgcgaagaaacatctgcgccctgttgcccgtcaaccactggaagttgctcgagcgaaactggctgctgtcactgaatggacaccagaaaatatccatcatgccattcaggcgactgctgatgaactggaagttggtatgggtaaagtcggtatgccactgcgtgttgcagtcaccggtgccggccaatctccaagtgttgatgtcactattcatgccatcaatcaagcacgttcattgtctcgcattgataaagcactggcctatattacccagcgtgaagtgcaataa

SEQ ID NO: 44891 - DNA, 1563 bp, Xenorhabdus nematophilus
tcagggaagtatctgatggcgcttgatgcaggaactggcagtatccgtgcagtaatatttgatctcgaaggaaatcaggttgccgttggacaggctgagtggatacaccagcctgtaccgaatgtctcaggttcaatggaattcgacctgaaaaccaactggcaactggcgtgtcaatgtattcgccaggcactgcaaaaggcggaactgcctgccagtgcgattcagggcgttgccgcctgctcaatgcgggaaggcattgtcctgtataatcgcagtggcgatcccatctgggcctgtgccaacgtcgatgcccgctctggccatgaagtcagcgaattgaaggagctttacgacaatacctttgagtatgatgtttaccgttactccggccagacactggcgctgggagcgatgccccgtctgctgtggcttgcgcatcatcgcgcggatatctatcggcaggccagtacactcactatgatcagcgactggctggcttatatgctcagtggcgagctggcggttgatccctccaacgctggtacaacgggaatgctggatttagtcagccgcaactggcgccctaacctattggaaatggccggactgcgttccgatatcctttcccccgtcaaagaaaccggcaccctgctcggttacatcaccgaaaaagcggcagcagattgcgggctaaacagcggcacgcccgtcattatgggcggcggcgatgtccagctcggctgcctcggcattggtgtcgtcaaacccgctcagaccgccgtactcggtggcactttctggcagcaggtcgtcaacctgccagctccgatcaccgatcccaacatgaacatccgcatcaacccgcatgtcattcccggcatggcacaggcggaatccatcagctttttcaccggcctgaccatgcgctggttccgcgatgccttctgtgcggaagaaaaactaatggcggaacggctgggtgttgatgcttacagcctgatggaagacatggcggcacgcgttcccgcaggagcttatggcatcatgccgattttttcagacgtaatgcgctttaaatcgtggtatcacgcagctccttccttcctcaacctgtcgattgatccggaaaaatgcaacaaagcgacgctatttagagcactggaggaaaatgcggccattgtctcggcctgtaatcttgatttgattgcaggtttctctggagtgaagccagactcgctggtctttgccggcggtggttccaagggcaaactctggtgccagatcctcgccgacgtaacaggattacccgtgcgggttcctgtggttaaggaagcaaccgcattgggctgtgcaattgcggccggtgtgggagtttcattgtatgactcactgcctgaaaccggagaaaaactggtgcgctgggagcgggaatatcagccggatttgacacattgggatatttaccaaaaagcgaaaaaaaattggcaggcggtgtacgcagaccaacttcatctggtagatgacgggctgacaacatcgctgtggaaagccccgggattg

SEQ ID NO: 44892 - DNA, 518 bp, Xenorhabdus nematophilus
tttggagttaacgcaggccgtgtcgttaatactatgattcttatatagacaggaagagtatttagatgagtgataatcgtactctgcaaattgaagagattttggatttgctacctcaccgctacccgtttttgctggtagaccgtgttttggattttgaggaaggtaaatttctacgcgcagtcaaaaatgtatcatttaatgaaccattctttcaggggcattttccgggtaagccaatttttccaggcgtcctgatccttgaagcaatggctcaggcaaccggaattctggcattcaaaagcgttggctcgctggctccgggtgagttgtattactttgccgctatcgatggcgctcgtttcaagcgtccggttctgccaggtgatcaaatggttctggaagttgaatttattaaagaacgtcgcggtgttgcgcgttttaagggcgtagcaaaagtcgatggagaagtggcttgcgaagctgaaatgatgtgtgctcgccgtcgtgaggcttaa

SEQ ID NO: 44893 - DNA, 1602 bp, Xenorhabdus nematophilus
ttcaaccgttggcctcaggatctggctgcactctatcgcctgaaagggtactggattgatcgtccattgagcgagattcttgatattcaccgcgagaacgataccacagcactattttgcggtgagcagagctggagctatcgggagctgaatgaggcagtaaaccgattagccgcctctctgcaccgacgcggcgtgcgtcagggacaaactgcactggttcagcttggcaacgaggctgagttttatatcgtcttttttgccttactgcgcctaggtgtcgcacctgtcaacgcgctttatagccaccaaagcagcgaattaaccgcgtatgcacgccaaattatgccaagcatactcattgccgatcgccaacatcgccagtttcatgatgatgttcttattgatcttctaatagatcagtgtccagaactgaatatagtggtgcttcaccatgcgaattcagattcagaccattcgcttgcacgcctgatatcggaagaaccgggagacttcacgccaacaccaacgccggcagatgaggtcgcatttttccagctttccggcggcagcactggcacacccaagctgattccacgtacccacaacgactactattacagcatccgcgccagtaatccgatctgcaacgtaagcagtaagacccgatatctctgtgcactgccggctgcacataactatcctatgagttcaccgggagctctgggcgtattctatgcgggtggtcaggttgtcctcgttcccgatcctagtccagatggatgttttcctgctatcgcacatcatcagatcaatcttgttgccctggtgccacctgctgtcagcatctggctggagtatgccaatctcatcggtcacatcaacgaactctccagtctggaggtgatgctggtcggcggtgctcctctgggagaagcactggccagacgcatcccaaaagagctagggtgccagctccaacaggtatttggtatggcggaaggtctggtgaactacacccgactagatgatgacgacacacataccttcacaactcagggtcgccccatcagcgaagatgatgaggtgtgggtagcaaaccaagaaggtctcccagtgccgctcggagagccaggattgttaatgaccagaggtccatacacttttcggggctattaccgcagcccagaacataaccaaaccgtgttcgacagcgatgggttttattgctctggtgacgtcgtcattcagcttcccggcggatacctcaaagtcgtcggacgtgaaaaagatcaaataaatcgtggcggcgaaaaaattgcggctgaagaggttgaacatcttctgctgcgccacccagcggtggtatacgccgcattggtcgctattcctgactgtctgatgggtgagaaaacttgcgcatatgtggtaacacgcgaacacgaagctgtaaagccagccgtattccgtcgctggttgcgcgaacaaggtatagccgactacaaaattcccgatcgtttcgaaaatctgcctacactaccgctcaccccggtaggaaaaatcaataaacaggcgttgcgtacacttgccagcgccgcctta

SEQ ID NO: 44894 - DNA, 1236 bp, Xenorhabdus nematophilus
tttactccagagaatctgctgcgtttacccgttgattacggaacaccattatgggtttatgacagtgacattattatccgaaaaatcaatcgattaaagcggtttgatatcattcggtttgcacagaaagcctgctctaatacccatatcctgagtttgatgagagcacagggagtaaaagtggatgcggtgtcattgggggaaattgaacgggcactttatgctggatatcagcccggccgtgatcgatccgaaattgtgttcactgcggatttgattgatgaaataacacttaatcgagtgattgagttggatattccagtcaatgtcggctccattgatatgctggagcagattggtacacgtcagtcgggtcatcctatttggctacgcattaatccgggatttggtcatggtcatagtcagaaaaccaatacgggcggcgaaaacagcaagcacgggatctggtttcaggatttaccgctggcgattgagaaagtccgccaatatgggctgaaattggttggattacatatgcacattggttctggagtggattatcaacatcttgccaatgtatgtaacgctatggtggaacaagttatatcgtgcggtgaggacattcaggccatttcagcaggaggcggattatcaattccttataaaacgggtgatgaaatagtggatactgaacactattacagtctgtggcataaagctcgccagcgcattgaacggcacttggggcatcatgttgaactggaaattgagccaggccgttttctggtggctgaatcaggtattttgatggctgaagtgagggcagtaaaaccaatgggtagccgtcattatgtgctggtggatgcgggtttcaacgatttgatgcgcccaacgatgtatggaagctatcatcatatttcagttttatcggtgaatagccagcatattgatgaggctgtttcgcaggatgctgagttacatgaaacgttagttgcagggccgttatgtgaatcaggtgatgtgtttactcaatcagcaggaggcgatgttgtgccgcgtttgttgcctcgcgtttgtgtaggggattatttgattttccacgatacaggcgcttatggtgcatctatgtcttcaaattacaatagtcgccctttgatccccgaaattttgtttattgagggtgacgcccgtttgattcgacgtaggcaaacaatagaagaattgctggcattggaa

SEQ ID NO: 44895 - DNA, 819 bp, Xenorhabdus nematophilus
atgaaaaatcgtaaaatcacctttattggcgctggaaatatggctcatgccattatcgccgggctggtcagaacaggttatcctgctgaattcatcacggtctgctccccaaatacaacccgtcgtgacgttctggcaaaagagtatggcatcaacagcgaaaacgataacattcgttatgcccaggaagccgatgtcattgttctggcagtaaaacctcaaatgatggaagaagtttgtgattcactgcgttcacaaatagatttcagtcataaactggtactctctattgccgcaggtattccagttgcccgtttttacacgctgttgcaagataacctcaatatcatccgcatcatgccaaatacgcccgcacttgtggggcaagggatcagtggcctatttgcgcctgagtacgtcactcagcctgatcgccagtttaccgaatcactgatgtgcggtgttggtaaagtctgctgggtcaatgatgagaatggcatcaacaatattattgccgtcgcaggcagtgcgccggcttactttttcctgtttatggaatccatgcagcaagaagctgaacgtctgggattcgatagccaaactgccagagaacttgtcctgcaagcggctacaggttcggctaaacttgctgagtcacaggcagatcttccttttgctattctgcgcgagcaggtaacatctaaaggcggtacaactgccgaagctctgcgcattttttatgaaggccatctacctgagatcgtatccagcgccatgcaggcagcaatccgccgagcgcaggaaatggaaaaactattt

SEQ ID NO: 44896 - DNA, 1308 bp, Xenorhabdus nematophilus
atgtcatcactgaataaattagttaacaaatttaataacaaaagtgcaaatatagctattgttggactagggtatgttggtttacctttaatgctacgctacaacgatattggttttaaagttatcggctttgatatagataaagataaaacagaaaaattaagccgaggtctaagctatattgaacatatttcctcttccagaattcaaaaagctattgaaactggctttgaagcaaccactgatttttcaagaatatcagaatgtgatgcaattattctctgtgtgcctaccccattaaataaatatagagaaccagatatgagtttcgtcataaatacaacagatatggtgaaaccatttttaagaaaaggtcaagtgctttctttagaaagcacaacttacccaggcacaactgaagaagagttattacctagagcagaagaaagtggcttaagagttggtgaagatatatttctagtatattcaccagaacgtgaagatccaggtaacccagatttcgaaacaagaactattccgaaagtaataggtggtcacacagaaaattgcttaaacgctggcattgcagtttaccaaccagctattgataaagtcgttcctgtcagctccacaaaagctgctgaaatgacaaaactacttgagaatatacatcgagcggttaatatcggattagtcaatgagatgaagctagttgcagataaaatgggcattgatatacatgaagtaatcagagctgcagcaacaaaaccatttggctttgttccttattacccaggtcctgggttgggtggtcactgcataccgattgatcctttttatctaacatggaaagctagagaatacggcgttaatacccgtttcattgaactttctggtgaagttaattcatcaatgccagattatgttgttactaaaacagtcttagctttaaataaagttaataaatcaattaatggtagcaatgtgcttgtcttaggcatttcatataagaaaaatgttgatgatatgagagagagcccatcagtccatataatggaaaaattaagagacttaggtgcattcgtagaatattcagatcctcacgtacctgctttccctaaaatgcgtgaacaccagttcgatctaataagccaatctataacttcaaataatttaaaagaattcgattgtattattttagcaacagaccacgataaatttgactatgacttaataattaacaatgcaaaattaattgttgatactcgtggaaaatattctcctaatcataataacgtgataaaagct

SEQ ID NO: 44897 - DNA, 963 bp, Xenorhabdus nematophilus
attaaaagaatcggagtcttaacgagtggcggtgatgcgcctggcatgaacgccgctattcgtggagttgttcgtgtcgctttaaccgaagggttggaggtttacggcatttatgatggctatctggggttgtatgaaaaccgcatgaagaagctagaccgtttcagtgtttccgacatgattaaccgtggtgggacgtttctgggatcggcgcgttttcctgaattcagggatgataaagtccgtgaaattgccattgaaaatatgcgtaaaaatgacattgatgcgctggtggtgattgggggagatggttcttatttaggggcgaaaaagctgactgaagcgggttttccttgtattggcctgcctggtacgattgacaatgatgtggcaggaacggattacactatcggttattttacggcgctggaaacagttgtagaggcgattgaccgtctgcgcgatacttcgacgtcccacaagcgtatttcgattgtagaagtgatggggcgctattgtggtgatttgacgttgtctgcggcaattgcgggtggatgcgaattcattgttttgcctgagaatgaaatcccgttcgatcgtgaagaattactggcggaaatcaaggcgggtatccaaaaaggtaagcgccacgccatcgttgccattactgagcatgtctgcaatgtggatgaattggcgaaatacattgaagcagaaacacgtcatgaaacccgtgcaacagtactggggcatattcaacgtggcggtgcgccggtggcgtatgaccgtattctggcttctcgcatgggggcttattctgtccagttgctgatggaaggttttggtggccgttgtgtgggtatccagaacgagaaacttgttcatcacgatattatcgatgcggtgcaaaatatgcagcgtgttttcaagaaagactggctggaaacggcgaagcagctttac

SEQ ID NO: 44898 - DNA, 1644 bp, Xenorhabdus nematophilus
atgaaaaacatcaaccctagccagaccgaagcttggaaagcattgcatcagcattttgagcaattgaaaaacgtccacttgcgggatttgtttgaacaggacaaagcgcggtttacggcattctccgctacgtttgacgagcagattttggtggattattccaaaaatcgtattaccgctgaaacactgacaaaattacagacactggcgaaagaaacggatctgtccggagctatccgcagtatgttctccggtgaaaaaatcaactgtactgaagatcgtgctgtgctgcacattgccctgcgtaaccgcagcaataccccgattaatgtggatggggaagatgtgatgccgcaagtcaatgcggtgctggcaaaaatgaagtcattcagtgaacgcatcatcagcggagaatggaaagggtataccggtcaagccattactgacgttgtcaatattggtattggtggttccgatctcggcccttatatggtctctgaagcactgaaagcgtataaaaatcacctcaatatgcactttgtttccaatgtggatggaacccatatcgcagaaacgttgcaaacattgaacccagaaacgacgctgttcctgattgcttccaagactttcaccacccaggaaactatgaccaatgcgtattctgcccgcaattggttcctgcaaaatgcggagattgaggctcatgttgccaagcattttgcggcactttcgaccaatgagcaggaagtcagtaaattcggtatcgatccactgaatatgtttgaattctgggattgggtcggtggccgttattcactgtggtctgcgattggtttatccattgcactttccattggctatgagaatttcgaacagttgctgagtggcgctcatgctatggataaacacttcgagcagacttctcctgatcagaacattccgatcctgctggcgctgatcggcatctggtacaacaatttctttggtgcagaaactgaagcgattctgccttatgatcaatatatgcatcgttttgccgcttattttcaacagggcaacatggaatcgaatggcaaatgtattgataggaatggcagcccggtagattaccaaactgggccgattatctggggcgagccgggcaccaatggtcagcatgctttttatcagcttatccatcagggaaccaaactgatcccatgtgattttattgcgcccgcaatcagccataatccgctcagtgatcatcacagcaaactactgtccaacttctttgcgcaaactgaagcactggcttttggtaaaaatcgcgaacaggtggaagcggaatttgttgcagccggaaaaaatgcacaggacgtggcgaatgtcgtgccattcaaagtttttgaaggcaaccgtccgactaactccattctattacgcgaaattacaccattcagtttgggcgcattgattgccatgtatgaacataaaatctttgcccaaggcgctattctgaatattttctcatttgatcaatggggcgtagaactcggtaaacagttggcgaaccgtatcctgccagaattgcacgatgatgaagcgataaatagccatgatagttcaaccaatggcctgattaatcgtttcaaaacatggcgc

SEQ ID NO: 44899 - DNA, 1341 bp, Xenorhabdus nematophilus
cagtatgttgtcgcaaaattcggcggtaccagtgtggcagactttgatgccatgaatcactgtgccgatattattctggcaaacgcagatgtccgcgtagtcgttttgtccgcttctgcgggggtgactaatttgctggtcgcattggcgacgggctgtgataacgataaacgtaaaaagtgcctgaaacagatccgtgacattcaatatgcgattattgaccgattaaatgacgtgaatgtgatatgtgaagaaattgatcgcctgctggaaaatatcgagatgttgtcagaagccgcatcattggcaacctctgaggcgttaactgatgaattggtcagccacggtgaagtgatgtccacattgctattcgtagaattactgcgtcaacgcaatgtaaatgcagagtggtttgatatccgcagggtcatgcgaacgaatgatcacttcggacgagcagaaccagactcccttcaactccatatatcggcggttgagctccttcagcctcgtttgaataatacagttgttatcacacaaggttttatcggcagagaagaaaaaggccgcacaactacactgggacgtggtggcagtgattataccgccgccttactcggcgaagcgctgaatttacagcgtgttgatatttggacggatgttcccggcatctataccactgatccccgtgttgcaccaacagccaagcgcatcgataaaattgcatttgatgaggcagcagagatggcgacatttggtgctaagatcctccacccagctacgttgctacctgccattcgttgcggtattcctgtttttgttggatcaagtaaagatccacaggccggcggcacactggtttgtgacaaaaccgaaaacccgcccctgtttcgtgcactggcattacgccgcaaacagacgttattaaccttgcacagcctaaaaatgttacatgcaaggggctttctggcggaagtttttacgctgcttttacgccataacatttcagtagatttgattaccacctcagaagtcagtgtcgccctaacgctggatacaactggctctaccagcaccaatggcagtctgctgactaatgctctgctgaccgaactttctacattatgtcgtgtagaagttgaagaagatctggcgctggtggcaattatcggtaatgagctttcacaggctaaagggttggggaaagaaatttttggcacactggaatcttttaatatccggatgatcagctatggcgcaagcagccacaatgtatgtttgctcgttcccggtcaagatgcggaatcagtcattcagaaactgcatcagaatttgtttaag

SEQ ID NO: 44900 - DNA, 1296 bp, Xenorhabdus nematophilus
atgggtaagaacgttgtcgtattgggcacccaatggggtgacgagggcaagggtaaaatcgtcgacttgctgactgaacgagctaagtacgtggttcgttatcaggggggccacaatgcgggccatacactagtcatcaacggtgaaaaaaccgttctccacttaatcccatccgggatcttgcgtgaaaatgtcattagcattatcgcaaatggggtcgttttagcaccagatgctttgatgaaagaaatgaatgcgcttgaatcacgtgggattcctgtacgtgaacgcctgcttatttctgaagcctgtccgttgatcctgccttatcatgttgcactggacaatgcccgcgagaaagcgcgtggtgccaaggcaattggtacaactggccgtggtatcgggcctgcatacgaagataaagtagcacgccgtggcctgcgtgtaggcgatttgtttgataaagaaactttcgcggtcaaactgcaagaaatcatcgagtatcacaacttccaactggttaactactacaacgagcctgctgttgattatcagaaaacactggatgatattctggctgttgcggatatcctgacaaacatggtagttgacgtttctgatctgctctataaagcaactcagaaaggtgaactggtgatgttcgaaggtgcacagggtacgttgttggatatcgaccacggtacctatccttatgtgacttcttctaataccacagcaggtggcgtcgcaacaggttctggtctggggccacgctacgttgactatgttctgggtattatcaaagcctactctacccgtgttggtgcaggtccattcccaactgaactgtttgatgaaaccggcgagtacctgcgtcagaaagggcaggaatttggtgcgacaactggtcgtagccgtcgtaccggctggctggatatcgttgccattcgtcgtgcgatccaaatcaactccttgtctggtttctgcatgaccaagctggatgtgcttgatggtctgaaagaagtgaaagtctgtattggttatcgtatgcctgatggcagcgtgattgacactacaccattggcagcagaaaactgggaaggtcttgaagcagtgtatgaaactctgccaggttgggatgaaagcacttttggcgtgaaagatcacagcctgctgccagaagcagcactgagctacatcaagcgtgttgaagaactgaccggcgttcctgttgatattatttctactggtccagatcgtgctgaaaccatgatcctgcgtgatccatttgatgct

SEQ ID NO: 44901 - DNA, 1356 bp, Xenorhabdus nematophilus
ctcacacttgacactaaccaaaccagtgccagcgatcgtgttcaactaagaagaacactgaccctgtttcaggtggtcatgatggggcttgcctacatgcagccaatgactatctttgacactttcggcattgtttccggattaaccagcggacatgttgcaacatcttatgctctcgcgctgatcgccattttatttacagcattgagttacgggaaattggtaaaacgcttcccatcagcaggatctgcctatacttacgtacaaaaatcaataaatccccatcttgggtttatggtaggttggtcatcattgctggattatctgcttatgccgatgatcaatattctgctggcaaaaatttatcttcaggctcttttcccaggcattgacccatggattttcgtagtcacgttgacaatactgatgacgattttcaacctgagcggcattaatgtagtcgcgaatctcaatggtgttattgtgattgttcaggttgccgttatgttggtactcgtcggtttcttggttcatggtgtctataatggcgaaggcgttggaacattactgagtattcaaccgttcacgtcagatgaagcgaagttgattccaatgatcacaggagcgacgatactctgcttctcattcctcgggtttgatggtatcagttccctgtcagaagaaacacctaatgctggaaaagtgatccctaaggcgatcttcatgactgcattaattggtggagctatctttattgcagtatcttattttttacagctttatttccctgatatttctcgatttaaaaacccagacgcctctcagccagaaattatgctgtatgttgctggtgcgctgttccagtacattattcttatgttctcctgtgttacggtagtggcttcagggatggcagcacatgcaggtgtatcccgtttgctctatgtgatggggcgtgatggtgtactgcctgaaaaagtatttgcttatattcacccaaaatggcgtaccccatcaattaatgtcatattggttgggattgttgctctgtcagcgggttggctggatttggtaacagcaaccgcattgataaacttcggggcgttagtcgcatttacttttgttaatctgtcagtgatttcgcagttctatattcgtgaacagcgtaacagcacactgaaagatacgattcactttttgattctgccggttcttggtgcagcgacagtaggtgtgttgtggatgaatctggagtcaagttcgatgaaattaggtctaatttggggaggaatcggtatgatctatatgttcttcctgacccgtagtttccgtcagccaatgcctcagtttactgaa

SEQ ID NO: 44902 - DNA, 1413 bp, Xenorhabdus nematophilus
ctgcgccgtgaattaaaagcgcggcatatggcgatgattgccattggagggtcaattggcacagggttatttgttgcttccggcgcaacaatttcacaggctggtcctggtggagccttactttcctatgcattaattggtctgatggtttatttcctgatgaccagcttgggcgaattggcagcttatatgccagtttcgggttcattttcaacctatggatccaaatatgttgatgaaggttttggcttcgcgttggggtggaactactggtataactgggccgttacgatagctgttgaccttgtggcagcacagttggtcatggggtactggttcaatgatgtgccaggttgggtatggagtgcgttgttccttggcataatttttctgctgaactttatttctgttaaaggttttggtgaagctgaatactggttttccctgattaaagtttctacgattattgtcttcattattgttggcatcttgatgatcatcggtatcatgaaaggggctgaaagtgccggctggcaaaattggcaagtgggtgatgcgccatttgccggtgggtttgctgccatgattggggtagcgatgattgtcggtttctcatttcagggaaccgaactgattggtattacagcaggagaatcaaaagatccggcgaaaaacattccacgagctgtacgcaaagtattttggcggatcctgttattctatgtttttgccattttgattattagtttgatcattccttatactgaccccaacttattgcgtaatggtgtgaaagatatcagtgtcagcccgttcacgctggtatttgaaaatgcggggttgttgtctgcggctgcgatgatgaacgcagtgatattgacggctgtgctttcagcaggaaattcgggtatgtatgcttctactcgcatgttgttcacgttggcgagggaaggtaaggcccccaaaatttttggtcatttatcaaaaggaggcgttccacgtaacgcactttacgcgactaccgtggttgcagggttgtgttttttcagctcaatgttcggcaaccagacagtatatctgtggctattgaatacctcaggtatgacagggtttattgcgtggctagggattgcaatcagccactaccgtttccgtaaaggctatatcgcacaaggacgggacttgaatgagctaccctatcgctcaggttttttccctgtcgggccgatttttgcgtttgtgttgtgtttgatgatcacattgggccagaactatcaggcgtttttgcaagataatatcgattggtacggtgtaactgcgacttacatcggtattccggtattcttgattatctggttcagctacaaactgaaaaagaaaactcggtttgttaaatgtagtgagatggaattt

SEQ ID NO: 44903 - DNA, 1263 bp, Xenorhabdus nematophilus
tcgaaacgtttacagggtacacttaacttaccagcttctaaaagttcctcaactcgagcccttctaacttcttccattacttctggaaaaagtattatcagaaatattgctactggttttaataccatagcgatgaaatctaattgtgagcgattgggggctgttttcaaagaagataaaggtaatttgatagtaaatggaattgacgtgagttctatcaaccagcctttagagttcaatccaggtaactcaggggtagtattgaggttgttgatgggggtagcgggtttcttaccagagacaaaatttataaccgattatcacgcctctcttggatttcgttctcaaacagaaatggttaatgcgctatgtatgttgaatgttcaatgtagagcattgggagaagagcatcgacttcctatcaggattaagtctgatagaaagttaaatgattatacagaggtatcttgtagaaaaagctcacaatttttaagtggattactatatcttggagcagtgatggataatgacttaactataaaggtagtcgacaaaataacagctccatcaatggttcacacaacaattaataaccttaagaaagcgggtattagaatcgaatatgatagtgattttcgtgaattttttgtacatggtcgatgtcgattgcaggcaagtgattttacagtaggttctgatccagctagcactgctgcaatccttgcgctttgtggctccctagaatcagaagttcaattgaatggtttcttcgaagaagaactgggaaatggtgctgtgattcaatatctaatcgatacagggactaatatcgaatttattgggaatgaaacgataataattagagggagtacagaaattcgtcctttagattttgacggttctttggcccctgatgcagttcccgcattagcggctagagcttcattagcctctggtacaagtattttttataacattgagcatatccgttataaagagtctgatcggatatctgattttagaaaagaattatcaaaactaggggtaaaatcagatgaaaaacatgatcaactcattatccatgggaaccccaaaggatataaaggcagggtggttctagatggacattacgatcatggacttattatggggctcacaacaataggccttcattgtagtgagcctgttattataaaagaaccatttcatgtagggcaaacttacccagaatatttttctgaaattcgttccttaggtgcgaaa

SEQ ID NO: 44904 - DNA, 1266 bp, Xenorhabdus nematophilus
ctgactggtgaagtttttataccatcatctaaacctcatattcagcgtgcattattactagctttactgaatgaaaatacaacgaaaattgttaatatatcttggaatgtagaaactgaaaatcaaattaatgctctgaaaaaatttggtctagaaatattgcataaagatggaacaacactgttacttcgtggtgtaggtagaaatttatcgtataatggggagatatatgcaggtggttcaggtatgttattcagaatgtgcgcagctttagcatctctcattgataatgaaaaaatagtaataaaatgcaatgaatctttatttaatagagagagtgtgtttgacgaagatttctgtaattatttagatattcatattgaacgtattgaaaatgaaaagattataatcactaagagtgaaactaatataaaaaaaccattgactgttttgaatagcactcagttcattacgtttgctctatttgtcactcctttcagcaaacaaaatatagtccctatagttatggacggcagtaaaatgggctatattgatatgacgataaaatcaatgtcccttctagggagcatggttacatatgaacaaaagcactttaaagtaactaaatatatacctaaagatattgaaataaaaataccctctgatttcacatcattaagctatatagcatcttctatattaagctcaaaaggtgttagtgatgtattgataagaaattattattttaatgacacaataaatgaacgtgatttatttaaattttatcaaagtataggtctaattattaagtatgattcaaattggaataatttgagaatattcaggcagtcgattaggttatgggatggtgaattttcattgaaagagcttccttccgtagccgtaaacataattgctgcttcatctaatttgaaaggaaaaaaaatttttagtggggtaaggggaataaataatcataaaagtcaacgagcatttattgttaatgaaaatataagaacaatgggagggagtagtgttctaatattcgatagagtaggaatgtttgagtcaatatatattgaaggaaaaggaccgttgaatggaggagttgaacttaaaagttacggtgaccatagaatttgtgctgctaatctcatagcatcgctcggtgctgagaaagaatccataatatacgatatagataaattaaatgatggatttcccgattatatcgatacgctgaggaatttaggcgttcatattaaa

SEQ ID NO: 44905 - DNA, 2542 bp, Xenorhabdus nematophilus
tcactggaaaatgcgacaactttctgcaaactacgcagtaatccttatgtcgagttagtccattggctgcaccagcttatgcagcaacaagactgtgatttacaatcggttatccgttactttgcattagatgaagccaagctggcaaaagatattattacagcactggatcgcctgccacgtggagccagtgcgatttctgatctttccgaacatattgatagtgccgtagagcgtgcctgggtatatggatcattaaaatttggtgttgacaagatccgtaccgcgcactggctgattggtatgttaaagactttcaatctgtacaataccctgaaagccatttcccgacagtttgaacaagtcaatgcagatacgttaatagataatttcaacgccatctgcggtaatagcagtgaagaaccggagaatgaaccaccctctcatcattcccaaccgacaaaaccacaatcctctgacagtgccctgcggcaatatgggcaaaatctcactgatctggctcgccatggtgatattgatcccgtatcaggacgcgatgaagaaatacgccagattgtcgatatcttgatgcgccgccgccaaaataaccccttactgaccggtgaagctggggtaggaaaaaccgccatcattgaagggctggcattgcggatcgccgcaaatgaggtacctccaccactgcaaaatgtgcaactttggttattggatattgggatgttacaagccggggcgggaatcaagggcgaattcgaatcccgcttgcgcagagtgattgacgaagtgcaatccagcccccttccgatcattttattcattgatgaaatccatacattaatcggtgcaggcgggcaacagggaacgggggatgcggccaatttacttaagcccgtactggcacgtggtcagttacgaacgcttggagcaaccacctggtctgaatacaagaaatatattgaaaaagatccgggccctcacccggcgttttcaggtcgtccaaattcatgaacccgatgaagccaaggcacttttgatgctacgcagtctggtctggacgctggaaaaacatcaccgtgttctcctactggatgaggccgttgaagctgccatacggctttcccatcgctatattcccgctcgtcagctacccgataaggctgtagctctattagatacggcatgcgccagagttgccattagccaaaacgctgaaccaccacagttggaaaattgccgacataaaatcgatgccttgaagattgagctagaaattgttgaacgagaagcaaaaatggggataggcgatcagcaacggtcaaataccatcctcaatgcgctatccctattggaagaacaacttattcaattggaaaaccgctggcagcaagaactctccttgattaatagaattattcatctgcaaactcaactttatgccccctcctttcatcaacaacagcataatgatcccaatgccctgcatgaagagctaatagcattgcaacaacaattaaaaacgttacaaggagagatcccccttatctttgcttcggtagacagcaatgttgtttccgccgttgtctcagactggacgggggttcctcttggccgcatggtaaaagacgaaattaatgcggtattgcatttggtggatacactcaaccaacgtattatcgggcagtaccatgctttagagttgatcgcaaaacgggtacgaacttcacgggcaaaattggatgatcccaataaaccggtgggggtgtttatgttatgtggcccttccggtgtcggtaagaccgaaaccgcgctggcattggcggaaacgctatatggtggcgaacagaatcttatcaccattaatatgagtgaatttcaggaagcccatacggtatccaccttaaaaggggcaccaccggggtatgtgggttatggtgaagggggagtattgaccgaagccgtgcgccggcgtccctacagtgtggtcttactggatgaaattgaaaaagcccactctgatgtccatgagattttttttcaagtctttgacaagggttggatggaagatggtgaaggccgccacattgattttcgcaataccattattatcctgacatccaatattggggctgatttggtgagttcgctgtgtttacaacaggctcctcttccagatccagaaaaactgagtaccgcattgcgaaaacccttactgcacgtatttcctgctgccttactcggacgtttgattgtcattccttactatccattgagtgataatgtgatgacaagtattgttcacctgcaattggcaaggatcaaaaaacgtttactggaaaaccatgacattgtagctacatttgatgaacccatgattaaatatatcgttggccgatgtacagaaatcgaatcaggtggccgtatggtagatgctatcctgaccaactccttgctgccgcagatcagccagctcttgctctctgctaacgcgaatggtcagcaatatcatcaattacaagtctctctc

SEQ ID NO: 44906 - DNA, 1431 bp, Xenorhabdus nematophilus
ctgctgcgccaacaggcttatatcaatggtcaatgggttgatgcgcataataaaacgacgtttgccgttatcaatcccgccaatggcgaagttattgccaatgtcagtgatatgggttgtgcagagacgcaacaagccattgaagccgcccagactgcccttcccgcatggcgggcattgactgccaagcagcgcagccaaaagcttaagcaatggttccatctaatcatggataaccaaaaatcgttagcggaactgctgagtgccgaacagggaaaaccccatgcggaagcgatgggagaaattgcctatggtgccagttttatcgaatggtttgcggaagaaggtaaacgcatttatggcgaaactatcccatcaccgatgccgggtcgtcgtctcgcgaccatcaaacagccgataggcgttgtagccgcgattacgccgtggaatttccccaatgccatgatcacccgtaaagttggcccggcactggccgcaggttgtacggttgtactgaaacctgccgcagaaactccgctgtctgcgctggcattagcagtactggctgaacaggcgggcattccggcaggtgtcctgaatattgtcaccggtatagatgccaaagcaattggcgaaacactgacttcaagccctatcgtacgcaaactctcttttaccggttctacccgtgttggcaagttactgatggcgcaaagtgccgataccgtcaagaagctttctctcgaactgggcggcaatgcgccttttattgtctttgatgatgcggatcttgatgcagctgtggaaggcgcgatggcgacgaaattccgcaacagcggacagacttgtgtcagtgccaaccggatcctggtacaagaaggcgtttatgatgcgtttgctgaacgtctggttcatgctgtcaaacaacttcgcgtcgggccgactcatagcgattcatcacaacctgtgccacaacaagggccactgattaatcaggcggctgtggaaaaaatacaggcacatatcagcgatgcggtttcccacggcgcgcgtattctggccggcggcaagtcccacaccttgggtgggttattctttgaacccaccgtgctggccgatgtggatgattccatgcgggtcagccatgaagaaaccttcggcccactggcgccgctgatcaaattccgcgatgaagcagaagccattcgcctcgccaatgatacagaatttggcctcgcggcttatttctattcccgcgatattggccggatttaccgggtggcagaagcactggaaagcggcatggtcggcatcaatgaaggtttgatttccaacgaagttgttccattcggaggcataaaacagtctggtctggggcgtgaaggttcacgttacggtatcgaagattatctagaagtgaaatatctctgt

SEQ ID NO: 44907 - DNA, 1347 bp, Xenorhabdus nematophilus
atgagcagcccacctgaagccatacaagagccagaaaatccggcttacccacctcaaaaactcaccgatcggcagcaaaacgtcatcaacaaattgttccgccgcttgatcctgtttttatttgttctatttgtgttttcctttcttgatcgcatcaatatcggctttgccggtctgacgatgggaaaagatctcggcctgtcgtctacgatgtttgggctggctgctacgctgttttacgcgacttacgtgattttcggcattcccagtaatgtgatgctcagtgttgtcggcgcccgtcgctggattgccaccatcatggtgctgtgggggatcgcttctactgccacgatgtttgccaccggcccgacaagcctgtatatcctgcgtatgctggtcggcattgcggaagcgggtttcctgccggggattctggtctacctgacttattggtttcccgcctattatcgcgcccgcgccaatgccctgtttatgatcgcgatgccggtcacaatggcgtttggctcgctggcctccggttatattctggaaatggatggcatctgggatctgcgtggctggcaatggctgtttttgctggaaggcttcccttctgttctgctcggttttgtcgtctggttctatctggatgactcaccggaaaaagctaagtggctgacgcgtgaagataaacagtgtcttcaggagatgatggagcgcgataaactttcgcaagtgcaatccagtcgcccggccagctccaaaaccagcctgtggcgtgaagtttttaccccgattgtcctgatgtatactttcgcttatttttgcctgaccaatactctgagtgccattaatatctggacgccgcaaattatgcagagtttcaatcaggggagcagtcatgtgatgatcggtctgctgactgctattccccaattctgcactatcttaggaatgatttactggagtcgccgctcagaccgtctgcaagaacggaaaatgcacactgccctgccctatctgttcgcggcagcaggctgggttttgacctcactgactgaccacagcatggtgcaactgctggggattatcatggcttccacggggtcatttacggccatggcggtattttggactacgccggatcaatccatcagcctgcgcgcccgtgccattgggatcgccgtcatcaatgccacaggtaatgtgggttctgctgtcagcccgctgttgattggctggctaaaagatcaaacgggcagtttcaactcaggtctctatttcgtcgccggactgctgattatcggggctttgatggtttcatttatcccgatgaagcaaacgcag

SEQ ID NO: 44908 - DNA, 387 bp, Xenorhabdus nematophilus
atgagtcatgtaccagcagaattaaaatatacctcatcacacgaatgggttcgtgcggaaggaaacggtgaatacactgtaggtattaccgagcacgctcaggaactcttgggtgatatggtattcgttgatttgcccgaagtcggtgtagttgtaaataatggtaatgactgtgctgttgtagaatcagtcaaagcagcttctgatatttatgcccctttgagtggtgaagtcaccgcggttaattcagagttggaaggttctcctgaattagtcaacagtgagccttataacgagggttggctgttccgccttaagatctctgacgagagtgaactcacccatctgcttgatgcggaaggttatcagtcacttttggcagaagaa

SEQ ID NO: 44909 - DNA, 1311 bp, Xenorhabdus nematophilus
atgactaaacaagaatatttgtcccgtcgtcaggcattattgtcaaaaatggcaccagccagtgcggccattatttttgcagccccgcctgcgaggcgtaattcagattgtgaatatccctatcgccagcacagtgatcttctttacttgactgggttcaacgagccgaaagcggttcttgttctgatcaaaagtgatgaaaaccacaatcatagcgtgttgtttaaccgtgttcgtgatctaactgcggaaatttggtttggtcgtcggcttggtcaggatgccgcaccggaaaaacttggggtggatcgcgccctgccatttgatgatctcagtaaacagctttacctgctactgaatggtttggacgtggtttatcatgcccagggggagtttgaatatgctgacaatatcgtattcagtgccttggatacattgcgaaaaaatagccgtcgtaacctcagcgcaccatcaatgatagcagattggcgtccgtggctgcatgagatgcgactgttcaaatcggcagccgaactggacatcatgcgcaaggcaggcgacatcagtgcgaaggctcatacgagagccatgcagaattgtcgcccaggcatgtttgaatatcagcttgaggctgaaatccatcatgaatttactcgtcaaggcgcacgttatcctgcttataacaccatcgttggtgcaggagaaaacgcctgtattctgcattacacagaaaacgagcgccgcatgaaagagggcgatttggtattgatcgatgcgggctgtgaatatgaaggatatgccggcgacattacgcgaacatttccggttaacggcaaattcacccgtccccagcgagaaatttatgacatcgtgctgcaatctatcaatgtctcttttgaactgtacaggccgggtaccagtatccgcaaagtgacggaacatgtggtgcgcattatggttgaagggctggtcaaattgggaattatgcatggcgaagtagaacaattgatcgagaccaatgcttatcgtcaatttttcatgcatggtttaagtcattggctggggttggatgtgcacgatgtcgggcattatggcatagatcgcgatcgcattctggaacccggcatggtgctgactgttgaaccagggctttatatcgcgccggatgctgatgtaccaccggaataccgtggtattggcatccgcattgaagatgatattgtgattacggaagcgggcaatgagaatttgaccgagcatgtcgtgaaagatccggatgaaattgaagcactgatggcacaggcgaaacag

SEQ ID NO: 44910 - DNA, 2397 bp, Xenorhabdus nematophilus
tcctaaaaactggcgaaagctaaacgaagagagagctctatgaaccctgagcgttccgaacgcatagaaatccctgtattgcctttgcgcgatgtagtggtttacccacatatggtgatccctctgtttgttgggcgtgagaagtcgattcattgcctggaagcagcaatggatcatgacaaacaggtcatgttggtcgcgcaaaaagaagcatccactgatgagccgggagtcaatgatcttttctccgtaggtacagtggcttctgtgttacagatgttgaaactgccagacggcacagtaaaagttctcgttgagggtttgcagcgtgcccgtattacaacattgacggataatagtgagtacttctatgcgcaggttgaatatcttgaatcccctgtcgttgatgaacgtgagcaggaagttctggtaagaaccgccattaatcagtttgagggttatgtcaaactaaacaagaagatcccgccggaagtattgacatcattacacagcattgaagatttagcaaaactggcagataccattgctgcccatatgcctttaaaaattaacgataaacagactgttttagaaatgtctgatgttgttgaacgtattgaatatctgattgcaatgatggaatcagaaatcgatctgttacaggtagaaaaacgtatccgcaatcgcgtcaaaaaacagatggaaaaaagccagcgcgaatactacctgaacgagcaaatgaaagcgatccagaaagaattaggtgagatggatgatgcacctgatgaatatgaaacgctgagacgtaagatcgaagacgctaaaatgccgaaagaggcacgcgaaaaggtcgaagccgagctgcagaaattaaaaatgatgtctccaatgtcagcggaagcgacggtggtacgcagctacattgactggatggtacaagttccttgggttgctcgcagcaaggtgaaaaaagatttggtcaaggcgcaggaagtgctggatatagatcattatggtctggagcgcgtcaaagagcgtatccttgagtatctggcagtacaaagccgtgtcagcaaaatcaaagggccgattctgtgcttggtagggcctcctggcgtaggtaaaacctcactgggccgttctattgcgcgtgcaactggtcgtaaatatgttcgcatggcactgggtggcgtacgtgatgaagcagagatccgaggtcatcgccgtacctatattggttccatgccgggtaaactggttcagaagatgtccaaaattggggtcaaaaatccactgttcctgttagatgaaattgacaaaatgtcatctgacatgcgtggcgatccggcttctgcattgctggaggttcttgatcctgaacaaaacgtgacatttaatgatcattaccttgaagtggattacgatctgtctgatgttatgtttgtggcaacgtccaattcgatgaacattccggcgccactgcttgatcgtatggaggttattcgtctgtcgggttataccgaagacgaaaaactgaacatcgccaagcggcatttactgccaaagcagattgagcgtaatgctttgaaaaaaggtgaattggctattgatgacggtgcgattctcggtattatccgttattacacccgtgaagctggtgtacgtaatctggaacgtgaaatttccaaactgtgccgtaaagctgttaaggcattgttgatggataagaagcttaagcacatcgaaatcaatgcggataatctgaaaaattatctgggtgttcaacgtgtggattatggtcgtgcggatactgagaaccgtgttggtcaggtgacatggccttgcatggaccgaagtgggtggtgaactgttaacgattgaaacagccagcgtgccaggtaaaggaaaactgacctatacggtttcgttgggtgaagtgatgcaagagtccattcaggcagccttgactgtggttcgtgctcgtgccgataaactgggtatcagttctgatttccatgaaaaacgtgatattcacgtcccacgtacctgaaggtgcaacaccaaaaagatggcccaagcgcaggtattgcaatgtgtactgcgttggtttcctgcctgacaggtaatccggttcgtgccgatgttgctatgacaggcgaaatcactctgcgtggtttagtactgcctattggtggtttgaaagaaaaactgctggcagctcatcgtggagggattaaaaccgtcttgattccagatgaaaataaacgagatctggaagagatccctcagaatattattcaagatttggagatccatcctgttaagcgcatagaagatgttttgtctattgctttacagtctcctgcgtttggagcagaagcagtatcactaaattag

SEQ ID NO: 44911 - DNA, 3325 bp, Xenorhabdus nematophilus
agtcaattattgatgtggctaggcatcatgctgttcattgcgctggcgatatacggtctgcggtatgtttggcgcgtatggctatttggggcgtcttatcggctggctgttaaactacgtagtgatttctaccagaaattgagcagccagaaccctgaattttatttgcgccacagaaccggtgacttaatggctcgtgcaaccaatgatgttgatagggttgtttttgctgcgggtgagggggtgctaactttagtcgattccttagtgatgggatgtgctgtccttatcgtgatgagtatagaaattagttggcaattaacgttgttatcactgttacccatgcccattatggcgttggtgattaaacgatatggcgaacagcttcaccatcgtttcaagtctgcacaaggagcattctctgctcttaataaccatgctcaggaaagtcttaccagcatccgtatgatcaaagcatttggtctggaagatctgcaatccagtcaatttgaagaagtcgctactgatgctggacgtaaaaatatacacgttgcgcgcgtagatgcacgttttgaccccaccattttcattgctattggcgttgcaaacctattagcgattggtggagggagttggatggtcgtacatggctctatgacactgggtgaattgactagctttgttatgtatctgggattgatgatctggccaatgttggcattggcatggatgtttaatattgttgagcgtggcagtgcggcatatacacggatccgtagcttgttacaggagccactggtgattgatgatggttctcagtccttattagttgagcgcggtacattacaggcaaatatcaataccttcatttatcccgcaaatgatagacctattttacatgatgtccgttttcaattatcaccaggtcagctattgggggtttgtggtccaactggtgcaggaaaaagcactttgcttgccttgttacagcggcaatttgatgtcactgacggtgaaattctttttcagtcacggcacgtttctacacttagattagaagaatggcgatcacgattggctattgttaatcagactcctttcctgttttcggatacagtcgctggcaatatcgcgctaggccggcctgatgcaactcaagaacaaattgaagaagttgctcgtttggcgaatgtgcatgatgatattttgcggttaccgcagggctaccaaacggaagtgggagaacgtggcgtaatgctttctggcggacagaagcaacgcatttccattgcacgtgctctgttattggatacggaaattttgattttggacgatgcactttctgccgtagatggtcagacagaacatcaaatcatgaaaaatctcagccagtggcggcgacagcgtaccgttattatcagcgcccatcggctgtctgctttaacggaagctgataacattttggttattcagcatggcacggttgcgcagcaaggcccgcacaaacagcttattgcacaatccggttggtattctgatatgtaccattatcagcaacttgaagccgaattggatggtgaacatgactaatcatgatatgcgtaagcccagtgtgcgtaagctatggccatcattaaagcgcttattgtcttacagtaagaattatcgcaagccaattttgctggctgtactgatgtcatgggttgctgcgctaacagaagtcagtgggccactgcttgtgagctattttattgataatatggtagcaacgggcaatcttccgcttgatgttgtcagtgggcttgcggttacttttttggtattgcagtttgttgctgctgccttgcactactttcagttcctattattcaatcaggcatctgtggggatagttcagaagcttcgtactgatgtcatgaattcggcattgcgccagccgttgagcaccttcgatagccagcccgttgggcagctaatatcccgcgtgacgaatgatactgaagccattaaggatctgtttgtaaatgtgatccctacagtgtttcgctgcatttcattgatcggggcaatgctgatagctatgtttattttggattggcgcatggcatgtgttgctttgacaatatttccagcagttttgctggtaatgataatttatcagcatttcagtactccaattattagacgggttcgtagttatctggctgatattaatgacggctttaatgaaaccattaatggtatgacagtgattcagcaatttcgccagcaagctcgttttggtgagaaaatgctggcgactaatcgtgaacattatcagtctcgcatgcaagcgttgcggttggatggcattttgctgaggccgttactgagtttgttttctgctgccatactgtgtggcctgctattgttatttggtttcaaaggaacggaagtgattggtgtgggtgttttatacgcattcgtcaattatcttgggcgcctgaatgaacctctgattgaactgactgctcaacaatctttactgcaacaagcggtagtttcaggggaacgggtttttgagttaatggatagcccacagcagcaatatggcactgatcagcaggcgctgatgagtggtagaattgatattgaaaacttaacttttgcctatcgtaatgacaaagttgtgttgagtgacatcaatctacatgttcctacacatgggtttgtggctttggttggtcatacgggaagtggtaaaagtactctgactaatttgattatgggatattatccgtggcaagacggtgaaatttatcttgatggtcgtcctgtatcttccctctctcatgcggttctgcgtaatggcgtagcaatggtacagcaagatcctgtagtgcttgcagcctcatttttcgacaacatcacattggggcgggatatcagtgaagataaaatttggcaggtgttggagatggttcaattggctgattttgtccgccgcttaccagatggtctgaattcagtactaggagagcaggggaatactctttccgcagggcaaaaacaacttttagcaatggctcgagtcctggtgcaaacgccgcagattctcatcttggatgaagcaacggcgaatattgattcggggacggagcaatcggtacagcaggcattgcggatgatccgtaaacagacgactctggtggtcatcgcccatcgtctttcaactattgttgaagcagattccatattagtgctacatcgtggtgcaatagtggagcaagggcagcatcaacagctactggctaaacgtggacgctattatcagatgtatcaactc

SEQ ID NO: 44912 - DNA, 555 bp, Xenorhabdus nematophilus
tcgattatgaccgctaatgcgcaaaaactacaatttattaaagatagtatcgaaacgatccctgattacccaaaagtcggggtactttttcgtgacatcaccacgctgctggataatcccgttgcctaccaagctacgattgatctactggtaatacattatcaagagaaaggcattaccaaaatcgttggtacagaagctcgtggtttcttgtttggcgcccctgttgcactacgtctgggagttggttttattcccgttcgcaagaaaggcaaattacctcgtgcgacgttaagtgaaacttacgatctggaatatggtactgataccttggaaatccataaaaacagtatcaaagaaggggataaagttctggtggttgatgatcttcttgcaacaggcggtaccattgaggcgaccgtaagtttgattcgacgtctgggtggagaagtttctgaagcggcattcatcattggcctgcctgatttaggcggtaccgagcgtttgaaaaaacagggtatcgagagctacacgctcatagagttccctggtcac

SEQ ID NO: 44913 - DNA, 1866 bp, Xenorhabdus nematophilus
atgaaaggtcaggaaacccgtggatttcagtctgaagtcaaacaactattgcagttgatgatccattctctctattccaataaagaaatttttctccgtgagttgatttcaaatgcatcagatgctgcggataaattacgcttccgtgcattgtcaaaacctgaattgtatgaaaatgatggtgagttacgtgttcgtcttgcttttgataacgagcataaaaccatcactatcagtgataatggtatcggcatgtcccgtgatgaagttattgataatctgggaacgattgcaaaatccggtactaaatcattccttgaatctgttggttctgatcaggtaaaagacagccagttgattgggcaattcggcgttggtttttactctgcctttatcgtggcggataaagtgactgtgcgtacccgtgcggcaggcactgcggccgatcaaggtgttttctgggaatcaacaggtgaaggtgattacaccattgctgatcttgaaaaaactgagcgtggtacagaaatcactttgcatctgcgtgaaggggaagatgaatttcttaacgactggcgtctgcgttctatcatcggtaaatattctgatcacattgcgttgccagttgaaattgaaaccaaaaacgaagaagacgataccgtcacatgggaaaaaatcaataaagctcaagcgctgtggacacgtggtaaagccgaaatcagtgatgaagaataccaagagttttataaacacatttcccatgatttcactgatcctctgagctggagccacaatcgcgttgaaggtaaacaggaatacaccagcttgttgtatatccctgctcaggcaccgtgggatatgtggaaccgtgaacataaacatgggctgaaattgtatgtacaacgcgtattcatcatggatgatgccgaacagttcatgccaaattatctgcgttttatgcgtggtctgatcgattccaatgacttgccgctgaacgtttcccgtgaaattctgcaagacagtactatcacccgcaatttgcgtaatgcgttgaccaaacgtgtattgcagatgctggataaattagcaaaagacgatgcggaaaaataccagaccttctggcagcagtttggcttggtactgaaagaagggcctgctgaagacggttcaaacaaagaagctattgctaaattactgcgattcgcaaccactcatcatgatggctcggcacaaactgtttctctggaagattacctcagccgcatgactgaaggtcaggagaagatttactacattactgccgacagctacgccgcagcaaaaaatagcccacatctggagctgttccgcaagaaaggcattgaagttctgttgctgtctgaccgtatcgatgaatggatgatgagctacctgaccgagtttgatggcaagtcattccagtctgtcagcaagacggatgaatctcttgacaaactggctgatgaaaacaaagccgagcaggaagaagaagataaaaaactggagccgtttattgagcgtgtgaaaacgctgcttggtgaccgtgtgaaagaagttaagctgacccacagactgactgatacacccgcgatagtgacaacgaatgccaatgaaatgagcacccaaatggcgaaactatttgcggcagcaggacagtctgcaccagaagtgagctataactttgaactgaatccagaacacaatctagtgaaaaaagcggctgatattcctgatgaagctcagtttgcggattggatagaactgttactggatcaggcattgtttgctgaacgcggcacattagatgatccaaaccaattcattcgccggatgaatcaattattattggct

SEQ ID NO: 44914 - DNA, 918 bp, Xenorhabdus nematophilus
atgagtagcaataagtatggtgtcttactggtgaatcttgggacgccggatgagccaacacctgtagcaataaggcgttatctggcgaaatttctgagtgaccgaagagttgtggatatcccttcgtttatctggaaaccgctgttgtacggcattattcttcctttccgttcttctcgtgttgctaagctgtaccaagaaatttggacagacgagggatcacctttgctggtttatagtcagcgccagcagaaattgctaaatgaaagattgacggatatccccgtcgttttgggaatgagttacggttttccttccttgccccaagctgtcggtaatcttctgcaacaaggtattgaccacctgattgtgcttcctctttatcctcagtattccagtacgacatcggctgcggtatttgatagcatcagcaaaatattgaagggatatcgtaccataccccatttgtatttcatccgtagctatgctacacatcctgcttatattgctgccttaaaagaaacaatcgagaagagttttgaaaaacatggtttgcctgatcgtttgcttctttcctaccacggtattccagaacggttggcaacgataggtgatatttatccgcaggattgcagggcaactacggagcttttgatacaggcattggattatcctgcagataaaattatgatgacttttcaatctcgttttggtcgtttgccgtggttaacgccctatacggataagacaatggcattattgccagaacaaggtgtggaacatgttcaggtactgtgtccgggattttcatcagactgtttggaaacactggaagaaatccaacagcaaaatcaagcgattttccggcatgccgggggtaaaaagtttgaatatatttctgcacttaatgataatgag

SEQ ID NO: 44915 - DNA, 738 bp, Xenorhabdus nematophilus
atgagcattttgatcacccgcccagatcccgcaggagagcagttggccaagcgactgagggctatgggaaaaatagccttcagtgcgccactcattacgatttatcccgggggcgatttgccgttgctgtcacagaaactccaacggctgtcggcgggtgatttagtcttcctgttgtcaaaaaacgctgttcactacgctaatgaacagcttctgcaagaaggcctatcatggcctgataagctatcctattatggtatcggcaaatcaacttccctgatgtttcatcaaaaaaccgggttggagatcctctggcctgaacagggtgaaacgagtgaagacctactgcaactccccattttacaacgggtgaatgataaaaagattttattgctgcggggtaatggggggcgtgaagttattgcttcgacattaataaatcggggagggaaagtcgattattgtgagtgttattcacgccagcctatcaaatatcatgtcgctgatttcagtcgccattggcaacaatatggtataaaaaccctcgttgtgaccagtggcgaaatgctgcaactattatataacttagccacagatgatgatggcaaagcgtggttattgagttgctacttgattgtggtcagcgaacgccttgccaatattgcccagacactgggttggcagacgataaaagtagccaagagtgcagataatgacgccttaatgcaggcactagaa

SEQ ID NO: 44916 - DNA, 930 bp, Xenorhabdus nematophilus
atgacaatgaaaatcattcgtatcgcgacccgccaaagcccgttggctatgtggcaagcccaatatgtccaaaagcaactggaacagtttcatccagaactgaaagtggagctgattccaatggtgacacgcggagatgtgatcctcgatactccactggcaaaggtgggtggtaaggggttatttgtaaaagagctggagttggcactgctcgaaaatcgggctgatattgccgtccattctatgaaagatgtccctgtggaatttcctgacggcttggggttggtcacaatttgcgaacggggtgatccaagggatgcctttgtttcagtaaaatatacctcgcttgatgaactgcccattggcagtatcgtcggtacatccagtttacgccgccaatgccagcttcgtcagttacgtcctgatttggtggttcgtgacctgcgaggcaatgtaggtacccgtctgggcaagcttgataacggcgattatgatgccattatccttgcagctgcgggtcttaagagattagggttggaagatcgcattcgtatgccattggaaccggagttactccttcccgcagtcggtcagggtgccgtcggtattgagtgccgccttgatgataagcaaacccgtgagttacttgctcccttgaaccatacaggaacagaaatctgcgttctggcagaacgcgccatgaatacccaccttgagggtggctgtcaggtacccattggcagctatgctatctggcagggaaacaatatctggctgcgcgcacttgtcggagctcccgatggcagtataactgttcgtggtgaaaaaaccgtatcaccagaagaggctcgtcgcgcgggggtggaattggcagaagaattattggaaaaaggtgcgcgccagattctggctgacgtctaccagaggaat

SEQ ID NO: 44917 - DNA, 822 bp, Xenorhabdus nematophilus
atgcagttctccaaaatgcatggtcttggcaatgattttatggtcgttgatgcagtgacccagaatgtttatttttcgccagaattaatctgccgtttggctgatcgacgtactggcgtgggctttgatcaattactgatcgttgaagctccctacgatcctgacttagactttcactatcgcatttttaatgctgatggtagtgaagtttcccagtgtggcaacggagcgcgctgctttgcccgttttgttcgcttgaaaggattgaccaataagcgtgatattaaggtcagtacgcaaacaggccggatggtactgagcatcaccaatgatgatcaggtctgtgtcaatatgggagaaccggactttgaaccacagcatgttccttttcgtgccattaaggcggagaaaacctatattatccgtgccattgaacgcaccgtgctctgcggtgtcgtgtcgatgggaaatcctcattgtgtgatacaggttgaagatgtcgacaccgcagaagtggagattttggggccagtattggaaaatcatgaccgttttcctgagcgggcgaatattggtttcatgcagatcatgaatcgtagtcatattcgattgcgtgtctttgaacgtggtgcaggagagacacgggcttgtggcagcggtgcatgtgcagccgtcgccgtcggtatccagcaagatctgctgaatagtcaggttcgcgttgatctgccgggtggtttcctgcaaatttgctgggacgggccgggcaagccactctatatgatagggcctgcaactcacgtttatgaaggtacgattcatttg

SEQ ID NO: 44918 - DNA, 2157 bp, Xenorhabdus nematophilus
atggacgtttcttatctgctcgaaagcctgaatgataaacaacgcgaagctgttacggcatcgcgtaccaatatgctggtgctggctggggctggcagtggtaaaacgcgcgtgctggttcaccggatcgcctggttactgtcagttgaaaatgcgtcacctttttccatcatggcagtgacttttaccaataagtcagcggctgaaatgcgccaccggattgaaaacctgattggcaccagccaagggggaatgtggatcggaacattccatagtctggctcatcgcctgctgcgttttcatcaccttgacgccaatctgccgcaagatttccagatcctcgatagtgaagatcagcacagactgatcaagcgtattatcaaggcgatgaatctggatgacaaacagtggccagcccgtcagggcatgtggtacatcaacggtaaaaaagatgaaggactgcgccctcagcatatcgaaatctacggcaatccggtagaaacgacatggatgaaaatttaccaagcctatcaggaagcgtgtgaccgcgccggattggtagattttgccgaattactgctgcgtgctcatgaattgtggctgaacaaaccgcagatcctgcaacattatcgtgagcgtttcactaatcttatggtggatgaatttcaggacaccaacagtattcaatatgcttggatccgcctgctggcaggagatagcggcaaggtgatgattgtcggtgatgatgatcagtcgatttacggctggcgtggggcgcaggtggaaaatatccagcgttttctcagggattttcccgccgcagaaaccattcgtctggaacagaattatcgttccaccagcaatatcctcaaagcggctaacgctctgattgctaataacaacgaccgattgggtaagagtctgtggacagaaggcggggaaggtgaaccgattgcactttactgtgctttcaatgaactggatgagtcacgttatgtggtcagccgtatcaagcattggttggataacggcggtgcactgaaagagtgtgcgatcctgtatcgcagtaatgcccagtcccgtgtgttggaagaggcgttattgcaggtttctatgccttaccgcatttatggcggccagcgcttctttgaacgtcaggaaatcaaggatgcgttgtcttacctacgtttagtatcgaaccgttatgatgattccgctttcgagcgtgtggtcaatacgccgacgcggggtatcggggatagaacgctcgatgttgtgcgtcaagtggcgcgtgatcagcagaaaacgctatgggaaagctgtctgctgctgcttcagcaaaaagtgttggcggggcgtgctgcatctgcattgcagcgttttattgaattaattgacgcgttggaaacggaaacgcaggagatgccgctgcacgtacaaaccgaccgcattatccgtgactccggcctgtgggcgatgtatcagcaggaaaaaggcgaaaaagcacaggcgcgtatcgaaaaccttgaagaactggttactgcaacccgccagttcagttttaaggatgaagatgaagacttgatgccattgcaggcctttttgtcccatgcggcactcgaagcgggggaagggcaggcggatgtttatcaggatgccgtacagttgatgaccctgcactctgcgaaaggtttggaatttccgcaggtcttcatcgtcggtatggaagagggaatgttccccagccaaatgtctcttgacgaaggcgggcgattggaagaagaacgtcgtttggcctacgtgggcgtgacaagggcgatgcaaaaactgacactgacttatgccgaaacccgtcgtttatatggcaaggcagtgtatcatcgcccgtctcgttttgtcggggaactgccgacggaatgtgttgctgaagttcgtctgcgggcaaccgtatcacgtccggtcagccataagcagctgggaacacctatcagtgccggcgacagtggttacgcacttggtcagcgtgtacatcatccgaaatttggtgaaggaacgattatcaatatcgaaggcagtggggaacattgccgcctgcaaatcgcgtttcaaggtgaaggtatcaagtggctggttgctgcttatgccagacttgaaaca

SEQ ID NO: 44919 - DNA, 990 bp, Xenorhabdus nematophilus
aaagcaagctggttaaaccgcgaacctcagttctctgcgtttacgaatggactattactggatttctggaaaaccagagacgaacgggaatttatgggtgttgatgatatccctattcgttatgtctctttccgttctctccatcacgataaaacgttgttgatcctgccgggccgcagtgaaagctatgtgaaatatcctgaaatagcctacgatttttaccacttgggctacgacatttttattattgatcaccgtgggcaggggcgttcagggcgaatgcttgatgatccccaaaaaggccacgttgaaaaatttgatcactatgtggatgatctagccaaatttgttgaattggaaattaccccgcgtcagtctcacggttattatgcgttggctcattcaatgggagccgcgatcctcagccgttttctattacggcaagaacttgtacgtcaagagcctgattttcgggcggtagctctgtgtgcaccgatgtttggcatcaacttaccgatgccgcgctggttggcaaattttctggtcaatcaggctgaaccttatcctaaaaggcgtaacagctacgcggtatcaacagggcagtggcgtccgttgccctatcttatcaacctgttaacccacagttatgcacgttatcagcgctatttacgctattatgccgattatcctgaattgcgcctcggagggccgacttaccactggatgcgtgaaagtatgcaaatgggagacgaactgattgaaaatgcaggggtaattcagactccgcttattgttttaaaagcgagtgaagataagatcgttaataatcgggagttactggcattttgtgaatctcgacaaaaagccggaacaggaaaagcaggaagaaaacctctggtcatccaaggggcacatcacgaaatcctgttcgaaaaagatgcattgcgggcgcaggctcttaatgcaatttgtgatttttttgaccagcac

SEQ ID NO: 44920 - DNA, 858 bp, Xenorhabdus nematophilus
gtgctggataatattaaaattaaattgcaatatttactgccaaaacaatgtattactaatttggcaggctggttcgccaataaaaaggcgggctggttgacacagtttgcaattcaatctttcgccaaagtctataaagtagatatgaatgaagccgaaaattcttcattcacagcttactcaacattcaatgaattttttgttcgcccattaaaagagggcattcgtcccatcgtcaatgaagctcaccagttggcgctgccagcagacggaaccatcagccagctcgggatgatccgtgacgatcaaattattcaggctaaaggtcactactataccgtagaagctctgctggccggccagcatcaacttgctgaacagttccgcaatggccatttcgtcacaacttacttatcacccaaagattatcaccgtgtccatatgccgtgtgacggcgtactgcaagagatgatctatgttccaggcgagctgttctcagtcaatccattgaccgcagcaaatgtccctaatctgtttgcacgtaatgagcgggtcatctgcctgtttgatacagctttcgggccaatggtacagattctggttggtgcaactattgtcggcagtatcgaaaccgtctggagcggctgtgtcacccccccgcgtgaaggcatcatcaagcgttgggcttacccagcagcaggtcaggaaggcgcgatttctctcaagaaaggagaagaaatggggcgtttcaaactgggttcaacggtgatcaacctgtttgcacccaatcagattcaatttgccaataatttatacagcggctcacaaaccctgatgggtgacctgttggcacagtct

SEQ ID NO: 44921 - DNA, 1251 bp, Xenorhabdus nematophilus
atggataaatttcgagtgaaagggcctacctgcttatcgggtgaggttactatttccggagcaaaaaatgctgcattacccattctgttcgcagcgctgctggcggaagagccagttgaattacagaatgtacctgaattaaaagatattgataccaccatcaaactactcaaccgtttgggaaccaaagtaaaacgcaatggttctgtttttgttgatgccagtaacgttaacgaatactgcgcgccttatgaactggtcaaaacgatgcgggcttccatttgggccttggggccgctggtcgcacgtttcggtcaagggcaggtatcactgccgggtggctgtgccattggtgctcgccctgttgatctgcacatttctggtctggaacagctcggtgcaaaaattgttctcagtgaaggctacgtcaaggcttccgtcgatggtcgcttgaaaggcgccagcattgtcatggataaagtcagtgtgggtgcgaccgtcaccatcatgaccgcagcgacactggcggaagggacaaccatcattgaaaacgcagctcgtgagcctgaaatcgaagatactgccgattttctgaatacactgggagcgaaaattaccggagcaggcaccgatcgcattgtgattgaaggggtagagcgtctgggaggtggtgtttatcgtgtgctgcctgatcgtatcgaaacaggaactttccttgtcgctggtgccatttcccgtggcaaggtgatttgccgtaataccaagccgaatacattggatgccgttttatccaaactgcgtgaagctggggcagacattcaggtgggagatgattggattagccttgatatgcacggcaagcgaccaaaggcggttacattccgcaccgccccgcatccgggctttccgacagatatgcaggcccagttcagcttgttgaatatggttgccgaaggtgtcggcatgatcactgaaactatctttgaaaatcgcttcatgcacattccagagttgattcgcatgggtgcgcgtgcagaaatcgagagtaatacggtagtttgtcacggtgttgaaaatttatctggcgctcaggttatggcgactgatttgcgtgcctctgcgagtttggtattggctggctgtattgctgaaggcaccacggtagttgatcgtatttatcatattgaccgaggctacgagcatatcgaagataaactacgtggtttaggtgcgaatatcgagcgtattaag

SEQ ID NO: 44922 - DNA, 951 bp, Xenorhabdus nematophilus
atgtttctgactattgctctgttcattaccgggttgattttactggtgtatggatctgatagattagtatatggtgctgcggtttttgcccgctcactgaaaatacccccctatatcgtcggattgacagttatgggaatcggcacttcactgccagagttgatggtatctatcacagcagctcaagatgggctaccgaacatagctgtaggcaatgccattggttccaatattaccaatctgctactgattactggcgctgcgtcactcattcgaccgatcacagtgaaatcagatatcctgaggcgggaattgccgctgatgttgctgattactgcatttgtaggctatattctggcagacagctacctgaaccgcctggacggtatcgtcctgttacttaccgccttgttttttatcgtcataatgatcaaaatgacaacagtttcccaagatgatggtctagacagctatatgcaggaacgagatgcagaattacctgtcgaaggcaacaaaggcatcgcacttctctgggttgttttaggattgattatcctccccatttctacccgcatggtgattgacaatgcggctgtgattgcacgtatttatagcatcagtgagctgattattggcctgacaattctggcggtaggcaccagcctgcctgaactggctacttcaattgctgcggccattaaaggcgagaatgatatggcgatgggcaatatcatcggctcaaatgttttcaacatcactctggtattgggtatccccggtatactttcacccggcgttatttcacctcaggccttttcccgggacttctgggtcatgatggctgccagtgtgttattcacgatattctgtctggggagaaagcatcgattgaaccgattaaacggcatcctgttactgggctgttttatcgcttattttttcgtacttttt

SEQ ID NO: 44923 - DNA, 597 bp, Xenorhabdus nematophilus
gttctagtaacccgccaagcccctgactttacagccgcagcggttctcggtaacggtgaaatcgttgataatttcaacctgaaaaaccacctgaatggtcgtccagccattatcttcttctggccaatggacttcacttttgtttgcccttctgagctgatcgcgtttgatcaccgttatgaagaattcaaaaagcgcggtgttgaagtcatcggcatttccttcgactctgaattcgttcacaacgcatggcgtaaaaccccaatcagcgaaggtggcatcggcgaagtcaaatacccaatggttgctgacatcaaacgtgacatcatgaaatcttacggcattgagcacccagaagccggtgttgccctgcgtggttctttcctgatcgacaaaaacggtgttgttcgtcatcaagtcgttaacgatctgccactgggccgtaacatcgatgaaatgctgcgtatggttgacgcactgcaattccacgaagagcacggcgaagtttgtcctgcacagtgggcaaaaggtcaggaaggtatgggtgcgtcccctgaaggcgtcgcaaaatacctgaccaaaaacgctgataaactg

SEQ ID NO: 44924 - DNA, 1143 bp, Xenorhabdus nematophilus
atgataaaacacaacgcaatggtaatggcaattccggttctcctcatcgctggcacagtaaatgctgctgaaatttataataaagacggtaataaaattgatttatatggcaaggctgatgttcagcattattttgccaaatcagggaataaaaaggatggtgataattctgtcgctcgtctggggatcaaaggagaaacccagattacggatcagttgacggggttcgggcgttgggaatataacatgggtgcaagcgggtctgaaaccgaaggtgctaagaataacagaacgcgtctggctttcgccgggttgaaattcggcaagtacggctcactggattatgggcgtaactatggtgtggtatatgacaccaacgcatggacggatgaattgccattctttgggggtgattccatagctgcgaccgataatttctggatggggcgttcgacagggttattaacgtaccgtaatactgactttttcggattggtggacgggcttaagtttgccctgcaataccagactaaaaatgacagcaacaccattaatggccgtgatgatattttgagacaaaatggggatggttttggtctttccagctcctatgatttcggtaatggtatcagtgtggccgcatcatatggcaactctaaccgaacttccgcacaaaaaaatgggactgataaaacgaaggttgtcgccaaagggaataatactgaagcatggctgatgtctgtaaaatatgacaaaaacaatgtgtatctggccgctatgtatggtgaaggccgtaatttaacccgatttggtaaactcgataattatgttttgttcgcaaataaaacacaaaatatcgaactgaccgctcagtatcagtttgattttggtctgcgtccatcaataggctatgtttattcgaaaggcaaagatttgggtggagacagtgagactaacgtgctggctgctaaaagctctgaagatttagtgaattacgtctctgtcggtgcttactataattttaacaaaaatatgggcacttatgctgaatataaaatcaatttgatgaaagacaatgactttaccaaaaaagtgaacatcaatacggataatgttctgggggttggtttagtttatcgattc

SEQ ID NO: 44925 - DNA, 1248 bp, Xenorhabdus nematophilus
atgctagagcagatgggaaaagcagctaaagcagcatcatggcaactggctcaattgagtaccagccagaaaaatcaggctctgagtcatattgctgacttgcttgaaaaagaaacagaagtgattcttgccgctaatcagcaagatatggaacaggctcgtgaacaaaacatgagtgaagcactgcttgatcgattattgctgacacctggacgattgagtgccatcgccaatgatgtgcgtcaggtttgtcgtctggctgatccggttgggcagattctagatgggcaatcattggacaatggtctgcaacttagtcgtcgccgtgttcctctgggcgttatcggcgtgatttatgaagctcgtccaaatgtcacgattgatgtagcctcactgtgcctgaaaaccggaaatgcagttatcttgcgtggtggcaaggaaactcatcataccaatcaggtcatggttaaagttattcagcaggcgctggagcaaagtggtttacctgccactgcggttcaggccatcggtaaacccgatcgtgagttagttgctgaattgctgaaaatgaatagctatgttgatatgttgatcccgcgtggcggggctggtttgcataaactttgtcgtgaacaatcgactattccagttatcaccggggggattggtgtctgccacacattcgtagacgaaagtgtcgatgttgaaaaagcgctggatgtgatcaccaatgcaaaagttcagcgcccaagtgcctgtaattccttggaaactttactgatacatgaacaaattgcgtctgattttctgccagcattgagtgccagaatgaaagagcagggggtgacactgcatgcaggagtatctgcgatggcactgctgaaagagggtccggccaaggtcgttgaagtaatagaagaagattactgtgatgaatggctgtcactggatatgaatgttgagattgtcagtggtatcgatcaggctattagtcatatccgcacatatggtactgctcattcggatgctatcctgacagagagcttgcaacaggctgattattttgtcagtcatgtggattcatcggccgtgtatgtgaatgcaagtactcggtttactgatggcggccagtttggtctgggggcagaagttgctgtcagtacccagaagttacactccagaggcccgatggggctggatgcgttgacgacttataagtggattggctatggcgattatctatcccgt

SEQ ID NO: 44926 - DNA, 480 bp, Xenorhabdus nematophilus
atgaaacagactctattcatcgtaggcgcacgaggtgctgggaagacgacaataggtaagttgttggctgaagcactatcgtatacgtttattgatactgatgaaagtattcaagccttttgtggaatgactattgctgaccttgttgaacaatatggttggacacatttcagggaattagaaagtcaaatactaaaaaatgccagtcagaataagtgcgttatttcaacgggaggcggaatgatactgtcgtctgaaaaccgccagtatatgcaacaaaatggtattgtggtttatttacaggctccagcggaagttttaatcaaacgactatcgctcaacccagaaaatacacagcgccccagtctgacaggtaaatcgatcacagaagaaatcgaaagcatcttgactgaaagagagcaattataccgtgaatgtgcaaatttcattgtggatgccaattcttcgacagaaaatatt

SEQ ID NO: 44927 - DNA, 981 bp, Xenorhabdus nematophilus
atggcaaacggtaaggttctcagacagcttataaaagctggggcgacaggtgatgtcgcgaccttccgtcgtgtttcggaagtgatcattgaggaagaacgacaaaaacagcatcatcttcttgcgaatgatcttgaacatatcctgtatggagatcacaccatacagacctcccgcgtgcctgcagctccccagatgcctgttgataaagagagaggcctaccattactggatattaaacagccaagccgttctctgaatgaaatcgtactacccgaatcaagttcagatgcaatcgaagagattcttgaagaaaatcgcagagctgatgtgctacgcagctatggaatgaaagctgttagtaaagtaatcttttttggtcctccgggatgcggtaaaactctggcagcagaagtagttgcttgtgagttggatatgcccttggcaatcgtcaggcttgatactcttgtttcttcttatcttggtgagactgctgctaacctacgccaaatatttgattttatctctcagtatccaatggttgtacttttcgatgagtttgatgctattggtaaagaacgaggggatagtggggatcatggcgaattaagacgggtcgtgaatgcagttctacagatgatggatgcatatcaggggaaaagcttgattcttgcggcaacgaaccatgagcatattctggatagcgctatttggaggcggtttgacgatgcaatcgaattcccactgcccgacaaacatcaattattagaattgatgaagctaaaacttcgtggtatacgtcgccagtttgagcttgaagatgatgccgtgctctcactatttattggaaaaagtggtgccgatttagaacggattgtaagacgtgcaatcaaaagaatgattttacgtagccaagagtttttaactctgaaagaccttaagaatgcactcttgcgggaaaatgtaaataaaactcgtcag

SEQ ID NO: 44928 - DNA, 1101 bp, Xenorhabdus nematophilus
atgaaaaatgtaggttttatcggctggcgtggcatggtcggctcagtattggtacagcggatgttggaagagcgggattttgatgaaataaatccggtttttttcacgacttcccaacacgggctttctgccccggaatttgcaggaaaatcaggtgtattacaggatgcttttgatattggggcactaagtgcgttggatatcatcattagctgtcagggcggggattataccaatgaaatttatcccaagctgaaagcaaccggctggcagggatattggattgatgccgcatcttccctgcgtatgagtgatgatgctaccattattctcgatccgattaaccatcaacatattcaaaacagcctgaataaaggcatcaaaacctttgctggcgggaactgtaccgttagcttgatgttgatgtcattgggcggattatttgccaatgatctgatcgagtgggcatcggtatcaagctatcaggcagcttctggtagtggtgcccgccatatgcgtgaactgctggtgcaaatgggaatgctgcataatcaagttgcagatgagttgcaagatccggcttccgcaatcttggatattgaaaaacgtgtcacggattttacccgcagtggtgcattgccgacagatcaatttggcgtacctctggcgggaagcttgatcccgtggattgataagcaattggaaaatgggcagagtcgcgaagagtggaaaggtcaggcggaaactaacaagatcttaaacacgggcagcaatgtaataccaattgatggcttatgtgtccgcatcggggcattgcgttgccatagtcaggcattcaccctgaaattgaaaaaagatattccgatccatgaaattgagacgctgttggcttcccataatgattgggttcgtgtcattccgaatgatcgtgaactgacaatgcgagagctgacacccgctgcggtgactggcacattgaatacgccggtgggtcgtttgcgtaaactgaatatggggccggaatacctatccgcttttaccgtgggtgatcagcttctatggggagcggctgagccgttgcgccggatgttgcgtattttg

SEQ ID NO: 44929 - DNA, 1827 bp, Xenorhabdus nematophilus
atgtgtggaattgttggtgcagtagcacaacgtgatattgcagaaatactgatcgaaggtcttcgtcgcctggaataccgtggttatgactcagccggtttggctgtggttgacagtgaaaacggtatgacccgtctgcgtgaagtcggcaaagtacagatgctggctgatgaagcaggtaaacagcctgtcactggtggtacggggatcgctcatactcgttgggcgacgcatggtgagccgaatgagctcaatgcccatcctcatgtttctgaacatattgcggttgtacataacggcattattgaaaactatgaagaactgcgtgaattattaaaagagcgcggttataccttcttttctgatacagataccgaaaccatcgcccatcttgttcactgggaacagaaacagggtggttcgttgttggaagtggttcagcgtgtgatcccacaattgcgtggcgcttatggcaccgtaattatggacagccgtcatcctgacgtgctggtggccgctcgttcaggcagcccgctggtgattggccttggcgttggtgaaaacttcctcgcatctgatcaactggcgctattaccggtgactcgccgctttatctatctggaagagggtgacatcgttgaaatcacccgtcgtaccgttcgcatctttgatgtcacaggtgcagccgttgagcgtgagcagattgaatccaacgttcagtatgatgcaggtgacaaaggtatttaccgtcactacatgcaaaaagagatctacgaacaaccgatggcaattaagagcacgctggaagggcgtttaagtcatggtcaggtagatctgtcagaactgggtgccaatgctgaagaattactgtctcaggttgaacacattcaaatcgttgcctgcggtacgtcttacaatgcgggcatggtttcacgctactggtttgaatctttggcaggtattccctgtgatgtggaaatcgcctctgaattccgttaccgcaagccagcacgtcgtaagggaagtttgctgatcaccttgtctcagtctggtgaaacggctgatactttggctgcactgcgtttatccaaagaactgggctatctgacttcgctggtcatctgtaacgttgccggttcctctctggtacgtgaatcagactttgccctgatgaccaaagcaggagcagaaatcggcgttgcatctaccaaagcatttaccacccagctgaccgtattattgatgctggtggcttacatggggcgcctgaaaggtgctgacgcagcattagaacaagatgttgtccacgcactgcaagcattgccaagccgcattgaaagcatgttgtcgaaagacaaagtcattgaagcactggcagaagatttctctgagaaacatcatgccctgttccttggacgtggcgatcaatacccgatcgcggttgaaggcgcactgaaactgaaagagatctcttacattcacgcggaagcctatgctgccggtgaattgaaacatggcccgttggcattgatcgatgcggatatgccagtgatcattgttgcaccaaacaatgaactgctggaaaaactgaaatctaacatcgaagaagtccgcgcccgtggcggccagctatatgtgttcgctgatcaggatgcaggttttaccaacagcgaaaacatgaagatcatctccctgccacacgtggaagatctgatcgcgccgatcttctataccgttccactgcaattgttgtcttaccacgttgccttgatcaagggaactgatgttgatcagccacgtaacttggcgaaatcggtgacggtggag

SEQ ID NO: 44930 - DNA, 1380 bp, Xenorhabdus nematophilus
atggctactggaaagattatccaggtaatcggcgccgtggtggacgtcgaattccctcaggacagcgtaccaaaggtatacaatgctcttgaggttaaaaacagtgaagaaaaactggtgctggaagttcagcagcagctgggcggtggtatcgttcgctgtatcgcaatgggtacctctgatggtctgcgccgtggtttggacgcgattgatttagggcacccaattgaagttccggtgggtaaagcgacactgggccgtatcatgaacgtattgggtgatccaatcgacatgaaaggtgagattggcgaagaagagcgctggtcgattcaccgtacagcaccaagctatgaagaattgtccagctctcaggaactgctggaaaccggtatcaaggttatggacttgatctgcccatttgctaagggtggtaaagttggtctgttcggtggtgcgggtgtaggtaaaaccgttaacatgatggaactgatccgtaacatcgctatcgaacactccggttactctgtatttgccggtgtgggtgaacgtacccgtgaaggtaacgacttctatcatgaaatgaccgattcaaacgtactggataaagtatctctggtatatggtcagatgaacgagccaccaggaaaccgtctgcgtgtagcactgacgggtctgactatggctgagaaattccgtgatgaaggccgtgacgttctgttgttcgtcgataacatttaccgttataccctggcaggaacagaagtatctgcactgttgggtcgtatgccatctgcggtaggttatcagccgacactggcggaagagatgggcgttcttcaggaacgtatcacttcaaccaaaacgggctccatcacttccgtacaggcggtttacgtccctgcagatgacttgactgacccatcaccagcgaccacctttgctcacttggatgcaaccgtcgtattgagccgtcagattgcttcactgggtatttacccggcggttgacccactggattcaaccagtcgtcagcttgacccactggttgttggtcaggagcactatgatgtggcgcgtggtgtacagtctatcctgcagcgttatcaggaactgaaagacatcatcgcgattctgggtatggatgaactgtctgaagaagataaactggttgtggcacgtgcccgtaagatccagcgcttcttgtctcagccattcttcgttgcagaagtcttcactggctcaccaggtaagttcgtctctctgaaagaaaccattcgtggctttaagggcatcctggagggtgattatgaccacctgccagaacaggcgttctacatggttggtaccatcgacgaagctgtagaaaaagcgaagaagatg

SEQ ID NO: 44931 - DNA, 861 bp, Xenorhabdus nematophilus
atggccggcgcaaaagagatacgtaccaaaatcgccagtgtgcagaacacgcaaaaaatcactaaagcgatggagatggtcgccgcgtccaaaatgcgtaaaacgcaggatcgcatggcggccagtcgtccttatgcagaaaccattcgcagtgtgattggacaccttgcgttaggtaatctggaatacagacatccataccttgacgagcgcgaagttaagcgtgttgggtacttggttgtttcgacagatcgtggtttatgtggcggtttgaacattaacttgttcaaaaaattgctgatagaaatgaaagactggtctgataaaggcgttcaagttgatttagcacttgttgggtcgaaagcggtttctttcttttcttctgttggaggcaacattgttgcccaagtaacagggatgggagataacccatcattgtccgagctgatcgggccagtcaacgtcatgatgcaagcatatgacgcagggcgtctggataaattgtatatagtgacaaaccggttcatcaatacaatgtctcaggttccgacaattactcagttattgcctctgccagccggagacgatgaaacattgaagaagaagtcctgggattatctgtatgaacctgatcctaaggcgttgttggataccctgctgcgccgctatatagaatcacaagtttatcagggcgtcgttgaaaacctggctagtgaacaggccgcacgaatggtagcgatgaaagccgcgaccgataacggtggcaacctgatcaaagagttgcagttggtttacaacaaggctcgtcaggccagcatcactcaggaactcaccgaaatcgtttcgggtgcttctgcggtt

SEQ ID NO: 44932 - DNA, 1767 bp, Xenorhabdus nematophilus
cacctgattaaccggttgcaacagcaatccattgaatatcccgaaaagattgcattcaggcaatggtcaccatcagagcagcttgaaatgagttggcaagacgttacttatagaacggaatccatcgcaaaagctttgttgtcactgggtgtagaaattcaggagaaagtcgctatttttgcgcataactgtattgcatggtcattggctgatttggccgttcttcagttacgtgcggttacagtccctctttatgcgaccagcagccgtgatcaggctaccttcattctcaaggatgccggtgtgcgggtactgtttgttggtgagcaagaacaatataatgttgcgatgacattgctggaattgtgccctcaactcaatcatcttattgtgctggacgagtccgttgacttgaagagctgtccgcaggcgcagtatttatctgccttcattgtcaatgcgcacgcacaatatcagccagagcttgataaccgcattgcagggcaggatttaaatgatcttttcaccttgatctacacctccggtacaacgggagagccaaaaggagtgatgctggattaccacaatatcgcttcgcagctttacttgcatgatcagcgtctgacactgaccaaagaagatgtatcactcagttttttaccgttgtcccatatcttcgagcgcgcatggagttactatgtcatgcatacaggggcgcttaatgtctatttaactgacaccaattctgtgcgcgaggcgatggctgaagtacgtcccactgttatgtgcgctgttccccgtttttatgaaaaagtgcatagtgctattcttgaaaaagtttcccgtgcgccatttttgcgcaggctgattttccgctgggcgataaagcggggggagaaccgctggatgcgtcagctacagaataaaaaagcgtgtatcttctctctctgtagtgatcaactggccgacaaactagtgttgagcaagctccgtaacatatttggagggcgagtgcgtttcttacccgtggcaggagcacgtcttgacgatgctattgcccggttttttctatccgccggcattaatatcaaatatggttacggcatgacagaaacttgtgccacggtatcttgctgggaagagaaaaactatctcccaggctcgattggcacaccattgccgagtattgatgtgcgcatcagtgccgaagatgaaattcaggtacgtggccctattgtgatgaaaggctatttcaaccagccggaagaaacggctcatgcttttaccgaagatggatggctgcgtacgggggatgcagggggattggatgaaacaggcaatttgttcatcactgagcgcctgaaagatttgatgaaaacctcgacgggaaaatacattgctccgcaaatgcttgaggggactttgggacaggatcgtttcattgaatatattgcggttattgccgattcccgtaattttgtttctgcgttgattgtccccagttatgatgcattagaagattacgcaaaatccatccatcttcattatcgtgatcgtatcgagttgctgaacaatcgtcagatcatcgaactgtttgaacaacgtttggcggaactacaaaaaaatattgccaaataccatcaggtaaaacgcttcatcctactgccagaagctttctccatggaaaaaggcgaattaactcctacactgaaactgcgccgtaaggtgatttcgcaacattatcacgatgaaatcgaatccatgtat

SEQ ID NO: 44933 - DNA, 1086 bp, Xenorhabdus nematophilus
tctggcagttatcacattgcggttttgcctggtgacggtattggccccgaagtcatgagacaagcctataaagtattggatgcaatccgccagcgttttaacctccacataacaaccagcgaatatgacatagggggcattgcgattgatcgtcatggttgcccgttgcctcaaacaaccatcgccggttgcgaaaaagccgatgcactcctatttggttccgttggcggccccaaatgggaacatttgccccccgcagaacaaccagaacgtggtgcgctgctaccactgcgcaaacacttcaaactgttcagcaatttacgcccggcgcgcttatatgcgggtttggaatctttttgcccacttcgccaagatatcgcggagagaggttttgacattttatgcgttcgtgaactgacgggtggcatctattttggtcaacccaagggacgggaagggaaaggaaaatatgagcgggcttttgataccgaaatctaccatcgtttcgagatagagcggatcgcccgtatcgcttttgaatctgcccgtaagcgtcgtcataaggtcacatcaattgataaagcgaacgttttacagagctccgtactgtggcgtgaagtcgtcagcgaagtcgcaagagcgtactctgatgttgaaatccagcacatgtatattgacaacgccaccatgcaattgatcaaaaatccggctcagttcgatgtcctgctatgctccaatatttttggtgatattttatccgatgaatgcgccatgatcacgggttcaatggggatgttaccttccgccagcctgaatgaaaaagggtttggcttatatgagccagcgggcggatcagcgcctgacattgcaggcaaaaacattgccaaccccatcgcccagattttatctaccgcattgttactgcgttacagttttgagcgtgatgatgctgcaaacgccattgaacacgccattaaccatgcactggagcaaggctatcgaacaacagatttagcaggtaatgacaaagcagtcagtacggatgaaatgggcgatatcattgcacgttatattgccgaagaaatt

SEQ ID NO: 44934 - DNA, 1032 bp, Xenorhabdus nematophilus
cttatgaaagcacttgtttatcatggcacaggcaaaaagcagtgggaaacaaaatcccctcctcaacttattgagtcaaccgatgcaatcgtccgcattatcaaaaccaccatttgcggaacagatctacatatcctcaaaggggatgttccaactgtggatgcagggcgaacattgggtcatgaagggattgggatagtcgaatccgttggagaatctgtccgtaatatcaaagtgggtgataaagtaattatttcctgcatcaccgtttgtggtcgttgtcgttattgtaaacgccagctttattcccattgtgaagatggcggttggatacttggacataagatcgatggcacgcagagtgaaaaagtgcgtattccccatgcagataacagcctacatcgtctgccggaaggcattgatgaagaggcggcattaatgctcagtgacatcctgcctacgggtcttgagattggtgtcatcaatggcaaggttcaaccgggcaataccatcgccttgatcggcgcaggccctgtagggctttctgcgttactggcatcccagttctattcacccgcccatatcatcatgattgataccgatgataaccgccttcatgttgcacaacagtttggtgctgacacagtcatcaaccccacacatcaaaatgtggtggaagtcatccaaaagctgactgatgggattggtgtcgatgtcgcaattgagtgcgttggtatccctgcaacattcaagatctgccaagatatcattactgctggtggatatatcgctaacgttggtgttcatggaaaatcagttgaattgcacttagaagatctttggatcaagaacatcactatcacgacaggattagtgaacacaagcagcacaccgatgctgttgaaaagcctccaatccggcaaaatttcacccgaaaagctggtcactcatcgctattcgctaagtgaaattaaaaccgcctatgaagtttttggtaacgctgagaaggaaaaagcactgaaaattgttctt

SEQ ID NO: 44935 - DNA, 1078 bp, Xenorhabdus nematophilus
atgtctaaaatttttgatttcgtaaaaccgggtgtcatcactggtgatgatgttcaaaaagtctttgctgtcgcaaaagaaaacaacttcgctttaccagctgttaactgcgtcggtactgattccatcaacgcagtgttggaaacagcggcaaaagtacgtgctccggtaatcatccagttttccaatggcggtgcggcattcgtagcaggtaaaggcttgaaggcagaaggccagcaggcggcgattctgggttcaatttctggtgctcatcatgttcatcagatggcagaatactacggcgttcctgttatcctgcataccgaccacctgtgcacgcaaactgctgccgtggattgacggcctgctggatgccggtgaaaaacattatgtgcagaccggcaagccgctgttctcttcccatatgattgacctgtcagaagagtctctggaagaaaacatcgagatttgtggccaatatctggcacgcatggcgaaaatcgacatgacactggaaatcgaactgggctgtactggcggtgaagaagacggcgttgataacagtcatctggacagctcttctctgtatactcagccagaagacgtggcttacgcttatgaaaaactgaacgctatcagcccacgtttcactatcgcggcttctttcggtaacgttcacggtgtctataagccaggtaacgtcaaactgacgccaaaaatcctgcgtaactcacaagactacgtgtctgagaagttcaatctgccacacaacagcctggattttgttttccacggcggttccggttctaccgcagaagagattcaggaagcggtcagctatggcgtagttaaaatgaatatcgataccgatacccagtgggcaacttgggaaggtattctgaactactacaaaaagaacgaaggctatctgcaaggccaattgggtaacccagaaggtgcagacaaacctaacaaaaaattctacgatccacgcgtttggctgcgggctgctcaggtttccatgatcgttcgtctggaacaggctttcaaagaattgaatgcggttgatgtgttgtaa

SEQ ID NO: 44936 - DNA, 1155 bp, Xenorhabdus nematophilus
atgtctgtaattaagatgactgatttagatctggcgggtaaacgcgtactgatccgtgctgatctgaatgtgccggtaaaagatggcaaagtgacctctgatgcacgtattcgtgcgtctttgccgacgattgtgtctgcgttgaatcagggagccaaagtcatggtgacttctcacctggggcgcccgactgagggagaatacaacgaagagttctcactgcaacctgtcgttgattatctgaaagaaaaactttcatctcctgttcgtctggaaaaaaattatctggatggcgttgaagtagcggaaggcgaattggttgtactggaaaacgttcgcttcaataaaggtgagaaaaaagacgatgaaacgttatcaaaacactatgcagcattgtgtgatgtgtatgtgatggatgcctttggcaccgcacaccgtgctcaggcgtccactcacggcgttgctaaatttgcggcaattgcctgtgcgggtccactgctatccggtgaactggaagccttgggtaaagcgctgtacaaccctgctcgcccaatggtggcgattgtggggggatccaaggtctcaactaaactgactgttcttgattcactgtctaaaatcgctgaccagctgattgtgggcggtggcattgccaatacttttgttgccgcagaagggcataatgttggccgttctctgtacgaagatgatttgatccctgaagcgaaaaaactgctggaaagctgtgatattccggttcctaccgatgttcgtgttgctactgaattctctgaaactgcggaagcaacgctgaaatccaccagcgaaatcaaagacgaagagcaaatcctggatttgggtgatgcttctgcagaacgtctggttgaaatcttgaaagatgccaaaaccattctgtggaatggtccggtgggtgtttttgaattccctaatttccgtaaaggaaccgaaattattgctcgtgcgattgctgaaagtgacgctttctcgattgcaggtggcggtgataccctagccgctatcgatctgttcggcattgctgataagatctcttacatctcaaccggtggtggtgctttccttgagtttgtcgaaggcaaaaaactgccagccgttgtcatgctggaagaacgtgct

SEQ ID NO: 44937 - DNA, 912 bp, Xenorhabdus nematophilus
attagctccttagggaaccaaattgataactctttggtttcaaatgccttcggtttcctgcgctttccgctgaatttccagccttattccagtgatgcagaatgggtgattaccggtgtgccttttgatatggcaacatctgggcgtgccggcagccgtcatgggccagccgctattcgtcaggtatcgactaatctggcgtgggaaagctgtcgctggccgtgggacttcagcttgcgcaaacgcctgaatgtggtggattgcggtgatctggtctttaacttcggtgatgctcaggacatgagcgacaagttgcaggcacatgctgaaaaagtgctggcatcgggtaagaaaatgctgtctttcggcggtgatcattttgtcactttgccattactgcgcgcccatgctaaacatttcggcaaaatggcactgattcattttgatgctcatacggacacctatccgaatggcagcaagtttgatcatggtacgatgttttatcatgcacctaacgaagggctaatagatcctcatcgttcggtgcaaatcggtattcgcaccgaacacgatactgacaatggttttactgtattggatgcggcacaggtcaacgatcgtagcgttgatgctgttgttgaacaaatcaaaaacgttgtcggtgatctgccaatttacctgacattcgatattgattgccttgatcctgcttttgcgcccggtacagggacgccagtgattggcgggttgacgtctgatcgtgcactgaaaatcctgcgtggtctgcaacccctgaatatcgtcggcatggatgtggtggaagtggctcctgcctatgatcagtctgaaatcaccgctctggcagcagcgacgattggattggaattgctgtatttgcaggcgtcgaaaaaa

SEQ ID NO: 44938 - DNA, 2097 bp, Xenorhabdus nematophilus
atggcactttccagcgcaataaaaaatcagatcagccaatggtataaggcgttatccatccatattgatggcttcattccacgcgagcctcaacgtcagatgattgcagaggttgcaaagacactggcagatgaagaaggacggcatttggtgatagaagccccgaccggggttggtaaaacgctgtcttacctgatcccgggtattgccgtcagtcgggcggaaaaaaagccgctcgtggtcagtacagccaatgttgctttgcaagatcagatttacagcaaagatttgccgttgttacgcaagctcatccctgacctgaaattcaccggggcttttggccgtgcgcggtatgtttgcccacgcaatctggaagctatctgtgctgcggagggggagcagattgatctgatgcttttggtcgaagacaaaactgaaatcgccaatagtgaagaacgggatctgtgtcgtaggctgcgcagtgattacagcacttttatctgggatggcctgcgtgaccatcatcaactggcgctatcggattctctgtgggcaaaggtcagcaccgataaaatgaattgtttggcgagaaattgccagttttaccatcgctgcccatttttccttgcccgtcgggaaattgaaagtgcggatgttgttgttgccaaccattctctggtcatcgctgcactggaaaatgaatccgttttgccggacgcgaaaaacctgctgctgattttggatgaagggcatcatattcccgatgttgcaagggattcactggaagttgaaggcgaaatcacgttatttcaacttaatgggcagttggatacctttgttcgtaatgtagaacaatacttgcttcaatttcgcccgacaaaaccgccagctttggcaaatatcacccgtttgcaggcgcattgtgaaaaaattcgtgaatgttttaaagagctggcggatatcacacaggtattattgccggaacgccgtgaagcagcagaatatttatttgaactgggaaaattacctgaaaatttgctgttatgctgccagcaattattcaaacttactgatggggtgcgtggcctgtctgaagcgattgtaaatgatcttaccgatcaaacagccaaacaggatattgtcaggttgcaccatgctattctgcaaaccagccgaacattgggttactttgagaatatggtgaaactgtggcgtttagcatcacaggaagaatcttcccatgcaccaatatcgaaatggctcactcgccgttatgagaaaaaccaatcgcatctttattttcactgtgcaggcattcgagtcagtgagcaattaacccagttgttatggcgtaagattccccatattgtagtgacatcagcgacattacgctctctaaatagcttctctcgtattcaggagctgacagggctgcatgaaaattatgatgatcgctttatcaccttgtcatctcctttcgaacacgtacgtcagggacgtattattattcccctgatgacgcaggaacccactattcaaaatgaaatgcagcatcttgaagaaatggcgcgttattttcgttcgcagatactgatgggagcctatcggggaatgctggtgctatttagcagccagcgtgcaatggaaggttttcttactttcgtaaaagaattgcggcttatgttattggtacaaggtgatcagccgcgttatcgattggtggaaactcattgcagacgtattgatgaagggcagcccagcgtgctgattggattacaatcattcgcggaagggctggacttaaaaggtgattatctttcacaagtacatatccataaaatagcttttcctcctgtgaccaatccggtcatcattacggaaagtgaatggctgaaatccctgaagcgatatccttttgaagtacaaagtttgccgagtgcgtctttcaaccttattcagcaagtgggaagattgatccgcagtcatgaatgttatggtgaggtggtgatttatgatcggcgcctactgaacaaaagttatggttcccgtttgttgaatgctttaccggtatttcctattgagcaaccggatgtgccg

SEQ ID NO: 44939 - DNA, 1707 bp, Xenorhabdus nematophilus
caaagagtaagtatcatggaactggaacacgaaagtaaacgtcctctctatattccctacgctggccctatcttgttggaatttcctcttctgaataaaggcagtgcctttactgaagaagaacgcagcaatttcaacttacatggtttattacctcagatagttgaaacgatagaagaacaagccgagcgtgcctaccgccaattttgcgattttaaaagtgacggtgacaaacacatttatttaagaaatattcaggacaccaacgaaaccctgttctatcggcttcttgatgcccatctcagcgaaataatgcctatcatctacacccctacggtgggtgaagcatgtgaacacttctctgatatttatcgccgtgcccgtgggttgtttatttcctatccaaataaagcgtctatcgatgacatgctgcaaaatgccaccaagcagaatgttaaagtcatcgttgttaccgatggtgaacgtatccttggtctgggagatcagggcattggcggcatgggtattcctatcggtaaactctcgctgtatacctcttgtggtgggatcagcccagcttacactctgccagttgtattggatgttggtacaaacaacccgcagcgtctgaatgacccactgtatatgggctggcgtcacccacgcattaccggcaaagaatatgatgaatttgtcgatgaatttattcaggctgtgaaacgccgctggccaaacgtgctgctgcaatttgaagattttgcccaaaccaatgctatgccgctgttgacacgctatcgtcatgatctttgctgtttcaacgatgatattcagggcacagcagccgttgccctcggcagcctgattgccgccagccgcgccgcaggacgccagttgagagatcaaaccgtgaccttcctcggagcaggttctgccggttgtggtattgccgaacagatcgtcgctcagatgaaatctgaaggattgagcgatgaacaggcccgcgcccgcgtgttcatggttgatcgctttgggctgctgactgataaacagccaaacctactggacttccagagtgtactggtacagaaaaacagcgtcctgcaatcatgggatgtcagcaatgacagcatttcactgatggatgtggttcgcaatgccaaacctaccgttttgattggtgtttccggccaatcgggtctgttcacggaagagattatccgtgaaatgcacaaacattgtgagcgtccaatcgtcatgccactgtccaacccgacatcacgtgtggaagcgcgccctgaagacatcattaactggacggatggcaaagcgctggtcgcgactggcagcccatttgcccctgtgaaatatgatggtcaggaataccctatcgcacagtgcaacaactcctatatcttcccaggcatcggcttgggcgtcattgcttccggtgccagacgtgttacggatgatatgttgatggtagccagccgcgcattggcggattgttcaccgttggcacaaacgggttcaggcccattactgccaccgattgatgatattcaaaacgtttcccgcaaaatagctaaagaagtggcgaaaaaagcccagattcaaggcatggctaccgtcacgtcagaagatgcgctggagcaagccattgagcgcaatttctggaaaccagaatatcgcgtctataaacgcacttca

SEQ ID NO: 44940 - DNA, 1404 bp, Xenorhabdus nematophilus
atgtccaaacaacagatcggtgttgtcggtatggcggttatggggcgtaatctggcgttgaatatagaaagccgtggttactctgtatccattttcaaccgctccagcgataaaactgatgaagttattgctgaaaatccagggaaaaaattagttccaagttattccattgaagagtttgtcggttcactggaaaagccacgtcgtattctgttgatggtcaaggcaggtgaagctacggataaaaccattgcatcgctgacgccacatttggataagggtgacattctgatcgatggtggcaatacctattttcaggatactattcgccgcaaccgtgagttgtctgctcagggttttaactttatcggtacaggtgtttccggtggggaagaaggtgcattgaaaggcccgtcaatcatgccgggcggtcagaaagaggcttatgagctggttgcgcctattctgaaagagattgctgccaaagttgatggtgagccttgtgttacttatatcggtgcagacggagcaggccattatgtgaagatggttcacaatggtattgaatatggcgatatgcaactgattgcagaagcgtattctctgctgaaacactccttgaatctgagtaaccaggaactggcggatgtgttcagtgactggaaccaaggtgaactgagcagctatttgatcgaaattaccgctgatatcttccgtaagaaagatgaagaaggtcaatatctggttgatgtcattctggatgaagctgccaataaaggtacgggtaaatggactagccaaagttctctggatctgggtgttccagtaacactaattaccgaatccgtatttgctcgttacatttcctctctgaaagatcagcgtgttgctgcctctaaagttctgtcagggccagaagcccagccattcaatggtgacaaggcagaatttattgagaaagttcgccgtgccttgtatttgggtaaaatcgtttcttacgctcaaggcttccagcagttgaaagcgtcttcggatgattacaactgggatctgaattatggcgaaattgctaagatcttccgtgcaggttgtatcattcgtgcgcagttcctgcaaaaaatcacaaatgcatacaatgagaacgcggctatcgccaacctgctgttagcaccttacttcaagcaagttgcggatgagtatcagcaagccctgcgcgatgtggtttcttatggtgtccagaatggtattccaacgccaacattctctgcggctatttcatattacgacagctatcgttcagcggttttgcctgcaaacctgattcaggctcagcgcgattatttcggtgcgcatacctataagcggactgataaagaaggcgtgttccacactgaatggttagat

SEQ ID NO: 44941 - DNA, 1143 bp, Xenorhabdus nematophilus
atggcagtatcaactttctttatcccgccagtgaataaaatcggtatgggatgcatgactgaagccattgaattaatgaaaaattatggctacagacaggctttgattgtcactgaccgagtgttaaacgagattggtgttgttggagaggttcagaatttactggctgaagcagggataaagagtgcgatttatgatgggacgaatccaaatccgaccactattaatgttgaagaagggctaaccatcctgcgccagcatgattgtgattgcattatttctttgggaggcggttcaccgcatgactgtgcaaaagggatcgcgctggtggcggctaacggtggggatatccgtgactacgaaggcgttgatcgttctgttaaacctcaattgccattgattgccattaacaccacagcgggtaccgcctctgaaatgacgcgtttctgtatcattacagatgttgatcgtcatatcaaaatggctattgtggataaaaatgtgacgcctattttgtcagtcaatgattcggcattgatggccggtatgccggaaggactcactgctgcaaccggcatggatgcgctgactcatgccattgaagcctacgtttctacggcagccaatcctatcactgatgcctgtgcgttgaaagcagtgacgatgattagcgactatttgcgccgtgccgttgcaaatggcaatgatatggaagcgcgtgagaatatggcttatgcacagtttttggcaggtatggcattcaataatgcctctttgggttacgttcatgccatggcacatcagttaggtggtttttatgatttgccgcatggtgtttgcaatgcagtattgctgccacacgtacaaaaattcaatgcaaaagtatctgcatctcgcctgaaagagattgctgctgtaatgggagctgatattgccaacttgaacgatcggcagggtgcagaagcctgtatccaagaaatcagcaaattagcaaaagatgtcaatattccggcggggttgtccgaattaagtgtcaaaattgaagacttgccaatgttggcaagcaatgcgttaaaagatgcttgtggttttaccaacccgattcaggcatcacacgaagagattgtggctatttttaaagcg

SEQ ID NO: 44942 - DNA, 600 bp, Xenorhabdus nematophilus
acagcacagcaaatcgaaaaactggattggaaaaaagtggataatctcatgcccgttatcgtccagcacgctgtatccggtgtggtgctaatgatgggttacatgaataaagaggcacttaatgccacactggattccggtaaagtcacctttttttcccgcaccaaacagcggttatggacaaagggcgaaagttccggccacttcctgaatctggttgatatctatcccgattgtgacaacgataccctgctcgccctcgtcaatccgattggctcaacctgccatacaggaaccgagagctgttttgcaccagcgcaaactgaatggggcttcctctaccaactcgaacaactactggcaagccggaaaaatgccccaccggctagctcttatactgcccgtctgtatgccagcggcacaaagcggattgcccaaaaggtcggtgaggaaggcatagaaaccgcactggcagctacagttaatgatcgggaagaactgaccagcgaagctgctgatttgatttaccatctgctggttttattacaagatcaagatttggatctcagttgtatcatccgccaattgcagaaaaggcat

SEQ ID NO: 44943 - DNA, 774 bp, Xenorhabdus nematophilus
atgttggcaaaacgcataattccttgccttgatgttcgtgatgggcaagtggtcaagggagtacaattccgtaaccacgaaatcatcggtgatatcgttccacttgcacagcgctatgcccaagagggagctgatgaactcgttttttacgacatcaccgcttcttcagatggtcgtgtggtagataaaagctgggtggcgaaagtcgccgaagtgatcgatattccattctgcgtcgcaggaggtatcaaaactaccgaagaagctggccagattttatcatttggtgccgataaaatttcgattaactcccctgctctggctgatccttcattaatcagtcggttggccgatcgttatggcgttcaatgtgtagtaatcggcattgatacgtggtttgatgaaaatagcaacagctatcgggtctatcaatttactggtgatgaaaaacgcacaactgcaacacaatggcaaacacgggattgggtcagggaagtacagcaacgtggcgcgggtgaaatcgtcctgaacatgatgaatcaggatggtgtccgcaatggctatgatcttacccaactgaaattggttcgggatatctgctccgtccctttggtcgcttccggcggtgcgggtacgccagaacattttttggatgcatttaaactggctaatgttgacggtgccttggctgcctccgtatttcacaaacagatcatcaatatcggtgagctcaagcaatatcttgctacacagggtgtcgaggttagaacatgt

SEQ ID NO: 44944 - DNA, 1065 bp, Xenorhabdus nematophilus
atgagccagaaactgctttttattgaccgtgatggaacgttaatcacagaacctccgaccgattaccaagtcgatcgccttgataaattggcctttgaagctggtgtgatccctgccctgttatccctgcaaaaagcgggttacaaactggtcatgatcaccaatcaggatggattggggactgatagcttcccccagaccgattttgagccaccacacgcactgatgatgcaaattttcacttcgcaaggcattcagtttgaagaagttatgatctgtcctcacaaacccgaagacaattgcaactgccgcaaacccaagctcgggttggtggaaaaatatctaacagaaggcatggtagatatgaaaaacagttacgttatcggggatcgggaaaccgacttacaattggctgaaaacatgggaattaaaggaattctctatcaagcccaatcacttggttggtcaacgatttgtgagcaactgacccacaaagatcgtcatgccagcgttgaacgtaaaaccagagaaactggtatcaatatcgatatctggctggatcgcgaaggtagaagcgaaatcaatactggcgtgggtttctttgatcacatgctggatcagattgccacccacggcggtttccgcatgaatatacaggttaagggcgatctctgtattgatgatcaccacaccgttgaagatactggattggccttaggtgaagctctgaagcaagcattgggcgataaacgcggcattgcccgttttggcttcacattaccgatggatgaatgcctcgcccgctgtgctctggatatttccggtcggccccatctcgaatacaaagcagagtttaaacatcagcgtgttggagatttaagtactgagatgatcgaacactttttccgttcactttcttatacgatgggatgcaccttacacctgaaaaccaaaggtaagaatgatcatcatcgggcagaaagcctgttcaaagtctttggtcggacattgcggcaggccattcgcatagaaggtgatgttctgcccagttctaagggcgtacta

SEQ ID NO: 44945 - DNA, 1062 bp, Xenorhabdus nematophilus
atgagtactgtttttaatgtcaattcactggcaagagaaaatgtccgcaaattagtcccttatatgtctgcccgccgtttaggtggcaaaggtgacatctggttaaatgctaatgaatatcccatcgcacctgattttcagttcagcgaaaaaacgctcaaccgctaccccgaatgccagcctgcctccgtaatccagcgctatgcagattatgctggtctgcaaccgaatcaagtccttgtcagccgtggcgccgacgaatccattgaactattgatccgcgttttctgtgagccgggaaaagacgccgtactgttctgccctcccacttatggcatgtacagtgtcagtgcagaaacctttggtgtagagcagaaaaagatccccacccgtgctgactggcagccggacattaccgccatcgaaaataatctggatcgcgtcaaactgatttatatctgtagccccaacaatcccacgggtaatctgattgctcctgcggcgctgcgccagatccttgaactagctcgtaaccgtgccattgttgccattgacgaagcctatatcgaattctgtccgcaacatactaccacccgctggctgcgagactatccgcacttggtgattttgcgaaccctctcgaaagctttcgcactggcaggactacgctgtggatttacgctggcttctcccgatattatcgcgctaatgttgaaagtgattgctccttatccacttgctatacctgtggcagacatcgctgcgcaggcactgacaggagcaggcattcatataatgaaagatcgtgtagaggaagtggtcaagaaccggacttatctccagcagacattgaatgaactggcaatggtcgaaaaagtgtttccgagcgaagccaactatcttttagtgaaatttaccgatgcggaaatcgtattcagggcattgtgggaacaagggatcattttgcgtgatcagcgaaaacaagcgggactaaataattgcctgcgtatcaccattggtagccgaaatgagtgtaaacagttggtcaatgccatcgctgct

SEQ ID NO: 44946 - DNA, 1290 bp, Xenorhabdus nematophilus
atcaattttaagaccgttatccgctggcaggaatgcccaccagaacagcaaaaagcgttgctgacacgccctgctgtcgtcgcttcagaaaatatttcccgcacggtaaaacagattctggaaacggtcaaagccaacggcgatgaagcattgcaggaattcagccaacgcttcgacaaaacaacaatcgatactatcccgctttctacaagtgaagttaacgcagccgccagccgcctgacaccagaaatcaaacaggctatgcagcaggccatgaataacattcgcctgttccatgaagcccaaaaacccgctgtgattgaggttgaaaccctgccgggtgttcgctgccagcaagtcacacgcccaatcgattctgtggggttatatattcccggaggttctgcgcctctgccttccactgtattaatgctgggaatacccgctggcatcgcagagtgccgtaacgttattctgtgctccccacccccgattgccgatgaaattctctatgccgcacagctctgcgggattaacgaaatatttcaggttggcggcgcacaagccatcgcagcaatggcttttggcacagaatccgttcctaaagtggacaagatttttggcccgggtaatgcatgggtaacagaggctaaacggcaagtgagtcagcgcttcgacggtgcagccatagatatgccagcaggtccatcagaagtactggtaatagcggacagtggagccaatcccgcatttacggcagcagatctgctttcacaagcagagcatggccctgattctcaagtcgtgctggtcacacctgacgaaatttttgccgagcaggtgatccgtgaaatcgaaacccaacttacggccctgccacgccagcaaatcgcgattcaggctctgcaatccagccggattatcgtcactgacaatctgacccaatgtgtagcgatcagcaatcaatacggccctgaacacttaattatccaaacccgtcagcctgagcagcttgtggaaaaaatcaccagcgcaggttcggttttcctcggagactggtcgccagaatccgcaggagactatgcttcaggcaccaatcacgtcttgccgacctatggttatacttcaacctattccagcctcggtctggcagatttcctgaaacgaatgacggttcagcaaattacaccgcaaggattaagaagcctcgctccaatcatcgaaacactggcgcaggcagaacaactcaccgcgcacaaaaatgccgtcacattacgcatagctgccctg

SEQ ID NO: 44947 - DNA, 618 bp, Xenorhabdus nematophilus
atgctgacaatctggggccgtaaaagctcatcaaacgtaaaaaaagtcacttggtgtctggaagagttaaacgtgccatatcagcaaattgatgttggtggtaagtttggcaaacttaatactccagaatacctgctcatgaatcccaatgccgtcattccctgtttgcaggaagacgattttatcttatgggaatcaaacacgattgtgcgctatatttcggcaaaattcggcgaaaatagtctttatcctgccaatcttcaagaaagagccaaaattgatcaatggatggattgggtcggctgcaatttcttcccgccaatcaaacaacttatgattaacattgtcagaacaccagaagatcagcgtgacccgaaagtgattgcccagatattaaaagagatagaaaaactgctgaaaattgtcgatgacatgctgggtaagcaaaaatacctttccggtgataaatttggcatggcggatatcgccctcgcgccactggtctatccgtggctaaacatcgagatagagcgtccatctctgccaaatttggaacgctggtatcaattactaaccgaaagaccagcgtttcaaaaaatcgttatgattgaaataagc

SEQ ID NO: 44948 - DNA, 1332 bp, Xenorhabdus nematophilus
tcaaaacaaagcctgcaaaggggacttgaggcacgtcatattgagctgattgcgctaggtggcacaatcggcgttggactgttcatgggttctgccagcacgttgaaatgggcgggaccttcggttctgttggcttacatcatcgctgggatttttgtttttttcatcatgcgttcgatgggggaaatgctgttccttgaacccgtcactggctcattcgctgcgtttggacataagtacctcagtccttattggggatgtctgacggcttggggctactggtttatgtgggtttcagtgggaatttcagaaatcaccgctgtgggggtctatgcagaattctggttccccgatctgccccaatgggtttctgcattggttgctgtcgggttggttgctctagcgaacttggcggccgtgcgtttgtatggggagctggaattctggtttgccatgatcaaagtgaccacgattatcgtcatgatcctgattggtatcggtttgatctttttcggactgggtaatgactggcagcctattggcttggataatttgaccgcacatggcggctttttctcgggtggctggaaagggttcttgtttgccctctgtatcgtggtggcctcgtatcagggagtggaactggttggcattacagcaggggaagctaaaaacccacaggtcacacttaaaaaggctattaacaatattctgtggcgtattctgatcttttatgtcggtgcgatttttattgttgtgaccctgtttccgtggacagaagctggtacgcatggcagcccgtttgttatggttttttccaaagtagggattgcttctgccgcagctgtcattaacttcgtggtgctgactgctgcgctttcgggatgtaacagcggcatgtatagtggtggccgaatgctgtatgccttggcgaagaatcgccagttaccggcttcattgctgaaattgtcaaaaaatggcgtacctgtgagatgtattgcgatcaccattggttgcctgattgcaggttccagcctgaactacctgatcccgaatccacagtcggtattcgtttacgtttatagtgccagcgtattgcccggtatggtaccgtggtttgtcattctggtaagccagttgcgtttccgccagcagaatcaggaagcattaaaacagcatcggtttaaatcgctccttttcccttatgtcaattacctgactctggtatttctgagttgtgttctgatagggatggcaattaatccggatacgcgtttttcactgatggtaggtggcgcatttttactacttgtgtcactggcttattggctg

SEQ ID NO: 44949 - DNA, 879 bp, Xenorhabdus nematophilus
atgaaaggaattatactcgcgggaggctccggcactcgtctgtatccaataacacgcggcgtctcaaagcagttattgcccatttatgataagccgatgatctactatccactgtcggtcttaatgctggcagggatccgcgatatcctgattatttccacgtcggaagacttgcctgctttcaaacgcttattgggcaatggcgaacagtttggtattcgcctgagctatgcagtgcaaccttctcctgatggcttggcacaggcatttatcattggtgaagaattcattggcaatgatgcctgctgtctggtgctcggagataatatctactttggtcaggcgtttagtccgaaactgcaaagtgtcgttgcccgtcagactggagcaacggtattcggttaccaagtgatggatcctgaacggtttggtgtcgtggagtttgatgagcaataccgcgtcctttcgattgaagaaaaacccgcccggccgaaatcaaactgggcagtcaccgggctttatttctacgacaacaaagtggtggatttagccaaacaagtgaagccttctgcccgtggcgagctggaaatcaccagcattaaccaaatgtatctggaacgcggcgaattgaacgttgaactattggggcgcgggtttgcgtggctggataccggcacccatgacagcctgattgaggccagtacttttgtgcagaccgtcgaaaaacggcagggattcaaaatcgcctgcctggaagagatcgcatggcgtcacggctggttggatgatgaacagttaaaagccgcggctgccgagttggcaaaaacgggctacggcaaatacctgatggacttgctccatgtctattcacgccaatat

SEQ ID NO: 44950 - DNA, 1245 bp, Xenorhabdus nematophilus
tttgaaacaatttctgtgatcggccttggttatatcggcttgccaactgctgcggcattcgcttcccgcaaaaaaaacgtcatcggtgtggatgtcaaccaacatgcggtagagacaattaaccgtggcgcgattcatattgttgaacctgatctggacaaagtggtgaaaaccgctgttgaaggcggttacctgaaggccgtgacttgtccgcaggctgcggatgctttcctgattgcagtaccaacgccgtttaagggcgagcatgagccagacatggcctatgtgcgttctgcggcagaatcgatagcgccagttttgaaaaaaggggatttgatcattttggaatccacttctcccgttggtgcaaccgaacagatggcagaatggctggcagcggcacgtcctgagctatcattcccacagcaggcaggcgaaaatgcagacattgatatcgcgtactgtcctgagcgtgttctaccgggtcaagtcatggtggaattgatcaagaacgatcgtgtagtgggtggcatgacattaaaatcgtcccgcagggcgagcgagctgtacaaaattttccttgaaggcgaatgcgttgtcactaatgccaaaacggcagaaatgtgcaaattgactgaaaacagtttccgtgatgtcaatattgcctttgccaacgaactttccctgatctgttccgaacaggggattaatgtctgggaactcatcagtctggcaaaccgtcatccacgcgtcaatatcctgcaaccaggccctggcgtaggcgggcactgtatcgcggtagatccgtggtttatcgtgtcccagaacccggcacaatctcgcttgattcataccgcgcgtctggtgaatgacggcaagccgctttgggtggttgatcaagtgaaagccgcagtagcgggctgtctggtggagagcggcaagcgggcggatgaaatcaaaatcgcctgttttggtctggcttttaaaccgaacattgatgacttacgggaaagccccgctgttcatatcacgaagatggtggcacagtggcatgttggtcaaactgtggcggttgagccgaatgttcatgaattgccgaattcgctgaaagagagtgtggaattaatcgatatgcaacaagcattgaatgaagccgacgttgttttgatgctggtggatcacagccagttcaaggcaattgccggcagagaaataaaacaaaaatgggttgttgatacaaaagga

SEQ ID NO: 44951 - DNA, 1281 bp, Xenorhabdus nematophilus
atgagcaaaacacatttgacagaaaagaagttttccgacttcgcattgcaccccaaggtcattgaagcccttgataaaaagggcttttccaactgcacgccaatacaggcgctaactttgccttttactgtcgaaggccgagatgttgcggggcaggcacaaaccggaacgggcaagacgctggcatttctgacgtctacttttcattatttactgacccatcctgctgcggcagatcacaaaaccaatcagccaagggcgctgattatggcccccacccgcgaattagccgtccagatttactctgacgcggaggagttggcagaagccacgggactgaaaatggggcttgcctacggtggcgacggctatgataagcagcttaaggttctggaatctggcgtcgatatcgtgattggcacaacaggtcgtttaatcgattacaccaaacaaggatatgtcaatcttaatgctgttcaggttgtggtactggatgaagccgatcgcatgtacgatttgggctttatcaaagatatccgctggctgttccgccggatgcctgttgccgctcagcgaatgaatctgctgttttccgctaccctgtcttatcgagtgcgtgaactcgcctttgaacagatgaatagtcctgaatatgtggaagtggaacccttacagaaaacggggcatcgcattcaggaagagctgttttatccttccaatgaagaaaagatgcgtctgttacagaccctgctggaagaagagtggccagatcgctgcatcatttttgccaataccaaacaccgctgcgaagatatctgggcccatctggctgccgatgggcatcgtgttggtctgctgacgggtgatgttgcgcagaaaaaacgtctgcgtattttggaagaattcagtctgggaaatctggatattctggtcgccactgatgttgctgcccgcggtctgcatattccttttgtaacccatgtatttaactatgatctgccggacgactgtgaagattacgtccaccgcattggccgtacgggtcgcgcaggagaaagcgggcattcaatcagtctggcatgtgaagaatacgctctgaatttaacgtcgatcgaagagtatatccagcatcagatccctgtaagcaaatataacagtgatgcactgctgatggatttacctgtacccaagcgccgtaaccgcgctcgttcaggagggcacccacggcgcaccaatatgtcgcgccgtggaaatccgactcgcaaccgtaaacatccaggc

SEQ ID NO: 44952 - DNA, 2001 bp, Xenorhabdus nematophilus
atgcgattaaatcctagtcaacaacaagcggttgaatttgtcacagggccttgtctggttctggcaggtgcaggctccggcaagaccagagtaatcaccaataaaattgcccacctgatccgtgcctgtggttatcaggcacgtcatattgccgcagtgactttcaccaacaaagcggcacgggaaatgaaagaacgtgtcgcgcagactttggggcgcaaggaaaccagagggctgatgatttcgactttccatactctgggtctggaaatcatcaagcgtgaatacaaagcgctgggtatgaagagtaacttttcgctgttcgatgatcaggatcagagggtactgctgaaagatctgacggcggatttgctggaagaagataaggatctattgcaaaaactgaactccagtatttccaactggaaaaatgatctgatgtcacccgagcaggtgattagacaggctcgttcggcgcaggagcatcaatttgcggagtgttatcgccgttatgatctgcatttgaacagttgcaacgttctcgacttcgatgacttgattaccaaaccgacgttgctgttaatgcagaatgaagaggttcgggaacgctggcaaaataaaattcgttatctgctggtggatgaatatcaggataccaacaccagtcagtatcaattggtgaaactattagtgggcaatcgggcacgttttaccgtagtgggtgatgatgaccaatccatctattcatggcgtggtgcgcgcccacaaaacttgatcctgctgaatgaggattttcctcagttgaacgtgatcaaactggaacagaattatcgttcatcagggcggatattgaaggccgcgaatattctgattgctaataatccccatgtatttgagaaaaaactgttttcagaactgggctatggtgatccgctcagggtgatcgaagcaaataatgaagatcatgaagcagagcgagtcgtgggagagttgctcgctcatcactttattaataaaaccgaatataaagattacgccattctatatagaggcaatcatcagtctcgtatttttgaaaaaatgctgatgcaaaaccgtattccttatcgcatttctgggggaacttcattcttttcccgccctgaaataaaggatttactctcttatctgcgggtgttgactaatcccgacgatgacagtgcatttctacggatcgtcaataccccacgtcgagaaatcggcgcgatgacaatccagaaattgggcgagtgggcaaatcagcgtaacaaaagcttgtatcacgccagttttgatctcggtctggagcagagtctgacaggtcgcgggctggctgcgctacagcactttacccactggatggatgaaatttcccgccaggccgagcgtgagccattgctggcagtgcgggatttgctgcgcggtatggactatgaaagctggctgtatgaaacgtcacctagcccaaaagcggctgaaatgcggatgaaaaacgtcaatcagctttttacttggatgagtgaaatgtttgaaggggatgacctgaatgaaccgatgacgctgtcgcaagttgtggcgcgttttaccctgcgagacatgctggaacgtggggaagacgatgaggaattggatcaggttcagctgatgacattgcatgcatccaaggggttagagttcccttatgtttttctggtgggtatggaagaaggtttgttgccgcatcaaagcagcattgatgaaaataatatcgacgaagagcgacgtctggcttatgtcgggatcacccgagcgcggcgggagctattttttaccctcagcaaagagcgtcgtcagtatggtgagctgattcggcctgaaccgagccgatttttgctggagttgccgcaggatgatttgcactggccgagaggcaaaaagatgatcagtgcagaagatcgaatgaagcaagggcaatcgcgtcttgctgatatcaaatcccgtttg

SEQ ID NO: 44953 - DNA, 1662 bp, Xenorhabdus nematophilus
atgagtgaggcagatgcccgcccgaccaactttattcgtcagattattgacgaagatctggcaacgggtaaacatacatccgtacatacccgtttcccgcctgaacctaatggctatctgcatatcggccatgcgaagtcgatctgcctgaatttcggcatcgcgcaagactaccaggggcaatgcaacctacgttttgacgatacaaacccagttaaggaagatatcgagtacgttgactccattaaaactgacgtacagtggctgggtttccactggagtggcaatattcgctactcttctgactatttcgatatgctgtatcaatacgccattgaattgatcaataaaggtctggcctatgttgatgaactcagccctgaacagatccgcgaataccgcggaacgctgaaagagccgggtaaaaacagtccttaccgtgatcgcagtgtggaagaaaaccttgccctgtttgaaaaaatgcgtgccggtgaatttgctgaaggtaaagcgtgtctgcgtgccaaaattgatatggcatctccattcatcgtgatgcgtgatccggtgatttatcgcatcaaatttgccgagcatcaccagtccggcaataaatggtgcatctacccgatgtacgattttacccactgtatttccgatgcgctggaagggatcacccattcaatatgtacattggagtttcaggataaccgtcgcctgtatgactgggtactggataacattacgattgactgccatccgcgtcagtacgaattttctcgcctgaatctagaatacacggtgatgtccaagcgtaaactcaaccaattggtgaccgaaaatattgtcaacggttgggatgatccacgtatgccaaccatttccggcctgcgccgtcgtggttatactgctgcggctatccgtgaattctgccgccgcattggtgtcaccaagcaggataacaacgtcgaaatggccgcattggaatcctgtatccgggatgatctgaacgaaaatgcaccacgggcgatggcggttcttgatccggttaaactggtgattgagaatatgccggaaggtgaaatgatcctgacgatgccgaaccatcctaacaagccagaaatgggcagccgcgaagtcccattcagccgtgaggtttatattgatcgtgctgatttccgcgaagaagctaaccgtcagtacaaacgtctggtgctcggcaaagaagtgcgcctgcgtaatgcttatgtgattaaggcagagcatgttgaaaaagatgcggaaggcaatatcactaccatttactgccactatgatgagcagacactgaacaaagatccggctgacggccgcaaagtcaaaggtgtgattcactgggtgagtgcggtacatgccgtgccagcggaattctatttgtatgaccgtttgttcagtgtgccaaacccaggggcggaagatgatttcctatccactatcaattcagaatcgttggtcgtgcgtaaaggttttgtcgagccagggctggtgaatgcacagccagaaagaacttatcagttcgaacgtgaaggttatttctgtgctgatagcggcctctccagtgcagaacatctggtatttaaccgcacagttggcttgcgtgatacttggacaaagatctctcag

SEQ ID NO: 44954 - DNA, 531 bp, Xenorhabdus nematophilus
aatataaaagctattttatttgatatggatggtactttagttaaatcactttcagaagttgaggctatttggtctatatggtgcgaattgaacaatatatccataaaaaaagtgttggatatttgtcatggtgttcgttccagagatgttatttcgtctattgctcctcatttgaatatggaagaacaaatacagctattagatgatttagaaattaaatattctgatactgcaaaggcattgcctggggcaaaagaatttctgatttctttagcggcttgtccgtgggctatagtcacttctgccagccaacgagttgcatatcataggatggcaatttgtggtcttaagataccagacttcataattggttctgatgatgtgctgaatggtaagccctatcctgatccctatcttatggcagcagaacgtttgaatattgcggctgaagattgtttagtttttgaagatgctcatgctggggtacaaagcgcattagcagcagggtgtaaggtcatacagattggtgga

SEQ ID NO: 44955 - DNA, 2040 bp, Xenorhabdus nematophilus
atgactaacccgttactgactccttctgtattgcccaaattcgctgccattgaaccaaaacatgtcgtgccagccgtgaaagagacgttagccaactaccgtcaagtgattgagaaagttctggccggaaatgtcacatttacttgggataatctgtgccagccaatttctgaagcgaaagatcatctttcccgcgtgtggtctcctgtcgaacatctcaatgcggtcaaaaatagcccagaacttcgcgaagcctatgaacaaagcctgcctctgatttctgagttcgaaacttggatggggcagcacgaagggttatatcaggcttataaggctctgaaagagagcgaagcctttaaagcactatctcagccacagcgtaaagctatcgaaaatacgctgcgtgattttgagttgtctggcattggtctgccgaaggaaaaacagaaacgctacggtgagatctccgcccgtttatctgagcttggctcccagttcggcaataatttgctggatgccacgatgggatggaccaagctgatcacggatgagtgcgatctggagggtatgcctgacagtgccaaagccgccgccaaggccgcagccgaagccaaagggttagagggctggttgctgacactgaatgggccaagctatttgccggtcatgacctatgccgatgacagtgaactgcgtcaggaaatgtattacgcctatacgacccgcgcttctgagcaaggaccaaatgccggtcagtgggataacagtgccgtcatgacggaaattctcgcactgcgtcatgagctcgcactattgctgggtttcaaaaactatgctgagaactctctagccaccaaaatggctaaaacacctaagcaagtactcgatttcctgaacgatctggccaaccgtgctcatgctcaaggtaaaagagagctggaagaactcaccgattttgccgaatcacactattgggtcgatgagctggaagcgtgggatctggcctattatagtgaaaagcagaaacaacatgatttctctatcagcgatgagcaacttcgcccttatttccctgaacagcgtgtcattgaaggtctgtttgaagttatacgccgcatttatgcgattaccgctaaagagcgccgcgatgtagaaacatggcatcctgatgttcgtttctttgaactgtatgatgaaaaacagacattgctcggtagtttctatctggatctctatgcccgtgagcataagcggggcggcgcatggatgaacagttatgtcggcagaatgcgtcatacttccggcgaattacagacgcctgtcgcttatctgacctgtaacttcaataagccggttggcgatcagcctgccctgtttactcacaatgaagtaacaacgctgttccatgaatttggtcatggcctgcaccatatgctgactcaggttgaaacgttagatgttgcgggtatcaacggtgtaccgtgggatgccgttgaaatgccaagccagtttatggagaactggtgctgggagccagaagcactggcgtttatctccggccactatgagacgaaagaacctctaccgaaagagatgttggataatatgctggccgccaaaaattatcaggcagcgatggcaatcctacgccagttggaattcggtctgtttgatttccgcctgcacgttgaatatgacccggcaaaaggggcgcaaatcctgccaaccttgcagtcagtgaaaaaacaggtcgcggttgtgccatcaccggaatggggacgtttccccaacaccttcagccatatttttaacggtggctatgcggcgggttattatagctatatgtgggccgatgttctggctgcggacgcttattcccgctttgccgaagagggaattttcaatcgcacaaccgggcagtctttcctcgataatatcctgacccgtggcggttcagaagacccaatgacgctgtttgtacgcttccgtggtcgcgagccgaaactggatgcaatgctgaaaagctctggcatcagtgga

SEQ ID NO: 44956 - DNA, 1341 bp, Xenorhabdus nematophilus
atgaatatttcaccctctttggtctcatttcttgattcgattcagtctcacaacccacatcaaccggaatatttgcaggcagtgcgggaagtgttgacatcactctggccttttcttcaacaaaatccgcaatatcgtgagcaaagcctattggaacgtctgatagaaccggaaagagtgatccagttccgtgtctgctgggtcaatgatcagggtaaagtacaggttaaccgtgcatggcgggtacagttcaattctgccattgggccatttaagggagggatgcgttttcacccttctgttaacctttctatcctgaaattccttggttttgaacagaccttgaaaaatgcgttgacgacactgccaatgggcggtgcaaaaggggggtctgatttcgatcccaaaggtaaaagccacggggaagtaatgcgtttctgtcaggcattgatgacagagctttatcgccatctggggccagataccgatgttcctgccggagatattggcgtgggaggccgggaagtggcctttatggcaggtatgatgaaaaaactgtccaacaatacggcatgtgtttttaccggtaaagaactctcttttggtggcagcctgatccgtcctgaagccacgggctacggtctggtttatttcacccatgagatgctcaaacgccacggtatggggctggaagggatgcgggtatcggtctctggcgcgggaaatgttgcccaatataccattgaaaaatgcatagagctgggggcgaaagttgtcaccgtatcggattcaggcggcactgtgctggatgaagaaggcttcactccggagaaactggctcatctcgaagagattaaaaatcaacgttacggccgtgtggaagagtatgccaaagagcacggattgaccttccttaaaggccaggatccgtggtcaatacctgtcgatatcgcattgccttgcgctacccagaatgaactggatctggatgcggcgaagacgctgatcaaaaacggcgtgaaagtcgtcgcggaaggggcgaacatgcctgcgaccatttctgccacagacgctttccttgaagctggcgtcttgtttgcaccgggtaaagcagccaatgcgggaggtgttgcaacgtccggtcttgaaatggctcagaacgcagctcgtctgagttggaaagcagagaaagttgatgtgcgcttacaccacattatgctcgatatccaccatgcctgcgtggaatatggcggggaaggcaagcagaccaactacgtacagggcgcgaatatcgctggttttgtcaaagtggctgatgcgatgctgtcgcaggggattttg

SEQ ID NO: 44957 - DNA, 1263 bp, Xenorhabdus nematophilus
atgactgaatctatgttagctaaaaggcgcagcgcggctatcgcaaaaggcgtcggcgtgacgacacaagtctatgttgaacgtgcggaaaatgctgaaatctgggatgctcaggggcaacgctatattgattttgccgcaggtatcgctgtggtgaataccggccaccgccacccgcgcgtcattgccgcagccagagagcagctggaacaatttatccatacctgtcatcaggtcgtgccttatgaaaattatgtagcgttagccgaacgactgaaccgtctggtgccgggtaatttcgtgaagaagaccgtttttgttaccaccggggctgaggcggtagaaaatgctgtgaagatcgcgcgtgccgcaaccgggcgcagcggcgtagtggctttcagtggcgcttttcatggccgtactttcctcggtatgtcattaaccggcaaagtcgtgccgtacaaaatggggttcggctcgctggttagcgacgtttatcgtgttccgtttccggtagcgctgcacggtatcagcgtggaacagacgctgaacgcgctggataatctcttcaaaaccgatattgagccgacgcgtgtcgctgccatcatcattgagccggtacagggagaaggcggtttctatcctgcgcctcccgaactgctcaaatccctgcgcgaaattgctgatcgctacggtattgtccttattgccgatgaaattcagaccggtttcgcgcgtaccggcaaactgtttgctatggaacatcatgaggttgcagccgatctgaccacgatggcaaaaggtctggcagggggatttccgctggcggctgtaacggggcgagcagagctgatggatgcggtagcaccgggtggcttggggggaacctatggaggtaatccggtggcgattgcggctggccatgcggtgctggatgtgatcgaagaagagaagctggctgcgcgtgcgacgcagctgggagagcggctaaaacaatgtctgaatgaactgcggccgcgtgtcccgcagatcgccgacgtgcgtgggcttgggctgatgattgctgtggaatttaaccgtgcggacagtcaggaacccgatgccggctttaccaacgccgtgcgtcagaaagcgctggagcggggtctgattctgttggcgtgcggtatacacggtaacgtgatccgttttcttccaccgctgactatacaaaatgatgtttttgacgaggcgctcaacgttctggagtctgtactgctcgat

SEQ ID NO: 44958 - DNA, 1434 bp, Xenorhabdus nematophilus
gtaagcatgccggtaccaacgtttaagcatttcattaatggtcagtatattgagtctcaaggttccgagtattttgatctggtcagcccggtcactggtaaagcttatgcgcgttctcctaacgcgactgtagcggatgttgatgatgcttatgcatcggctaaagaggcatttaaaatatggggacgcagtacaccctctgcacgtcagcaggcgttactagcgctggctgatacggtggaaaaaaacgctgaacgtctgattgagtcgcaaagccgtaatacagggcagcttaagcacctgattgcctccgaggagattgcgacgtcggtggatcatatccgcttcttcgccggtgcagctcgttttctggaaggcaaggctacagcggaatatctttctggtatgactagcagtatccggcgtgaaccgctgggcgtggtagggcaggttactccatggaactatccgttgatgatggcggtgtggaagatagctcctgctctggcagcaggtaataccgtggtgcttaaaccgagcgatactacgccggaaagtactctgttgctggctgaactgtccgctccgttcttccctgccggcactttcaacgtggtgctgggtaatgccagcgcaggttctctggtcgtttcacacaaaacgccggctatggtttccatcaccggttccgtacgtgccggtttgcaggttgcgtcttcggcggcagctaatctcaccagagcgcatctggagctgggtggcaaagcgccggtggttatttttgccgatgcggatatagacaaagccgtgggaaccattgttaccgcagggtatttcaacgccggtcaggactgcacggcagcttcacgtgtgctggtgcatgaatctgtttacgatattttcgtcactaaactggtggcggcagctaaagctacccgttttggcgatccagaagataaagaggcgctgtatgggccgcttaataatgttcgccagttggagcaggtcacagggttccttgcacgtctgcccgctcatgcccgtatcgaaacaggaggtcgtcaggctgatcgttcgggatattactttgaacctacggtgattactggtctggagcaagaagatgaaatgattcagaccgaaatttttggccctgttatcacagtacagaagtttctaacagaacaggatgctatcgagaaagctaacgatgtgaaatacggactggcctccagtgtctggacccgcgaccatggtcgcgcgttgcgcctgtctcgtgagcttgactttggaacagtctggattaacacccatattcctcttacggcagaagcaccccatggcggcttcaagaactctggatacggtaaagatctgtcggcttatggtttcgatgaatatacgcgtatcaaacacgtgatgagttccaacgac

SEQ ID NO: 44959 - DNA, 513 bp, Xenorhabdus nematophilus
atgagcaatacccaacagccaaatcatgtttttgtattgatgggggtatccggcagcggtaaatctgcggttgccagtggggttgcccgtaagctgggcgcggcgtttctggatggtgactttcttcatccccgcgccaatattattaagatggcacaaggccacgctttgaatgacgatgatcgtcagccgtggttaaaagcactcaacgatgccatttttgccatgcagcgtacaaataatatctctttgctcgtgtgctctgctctgaaaaaaaactatcgggatatgctgcgtaatggcaacaaaaacctgtcatttctgtatatgcagggggatttttatttaattgaaagccgtctgaaagctcgcaaggaacacttcttcaaaccccaaatgctgatctcgcagtttgaggtattggaagaaccgactgacgatgaaaaagatgtccatcacattgatatcagaccagaccttgatgaagtaatcaaaaacacaatgacaacaatt

SEQ ID NO: 44960 - DNA, 1299 bp, Xenorhabdus nematophilus
aaaccgatcaaaattgccgttattggcggcgggagcagttatacaccggaattggtggaagggattattcagcgtagccaaattattccgctttctgagctggcgctggtggatgtagaagccgggcggcacaagctggaaaccatcgctgcgctgactcgccgtatgctggatcgtcatgatctggagcacgttactgtcacggcgcattattcaccggatgaagcgattaaaggagccagtttcgtactcactcaactgcgcgttggtcagcttcctgcccgtgctgctgatgagcgtctggggctgaaatatgggttgctcgggcaggaaacaacaggcgtaggcgggtttgccaaagcattgcgtaccattcctgtgttactggatatcgctcataaagttgaacgccttgcgccggaggcgtggatcatcaatttcagcaatcctgccggcgttgtcacggaagcggtttcccgctatagcaaagccaaaatcatcgggttatgcaatgtgccaatctcaatgcaccatatgatagccaatatgctgcaacgtccatatcaggacgtacaattacgttttgctggccttaatcatatggtctgggtacatcaggtactagtgaatggcagggatgaaactgagcaggtattagaattgctgtgtaatggcgcagagctgacgatgaacaatatcaaagaagaaccgtggcctccggagtttttacaggcattaggcgcaattccctgcccgtatcatcgctacttctatcaaaccggtaagatgttacaggaagagaaagaaatcgcggcgagcaaagggacacgggcagagcaggtgatgcaagtggagcgggagctgttcgagttgtatgccgatcctaaactggatcacaaacccgctcagctcagttttcgtggcggatctttctattctgaagtagcgttggaattgatctcggctattcataataatctcggtacgcaattggtcgtcaatacggagaatcggggagctatcatcgacctgccagatgatgcggtgatcgaagccaactgtattgttgatgctcaaggggcgcacccactggcgtttggtcacctgccggacagtatgtcagccctgacccagcaagtgaaagcatttgagcgcctgaccatcgaagccgccgtccatggcgatcgcaaggtcgcactgttggcgctggtcactcatccgttgattggcgatgtggcgttggattcgacattattgaacgaaatcttagagattaaccgcatgtatttgccccagttt

SEQ ID NO: 44961 - DNA, 819 bp, Xenorhabdus nematophilus
atggctgatacagatattcgcgttgctgttgtaggtgcaggtggccgtatggggcgtcatctcattcaggcagcccagcagttggatggcgctacgctcggtgcggcgctggagcgttcaggttcttcattagtgggaacagatgcgggagaattggcaggtatcggcaagaatggtattaccgtcagtgatgatttgcatgatgttattgagcattttgatgtcctgatcgattttacccgaccagaaggtacactcgcttacctcgcaatctgccgccagtatcgcaaggcaatagtcatcggcacgacagggtttgatgacgcaggtaaacaggcgattgaagacgcttctcgtgatattcctatcgtttttgccgctaatttcagtgtcggtgttaatctggtgctgaaactactggaaaaagcagccacagtgatgggggagtatacagatatcgaaatcattgaagctcatcatcgtcacaaagtggatgctccgtcaggaacagcgctggcaatgggggaatctatcgcccatgctttagggcgtgatcttaaaacctgtggggtctatgcccgtgaaggccatactggtgagcgtgacccgaaaagcatcggatttgcgacggtgagggcgggcgatatcgttggagagcataccgcaatttttgcggacattggtgagcgtgtagaaataagtcacaaagcttcaagccgtatgacctttgctaatggagctattaaagctgcaatatggttgaatgcgaaaaacaatgacctttatgatatgaaagatgtccttaaccttaaaaattta

SEQ ID NO: 44962 - DNA, 1137 bp, Xenorhabdus nematophilus
ttgattaagtcagctatattggttctcgaagatggaacccaatttcatggtcgcgccataggtgtagagggtgtggctgttggagaagtggtcttcaatacctcaataaccggatatcaagaaatacttaccgacccttcctattcccgccaaattgttactcttacttatccccatattggtaataccggcatcaatgccgctgatgaagaatcccccgccatccaagcccaaggtctggtcattcgcgatttgcctttagtgaccagcaatttccgcagtgaagaaaatctgtctgattacctgaaacgccacaacattgttgccattgctgatattgatacacgcaagctgacccgcctgttacgggaaaaaggtgctcagaacggctgtatcattgcgggtaatgaggcagatgctcaagttgctctggaaaaagcgaaagctttccctggtttgaaaggcatggatctggcgaaagaagtcaccaccgaacaatcttacccgtggttacagggaagctggacattggcagatgggctaccggaagtttgcaaagagcaagaattaccgtatcacattgtggcttatgattttggtgtcaaacgtaacatcctacgcatgttggtggatcgtggctgtcgcgtaacggttgttcctgcccaaacccccgcggatgaagtgctgaaaatggcaccggatggcattttcctgtctaatggccccggcgatccagagccttgtgactatgctattgaagcaattcaggctttcttgaataccgagatcccagtatttggtatctgtttggggcatcagttactggcgctcgccagtggcgcaaaaacggtgaaaatgaaatttggtcatcacggcggcaaccatcctgttaaggacttggagaacaatgtcgtcatgatcacagcacaaaatcacggtttcgctgttgatgaaagcaccttaccaacgaatctgcgtgtgactcataagtcactatttgacggcacactgcaaggtatccatcgcactgacaaacctgcattcagttttcaggggcatcctgaagcaagtcctggcccacatgaagccgcttcactgttcgaccatttcattgaattgattgaacagcatcgtcag

SEQ ID NO: 44963 - DNA, 3216 bp, Xenorhabdus nematophilus
atggcaaaacgtactgatattaaaagtatcctgatcttgggtgcgggtccgattgttatcggtcaggcttgtgaatttgactattccggcgctcaggcttgtaaagcgttgcgggaagaaggctatcgcgtcattctggtgaactccaaccctgcaaccatcatgaccgatccggaaatggcggatgcgacctatatcgagccaatccattgggaagtggtacgcaaaattattgaaaaagagcgtccagacgcaattttgccaaccatgggcgggcaaactgccctgaactgtgcactggaactggaacgtcagggcgtactgacagaatttagcgtgaccatgattggtgcaaccgctgacgcgattgataaagcagaagatcgtcagcgttttgacaaagcgatgaaaaaaatcgggctggatactgcgcgttctggtatcgcccacacgatggaagaagcgctggcagtggcagaagacgttggcttcccttgtatcattcgtccttctttcactatgggcggaagcggcggcggtattgcttataaccgtgaagaatttgaagaaatctgtgagcgcggtctggatctttccccaaccaacgaattattgatcgatgaatcattgattggctggaaagagtatgaaatggaagtggtgcgggataaaaatgacaactgtatcatcatctgttcgattgaaaatttcgatccaatgggtatccatacgggtgactctatcaccgtagcgccagcacaaacactgactgacaaagaataccagatcatgcgtaacgcttcgatggcggtactgcgtgagattggtgtagaaactggcggctcgaacgttcaattttcagtgaacccgaaaaatggtcgtttgattgtgattgagatgaacccacgcgtatctcgttcatctgcgctggcttccaaggcgacgggcttcccgatcgcaaaaattgcggcaaaactggcagtgggttatacccttgatgaattaatgaatgacatcacgggtggccgtacaccggcatctttcgagccttctatcgattatgtcgttaccaagatcccgcgtttcaactttgaaaaatttgctggcagcaatgaccgcctgacaactcagatgaagtctgtcggtgaagtgatggcgattggccgtactttccaggaatccatgcagaaagcgctgcgtggtctggaggtcggcgtgaccgggttcgatcctaaagtcaatctggatgatccacagtcactgaccaagatccgcagcgaattgaaaagcgctggcgctgaacgcatctggtatgtcgccgatgctttccgcgcgggtatgtctattgatggcgttttcaacctgactaacattgatcgctggttcttggtacagattgaagaactggtgcgtttggaagagcaggtggaagaacagggcattaatggcctgacgtttgatttcctgcgtcatcttaagcgcaaaggctttgcggatgcacatttggcgaaactggtcggcgtatctggcaaagagatccgcaaattacgtcacgattacaacttgtatccggtttataaacgtgttgatacttgtgcggcagaattttcgaccgataccgcttacatgtactccacgtatgaagacgaatgtgaatccaacccgaaccatgacaagccgaagatcatggtattgggtggtggcccgaaccgtatcgggcaaggcattgaatttgattactgctgtgtacatgcgtcactggcactgcgtgaagacggttacgaaaccatcatggtgaactgtaacccagaaactgtttcaacggattacgacacttccgaccgtctctattttgaacccgtgacactggaagacgtgctggaaatcgtccgtgttgaaaagccaaccggtgtgatcgtccagtatggcggccagacgccattgaaactggcgcgtgagttggaagcggccggtgtgccgattatcggcaccagcccggatgctattgaccgtgcagaagaccgtgaacgtttccagcaggctgtcaatcgtctcggtttgaaacaacctgcgaacgctaccgtctccaccatcgaacaggcggttgagaaaggtaatgggcttggctatccgctggtggttcgtccatcttacgtgctgggtggacgtgcgatggaaattgtctatgacgaaactgacctgcgtcgttacttccagaatgcagtcagcgtatccaatgacgctcccgtattgctggatcgcttccttgatgatgcggttgaagtcgatgttgatgctatctgtgatggtgagcgtgtcttgattggcggtatcatggagcatatcgaacaggcaggggttcactccggcgactcagcgtgttcactaccagcttacacgttgagtcaggaaattcaggacgtgatgcgccagcaagttgaaaaactggcttttgaattgcgtgtccgtggtctgatgaacgtgcagtttgcagtgaaaaataacgaagtgtacctgattgaagtgaacccgcgtgcggcacgtaccgttccttttgtttccaaagcgaccggtctgccgttggcaaaagtagctgcacgggtgatggcgggtcaatctctgctgaaacagggcgtcactaaggaaattattcctccgtactactctgtaaaagaagtggttctgccgttcaataaatttctgggtgttgaccccattttgggaccggaaatgcgttctacaggtgaagttatgggtgttggccgcactttcgctgaagccttctccaaagcgatgctgggcagtagctccacgatgggcaagcacggccgtgccctgttgtctgtacgtgaagaagataaagagcgcgttgttgatttggccgctaaactgctcaaacagggctttgaactggatgcgacccacggtacagcgattgtgttgggtgaggcggggatcaacccacgtctggtgaacaaagttcatgaagggcgtccgcatattcaggatagaatcaaaaacggtgaatataactatatcgttaataccaccgcaggccgtcaggccattgaagattcaaaactgctgcgtcgtagcgcactgcaatataaagtgcattatgacaccaccctgaatggtggttttgcgactaccatggcactcagtgcagatcccactgagcaggtgatttctgtacaggaaatgcacgcaaaaatc

SEQ ID NO: 44964 - DNA, 708 bp, Xenorhabdus nematophilus
gttggctatcgttccattgatactgcggcgatttatcacaacgaaagcggagtcggcaaagcattaaaggaaatcgatattccgcgtgaagaaattttcgtcaccactaaactctggaatgatcgccaccaagatgccaaagcggcattagaagaaagtttggataagctgcaactggattacatcaatctctatttacttcactggcctgttccccatcaggatcaatatgttgaagcctggaaacagcttattgaactgaaagaatccggtctggctcgtagtattggtgtatgtaattttcacattgaacacttacagaacttgatgtcagaaacgagcgtcattcctgctatcaaccaaatcgaattgcaccctctgatgcagcaaagacaactgcattcgtggaatgcaactcaccatattacaactgaatcctggagcccattgtcacaaggcggaaaaggcgtctttgacaacccattggttcaacatctggccattaaatatgaaaaaactcctgcacaaatcgtgattcgctggcaccttgactgcggcatgattgtcattcctaaatctgtcacgccttctcgtattaaagagaactttgacgtatttgatttcaggttggaaaaagaagatttgacggctatggctgaattggatattggcaaacgaatagggccaaaccccgatatttatactggc

SEQ ID NO: 44965 - DNA, 1182 bp, Xenorhabdus nematophilus
atgaccgaaaagaaactggagaccttattggtcagtacaggcagaaagaaaaaatatactcagggtgctgtcaatcccctcattcaacgcacttcatccatcattttcgacaccgtcgaagacctgaaacatgcgttgaaaaaccgggctaagagtgagttattctatggacgccgtggcactctgactcatttcgcctttcaggaagcgatgacggagctagaaggcggtgcaggctgtgctctgtatccttccggcgcagcagcgatcacccattcgattctggcctttgtggcaactggcgatcatgttctgctgacagggagtgcttatgagccgacgcaagatttctgtaatcacatcctcaaaaagatgggcatttctaccgattattttgacccgatgatcggagaagggatcgcatcactgattaagccaaacacaaaagtcgtttttcttgaatcccccggctctctcaccatggaagtgcaggatattccgtccatcgtgcgtactatccgccagatcaatcctgagattgtcattatcatcgataatacatgggcggccggcattctctttaaagcgctggattttggcatcgatatttccatccaatcggccacaaaatatatcattggtcattcagacggcatgctggggacggcggtcgctaatgcacgctgctgggatcaactcagagaaagttcgtatctactgggtcaaattgccgatcccgatacagtttataccgcaacccgtggattacgtacgctggcaattcgcttaaaacatcatgaagagagcagcctgcacatcgccaaatggctcgcccagcggccagaagttgccgaagtttatcaccccgctttgccttcttgtccggggcatcattatttccagcgtgatttcaccggcgccagcgggttattttccttcctgctgaaggtcgaactgacccctcagcaattcgctgagtatctggataatttacatcatttcaaaatggcattttcatggggcggatttgaatccctgattctgggtattcagcctgacatgctcacttcgctgcgtcgatacgatcccctcaaaaagacgggaacattatttcgcgtgcatatcggattggaaaacccacaagacctgattgacgatcttgcagccggttttgcccgtatt

SEQ ID NO: 44966 - DNA, 1989 bp, Xenorhabdus nematophilus
atgccactgtatttatgtgaaaagccctctcaggccagagatatcgcccgggtgctgggcgtgaagcagcgcggacagggctatctctttggcgacagtattactgtcacctgggctatcgggcatttgctggaaatggctgcacccgagcactatggtgaacaattcggcccgccgtggcgcatggaacccctgccggtgctgcctgtgcagtggcaatggactgtgaagaaagagaccgccgatcagtttgcggtgatcagacaattactgaaacaggccgacgaagtgattatcgccactgatgctgaccgtgaaggggaagtgattgcccgtgaactgctggagtattgccgttttaccggccccgtcagacggctgtggctgtctgcgctggatgaaaccagtatccggcaggcactggccgcgatattactgggggagcaaaccgaaccactctggcaggccggactgggacgggcacgggcggactggctgatgggaataaacctgacccgcctgtataccctgaaagcgcaggcacagggatttggtgaggtgctgtccatcgggcgggtacagacgccgacactggcactggtcgtgaaccgtgataacgatatcgcccggtttgagccaaaaccctactggcaggtgatggccgcattgcaaaaagatgacattagctttcgggttaaatggctgcctgcgcccgacgattgcgatgaagaaaaacgctgtatccgggaggatatcgcgcagagtgtggttcagcgttgtcagcaggcacaagatgccgtggtgactgaactcacgcagaaacgggaaaaaaccccgccgccgctctgttttgatttggggatgctccagcaggtagcctcccgtcaatggggaatgggggccggtcaggtactgacgattgcccagtcgttgtatgaaatccataaagcgaccacctacccgcgcacggattgcggttatctgccggtttcaatgcgggaagatattccggccgtgttcaccgcactgacccgtaccgatcctgcgatgaatgccattatcagccagctggatgccagcactctctcccgagtctggaatgacagccaaatcacggcgcaccatgccattattccgacccgccacacttttgatatgacgaaactgaccgcggacgaattaaagatctatcagttgatccgccactattatctggcgcagtttctgcccgtacaggaaacggatgtgactgacgtgacattcactatcggcgggcaggtatttcaggcgaaagggcgggtcagtgtggtcacgggctggaagacgctgtttgccgatgaaaaacaggtgcaggagcaggacgacaataccgcgctgcctgcattgaaaaaagaggaaatctgcccggtactccgtgcagaaatacagccccggcaaacccggccgcctgcgccttttaccgaaggtacgctgattgccgccatgaaaaatgccgctgcgtttatccacgatccgcagcttaaaaaagtgctgcgggaaaatgccgggctgggcacggaggccacccgggcaggtatcattgaagccctgtttaaccgtcagctgctggcgcgaaaaaagaaaaacctgcatgcaacgccgctggcgcaggagctgattgccgggctgccggacgtcctgacccatccggggatgactgcgctgtgggaacagtctctggacgacattgcccggggccgggccacactggatggctttatgcagaaacaggcacaatggctggcgcatttagtggaaaagggcaaaacacagccgatccggtttaccctgccgaaaaccccggcgtgcccgcgctgtggcggcccgatgcaaaaacgggcgggaaaaacaaccccgttctggggctgcactcgctatccggcatgcaaagggatgctgaacgctaacgcggtgaccggctcccgaaaaacccggcggggaaattcaccg

SEQ ID NO: 44967 - DNA, 1062 bp, Xenorhabdus nematophilus
atgaatgagttgaaaaacgaccgctatctgcgcgccttattacgccagcctgttgatgtcacaccagtatggatgatgcgtcaggcggggcgatatttgcctgaatataaagcaacgcggcaggaggcgggagatttcatctcgttatgcaaaaacactgaactggcctgtgaagtgacgctccagcctctgcgtcggtttccgctggatgcagcaattctgttttccgatattttgactattcctgatgcaatggggcttgggctgtatttcgaaactggggaagggccgcgttttcactctccgattctcaatcatacagatgtggaaaaactccctgtacctgatccggagatggagctgggctatgtcatggatgctgttcgtgcgatccgtaaggcactggcaggccaagttcctctgataggtttttcgggtagtccgtggacactggcgacgtatatggtcgaagggggaagcagtaaggcgttcaccaaaataaaatccatgatgtatgcccaacctgctacgttgcatctgttactggataaattggcaaacagcgttattctatatttgaacgcgcaaataaaagcaggagcacagtctgtcatgattttcgatacttggggtggtgttctgtctcatcgcgattatcgggagttttcgctgcaatatatgcataaaatcgttgacggattgatccgcgaacatgatggccgtcgtgtgcctgtcaccttgtttaccaaagggggcggacaatggctcgaagcgatggtggcaactggctgtgatgcccttgggcttgattggacaacgaatatcgcagatgcccgtcgtcgtgtaggcgataaagtcgctttgcagggcaatatggacccatctatgctgtatgctgctccagcgcgaattgaagaggaagtttcgacgattttgcaggattttggtacgggtaatgggcatgttttcaatctggggcatggcattcatcaggatgtcccaccggaacatgctggcgcattcgtcgaagcggtacacagactttcagaaaaatatcaccga

SEQ ID NO: 44968 - DNA, 534 bp, Xenorhabdus nematophilus
gtcatttttgatatcgatggggtcattgtcgatagtgaacaactgcattttgatgtgctgtgtgaactggcacctgatcacacgcgtgatgttcagccacagcaattaattggtttgagtctggctgaaacactgaatgaaattggtgttccattacccgagcagcaaggcattaccgacaggattatctcggtttatcaggaaaagttatctgcacattatctacgcccgggggttactcgcctaatcgcggccttacagcaaaatgacattgcttttgggtttgtttccaccgcaccgcgtgccgtttgtctggcgaatctggggttactggatttgtttgatgaacctgctttgatttccggtgatgatgttgaaagaactaaaccttttcctgatccctaccttgctatgctaaagctgaaaaggatggatgttcagcagactttggtgattgaagacacggatctggggatcgcagcggcaaaacaggcagggatcccgtgggtatatgcttggcctcatgatttgtcg

SEQ ID NO: 44969 - DNA, 1155 bp, Xenorhabdus nematophilus
tatttggaaattgatggcgaaaagcatattgatgcggcatcaggtacgtttaatttgccgcttggctacactaaccacagagttgcggaaaaactcaagcaacagattgatagatgtacgcatttaagttctgcttatacgcgagaaatgtcacaatatattttgaccaaattggtgaaacatacaccagaaggcattgaccgaatgtggctgcgggatgtttccggttctggggctgttgaaggtgccattcgcatcgcccaaaaagccacaggacgctccggcattatttcgttctttcttgcccaccacggccagtctcttgcgactgcgcagatttctggcaatgcgttcagaattaaagatttccatatcagtattgatggttcgataaaaattccagcacctgccagtgtcatggcagaacctgacccgaatgagacagagaaccaatatgtcgatctggaacagtttattcagttgggctccagtgacaatatcgcatgtctgattattgaaccgattcagggcaatggcggcaacaccgttttccccgtggagttctatcgcaaaatcagggaaatctgccatcagcacggcatcatcattattgcggatgaaatacagacagggtttggccgtaccggaactttctttgcgtcgacaggttatgccaaggaattagagccagatatcattgtatttgcgaaaggggcagggggtattggtattccgacagggggtgtgctgatgcgcagctcgctggatgtgctggaatcatttgagcattccagtacttctggtgctaatcccttgtctttagtcgctctcaacgaaatcattgatattattgaagatgatgcgattctggaaaatgtgcagcagaacgaggctttcctgcgtgatggactgttggccttacagcataaataccctgaaatcacgggggtcagaggcatgggctacatgttcggttttgatactccaaccccagaatttgcggcacaggtgattgaaaccgccagccgtcaccgattgatcctgcgcggctcccgttatggcaaagggcgggcacttaaggtacgtcctcctttggtttgtacacaggaacacttacatgaaattctccataaattggatctggcattcgctgaa

SEQ ID NO: 44970 - DNA, 2406 bp, Xenorhabdus nematophilus
atgcaacagcccaaattagatagagccgtctttcaggccgcgcttacacgccagtggcagcgctttggccttagttcagcacaggaaatgaccccacatcagtggtggcaggccatcagtgctgcactattagaattacttccctcttccagcccgaaccatggtcatcagttgcataactctaagcgtcatgtgaactatatttcgatggaatttctgataggccgtctgacagccaacaatttgctgaatcttggctggtatgacgatgttcaggcttatctggcagaggatgggctgactttgagtgatttacttgaacaagaagctgatcctgcattaggcaatggtggtctgggtcggctggcagcctgttttcttgactcaatggcaacgattgatcaacccgcaacaggctatggccttaattatcagtatggcctgttccggcaatcctttgatcaaggattacaaattgaggcacctgatgactggaagcaaggctcctatccgtggtttcgccataatgcccaattgaaagttgacgtgggttttggcgggaaaatcgtgatgacagacgaaggtcatgaaacttggcttcctgcctttaccttgattggcgaagcttgggatctgccggtcgttggctatggtaatggcgtcacacaacccctgcgcctgtggcaggcaacacacgataacccttttgatctgtcacttttcaatgacgggcagtttctgaatgctgaacaacaaggcatcgaagccaccagcctgaccaaagtgctttacccgaacgataaccatcaggacggaaaacgcctgcgcctgatgcagcaatatttccagtgtgcctgtgcggtggccgatattctgcgtcgtcatcagcaggcgggccgcaaggtggaagaattaccacgctacgaagttatccagcttaacgatacccacccgactatcgccgtccctgaaatgatgcgtctcctgctggatgagcacagattggattgggaaaccgcatgggaaattacggggcagactttcgcctatactaaccatactttactaccagaaggtttagagcgttgggatgagcatctagtcagtgaactattgccacgtcatcaccgcattattcaggaaatcaaccgtcgcttccagaaaaccgtggagcaaacctggcccggcaatcaacaggtgtgggaaaaattagccgttactcacggaaatcaggtaagaatggctaacctctgcgtagtggcctgttttgctgtcaacggtgtggcagcactgcattcatccctaatcgtgacggatctgtttccagagtattatcacttatggccgaaaaagttccataacgtaaccaatggcgtcacaccgcgtcgctggttaaaacagtgcaatccagcactctcctcactgattgaccaaaccttgaatcatgaatgggttaatgatcttgagagcctgaaacaactcgaaccttatgccaacgatacagctttctgcgaagcttatcgcagcatcaaacaggaaaataaaatccggttgtccaactacgtcaataaagtcatggggcttaagattgatccccacgccatttttgacgtgcagataaaacgtctgcatgagtacaagcgccaacatttgaacctgctgcatatcctctcactgtatcggcagattcaggaaaatccgtcactggatgtccacccccgcgtcttcctgtttggtgccaaagcagctccgggatactatctggcaaaaaatattatttcagccattaaccatgcggctgaaaagatcaatcatgatccgatcgtccgtgatcgtatcaaaattgcctttattcccgattacaacgtttccaccgcagaattgatgatcccagccgccgatgtctcagagcaaatttctaccgcaggtaaagaagcctccggtacaggcaacatgaaactggccttaaacggtgcactgaccatcggtacgttagatggcgccaatgttgaaatcgccgaacaagtcggcaatgatcatatttttatcttcgggaataatgttgaagaagcaaaagccttactgaaaagtggctacaatccacggcacatcctccagcagaaccctcatctacaaggcatactggatgcacttgccagtggtgaattcagccacggagacacacaagcattcaatctcatgctgcatagcttggttgatggcggtgatccttatttggtactggcggattttgactcctactgccaggcccataagcagattgataccctataccgtaatcctcaacactggacacacagtactattctcaatactgcccgcatgggtaaattcagttctgaccgagctattcaagattaccaacagcgtatctggcaggccaaa

SEQ ID NO: 44971 - DNA, 4221 bp, Xenorhabdus nematophilus
gtgaaagacttattgaagtttctgaaagcgcaaactaagaccgaagagtttgatgcgatcaaaattgctctggcctctccagatatgatccgttcgtggtcattcggggaagtaaaaaagccggaaaccattaactaccgtacgttcaagcctgaacgtgacggtcttttctgcgcacgtatcttcgggccagtaaaagattacgaatgcttgtgtggtaaatacaagcgtttgaaacaccgtggtgtgatttgtgagaagtgtggcgtcgaagtgacccagactaaagttcgtcgtgaccgtatgggtcatatcgagctggcatctccaaccgctcatatctggttcctgaaatctttgccatcccgcatcggtttgctgctggatatgccactgcgcgatattgaacgcgtactgtacttcgaatcctatgtggttgttgaaggcggcatgaccagccttgagcgtgcacagatcctgacagaagaacagtatctggatgcattggaagagttcggtgatgaatttgatgcaaaaatgggcgcagaagcgatccaggctttgctgaaaaaccttgatctggaaaacgaatgtgaaaccttgcgtgaagagttgaacgaaactaactctgaaactaaacgcaagaagctgaccaagcgtattaaactgttggaagcattcattcagtctggcaacaagccagagtggatggttctgaccgttctgccagttttgccaccggatttgcgtccattggttccactggatggcggccgttttgcaacttcagacttgaacgatttgtatcgtcgcgttattaaccgtaataaccgtctgaaacgcctgctggatctggctgcgccagacatcatcgtgcgtaacgaaaaacgtatgttgcaggaagcggttgatgcgctgctggataacggccgtcgcggtcgtgcgatcaccggctctaacaagcgtcctctgaaatccttggcagacatgatcaagggtaaacaaggtcgtttccgtcagaacctgctgggtaaacgtgttgactactcaggccgttctgtaattaccgtagggccatacctgcgtctgcatcagtgtggtcttcctaagaagatggcattggagctgttcaagccattcatctacggcaagctggaactgcgtggtctggcgacgactatcaaagccgccaagaaaatggttgagcgtgaagaagcggtcgtatgggatatccttgatgaagtgatccgtgagcacccagttctgctgaaccgtgcaccgacccttcaccgtttgggtatccaggcattcgagccagttctgatcgaaggtaaggcaatccagttgcacccactggtgtgtgcggcctataacgccgacttcgatggtgaccagatggctgttcacgtaccgctgacactggaagcccagttagaagcgcgtgcgctgatgatgtctaccaacaacatcctgtctccagcgagcggtgagccaatcatcgttccctctcaggacgttgtattgggtctgtactacatgactcgtgactgtgttaacgccaaaggcgaaggcatggttttgaccggtcctaaagaagctgaacgcgtttatcgcgccggtctggcttctctgcacgcccgtgtcaaagttcgtatcactgaagaagtgagagatggtgaaggcaatgtcaccaccaatacgggtctggtggataccaccgtcggtcgtgccatcctgtggatgattgtaccgcgtggtctgccttactcgctgattaaccaggcgttgggcaaaaaagctatctccaagatgctgaacacctgttaccgcattctgggcctgaaaccaaccgttatcttagctgaccagaccatgtataccggttttgcttacgctgcccgttcaggggtatccgtaggtattgatgacatggttattcctgagaagaaagaaggcatcattgcagaagcggaagcggaagtggccgaaattcaggaacagttccagtcaggtctggtaactgcgggcgaacgctataacaaagttatcgatatctgggctgcggcaaacgaacgtgttgccaaggcgatgatggaaaacctgtctactgaagctgttattaaccgtgatggcgaagaagaacagcaagtttctttcaatagcatctttatgatggctgactccggtgctcgtggttctgccgctcagatccgtcagctggcgggtatgcgtggcctgatggcaacaccagatggttccatcatcgaaaccccaatcaccgcgaacttccgtgaaggtttgaacgtactccagtacttcatctcaacccatggtgctcgtaaaggtttggcggataccgcattgaaaacggcgaactccggttacctgactcgtcgtctggttgacgttgctcaagacttggtcgtgactgaagatgactgtggtactcacaacggtatcttgatgactccggttatcgaaggtggtgatgttaaagaaccactgcgtgagcgtgtactgggtcgtgtgacggctgaagacgtcctaaaaccaggtacagcggatattttggttccacgtaacactctactgaatgaaaaatggtgtgatctgttagaagaaagctccgttgacagcgtgaaagtacgctccgtagtaagctgtgagacagacttcggcgtctgtgcaaactgttacggccgtgaccttgcccgtggtcatatcatcaacaaaggtgaagcagttggtgttatcgcggcacagtcaatcggtgaaccaggtacacagttgacgatgcgtacgttccacatcggtggtgcggcatctcgtgcggcagcagaatccagcattcaggtacgtaacaaaggtcatctgaagctgttcaacgcgaaatacgtcactaactcagcaggcaaactggttattacttctcgtaatacagaactgcgtctgattgatgatttcggccgtaccaaagaaagctacaaagtcccttacggctcggtattgtcgaaaggtgatggcgagacagtgactggcggcgaaaccgttgcgaactgggatccacacatcatgccagtcgtgagtgaagtgtccggtatcatccagttctatgacatggttgatggccagaccattactcgtcagacggacgaattgaccggtctgtcatcactggtggttctggacagtgcagaacgtacaggtagcggtaaagacctgcgtccggcactgaaaatcgttgacgctcagggtaaagatgttctgatctcaggtactgatatgcctgctcagtacttcctgccgggtaaagcgattgttcagctggaagatggcatgtctatctctgcgggtgatacgctggcgcgtattcctcaggaatctggcggtactaaagatatcaccggtggtctgccacgcgttgcggatctgttcgaagcacgtcgtccgaaagagcctgcgatcctggcagaaatcagcggtattgtttccttcggtaaagaaaccaaaggtaaacgtcgtctggtaatcagcccattggatggtagtgatgcttacgaagagatgatccctaaatggcgtcagctcaacgtattcgaaggtgaagttgctgaacgtggtgacgtgatctccgatggcccagaatctccacacgatattctgcgtctgcgtggcgttcacgcggttgcccgctacatcaccaacgaagtacaggaagtttaccgtctgcaaggcgttaagattaacgataaacacatcgaagttatcgttcgtcagatgctgcgtaaagtgactatcgcgaatgcgggtagttctgagttcctcgaaggcgagcaggttgaatacgcgcgtgttaaagtcgcgaaccgtaagctggaactggatggcaaattagcggctaccttccatcgtgacctgttgggtatcaccaaggcatcactggcaacagaatccttcatctctgcggcgtcgttccaggaaacaacgcgcgtactgactgaagcagctgttgcaggtaaacgtgatgaattgcgtggcctgaaagagaacgtcattgttggtcgtctgatccctgcgggtacaggttatgcgtaccatcaggagcgcatccgccgtcgtcacgcaaacgaagtggttgaagcgccaccagtcagtgttgatgaagcgactgcaaaccttgctgaattgttgaatgcaggtttcggtagcagcagcgataaa

SEQ ID NO: 44972 - DNA, 4026 bp, Xenorhabdus nematophilus
atggtttactcctataccgagaaaaaacgtattcgtaaggattttggtaaacgtccacaagttttggatattccatatctcctttctatccaacttgactcgttccagaagtttatcgagcaagatcctgaaggccaaaatggactggaagcggccttccgttctgtgttcccaattcagagttacagcggcaattccgagctgcaatatgtaagctaccgtcttggtgagcctgtttttgatgtgcaagagtgtcagatccgtggtgtgacttattccgcaccgctgcgcgttaaactgcgtctggtgatctatgagcgcgaagcgccagaaggcacagtcaaagacattaaagaacaagaagtctacatgggtgaaattccactcatgactgataacgggactttcgttatcaacggtactgagcgtgttatcgtatctcagttgcatcgtagcccaggcgttttttttgacagcgataagggtaaaacccattcatccggtaaggtactgtataacgcgcgtatcatcccttaccgtggttcatggctggatttcgaattcgatcctaaagataatctgtttgtgcgtatcgaccgccgtcgtaaactgccggcttcgattattctgcgtgcaatgaattatagtactgaagacattctgaacctgttcttcaacaaaacgatcttcgaaattcgcgataacaaattgcagatgactctggttccagaacgtctgcgtggtgaaacggcttcatttgatattgaagcaaacggcaaactttatgttgaaaaaggccgtcgtatcaccgcacgtcatatccgtcagttagaaaaagatcaggtagaccgtattgaggttcctgtcgaatatatcgcgggtaaagtcgtcgcaaaagattacatcgatcaaaatacgggtgaaatcctctgcgctgctaacatggagctctctctggatctgctggcgcgtctgagccagtctggtcacaaaaccatcgagactctgtttaccaacgatctggatcacggtgcatacatctccgaaactctgcgtgttgacccaaccaatgatcgtctgagcgcgctggttgaaatttaccgcatgatgcgtccgggtgagccaccaacacgcgaagccgcagaaaatctgtttgagaacctgttcttctctgaagaccgctatgatctgtctgcggttggccgcatgaagttcaaccgttctctggatcgtacagaaattgaaggttccggtatcctgagcaaagaagacatcaccgatgtgatgaagaagctcatcgatattcgtaacggtaaaggcgaagtggacgatatcgaccacttgggtaaccgtcgtatccgttctgttggcgaaatggcagaaaaccagttccgcgttggcttagttcgtgtagaacgtgctgtgaaagagcgtctgtcactgggcgatctggataccctgatgccacaggacatgatcaacgctaaaccaatttctgctgcggtaaaagagttctttggttccagtcagttgtcccagtttatggatcagaacaacccgttgtctgaaattactcataaacgtcgtatctctgcattgggcccaggcggtctgacccgtgagcgtgcaggcttcgaagtacgtgacgtacacccaacccactacggtcgtgtatgtcctatcgaaacgcctgaaggtccaaacatcggtctgattaactcactatccgtttatgctcgtaccaatgagtatggtttccttgaaaccccttaccgtttggtgcgtgacggcgtagtaaccgatgaaattcattatctgtctgctatagaagaaggtaactacgtcattgcacaggctaacaccgtgctggatgaagaaggccacttcgtagaagatctggtgacttgccgtcattatgatgaatccagcttgttcaaccgtgatcaggttcagtatatggacgtttcgacacagcagatcgtgtccgtcggtgcttctttgatcccattccttgaacacgatgacgccaaccgtgcattgatgggtgcgaacatgcaacgtcaggcagttccgactctgcgtgctgacaagccgctggttggtacaggcatggagcgtgcagttgctgttgactccggtgtaacgtcagtcgccaagcgtggtggtgtgattcagtacgtggatgcatcccgtatcgttattaaagttaacgaagacgaaatgtacgcgggtgaagctggcatcgatatctataacctgaccaaatacacgcgttccaaccagaacacctgtatcaaccagatgccatgtgtttctctgggtgaattggtagagcgtggcgatgtactggctgacggcccatccactgatttgggtgaactggcgctgggtcagaacatgcgcgtggcgttcatgccatggaatggttataacttcgaggactccattctcgtatctgagcgtgttgttcaggaagaccgtttcacaaccattcacattcaggaactggcttgtgtgtctcgtgacaccaaactggggcctgaagagatcactgctgacattcctaacgtgggcgaagctgcactgtctaaactggacgaatccggcatcgtttacattggcgcggaagtgaaaggcggcgatattctggttggtaaagtgacaccgaaaggtgaaacccaattaacgccagaagaaaaactgttgcgtgcgatcttcggtgagaaagcatctgacgttaaagactcttcactgcgtgtgccaaacggtgttgccggtactattatcgacgtgcaggtctttacccgtgacggtgtagaaaaagacaagcgtgcgttggaaatcgaagaaatgcagttgcgtcaggcgaaaaaagacctgacagaagaactgcgtatcttcgaagcgggtctgtttgcgcgtattcactccgtactggttgccggtggagttgaagcagaaaaattaagtaaactgccgcgcgagcgctggttagagctgggtctggctgatgaagaaaaacagaatcagttggaacagctggcagaacagtatgacgaactgaaaactgagttcgagaaaaaactggatgctaaacgccgtaagatcactcagggcgatgatctggcaccgggtgtgctgaaaatcgttaaagtatatctggctgttaaacgccagatccagcctggtgataagatggctggtcgtcatggtaacaagggtgttatctctaagatcaacccgatcgaagatatgccttacgatgaaaacggaacacctgtagacatcgtattaaacccgctgggtgtaccatcacgtatgaacatcggtcagattctggaaactcacttgggtatggcggccaaaggcattggtgacaagatcaatgccatgctaaaacaacagcaggaagttgccaaactgcgtgaattcatccagaaagcctatgaccttggtgacgatacccgtcagaaagttgacctgaatactttcactgatgaagaagttttgcgtctggctgaaaacctgaaaaaaggtatgccaatcgcaacaccggtcttcgacggtgcgaaagagactgaaatcaaagagctgttgcaactggctggcttgccgacttccggtcagatcacgctgtttgacggccgcactggtgagcagtttgagcgtcaggttactgtcggttacatgtacatgctgaaactgaaccacttggttgatgacaagatgcatgcccgttctaccggttcttacagcttggttactcagcagccgctgggtggtaaagcacagttcggtggtcagcgcttcggtgagatggaagtgtgggcattggaagcatacggtgctgcgtacaccctgcaagaaatgctcaccgtcaagtccgatgatgttaacggtcgtaccaagatgtataaaaacatcgtggatggtaaccaccagatggagccaggcatgccggaatctttcaacgtattgctgaaagagatccgttcgttgggtatcaacatcgagctggaagacgaa

SEQ ID NO: 44973 - DNA, 1263 bp, Xenorhabdus nematophilus
aaattagaaactctatccattcatgcgggttattcgccagatcctgccaccaaagcagttgccgttcccatctaccagacaacgtcttacgccttcgatgatacccagcatggggctgatctatttgatttaaaagttgaaggtaacatttactcccgcatgatgaacccaaccaatgatgtgttggaaaaacgcattgcggccttggaaggtggcattggtgcgctgtctgttgcttcaggtatggcagccgtcacctatgctatccaagccattgcccaagcgggagataacatcatttctgtggcaaaactgtatggtggaacctataacgtgatggcgcacactttcccaagcatagggattgagacccgtttcgttgatcacaacgatatcgcagccatcgaagcattgattgatgagaaaaccaaagcagtatattgcgaatccatcacaaaccccggtggccatatcattgatatccaagcaatggcagatgttgcccataaatatggtatcccgctgattgtcgataataccgtcgcaactccctacttatgccgtccgtttgaacatggtgcagatatcgttatccattctctgaccaaatatatcggcggtcatggcaccaccattggcggtattatcgtcgattcaggcaaattcccgtgggcagaacatcaagatcgttttgctattctcagcacaccggatgcgtcgtatcacggaattatttataccgaacattttggtgcagccgcctatatcgcccgctgccgtgttgggccactgcgcagtactggtgccacactttcggcattcagtgcgttcctgatcctgcaagggcttgaaacattagcgcttcgcatggaacgccatactgaaaataccttgaaagtcgcacaatacttgaatgagcatcctcaagtatcttgggttaaatacgccggattgcctgaacacccagagcatgaactggcggtacgttacatgggggggaaaccttcgtctgtgctgtcattcggtatcaaaggagaagaagaagctggcacacgtttcattgatgcactggaactgatcgtgcgtctggtcaacatcggcgatgccaaatctctggcctgccatccggcatcaaccacacaccgccagttaaacgatgcagaaatggtaaaagcaggggtatcacgagatttgattcgtctttccattggaatagagcacagcgatgatattattgccgatctttcacaggcgttagatgcc

SEQ ID NO: 44974 - DNA, 1662 bp, Xenorhabdus nematophilus
gtattctggactattggcttatttacggcatttatcaatctgctgatgttggttccctctatttatatgcttcaggtatatgatcgagtcctgccatccagtaatgaaatgactctgctgatgctgaccctgatcacgctcggcatgttcgctattatgggcgggctggaatatatccgtagcatggtggtgatccgcatcggcagccagtttgatatgtgcctgaaccagcgtgtttataccgcgtcgtatgagtccaacctgaaaaatggctccaccgatgccgggcaaatgctcaatgacttggcaactatccgccagttcctgacgggcaatgcgctgtttgctttttttgatgtgccttggttcccgatctatctctgggttatttttctgtttagcccgtacttgggactgctggcgctggttggggcgatcattttgatcacgttggcggtactgaaccaatggctgtctcagtcgcctttatcggaagcgagtcatctctccctgcgctctgccaatcttgccagtactaatctgcgtaatgcggaagtcattgaagccttgggtatgttgccggcactgcgtcagcgatggtttagcctgcatgagcgctttctcaatttccagcgtattgccagcgaacgggcagcatccatcaccgcactgaccaaaacagtgcgcatggccttgcagtcgttgatcctcggtttgggaggctggctggcgattgaaggcaatatcacgccgggtatgatgatcacgggttctatcttgatgggacgggcattgtcgccgattgagcagttgatccaagcgtggaaaagctggagcgccgctcgtctgtcatggcagcgactggataaattgctgaaggcgcagccagaacgtaaaagcggtatgtcactgcctgcccctaaaggtattttgttgctggaaaaagttgccgcaataccaccgagtaaaacacaggccagacaaacggcggggaatcataaacaggttttgcaggatatcagtttttccctgaatgccggcgatgtgttgggcgtgattggccccagtgcgtcggggaaatctacgctggctcgcctgctggtggggatttggccgtcacaggaaggtgttgtgcggctcgatgatgccgatatttaccaatggaacaaggatgaactgggggcatcgataggttatttgccgcaggacatcgaactatttggtggcacgattgcggaaaacattgcgcgttttaatgacgtggatcctgaaaaagtcattgaagcggccaaaaaagcgggtgtccatgaactggtactcaatcttgaacagggttatgacacggtgattggcactggaggaatgggattgtccggtgggcagaagcagcggattgggctggcacgggcattgtacggcaatccgtcgctgctggtgctggatgaaccaaattccaatctggatgatatcggtgaaaaggcgctgagtcaggcgattacgcaattgcgggaacagggcaaaacagtggtagtgatcacgcatcggccttctttgctctcacaaacaaacaaaattttgctgttggtgcagggaaaaatgaaaatgtttggcccatctcagcaagttatggcggcgctgtcgcagtcaaaaacagtcgaacgt

SEQ ID NO: 44975 - DNA, 2262 bp, Xenorhabdus nematophilus
atgacagttttgaatcatacattaggttttccacgtatcggcttgaaaagagagctaaaaaaggcgcaagaaaattattgggcaggcaagatttctcaacaggaattgctggaaacaggtcgtgaattacgtgcacgtcactggcaacagcaaaaagaggcgggagttgatttagttccggtaggtgattttgcttggtatgaccaagtattgacgactaacttgctattgggcaacgtgccaccacgtcatcagaatgaagatggtagcattgatctggatacgctgtttcgtattggccgcggtcgagctccaacaggcacaccagcggctgcttctgaaatgactaaatggttcaatacaaattatcactatatcgtacctgaatttcagcaggggcaagaatttaaattgacctggactcaattactggatgaagtggatgaagcactggcattgggacacaaagtcaaacctgttctactggggcctgtaacttatttatggctcggcaaggtgaaaggtaaagccttcgaccgcctctccctgttaacggatattcttcctgtctatcagcaagtattagcagaattggcaaaacggggcatcgaatgggtgcagattgatgagccggcactggtactggaactaccgaaggaatggctggaggctttctcgacggcttatcaggcgctgcaaggacaggctaaattactgctgacaacgtatttcgatagcatcagccataatctggcgacgatcaaatcactgccagtacaagggctgcatgtcgacttagttgcagggaaggattcccttgatgaattgaataaatctctgccggaaacgtggttgctttcattgggggttatcaatgggcgcaacgtctggcgagcagatttgagtgctaaataccagcttgtggcatcgctggcaggcaagcgtgatatttggatcggcacgtcctgttcattgctgcacagcccgattgacctgaacgatgaaaccgggctggatgaagaagttaaaagctggtttgcctttgcattacagaaatgcgcagagctgtctttgctggcacaggcactgaatgcaccggaaggcagcaaacaggctgaactggatgcttacagtgcgccaatccgtgcacgccgtagttccacaagggtgaacaatccgacggtgactgagcgcatcacggcgatcaaaccacaggatagcgagcgtaatctggtttatccagaacgagccaaactccagcgtgaacgttacaatttaccgttgtggccgaccacaactatcggatcattcccacaaacaacggaaattcgtagcctgcgtctggatttcaaaaaaggtcgtgtggataacacgcattatcgcaccaatatttctgaacatattaagcaggcgatcaatgaacaggaaaatctgggactggatgtgctggtgcatggtgaagccgaacgtaacgacatggtcgagtatttcggtgaacattttgatggttatgtctttacccaaaatggctgggtacaaagctacggttcccgttgtgttaagccgccagtaatcattggcgatatcagccgtccggaagccattactgtaaattgggcaacatatgcacaatccctgacagataagcctgtcaaaggaatgttaacagggccggtgactatcctctgctggtcattcccaagggaagatattagccgcgaaacgattgctaaacagattgcactggccttgcgtgatgaagttgatgatttacaaaaagcaggtattggtatcattcagattgatgaaccagcactgcgtgaaggtttgccgctgcgtagggaagaatggcaggaatatctggaatgggcggtggatgctttcaaactgagtgccgcgattgcggaggatgatactcagatccatacccatatgtgttattgcgagttcaatgacatcatgctttccattgcagcactggatgcggatgtgatcaccattgaaacgtctcgttcagatatggaattgttggattcatttgaagatttttcatatccgaatgagattgggcctggtgtgtatgatatccactcacctaacgtgcctagtgtcgaatggattgaagcgttgctgcgtaaagcggctgaccgtatcccagtggaacgtctgtgggttaacccggattgcggcctcaaaacccgtggctggactgaaacccgtcaggcactggcgaacatggtcgaagcggcgaaacgtctgcgt

SEQ ID NO: 44976 - DNA, 1620 bp, Xenorhabdus nematophilus
atgactcctagtgagataaaacgcctttactttattgttcgggtctttctttcctatggcttagatgagctgatccccaatattcgtctgacatggccgttgcgcttcgggcgttatttcttgttctggcttcccaatcgacacaaggataaaccactcggtgagcggttacgcctggcattgcaagaacttggcccagtgtggatcaagtttggtcaaatgctttctacccgtcgggatctgtttcctccagctatcgccgatcaactctcaatgttgcaggatcgggttgtttcttttgatggtgccgtggctcgcaaatccattgaaattgctttggggggaccgctggaaacatggtttgatgattttgactcacagccattggcttcagcttctattgcacaggtgcatactgctcggcttaaggagaatggtaaggaagttgttcttaaggtgatccgtccagatatcctgcctgttattaaagcggatgtccgtttaatgtaccgtatggcgcatctggttcctttactgcccgatggctatcgtcttcgcccgcgtgaagttgtgcgtgagtacgaaaaaacgttgcttgatgaactgaatttattgcgtgaagcagcaaatgcgatccaactgcgtcgcaattttgaagatagctcaatgctttacgtgccagaaatttatcctgattattgtcgggagaatgtactggtcatggagcgtatttatggcattcccgtgtcagacattgctatgttggaagcacggaacacggatatgaaactgcttgcggaacgtggtgtgcaggtgttcttcacgcaggtatttcgtgacagttttttccatgcggacatgcatcccggcaatatttttgtcagttatgaacggccggaagatccgacttatatcggcattgattatggtattgttggttcattgaacaaagacgataagcgctatttggcagaaaacttcattgctttcttcaatcgtgattaccgcagagtggctgaacttcatgtggattctggttgggttccagccgatattaatgtggaagatttcgagtttgctatccgtacggtctgtgaacctatttttgaaaagccgctggctgaaatctcatttggtcatgtcctgttgaatctcttcaatacggctcgccgttttaatatggcggttcaacctcagttggttttgctgcaaaaaacgctgctgtatattgaaggcttagggcgccagctttatcctcagcttgatttatggaaaacagcaaaaccttttctggaagattggttacacgatcaggttggtattccggcgattgtgcgcgcatttaaagaaaaagcgccatattgggctgaaaaattacccgaattccctgagctggtttatggtgctcttcaacagcataaacgtttgcagacgagcattgatcagatatcgcagcaattacagaaacaacaggtcagccagaaaaaatctctctatttactggggatcggcgcgacattgtttatctgtggtagtctgtttttcatgactgacaagattcatctatcgtggtggttgatgggggcggcagtcatatcgtggatatttggttggcgcagg

SEQ ID NO: 44977 - DNA, 975 bp, Xenorhabdus nematophilus
tttcctggtcgtcgtatgcgccgtgtacgtcgtcatgatttttcccgccgtctggttgctgaaaatcaactcactgtcaatgatctgatttatcccgtttttgttatggaagggattaatcaacgtcaagaagtgtcttctatgccaggagtgtatcgtctgacaattgatcttttgctgaaggaagccgaagagattgcccgactgggtattcctgttttgtctctgttcccagccattgaagcagacaaaaaatcactggatgcgcaggaatcctataaccctgatggtttgattcagcgctctattcgtgcattgaaaaatgaggttcctgagctgggattactgacagatgtggcactggacccatttaccacgcatggacaggatggtgtcattgatcaggatgggtatgtcatcaatgatattaccaaagagattctggttaagcaggcgctatcccatgctgaagctggggctgaaatcgttgcaccgagcgatatgatggatggccgtattggtgccattcgtgatcagcttgaggtcgatggctatatcaacacgcagattatggcttactcagccaaatatgcctcttgttactatgggccattcagagatgcaattggctctagcggtaatttgaaaggcggcaataagatgacctatcagatggatccagcaaacagcgatgaagcgttgcaggaaattgcacaggatttgcaagaaggggcggatagcgtcatggtcaaaccaggtatgccttatctggatgtgatccgtagggtgaaagatacttttggtgtgccaacattcgcttatcaggtttctggtgaatatgcgatgcatgtggctgctatccaaaatggttggttgaaagaacagccagccattatggaatcattgctgtgcttcaaacgtgcgggtgccgatggcgtactgacttattttgccaagcgtgtagcacaatggttg

SEQ ID NO: 44978 - DNA, 1158 bp, Xenorhabdus nematophilus
gaaaacgtagtcattattgatggtattcgtaccccaatggggcgctcaaaaggtggtgtattccgtcaggtccgtgccgaagatctctctgcacatctgatgaaatcgatactcaagcgcaacccatcagtacaacctgagcatatcgacgatatctcttggggatgtgtgcaacaaacgctggaacaggggttcaatattgcccgtaattccgcattgctggcaggtattccccattcggtccctgctgtgaccgttaaccgtctgtgtggttcttcaatgcagtcattgcatgacggtgcccgcatgatcatgactggagatgccagcattgcgatgattggcggtgttgagcatatggggcatattcccatgactcacggtgtcgattttcattcgaaattaaaccgcaatgttgctaaagccgcaggcgttatgggcttaaccgcagaaatgctggcaaaaatgcacggtatcagccgcgaaatgcaagatgaattcgccctgcgctctcatctacgagccgcacaagcgacagaatcaaaagcgttttctaacgaaatcgcaccaattcatgggcacgatgctgatggcaacctgaagttcatcgattttgatgaagtgatccgtcccgataccaacctgaaaaatctggctgggctgcggccggtctttgatcctgtcacaggcagtgtcacggcgggtaactcttcagcactttcagatggcgcatctgcgatgcttatcatgagtgaaagcaaagccaaagaattagggttgaaagcacgtgcccggatccgttcgatggcagttgttggctgtgatccttccatcatgggttatggccctgtacctgcaacacagatggcattgaaaaaagcaggcctgagtcttgctgacattggccttattgaattaaatgaagcatttgcagcccaatcactggcctgtatgaaagggctgaatctgttggatagtatggacgataggatcaacctgaacggtggtgcaattgctctcggccatccattaggctgttctggcgcacgcatcacaactaccctgcttaacctgatggaacgcaaagatgtacagttcgggctggcaactatgtgtattggattagggcaaggcattgctacaattatcgaaagagtt

SEQ ID NO: 44979 - DNA, 1934 bp, Xenorhabdus nematophilus
atggaaaagttggcatctctgtaccacgaacatattaaaatcttacaaagacgtgcccgcgaaatactggcacgaaatcagcttgacgctctacttattcactctggcgagtcattacgtgtttttctggatgactgcgattatcctttcaaggtaaatgcacacttcaaggcttgggtgcctgtgactaaagtacccaattgctggctatgggttgatggtgttaataaacctaaactctggttttattcacccgtagattattggcatagcgtggaggctttgcccaatagccactggactgaagaagttgagttaatccatctggcaaaagccgatgatatcaaagcagaattgagtggcttatcaaaacagaatacagcttatattggtgagcagactgagcgtgcaaagaacttgggtattctcgaacacaatatcaatcccaaaatggtcttggattatttgagttaccatcgctcatataaaacagattacgagctggtctgtatgcgtgaagcgcagaaaactgccgtaaatggtcatctggccgcatacgacgcatttacatctggtgtgagcgaattcgaaatcaatatgttctatttgatggcaacagggcaccgcgatacagatgtcccttataataatattattgccctgaatgaaaatgcggccgttttgcattacaccaaattacaacagacgttaccttccgaaattcgcagttttttgattgatgctggtgcagaatataatggctatgttgctgatatcaccagaacttatgcagcaaaacataacaacgatttcgcttcactgattaaagatttaaatggggaacaacaagcgattattggctcgatcaaggcgggtattcggtatactgattatcatatcaatatgcatcgtcgcatagccaagttgctaaaaaaacacgggatcattaatggaatcactgaagaaactatggttgagaaagggctgacaacgccatttttcccacatggacttggccattcactgggtctgcaggtgcatgacgctgctggattcatgcaggatgataccggaacccatctggccgcgccgacattacatccttatctgcgttgcacacgtattttggagccgaggatggttttgaccattgaaccgggtatttatttcattgaaacgttattggcaccgtggcgtgaaaatgaatacagcaaacatttcgattggaaaaaaatcgacatgtttaagctttatggtggtattcgcattgaagataacatcgttattcacgacggaaaaattgaaaatatgaccagagatttacagttgtcgtaatgaagccttatttgatccctgcggcttcagtcaatttcactgaagaaataaagaaaagtcgtttcatcactctgctggaacacaccagcggggtgaatgaggcaaagttatttatccagagcatcaaggagcaatacccggatgcccgacatcattgctgggcttttgtagcaggtgcgccggatgattcccagcaattaggtttttcagatgatggagagccgacaggaactgctggtaagcccatgatcgcgcaattaataggaagcgggatgggagaaatcactgccgtgtcagttcgctattttggtggtatcaaacttggcacgggaggattggttaaagcctatggcaatggtgtgcagcaggcactgaaattactggaaacagaatacaaagtaccgcagaaactgtatcaattgcagtgtgaatatgcctatatctcgatggtagaacaattgctacaaaaattctcagggcaagtgattgctagtgaatatgctgaaaacgttacattgcaagtttcactgccagctacccttgcgggggagataggtgataaattacgtgacttaagccgtggtgctctgtttttaaca

SEQ ID NO: 44980 - DNA, 438 bp, Xenorhabdus nematophilus
atggcagacaagtttcgcattttactcttgaatggccccaacctgaacctgttgggaacgcgagagccagagacctacggcaagttaacgcttgatgatatcgtcagcaaactgtcaaaagaagctcaccaatcgggagtcgaattatcccatctgcaatccaatgcagaatctgaattgattgagagaattcatacggcgcggggcgataccgattttattctgattaaccctgcggcattcacacataccagcgtggcactacgcgacgcacttctagcggttgatatcccatttattgagattcacctctccaatgtgcatgcccgcgagccattccgccatcactcatatctttctgatattgccgttggcgtgatctgcggattgagtgccgatggttatagtttcgcattacaggcagcggtcaaccgcttg

SEQ ID NO: 44981 - DNA, 1356 bp, Xenorhabdus nematophilus
atggtagaacaagcagaacaatctacgcttaagcgtggtttaaagaacaggcatattcagcttattgccctcggtggtgcagtaggaacgggattgtttttggggattgctcaaaccataaaaatggctgggccttcggtacttctcggatatgccattggtggttttattgcatttctaattatgcgccaactgggtgaaatggttgtcgaagagcctgtcgctggctcgtttagccattttgcttataaatactggggtaattttgccggttttctgtctggctggaattactgggcaatgttcattcttgtcggaatggcagaattgacggcagtcggcatgtatattcattattggtggccggaaatcccaacatggatttccgctgcaatattctttgtgctgattaatgccattaacctgattaatgtccggttatatggtgaaacggaattctggttttctatcatcaaagttactgccattattggcatgattatctttggggcttatttgctcatcagcggcactggcgggccacaggctagtgtaaccaatttatggcagtatggcgggtttatgccaaacggggtttccggtctgattatggcgatggctgtgatcatgttttcatttggtgggctggaaatggtcgggattactgcggcagaagctgaagatcctgaaaaaaatattccaaaggcaactaatcaggtcgtttatcgaatcctgctgttttatattggttcattgtctattctgctttcgctttacccatggatgaatgtggtcgaaggcggcagcccatttgttttgattttcgatcacttggataacttttgggtgtctaatatcctgaatgtggttgtattaacggcggcattatctgtttataacagtggcgtgtactgtaacagccggatgctgtatggtttggcaaaacagggtaatgctcctcgcatcctgacaaaagttaatcagcgcagtgtacctgttttatcaataggattgtcagcattggcaacatctataggggtgctggttaactatattatgcccggaaaagcatttgaactgttgatggcgttggtagtgacaacgttggtcattaactggatcatgatctgtctggcacatctgaaattccgaactgcaaaaaatgcagaaggaattaagacgaagtttcaggcattttggtatccattcggtaactatttgtgcttaatattccttgcattcattctcgtcattattctgatgacaccggaaatacgtatctcagttatcctgatgccgttctggattggcatgttatggggaggctacttgttttccaaggctaaaaaggcaaag

SEQ ID NO: 44982 - DNA, 717 bp, Xenorhabdus nematophilus
cgatttgaaaataaagttgtcgtgattaccggtgcgggaagtggtatcggtgaagccaccgcgaagcgtttttctcaggaaggcgctattgttgttttggtgggacgcaatgttgataaacttaatcgtgtgtacagtgagctgtcatccagttatgcacgggtcattcaggcggacgtgtcggatcaggattccgtcaagatgatgattgatgagaccatcgaacatttcggcaagatagatattctcgtcaataatgccggattgtatattcccagtacgatattggatacttcgctggatgatggcaaaaaagtgttggcggccaaccttgatggtgttatttattgcagccattttgccttgcctcacttactcaaaagcaaaggatgtattgtcaataatgcctctgtatcggggataagggctgattggggcaatgcttattactgtacggcaaaaggggcggtggtcaatctgacccgtgccatggcattggatcatggctcacagggaattagggttaacgcggtgtgcccaagcctgatcatcacaccaatgaccgagtatatgtccgatgacgttctgcaaaaattcgattctcgcatctcaatgaaaagagcgggaactccggctgaagttgcatcagccattgcatttttagccagcgaagatgccagctttattaatggtgttaacctgccaatcgatggtggt

SEQ ID NO: 44983 - DNA, 1272 bp, Xenorhabdus nematophilus
gggcgtctgacccgcgcgaccggtttagtactggaagctactggcatacagatgcctttgggtgctacctgtctgatcgaacggcagaatggcagtacggttgaagaagttgaaagcgaagtggttggtttcaatggtgaaaaactgttattgatgccattggaagaactggaaggcatagtaccgggtgcccgtgtctatgcccgttcttacggtgaagattcggctggcggacgtcgtttgccactggggactgaattgcttggcagagtgctggatggctctggtcgccccctcgacggcttccctgcccccgatacaggttatcgtgccttgttgactactcccccgatcaatccactgcaacggacacccatcagcgatgttctggacgttggtgtgcgagccatcaattccctgctgaccgttggacgcgggcaacgcatggggctgtttgccggatcaggcgtcggtaaaagtgtgctcctcggtatgatggcccgctatacccaagcagacgtgattgtcgttggactgatcggtgaacgtggccgtgaagtcaaagatttcatcgaaaacattttaggtgtggaagggctggcacgttcagttgtcgtggccgcacctgccgacgtttcgccactgctgcggatgcaaggcgcttcttatgccacccgtattgccgaagatttccgcgatcgcggcaaacatgtcctgctgatcatggactccctcacccgctacagcatggcgcaacgcgaaatagccttggctatcggcgagccgccggcaaccaaaggctacccaccttccgtatttgccaagttgccggcactggtagagcgagcaggcaatggcgtcagtgatggcggttcgattactgcgttttataccgttctgacagaaggtgatgatcagcaagatccaattgccgattccgcccgtgctattctggatggtcatatcgtgctatcgcgttcactggcagaatctggccactaccctgccattgacattgaagcgtccatcagccgcgccatgacctcgctgattgataacgaccattatcgacgggtacagcagttcaaacagttgcttgccagctaccagcgcaatcgggatttaattaatgtcggcgcttacgccgcgggcagcgatcctttactggacagagcgattcagctttatcctcatatggcccagttcctgcaacagggcatgagtgaacgtagtgagtacgatgcggcatgtattcagcttcaacaattattg

SEQ ID NO: 44984 - DNA, 1107 bp, Xenorhabdus nematophilus
ttgtcacctttgcaaaacgagtggttacaggtatttgagcaattttcagcgactgaaattgcgccttatgctgacgaatgggatttggcagaagcgatccctgcaacggttgtgcaaaaacttgcacataacggttggttgggtgggttggcgaaacccgaaaatggtggtctggggtttgatgtcacgaccttcggattgctgaacatggctatcggcgcagggagtggttcgctcacggggttgctgaatgtacacgccatggtgttgaaaactattgaagattggggttctcaagatcaaaaacaacgctttctggcaccgctggtaaagggtgaaatcattggtgcattcgcgcaaacggaagtgtccgctggcggagattccaagaatctgtcgacgcagtttgcagaagacggaaattatctcagggctaatgggcaaaaatcttggatcacttttgcccagattgcggatttatttctggtattcggtaaatatcaggggctggataccgcagtgctggttcctaaagatactccggggctaaaagtgaccgccaaaaaaaatatgctgggcttcaagagtgcatatttggcagtgttggatttcaaagattgtcgggttcctaagaccaatattgtcggaaaacccggatttggacaaaacctaatctctaacaatgccttggactatggccgcatcagcgtggcctgggcggcgctcggaatacagcaggccgcattggcggcatccgctcgcagggctaattcccgcatcacctttgatacgttacttgcggatcaaggtatcattcgcggctatctggcggaaatgtccagtagcctgctggcctctcaactcatttgtttatcagcgacaaaagccaaagaaacaagggatgaagacgctcttgagcagatccttcaagccaaacttttctcatcgcatgaagctggcatcgcagcagcgaaagcggtacagattcacggtggtcacggttgcgatgaaagcaacggcatcagtcggctctatcgggatgcgaaaatattgcaagttgttgaaggcagtaatgaacttcaaaaaatgctgatcggcaaggcagta

SEQ ID NO: 44985 - DNA, 990 bp, Xenorhabdus nematophilus
gtatttttatttcccggcgtgggcgcacagcaacccgatatgtttgccgcattcagaacctatcccgaatatcgagcctgtctggaagaagtgtcggagctgtctcaggtcgatctatttagtgttattcatggcgaacagcgcgacaccttgaaacaagtgcgcattgcccaactggcgctcacggcgactacggtcgccattgcgggcatattacgtacgcgctgtgggcttgttcctgagtttatgatgggacacagtctggggcagtatccggctctgtgcgctgctggctatcttgatctggcgacgttgaccaaagtggttaacctgcgctcggaagtcgtggaagcctgcgcccgtcgttacgaacagggcgacatgtgttgggtattgcaccttcctgccgaggttgtggtacaggcagtggataaagccagaaaagacgatggtatagaattgtatgtatccgccattgatgcgtttgatcaggtgacggtttctggcgttatggcagacattcgacgctttgcgccgcgtatggaagcgctgggcgggttgctttatccattgaaaatcggtggcccgtttcattcgcctttaatgatggaagcgcaagagaaattggcggcattgcttgatttcctgcctgacacagacaagcaggggacgctgctctccagactggtctgcaacgtcagtggcgcagagttacctgctgaggatctcaaaccatcaattttacagcatctgacttctcccgtgcagtggctgcggagtttgcagtatgccgcgcaaaacggtgtcacccgctatctggaaatttccccgaaaacagtactgagttatctgaatcagcgcgcgggattgcccatgcaacctttatgcgaaccggatgaaattttcactttcgctgaggcactaagcaccgcagagagccgattggagcggtttttcaggcactgttatttccatctttatagctccaga

SEQ ID NO: 44986 - DNA, 453 bp, Xenorhabdus nematophilus
atgtatcatcattacctgaatactccagaaggctttcctaagccttatgtacatatcactgcagatgatgaaggagtcactagcatctactttgttaatgaaaagaaagaattagaatctaaaaacacgattactaagcagtgtgtaaaagagttacaggaatatttcaaaggaaaacgacatacattcacggttcctttgagcatgaagggaacagaattccagaagcgagtctggcagcagctctgcaacatcccttttggcgacatgtggagttataaacaattggcattgactttgggatccgttaattattgccgtgctgtaggaatggcaaactcacgtaatcccatttccctgattgtaccttgccatcgagtgattgggcatgatggtaagttagtcggctatactggtgggctggatatcaaaggatggctgctggaacatgaa

SEQ ID NO: 44987 - DNA, 1170 bp, Xenorhabdus nematophilus
attaaactcgaagttagaaatctatataaaatattcggagatcatccagaacccgcatttaagttattagaatccggttttaacaaggaacagatttttgaaaaaaccggtctggcgattggagtgcaaaatgccaatctggccattgaagaaggcgaagtatttgtcatcatggggttatccggttcaggtaaatctacgctggtacgccttctcaatcgtctgatagaacccaccagaggtcaggttatcattgatggaaaagatattgctgctatttcagacacccaactgagggaggttcgccgcagtaaaatcagtatggttttccagtcatttgcactcatgccccatttaaatgttctggaaaataccgcgtttgggatggaacttgccggtattcccaaaaaagagcgtcactacaaggcacttgaaaccttgaaacaagtgaatctggaaaactatgctctgtcatatcccgatgagctttccggcggtatgcaacagcgtatcgggttagctagagcattagccaatgatcccgatattctgttgatggatgaagccttctctgctctcgatcctctgatccgcaccgaaatgcaggacgaagtactacgtctgcagggcgagcaccagcgcacgattatctttatttcccatgacttggatgaagcaatgcgcattggtgatcgcattgcgatcatgcaggggggcatcattgtacaagtgggtacacctgatgagatcctgaataatcctgccaatgattacgtcaaaacgttcttccgaggtgtagatattagccatgtattctcagcaaaagatgttgctcgtcgtcggcatgaagctctgctccatatagccacaggttttggccctcgctcggctctgaaagttctggatgatgaagacaggaattatggatatctgatcgaaaaaggccaaaaatttattggcgtggtttcggtctgctctttacaaaaagcgctgacagaaaagcaaccgattgaatatgccacgttgaaagaacccgccgccgtctcggctgatatgccgctgcatgaattgatatctatcgtggcgcaatccccctgtgctgttcctgttgtgggtgataatgaccgttatttaggtgtcatttccaaagggatcctgttacaggcttta

SEQ ID NO: 44988 - DNA, 453 bp, Xenorhabdus nematophilus
ttggatatgaaaagactatctatttttaccatattgttattccctattacctcttttgcggttcctaatatgtgggccagtggctttggtcagggcataactgaatacctgatcatcagcccggaaaatgtcgtttttaaccttaactgcaccatgaatccggatgagcagaatatcctacagcacaatgtactcatcgacctacctgacggtactcgcttggactcacgcgatgacaaaacaacaataacggttgtgaccgatgatcaacagttcccgttacctgcatcgctgggctggcgaaatggggataacgcctggattcagtttattgatgcccttggtcacgccgcaacgttcgatgtttatgttaatgataaaaaagtaggaagttttactcctggtattaagaatacagaaaaagagctggatgacctcagcggttgcagaaat

SEQ ID NO: 44989 - DNA, 1605 bp, Xenorhabdus nematophilus
ggcattactgcgcaggaacttgcggtttatggtatttgtgatgttagcgagattgtttataacccaagttatgaattgttattctctgaagaaactcagccctcactgcaagggtatgagcgtggcacactgacccatcttggtgcggttgcggtagatacagggattttcacggggcgttctcccaaagataaatatattgtccgcgacgatgtgacgtgcgataccgtatggtgggctgatcagggaaaaggtaaaaacgataacaaaccgctcagtcaggaaacctggtctcagctcaagggattggttacgcagcagctttcaggcaaacgtttgtttgtcgtagatgcattttgcggcgcaaatgcggatacccgcctgaaagtgcgttttatcaccgaagtggcgtggcaggctcattttgtcaaaaacatgtttattcgcccatcggatgaagaattagttaacttcacgcctgattttattgtgatgaacggggcgaaatgtaccaacccgcagtggaaggaacaagagctgaattctgagaactttgttgcctttaacctgacagaacgtatgcagttgattggtggtacttggtacggcggcgaaatgaaaaaaggaatgttctcaataatgaactacctgctgccattgaaaggtattgcatccatgcactgctctgccaacgtgggtggagaaggcgatgttgccattttcttcggcttgtctggtacaggtaaaaccacgctttccaccgatccgaaacgcaagctgattggtgatgatgagcacggctgggatgatgacggcgtgtttaacttcgaaggtggctgctacgcgaaaaccattaacctctccaaagaagcagagccggatatttatcacgcgatctgccgtgatgctctgctggaaaacgttaccgtgctggcggatggcacagtcgatttcaatgacggttctaaaaccgaaaatacccgcgtttcttatcctatctaccatatcgaaaacatcgttaagccagtatcgaaagccggacatgccactaaagtgattttcttgaccgctgacgctttcggtgtattgcctccggtttcctgtctgacgccagaacagacccagtatcacttcctgtctggttttacggcgaagctggcgggaactgaacgtggtgtgacagaacctacgccaacgttctctgcctgctttggtgcggcattcctgtcactgcatccgactcagtacgcagaagtgctggttaagcggatgcaggcatcaggtgcgaaagcttatctggtcaatactggctggaatggcacaggtaaacgcatctctatcaaagatacccgtgcgattatagacgcgatcctgaatggtgatattgaagatgcagataccattgagctgccgatctttgacttagctgtaccgacagcattgccaggcgtggatacaggcattcttgatccacgtaacacctatgcggataaatctgaatgggatgttaaggctaaagatctggcacagcgttttgtcgataactttgacaaatatactgatacagccgcaggtgctgcattggtgaaagcagggcctaatctg

SEQ ID NO: 44990 - DNA, 1125 bp, Xenorhabdus nematophilus
aaaccgaaaaaatccgttgccttgtccggcgtgactgccggtaatacggcgctctgtactgttggcaaaaacggcagcgatttacattaccgtggctatgatattctcgatttagccacgtattgtgaattcgaagaaattgcttatctactcatccatgaaaggctcccttcccgcgcagagctggccgcttacaaaaccaaactgaaagccttgcgtggcctgccaagcagcgtcaaagccgcattggaagctttgcctgcggtcgcccatccgatggatgtaatgcgtacgggcgtttctgtctttggttgtactctaccggaaaaagaagatcataatcttaccggcgcccgtgatatcgccgatcgtttgctggcatccctcggctctatcctgctttattggtatcactacagccataacggacgccggattgatgttgaaactgatgatgattccatcggcgggcattttctgcatcttttacatggacaaaaaccgcgtgattcatgggaaaaggcgatgcatgcctctttggttctgtatgctgaacatgaatttaatgcttcgacatttaccagtcgcgtgattgccggcacaggatcagatacgtactccgctattatcggtggaattggcgccctgcgcgggtcaaaacatggcggtgccaatgaagtttcattcgaaattcagcagcgttatgactctcccgacaaagccgaagccgatatccttacccggctggaaagaaaagaagtcattattggctttggtcatccggtttataccgtctccgatccgcgccataaggtgattaaagagatttccctgcatctttccaaggaagccggcaccactcagatgtttgatattgcagatcgcattgagtctgtaatgcgggataacaaaaaaatgttcccgaaccttgattggttctcggcggtgtcttatcacatgatgggggttcctaccgccatgtttaccccactgtttgtgattgcccgtacggcgggttgggccgctcacattattgaacaacgcatagataacaaaattatccgcccttcagccaactataccggccctgaaaacctgccgtttacgccaatcgaccaacgcaag

SEQ ID NO: 44991 - DNA, 1863 bp, Xenorhabdus nematophilus
ttccaagatttttatcagtattcgattgatgatcccaatgccttttgggcagaacaggcccgacgaatacactggcagcatccttttgcacaggtattggattacaataacccgccttttgcccgctggttcagcggtgggaaaaccaatctatgctacaacgcactggatcgctggctggaaacccaacccgatgccaaggcactgattgccatttcaaccgaaaccaatagtgaagaagttttcacctatcaagaattatatcaggaagtcaaccgagccgcggccatgatgctctcactgggagtaaaaaaaggtgatcgcgtggtggtttatatgccaatggtcgcagaagcgctgttcgtcctgctcgcctgcgcccgtatcggggcgattcattccgtcgtgtttggcggctttgcttcccacagtctcgccacacgactggataacgcagagccggtgctggtcgtctctgcggacgcgggatcgcgggggggcaagattattccctataaacccctgctggatgaagcgattgaactggcacagcacacaccacgccatgtcttgatggtgaaccgcggtctggccgcaataaattggctggaaggacgggatatcgatttcgccagcctgcggcaaatacaccttgatgcagatattcctgtcacatggatggaatccaatgaaacctcctgtgtgctatatacatcgggcacaacgggcacgcccaaaggcgtacaacgtgatgtcggcggctatgcagtagcactggcgacctcgatggataccatttttggcggcaaaccaggcggcgttttcttttgcacatcggatatcggctgggtggttggccactcttacattgtctatgccccacttatcgctggcatggcaaccatcatgtatgaagggctgccgacccgccctgatgcgagtatttggtggcagatcgtggaaaaacatcgggttaacagaatgttttctgcgccaactgcaatccgtgttctgaaaaaatatcccacagattgtattgcaaaatacgatatttcatcacttgaggcattatatttggccggtgagccgcttgatgaacataccgcccgctgggttgcggaaatcatcaacgttccggtcattgataattattggcagaccgaaaccggctggccgattatggcgattgcgcgtggattggatgaccggccgagtcgttttggcagccccggttttccaatgtacggcttcaacgtcaaactgatcaacgaactaactggtcaggaatgtggcgataatgaaaaagggatgttggtcgccaaaggccccctgcctcccggttgtattcagaccgtttatggtgatgatacgcgttttataaatacttactggaagcattttgcccagcagatttattctacgttcgactggggcatccgtgacagcgacggttactattttattctggggcgttcggatgatgtgattaatatctcagggcatcgcttaggaacacgagaaatcgaagagtgcattaccagccatgaagacgtggcagaagtagccgtgattggcatcaaagatgaagtaaaaggacaagccgcggttgcctttgcggtacttaaggaagggcggaaaatccagagtgctgaccatttcgcagcgctggaaaaagcattgatggatttggtcgataagcagctcggcagtgtcgggcgtccggcacgggtctattttgttacccagcttcccaaaacccgctcagggaaaatgctgcgccgcaccatgcaggcgatttgtgaaggacgggagccgaacgatattgcattaattgagaactctgcctcgctggagatgatccgg

SEQ ID NO: 44992 - DNA, 1134 bp, Xenorhabdus nematophilus
atggcaaaaaaagattattatgaggttttgggcatttccaaacccacagaagagaaagagataaaaaaagcctataagcggctggcaatgaaatatcacccagatcgcaatcagggtgataaagaagcagaaagtaaattcaaagaaattaaagaagcgtatgagatcctgacggatgcacagaagcgcgccgcttatgaccaatatggtcatgctgcctttgaacaaggtggtatgggtggtggagcaggcggtttcggtggcggggctgattttagcgatgtctttggtgacgttttcggggatatcttcggtggtggccgtcgtcagcagcgttctagccgtggctctgacctgcgttacaatatggacttgacactggaagaagcggtccgtggtgtgaccaaagagatccgtattcccactctggaatcctgtgatacctgtcatggcagtggcgcaaaagcgggtaccaacccagaaacctgctcaacctgtcacggtgcagggcaagtgcatatgcgacaaggattctttacggttcagcagccgtgtccgcaatgtcatgggcgtggaaaagttatcaaagagacttgcggaaaatgtcatgggcatggccgtgttgagaaatacaaaaccctgtccgttaaaattccagcaggcgtcgataccggtgatcgcattcgcttgggtggtgaaggtgaagcgggtgaacacggtgcaccagcaggtgatttgtatgttcaggttcaggtcaaggcgcatcatatcttcgagcgtgatggcagcaacctttactgtgaagtaccgattaacttcgcaactgcggcactgggcggtgaaattgaagtcccaacccttgatggccgtgtcagcctgaaaatccctgcggaaactcagacgggtaaattgttccgcatgaaaggcaagggcgtgaaatccgtccgtggcggcgctcagggcgatttactgtgtcgtgtcgtggtagaaacgccggtgaagctgaacgacgaacagaaagacttactgcgcaagctgggtgaatctttgggtggcaagagtggtgaaaccaatagcccacgctccaagagtttcattgacggcgtgaagaagttttttgacgatttgactaag

SEQ ID NO: 44993 - DNA, 1902 bp, Xenorhabdus nematophilus
atgggtaaaatcattggtatcgacttgggaactaccaactcttgtgtagcaattatggacggcacaactgctcgtgtgcttgaaaacagcgaaggtgatcgcactacaccttctatcatcgcgtatactcaggatggtgaaactctggttggtcaaccagctaaacgtcaggctgtaactaacccgcaaaacacattattcgccatcaagcgtttgattggccgtcgttttcaggacgaagaagttcagcgtgacgtttctatcatgccatataaaatcattggcgcagacaatggcgacgcatggctggaagttaaagatcagaaaatagctcctcctcagatttctgctgaagttctgaaaaaaatgaagaaaacagcagaagactatctgggtgagccagtgacagaagcggttattaccgttcctgcctacttcaatgatgcacagcgtcaggcaaccaaagatgctggccgtattgcgggtctggaagtcaaacgtatcatcaatgaacctacggcggcagcgctggcctacggtatggacaaagaagtcggtaaccgtactatcgcagtttatgacttaggtggcggtacttttgatatctctatcatcgaaatcgacgaagttgacggtgaaaaaacgtatgaagttttggcaaccaacggtgatacccacttgggtggtgaagacttcgatagccgtttgatcaactatctggttgatgaattcaagaaagagcaaggctttgatctgcgtaacgatccactggcaatgcagcgtctgaaagaagccgcagaaaaagcgaaaatcgagctttcttctgcacagcagacagacgtgaacctgccatacatcactgcggatgcgacgggtcctaagcacatgaacgtcaaagtgactcgtgcaaaactggaatcactggttgaagatttggttaagcgttctatggagccgctgaaagttgccctgaacgacgctggactgtctgtatctgacatccaagacgtgattctggttggtggtcagacccgtatgccaatggtgcagaaaacagttgcagacttcttcggcaaagagccgcgtaaagacgtcaacccagacgaagccgttgcaatgggtgcggctgttcagggtggtgtactgtcaggtgaagtgaaagatgttctgctgctggacgtaacgccactgtctctgggcatcgaaaccatgggcggcgtgatgacggcgctgatcacgaagaacaccactatcccaaccaagcacagccaagtgttctctactgcggaagacaatcagtctgcggtaacgatccatgtattgcagggtgagcgtaagcgttccggtgataacaaatctctgggtcaattcaacttggatggtattcagccagcacctcgtggtatgccacaggtcgaagtgaccttcgacattgatgctgacggtatcttgcatgtttctgcgaaagacaaaaactctggtcgtgagcaaaaaatcaccatcaaggcatcttctggtctgaacgaagaagaaatccagcagatggtacgtgatgcagaagcgaacgcagaagctgaccgtaagtttgaagaattggtgcaaattcgtaaccaagcggatcagctgattcacggtactcgcaagcaagttgaagaagcaggcgacaaattgactgcggatgacaaagcagggatcgagaaagccgtttctgagctggaagttgctgtaaaaggcgaagacaaagctgaaaccgaagcgaagattcaggcactggttgaagcttctaagaaacttctggaaatcgcacagcaacaggctcaggaaggtgctgctgaagcgggcaccgcgaaaaaagatgacgacgttgtagacgctgaattcgaagaagttaaagacaaaaaa

SEQ ID NO: 44994 - DNA, 1104 bp, Xenorhabdus nematophilus
taccggaaatcttgtcgtgaatttcttgagagtgagatcgttcctgaacatcaggcttgggaatataatggtctgatggcgcgttctttttgggagagattaggtaaggctggcttgttgggtatcagtgtcagcccagaatacggcggcttgggaaaacatgattaccgttttgccgtgattctgacggaagagcttatcagagctggcgttacagtcccggggatcgtcgcccataacgatattattgccagttacatttttgccctcggcagcggagaacagaaacaaaagtggctgccggaattatgcctcgggaagcgagtcgcagccattgccatgactgaacccggcggtggttctaatacggcagatatcaaaactgtggccaaacggcagggagatcactatctggtcaatggcggcaaaacctatatcaccaatggtatcaatgctgatctgatcgtggtggcggtaaaaacagagcagggtcagcaaggtcaggggatcagcctgctggtgatagaacgggatatggccgggttctccagaggggagccaatgaagaaaattggctggaacggcagcgacacggctgaactgtttttccatgattgcaaagttcctgttaccaatctgattggccgtgaaaatctcggtaactattacttcatgtcggcaatgccacgggaacggctcagtatctcagcggtggcggttgccagcgcagaacatattttacagagtacgctggcttacgtgaaagaaagaaaagcgtttgaccagccgattggctcctttcaatacaaccgttttatccttgcacagttggataccgaagtaaaaattgcccgcatctatcttgataacgccgttgagcaatttagcaagggtctttttagtttggtggatgctgcccgtatcaaatggtggacaacggaactccagatgaaagtcgcggatcgatgcctgcaattatatggcggggcaggttatatgcgtgattctgttgcgggcaaaaactggctcaatagccgcgctcaaactatttatggtggaaccagtgaagttttacaggaaatgatcagtaaatcgatggggctt

SEQ ID NO: 44995 - DNA, 1602 bp, Xenorhabdus nematophilus
gattacatcgtggtaggtggcggctctgcggggtgtgtggctgcatcgcgcctgtctgagaacggtacgaaatcggtactgttgcttgaagcgggtcacgcatctgatgttaatgatccggccagcccgctccgggatgcgtcaaggctggtactggaagggtataactgggattacgaagcgaatgtacgcagtgaagatcggttcgccgatctcatttcgccttctcattacctgcaagatgaaaaaaaacaagagcacaaacaccggggaagaaaactgttcaattatcgggtgggaaaggtgcttggtggttcttctgccgttaatggtgccattgccttcaggggatttcccagcgattttgaacagtgggtgaaaatgggttgttctcgctggtcttgggaacaggttctgccgtggtttaaacatctggagaatgacgtcgatcgcacgggtgatgataaccacggttcactggggccaatgtgtttgcgcagaccgcaacatgaggaaatccatcccctcgatatggcttttgcccatgcttgtgagcagtcgggtgttccctatgtggatgatcttaatgccggagagtctcccgccgtagggcctgtacctgccaacgtcatcaatggggctgaaagagtggatgtttatcgctcatatcttgaacctgttcttcatagaaagaacctgcgcgttatgacggatgtgctggtggcacagatcatttttaacggaacggtagcggccggcgtaaaagtgattcaggccggagaagaacagatttatcacgcagagcacatcgttctctgtgcaggcgcaattggttcggcaaccctgttacagcgttcaggtgtcggcgatcccggacatctgcgtgctttgggcattccggtgattgcggagttgcccgccgttggccgaaatttgactgatcacgcttcagttgtgctctggtcattgccgaaaaccggcgtgtgtacaacgggtttaccgtggcggcaaattgctgcccgcatcagcagtggctatgacacaaaagttgatgtgcaaatcgggctgttgaacaatgttgccagtgagacggtgccgggattcaaagatcgtgtcgcttatcccatgctggttggtgcttccgtgatgctgatgcggccacaggctctggggcgtgtttttatcagtaccgccgatcctaccgtgctgccccagattgacctgccactgacccgcaatcctgcggatatcgcccgtcttgtcggtggtgttcgtaaaatatgggaagtcctgcggcatccggaagttgatgcgtttctggatgggattcagttttggtctcattccatgatttacaacgatgaaatcatgaacagtgcgattaagaaccttgttaatccgggctggcatgcgtcaggaactctcagaatgggagctgactctgatcctgactgcgctactcaagaggatggacaagtgtatggcatcacgggagtgaccgtagctgatgcatcgctgtttcccaccattccttcgatgccgaccaatctgacgaccatcatgaccgctgaacggattaccagctttctgatggagcgagag

SEQ ID NO: 44996 - DNA, 1665 bp, Xenorhabdus nematophilus
ttggctcaatatgtttatagtatgcatcgggttggtaaaattgttccccccaaaaggcatattctgaaaaatatttctctgagttttttccctggagcaaaaattggtgttctcggcctcaatggtgcgggtaaatcgaccttactgcgcatcatggcaggtatcgataacgatattgaaggggaagctcgtccacagcccggcattaaaattggttatctgccgcaggagccaaagctcaaccttgaacataccgttcgcgaagctgtagaagaagcggtcggcgaagtcaaaaatgcgctgacgcgtcttgatgaagtctatgccgcttacgccgatcctgatgcagattttgacaagctggcaaaagagcaaggtcaactggaagcgattatccaatcccatgatgggcataatctggataaccaactagagcgagcggccaatgccctgcgtctgccagcatgggatgccaagattgagcacctttcagggggtgaacgtcgccgagttgcgatttgccgcttgctgctggaaaaaccagacatgctgctgctcgacgaacctaccaaccaccttgatgccgaatctgtcgcatggctggagcgctttctgcacgattatgaaggcactgtcgttgcgattacccacgaccgttacttcctcgataacgttgctggctggattttggaacttgaccgtggtgaaggcattccatgggaaggcaactattcttcatggctggaacaaaaagacgcacgtctggcacaagaagcctcctcagaagctgctcgacgcaaatccattgaaaaagaacttgaatggatacgccaaaatccgaaaggacgtcaggcaaaaggtaaagcgcgtctggctcgctttgaagagctcaataacgttgattaccaaaaacgtaatgaaaccagtgaattgtttatcccgccaggtccgcgtctgggtgataaagtgctggaagtgaccaacctgactaaatcttatggcgatcgggttttgatcgacaacctgagtttcgctctgccaaaaggggcgattgttggaattatcggcccgaacggtgcgggtaaatcaactttgttccgtatgttgtccggtcaagagcaacctgattcgggttcaatcacactgggcgaaactgttacgctggcttccgttgagcagttccgcgatagtatggatgataaaaaaaccgtctgggaagaagtttccggtggtcaggacatcatgcgcatcggcaactttgaaataccaagccgtgcctatgttggacgctttaacttcaaaggcgtagatcaaggcaaacgtgtcggcgaattgtctggtggtgaacgtggccgtctgcatttggctaaactgctgcaagttggcggcaatatgctgctgcttgacgaacccaccaatgatctggatatcgaaactctgcgggcactggaaaacgccctgctggaattccctggctgtacgatggtcatttcccatgaccgttggttccttgaccgtatcgcgacacacatcattgattatcaagatgaaggtaaagttgctttctttgaagggaacttcagcgaatacgaagattataaaaagcggacaatgggggctgaagcactggagccacaccgcattaaatataagaaaatcagtaaa

SEQ ID NO: 44997 - DNA, 2457 bp, Xenorhabdus nematophilus
atgcgagtactgaaatttgggggcacctcagttgcaaattaccagcgtatactgagtgttgctgatatcgccgaaagtgaactatcccttgggcaagtggccctggttctttctgcacctgcaaaaatcacgaaccacttggtggcgatgatagacaaaacggttgcagggcaggatattgtttctaacatgagcgatgtgtcccaaatctttgctgatttgctgtcgggcttaaaagaacatcagccgaatttcggttatgaatacctgaaaggcgttgtggaacgtgaatttgcctacctgaaacagaccttgcatggcatttcgctattgaagcagtgtccagacagcattaatgctgctctgatttgttgcggtgaaaaactgtccattgccattatgggggcggttttacaggcgcggggtcataaagtgacagttattgatccggtcaaaaacctgcttgcccacgggcattatcttgaatcgaccgttgatattcacgaatcgtccaaacgcattgctgcgttgaacatcccggctgggcatatcattctgatggcgggttttactgcgggtaacgataacggtgaattggtggtactggggcgcaatggttccgactactcagcggcagtgctggctgcgtgtttacgcgcagactgctgcgaaatctggactgacgtagatggcgtttatacttgcgatccaagggctgtacccgatgcacgtctgctaaaaagcttgtcatatcaggaagcgatggagctttcttatttcggtgccaaagtccttcatccgcggacaatcgcgcctattgcccaatttcagatcccttgcctgattaaaaacacggcgaaccccgatgtgccgggcacctttatcggagaaggacagaaagacgaaaatctgcccgtcaaaggcatcaccaacctgaacaatatggcgatgatcaacgtctcaggtcctggcatgaaaggtatggtcgggatggcggcgcgggtgttttccgtcatgtctcgcaaaggtatttctgtcgtgttgatcacacagtcttcatcggagtacagcattagcttctgtgtgccgcaaaaggagctgacaaaagcacagaaagcgctgaccgaagaattttatctggagctgaaagatggtgtactcgatcccattgatgtgatcgataaccttgccatcatctctgttgttggggacggaatgcgcactcagcgaggtatctctgcccggtttttctctgcgctgacccgcgccaatattaacattatcgccattgcacagggatcatctgaacgttccatttcggcagtgattgacaatgataccgctaccacagcggttaggttctgccaccaaatgttgttcaacaccgctcaagtggttgaagtcttcgtggtgggtgtgggaggggtgggtagtgcattgattgaacagatccgtcgccagcagtcatggctcaaacaaaaacacattgatctgcgagtgtgtggcattgccaattcacgggcgatgttgacggatatgcagggcatcggtctggataattggcaacagtcactgtcggaagcgatcgagcctttcagcttgagccgccttatccgtcttgaaaaagaatatcatcttctgaatccggtcattgtggactgcacttcgaatcagtcgattgcggagcagtatgccagctttttaggcgatggttttaatatcgtgacaccgaataaaaaggctaatacgttgtcgatggcctactatcgtcaaattcgtcaggcagccgaaaaatcgaaacgaaaattcctgtatgacaccaacgtaggagcaggattgccggttatcgaaaacttgcagaatctgctcaatgcgggggatgaactggtgcagttcaacggcattctgtccggctcgttgtcttatattttcggtatgttggatgaaggcatgacgctttcacaagcgactctgctggcaaaagaaaagggctttaccgaaccggatccacgggatgatctctccggtatggatgttgcccgcaagctattgatccttgcacgtgaatctggctatgaactggaattggaagatattcacgtcgagccagtcttgccggctgcgtttgatgccagcggtgatgttggtcgcttcctgcaacgtttgccacagctggatcaagaattcactcatcgtgttgcggatgccgcaaaacaggggaaagttctgcgttacgttggcatcattgaacaaggccgttgtagggtgaaaattgccgcagttgatggcaacgatccgctttataaggtcaaaaatggcgaaaacgcactggctttctatacccgttattatcaacccattccgctggtgctacgtggctacggtgctgggaatgatgtcacagccgccggggtttttgccgatatattacgaactctgtcatggaaattgggggtt

SEQ ID NO: 44998 - DNA, 951 bp, Xenorhabdus nematophilus
atgaccgataaactgacttccctgcgtaaactgacaacagtcgtagcagatactggggatatcgcggcaatgaagctgtatcagccgcaagatgcaaccaccaacccttccttgattttgaacgcagctcaaatccctgaataccgccaactgattaatgaagccattgaatgggcgcgtggtcagagcgattctcgtgagcagcagattattgatgccggcgacaaattggcagtcaatattggtctggaaattctgaaactgatccctggccgcatttccaccgaagttgatgcgcgcctttcttatgacactgaagccagcgtagcgaaagcaaaacgtttgatcaaactgtacaacgaagcgggtattagcaatgaccgcattctgatcaaactggcttctacatggcagggtatccgtgcggcggagcaactggaaaaagaaggcatcaattgtaacctgaccctgctgttctcttttgctcaggcgcgcgcttgtgcggaagcgggtgtttatctgatttctccgtttgttggccggatccttgactggtacaaagcgaatggcgataagaaagaattcgcaccacatgaagatccgggcgtgatctctgttgctgaaatttaccagtactacaaagaacatggttataacacggtggttatgggcgcaagtttccgtaattccggtgaaattctggaactggctggctgtgaccgtctgactatctctcctgcgctgctgaaagaattatctgaaacagcaggtgaagttgagtgcaaactgggttatgaaggcgagatcaaagcgcgtccagctcgattgacagaagctgagttctactgggaacaccatcaggatgcgatggcgaccgaaaaactggcggaaggtattcgtaaatttgccgtagatcagggcaagcttgagagcatgatcgctgatctgctg

SEQ ID NO: 44999 - DNA, 1734 bp, Xenorhabdus nematophilus
aaagtgctgattgccaaccgtggtgagattgccgttcgtattattcgagcctgtcgtgattatggtgtgcagactattgctgtttatgcggatgctgatattaatgctcaacatgtgcaattggcagatgaagcttacggtttatcggggaatagccccgcagcaacctacctcaatattccacgtttattggcgatagcgaagcagtcgggagcaacgatggtgcatcccggatatggattcttgtctgagcgagcggaatttgcccgtgccgttatggacgcaggattgatttggattggccctaatccagaaaccattgatgaacttggcgataaggttaatgctcgtaagattgcccataaagttggtgcgcctttggtagtcggtacgtcagagccagtcaaagatgcacaggaagttgtcgcttttgcagaggaacatggcttgccgatagccattaaagcggcatttggcggagggggacgtgggctgaaagtcgcttggcgactggatgaagtggcagaactttatcactcggcagtacgtgaggcgacagctgcatttggccgtggcgaatgttttatcgaacagtttcttgataagccgcgtcatatagaagcacagattattgcggataaacagggtcatgttgtggtggttggcactcgtgattgctccttacagcgccgcaaccagaaattagtggaagaagccccggcaccatttttgactcaacaacaacgggagcgtattcatcaggcggcaaaagcgatttgtgcggaagccaattatgtgggagcgggtacagttgaattcttactaagcgccgatggaacgctctcttttttagaagtgaatactcgcttacaagtagagcatcctgtcacggaggaaacggcaggtatcgatctcgtgattgagcagttgagaatcgcggaaggtcatccattgagtattcaggagacaccagttccaagaggccactcatttgagtttcgcatcaacgctgaagatgcaggcaaaggtttcctaccgatgtcaggggttatcagcgaatttaccccgccttcggggcccggtattcgtctggattctggcgtgatcagtggctccactattcctgcgaccttggattctctgatggcgaagttgattgtcacaggcacaacccgtgaacaggccatctcgcgcgcacgtcgggcactacgggaattcagaatccgtggtgtggcttctgtgttgccttttcatcaagccgtgatggaacatcctgattttgtttctgatgagatcttcaatgttcatacccgttggattgaaacggattttgcgaatgagattgaagcgttaccacgccagattgtgacagaagataacagcatcacgcgtacatatattgaaattgatggccgcaggcatgagctcgggttgtctgccgatttatttgcgggattttctcatttggcacctgttagggaacagcaatcttcccagtctgcaataaaggaaaaaatgccggcagactctcgtcaggtgaaggcaccgatttccggtattttgcattcttggattgtgaaagaaggtgagcaggttaatgagggcgaactcattgccgtgatggaagccatgaaaatggaggtgcaaattaatgcacaccgtgcagggaaaatcacattctgtgtacaggcgggggattatcaggatgcagaaagcactctggcccatattgaa

SEQ ID NO: 45000 - DNA, 726 bp, Xenorhabdus nematophilus
gagatgaaaaacctgaaaatggaagtcatgcgctataacccggaaatcgacagcgaacctcatttcgtcacctacgaggtgccttatgatgagcaaacctccttgctggatgcgttaggctacattaaggacaatctggctcccgatctgtcttaccgctggtcttgccgcatggcgatctgcggttcctgcggcatgatggtaaaccgagtgccaaaactggcatgcaaaatctttctgcgcgattatccgcaagggatgaaaattgaagcgctcggcaacttccccattgaacgagacttagttgtcgatatgactcactttattgagagtctggaagctatcaagccttatatcattggtaatgatcgcaagcctgctgatggcccgaatgtgcaaacaccggcacaaatggcgaaatatcaccagttttcaggctgcatcaactgcggcctgtgctatgccgcctgcccacaattcggtctgaatcctgaattcattggccctgccgcagtcacgctggcacaccgttataaccttgataaccgtgaccacggcaagaaagaacggatgcctcagatcaacagtgacaatggcgtgtggtcttgtacttttgtcggttactgctctgaagtttgcccaaaacacgtcgatccggcgggtgcaattcagcagagcaaagcggaaagtgccaaagatttccttatctccatgctgaaaccacaa

SEQ ID NO: 45001 - DNA, 1794 bp, Xenorhabdus nematophilus
gtgcaaaccttcaatgccgatctagccattatcggagccggtggcgcaggcttacgggcagccatcgctgccgctgaagccaatccccaactcaagattgccctgatctcaaaagtttatcccatgcgcagccacaccgtggccgcagaaggcggatcagccgccgtcactcaatctcatgactcctatgactttcacttcaatgacaccgtgtcgggtggcgactggttatgtgaacaagatgtggttgagtatttcgtcaaacactgcccgacagaaatgatccaactggagcaatggggttgtccctggagccgtaaggaagacggttccgtgaacgtgcgtcgtttcggcggcatgaaaatcgaacggacatggtttgccgcagataaaaccggctttcatatgctccatacgctgttccagacttccctgaaatacccgcaaatacaacgcttcgatgagcactttgtgctcgatattctggtagatgaagggcaggtgcgcggtttggttgcactgaatatgatggaaggaacgaaagttcagatccgcgccaatgcggtcattatggcaacgggcggggcaggacgcgtgtaccgttataataccaatggcggcattgtcacgggagatggcatgggaatggcattccgccacggcataccactgcgtgatatggagtttgtacaatatcacccaaccggcctgccgggttctggtattttgatgacagaaggctgccgtggtgaaggtggcattctggtgaacaaagatggctaccgctatctacaggattatgggatggggccagagacgccccttggtcaacccgaaaacaaatatatggaactggggccaagagacaaagtttctcaggctttctggcatgaatggcaggcaggccgtactatcgcgacgccgcgtggtgatgtggttcatctggatctgcgccatttaggtgagaaaaaactgctcgaacgcttgccattcatctgtgagttggcaaaagcctatgtcggtgttgatccggttaaagaaccaattcctgttcgcccaacggcacattacaccatgggtggaatcgaaactaacccgcagtgtgaaacccgtatcaaaggactgtttgctattggcgaatgcgcttccgtcggcctgcatggggcaaaccgcctcggttccaattcattggcagaactggtggtatttggccgtttggcaggtgaagaagccgtcagacatattcagcaaaccacacctgccaatgaaaacgcgctggatgcacaagcccgtgatatcgaaaataaactcaataagctgctgaatcagaaaggtattgaaagctgggcgaaaatccgtgatgaactgggtatttcaatggaagaaggctgtgggatttaccgtactccagagctgatgcagaaaaccatggataaaattacggaattgaaggaacgcttcaggcatatcgaaatcactgaccgttccagtgtgttcaatactgatctgctctacacaattgaactgggctttggtctggatgtcgctgaatgtatggcgcattctgccatgaaccgcaaagagtcccgtggagcccaccagcgccttgatgcaggttgtacagagcgtgatgatgagaatttcttgaaacatacgctggcgttctataacccagaaggtgcaccacgtttggagtacagtgatgtgaaaatcaccatatctaaacccgcgaagcgggtctatggtggtgaagccgcagcacaagataaacaacagaaggagcaggcgaatggc

SEQ ID NO: 45002 - DNA, 1095 bp, Xenorhabdus nematophilus
atgctgaaagtgatccagtctccatccaaatatatccaagggccaggtgcgttatctcacatcggccaatacaccaaaatacttgctgatcacgtttttgtgattgccgataatttcgtaatgagcctcattggagatgccgttagcaaaagtctggaagcacacgcagtcaccagccattttgagatcttcaacggtgaatgtagccgtggcgaaatcaaacgcctgtcagacatttcagcgagtcaccaatgtcaggccgtaattgggatcgggggcggcaagactcttgataccgccaaagctatagcgcatgcatgcaggctacctgtaataatttcccctaccatcgcttccacagatgccccaaccagtgccctttccgttctgtataccgagctgggtgaatttgatggctacctgctgtatccacaaaaccctaatatcgtactgatggacacccgtattattgccaaagcaccggttcgtctgcttgtggcaggaatgggagatgcgcttgccacctattttgaagcccgggcaaatagcgctgctcataaaccaacaatggcggggggtgcaacatccaatactgggctggctctggccaaactgtgttacgacaccttactggcagaaggttataaggcaaaactcgcggtggaagcgggtgtcagtactccggcagtggaaaatatcattgaggcgaatacttatctcagtggtatcggttttgaaagtgcaggacttgccgctgcccacgccattcacaatggcttcaccgtgctggaggaatgtcatcatctctatcacggagaaaaagtggcgttcggcacactggcacaattgatgctggaaaacagcccgaatgaagagttggaaaccgtgctcgatttctgtgttcaagtcggtcttcctgtcactctggagcaactcggcttgcgggacagtgagaaattgcaccagaaaatcatggaagttgccaaggccagttgtgccgaaggtgaaactattcacaatatgccgtttaaagtcaccccagaacaggtctatgcagcaataatggccgcagatcgcatgggcatggattggctg

SEQ ID NO: 45003 - DNA, 2127 bp, Xenorhabdus nematophilus
tgttcacacgaccatgcccctaccatacaggatacaacccctcttgaattaaccgccaaccagcgttttaactggataatccacggcatggattgcccaagctgtgcaggcaaaatcgaaaatgcggttaaaaaattgcctgaagctaaacaggtcagggtgctgtttactacggaaaaactggtggtcgatgctgattctgatattcgcgcagccgtcgaacaagcggtaaaacaggcgggttttgaaatcaagcaaacggattcgacgattagattgcctccagcagcaaatcactggaaaaccttttccccaattctcattcttatagcattaatggtcatcagttggggcattacaaaaataaatccacccgctggacagattgcattcattgttaccacgttgattgggttatacccggtcgccaccaaagccatcaaactgatccgttcaggaactccctttgccattgaaaccttgatgagtgtcgccgctatcggtgccctattcattgatgccaccgcagaggcagcaatggttattctgctgttcaaagtgggagaagtactggaatcttatgccgcagggcgtgcccgccgtggtgtcagtgccttgatggctctggttcctgaacaggcgctgcgggtgacaggaggagaaaagaaaaccgttccggctgctgacctgcgtccgggggatattattgaaattgcgccgggtgcccgtttacctaccgatgccgaactactcagtccgttcgccagttttgatgaaagtgctctgacaggtgaatctattccagttgaacgccagcagggagaaaaagttgctgcgggctgcctctctgtcgatagcgcagtgcaaatgagagtgttctctgaaccgggacacaatgccatcgaccgcattcttcaactgatagaagaagcggaagagcgccgtgctcccattgagcgcttcatcgatcgattcagccgtatttatacaccgctgattatcttgttctctgtactggtcgtagtaatccctcccctcctccttgccgagccttgggaaacttggatctatcgtggattgaccctgctattaatcggctgcccctgtgcgctggttatctcaacacccgccgcgatcacttctgcactggcggcagcgacccgtcgtggtgctttaatcaaaggcggagcggcattggagcagctcggttcagttaccaccattgcgttggataaaaccggcacactgaccgaaggaaaaccccgggtcacggaaatagaacccgtggaaaacatcagcgtagaaacactgctggcgctggcaggagcggtcgaaagtggctcgcaccacccattggcaaaagctatcctcaacgcggcagaaaataaaggtgtgacggttgtcgaagctgaacaccgtaaagcgttggctgggatcggggttgaagggcgattgtcagggcagaaaattctggtcgcggctccggggcgactgccggaaaacacgttatccaccgcatggaaacaaagggtcacagagctggaaagcaacggtaaaacggcggttgccgtggtacagggtgagcaatttgtgggtttgattgccatgcaggacaccttgcgtcaggatgccatagacgcaatccgcgccctgaaaaaacaaggcgtcaatgctgtgatgctgactggcgataaccctcgtgctgcggccgctattgcagctcaattggggatcgattatcgcgcgggtctgttgccggaagacaaggtaaaagccgtcactgagctaaatgaaaaacaccataccatgatggtcggtgatggcatcaacgatgcccctgccatgaaagcggccagtatcggtgtcgccatggggagtggtactgatgttgcgctggaaacagcggacgccgccttaacacacaatcgactgaccggtttgcctgaaatgatcgctctgtcccggacaacgcactataacatccgccagaatatcaccattgcgttaggcttgaaggcgatattccttattaccagtctattggggatcacgggtctgtggatggccgtgctggctgattcaggtgccacggcgctggttacagcgaacgccatccggctgctacgg

SEQ ID NO: 45004 - DNA, 1539 bp, Xenorhabdus nematophilus
attccatcccccgttctgcaatctgaccgatacacggaagaaacttacgagaaggtgaagtacaagcccgatggctcaggcacaaatctctcttataccgcgacccgtgtctgtaaaccgatgtataaccaatatgagcgtgacccggctaaacccaaactttccgcttacattacagactggtgtcaatatgatgcccgtcttgatgacaagaatgaaaaccccgaggatcgcggcagagggtttaatctatcgacgatagatccgacaacttacgacaaattgattttcagcttcttgggtatctgtggggatattggcgttaagaaagaaaaagttaaggaagtctgggacggctggaattcccagactgaccagaaaatcaccgaaggccatatcgtgccactggacccttacggcgatttaggcactgcccgtaacgtcggtctgccggaatcgagtaaaaatacttcaattaatgcggggacttttctgccctattatcagcagagtaaagcggcgggtttgctgggaggattacgggaattacaaaagcgcgcgcgggcagcaggacacaaacttgagctggcattcagtatcgggggctggagtttatcgagttatttctccaagatggccgaaaatgaaggacagcgcactgttttcatcaacagtgtggttgatttttttgaacgcttcccgatgttcagttgtgttgacatcgactgggaataccccggtgctgagggagatgtacacaatattatcagtgaaaacgacggcaaaaattatgccttgctggttaaagagctgagaacggcactggataatcggttcggtacaggcagtaaagaaatttctattgcctgtagtggggtaaaagccaaacttgctaagtcaaatatcgctgaattagttaaaaatgggctggataatatcttcctgatgagttacgacttttttggcaccggatgggccaattatatcgggcatcataccaacctctattcccctaacgagcccgatcctaatggagaatatgatctctcggcagaagcggcgattaattacctgcatcaagatctcggtattcctctgagtataattaacttgggttatgccaactatggacgttcgggtaaaggtgccaagctggaaacgcgtttgtacgataagccgggtgatgctctgggcacaatggaaaaaggggcgccggaattcttcgatattgtcaataactacatggatagtgaacatacactgagtacgggaaaaaatgggtttgtactaatgacagataccaatgctgatgcagatttcctgttcagtgaaaaacaggggcatttcatctcactggatactccccgcacggtgaaacaaaaaggagaatatgtcaccgggcatcaactgggagggatcttttcctggtctggtgatcaggattgcggtctgttggccaatgctgccagagaaggtatgggatatatcgccaaatctaatcatgaaactatcgatatggggccgttatataatccgggg

SEQ ID NO: 45005 - DNA, 1533 bp, Xenorhabdus nematophilus
acacaaaaaacctatcaattaaacggttatgacccggcaacaagcaccgatattctgacctataccgccacccgcatggctaagacggtgtttaacacttatcacgatgatgatgaattcagtatcgcgtgttacttcacggactgggcacaatatgatggaagggcagtggaggcatcaccatcggatgaagtattcagaaatcaggggggacgcagtgccgatttgacccgcattaaaggcgattcaaccaatggcagcccctttaagaaattgatattcagttttgccggcatcgttggtgatgaagggccgaaaggaaacataattctgaaagctgccaaagattggggattcggagccgatgaggctgaaaccctcaaaaattacaccggatggcctattccaatcgacccgtggggtgatgtcagcacttactttaactgcggtttcgatagtggggcatctggagcggctaaagatgtctataaccaagagaaagccacaggattactgggtggtttcaattcactgaaaaaagctgatcccaatctggaggtttccgtcagtatcggcggctggtcaatgagtggtgctttttatgaaatttgtcgcagtgatgcctatcgtaaacagtttattgatggagtcaaaaatctattctgtcgtttctcaatgttcaatcatatcgatattgactgggaataccccggctcggcgggaatgggaaacccatttgataaagatgattatgtctattataaaaaactaattgaggaattaacggcagccaagatccccaatttacaaggtattagtattgcagcttcagccgatcctcaaaaaattgatgatgcccatattccagaactgatggaagcaggtgtcaccggcatcaacctgatgacctatgacttctttactctgggtgatggcaaactttctcaccataccaacctttatcgcaacaaaaatgaccaacattccaaatattctattgacgatgccgttcagcatttaatcactcagggtgttgacaagaaaaagattttcattggttatgccggttatacacgcaatgcaaaaggcgcaaacattaccagcaaaagcccgcttcaaggaacttataacggacaaggcaatatcgtcggcactttcgaatccgcggttattgaatggactgacattatctataactatgttgatttcgaaaatggcataggtcgtaatggctatgaaatcattcaagataatgttgctaaggcagattatctttataaccaagatctcaaagtttttatgtcattggatacgccacgttcagtcagagaaaaagcccgctacgtcaaagaaaaaggattgggcggcttatttatttggtccggtgatcaggataatggcttattaaccaacgctgcccacgaaggtctgggacgtcccgttaagaaaagcgttatcgatatgtcaccgttttatttcgataacgatgatctcccttcttacgataaacccaaagaaccccaatgcaaagac

SEQ ID NO: 45006 - DNA, 885 bp, Xenorhabdus nematophilus
gttgtggttatggggtcggctacaggagatattgttctcaggttatctgaattaccccacagcggtgaatattgggaagctgaagaagttgatcggcaagtaggcggctgtgctttcaacgttgtgcgggcattgtgccgtcttcaaattccggttatcaatggcatattcgtgggtaatggtgtttggggagaacgtgtcacagaagagatggaaatgctcggattaacagtgacattgcgtcatccaaaacgtgacaatagctggtgcattgccatgatgacgccagatgataagcgcatatacgtttctgtccccggttgtgacgatagttggaatgccgatattctggcgactattccgcttccggagcaggggcatatctattccagcggctatgaattggcaaacccaaaagcagacgttttgcgtgaatggttgctggcttctccctcagggctgacattggtattggattttggccctcgtctgcctgatatagatagggagtttattcaggcactgcctgctgaaagaacaatattgagtttaaatcttgatgaaacggcgatgctgtgtggcgccggcgatccagtggtacaggctggccgttatgttaatgagcgggggttcactgccattgttcgtcttggtgcagagggagcgtggatatgtcagccgggctgcgaaccggaatatattcctgcttatcaggtcaacgttgcagataccattggtgcgggtgatgcgcattgtggcggcatgctggctgggctgtctcagggaatgtcgctgcgtgatgcggtggagctgggcaaccgtgttgcggccgtgactgtcagccgttctggctctgatggcgcaccgaccaaggatgaactgatg

SEQ ID NO: 45007 - DNA, 1119 bp, Xenorhabdus nematophilus
atgaaatctctacggttagccatcgtccgtcaaaagtatcgtccagatggcggggctgagcgttttgtcacacgggccctagaggctctcaatcaccaacaacttgaacttaatatcattacacgctcttggcagggagaaagtaatcctaattggaatattcacctatgcaatcctattaaatttgggcgaatcagccgtgagcgtggttttgcaaaagcagcgcgaaacttatggcaaaaagagcaatttgatttagttcaaagtcacgaaagaattgctggctgtgacatttacagagctggagatggtgttcatcagcgttggttacatcagcgcgcaaggattttgccaaagtggaaagctcactggctattaaataatccataccacagatatgtaatgaatgcagaagaggaaatgtattcctcaccatcattaaagcaggtgatctgtaatgctgaaatgataaaaaaagaaattatcgaagaatttagtctcgctgaagacaaaatatccgttatatataatgccattgatagcacaaaattctttcctgcccatgagcaaactcgcctgcaattgcgacaacaatataacattcccactaccgcaaagtgtctgatttatgtaggctctggttttgaacgaaaaggtttgtctgccgcgattaaaactattgctaaaacaggagactatctgttagttgtaggaaaagataaggaacaggtaaagtatgaagaacttgctaatactttaggatgccagcatcgtatccgtttcatgggattacaaaaaaatacattgttgctttatcaaatgtctgatgccttattgctaccgacattatatgatccatttcccaacgtcatccttgaagccatggcgtgtggtttgcctgtcattaccagtacgacctgcgggggagcagagtttatcaccgaaggtaaaaatggctttatctgtgacgcactcgatatcggaaaactagaagaggcggtttattgtcttcctaataatatattaggtacggatatgtcaatatcagcgcgaaatcaggtgataaattcaacacctgaaaatttatctcaacaattaattcagctttatcaacgagtt

SEQ ID NO: 45008 - DNA, 1194 bp, Xenorhabdus nematophilus
atgtcagcgtctttttatcagaaaatgaatgagcagttggaacaaacccgtgcggaaggattattcaaaaatgaacgtatcatcacttctgcgcagaatgccgatattaccgttgccgatggtagccaagttattaatttttgtgccaataattatttagggttagctaatcacccggacctgatcgctgccgcaaaagcgggactggatagccatggttttggcatggcatctgttcgttttatctgtggtacgcaagactcccataaagaactggaaaataaaatagctgaatttctgggtatggaagatgccattctgtactcttcatgttttgatgcgaacggcggcctgttcgagacattattcgggccggaagatgccattatttcagattctctgaaccatgcttcgatcattgatggcattcgtttgtgcaaggcaaagcgttatcgctatgccaataatgatatgcaggaattaagagcacagttggaaaaagcaaaagcagacggtgcggagaatattctggttgcaaccgatggggtgttctcaatggacggtgtgattgctgacttgaaatcggtctgtgatctggccgatgaatttgatgcgctggtcatggttgatgattcccacgctgttgggtttgttggcaaaggcggacgtggtacacatgaatactgtgatgtcatgggtcgcgttgacattatcactggcacactcggtaaagcgctgggcggtgcatctggcggttatactgcggcacgcaaagaagttgttgaatggctgcgtcagcgttcacgcccttatctgttctccaattcactggcaccttccattgtagcagcctctatcaaagtgctggatatgctgaaacatggcgacgaattacgcgatcgcctgtggagaaatgccaacctgttccgtgcaaaaatgaccgccgcaggctttacactggctggtgcagatcacgcgatcatccctgttatgttaggagatgcgaaactggcgcaggaattcgctgccgagctgctgaaagaaggcatctatgtgattggattcttctatcccgttgttccgaaagatcaggcacgtatccgcacccaaatctctgctgcccataccgaagagcaaatcgaacatgcggtggctgcgtttatccgtatcggtaaacagttgaatgttattgca

SEQ ID NO: 45009 - DNA, 1023 bp, Xenorhabdus nematophilus
atgaaatcactgtcaaaattaaagccagaagaaggtatttggatggcggatgtgcccacaccggaactggggcacaatgatgtgatgattaaaattcgcaagaccgccatctgtggtacggatgtacacatctataactgggatgactggtctcagaaaacgattcctgtgccgatggtggtagggcacgaatatgtcggtgaagtggtcgcgattggtcaggaagtcaaagggttcaacatcggcgaccgtgtgtctggtgaaggccacatcacttgtggtcattgccgtaactgccggggtgggcgtacccacttgtgccgtaatacgaccggcgttggcgtgaaccgtgcgggtgcatttgcggaatatctggttatcccggcatttaatgccttcaaaattccggacaatattccagatgaactcgccgctatttttgacccgtttggcaatgctgttcacactgcactgtcttttgatctggtcggggaagatgtactggtatctggtgctggcccgattggtattatggcggctgcggtgtgtaagcatgtcggagcacgtcatgtcgtgattacagatgtcaatgaatatcggcttgatttggcgcgtaaaatgggtgtcacccgtgccgtgaatgtcagtaaggaaaatctgaccgatgtcatgaaagaattaggcatgacagaaggttttgatatagggctggaaatgtcaggcgcgccacaggcattccgcactttattgagtaccatgaaccacggtgggcgcattgccctgttggggatcccaccttcagatatggcgatagattggaatcaggtcatctttaaggggctgtttatcaaagggatctatggccgtgaaatgtttgagacatggtacaaaatggcggcattgatccagtctggtttagatttgaccccgattattactcaccaattctcgattgatgatttccagaaaggttttgatatcatgcgttcagggcaatccggcaaagtgatcctgaattgggat

SEQ ID NO: 45010 - DNA, 990 bp, Xenorhabdus nematophilus
gcttctatgacagttatcggtgccggttcatacggcaccgctttagccatcacactggctcgcaacgggcatgaagttgtgctctgggggcataaccctcagcatatccacgccttgcagcaggcgcgttgcaatcaggcatttttgccggatatttctttccctgataacttattgctcgaagcagacctgaaaaatgcggtttcaaccagcagtaatattctgatcgtggttcccagccatgttttcggggatgtattacagcagataaaaccatatttacagccggattcccggattgtctgggcaacgaaaggccttgaagcagaaaccgggcgtttattgcaggatgtggcacgtgagatattgggtaacgaaatcccattggctgtggtatctggcccgacattcgccaaagaactggcagcaggtttgccgacagcaattgctgtatctgcgacgacccctgaatttggcgaagaactccagcagctttttcactgcggcaaaagttttcgtgtgtataagaacccggatttcactggcgtacagcttggcggcgcaataaaaaatgttattgcaattggtgccgggatatctgatggtatgggttttggggcaaatgctcgcacagcattaatcacccgaggcttggccgagatgagtcgccttggtatcgcattaggcgctgatccttcgacatttataggtatggccggattgggtgatttagttttgacctgtactgataaccaatctcgtaaccgtcgttttggcatgatgctgggtcaaggtatcagcgttgacgatgcacaacgtgagattggtcaagttgttgaaggctatcgtaacaccaaagaagctcgggcattggcagaacgagccggtgttgagatgccgattacagaacagatctatcagatactatattgtaataagaacgttatcgaagcagcccagacattattgggcagagcgacaagagatgag

SEQ ID NO: 45011 - DNA, 1164 bp, Xenorhabdus nematophilus
atggatataacaatagcaggtataggatacgtgggcttatctaacggaattcttttatcacaaaaacataaagttattgcgttagatattagcgaagaaaaagtcaatcttataaataaaaaaaaatctccagttgtcgataaagaaatagaattctatataaaagaaaaaaaattagacctcattgcaacacttgataaaaaacttgcatatgaaaacgctgactttgttatcattgcaacacctacagattacgaccctaaaactaactattttaatataaaatctgtcgaatctgtcatagaagatgttctgtattataatcccacagctataatgataattaaatcaacaattcctgttggttttacgaaacagatgagagaaaaatataatacggacaatattattttctctccagaatttctcagagaaggacgcgcattatacgacaatttatatccatctagaattgttattggcgaaaaatctgaaagggcacaattattttctgatcttctactcgaaggagctataaaaaaagacattcctattctttttactgaatcaactgaagcagaagcaataaaattattttcaaatacatatttagctatgcgagtagcatattttaacgaacttgatagttatgcagaaatcaatgaattaaacactcgccaaattatcgaaggtgtttctttagatcctagaattggtaatcactataataatccatcatttggatatggtggctattgcttacctaaagacactaaacaattacttgctaactatcaaaaagtaccaaataatattattaatgcaattgtggaagctaatcgtacacgcaaagattttatcgctgattcaatccttagcaaaaatcctaaaattgtcggtgtttatcgattaattatgaaatcaaactctgacaattttagagcatcttcaattcaggggatcatgaaaagaatcaaagctaaaggcattgaagttgttatatttgaaccagaaatgacagatgagtattttttcaactctaaacttattcgcgatttagaatattttaaatctatatcagatataattatctctaatcgcatgtctgaagaactcaaggatgtgaaagaaaaagtgtatacgcgagatttatttggtaacgat

SEQ ID NO: 45012 - DNA, 579 bp, Xenorhabdus nematophilus
aatgtcgtttggcattcacatacgttggacagaaagcaaagggaagtggtgaatggccatcctgctttagtcatctggttcactgggttgtctggctcagggaaatccacacttgcaggcgcactggaacaagccctgttttcgcgggggatcaaaacctatttattggatggagataatctgcgtcatggcttgtgcagcgatttgggattttctgaaactgaacgacgagagaatatccggcgtatcggagaagtctcaaaattgatggttgatgctgggctagtagtcttaacggcgtttatttctccccatagagctgaacggcaaaaactacgtgaattgatgggagccgatcgatttattgaagtctttgtggatacgccgctggcgatatgtgaagcccgtgatccgaaaggcttgtataaaaaagcgcgggcgggggagctgcttaacttcacgggaattgattcagcttacgagacgccagaacagcccgacatctatttggatggctcactacctgttgaatcatcgatagaaaaattgcttgctgcgctgcataaccacaactttttg

SEQ ID NO: 45013 - DNA, 729 bp, Xenorhabdus nematophilus
atgagccagcttcatttagcagaattgctggcattgaatcatgatcagcgtgccgaagcattagctgacatcaatcaacaactggaattactggatgcccgccagcgtgttagctgggcattggaacatctatctggcgaattcgtgctttcttcaagttttggcattcaggctgcggtctgcctgcatctggtgacacaagaatatcctgatattcccgttatcctcacggataccggttatttgttccccgaaacttaccaatttatcgataagctgactgacgaactgaaactgaacttgacggttttccgggcagaactttctcctgcctggcaggaagcgcgttatggcaaattgtgggaacagggagtggaaggcattgagcgctataaccagatcaacaaagttgagccgatgaaccaagcattgaaatcactgcatgcacaaagctggtttgcagggttacgccgccagcaatcggaaagtcgcgctaatttacctgtgctggccgttcagcgcgatgttttcaaaattctgcctattgttgattgggataatcgtcgagtgcatcaatatttggcgcagcagggtcttgaataccatccgctatgggagcagggctacctctctgtgggggatacccatacaactcaaaagtggcagccgggcatgagcgaagagcaaacccgcttttttggcttaaaacgtgagtgtggtttgcacgaa

SEQ ID NO: 45014 - DNA, 1716 bp, Xenorhabdus nematophilus
aatatgagcaatgaaaaacaaggtcctttgaaggttgaaggtaaactcgctgacagtgaacgcatgaaattaaatagcgactatttgcggggtacaatcagcgaagatttaaaaaatgggctgacaggcgggtttgagggggataactttctcctgatccgtttccacggcatgtatcaacaggatgaccgtgacatcagagcagagcggacggaacaaaaacttgaaccccgtcacgctatgatgctgcgttgtcgcttgccaggaggcattatcacacccagtcaatggctgggtattgatcagtttgcgacagaagataccttatacggcagcatccggttgaccaaccgacaaacgttccagtttcatggcattttgaaaagcaacctaaaacctgcccatcagttgctggcaaaaatggggctggattcattggcaacggccaatgacgtcaaccgtaacgtactttgcacatcaaatccggtgcaatcggctttgcaccagcaggcttatgaatgggcgaaaaagatatcggaacacttattgccacgcacgagcgcttatgccgaaatctggctggataaagaaaaagtagcgactaccgatgaagagcctattcttgggtcaacttatctgcctagaaaattcaaaacatccgtggtgattccgccacaaaatgatgtcgatctccatgctaatgacctgaactttatcgctattgcagagaatgaccagttgatcggctttaacgtgctggtgggtggcggattagcgatgacccacggtgataagaagacttttcctcgactggcgagtgagtttggttttattccactgaaacacacattggcgattgcagaagccgtggtgacgacacagcgtgattggggcaaccgaacagaacgaaaaaatgccaagaccaaatatacccttgaacgagttggtgtcgacaccttcagacaggaagtagaaaaacgggcaggagtgcactttgaggctattcgtccgtatgaatttacgggtcgcggggatcaaattggctggttgaaaggcatagatgatcaatggcacctgactttgtttattgagaatggccgcttgctggattatcccggtaaaccgctaaaaacggggatcgcagaaattgcgaaaatccacaaaggtgatttccgtctgacggccaatcaaaacctgattgtggcgggagtgccagaaagcgaaaaagcacgcattgaagaaatcgcccgcacacacggcttaatagataatagcgtgacattcctgcgtcatcattccatggcgtgcgtttcatttccaacttgcccattggcgatggcggaagccgaacgtttcttgccgacatttgtcgattatgttgatgcattaatggaaaaacacggtgtttctgacgaacatatcgtcctgcgtgttacgggctgcgcgaatggatgcggcagggcgatgctggcagaaatagggttggtaggtaaagctcaggatcgctataaccttcacctcggtggaaaccggattggcagccgaattccccgcatgtacagggagaatatcacttcagcggagattctggtgatactggatgaattgattggtcgctggtcagcggaacgcaatgtccatgaatgctttggggatttcttggttcgtgccgacattatcaaacctgtcttgaattcagcccttgatttttatgac

SEQ ID NO: 45015 - DNA, 366 bp, Xenorhabdus nematophilus
atcatgagcactaccatctttaaagattttcaatttgaagcggcgcatcgcctgccgcatgttccggaaggacataaatgtgggcgtctgcatggacactcattcatggtacgtctggaaattaccggagaggttgatcctctcagcggatggatcatggattttgccgatgtaaaagtcgcatttaagccgatttgggaacggctcgatcataactatctcaatgaaattcctgggctggaaaatccaaccagcgaagttttagctaagtggatctgggaaaagctaaaacccactctgctgccccaactcagtgccgtcatggtaaaagagacttgtagcgcaggttgtatctatcgtggcgaa

SEQ ID NO: 45016 - DNA, 1403 bp, Xenorhabdus nematophilus
atgcaacataatgaaaatcagcttaaacagggtctgagcgtacggcatattcgctttatggctttaggctctgcaataggcactgggctgttttatggctcggcagcggcgattcagcatgctggccctgctgtattgctggcctatttaatcggtggtgctgctgtatttatggtgatgagagcacttggcgaaatggccgttcaccatcccgtttccggttctttttcacaatatgccagccattatctgggaccattggccggctttctgaccggttggatttatgttcttgaaatgctgtttgtttgtctggctgatatcaccgcattcggcatgtatatgaggctatggttcccacacgtcgatcaatggatttgggtgctgggtattgtatgttttatcggtgccctaaatctgtgccatgtaaaaatattcggtgaaatggagttctggctttcgatcgtcaaagttaccgccatcattgctatgattatcggcggcatcataattatgatctacggttttggtcaatcaactgaacatgctaccggtatttccaatttatgggagcatggcggcttcatgccaaatggtatcagtggggtggttgcctcattcgcaattgttatgttcgcttttggtggcatagaagtgatcggtattactgccagtgaagcgaaaaacccagaaaaaacgattcctaaagcaatcaatgccgttccattccgtattttgatcttctatgtcctgacgttgtgtattctaatgtgcatctatccatggaatcagattgatcagaatgcaagcccatttgtacagattttttccaatctgggaattaattcagcagcgaatattttaaatgtcgtcgtgattactgccgctatttcagccatcaacagcgatatttttggtgcaggaaggatgatgtacggcatggctcaggaaagacaggctcctgaagcattcaagaaactgacccgtaatggtgtaccgtggatgaccgtgcttgtcatgactatagttctattacttggcgtatggctgaatttcttgatccctaatgatatttttatccttatcgcgtctgttgcaacatttgcaaccgtctgggtatggctgatgattttaatttctcacgttgccatgcgccgtcaaatgagtgcaaaagacatcaagtcattgaaatttcccgttccaatgtggccaattgcgcctgcaattacgatcgttttcatggtcggtgtcatcatgttgctcggctattttgagcaaacaagggatgctctgtatgttgggataggttgggtgttagtcctcacactggcttattctttctgtgtgaagaagaaattatcaaaaaatcatctttctactaaccaataagactagaaaaagtg

SEQ ID NO: 45017 - DNA, 1926 bp, Xenorhabdus nematophilus
ctctactccatgaaggagactgccatgaatgataatatcgctcgtaaaatgcgacagacctacaatatcgcatactggggtggcggctattactatgtcaacgatctgggtaatgtcagtgtttgtccaaaccctgatttaccggaagctcaagttgaacttactgagctggtgaagaaagttcaggaagaaaaaaaacagctgcgcttgccctcattattttgtttccctcagattctgcaacatcgtctacgttctattaatgccgcgtttaaacgtgcacgtgaatcttatggttataagggcgattatttcctggtttatcccatcaaggttaatcaacagcgccgtgtgattgaatcgttggcaaatgcgggtgagcccatcgggctggaagcgggctccaaggctgaattgatggctgttctggctcatgctggcatgacacgtacggtcattgtctgtaatggctataaagatcgcgaatacattcgtctggcactgatcggtgaaaaactggggcacaaagtgtatctggttatcgaaaaaatgtctgaaattgcaatggtgctggaagaagctgaacgcctcagtgtgatccctcgtcttggtgtgcgggcgcgtttggcgtcgcaaggagcgggcaaatggcagtccagtggtggtgaaaaatccaagtttggtcttgcggcagcacaagtactgcaattggttgaaactctgcgctcagcaggaaagctgaatagtttgcagctgctgcatttccatctgggttctcaacttgccaatatccgtgatgtggcaaccggcgtacgtgaatctgcccgtttttatgtcgaactgcataaattgggtgtcaacatccaatgctttgatgttggtggtggattaggtgtcgattatgaaggcacccgctctcagtcagaatgttcagttaactacggcctgaatgaatacgcgaataacgtcatttggggaatcggtgatgcgtgtgaagagcatggtctgccgcacccaaccgtgattactgaatctggccgggcgttgactgctcatcatacggtcttgatctctaatgtcattggagtagagcataacgaatttactgaaacaacaccgccagcagaagatgcttcacgtcctctggcaagtttgtgggatacgtggcaggaaatgcaggatggcggctattctcgttccctgcgtgagtggctgcatgatagccagtttgatcttcaggatgtccatacccaatatgcacacgggatgttgaacctgtctgagcgggcttgggcagaagaactctatttaaatatttgtcgccatattcagcgggatcttgacccaagtaaccgtgcgcatcgtccgttcattgatgaattgcaggaacgtatggcggataaattctatgtgaatttttcgctgttccagtcgatgccggatgcgtgggggattgatcaggtgttccctgttctgccgattgaagggctggataagccactggatcgccgtgcagttctgttggatatcacttgtgattctgatggcattattgaccactatgtcgatggtgatggtatagcagcaacgatgccaatgccggcttatgatccagagaatcctcccttgatcggtttctttatggtcggggcgtatcaggaaattttgggtaatatgcataacctgtttggtgatacggctgccgttgatgtttacgtttcagaacacggcgaagtgacctacttgcagagcgaagagggtgattctgtagccaatatgctccaatatgtaaaactggagccgcaggtactgatgagccgcttctgtgatcaggtgaaagcggctgatctggatgaaaatttgcaggagcagttcctgcaagaattcgaaagtggactgtatggctacacctatttggaagatgaa

SEQ ID NO: 45018 - DNA, 1152 bp, Xenorhabdus nematophilus
atgactacacacctttttacttctgagtccgtttcagaaggacatccagacaaaattgccgatcaaatttccgatgctgttcttgatgcaatcttagaacaagatcctaaggctcgtgttgcctgcgaaacttatgttaaaactggcatggtcatggttggtggtgaaatcactaccagcgcttgggttgatattgaagaaattacccgccgtactgtccgtgaaatcggctataccagctcagacatgggttttgatgccaattcatgtgcagtgattagtgcaattggtaaacagtctcctgatatcaatcagggtgttgaccgtgcagatcctctggagcaaggtgcgggtgatcaggggctgatgtttggttatgcgaccaacgaaaccaatgtgttgatgccagcacctatcacgtatgcgcatctcctggttgagcgtcaagctcaagtccgcaaaaacggtatcctgccgtggctgcgtccggacgcaaaaagtcaggttacctttcagtatgacaacggcaaaattgtcggcattgatgccgtagtgctttctactcaacactctgaagatatccagcagaaagaactgcaagaagccgtgatggatgagatcatcaagcctgtactgccggctgagtggcttactccaatgaccaaatatttcatcaacccaacggggcgctttgtaataggtggtccaatgggtgactgtggtctgactggccgtaaaatcatcgtggatacttacggtggtatggcgcgtcacgggggcggagcattctccggtaaagatccctccaaggttgaccgttccgcagcttatgcggcacgctacgtcgccaaaaacatcgttgcggcgggtctggctgatcgctgtgaaattcaggtgtcttacgctatcggtgttgctgaacccacttctatcatggtagaaacgttcggtactgaaaaagtgccaacttccaccctgatccaattagtccgtgaattctttgatctgcgtccatatggtctgatcaaaatgttggatcttctgcacccaatctatcgcgatactgcggcatacggtcattttggtcgtgaacatttcccgtgggaagcaacagacaaggcagaaattctgcgttctgcggcaggattgaaa

SEQ ID NO: 45019 - DNA, 1245 bp, Xenorhabdus nematophilus
aaaaaacctttataccagatcctttatattcaagtcatatttgccatcttactgggtatagcgctgggtcatttttatccagatattggtgaatcactcaaacccttaggtgatgctttcatcaaaattgtaaaaatgattattgctcctgttatctttttgacggtcgtcacagggatagcaggtatgaataatatgaaagccgttggaagtgtcgtaggaaaatcgatgttgtatttcttgacgttttcaactcttgctttaattattggtttgattgctgccaatatcattcgccccggagatggcttaaatatctcacctgaatcgttagatagtagcaaagtcatcggttatgtggagaaggcacatgaatcatccatcgtcggctttctcatgaatattataccggaaacggttgttagcccacttgtaaatgggaatattctgcaagtactctttattgctgttattttcggtatcgctttagcgtcgacaggaaaaaagggcgaacctatattggtgtttttgcaaaacttctcagagcctgttttcaagatggtaggcatattgatgaagctggcaccgattggcgcatttggggcaatggcatttaccatcggtaaatatggcatttcatccattggaaatttaatgatgttaattgtcactttttacatgacatcattactctttatttttgttgtattgggggctgttgctaaatataacggtttctccatcattaaattaattaaatacattaaagatgaactgtggttggttttgggaacatcatcctctgaagcggctttacccagcctgatgagaaaaatggaaaatgcgggctgtgagaaatcggttgtcggattagttattccaacaggttattcatttaatcttgatggtactaatatttatatgacgatggcggcattatttatcgctcaagcaacaggcattgagttgagtttcacggagcaaatatctttattattagtcgcaatgatcagctcaaaaggtgccgctggagtaacgggtgcaggctttattacgctagccgctactttatcagttgttcccagtttacccgtagccggtatggctctcattttgggcattgatagatttatgtctgaatgccgcgcattgaccaatttagttggaaatgcttgtgccagcattgttgtcgctcgttgggaaaatgctttagataaggataaaatgcatcaagctttaaatggt

SEQ ID NO: 45020 - DNA, 1473 bp, Xenorhabdus nematophilus
aaactgcataatatcgcaaaagaaatgttacctgctaaatcgtataaaatgctgattaatggagaatgggtagatagcgtttcaagagaaacccgtaaaagttataaccccgcaactggtgagttactcacagaatatgctgctggcaatgctcaggatgttgaactggcagttaaagccgcccaaaaagccttacctgcatggagtaaagaatcagcaaccgaaaaacaatctctgctactgaaaatcgctgacttgctggaagctgaatcagaacgtttcattactcttgaagccttagacgccggtaagacactaaatctatgtcggacgtttgacattccttttgccgttgatcactttcgctacttcgctggcgtcattcgtgcccattccgatgaagccgatgtgattgatgccgataccctcagcctagtgatcagagaacccattggcgttgtagggcagattatcccgtggaactttccactgctgatggctgcatggaaactagctcctgccctcgccgccggtaataccatcgtgatcaaccctgccagcctgacttcaattagtctactcgaatttggccgtatcctgaatcaagttctgccagcgggcgttgtcaatatcgttacaggtcgcgggtctagtgttggtcaagcgatcctcgatcatgaaggcattgacaaggtagcctttacaggttcaacagaaatcggttacaacgttgccgcagcggcagccagacggatcatccctgccacattagaactcggcggtaaatctgccaacattattttccctgatgccaatatgaaaaaggctgtcaaatatgctgctgacggcattttgttaaatcaggggcaagcctgtgaatctggcgctcgcctgttcctgcataaagatattcatgacgagttcctgaaatcgctgaaagcggtatttgaatccgttcgggtgggcgatcccatgatgaccgaaaccgagatgggttgtcagatcagtcaggaacaaatggactttattctgggctatattgaccttgcgaagcaggaaggtgcaaccgtgctgaccggtggaaaccgcataacaggcgcgggatacgatgatggtttctttgttcagccaaccattattaccaatgtgaccaataaaatgcgggttgcacaagaagaaatctttgggccagtgctgtgtgtcattccatttagcagtgaagaagaagtcgtggaaatggccaatgattcggaatatggtttgggaggcgcggtctggacgcaggatatcaaccgtgctctgcgcgtggcaaaagcggttcagacaggccgcatgtgggtcaatacctatcatgccctccccgcccatgccccatttggcggttacaaaaaatccggtcttggcagagaaacccacaaaatgagtctggatgcttacactcaggtgaaaaacatctatatcagtacgaaagaa

SEQ ID NO: 45021 - DNA, 1338 bp, Xenorhabdus nematophilus
tcaaataaaagaggcttaattattctcgcgctggatattatcttgcttgtcgctctgcttaagtttttgccgtatggcgaaaaaaccaatgcgggtctggcattgatggcatttgttggtgtgctatggctgactgaagccatacacgtcacaattacggctctgtgtattccaattctggctgttggtatgggattgatgaacacgggtgatgcgctgcaatcttttgcaaacccgatcatctttctgttctttggtggttttgcactggcaacggcgctgcatattcaaggtctggatcggctgatcgccaaccgtcttctgatgattgcccgtgggcgtttatcggtggctgtattgctgatatttggtattaccgccgtgctttctatgtggatcagtaacactgcgactgctgcaatgatgctgccactgatactgggcattctggctaatctggatgtgcgcactgaacgcaatacgtttgtttttgtgttgctgggggtggcatacagcgccagtatcggtggtttgggaacgctggtgggaagcccaccgaatgccattgcagcggcgcaactgggcatggacttcttcacatggatgaagtatggcgtgccgatggtcatcattttgttgccagtcatggtggctgtgatgtacatcatgctgcgtccgaacctgaagcataaatttgatctgaaattggaacatctggagtggaacagtaagcgcattatcactatggctatcttcctgctgacggtgtttagttggattttcagttcaatcatcagtgatgcttttggcggtatcaaagatctggatacgattattgcagtgagcgcagccatcctgattggcatcactggcgtgtcaacttggtcacagattcaaaataacaccgaatggggcgtattgatgctgtttggtggcggcctgacgctgagtgctgtcctgaaaaactccggagccagcgaagttatggcgaatggcatggcggcaaccttcggtgccagtcactggtttgtgatcatccttgctgttactgcgttcattatcttcctgacggaatttaccagtaataccgccagtgccgcactgctggtgccgattttcgctacggttgcagaagccttggggatgcctgttatggcgctgaccatgattatcggtatcggtgcatcctgtgcatttatgctacctgtggcaacgcctcctaacgcaattgtttatggctctggctatatcaagcaaattgagatggtgagagtgggcatggtgctgaacgtggtatgtatcgccattatctctgtggttgcctggttcttctggttg

SEQ ID NO: 45022 - DNA, 1275 bp, Archaeoglobus fulgidus
atggcagttattgtaggagcggcaagaacccccgtgggtagatttggaggcagcttgaaggatgtagctgcatacgagcttggggctgttgcgattaagggaatgctgaaaaagctgggcgttgcaccaaagcccactcccgaatccattgagttctacccggagaagctggagaagggcagaattgatctggagtcggcctacgactacgatggggttgaggtggagattgacgaagtcattatgggaaacgttttgcaggcagctcagggacagaatccagcgaggcaggcgtcaattcttgcgggaataccaaaggagattcccgcttacactgtcaacaaggtttgcgggagcggcttgaaggccatcgccctcgcctaccacgccgtaaaggctggagacgctaaggcaatcatcgcaggagggatggagagcatgagcaacgccccctacgccctgccaaaggcgaggtggggatacaggatgagcgtcacagccaaggacgagattctggacctcatggtttacgacggcctctgggagaagttctacggctaccacatggggatgacagccgaaaacatagtggagaggtacggcataagcagagaggagcaggaccagcttgcatacgagagccacatgagggctgtaagggccattgacgagggcaagttcgctcaggagatagtcccggtggaggttaagcagaagaagggagcagttgtggtggacaccgacgagcatccaagaagggacacgagccttgagaagctcgcgaagctaccccctgtcttcaagaaggatggaactgtcactgcaggaaatgcgagtggggttaatgatggagccgctgccgttctggttatggacgagaaggcagcgaaggactacgggctggagccgaaagtcagaatacttgctgttgcttcagcgggcatcgaccctgcatacatgggccttgggcctataccagccataagaaaggttctgaagaaagctgggcctgaaatcaaggacatagggctgattgagctcaatgaagcctttgcagctcaggcgttagcctgcataaaggagcttggactggacatggaaaaggtcaacgtcaacggcagcggtatatccctcggccacccaattggctgcacaggggcgaggataacaacaacgctcatctacgagatggagaggagaggggtggactacggtctggcctctctctgcatcggcggtgggcagggaatggcgatggttgttgagagagtctga

SEQ ID NO: 45023 - DNA, 498 bp, Archaeoglobus fulgidus
gtgagtgaattgtcaaaactgaccttcgttcacgaccgcaggaaatgcattggctgctatgcctgcgtaatagcatgcaaggtcgagcacagctccgagaacttcgacgaccccggaagaatcagagttttccacgatggaccaaggattacgggtgagaaggtacagcagcacttcaaagtcgtcgtttgcaggcactgcctgagtgccccgtgcgtggatgagtgcccgactggtgcgctgaggaaaagcgaggatggaatgacggtcttggacctggatttgtgcataggctgcaaaatttgcatggaggtgtgcccattcggagcgccgcagctgggcgatgatggaaaagtcagaatctacgacctctgcatgccgcgcattgaggaaggtaaaaaacccgcctgcgtttcagcctgcgttgctcagtgtcttcaggtcaaatcggtggaggatttgaagaagaaatctaaaactcggaaacctgaaggatga

SEQ ID NO: 45024 - DNA, 2226 bp, Archaeoglobus fulgidus
gtggatggcgctgataatcgccctcatgttcatttattttggcttcggattttacggagccagaagaagaaagtaatcccttccatttttttgagaggtgctgaaatgtccgagcatgtcgtaaaaactacctgcaagagctgtcacggcggatgcagggtgctcgttaaggtaaagtcagggaaaatagtgcacatagagggtgatcccagctcgcttaccagaggaacgatgtgtccaaagggactggcgagcatcaaggaggtttacaacccttcgaggctcaaatatccgctgaagagagttggcgagagaggagagggagagtggaaaagaataagctggaaggaggctctggatacgatagcggaaaaaatgaaggaatacatcgaggagtacggcccctcctcaattttaatcggtcagggaacagggagaggctacaaccgctacacgttcagatttgcgaggtcgataggatcgccaaacgtcctcctgcctgcacatttctgctatgctccaaggctcgcagcctttggcattaccgtcggtggcaggctgtactgcgactaccacggatggggtggggagtaccccaaaaccatagtccactggggaaagcagcttgagtacaccaacgccgacggcgagatggcggtctggtttttgagggctctggaggaggcagagcacttcatcctcgttgacccgaaggcaactcccgttgcacacagagcggacctctggctgcccgtaaggccggggactgacgctgcgctcgcgttgggtatgctcaacgtcatcatcagcgaggagctctacgacaaagacttcgtggagcagtggactcacggcttcgacaggctgagggagagagttgaagagtacagccctgacaaggtgagcagaatcacgtgggtgcccgaggataagataaagctcgccgcggagtggttcgcaacatcaagaccgggctgcatacagataggtcaggctctggaagcgggaaacaactccattcaaactctcagagcaataatctgtctgatggcggtaaccggcaacatagagaggcctggcggaatggtgaactgggtgcctccagaaacaggggagatggaggagttcgccttagaggttccgccacctgaagagctgcccatcggcgctgacaggtacaaacttctcgcccttccgcccttcgcaatgtgccacttcgagagcgtttgtgaggacctgctcaatggggagagaagaataaaaatgatgcaccttcagggaacgaatcccgtgctggcctacgccaactcgaaagacgtgctcaaggcattgctcaacgtggagttcatctcggttgttgacctctacatgtcaccgacggcaaagtatgccgacatcgttctcccagcggcacactggctcgaaaccgacgatatttacgacatgcaccccagattcttcgtctcggcgatagtcagggcggttgaacctgttggggaagctctgcccgacaacgtgatattcaacgaactcggcaagaggcttgcaccgaagtactggttcagcgacgtttacgaaatgctgaactaccagctcaggaaggcggggattacatgggaggagttcaaggaaatcggcgtgctggcaagaaccggaaaggagcactactacaagtacaaaaccaactactggagggagggaggaggatttccaacaccgaccggcaaaatagagctttactcaaccatcctcgaaaacctcaactacgacccgcttccccactaccgggagccgaatgaaagcccctacagcacgccggagctgagcgagaagtatccgctgatactctccacaggcgggagggtgccgtactacttccactcccagtaccgccagaatccgtggttaagagagctgcagcccgacccagtagccctgatacatccagaaactgctgagaaatatggaataaaggacggagactggatatggattgagaccccgcgtggaaggataaggcagagggcgaggctttttgaggctatgaatcctcgctacgtgttcgctcaggcttcatggtactatccggaaaaacccgacctcggtattttcgagagcaacgccaacgttctgacgagcaacaaacctcccttcgacccctgcattggctccacgaccttcagggctatgctttgcaggatttacagatgcgacgggggtgagtga

SEQ ID NO: 45025 - DNA, 948 bp, Archaeoglobus fulgidus
gtgggcgtaaaggttgcctgcattggcgccggaacagttggcgcaagctgggcgtcactttttgcttggcgtggttgtgacgttgcggtttacgacccgtttcctgaggctctgaatagggcagaagcgagcatcgctcgcacagtttcaactctcagtgaaattttttctggtagtgaggatgacgtgaaaagcgccctgagcagagttaaattcactgaaaacctcgaagaggcactgaaaggggcatactacgttcaggagtcggcggtggaaaagctggaagttaagagagacctttttgaaaagatggatgcaattgcagaaccggaaacgattctcgccacgagcacatcaggtctgagcatatcagaaattcagaccgctgccagaaagcatcccgagaggtgcattaccgcccatccgtacaatccgccccacctcattccgcttgttgaggtcgttccgagaaagcagacggacgaaagctgcacagagaaaacagttgaattcatggagagaatgggcaagaagcccatcgtcgtaaagaaggacgttccgggaatggtggcgaacagacttgctgcagcactgtggagggaggcggtgaacctcgtttatcagggaatagccacacctgaggagatagatgtggcagttaaatacggtccgggaatcagatgggcgattactggggtttacctcacctaccatctcggtggtggtcagggcgggatgaagtacttcctcgaattcttcgatgaccactacaggcgactgtggtctgatctggcgaactggtcggagtatccggaaggctcatttgacgccatactcaaatcaatggaggggtacgatatcatcaaaagaatgtcatacgatgagcttgcgaagtggagagatgatcagctggcgaagattctcaaattgattttggaggatggttaa

SEQ ID NO: 45026 - DNA, 846 bp, Archaeoglobus fulgidus
atggtaaaggaggttttcgagtccatagaggattacgagaaatctctggaggagagaattcagagcggttcgatggggtacagaaagatgtttgacttgaccggaaaggtggccattgtcacaggtgccaccggtggacttggtgggccaatcgctctcggactggcggactttgggtgcgacgttgttgtggtgggaagaagactggaggtgctggaaaaactgaaggaaagcatagaaaagcttgggcaaagagcactggcagtaaagtgcgacatcacaagcgaggaggatgtagcaaatcttgtgaacaggacggtggaggagttcggcaggattgacatcctcgttaactgcgcggggataaacattccgaaacctgctgaggagtatccgctggaagactggaacaaggtcatggatgcaaacgtcacgggagtgttcctggtttgcagagaggtcggcaaggtgatggtcaagcagaatggagggaaaataatcaacgtgtcctctgtcagaagcagctacggtatgcccaaaaactacatcgcctactgctccagtaaggctgccgtcaacatgataacaaaacagctggcgtgtgaatgggcaaaatacaacatcctcgtgaacgcaatagccccgacagtaattgcgacaccgctcaccgcccacatcatgaaggatcctgaactatcaaagacgatgaaatcgcgcattcttctcggaaggtgggggtatccagacgaccttattggtgcagttgttttcttcgcctctgacgcgtcgaacttcgtgacagggcagatactctacatcgatggaggggttacttcgtgggcgtaa

SEQ ID NO: 45027 - DNA, 312 bp, Archaeoglobus fulgidus
gtggaattctgtccgaagtgtaagagtctgatgatatatcagggggacaagctcgtttgcaggaagtgcggctatgagaaggaggctgatgacagcgaggagcttgtaatcaaggtggagaggaacaaggaagatgttcccgttatagagggtgagaacctcaagactttgccaacaacaaaggccatctgtccggcatgcggccacaacgaagctttctggtggttaaggcagctcagggccgcagatgagagtgaagtcaggttcttccgctgcacaaagtgcgggaagacgtggagagagtacgattaa

SEQ ID NO: 45028 - DNA, 1257 bp, Archaeoglobus fulgidus
atgaagcttgataagtcgagaaagctctacgctgaagctttgaatctgatgcccggaggtgtaagcagccccgttagggctttcaagccgcatcccttttacaccgcaaggggaaagggctctaaaatttacgacgttgatggaaacgcttacatagactactgcatggcctatggcccgctggttcttggccatgcaaatgaggtggtaaagaacgccttggcggagcagcttgaaaggggctggctctatggaacccccatagagcttgaaattgagtatgcgaagctaattcagaagtacttcccctcaatggagatgctcaggtttgtgaacacgggcagcgaggcaacgatggctgccttaagggttgcgagaggctttacagggagggacaaaattgtcaaggtcgaggggagctttcacggtgcgcatgatgccgttcttgttaaggctggaagcggtgccacaacccacggcattcccaattctgcgggagtccccgctgacttcgtcaaaaacactctgcaggtgcccttcaacgacattgaggctctatccgaaattctggagaaaaatgaggtagcagcattaatccttgagcccgtgatgggcaactcgtccctgattctgcctgagaaagattatctgaaggaggtaagaaaagttacggccgagaacgacgtcctgctgattttcgatgaagttattactggcttcagggtatcgatgggcggagcgcaggagtattacggagttaagcccgacttaacaactcttggaaagattgctggaggtgggttgcccatagggatttttggcggaagaaaggagataatggagagggttgctccttcgggagacgtttatcaggccggaaccttcagcgggaaccctctgagcctcactgccggttacgcaactgtgaagttcatggaggagaacggagtgattgagaaagtcaactccctcaccgagaaactcgtttcgggcatagctgacgttctggaggataaaaaggctgaatgtgaggttgggagtttggcttcaatgttctgcatatacttcggcccaactccgagaaactacgccgaagccttgcagctcaacaaggagaggttcatggagttcttctggagaatgcttgagaatggagtttttctgccaccatctcagtacgagacctgctttgtaagcttcgcccacaccgaggaggatgttgaaaaaactgtggaggcggtgagcgaatcgttatga

SEQ ID NO: 45029 - DNA, 870 bp, Archaeoglobus fulgidus
atgaagctcattgtggggacaaggggcagcaagctcgctttagcccagacaaacaaggttgctgagaggctgaaggagaggtacgaggtagaaatcaggattgtgaagactgcaggggacataatgaaggacaagcccctctacgagttcaaggggatgggggcctttgtcagggctctggacacggctctggccgaggggaaggtggacgtggctgtccacagcttcaaggacgtgccgagccagagggtggaggggacagttgttgccgcggtgattgagagggattctccatgtgacgtgctcatttcaagggacggaagcactctggaggagcttgatgagggtgctgtggttggaacctcaagtcttagaaggagggcacagctttcgaggctgaggggggatctgaggttcgagaatctcaggggaaaccttgacacaaggctgaggaagctgagagagggcaattacgacgctatagtggttgcggaggctggtttgaagaggctggggcttgacagggaggttgagtatcagcccttcccgcctgaggtgattgtcccccctgccaatcagggaataattgcgatagccacgaggaagggtgaggaggatctggttgctttcctcaatgacgagaagacttggctggaggcgatggttgagagagctgtaataaaggagcttggtgttggctgcgctgttccggtaggtgtttacgctgaagctcaaagcagagtaaggctgatttgcgagattcttgacaaaaagtatttgagagttgaggagaagctttcgaaggatacagcagttgaggaggctgctgaaataggcaaagatctcaggaaggagatctatggtgggtaa

SEQ ID NO: 45030 - DNA, 924 bp, Archaeoglobus fulgidus
atgaagcatcttctttcgatggctgacctcgaaaaggatgagcttttcgagatactcaagcttgccgagaagctaaaggaggaaaggtacaagggcgttgttaccgattacctgaaaaacaaaagcctcgcaatgatcttcgaacttccttcaacgagaacaagagtatcttttgaggttgctatgaccgacttgggcggccacgcgctctacctcgggtgggacgaacttcagctcggcagaggggagccgataaaggacacagcgagagttctcagcagatacgttcatgcggtaatgatgagggttagggagcacagcaccatcgaggagtttgccagatactcaacagttccagttatcaacggtctgagcaaccttgagcatccgtgccaggttattgcggatttgctgacgatttacgagtacagaggggacttcaaggacgtcactctcgcatgggttggggatggaaacaacgtctgcaactccatgattctcgccgctgcgctaaccggaatgaagatggtcatctcaacacctgaaaactacgacccaaatcccgagattgttaagaaagccgaggaaatgggtgcaaagctgcggttcgtgagagacccgaaggaggctgttaaggaggcggatgtgatttacaccgacgtctggacgtcgatgggtcaggaggccgagaaggaggctaggctaaaggcgtttcagccgtatcaggtttcagatgagctgctcaagttctcaaaggatgatgtcgtcgttatgcactgcttaccagcacacagaggggaggagattacggatgaggtgatggaaggtaagcactccatcgtgtttgatcaggctgaaaacagattgcacgcccagaaggcaatactgcttaagctgctcgggaaggagagcgaggtttactga

SEQ ID NO: 45031 - DNA, 1077 bp, Archaeoglobus fulgidus
atgaaggccgctttggctttggaggatgggacgtatctcgaaggtaaggccttcggggcggagaggggtgggctgggcgagatagtcttctgcacctccatgacgggctacgttgaagctctaactgacccaagctacaaggggcagattctgatgatgacctacccgctcataggcaactacggagtgaacagggaagattttgagagcgatggggtcaaggttgagggatttgtggttaaggagctctgcaagaatccgagcaactggagaagcgagatgagcgttgatgagctgctgaagcagtacgacgttccggggatagagggagttgacacaagaatgcttaccagaaagataagaatttacggctccatgaaggctgcaattggcataggggacgttgacagggagaagcttgtcagaaaggcggttgagcagccctttataagcgacattgaccttgtggataaggtctgcgtgaaggaggcaaagaggtttgagtcagatggcgatttggaggttgtgcttgtagattgcggggttaagatgagcatagtcaggcagctgctgaagaggggcgtgaatctcacagttgtcccttacgattttcctgcagaaaagattaaggagatgaatccagacggagttttcatctccaacggtcctggggatccggcaagggttaagcccacaatcgagacgataaggaagctcgccgggcagattccgatggcgggcatatgccttggccatcaacttacagcccttgctcttggggcaaagaccttcaagctcaagtttggccaccacggcagtaaccagccagtaaaggattttgagacggggagagttttcatctccagccagaaccacaactttgccgttgacacaaaaaccctccccaaggagtttgaggtcacacaaatcaacctgaacgaccacacggttgaggggatggttcacaaggatttcccgctcataactgttcagtatcaccccgaagcggggccgggcccccatgacacctacttcttcttcgacaggtatgtggatatgctgagagaatacaggtga

SEQ ID NO: 45032 - DNA, 3231 bp, Archaeoglobus fulgidus
atgccgaagagagaggatataaggaaaatcatggtcatagggagcgggccgattgtcatagggcaggctgcggagtttgactactcaggaagtcaggcgtgcaaggctctgagagaagaaggctatgaagttgtgctggtcaactcaaatccagcaaccattatgactgatccagagatggcggacagagtttacatcgaaccgctggatgccgaaattgtggcgaaaatcatagagagggaaactcctgacgcccttctcccaactctcggagggcagaccgccctgaaccttgctgtgcagctcactgaaatgggagttctggacaaatatggggttgagctcattggagcgaagtttgaggcaataaagaaggctgaggatagggagcttttcaaggaggctatgagaaaaataggccttgacgtgccaaaaagcgatgttgcccatgatgtcagcgaggccttggccattgccgacgaaatcggctatccagtagttgtcaggccagctttcaccctcggagggacgggaggtggaatagcctacaacagggaggagcttagagagattgctgaaaggggaataaaaatgtctatgatcaatcaggtgctcattgaggagggagtgctgggctggaaggagttcgagcttgaggttatgagggacttggctgataatgtcgtcataatctgctccatcgagaacttcgaccccatgggagttcacacaggtgatagcatcaccgttgctccagcccaaacgctgactgatgttgagtaccagtatctgagggatgctgcaatcaaaatcatcagggagattggcgttgaaactggaggtagcaacatccagtttgcagtccatcctgaaaacggcagagttgttgccatagagatgaacccgagagttagcaggtcttcagccttagcctcaaaagcaactggcttcccgatagccaagatcgctgcaaagcttgccgtcggctacaccctcgatgagatacccaacgacataaccaaggagaccccggccagcttcgagccgaccattgactacgttgtggtcaaaatcccccgattcgccttcgacaagttccccactgctaaccaagtgctgggcagccagatgaagagcgttggagaggttatggctgtcggcagaacctttgaagaagctctgcagaaggcaataaggagcctcgaaataggcagatacggattggggtgcgatggaaaggacaaggaggtgacgatggaggagataagagagaggctgaggtatccaaatgcaagcagagtgttctacatccgctatgcactgcagaaggggatgagcgttaatgagatttacgagctaactaagattgacccgtggtttatagacaaaataaagaaccttgtcgagttcgaggagcagctgaagcagattgcggagaggatgagcattgaggaagttccgaaggagattctgaagaaggccaaggagctcggctattcagacaggcagcttgcagtgatcttcaacaccaccgaaagggaggtaaggagagtaaggaagggcaaagggctcagagttgtttacaagatggttgatacctgcgctgcggaattcgaggccaaaacgccctactactactccacctacgaagatgagaacgaggctttgaggagtgagagaaagaaggtcatgattctcggagctggcccgaacagaatagggcagggcattgagttcgactactgctgcgtccatgctgttttcagcctgaaggatgagggatacgagacgattatggtcaactgcaaccctgaaacagtctcgaccgactacgacacctccgacaggctctacttcgagccgataacccatgaagatgtcatgaacatctacgaaaacgagcagcctgagggagttatagtccagtttggcgggcaaacgccgctcaacatagcgagggagcttgaggatagcggggcgagaattctgggcacatcagttgactccatagacattgctgaagacagagagaggtttgctgagctgctggaaaggctgaacatcccgcagccagagaacggcatcgcccacagccttgaggaggccaaggagattgcgaggaagataggatttcctgtgcttgtaagaccgagctacgttcttggcgggagggcgatggagattgtttacgacgaggagacgcttgagagatacataactgaagccttggaagtcagccctgagaaacccattctgatcgacaagttccttgaggatgccattgaggttgaggttgatgccctctgcgatggggaagaggtggtgattgggggaataatggagcacatcgaggaggctggagtgcacagcggtgactctgcgtgtgttttaccaccagtttccttggatgaagtcaccattaacaccattgtcgactacacgaggaagctggccctcgccctcaacgttgtggggcttataaacatacagtatgctgttaaggacggtaaggtttacgtccttgaagcgaatccgagagcgagcagaacggttcccttcgtgagcaaggctactggaattccattggcaaaaattgccgcaaagcttatgatgggcaagaagctgagagagcttggagttaaggagaagctgaagctgaagcacgttgctgtgaaggaagctgtgttccccttcataaagcttcccggtgttgaccccgtcctcgggcctgagatgaagtcaacgggagaggttatgggcatagactacgacttcggccttgcctactacaaggctgagctggctgcgggaatgaagcttcccctgaaggggacagttttcatcagcgtaaggaggaaggacaagaacgacaggctgctttaccttgcaagaaagttcaaggagctgggattcaggattattgccactgacgggacgagggactttcttgtgcagaatggtatagaggcggatttaatcctcaagataagtcagggaaggcccaacattctcgatgccattgtgaacgggcaggttgacttaatcatcaacacgccctcgggcaagaggggaaggactgagggctacatgataaggagggctgcagtggattatggagttgcccacatcacaactcttgctggagcgatggcggcggtgagggctatagaagcagtgaagtcgagaaagatggttgttaagtccattcaggagtaccatgaggagagctga

SEQ ID NO: 45033 - DNA, 873 bp, Archaeoglobus fulgidus
atggaaaacgtggaactgctgatcgaggctcttccatatataaaggattttcactccaccacgatggttatcaagattggcggtcatgcgatggtcaacgacaggattcttgaggacaccatcaaggatatagtgcttctttacttcgtcggtataaagccggtggtggtgcacggcggtgggcccgagatttccgaaaaaatggagaaattcggactgaagcccaaatttgttgaaggactgagggtgactgataaagagacaatggaagttgtggagatggttctggacggaaaggtcaactctaagattgttacgacctttataagaaacggcggcaaggccgttggccttagcgggaaggacggtttgctgattgtggccagaaaaaaggaaatgaggatgaagaagggtgaagaggaggtaataatcgacctcggctttgttggggagaccgaatttgtaaatcccgaaattatcagaattctgcttgataacgggttcattccagtcgtgtcccccgtggcaaccgaccttgcgggaaacacctacaacctgaatgccgatgttgttgcgggagacattgctgcagctttgaaggcgaagaagctcatcatgctaaccgacgttccgggaatactcgagaatccggatgacaaatcaacgctgatttccagaatccggctgtcagagctcgagaacatgagaagcaagggagtcataaggggaggcatgatacccaaggtcgatgccgtcattaaggctctgaaaagcggagttgagagggcccacataatcgacggctcacgtccccattccatactgatagagcttttcactaaagagggaatcgggacgatggtggaaccgtga

SEQ ID NO: 45034 - DNA, 1059 bp, Archaeoglobus fulgidus
atggcaaagagggaaacggctgagttgagatacctgatagttcgtcctttgggctaccccctcaaggcgagctatcacgaatatccccaggtggataatccgaaggtctttgatgtttacgctaaagaccagtggaagggggagtttgtgcacaagaacaagctaattttcgatatgaggatgtttcccgactttgcctttgaggtaatcgactgcgacccgccatcggggtacatttcggactccacgataatcctcgtggaaagcgaccccagagttatcgagaccgaaattgtcagagacatcacgctggacgatgtggttgggcaggaagaggcaaagaggaaggcaaaggtcattcttgagtatctcaggaatccagaaaagttcggcaagtgggctccgaagaacgtgctcttctacggcccacccggcacaggtaagacgatgatggccaaagccctgtccaacgaggcaaaaacaccctttttgtcggtgaagtcaacgaagcttatcggagagcatgttggtgacggagcgagaagagttcacgagctctacgagagggcaaggcagcttgctccctgtatagtctttctggacgagttcgatgcaatagcccttgaccgaggctatcaggaaatcaggggcgatgtttcggaaattgtgaatgccctgctgacagagcttgacgggacgaacagcaacgaggggatatgcacgattgctgcaacaaacagagttgagctgcttgacgcatcgataaggagcagattcgaggaggagatagagttcaggctgcccagctatgaggagagacttgaaatcctaaggagaaaccttgaagaattcccagttcctgttaaggccaggcttgagcttgttgctgctgcatcggagggattcagcggcagagacctggttgagaaggtgataaaagcctctctgcacaaggcgattgcggagggaaaagataaaatagaaaccgaagatttgctcacggctgccgagaaggtcaagatgccctcaagacagccgcccaagcaaatgttcgtttag

SEQ ID NO: 45035 - DNA, 1761 bp, Archaeoglobus fulgidus
atgaagatggaggagatatatagggaatttatcgaattgacgaagttgccagacaatgagacgaaggaaaaggccatggaagagtttttcagaaagctgaacacgatgcagctgcctgagtacttcaactgggcggaagaaatctttgagggagttcacgtgaaggatagggggaatcagaaggccctgatatggtcgaacattgagacgggagaaaagaaggaatacacctacgagcagtttgctgctgaaggaaacaggattgttaacttcctgaggggacacggcgtggagaagggggacagcttctacatgatgattcccctcctgcccccaatatggttcgcaacctttgcaactgtcaagggagggttcataggagttcccaccgctacaacgatgacggtcagagaccttgaatacaggttcaaagtttacccgccggttgcaattatggccgacgaagcttcagccaaaacaattgatgaggctttaagcaacgttggtgcggagccaaaagtcaaaattgttatcggagacaggagcggatgggagagctacgattcccttagcaaggagtcgtcggaagctgaggctgcaaagacgaagtgggacgacataatcttcagcttcttcacctcgggaacgacgggattgccgaagagagttgcccacaccgctacatcctacccagtgggccacctcatgacagcatgcataatcaatgtgcaaccgggagatattcaccacaacctgagcgctccgggatgggcgaagtacgcgtggagctccttctttgcccctcttaacgtcggagccactgcgaccggtttctactacacgaggctgaacggtgacctttaccttcaggctgtgtccgagttcaaggtcaacaccttttgcgccccgccaacagcatggaggctgttcatgttcgcagacataggaaagtacgactactcggcattgagggatgtcgttagcgctggagaaccactcaaccccgaactctacgagcagtggaagaagtacaccgacacggaaatcagggacttctacggccagacggagagcaccgcaatgataggcaacccgccgtggttcaagggaggcaaaatcattcccggctctttcggcaggcccaccttcatgtacgacgttactctcgttgatgatgagggcaatgaaataacgaagcccaatgaggttggccacatcgtcgtcaggcttgatcgctggaggccgattgggctgttcaaggagtacatgggcgaccctgagaaaacggccaaagttttcgttggaaagtactactacacgggagataaggcgttcttcgacgagaaggggtactggtggtttgttggcagggctgatgatgtcataaaaacttctgattaccgtgtcggaccatttgaggttgagagcgcccttattgagcaccctgcagttgctgaggctgctgttgttggaagcccgcatcccataaggtatcagctcgtcaaggccttcgtcatacttgctccgggctacgagccatcaagggagcttgctcttgagctgttcatgcactgcaagaatattcttgcgaggtacaagatacccaggataatcgagtttgttcccgagctgcccaagaccatcagcggtaaaataaggagagttgagctgaggcagattgaggaggagaagaggaagaagggagagaagggggagcacgagtacttctacgacgacttccctgaactcaagtcttcctaa

SEQ ID NO: 45036 - DNA, 1179 bp, Archaeoglobus fulgidus
gtggcggttttgggagttggaatgacgaagttcgggaagcatcccgataaatctctcgtcgatttgtttgcagaggccttttatgaggcctttgaggagtccaacatcgagctgaaggacattcaggccttatactacggtaactttgttggtgagatgacggacggctcaggcaatctttcgggcttcatggcggacgagatagggctgaggggtataccagctataagatacgagggggcgtgcgcttcatccagcgttgctttcagggaagctgtgagggccgttgctgcaggctactacgacattgttgcggttggagggagcgagaggctctacaccgctggaacggaaataggaacgagggctttagcgactgcggtagatggcgtttacgagattaccgcagggctgacgttccccggagttttcgccctcgcagcgaggctttactccaagaagtatgagataccgcttgaggagctcagagagatgatggcgatggtctccgtaaagaaccacaggtatggggcgataaaccccaaggcgcagttctacgggaagcttggtgatttgaaggttgaggatgttctgaactcaaggatgataagctcgcccctaacgctgctggactgctgcccgatgaccgacggtggaagcgctgcaatcattgcagctgccgacttggcagaggagctcgttgacacgcccgtttacgtaaggggaacagggcaatcgtcagcgggagggcttttcaggcagaaggaggatatcatcagagcgataccgagaaggaaagcttcagagatggcctttaaggaggcaaatatgactcccaaggacatcgactttgtggaggttcatgactgcttcaccatcgccgaaattatcgccttagaggccatgggattcttcgagtacgggcagggatgctatgcggtgaaggagggtgtaacgagtattgatggtgacctgccagtcaatccagacggcgggctgattggcaaggggcatcctgtgggtgcgacgggagtttcgcaggtttactcggtggttaagcagctaaggggagagttcaaggagaatccggtgaaggatgcggagacgggaatgaccgacacgcttggcggggacttcggaacgctggtgaacataattttgagcgttcacaggaggtga

SEQ ID NO: 45037 - DNA, 1155 bp, Archaeoglobus fulgidus
gtgaagatgaacttcgagcttgatgaggaccacagaatgctccagaatgcagtgagggagtttgcagagaaggagataatgccctacggcaaggagtatgacgagaagagggagtatccgatggagattttcagaaaggctgcgaagcttggctatgtaggggcgagcgttcctgaggagtacggtggagcggggctggattacctcggagaggctatcatcagcgaagagcttacaagagctgacagcagcattgggactgcagttgatctggcaattctcggagttccaatggttctgagatatggaagtgaggagcagaaggagaaatacatcccacccgtcgttcagggtaaagctccttcggcaatagccatcacagagcccgactgcggtactgatgtcgctgccatgagaacaaaggccgttaaggagggagaggagtgggtgataaacggctccaagaccttcatcaccaatggaagcgttgctgggcacaccatcgtcctcgcaaagaccgctgaagtcgagcctccccacagagggatttcagcctttatcgttgagccagcatgggaggggtacgaggcgaggagaatagagaagatggggctgaactgccacgatacggctgagataacgctgaaaaatgtaagagttcccgctgaaaacctcctcggggaggagaacaggggattctaccagctgatggagttcttcaacgagagcagggttaagattgcagctctccacttgggaatggctgttggagcttacgagagagccttggagtacgcgaagcagagaaaggcgttcgggaaagctttgatagagcatcaggcgattcagttcaagctcgccgacatgtggaaggatatcgaagctgcaaggctgctggtttacaaggctgcgtggcttattgaccagggtaagcccgtacccgccataagctcagcagcgaagctcttcgccagcgaggctgctgtaaaggttacctatgaggctctgcaggtttttggcggctacggctacagcaaggagtacgacatcgagcgctactacagagatgcaagagtcgggacgatttacgagggaacgagcgaggcccagaggattgtgattgcgaggagtctgatggggagggttaagcggtaa

SEQ ID NO: 45038 - DNA, 2202 bp, Archaeoglobus fulgidus
atgagtgataaaaaaggtgaggaaataacccttagagttgctgaagctttctatcgcgatgttggaaggggtgttgccagaatcgatccagcagtgatggaaaagtacggactgcagagcggtgacataatagagattataggaaagagcaccgttccagcaatagtctggccgagctatccggaggataggggaaccggaataataaggattgatggcagcattagaagcaacgcaggcgttggtattgatgacaaagtcagaataaggaaggttacagcaaagccagcagagaaagttacactcgctccaacagagccggtaaggctgatgggtggcgaggcgtatctgctgaggctgcttgaaggcagaccggtcatcaaaggtcagaaaatcagggttgaggttttcggtcacactctgacgttcgtaataaccgccaccaggccctcaggagtcgtcgttgtcacgagaaacactgcgatcgagcttaaggagaagccggccgaggaggtaaagagggctgttcctgacgtaacttatgaggacataggcggtctgaagagggagcttaggctggtcagagagatgatagagcttccattgaagcatcccgagctcttccagaggctcggaatcgagccgcccaagggtgtgctgctctacggtccgccgggaactggaaaaacgctgattgccaaggctgtggcgaatgaggtggacgcgcacttcatacccatcagcgggccggaaatcatgagcaagtactatggagagagcgagcagaggctgagggagattttcgaggaggctaaggagaacgctccgtcgataatcttcatagacgaaatcgactcaattgctcctaagagagaagaggtcaccggagaagttgagagaagggtcgtcgcccagctgctggcgctgatggacgggcttgaggcaagaggagacgtcatagtcattgccgctacaaacaggcctgacgcgatcgatcctgcactgagaaggccgggaaggttcgacagggagattgagatcggagttccggacaaggagggcaggaaggagattctcgagattcacaccagaaagatgcccctcgccgaggatgttgaccttgaagagcttgccgagctgacaaacggatttgttggagcggatctggaagcactgtgcaaggaagcagcgatgcacgccttgaggagagttctgccggagatagacatcgaggccgaggaaattcccgcagaggtcattgagaatctcaaagtcacgagggaggacttcatggaggctctgaagaacatcgagccgtctgcgatgagagaggtgctggtggaggtgcccaacgtcaagtgggaggacatcggtggacttgagcatgctaagcaggagctgatggaggcagttgaatggccattgaagtatccggaggtgttcagggcagcaaacatcaagccgccgaggggaatactgctgttcggcccacccggaacgggtaagaccttgctggctaaggctgtggcaaacgagagcaatgcgaacttcatcagcgtgaaggggcctgagctgctgagcaagtgggttggtgagagcgagaagcacgtcagggagatgttcaggaaggcaaggcaggtagctccgtgtgtcatattcttcgacgagatcgacagccttgcccccagaagaggcggaattggcgattcacacgtcactgagagagttgtgagccagctcctgacggagctcgacggactggaggagctcaaagatgtggtggtcatagccgccaccaacaggccggacatgattgatccagcgctgctcagacccggaaggcttgaaaggcacatctacatacctccacccgacaagaaggcgagagtggagatattcaagatacacctcagaggaaaaccgcttgcggatgacgtgaacatcgaagagcttgcggagaagacggagggatacagcggagcggacatcgaggcagtgtgcagggaggcaggaatgctcgcaatcagggagctcatcaagccgggtatgacgagagaggaggctaaagaggcggcgaagaagctcaagattacgaagaagcactttgaggaagcgctgaaaaaggtcaggccgagcctaaccaaggaggacgttgagaagtatgagaagttgattgaagatttccacaggatgtacgcttaa

SEQ ID NO: 45039 - DNA, 981 bp, Archaeoglobus fulgidus
atggcggaggtagaaaaggtaagggaaaaggaagtagagaaggaagtagaaagaaaggaaatagaaagggaagaggacgttgaagtctgtcctgagtgtggaagtccccgcctcattcgcgattaccgcagaggagagttcatctgtcaggattgcggtctggtaatcgaggacacgtacatcgacgcagggcctgagtggagggcttttgacagtgagcagagagacaagaggagcagagttggtgcgcctgtaacctacacaatccacgataagggcctgtcaacaataatcgactggagcaacaaggactactacggcaaggcaatttccgtgagaaacagggctcagcttttcagactgaggaaatggcagagaagaatcagaatcagcaacgctacggagagaaacctcgcctttgccctcagcgagcttgacaggatggcctcagcccttggcctgccgaagagcgttagggagactgctgctgtaatctacaggaaggccgtagagaagaacctcataaggggcaggagcattgagggtgtggttgccgctgctctctacgcagcctgcaggcaggctggagtaccgagaacgctggacgaaatagccacatactcaagagtggacagaaaggagattggcagaacctacaggtttatcacgagggagcttgggctgaagctgatgcccacaagccctgcagactacattccgcgcttctgcgctgcccttggactgagcggagaggttcagaagaaggccattgaaatcatcaagaaggcggaggagagggagcttacaagcggaaggggtccgacaggagttgcagcggctgcactttacgttgcatcaatactgcttggagaaagaagaacgcagagggaagttgccgaggtagcgggagttacggaggtaacgataagaaaccgctacaaggagcttgccgagaagctgggtatagaaataatcctctaa

SEQ ID NO: 45040 - DNA, 912 bp, Archaeoglobus fulgidus
gtgagggcagtagagtgcagagacgtctggatggtttacaggactttcatggagaggggtattgtggcattgaggggaatcgacctcgacattgaggacggagttattttcggattgctcggtcccaacggggcaggaaaaacgaccctgatttccattctgtccacgatcctgattccgacaaagggcgaggtgaggattctcggaatggacgccttcaagaacaccaggaaggtgagggagagaattaacatctcaagcggagtcagaatgccgtgggggatgaaagtctacgagtgcctccgcttctacgcaatgtgctacggaattaccgatagaagagtagtcgatagggtaatctcggaattcgagcttgaggagcacagaaacaagaggttcgatgacctctcaaccggaaacaagcagaaggccaatctggcaagagcctttctgaacgatcctgaggttgtttttctcgacgagccaacggcaaatctggatccagatatggcaaaaaagatacgccagatgattttgaggataaaggaggagaaggacgtaaccattgttttaaccacccacaacatgagggaggccgagatgctttgcgacagaatagccttcatcaaggaaggaaaaattgttgccgaaggaacttctgaagagcttaagaaatacacgaaaatgagcgaaagggtgattttaaagctgaaaggtaatgccaaaaaactgcacatcccttatccttacaggatggatggaaacacgcttattgccttcgttgaagatgcggaaaaagcacttccctcaatcgtggtaaggctggcggagcagggtgtgtttgtcgaatcggcaaagatggaggagataactcttgaagacgtctttatcgagcttgcagaggggtcttag

SEQ ID NO: 45041 - DNA, 1518 bp, Archaeoglobus fulgidus
atggcctccattcttgcagttgatgttgggaccacctccattaaagccgggattgttagcaccgaaaattttgaggctgagagtactcaatcaacaagggctgttgtggagtatccgaaaaagcactgggctgagaaggatccggaaaagctgtggaacagtattgttgaagtttgcaagcctctggctgagaaagcaaatcccgacgccattgtgtttggcgcccacatggcgggggttgtgcctgttgatggagagggcaacgcgctgaggaacatcataacgtggctcgatgaaagggctgcgggactgcctgaggacgtgtggaagggtttgattaaaattcagggctactcattaaccaagctaatcaaatttctgcgtttgacggggggagcaccgtcgaggacgggtaaagacccgatttcaaagatagtctggatcagggagaatgagccggatgttttcggcaagaccttcaagatgctcgacgttagaggatatttggttgcgagagccaccggaaattttgttacgagtcccgacgaagcacacctaacatggcttgcagacacccgcggagggaaggcgaggtggtctgagagcatccttaaagattatgccttgtcagcctcgctcttccctgagataaagaactgcacagaaattgccggctatcttcgccctgaggtgaggaaggaatttggattagagggggatgtgccggtaatggttggctctggagacgttgcagctgcagccgttggctctggagcggtgaaggactacgagtgccacatttacgtcggaacgagtgactgggttgctgcccacattccacaaagaaaaactgacatcttccactttatagggagcctgctgagcgccattcctgagaagtacttgctgattgccgaacaggaagttgctgcaggcgctctggagtgggcgatgaggcttgtgggcattcaaggagaatacgagctggtgaaggagcttgtggagaaggctcctgcaggaaagctgatattcatgccgtggttctacggcgagagggctccaatcgacgacccctacgttaggggagggctggtaaacgtgggcctcgacagcgggagggaagaggttctgagggcgatgatggagggggttgcattgaacatcaagtgggtctttggctatgtggaaaagatgaccgctccgcagcagatggtgagcattgtcgggggaggggcgctttttgacatctggtgtcagattatatcgaatgccgttagaaggccgctgaggaggataaagcatcctgaggaaactgggttgagaggtttggctacaatggcggcggttgggctgggggaggagagctttgaaagtgcagcagcgaagttcgaggttgacagagttttcaagcccgacgatgaggaggcaaaggtttacgacaggcttttcgaatactacaaggagctttacagcaagctgaaaaaagtttacagaaagctgaactcagcggaatattag

SEQ ID NO: 45042 - DNA, 1119 bp, Archaeoglobus fulgidus
atgaaggacggattggaagatgtgattgcctgcaaaaccacgatttcgaggattgcccttgaaaacgggagggcaattcttgagtacaggggttacgacatccgtgaccttgcgagaaaggcaagctacgaggaggtggcttaccttctgctttacggagagctgccgaagaaatacgagcttcaggacttcaaaatagagcttgctgagaggagggagctaccacctcaaatcataggtctcctcactcatctgccgccatacacgcaccccatggtcgtgctcagaactgcaacaagctacctcggcagccttgacaagaagatagctgtaaggacgagggaggaaactttcaacaaggcaaaggacttgattgccaagtttcccacaatagtggcttactatcacagaatcaggacgggaaggaacataattccgccagctcttgaattcagccatgctgcaaactttctgtacatgcttcacggggaggaaccaaccaaaactgctgagagagcgctggacatggatttaattcttcacgcggagcacgagctaaatgcctcaacctttgcggcgaggattgcagcgtcaactcttgcagacatctacgcctgcgttgttgccgcaactggaacgctgatggggccgctgcatggaggagcggcgcaggaggtcatgaggatgcttagggaggttgcatctccaagaagggctgaggagtacgtgaaaagaaaaatagaggctggagagaggataatgggattcgggcacagggtttacagaggagttatggacccaagggcggagttgctgaggtatctggctaaaagacttgctgctgaaggctcaacgaagtggttcgaaatcagcgaggccatcgccaaggctgcttacaagtacaagaagctccttccaaacgttgacttctactccgcaagcgtttacgccaacctcggcattcccgacgacctcttcgtcaacatcttcgctatgggcaggatttcaggctggactgcccacatcatagagcagtacgagaacaacaggcttataaggccaagagcggagtatgtgggggagaaggagaagaagttcatccctctgtcgaaaaggtga

SEQ ID NO: 45043 - DNA, 1167 bp, Archaeoglobus fulgidus
gtgattgaaatcggaattgcggggaaaccaaacgccggaaagtcaacgttcttcaaagctgctacccttgctgatgcagagatagccaactaccccttcaccaccataaagcccaacgttggtattggacatgtgagggttaagtgcgtctgtcaggagctgggggtaaagtgcaatgagtgcgttgatggctggaggtttattcccgtcaagctgattgacgttgcagggcttgtgcccgacgcccacaaaggcagagggttgggcaacgagtttctcgacaacctcaggcagagcgaggcagtcatccacgtggttgacgcttccgggtcaacagacgaggaagggaacgagattggcgttggagagagaaatcccgtcgaggacgtgaagtttctctaccgcgagatagatatgtggcttttcggcatactcaagaggaactgggacaagattatcaggaggatgaaggcggagaagagggatgctgcaaagttcctgacggagcagcttgccgggcttggttttgaggagtggatggtcagagaggcgatgaggagttttggtgatgtatcaacgctcagcgacgaacagctgagagactttgccgttgaactaagaaaaaggaggatgcagatggttattgctgccaataaagctgacaaagctccaaagaacttgctcgaagagttgatgaagctcgatgagatcgttgtcccaacctctgcagcctacgagcttattttaaggactgcagcaaagaacggctacataaagtatctgcccggcgattcggactttgaaatagtaaaggagctgaatgaaaagcagatgaaagcccttgagaaaataagggagttccttagagagtttggcagtacgggcgtgcaggaggctataaacagagttgtcttcgacctcctagactacattgttgtttatcccgttgaggatgagaacaagttcaccgactccaagggaaacgtcctgcctgatgcgatgctggttaaaaggggcacgacggccaaggagcttgccttcaaaatccacacagacattggaaagcactttatctacgccctcgacgcaagaaccaagatgagggttgctgatgactacgagttgaagaacaacgatgtaataaagattgtttccggagctaagtga

SEQ ID NO: 45044 - DNA, 1947 bp, Archaeoglobus fulgidus
gtgaaagagttcatagaggggttgatcaggctaacagaggttgagagagatgctcagatttccgcaatgatggatgagataaggcggttgagcggagagaagagagaaaggaaggggagggctgttctggggctgagaggtaaggtggttggagaagagcttggcttcaagcttgtaaggtacgggaggaggaaagcaatagagaccgagatttctgttggagatgaagtgctaatcagcagaggtgacccgctgaaaagcgatttgagaggagttgtggtagagaaggggagcagataccttaccgtctctctcgaatccgttccggagtgggcgctgagggatgtaagaattgatttgtatgccagcgacctcaccttcaagaggtggattgaaaaccttgagaatctgacggaaaatggaaagagggcgctgaaatttgcccttggccttgaagagccctccaaaacagaatgtgaagacttcaagcctttcgactcttccttaaacagagcgcagctcaaagctgttggctgtgccgtctcaactgacgacttcttcctcattcacggcccctttggaacaggaaagacgagaacagttgttgaggtggtaaggcagctcgttaagaggggtgagagagttctcgttacagctgaaagcaacaccgccgttgacaacctcgttgagcttctctcagacatgaaaatcgtcaggctcggccacccttcgagggttgagaaaaggcttaaggagcacacccttgcctccctcgtcctcaaccaccccgattacaagaggattgaggaaattaaggggaagattgaggagattgaaagaagaatggaaaggctgaccaagccatccccccaattgaggcgtggtctgagcgatgaggagattttaaggcttgccagaagcaacagaggggcgagaggtgttgcagctaaaaaaataaggtcgatggcagagtggattgaggcgagaaaggctcttgaccagctttacacggagatgaaggaagaggaggagagaatcgttaaggagatcattgaggagagcgatgttgtgatttcgacaaactcctccgcctttttgctcgaagaaagctttgatactgcagtaattgacgaagcaagtcaggcaacgattccaagcgttctaataccaataaacagggcgaggaagttcatccttgctggagaccaccgacagctcccgccaacggtaatgaaggcagagaagctttcagagactctcttcgagaagctaattgagctctaccctgaaaaatcccagcttctaaacgttcagtacaggatgaatgagaaactgatggagtttccaagcagggagttctacggcggaaggatagtggcgcatgagagctgcacagcgatagccttaagccagatagcgaagagagaggctgagaagctgagagagatacttggagatgagcccctggtgttcatagacacctcaaaatgcaagaacaggtgggagggaaagcttgcggattcaacgtctaggtacaacaggcttgaggcagaaattgtgacagaaatcgttaccgagttgctgaaaatgggcttaaaaaaggagcagattggagttataaccccctacgatgaccaggttgacctgctgagggagaaggttgacgtggaggtcagcagcgttgacggatttcaagggagggagaaggaggttataatcatttcattcgtcagaagcaacaggaagagagagattggcttccttgatgacctgagaaggctgaacgtttcactgacgagggcgagaaggaagctgataatggttggcgattcggaaactctaagtgttaatggcacctatgcaaggctgatagatcacgtcaaaagaaagggtgtttacgttgagctggataaaaatgggaagcttggtggcaatccgaagggctga

SEQ ID NO: 45045 - DNA, 816 bp, Archaeoglobus fulgidus
atgaaaataattccgtgtccgtcttctccgctgctggcgaggagggttgctgaagccgcaggaattgagattggaggggcggttttcaaaaaatttcccgatggagagctttacgtgagggtgatggagaaagaaggggtggttgtgggaagcataaactccaatgaagacctcattgccctaatcttcgccttggatgttctggaaaatgccaaggctgtggttccatacatgggctacgcaaggcaggacaaggtgtttcaggaaggagaagctgtgagcattaaaattgtggctgagatgctggaaagcagggctgacgaagttgttactgtaaacatccacagcagcgatgcggcatcgcacttcagcaagctgaagaacctcgatgcaatgcccttggttggtgagtactttgcagggaaggatgttgttatgatttcccccgataaaggctcgatggagagagtaaagactgctgcaaagcatgcaggatgtgagtgggactacatggagaagcgcaggattgacgccacaactgtcgaaatcactcccaagacaatcgacgttgagggaagagacgttgtcattgtggacgacataatctccactggcggcacagttgctgaggctgcgagaattctttacggtcttggagctaaaagcgtcagtgcggcatgcgttcacgcagttctggctgagaatgctgcaataaagctcttcaatgccggaattaaggacatcatcgctaccgacactgttgagtgtgccttcagcaggataagcgttgctgagcttatagcggagaatatctga

SEQ ID NO: 45046 - DNA, 1638 bp, Archaeoglobus fulgidus
atggcaacgttacagggtcaacctgtgctgatattgagggaaggtacccagaggactgtgggcagagatgcccagagaatgaacataatggccgctcgcgttattgctgaggcagtgaggagcactcttggcccaaagggaatggacaaaatgctcgttgacagccttggagatgtggtcattacaaacgatggtgtgacaattctgaaggagattgatgttgaacacccggcagcgaagatgattatcgaggtggcaaagacccaggacaatgaggttggtgatggcaccacaactgcagtagttcttgccggagagctgctgaagagggctgaggagcttcttgatcaggagattcatcctgcaataatcgcaaacggttacaggtatgctgcagaaaaagctcttgaaattctgaatgagattgcaatcccaatcagcaaggatgatgatgagattttgaagaagattgccacaactgcaatgactggcaagggtgcagaggtggcaattgacaagcttgccgagattgcagtaaatgcggttaagatgattgcagaggagtcaaatggccaagttgaggtcaacacggactatatcaagattgagaagaggcagggaggaagcattgaggagactgagctggtagatggcatcgtccttgacaaagaggttgtccatccgggaatgccgaagagagttgagaacgccaagattctgctgctcgactcagctctggaggttaaggagactgagattgacgccaagatcagaatcaccgacccggagaagctccagaagttcatcgagcaggaggaggcaatgctgaaggaaatggttgacaagattgtcaacgccggagccaacgtggtcttctgccagaaaggtatcgatgaccttgcccagtactacctcgcaaaggctggcgtgcttgctgtgaggagagtgaagaagagcgacatggagaagctggccaaggcaaccggagcgaaggttctgacagacctgagagacatcagcagcgaggacctcggtgaggctgcactcgtcgaggagaggaaggttggcgacgagaagatggttttcgtcaccggctgcaagaaccccaaggcggtcacgattcttgtgaggggtggaacagagcacgtcgttgaggagattgcaagaggtattgaggatgcggtgagggcagttgcctgcgcagttgaggacggcaaggttgttgttggcgctggcgctccagaaatcgaggtaagcctgaagctaagggagtgggctccttcactcggcggcagggagcagctggcagttgaggccttcgcaacagccctcgaaatcatcccgaggactctggcagagaacgctggtctcgacccgattgacgttcttgtggagctcaaggcagcccacgagaagggacagaaatatgcaggagttgacgttgacaccggaaaagtcgtggacatgaaggagaggggcgtcttcgagcctctgagagtcaagacccaggccatcggctccgccactgaggttgcggtgatgattctgagaatcgacgacatcatcgctgccaagggacttgagaaggagaagggtggaggcggagagggtggaatgcccgaaatgcctgagttctaa

SEQ ID NO: 45047 - DNA, 2226 bp, Archaeoglobus fulgidus
gtggagtacgtaacgcatccgttgataaaggagaatacgattgaaaggagaatgtatcagatatcgatagcagctaccgccctgaccaaaaacacgctggttgtgattccaacgggattggggaaaaccacgattgccgcgcttgttatcgcctcaagattgctgaacgaagatggtaaggtgcttttcctcgcacctaccaagcctttggttgagcagcatgcgaggtttctgaagagggtgctcaaagttgaggaaatagtgtctctcagcggcgaagttcctccagaaaaaaggaaggagttgtgggaaaaggcaagaattgtggtttcaactccccaagttgttgaaaatgaccttctcgcaggcagaataagccttgaggatgttatactcgttgtttttgacgaggctcacagagctgttggaaactacgcgtacgttttcatcgccaaagagtacctcagaacggccaaaaagccgctaattctcgcaatgacagcctctccgggaagcgatccggagagaataatggaggtaatccagaacctcggcatagaagccattgaagttagaacggagtgggacagtgacgttgcaccttacgttggaaagaagaggattgaatggataaaggtggacattccggaggagatgaaggaagtaaaggagaggcttaaggagtgcataaaaatcagattcaagagattgagggaactctggatagaggtgcctgaaaactcgtcaaagagggaccttcttgcccttcaggaagcccttcaggcagaggctgcgagcagtcagagttcagagatttttgaggctctgtcgattctggccgagataatgaagctccagcatgccgttgagctcatagaaactcagggggtaaaggcggtaaaaagctacctcagaaagctcgtaagggaggcgacgtcgaagggggggagtaaagcggcaaagagtatcgttggcgatccaatctttaaaaaagctgttatagctctttcgaaatgcaaggtcgagcatccaaagctcgaaaagctgaaggaaatcctcaaagagcagtttgagaaaaatcccgattcgagggttatagtgttcacaaactacagagattctgcagagatgcttgtaaacgagctctcaccactcttccccgttgctaagttcgttggacaggcgagcagagacaacgacaagggaatgaggcaaaaggagcagatagaaaccattgacaagtttaggagaggggtgtacaaggttctcgtcgcaacgtcagtgggagaggaggggctcgacatcccatctaccgacttggtggttttctacgaagcggtgccgtcagaaatcagggcaattcagaggaaaggaaggacgggaagggggagagagggcagaatcgtcgttctggttacgaagggaactagggacgaggcctactactactccagcatgaagaaggaaagaaagatgtacgacaaaatacttgagataaagagaataatcgacagaaagcagaggagcattggggattacgttctgccagaggagactggaataaaggtcattgtggattcaagggagcttaggtcggaagtcgtgaagcacctgagggagattggagcgaagatcgaaataagaaatctcgaggtcgcggattacgttgtgagcgacagagtcgcggtggagaggaaaacggtggaggacttcctgaacagcattattcagaaggaaaggctcttttcacaggtcgcaaggttaaagtctgcgtacagcaggccggtaataatcatcgagggcgagaacttctacaggggaggtgtgcatcccaatgctgtgagaggggccattgcatcgctgattatcgacttcggaattccggtgttgaggagcagcaatgctagggaaacagcagagctgatcttcgcaatggcgaggagggagcaggaggaaaggaagaggggagttgtggagcacaccgcaaaaacaaaaagaacgcttaaagacgagcaggaatacatagtttcggcaatctcgaacgttggtaacgtaatagccagaaatcttctggattacttccagacgatagagaacattgcaacggcagacgaggaggagctggcgaaggtgccgaaggttgggaagaaaattgcaaagaggataaggcgtgttatgaccacaccctacagtgaggcgggtttttacgatagcgaaagcttttaa

SEQ ID NO: 45048 - DNA, 1251 bp, Archaeoglobus fulgidus
atggatgtgattgtcaggaaaggcgagattagagggaaggcgaaaccgcccgcctccaaaagctacacgcacagagcgttcatagctgcatccctctccccatcggcaagagttgtgaatccgctaatctccgaggacacgatttccacgctcaatgcatgtaagagaattggagcggctgtgctaaaaaaaggaaacgagtggcttttcagcggagttgatggtgttgaagctgaagggtacttcaacttcgcgaactcgggaacgaccttgagaattttcacaggtcttctctccctgtcgcccttcagaagcgttgttgatggcgacgagtctctgaggaagaggccaaacggggagcttgtgctcgcactctccaaactcggtgcaaggttcaagggtagggagccttacacaccacccttctcggttcagggggtgattaagggaggagaggtggagattgaagctccgagctcacagttcgtctcttccctcctctttgcgctgtcgctggctgagggcgattcttcgcttagggtggagaaggtgaaatcacagccatacatagacgtgactctcgacgttctcagggagagcggcgttaaggttgagagagaggggaatttttaccacatacccggctcacagagcttcaagctgcggagatatgacgtcccggcggacttctcttctgcaagctacctcatcgctgctggtttgattgcaggagaggtcgttctggagggcatgttcgagtccgctcagggcgacagaaaaattgtcgacatctgcagggaaatgggtggcagcgtggagtgggataaaaagagaggtgtcatcagagcggagaggtcggagctggagggcgttgaggttgacgcttctgacatccccgacctcgtgccaacaatcgccgttctggctgctgtggccaaaggaaaaacgagaatttacaacgccgagcacctgaggataaaggagatagacaggatagagggaatccatcagaacctgaaggccttgggtgttgagtcgaaacccctgaaggatggattaatcataaaagggggcaagggggagttcaggggagtggtggactcattcggagaccacagaatggcccttgccttctcactcctcggccttctcggggaggtgaaatgcaggaatgcggaggtcgtttctgtctcgtttccgggctacttcagagtgcttgagtccttgggagccagcgtaatcagactctga

SEQ ID NO: 45049 - DNA, 1032 bp, Archaeoglobus fulgidus
atgcgatacagtgtcggagtacttggggctaccggaatggtggggcagaagttcatccagatgcttgcagagcatccctggttcaagctgacgagccttgcagcgtcggaaagaagagtggggaagaagtatggtgaagaagtggactggatagtctccagagaggttccggacattgccaaggacatcgaaatggtgccaatggaccctaagcatgtggatgctgacatcgtcttctcagcgctgccctcagacatcgcaagagaggttgagccgaagtttgccgaggctggatttgtcgttgcgagcaatgcatcagcctacagaatggctgaagacgtcccccttgtcattcctgaggtgaatcccgagcatctcggcctgattgaagtgcaaaagaaaaacaggggctgggatggcttcatcgtgacgaatcccaactgcacgaccatcgttctcgtcctctcgctgaagccgctgatggacctcggcctcaggactgtgagggttgcttcaatgcaggccttgagcggtgcaggttatcctggcgtcccctccctcgccataaccgacaacgtgattcccttcataaagggtgaggaggacaaagtggaggaggagccgctcaagcttctcggcaagtttaacggccggaagattgagtttgcggacataaaagtctcagcctcctgccacagagtccccgtcattgatggtcacactgaagctgtctgggttgagtttgaccgggaggtgagcgttgaagaggccaaggcagccttcgagtcccttaagcccctcgacctgccaacttcgccagagaaggtcataattgtcagggaggagccggacaggccccagcccagactcgacagggatgctggaaacgggatgagcatcacggttggcaggataaggaaggatggtgagagggggctgaagtacatagtattgggccacaacaccgtcagaggagcagcgggagcaagcatccttaacgctgaactgatgataaaggagaagattatctaa

SEQ ID NO: 45050 - DNA, 1659 bp, Archaeoglobus fulgidus
atgaaaccttggttcaggcactggccccctcttttgacaaaaacacttgactacccaagggttcccctctttgagtttgtcgagacgtctgcgaggagatttggcgataaggctgcaataatctactatggcagggagataacgtacaatgagcttcttgacgctgttgagagatttgccacttttttaagcaatgccggggttgagaaaggggacagagtggcaatctacgcccagaactccccgcagttcgtaatcgcatttttcggaataatgagagccaatgctgctgtcgtgccagttaatccgatgcttgttgagagggagcttgagtacgttctgagcgactctggcagcaagcttgttgtagcaacttcagagcttgcaggcagggttctgcctgtggcaaagaagcttggaattcaggtggtttgcggaaacctctctgacttcatacccgagcagcccacactgccagttccagactttgccaagctaaaaattgacgttgaggggacaacaagctggagtgaggcaatgaaggagagaaatccgcctgaagttatggtaggaagcgatgaccttgccctgattccctacacagcgggcacaactgggttaccgaagggctgcatgcacacgcattttacagcaatagcaaacgttctgagctcagttcactggtttaacctcaccccctcagccatatcactggcaaccctgccgtttttccatgtcacaggaatggtgcattcaatgctcgctccggtctacataggtgccacaatggtcttgcttacgagatgggacagggagacagctttgcaggcgattgagaggtatcgctgcacccactgggtgaacataacgacgatggtaattgacctgctcagcgacccgaaaattgctgagagggatttgagctctctgcttgtagttggtggtgggggagcgccgatgcccaaagccgtggctgagaagctgtatcagcttacggggataaggtacatggagggttacggcttaaccgagaccatctcccagacgcacatgaaccctccccaaaatccaaagcttcagtgccttggcattcctgattttggtgttgatgccctcgtgattgacatcgagacgggaaagccgctcccaccaaacgaggaaggagagatagttgtttcagggcctgagattttcaagggatactggaacaagcctgaggagacggaaaaggcatttattgagatagatgggaagagatacttcagaacgggagacctcggctacatggatgaagacggctacttcttcattgttgacaggattaagaggatgattaaccgttctggcttcaaagtctggcctgcagaggttgaagcggttctctacaagcatcccgcagttaaggaggtctgtgttataggagttccggatgagagggttgttgaggaggttaaggccttcatcgtcgtcaatcctgagtacaggggcaaaatcacagaggaagagataatccagtgggcgaagcagcagatggccgcatacaagtatccgaggattgtagagtttgatgatgagcttccgaagagcggggctggtaagattttgtggaggttgctgcaggaaagggagaaggagaaattggagaagggaggtggttga

SEQ ID NO: 45051 - DNA, 876 bp, Archaeoglobus fulgidus
gtgatggatgtggcgattcttgttgatgaaaacacccgtgttattgtgcagggaataaccggatttcagggaagtttccaggcaaagagaatgctcgattacggaaccaaagttgtaggaggggtgacacccggaaagggcggtagtgaagtgcacggaatacccgtttacaatactgtggaggaggcagtagcagaaacaaatgcagacacatcgataatttacgttcccgcacgctttgcaaccgacgccatttttgaggccttcgacgcagggctgaggcttgttgtgtgcgttactgagggcatacctctctacgacgagatgctcattcacaggaagctcagggaagtgaaatccatgctccttggccctaactgccccggtgttataagtccggggaggtccaaggtaggtcttctgcccgacagaagctttacacagggcaatctcggtgtagtttcgagaagcggaactcttacctatcaaatctgcgagaatcttacaaaggcagggattggccagtccacagttgtggggattgggggcgacccgatgcctggattgacctttgttgacgttctcaaaatgtttgaggaggacgaagagaccaaagctgttctgctggttggtgaaataggtggaacagccgaggaaaaggctgcggagttcataaagcaaatgtcaaagcctgtcgtggcattcattgccggaaggacggcaccaccggggaagagaatggggcatgccggcgcaataatcgaggggagtacggggactgcagaggcgaaaatggctgcactacgcgatgcaggggcgagggttgcggaaactttgctggatgtggtgaaggaggtcagaagagtgctggagtga

SEQ ID NO: 45052 - DNA, 1152 bp, Archaeoglobus fulgidus
atgatgcgccttcacgagcatcaggcaaagcagatatttgcaaagcacggaattagggttccgcggggcgaggttgctacatcacctgaagaggcggagaaaattgcggaaaaacttggaggcagggttgtggttaaggcccagattttggttggtggaaggggcaaggcggggggtgttaagaaggcaaacagcccggaagaggcaaaggaagtggcaaagaagattctcggcatgaccatcaaagggcacagggttgagaaagtgcttgtggaggagcagctcaatatgagaaaggagtactacgtgggctacgtcgttgacaagtcgagcaggctccccacagtgattttcagtcggatgggaggtatggatgtggaggaaatagctgcgaagcaccccgatgcaatacacaggatttacttcgaccccctttgggggctgaaggattacgaggttcgcaaggctctgttcagagccggctttgaaggagaggagttcaagcagatgtttgacataatcaaaaaacttgtcgatatcgcatttgcctacgaagctgagctgacggagataaacccccttgcggtgacggatgagggatttttggctgccgacgcccgattgaacaccgatgacaacgccctctaccgccatccggagcttgcagaactgagggaggcaacggaggaggacccgcttgagagggaggcgaggctgaaaggaatcaactacgtccaccttggcgggaatgtgggggtaattgcaaacggtgcgggccttgcaatggccacaatggacataatcaacctgatgggaggaaagccggcgaacttccttgataccggaggaggcctggctgacccggttaaaatgaaaaattgcctccttcacgttctcaaggacccgaatgtgagggttgttttcataaacatctacgcagagataacgaggtgtgaaaaggttgctgaaggaatcattctggcactggacgaagctccgagaaaggttccgcttgtcgtaaagcttgcgggcacaaatgaggaaatcgggagggaaatgcttgagaggtacagttcggagaagggggcggaaatccacttcgtggagtctattgaagagggagccagaaaggctgttgagcttgcggggtga

SEQ ID NO: 45053 - DNA, 879 bp, Archaeoglobus fulgidus
gtgattgatacctgggaagaatacaggatttttgaggacagcttgaagaagtttgtggaatcggtagaggctactccaaaaataaagaagggtcttgcctacgctataaccgcaggcgggaaaagaagcaggcctgttatagtccttctctccgccaagctgtgtggcggcgattatgctgatgtaatgaaccttgcgctctcagttgagctaattcacaccgcaagcttggttcatgacgatgttatcgataaggctgaaaagcgaagaaagagggaagccttgcacaaaaagtacgacatctctctggcaatagtcctcggggactggctgatttccaagtcggtggagctgacttcaaaatacggggaggagattatcagggacttctcgaacgttggaatgatgatgtctgagggcgaggttcttgacatctacagcatcaaggaaaattttaccgaaaaggactactttgagtgcatagaaaagaagaccgctgctttgtttgcctactccgcaaagagcgcttgtaaaatcgtttgcgaagaccgcattgccgcggataaactcttcgactacggcctgaatctcggaattgcttaccaaatcgtggatgacctgctcgagtatctcagacttctggatgacaagcactcggtgtttgaatcgagaacgcttccgcagatttacgaggaaaagtacgggaaggaggagggtgttaacaaggtcatggagaagataagtaccttcgttgagaggagcttaagctctctggaatattttgatgaaagtccggagaaggagaagcttagaaaaatcgtcgatttcatgacctacgatatgataagaaataaagccgaaaagaaggctattttctga

SEQ ID NO: 45054 - DNA, 3471 bp, Archaeoglobus fulgidus
atgcacatcgagaaaatacggctgaaaaactttaaatccttcggcaaaaaagctgaaattccttttttcaagggatttaccgttatcaccgggcccaatggtagtggtaagtcaaacatcatcgactccattcttttctgccttggcctatccacctcaacaaagcagctgagagccgagaggctaacagacctcgtccacaacggaaggagcgaggcggaggttgcaatcctcttctccgagaatggaaagaagtacgagatagcgaggaaggtgaaaattacggagaagggctactacagctactactacctcaacggcaagagtgttagcctctcggaaattcacagctttttatcacagttcgggatatacagcgacgcttacaacgtggtgatgcagggagacgtgacgagaataatcgaaatgtccccattccagaggagaaagataatagacgacgttgccggtatctcagaattcgacgaaaagaaggagaaagcgctggaagagcttgagagagttagggagagcatagagaagcttgaagctgttattgccgaagtcaacgacagacttcaaactctggaaagggacaggaatgaggctataagatacaaggagattctgagcaaaaaggaagagtacgaaggctatttgagggctcacaactacctgacagccgtcaaaagcaaagaaaaagtcgaaagagagcttgaaaggcttgaaaggcaaaaggatgagctgacaagcaagataccggaaatcaacgcgaggattgctgagctcaatgagaaaatcaacgagcttgccgctaaaatctcagagcttggagacgagaggtctgccgaaattcaatcgagaattctcgaactaagctcggagcttgaatctctcaggagagcggaaagattctaccttgatgaggccaaaaggcttgaggaggagtctgtaaagataatttcggaaatatccaaaataaaggaagaaatggagagcttggatggagagctggaggaatacgcgataaaaaggattcaggtcggagagatcgttgatgagcttgccgctaaaatggagctgctgaggcaaaggctggaggaggttgacaaaaagcacagagagctgagagacaggcttgtaagcagaaaagaggagctcgaaatgtacaaggagaggagaggtgagattttaagggaaagggacaagctcatcgagctgctcagaaggatagacatggacgttgaggacatcaaaaacgagattgcatctattgagtccaagctaaaggagtttgagaccgagaagaaggccaaacaggaggaggtctggaagcaagaagaggagctgatgagcgccaaaaagatgctctcttcagctgacaaaaagctttttgacataagggccaagatttccgatgtcgaggatgagttgaaaaaggccgagcttgagcttgcaaaggtgaaggcgacgctctccacgctgagaacgtactcaaagccggttgaaattctcctcgatgcgagaaacagaagagagctccccggaatctttgggacggttgcacagcttggcgaagtggatgaggagtacgtagctgcaattgaggccgctgctggaaatgctctgcagttcgtcgttgttgagactgaagatgatgccgtttcagctataaacttcctaaaggcggtaagaggggggagggctaccttcatacctctcagaaggataaagagcttcaagctgagccttgacaagtcgattctgaaggaggacggagttatagacttcgccgttaatctcgtaaggtgcgataagaagttccagcctgtcttcaggtttattttgagggacacggttgttgttgacaggattgagactgcaaaaaggctgatggacaggggcttcaggttcgtgactctggacggggatattgttgagaagtccggtcttatgaccggtggaagcgctgaaaagaggggcattctcgtttcaagagagctcttggagaaggaaagaatgctttccgataaaatttacgagcttcagcgggagaaggagggcctttttgcggagcttaacagggctgaaagcctgaggaagcagtacaaggacgaggtggacaggcttacgggaatgatcagcgagctgagaaacagaataagtctgctcgacgagaaaataagaacggagagtggaagaattgaggagctgagggagaagatttcgcagaaaagcagagagaaggagaattacataagctccctgaaggattacaactcaaagctggcggagatggaggaagcgattggagaacttgaggcggaaattgaggaaattgagaggatgctcaggggcagcgaggtgccgaaaatcgtggaagagcttgataaaattaaggaggagcaccagagaaacagggaaattctcatttccatcgaaaagaagattgagagccttgaattcaagagagagcagcttgaaagcagcatgcaggaaaagcaggtgtatctggatgagataaaggacaggatagacgaaattcggaggacgattgaagaggggaaggccagagtggaggagattaactccgagctcgaagagctcaggaaagaggagagggagcttggaaaggagcttaaaggcctgagaaaggagagagatgagttaataaagcagttgagaaatgctgaggaagagaagaggaaaatcgaggctgagatagacaggcttgaggagaggataaagctccagaaggagaggcttgagattgcggaatctgagattgcagaaattggcgaggtcgaggttcccgaaaacctcccaccgcttgaaaaagttgagaaggttcttgatgaggtgttggtagaactttcaacatttggcgatgttaacttaaaggctattcaggagtacgaggaggtaaaggcgaggagagatgagcttgttgagaaaaagatggttctggagaaggagagagctgatattctggacagaattgagaaatacgagagaatgaagagggaaatattttttgaggtcttcaccgcaataaacaggaactttgcagaaattataagggagttggccaacggggagggagaactttacctcgacagcgatgatcctttcaacagcgggctttacatcaaagttaagcccaacaacaagcccgtgcaaaaacttgagtccatgagcggtggggagaagagccttgttgcccttgctttaatctttgccatccagatgtacaagccagcccccttctatgccttcgacgaggttgacatgttccttgacggtgtgaacgtcggaagagtggcgaagatgataaagaagaggtcgaaggatgctcagttcattgtggtctcgctcagaaagccgatgcttgagcaggccgatgcgattgttggaataacactggggagggataacgtatcgcaggtgactggaatcaagctgaaaacctga

SEQ ID NO: 45055 - DNA, 600 bp, Archaeoglobus fulgidus
atgatggttaaggtttgcggtgttaaaagcctgaaggagcttgatgctgtggagaggtatgcagatttcaccggggttgttgttaaaagcgattcaaagaggtgcgtggagcttgatgtggctaaagagcttatcgggagctcatccattccggtttttgcggtgtcaactgcaagcagctacgcggaatgggaggaaattctcgcaaagacggaatgcagcttcgcccaggttcactccgaaatgccgctggaggattttgagaggctgaaggcggaggttaaggtcatgaaggcctttattgttgaaggcccggctgaaaagatcgctgccaagattgaactctactcccctcacctcattctcctcgattcggggtgcgggagcggaaaaactcacgactggaatgttagcaaggctctggcggagagatacggcgtttttctggccggagggcttaatttggacaacgtgagggaggcgataaggttcgtgaggcccatgggcgttgacgtctcgtccggagtggagagagacgggcttaaggatgagatgctggttagagaatttgtcaggagggcgaaaaatgaagttcggtga

SEQ ID NO: 45056 - DNA, 1038 bp, Archaeoglobus fulgidus
gtggttggctacgctgtcgaacttgagggcatttcaaagagctacgacagcactacggtgctcgaagacataaatctcaggattcagcagggtgagttcttctccctgcttggcccaagtggttccgggaaaaccacaatcatacggataattgcgggacttacctttcccgatcagggttttgtgaggattaacggggaggattgcacctctttaccgccctacaggcgcaacgtcggtatggtgtttcagaatctcgccctcttcccccatcttaacgtttttgaaaacgtcgcctacgggttgaggctgagaaagattcccgaaggtgagataaaggatagggtttaccgctacctcgaactcgtcaacctcgaccctgagatttacgcaaaaaggaaggtagagcagctatctggagggcagcagcagagggttgcaattgcgagggctctggttaccgagccttccatcctgctcctcgacgagccgctcggcgctctggatttaaagataaggcagcacatgatttccgaacttaaaagaatccagaagacgctgggaacgaccttcatttacgtcacccacgaccagagcgaggctttgctgctttccgacaggttggccgtcctcaatgaaggcagaatccaccagattgggacgccaagggaaatctacgagaggccaaaaacgaggttcgtcgcctcattcataggcgaaaccaactttctggaggcaagggtcgtgaacggagaggtcatcaccgaaatcggaaaggtgagggttttcggccttgatggggcgagggagttctgcatatccatccgccctgaaaagcttaaaatcaaccagcaggctgagaacacctttgaggctgtcgttgaggaaattggctacctcggaagctttttgatgctgaagctgagggctggcgatgttgtagtgaaggccttcgccccgccgcaggaaaatgttagggaaggggaaagggtgattgttggttgggatagtagggatgcggtaatcttggaggcatga

SEQ ID NO: 45057 - DNA, 1173 bp, Archaeoglobus fulgidus
atgaggaagacaggaggcttgcctttgtcccgtagacttgcgagaagggttgaggagctgaagccgtcgggaataaggagatttttcgacttagtggtgggaagggatgatgtgataagtctcggcgttggagagccagacttccccgtgccgtggaggataagggaggagatgatttactcgctggaaaagggatacacatcctacacatccaacctcggcctgccggagctgagggaggggattgcggagtattatacgaggttcggcgtcaaggctctgcccgagcaggtcatggttacctcaggcgttagcgagggcgttgacattgcaatcagagctctgatagagccgggcgatgctgctctcatccctgagccgtgctacgtgagctacaaaccactcgttgagatatgcggcggtgaagccgtgacgattcccaccgctccggagttcaggctcacctacgagatgctgatgcagtacagggatgcgaaggccaaaattctcgttttgaactaccccgcaaatcccacgggtgtgagctactcgaagaaggagcttgaggagattgctgacgctgtaaacgagctcgacctcatcgttctgtccgatgagatttacgctgagctcacctacacgggaaggcatgtttccatggccgcgctgaacggaatggaggacagagttgttattttcaacggcttctccaaagcgttcgcaatgaccggaatgagggtcggctacgtgattgccccacctgacatctttgcggggatgctgaaaattcaccagtactgcatgctctgcgctccaataacgggacagataggggcgattgaggctctgaggagccttgacgaagtggagaggatgagggcagagtacatgagaagaaggaattttgtggtcaaaagattgagcgagatttttgagataaagaagcctgaaggagcattttacgcttttccgaagatttcctcaaccggaatgtccagcgaggagtttgcagagaagctgctgctcgagaaaagcgttgcggttgtgccgggaaatgccttcggcgagtgcggggagggctacgtaagattggcttacgctgtgaagttcgagaagctgaaggaagcaatggacagaataaaggagtttgttgaggagcatggtgagggttaa

SEQ ID NO: 45058 - DNA, 2259 bp, Archaeoglobus fulgidus
atgaagctcaatcgtactgctgaaactgtgctcagaaagaggtatcttctcaaggatgatgaaggtaacgtaattgagactccagaagagatgtgctggagggttgccagggcaattgcaaaggctgaggagaattacggaaacaatgctgaagagtgggctgaaaagttcttcaagctcctctgggagcagaagttcatgcccaactccccaacgctgatgaatgcggggacggagctgaatcagctttctgcatgcttcgtcatccccgttgaggactccattgacggcattttcaaggccctctgggatatggcgaaggttcaaaagagcgggggagggacgggattcagcttttcaaggctgagaccgaagggagatatagtaaaatccacaatgggcgttgcaagcggaccggtaagcttcatgaaaatatttgatgctgcgacggagcagataaagcagggagggaggagaagaggggcaaacatgggcgttctgaacgtccaccacccggacattgaggaattcataaaggcgaaatgggaggagggggtgctgagaaacttcaacatcagcgttgccgcaaccgacgccttcatggaagctttgaagaaagatgatgattacgacctcatcaaccccagaacgggggaggttgtaaggagagttcccgccagaaagatattcaatttgattgtggagggagcatggcgcaacggagagccgggaatgattttcatcgacaccataaaccgcttcaaccccactccgcacgtgggacagattgaagcaacaaacccctgcggagagcaaccgctcctgccctacgaatcctgcaaccttggcagcataaacctcgcaaagttcgttaaagatggggaaatcgactgggatgggctcagggaggttgtctggattgccgtgaggtttttggatgacgttatcgatgtcaacagctaccccattcccgaaatcgagcagatgaccaaagccaaccgcaaaataggtctcggagttatgggctgggctgacatgctctttctgctcaacatcccctacgacagcgatgaagccatccagcttgctgagaaggtgatgaagttcattcaggaggaaagtcacagggcttcgcagcagctggcggaggagaggggtgttttccccaactggaagggcagcgtgtgggagaagaagggaataaagatgaggaacgcaacgacaacaacaatcgcaccaacgggaacgataagcattatcgctggctgttcaagcggaatagagccgattttcgctttagcatacaagagaacgaacattcttgacggagaagagttcttcgagataaatgagatattcgaggaagttttaaggagaagagggctgtacacagatgagctgattgagaaagttgccgaaaaaggcagcattcaggaaatagaggagattcccgaggacataaggagggtcttcaagtgcgctctcgacatctctccagagtggcatgtgagaatgcaggcggccttccagaagtacacggacaatgcggtcagcaaaaccataaatatgccgaactctgctacgcggaaagacgttgagaaggctttcctgctggcatacgagcttggatgtaagggcataaccgtttacagagatggcagcagagaggagcaggttctcagaataaagaaggctgaggaggagaagaaggaggcgaagccgagaccccctgccaagtacatcgagccgaggccgaggccgaggataaccaccggcagaacgattgagaccagaacaggctgcggttccctgtatgtgaccatcaacgaggacgagtacgggattgccgaagtcttcgtgcagcttggaaaaagcggaggctgcgctgcgtcgcagacagaggcaatggggaggctgctttcagtcgcgcttaggagttggattgaccctgaggtgctgataaggcagctcaagaacatacgctgtccctcgccaggattcgacaacggagaggtcataacatcctgcgcggatggagtggcaaaggttctcgaaaagcacctaaagggagagtacaagaaaataaagttcgaagttgagggaatcaagcccctcacggccttcaccggcgaggctgaggagagagaggagccgaggacgaagcagattggcggagtgtgtcctgaatgcgggaatgttcttgagtacggggagggttgcgcaacctgcaggttctgcgggtttacgaggtgcggttga

SEQ ID NO: 45059 - DNA, 1380 bp, Archaeoglobus fulgidus
gtggaagagatgcctttaattaaaacaccgccaccgcacggcggaaaacttgttgagagagttgttaaaaagagagacattgctgaaaaaatgattgctggatgcccaacttatgaactgaagcccacaacgctgcccgatggtacaccaattcgccacgtttacagagagataatgtccgtctgttacggctttttcagccccgttgagggatcgatggtgcagaacgagcttgagagagttcttaacgagaggagattgctgagcgaatggattttcccctatccgattctcttcgacatcagcgaggaggactacaaggctctcgacgtcaaagagggagacaggctcttgctcatgcttaaaggtcagccctttgcaactctcgacatcgaggaagtttacaagattgaccccgtagatgttgcaacccgcacctttggcactccggaaaagaaccctgaagttgtgagagagccatttgacgacaagcatccgggatacgtgatttacaagatgcacaatccaatcattcttgcaggaaagtacacgattgtgaacgagcccaagttcaaggagccctacgacaggttctggttcccaccgtcaaaatgcagagaagtaattaagaacgagaagaagtggagaacggtcattgcccaccagacgagaaacgtcccccacgtggggcatgagatgctgatgaagtgtgctgcttacaccggcgacatcgagccgtgccacggaattctcgtaaacgccatcattggagcaaagaggagaggtgactatccggatgaggcaatccttgaggggcatgaggctgtaaacaagtacggctacatcaagcctgagaggcacatggtcaccttcacgctctgggacatgaggtacggcaacccgattgagtcgctgctgcacggagttatcaggcagaatatgggatgtacgcaccacatgttcggcagagaccacgctgcggttggagagtactacgacatgtacgcgacgcagatactctggagccagggcattccgagcttcggcttcgaagctccgcccaatgaggtggactacggcctgaagattatcccacagaacatggctgagttctggtactgcccaatctgccaggaaatcgcctacagcgaaaactgtggccacaccgatgcgaagcagaagttcagcggaagcttcctgagaggaatggttgccgagggagtcttcccgccgagagttgtcatgaggcctgaggtttacaagcaaatcgtaaagtggtggaaagtgtacaactaccccttcgtcaacagaaagtacctcgaactcaagaacaaggagcttgagatcgacctcccggcgatggaggttcccaaggcgtga

SEQ ID NO: 45060 - DNA, 1932 bp, Archaeoglobus fulgidus
atggtatattatccgaaaaagtatgagttgtataaggcagatgaagtgccgacagaggttgtggagacggacatcttgattatcggaggaggtttctccggctgtggtgcagcgtacgaggctgcctactgggcaaagcttggcggtttgaaggttacgcttgttgagaaagcagcagttgagagaagcggagctgttgcccagggtctttcagccattaacacatacatcgaccttaccggcaggtccgagaggcagaacacccttgaggattacgtcagatacgtcaccctcgacatgatgggattggcgagagaggaccttgttgctgactacgcaaggcatgttgacggaacggtccacctcttcgagaagtggggactgcccatctggaagactcccgatgggaagtacgtcagagagggacagtggcagataatgattcacggtgagagctacaagccaatcatcgcagaagctgcgaagatggcagtcggtgaggagaacatctacgagagagttttcatcttcgagcttctgaaggacaagaacgaccccaacgctgtggccggagccgtcggtttcagcgttagagagcccaagttctacgtgttcaaggcgaaagccgtcattctggcaaccggaggtgcaacactgctcttcaggccgagaagcactggcgaagcagcaggaaggacatggtatgcaatcttcgacactggcagcggttactacatgggcttgaaggccggagcgatgctcacgcagtttgaacaccgcttcatacccttcaggttcaaggacggttacggcccagttggagcatggttcctgttcttcaagtgtaaggccaagaacgcgtatggagaggagtacatcaagacaagggctgcagagcttgagaagtacaagccctacggtgcagcccagccaatcccgacaccgctgagaaaccaccaggtcatgctcgaaatcatggacggcaaccagccaatctacatgcacactgaggaggctctcgctgagctggctggaggagacaagaagaagctgaagcacatctacgaggaggctttcgaggacttcctcgacatgacagtcagccaggctctgctgtgggcctgccagaacatcgacccgcaggagcagccgtctgaagctgcaccggctgagccctacatcatgggttcacacagcggtgaggcaggtttctgggtatgcggtcctgaggatctgatgccggaggagtacgcaaagctcttcccgctgaagtacaacaggatgaccacagtcaagggactcttcgccatcggtgactgtgctggtgccaacccgcacaagttctccagcggttcgttcactgagggcaggattgcagcgaaggccgcagtgaggttcatcctcgagcagaagcccaacccagaaattgacgatgcggtcgttgaggaactcaagaagaaggcctacgcaccgatggagaggttcatgcagtacaaggacctctcaactgccgatgacgtcaacccagagtacatcctgccgtggcagggtcttgtcaggctgcagaagatcatggacgagtatgctgctggaattgcaacaatctacaagaccaacgagaagatgctgcagagagctcttgagctgctcgccttcctgaaggaggacctcgagaagctcgctgcaagagacctccacgagctgatgagagcatgggagcttgtccacagagtctggactgctgaggcacacgtcaggcacatgctcttcagaaaggaaaccagatggcccggatactactacagaaccgactacccagagctcaacgacgaggagtggaagtgcttcgtctgcagcaagtacgacgctgagaaggacgagtggaccttcgagaaagtgccgtacgtgcaggtcatcgagtggagcttctaa

SEQ ID NO: 45061 - DNA, 1056 bp, Archaeoglobus fulgidus
atgagattcaagacggttgaccttccgtatcacgtgtacattggcgaaaacgtgatttcaaaactgccgaaggttctgagaagtttggatgcaaactactttcttctcctgacggatgaagttgtgaagaatcttgtagttgtcaatctcaaagaaacactaaaggacttcgaatacgacatgatgctcgttgagtcggcaaagatggaggaggcaaggaaaatcgtgctgagaggaggctttgcagactatgatgcagttgtcggtgttggtggggggaaggttctagacgtttcgaaagttgtttcgtcagagcttaacgcatcgatgataagcgtgcccaccacagcctctcacgacggtatagcttctccggtggcgagcttcaaggagaacggaaagccgatatccatttcaaccaaccccccgtcggcggtgattgccgacctgaacattataaagaactgtcccatcaggctgctcaggtccggctacggtgacctcgtttcaaacatctcatcagtgaaggactggcagcttgcaagagacttggttggggaggattacaatgaggttgctgcatctattgccgtgatgccagcgcagctaatggtgagcaaggccgatgagcttgatttaacgctcccgccccacctgctgatgctgctgaggggactgattatgagcggcgttgctatagccttcgtgggctcaagcagacccgcaagcggagcggaacacaagttcagccacgctctcgattatctcggctacgggaacggcactcatggagagcaggttgccctcggtacgataataatggagtacctccacgaaaagtactacgggaggggtgactgggagcagattaagatgtcgcttgagaaggtccatgccccgacaacggcaaaggaaatcggcctgacaagggagcaggtgatagaggcattgatgcttgcgacgaagctcagaaaaaagaggttcacaattctcgaagctgtaaaacccacaaaagaagagtttgagctcgttgtggagaagacaggcgtggcttaa

SEQ ID NO: 45062 - DNA, 1371 bp, Archaeoglobus fulgidus
atgtatcgtgtaaaaacatttaagtactatagtacgtataagatttgtatgattgaagaggtgtttgaattgacccagaacggaagggcaaagaaatggcacgctttttatgggggaaagatagagatactcccgaaagttcccattcgaactcttgacgacttcagcatatggtacacacccggagtggcggaagtttgcaacgaaattgccgaggacgaggaaaaggcctacgattatacgaacaagtggaacctcatcgcaataatcacggacggctcaagaactctcggtttggggaacattgggccgaaagcagcgatgcccgttatggaaggcaaagctctccttttcaaattcctcggtgcggttgacgctttcccgatcgctcttgcggagcaggatgctgacaggtttatcgagattgttaaagccatctcaccaacttttggaggtgtaaaccttgaggatatttcctctccgaagtgcttctacatccttgaaaggctgcaaaaggagcttgacatcccagtctggcacgacgaccagcaggggacggctacggccacacttgcagccctcatcaacgccctgaaaatcgtcgggaaggacatcagcgaggtgaagatttccataatcggagttggagcggccaacttcgccacaatcaggctgctgaaggctgcaggggctgatccgaagaagatgtttgttgttgacagcaaaggcattctgcacccagacagggctgacctgaaggagaagaagggatacaagtggcaggtggcgattgagaccaacggtgagagaaggaccgggggaatggaggaggctataaggggcactgatgtccttatagccgcaagcaagcccggtccggacgtcataaagaaggagtggattgctgaaatgaacgatgacgccatcgtattccctctggcaaacccaacaccggaaatctggccgtgggaggcgaaggatgcaggagcgaggattgttgggacggggaggagcgacttccccaaccaggtcaacaactccctcgtctttccgggagttttcaggggtgctttgacggtaagagcgagaaaaataacggacgagatgtgccttgccgctgccaacgcccttgcagagtttgctgaaaggaacggtcttagcgaggactacataattcccagaatgactgaaaaagaggtgttcccagaggtggcgacagccgttggcgtaaaggcggttgaactcgggctggctaggctggagctgagggaggaggagatttacgagatagccgagctgatgatttccgccacgcagaggaagataaagaagctctacgagcttgggtttatcaaggaacccccatcctga

SEQ ID NO: 45063 - DNA, 1071 bp, Archaeoglobus fulgidus
atgaaggtagttctgctgagttcgtactttccaccccacatcggcggggttgaggttcatgttgaaagaattgcccaccacctccacagaaggggtttcgaggttgttgttgtcacctccacagcttctgggagagaaaagtttccgttcagagttgagtacgttccgagcatcccgattccctattctcccatcacaccattcctcgggaggttcttggagaaaatagatggcgatatttttcactcccacacacctccccccttcttttcctgctcactcagaaaatcgccgcacgtcataacctaccactgcgatatagagattcccgagaagtacgggagatttccgattccgagagctttatcgaagctaataatcagaagaaccgacgatatgctttccgaagcccttgaccgggctgatgcgattgttgcgacgacaaaaagctacgcggagacttcgaggctcttggcaggcagggactaccacgtcatccccaacggcatagagctaagcgagttcgaaggggttgaggcggaaaaggagcccacggtcctcttcctcggcaggcttgcggcaacaaagggggttgacgttttgcttaaagcaatgaagcacgttgatgttgaagcgagatgcgtgattataggtgatggagaggagaggagctcgcttgagaggctggcaagagagcttgaggtgaatgcagagtttacaggcttccttccgagaaaaaaggttatagagtacctttcaagagcttctcttctcgttctgccctcattatccaggctggaggcgttcggaatagtccttcttgaggcgatggcatgcggaactccagttgctgcctctgaccttccgggtgttagggatgttgcatctgaggcgggcttcgtttttcctccgggagattacatgaggctgagcgaaataataaacgaagttctgagcgacgagaggaaggtgaaagcgattggagaaagcggaaggagaattgtaagggagaagtacagctgggatgtggttgtcaagtccctcataaggttgtacgagtctctcatttga

SEQ ID NO: 45064 - DNA, 1023 bp, Archaeoglobus fulgidus
atgatgaaggttaaggtggcgataaacggttacggaaccatcggaaagagagtggctgatgcagtcagccttcaggacgatatggaggttgtcggagttaccaaaacccgcccagactttgaggcgaaactcggcgccaaaaggtatcctctctacgtggccaagcccgagaacgtggagcttttcgagagggcggggatcgagattcagggaacaatagaggatttgctgccaaaagccgacatcgttgtcgactgcagcccgaacaaggttggggcggaaaacaaggcgaagtattacgagaaagcgggcataaaggcgatattccagggcggggagaagaaggacgttgccgaggtctccttcaacgcgctggccaactatgatgaggctgttgggaaaagctacgtaagggttgtgagctgtaacaccaccggtttgacgaggctcatttacatgctcaaaacgaacttcagcatcggcaggattagggcgacgatgctgagaagggttgtcgacccgaaggaagacaagaaggggctcgtcaacggaatcatgcctgatccggttgcgattccatcccaccacgggccggacgtcaagactgttttgcccgatgttgatattgtaacaacagcattcaagctccccacaacgcttatgcacgtccactccctctgcgttgagatgagagaagcggtcaaagcagaagacgtcgtgagcgctctcagcgaggagccgagaatcatgcttatttccgcagaggatggcttcacctcaacggcaaaggtaatcgagttcgcgagagagctcaggctcaggtacgacctctacgagaacatcgtttggagggaatcgatcggcgttgatggaaacgacctcttcgtaacgcaggcggtgcatcaggaggctattgttgttccggagaacattgacgccataagggccatgttcgagcttgcggagaaggaggagagcataaggaagacgaacgagagccttggaattgggaaagttttttaa

SEQ ID NO: 45065 - DNA, 1311 bp, Archaeoglobus fulgidus
atgcaggttcttagactcgaccgaagacattataaatcagggaagattagaagagccatgagttctcgcattcccggattttacaagctcagcgtggaggaaaggctgaagaaggttgctgaattcgctggattgagcgatgaggaggttaaagcagttttatctcagggtttgcccctcgacgttgctgacaggatgattgagaacgttatcggcacctttgagcttccgctgggcatagccaccaatttcctgattgatgggaaggattacctcatcccgatggccattgaggagccaagtgttgttgccgcagcaagcaacgcagccagaatggcgagggagagcggtggattcaccacagactacaccggctcgctcatgattggccagattcaggttacaaagcttctcaacccaaatgcggcgaaatttgaggttctcaggcaaaaggatgaaattatagagagggccaacgaatgcgacccgatgctcgtaaacctcggagggggctgcaaggatatagaggcgagagtcattgacaccataatggggaagatgctcatagtccacttaattgttgatgtaaaggatgccatgggggcaaatgcggtaaacacgatgtgcgagaaggttgctcccttcattgagagaatcactggagggaaagtttatctccgcatcatctcgaaccttgcagcctacaggctggcgagggcgaaggctgtttttgacaaagatgttatcggcggagaggaggttgttgaggggatcatgctcgcctacgcctttgcagcagctgatcccttcagatgtgccacgcacaacaagggaatcatgaacggcatctcagccttgatgattgcaacgggcaacgacttcagggctattgaggctggagcccacagctacgctgctattggcggctataaacccctcactacctacgaggttgacaggaaggggaatctggttggaacgatagagattccaatggctgtgggggtgattgggggggcaacgaaggtcaatccgctggcaaaaatctcgctgaagattcttggagtaaacactgccgaggagctggcgagagtagctgcagctctcggccttgctcagaactttgcagctttaagggctttggcaactgaaggaatacagagggggcacatggagcttcacgccagaaacctcgccataatggccggtgcaacaggagatgaggttgacagggttgttgagataatggtcagggacggaaagataaggctggactacgccaaggaggttctggagaggttaagaagctga

SEQ ID NO: 45066 - DNA, 1482 bp, Archaeoglobus fulgidus
gtggatagaggaggtgatttagtgcattttctcggcatcgatgcgggaacgacaggagtgactgtgggagtttacgatgccgatggaaatctggttgcaaagagctactccgagtttgaaacctactacccccagccgggatgggtcgagcaggatgccgagcactggtggaacagcatcatcgatgcctgcaggcaggcggtgaagattgccaaagcctctgacagcatagcagctatagctgttgcaaatcagagggaaacaatcgtccccgttggcagagacggtgagcctgtaagcagagcgatagtctggcaggacaggaggtgcagggaggaggttgagctgataaaggagagaatcggggaggaaagggttgcaaaaattaccggactaaagccggacccctacttctccctgccgaaaattctctggtggatgaggaacaggcctgaagtcatagagaaaagctggaagctgatgctcgtccacgactacatcgtttacaggctaaccggagaggttgtgacggactactcaaacgcctcaaggacgatgctcctcgacctgaattcgaggaagtggtgcgatgaaatcgctgccgaattcaaccttgacctgtctctgatgcctgatctcgtcaattcgggagaggttgtgggggagatcagggggaacgtggcggagaagcttggcataagttcgaatccggtagtggttgcaggtgggggagaccagcagtgctccgccctcgctcagggtgttgttgaggaggggagcgtgaagtccacgacgggaacggggaccttcatggttgcacctgtggagaaagtcagaggccacggagacatcatatactccgcccacgttctgcccggcatcaatgtgggcgaggtgagcatcttcaccacgggcagcctgctatcgtgggttaagaaagccttctatcacggtgagggctatgatgtgattaacgaggaggctgagaagtcaggagtgggggcgagaggtgtgttcatcctgcccttcttttccggagctggctgtccccactggaatccggaggcgaagggggttatattcggcttaactcttgcccacaacagaggagacattgcgagggctgtgatggaggcagtagctttcgaggtgagaagcaacattgaggtgatggagaataagggaatcagcattgaggagcttcgccttgatggcggagcagcgaacagcaggctttggaaccagatttttgctgacgttaccggcagaaaatgcctcgtttcatctgatgtggaagcgactgcgaggggggcggcaattcttgcagcttccggatctgacagcttcaatggtattgacgacgctcttacaaccttcctacccgatttcacagaggttatgccgtccgaggatgggatgggaaaatacgaggagatttatagcaaatatgtccagattagggatgcatacttgaaaggctga

SEQ ID NO: 45067 - DNA, 801 bp, Archaeoglobus fulgidus
atgactctaagaacgaaagacgggctcactctctacactcgaaggtgggatgttgagtctccaagagctgtaatctgtcttgttcatggtctgggggagcactctggaagatacgagcacgttgcaaggtttttcaatgagaatggcatctcctttgcagcttttgatttgagggggcatggaaggtcggaggggaagagggggcatgctgaatatcagcagttaatggatgacatcacccttttcctccaaagtttggattacgactgcccgaagatactctacggccacagcatgggcgggaatctcgctctgaactacatcctgagatacgaccccgacattgcgggaggtataatttccgctcccttccttgctctgccaaaggagctaccaaaacacctgtttttcattctgaagctcctcaacgttgttgctccttcaattcagctttcaaatggcatcgacccaaacttaatcagcagagatagggaagttgttgaggcctatgtttctgaccccctcgtccacgacaaaatctcccctcgattcattctgcaatctcttgaagcgggaaaatgggcgctggagaatgcagacaggctgagaaagcccattcttctgatacacggaactgctgaccaaataacctcctacagagcaagtcaggagtttgcaaaaagggctggggagctttgcaagtttgtcagctacgaaggcttttatcacgagccccacaacgagcccgagaaggagagggtgcttgctgacatgctgaagtggatagaggaggtgatttag

SEQ ID NO: 45068 - DNA, 1710 bp, Archaeoglobus fulgidus
atgcttggtgtggaaggaaagagcataacagaaattgacgagaaggagataaacaggatctggctaaagcactacgatgaaggagttaggcccaacattgactaccccgaaattccgctgtatcagcttctggaggatacggcgaagaagtatcccgacaagaccgcgctgattttcttcggaaagaaaatcacgtacagagagcttgacgagatgagcgacagaattgcaggttttttgaagagcctcggcattaagaaaggagacagggtcattctggacctcccgaacgtgcctcagtatgttgcggcctactacggaattttaaaggtcggcgcgaccgttgtgcagtgcaaccctctctatactgagagggaaatcaggtacattcaggagaacagcgaggcggagtacggattctttgtcgaattcgtttatcctagaataaagggtcttttagctgaaggaaagttaaagaaagcggtaatctgtaaaattgaggattatctcccattccccctgaacatcctttatccgctcaagaaggagaaggtaagaatcgagaagagcgataaggtagtttactggaaagatgccttgaagtcaccgctaacaaaggaaaggcctgaaatcaaccccaaggatgatgtggcaatcttcctttacaccggaggtaccactggtgtgccaaaggctgtgatgtcgacgcacttcaatctcgtcgcgaatgtttaccagacacttgagtgggttgttgacagaactcctgatgatgtcttcattggagtgctgccctacttccacagctttggaatgacgacctcaatgaacgctccaatcgccaacggctcaaccatcgtcctgattcccgaccccagagacatcaagaggatacttgagagcattcagaagtacagggcgagcattttctgcggagttccgacgatgtatgcggcgataatcaaccaccccgatgtgaagaagtacgatttaagttcggtgaaagcatgtattagtggtgctgccccacttcccgttgaggttaagaggaggttcgaggagattacgggaggtaagctggttgagggctatggtttaagtgaaacctctcccgtagcacttggcaaccctgtttacggcctcaacaaggaggggagcattggcatacccttccccgacacctacgctgtcgttatagacgatgaaggaaaggttctcccaatcggtgaagttggagagctagttataaagggaccgcaggtaatgaagggctactacaagatggaggaagagacgaagaaggttctcgtcaatggctggctgctgactggagacatggcgaagatggacgaagatggatacttctacatcgtggacaggaagaaggatatgataattgcaggaggttacaacatctatccgagagaggttgaggaggtgctttacgagcatccagcagttgttgaggctgctgtagtaggagtgcccgacccctacaggggagagacggtcaaggcttacattgtcctgaagccggaatacaagggaaaggttaccgagcaggagataatccagttctgcaaggagagattggctgcatacaaggttccaaagcttgtcgagttcagagatgagctgccgaagtctgcggtaggaaaaatcctcaggagagttctgagagaggaggaaatcaagaaaataaaaggttaa

SEQ ID NO: 45069 - DNA, 1992 bp, Archaeoglobus fulgidus
ttggttatgagctggcttataataactgagaaggacaacactgccagaaggattgcgtcaattctcttcaaagacgttaaaacgctgaaaaagggtagggtgagttactaccactctccttcaaacgacgcctacgttgttgggctgaaaggccacatagttgagcttgacttcccgaaggagctgaataactggaccaaaactcctcttgagaaacttcttcaggcagagctggtgaaaaaggtcaaggagaggacgatttcctctattttgaaggaaattgccaagaaggcggacagagttacggtcgcaacggactacgacagagagggtgagctgataggagttgaggctctggaaatcgtcaagtcggttaatccaactgttaaggttgacagggtgaggtacagtgctgttacggagaaggagataaggtcagccttctcaaaacccgttaaagttgacttcaacttggccaacgctgcgctcgcaaggcagaagatagacctgatatggggtgccacactcaccaggctcatctcggttcattccggcaggatgggcaaggacttcctgagcgtcggaagggtgcagacgcccactctaaggctgattgtggacagggagctggaaattcagaacttcaagcccgagaagtactacgagatttttgcggagtttgaaggattcatcgcaaagcacccaaagaggtacggcagcaaggaggaagctgagaaattattcgccaagattggcgaaacggcgaaagttgaggaattcacaagaaggagaatggaggagaacaggccaacgcccttcaacaccaccgagttcttgagggaagcatcgaagttcatgtccccccacaaggcgatgaacatcgctgaaaccctttacatgaacggctacatcagctaccccagaacggataacaccgtctatccccccaccataaacctcattgaaatcgtttctgcgctctcatcagtttttccgagggaagctcaaatcgtgctatctcaggataaaataacgccttcaagaggcagaagggaaaccaaggaccacccgccaatatatcccaccggtgttgcgaagaggggggagctttcaaaggatgagtggacgatttacgagcttgtggtaaggaggtttctcgcgaccctcgcacccaaagccgtttgggacgttagaagagtcgttctcgatagcaacggcgtaaagttcgttgccaacggcagacagctcgttgaagcgggctggagggacatctacatctactcaaaagctgaggaaaccgagctacccttgctgaagaaaggtgacgtcctgagaatactcaagaaaagacttgaggagaaggaaaccaaacctccggggagatattctgcttcatccctgatcaaaatgatggagaagctcaatctcggcacgaaatcaacgaggcacgagattattcagaagctcgtcagcagacgctacattcacggtaaccccttcaggccgagcgaaacggccttttctgtaataaacgtgctcaaggagactgcggagacgataacgctgccagacatgaccgctaagcttgaaaacgagatggacctcatcgcggaggggaagaagagggagccggaggttgtggacgagtcaagggagatgctcctgcagatactaagggcaatagattacagaaagctcagcaaagatctgagggagggtgtaaagaaagataaaattgttggaaaatgtccagaatgtggtggagagcttgtggtgagacagtccaaggccggtaagaggttcataggttgcagcaactatcctgactgcaccttcacccttccacttccccagaatgggactttgtacatcacagccaagcagtgcaaggagcacgaaatcaaggaggtcaaaatcaggacaaagaagggatactggaatctcggatgcccctactgcaactatctcaactggaagaaggagaacagctaa

SEQ ID NO: 45070 - DNA, 1275 bp, Archaeoglobus fulgidus
atgggctttacaggtagaaggggtaaggcggaaatcattgaggctttttcaaagcacgtctcgccctacaaggccaagtttttctcaatggtgggcatcgacttcgttcctgcaagaagggagggggtgtggtactgggatctggatgggagaaagcttatggactgccactgcaatggaggagttttcaatctcggccacagacatcctgaaatcgtaaaaacgcttgttgaggccttggatgagcttgacattggcaatcaccacctcatcagcgagcagagggcgaggttggcagagaagctcgctgaactgatgcccggagacataagcaggactgtttttggtgtgggtggtggggaggcaattgattttgcaataaagctggcaagaggtcatacgggcagaaaaaagataatttatgctaagggcggttaccacggccacactggttttgccctcgctgccggggacgaaaagtacagaaagcccttcgagcccttagctccgggctttgttgaagttccctttggtgatgctgaagctgttgagaaggcggttgatgatgataccgcagctgtgcttttcgaaacaattcctgctacccttggcatgcccctgccacctgaagatttctacagaagggtcagggagatatgcgacgagaagggctgcttgatgattatggatgaggttcaaacgggactgggaaggacgggaaagatgtggggaattgagcattacaaagtagttcctgacgtgattgttacagctaagggtctgtcaggcggcgtttatcccatctcggccacatgctttaaggaggggctggatgacttcatggcggagaatccctttatccacgtttcaacctttggaggagctgagcttggatgcgttgttgcagagaaagtgctcgaaatcacctcaagagagtccttcttggagaacgtgaggaaaactggcgaagctttgtctgagatactgggaaaactgaaggatgagtacgactttgtagatgagataaggcagaagggtctctttattggaattaagatggtcgaagaaggctggggacctctgctctccatttcctgctaccacagcggcattctggcagtttacgccaacaacgacacctctgtcatgcagttccttcctccgctgattgtgggagagaaggaggttgattacatcagagaaaagctggcaggagcgatggagatagcctctcaaaggcgggagatggttgagtttatcagaaaaatgctatga

SEQ ID NO: 45071 - DNA, 1674 bp, Archaeoglobus fulgidus
atggtagttctctacgggaaggatgtggtggacagatacgttgcagagggatggtgggacaacgtaacgctttttgagagattcaggaggaactgcaagagaaatcctgaaaggactgctgttgttgaccctccaaacaaggaggagctcgtgggttttaagcctgaaaggttgagttatgctgagctcagcgattttgatgacagactggcctcatttctgctcgataacggagttttcaaggatagctgcgttttggtgcagcttcccaatacggtggagctaattgctgcatacctcgcaacgtggagggcttcagccttcatctctcccgttccaatgcagtggagggagcacgagatggggcatgtttgcagggttttgcagccaaaggttttcataacagcagacaccttcaaaggcttcgaccacgctcagatggcctccaggattaaggaggcttttccgagcattgagaaagtcgtaacgtattcccagctttacgagatttgcagaaactaccgcataagggaggatcttgatgaggcgtcatcctttgcatctggaaacgatattgccgtggtgcagtggacctcaggaaccgaagccgagcccaaagcctgtcccctctcccacaacaactggggctttctgcgctttctttacgatggagagagatacagaggagggctgctgagcgatggggatgttataatgaacccggcccccatagtgaatatgacaggaattggagttggcctcattccgtggatcatgtgctccggaacctttgttctgcaccaccccttcgaaccaatgctctacgtcaggcagctgattgaggagggtgtgaacttcactctcgctcctcctgctgttgttgttgcaattctaaaacatcccatggcttcacagctcagctttgacaagctgaagtacttcgcccaaggctcggcacctccaccaccatggacttttgtcgagctgaaaaacagggggatagagccgatgaacatctgggggcagaatgaggggactggactgttctcctacgacaggacaatccctgatctggagaagagggcaaggagctttcccattccggataaagtaagggatttgcccttcttcagggctatagagataaagattgttgacgagagtggtaaggagatgaaggagccgggcagtgtgggagagctgtgctacagaagcccacttacgatgccatgctactaccgccagcctgagttgacgaagaagtcctttgatgctgacggcttcttccacacaggtgatctgtttgaggtagttgatgatactacaatcgccttcttcgacagaaagaaggacataataatcagaggagggttcaatgtaagctccgctgaggtggaggacgtcgtcaagaagcaccccaacgtattggatgctgcagcagtgggtgttcctgacgagaggctcggggagagagttggcttgtacgttgttccaaagcccggcactaccgtaacgctggaagacataaagaagcacatggaggagagcggagttgcagtttacaagtggcctgaagtggtggttgttgttgacgagattccaagaaatcctgtggggaaggttctgaagagtaggctgaggaaggagatcgttgagaggatgaaagctggttaa

SEQ ID NO: 45072 - DNA, 1347 bp, Archaeoglobus fulgidus
atgtgtattatgaagtacgacgttttgattatcggaggtggaccagcaggaatagtcacagcaacgacggctaaaaagttttaccctgccaagagcgtggcgataataaagaaagaggaaacaagtttggtgccttgcggtataccgtacatcttcaaaactctcggctctgtagaggctgacgtgatgccaacgaagcctgcagagaaccttgggattgagttcatcatcgatgaggtcgaagatgttgacgtaaaagccaaggtcgtgagaacgaagggtggaaagagcatttcatacgagaagcttgtttttgcaacgggttcaacaccggtgatgccgagaatagagggggttgagaagaaaggagttttcacggtctcgaagaacatagaagagctcagaaaactgcatgaggcagtaaaaaaggctgaaaaggttgtcatagtcggaggcgggttcataggtgtcgaggtaggagagcagattgctaaagctgggaaaaagtttacgatggtggaaatgatggatcagctgcttccagccgcttttgacaaggaattcgcaagaattgctgaggaagagctcaagaagcttggagtagaagtttatctgaactcgacagttaagaggattacgggcaattccagcgtagaagctgttgaactcgcggatggcaggaagattgaggcagatgtggtcataatgtcggtgggataccgtccgaacatagagcttgctaagaaggcaggacttagaataagcataggaaatagaatatggacggatgagtacggaaggacgagcgagaaagacgttttcgccgttggggactgttcggaagaaaaggactttttcaccagggaaacgagcagggtaatgttagcttcaactgccaccttcgaagcgagaattgttggggcaaatctgtactctctcaaggttgtgagagtgaacaagggaacggtgggtgttttctcaaccttcgttggggatgttgcactcggcgctgcaggccttactgaggagatggcgaagaaagaaggttttgaggtcgttgcaggctacggagagagcttaaacagacatctggcaagtatccccggggcggcaaagacgaaggtgaagctgatctttgccaaggagagtggtgtaatccttggaggtcaggttactgggagatatgaggttggagaaatggtaaatcagatagcaatggcaatccagaacaacctgaccgcctcagagatagacacgcttcagataggcacgcatccgcttttaacttcagctcccaccaccccaccagtaatacttgcagcagaggatgcgctcaggaagatgtga

SEQ ID NO: 45073 - DNA, 1197 bp, Archaeoglobus fulgidus
atgtggtcctgcagcttgaacttcatgttgatcctcctatttttaaatacgggctcgacgggatttgaacccgcgaccgacgggttaaaagcccgtcgctctgcctggctgagctacgagccctcatccattagcgatggtgaggatttaaatctttttcgtgctctaaagatacaagcaaaggacagatatatttatcggtgcattcgagatttgcggggaaaaggcatgtacgccattgaagtggagaatctggtgaaaaagttcggggattttgaagctgttaggggtgtaagcttcaaggttaaaaggggtgaaatcttcgcttttctcggccccaacggggctgggaaaacaacgacggttcacattctcacaacactgctcaagcccacctcggggaaagcttttgtcgcaggccttgatgtggtgagggaggcaagggaggtgaggaggagaataggaatagtctttcaggacccaagcgttgacagagatttgacagcatacgagaacatgctggttcatggtggcgtttacggattgaagggaaaggagcttaaggagaaaatagagaggctcttgaagttcgttgagctctgggagttcagagataagctcgtcaagtacttcagcggggggatgcagagaaggctggagatagcgaggtctctgctgcaccatcccgaagtgctcttcctcgatgagccgactattggcttagacccgcaaacaagagctcacgtctggagctacattgaggccatgaaggaggagcaggacatgacgatatttctcacaacccactacatggaggaggctgagaagcttgcggacagagttgctataatcgaccacgggagaattattgcggagggaagcgttgaggagcttaaaaggctcgtggggagcgatgttgtttaccttaaagtggaaaacggggcggagtgctttgagacgggtttgggcaactgcgtcgttttgccggatggaagaatcagaatagacgtctccaacgcgagcgaggcgataccaaaaattttcgagattgcaagagagaagggcgtcaggattttggaggttacataccacagacccacgctcaacgatgtgtttctccacctcacgggaagggaaataagggatgagggtggtgagctgagaaaagcgattatcagggctagaatgaggagataa

SEQ ID NO: 45074 - DNA, 1815 bp, Archaeoglobus fulgidus
atgaggaagtgtagggtttacatcaacggtgcccttgtaggatttcacgataatggggaggagcttgcaaataaaatccgagagctgagaagaaagggcagaatttccaatcaggttaatgttgtttactatcccgactcaaacgaggtgagaataaacacagatgcaggaagggcaaggaggccgctgattgttgtcaaagacggtaagcccctcgtaacgccggagcacatcgaaaaaatcaagaagggggagctgacgattgaggaccttgtcaggcaggggctgattgagtaccttgacgctgaagaggaggagaacgcgtacgttgccgtttacgagcatgagctcactcctgagcacacccacctggagctcgacccctcgcttatcgttggaatctgtaccggcagcattccatatgcggagcacaacgcatctccgagaaacacgatgggagcggctatgataaagcagagcctcggaattccgtactccaacctcgcgtggagaacggatacaagagggcacctgatgcagcacccgcaggttcccatcgtcacaacagacacgcaggtagagataaaatttgatgaaagacctgcggggcagaatttcgttgtggcagttctcagctacgaaggttacaacatcgaagatgcactcataatgaacaagggaagcgttgagagaggccttggaaggagcttcttctacagaacttacgaatctgaggaaatgagatatcccggtggtcaggaggacaagtttgaaatacccggagctgatatttcaggcttcaggggtgcagaagcttacgcgcatcttgatgaggatggactaatcttccccgaaactgaagtagggcctgatgacgtgctcataggcagaacctcccctccgagattccttgaagagccgacggagcttgggatttccccgcagaagagaagagagacgtctgtaaccatgagaagtaacgaaaagggtgttgttgacgccgttttcctgatgcagtcagaaggcggctcaaagctcgccaaggtaagggttagagatttgagaattccggagcttggtgataagttcgcatcaagacacggtcagaagggagttgttgggctgctggttcctgaggaggacatgcccttcaccgagtcaggaatcgttcccgacttgataatcaacccccacgccatcccctcaaggatgacagtcggacacgttctagagatgattggagggaaggtcggcagcctcgagggaagaagggttgacggctcactcttccacggtgagagtgaggaggatttgagggcaacgctcaaaaaatacggtttcagccacacaggcaaggaagtcatgtacgacggaattactggcagaagatacctcgtggatattttcgttggagtcatctactaccagaagctctaccacatggtctcgagcaagattcacgcaagaagccgcgggccggtgcaggttctcacgaggcagccaaccgaggggagggcgagaaagggaggtctcaggttcggagagatggagagggatgttttaatcggacacggcgcggctctgttgctaaaagataggctccttgaggagtccgacaaagtagaggtgtgggtctgcggaaactgcgggcatgtggcaacctatgactacagaagaaacacagcctactgccatatttgcgatgatgagagcaacatccacaaggttgagatgagctacgccttcaagctccttctggatgagctgaagtcaatgatgatcgctccgagaataattctcggagataaggcatga

SEQ ID NO: 45075 - DNA, 543 bp, Archaeoglobus fulgidus
atgaaaataaccatttccggacctcctgggagtggtactacgactgttgcaaaaattgttgccgaaaagcttggcttaaagcttatttctgcaggagatgttttcagacagcttgcggccaagaaaggaatgactgttgaggagttcagccagtacgcggaggagaacccggagatagaccgcttaatcgatcagactcagaaggagatggcggagaaggagaagaacgttgtggtcgagggcagactttccggctggtttgttaaaaacgccgacctcaaggtttggatttttgccgaccccgaggtaaggtactcgagaatagcaaagagagagggaaaggacctaaccgtagtgaggcaggagacgaggctcagggaggaatttgaaaagaggaggtactggaagttttacagcatcgacatcgacaactggacgatttacgatcttataataaattcgggaagctttgatgctgaaggagtagtggaaataatacttaaagcggtagaggttaaaaaaattaaagttgatcaaaagtaa

SEQ ID NO: 45076 - DNA, 1530 bp, Archaeoglobus fulgidus
atggttcgggaattcgattatatctggcagtatcttgaccactgggctgatgtagatgaaaaatatcctgctataaaattcaaggacaaagaaatcagctacggtgagctgaaggagaatgctaatcgtcttgcggcatcactactaaaacttggagttggtaagggagacagagtcgccacagttctcccaatgacacctgaatatgtctgcacttttttagcatgctccaaaattggagcaatctgcgttccgatggatgtcaggtacagaacggcagaacttaggaggtttttgagtcatgcggagccgaaagttataatctcagttgaaagctttcaggagaacaatcaaagaaaaatccttgatgaaataaaggaagagatcggaaaccccgaaattttctttgtaggggagtttgacgaactgcttaaaagtgaacccttggggaaagctgtagagcaagaaccgaacgatgatatcctgataatctttactggagggactactggtgttccaaaggctacactcctctcccacataaacatagtgtcaatggcactcggcgagttaaaaagtattatcaggtacatcggaagggaagagagaatgaacatgctcgtacaccttcctccaagccatgtcggaggcacaacagaattgctcgcaacaggattggtaaacggctcgaaaatggtacttatagaccactggaggccggatacagtgctaaaagagctaaaagaggaaaaaatagcgttctttggtgccgttcctacgatgtttgctctaatcttctccttgaatgtgccactcccgcctgtcgagcttcttgtaactgctggcgagaaactgaatcctgaactccttaaaagaatgatgcagtggtgtgagaagattggagttggctacggttcaacagaaacggccggctttgcgaccttctctctgccagaggatgacccattgaagttcaccgagggttatgtaggcgtaccgttcgagggagtggatgtgagaatcgttgatgatgaggggaacgagctaccagatggagaaatcggagaggtcttggtaaagggaccgatggtgagcaaagggtatttcaggcagcctgaagagacagagaaggggttcagagatggctactgggtcagcggagacctgggatttaaaaaggggaaggagttgtacattgtaggcagaaagaaggaggtgataagagtaggtagctacacggtgctcccttcagaagttgaggaggttgtgatgaaaaatcccaaagttgggatagctgcagccttcggttatccccacgaaatatatggggaagtggtatgggttgcggtcgttcccagagcaggagaggtagtcagtgaagaggaaattatcgaagcatgcaagaaagagctggcagacttcaaagtaccgagaaaagtgctgataatggactccattccgcttacgaggctcggaaaggcagacaggataaagctaaaggaaatcattttgaaggagtttttcgaatga

SEQ ID NO: 45077 - DNA, 1362 bp, Archaeoglobus fulgidus
gtggaggagtttgagggcgaggcaattgtagaggctgagaacgttgtgagcataatgctgagaagagaggctgcggaaagagcggacgagattctccatttcagttactggagcggtgaaatcaaggagctggacgctccgggctacctcgacaggtggcagaaaaagtgctaccatgcaacctgctcgcttgatgaaggggagatattgctcgtagtaggcccaccgggcagcggtaagaccacctttattgcggaggctgcgagaaagctctcggaggaggaaagagtttgggtgacgtcgaacacgaacattgcggttgacaacgttcttgagaagcttgaaagagcgctcagaataggccatccgtcaaagataacggctggtgtgaggaggcacagcgttgagtataacctgctgtctgggataaggttttcagactacagggagtacgcttcaaaggtggcggaggcttacagagagattgcgaggatacagaacgacatgatcaggaagggtaagatcgtcgttggttcgacaattttaaaggggatgatgagcgccttgaaaaactacgacttcgacacggtgataattgatgaggcgagcaacacctgcatttcaacagcccttcttgctctggagaaggctgaaaaagccgtggttgttggagacccctatcagcttccacccgtttacgaagttggagggcacaaggcagcaaagttcagcgcctacaactttctgatcaatatttacggcaaaaatttatggctcagaaggcattacagaagcaatgcaaagattgctgagtttgcggcaaggcacgtttacggatttcttgaaattgacgagaaatgccgcagaataaaaattgagccgtgcaaaacaaccattcccgaggtgggagaccccgagaagccgcttgttttcatcgactgcaacggtgttgagaggagggaggggaggtcgaaggtaaatgaggaggaggcagaggtcgttgcgatgattgccgaggagcttgcggagtgcgtgggagaggagaacgttggagtcataacgccctacgtcaagcaggctgagcttataagaggcatactttccgagttcggtgtgatggttgaggttagcacggttcacagctatcaggggagggagaaggacgtggtgatttactcgataaccgcaaccggcaatccctacttcgcgtcggaaaaaaggctcttcaacgttgctctgacaagagcgagaaagaagttcatcgctgttggaaactcaaaggccctcgaaggaaagaacctcttgctcacgaggttcatggtagccgcaataaaagagggagggttcgtcagactgcgttag

SEQ ID NO: 45078 - DNA, 1302 bp, Archaeoglobus fulgidus
gtgcctaccagcaaagtttttatcacccccaattttggctttaacatggctcagacactggtagaaaagatattttcaaaggcgagcggtaaggaagtgaaagcaggagaattcgtaatggcaaacatcgacctcgccatgattcatgatataaccgctcctctcgcgattaaagctttcagggaaattctcggcagtgatgcaaaggtctgggacaaaagcaaggtgattatggccttcgaccatcaggtgccggcggacagcgtgcatgctgcagaaaaccacaagatgctgaggaagtttgctgaggagcaggggattctgaactacgatgttaaagggggaattgcccaccagataatggttgaaaaccacgttgagcccggaatgctgattgttggggccgacagccacacgtgcatgtatggggctttgggagctttcgccacaggtataggctcaacagacatgggcttcgttttggcgatgggaaagctgtggttcaaggttccagagtcaatcagattcaacgtccacggtaagctggaaaagcacgtttacggcaaggacatagtgctcaagctcatcggaatggttggggctgatggagcgaactacaaggcctgcatctacagcggagaggttgtggaaaagcttggaatgtctgataggctgaccatgtgcaacatggccattgaaatgggaggcaaggctggaattgtggagcccgacaaaacaacgcttgaatatttgaaggcaatgggcaggccctatgagggagagctgctgaaaagcgatgaggatgctgaatttcaggaagttgagcttgatgtgactggaatggagcctcaggtcgctgccccgcacagagttgacaacgtggttggaatatcggaggttgaggggacgagggttgatcaggttttcatcggctcctgcaccaacggcagatacgaggatttgaagattgcggctgagatactaaagggagagaaggttgcgtcaaatgtcagattaatagtcattcctgcaagccacagggagtacaggagggccttgaaggaagggctgattgagatattcgttgacgctggagcgctggttgaggccccgtgctgcgggccgtgcatgggaggaagctttggtttgattgcaagcggagaggttagtgtgtcaacctccaacaggaacttcatcggcaggcagggaagtcctgagggcaaaatctaccttgtgaatcctgcagtagcggcagcaacggcaatctacggagaaattaccgacccgagaaaaataaagtaa

SEQ ID NO: 45079 - DNA, 969 bp, Archaeoglobus fulgidus
atggcagagtttccgaaggtaaggatgcgaaggttgaggaaggcaaacctgaggtggatgttcagagaagcaaggctgagtcctgagaatctcataacaccgattttcgttgatgaaaatattaaagaaaagaagccgatcgaatccatgcctgactacttcagaattccgctggagatggttgataaggaggttgaggagtgcctcgagaaggacctgagaagcttcatcctttttggcatcccctcctataaggacgaaactggttcttctgcttatgaccaaaatggtgtaatacagaaagccgtcaggcgaattaaggctgagtttccggatgctgtaatcgtaacggacgtctgcctctgcgagtacacaactcacggccactgcggtgttgtaaaggatggggagattgtgaatgatgagacattgcccataatcgggaaaactgctgtgagccatgcggaaagcggagcggacattgttgcgccatccggaatgatggatggaatggttaaggcgataagagaggcccttgatgcagcgggttttgagagcactcccattatgagctactccgccaagtatgcttccaacttctactctcccttcagagatgctgcggagagcgggttcaagtttggtgacagaagggggtatcagatggatatccacaatgccagagaggcgatgagggagatcgagcttgatgtcaaagagggagcggacataatcatggtcaagccggccctgccctacctcgacattataagaatggtacgggagcgcttcgatttgcctttggcagcgtacaacgtgagcggagagtacagcatgatcaaagctgcgataaagaacggctggctgagcgaggaggcaatctacgaggttctgatttccataaaaagggctggagcggacctcatcataacctaccactccaaggaaattgccgagaagcttcagtaa

SEQ ID NO: 45080 - DNA, 1314 bp, Archaeoglobus fulgidus
atggaaattggatgcataacgatttctcacaaaaatgccaaagttgaggaaattgagaaaatctggcttactgtaaagccgagactggaggatgtgatttcgaaatgcagtttttccgagtatgcttacatcttcacatgcaatcgcttcgaaatctatctcgttggcgagaatctgaaaagctgtcttcaagatattgcggaggagcttggtataaccggaaaggctgaaatttttgttggtgagagctgcctgaggcacctgctgagagttgcttcgggaatagagtcgatgattgttggggaggagcagattctcggtcaggtaaggcagtgctttaatctctgcagggaaggtgggcaggctggggaggttctggagagggttttcggcaaggccgttcaggtcgggagaagggttaggagagagacggcaatttcgaaaggctcggtgtcgattggctctgctgcggttgaggtggcggagagagttctgggaacgctgaagggaaagaaggctttgctcgtaggtgcgggggaaatgggcacgctcgttgcaaaggccattgcaggtaaggaagtagaggctgttttaatagccaacagaacgtacgagaaggctgaggagcttgcaaaacgaattggcggggttgcagtaaagtttgacaaactggttgattacctcaaggtctgcgacgtcgtcatatccgcaacctccgcaccccacgccgtcataacgaggggggacgtggagagggctatgagggagagaagtcagaagcttctcatcattgacatagccttgccgagagacgtggatgagagcgttgcacaacttgacggagttgagctactcacgatcgatgatttgaggagaataagcgaggagaaccttgccagaaggagggaggagatagcaaaggttgaggggattattgaggaggagcttgagcagctaaagctgctcttgaaggacatctccgccagagacgccattgcagccatgtactctctcgctgagaggttcgttggcgaagaggtggaggagctttacgcaaagctaaacgcgagatacggcgtttcagaggatgttaaggaaattctcaacgattttgccaactccctcattaagaaattcctgagagagcctacagttcgcctgagggaggcggcgaggaaggatgagtttcacgttattgagtccataaagtatgttttcggtgatggaaatggcagagtttccgaaggtaaggatgcgaaggttgaggaaggcaaacctgaggtggatgttcagagaagcaaggctgagtcctga

SEQ ID NO: 45081 - DNA, 1197 bp, Archaeoglobus fulgidus
atgggcgatagcgaaatacaatacctcctggaaaagttgaagaagctggaggaggattactacaagcttagagagctttatcgcagattggaagacgagaagaagtttatcgaaagcgaaagaataaggtatgaaagagaagtaagaaggctgagaagtgaagttgaaagattacgctcaccgccattactcgtaggtgttgtttcagacatacttgaagacggaagagttgttgtgaagagctcaaccggaccgaagttcgttgtcaacacctcgcagtacatcaatgaggaagaactcaagccgggtgcgagagtcgctttaaaccagcagacgctggcaatagtgaatgtccttccaacatccaaagacccaatggtttacggctttgaggtggaggagaagccagaagttagctacgaggacataggaggtcttgatgtacagattgaggaaatcagagaggctgttgagctgccgctgctgaaaccggagcttttcgcggaagttggcatagagccgcccaagggtgtgctgctctacggtccgccgggtacgggtaaaaccttgctggccaaagcggtcgcaaaccagacgagggcaacgttcatacgtgtggttggcagcgagttcgttcagaagtacatcggagagggagcaaggctggtcagagaggtgttccagctcgcaaaggagaaggcaccttcaataatattcatagatgagcttgatgcaatagctgcgagaaggacaaacagcgataccagcggtgacagggaggttcagaggacgatgatgcagctcttagctgagcttgacggcttcgacccgagaggggatgtgaaggtcatcggtgcgacgaacaggatcgacatactcgacccagcaatccttcgacctggaaggtttgacagaataatagaggttccgctaccaacgttcgaggggaggatacagattttcaagatacacacgaggaagatgaagcttgcggaggacgttgacttcaaggagcttgcgagaatcacggagggtgcgagtggagcggacatcaaggcgatatgcaccgaggcagggatgtttgccatcagagaggagagggcgaaggttacaatgctggacttcaccaaggcgatagagaaggtgctcaagaagacgactccgatacccgatttgaagggagtgatgttcgtttaa

SEQ ID NO: 45082 - DNA, 1476 bp, Archaeoglobus fulgidus
gtggccatggagagggaaaactgggctacaagagccggtttcgttctcgccgccattggctcggccataggactcggaaacatctggagattcggctatcttgtttacaaaaacggtggaggggcgtttctcatcccctacttcgttgcactctttgtggcgggaataagcctgatgattctggagtttgccatcggccacaggttcagggggagcgctcctgcatcaatgaggaagcttggaggcagaggcttcgagtggattggctggtgggcggtcacaggaggcttgataatcacaatgtactacacggtagtcattggatgggccatagtttacttcacaaagtcattgacgctggcgtggggagaggatacgggaggatacttcttcggcacggttctgcagctctccgacaatccatgggatttcggcgggtttgcaaccgaagttctgattgctacaatcattgtgtgggcgctgaactggcttgtcgacttcaggggcatcaggaagggaattgagaaggccaaccttttgctgatgccgcttctctggcttctcgccgtaatccttgtcatcagagcggtaactctgccgggagcgatggaggggatagagtggtatctgaagcccgacttcagcaagctcggcgattacaacatctggcttgccgccttcgggcagatattcttcacgctcagcctcggaatgggcataatgatagcctacgccagctatctgcctgaaaagagcgatatagcaaacaacgccttcatagtcagccttgccaactgcgccttcagcttccttgtcggctttgctgtcttcggcactctcggatacatggcctacgccactcaatcggatataagcgacgtggtagcgcagtcggtcggtctggctttcgtggtgtttccgaaggctctgaacatgctgccagcactgaaggtgttcacagcagcggtattcttcctcgcactggtcgttgcagggctttcgtcctccatatcactcgttgaggccgtcagctcggcactgatggacaagttcggcatggagaggagaaaggccgtgaacatcgtcgttttagttggatttctcggaagcatcgtctacacaacgaaggcgggcctttactggctcgacgtcgttgaccacttcatcaactactacggccttgttctggtggggctgctggaggtcatagccgcagcgtggctctttgatttgacagtgctgaagaaccacatcaactctgtttcggagataaaggtcggtatgtggtgggatttggcagtaaagtttgcaacaccgctcatactggcagtgctgctgattctcgacatcagaggaaacctcacggagaactacggcggctatccgacggaagtgctgctgacgggcctttctattatagttctgggcatgattgtggcagcaatactctcatggagggataaaaatgtcagctga

SEQ ID NO: 45083 - DNA, 1218 bp, Archaeoglobus fulgidus
atggagggcttcaggaagattgagtgggcagagcgctacatgaaggttcttggaaagataagggagcagttcaggaaggagagaccgctggagggctttaccgtcggcatggctttgcatgttgaggcgaaaaccgcagttctggttagaactctcgttgatgctggggctgaggtggcgattacgggctgcaatcccatgagcactcaggatgatgtggcagatgctttgagggagagcgggattgcatgctacgcaaagagggggatggatgttgaggagtattacgaggccttgaggaatgttataagggctgaaccggatatagtcatcgacgatggcgcagacctcattttcctccttcacggcgagatggagagctatgctgaaaaggtgaagggggcgagcgaggagacgacgacgggagttataaggctcagggcgatggaaagggagggggtgctgaaattccccgttattgctgtgaatgacgcctacacaaagtacctcttcgataaccgctatggcactggccagtccgccattgatggagttatcagagccacaaacctgctgatggctggaaaaattgttgttgtagctggctacgggtggtgtggtagaggaatagcgatgagagcgaggggaatgggggcaagcgttgttgttacggaggttgatgaaatcagggctcttgaggcggtgatggatggattcagagttatgaggatggaggatgcagcaaaaatcggggatatcttcatcacagctacgggcaacagggacatcatcagggaggagcacataaggctgatgaaggatggggcgattctggcgaatgccggccatttcaacgttgagattgacatcccggcccttgagaggatggcaaaggcgaagagagaggcgagaaagtacgtaacagagtatgatctgggcgataaaagggtttacctgctcgcagagggaaggctggtgaacctcgttgctgccgatggtcatccagtagaggttatggacatgagctttgccaatcaggctttagctgctaaatacattgccgagaactggcagaagctggagaggaaggtttacaggctgcccgaagagcttgacagaatggttgcgagaatgaagcttgagtcgatgggcgttgagattgaccagcttactgaggagcaggtaaggtatctgagcgactggaggtgcgggacatga

SEQ ID NO: 45084 - DNA, 960 bp, Archaeoglobus fulgidus
gtggttaagcttgcctcgaacgagaatccctatgggccgagcccaaaagccatagaagcgttcaggagctactccgacctgcacatctatccgaatccagagtacagggagctgagggagaagatatccgattacactggatgggatgctgatagagttgtggtgggggcaggaattgacggaatccttgaaacgctcttcagaattctcatagacgagggggatgaggtcgtcataccgattccgaccttcccttactaccacattctaacaaagcttagctgcgggaaggaagttctggtgaggagaggcgagaactaccgcattgatgagtccatttttgatgccataactcagaaaaccaaaattatcctcatctgcaatcccaacaatccaacggggaatgcggaggatgctaagctaatagaggagcttgttaactcaaccaatgcccttatcttcctcgatgaggcctacgttgagttttccgatgtatcctttagcgtcgatgcggagaatgttgtaattgcccgaactttctcaaaggccttcgggctggcgaacctgagaattggatatgccttgctacctgaatggctcgttagccccttcagggcggcaatgactcccttccccctctcaactcccgctgcaaaggctgctgaggcggctctcgatgatgtggagtggatgcgaagctgtgtggggagaataaaggcggagagggagaggctgtacaaagagttgaagaagctcgtagaggtaaatctctcacaggcgaacttcctcttctttgagagccccgttgagaatctggcagaggagctgctgaagagaggggttatagtgagggactgcagcagctttgttggttgcggtaaccacatcagagtgactgttggaaggccagaggaaaacgacatgttccttgaggctttgaaagaggtgcttggatgctga

SEQ ID NO: 45085 - DNA, 1206 bp, Archaeoglobus fulgidus
atgggtgaattctccaagtttgagaaactaatagtccttcttgcagccgccataggatggtcacacgatgctgttgggctcacactgcttaacttccttgcagagccaataatgagggagttcaacgtgggtacgcttgaaatcggatttatattctccgcccagtacattttctgcatcttcggagcaatgctttttggggagatgggggacagatttgggaggaaaaatgccctgatattatccatactctgggttgcggttttcagcgttctctcagcctttgcccccaacttctggactctcgcaattcttaggctcatttcgggaatgggcgtgacttgggggcttgcgttcacctacatgagcgagttctactctccaaagagaagggggctgtttggcggtttgattcacgccaccttcgttttcggattcatcctttcagccctctcagtgtccctgatttaccccatttacggctggagagcctgctttttcgtcaccctctatcccattcctttcctgatactctttgccaaatacctgccagaatcgaggatatgggaaaagcacagcgccgagatggataaaagcctgaggctggccgaaattgtgagagagagcaggtatctaaggctactggtgctcgccacattccttttctggctcgcagaattcgcctaccatgcaatagttgactggtcgccaacattcatcataaggcagttcaactaccgccctgaggaggcaagcatgattgttctacgcatttctctcgttgccctcatcgttctcccattcttcggcctcatcagcgattacattggaaggaggtcgagctttgccatctccgcttcaatagggctgcttggctgcttaatgcttgcttacttcactctggtgaactacaatcctggtcttgctcttctttccctcttcgtcatacccatcggcttcggctcccatgcactcttcggagtgtggagcagcgagatgttcccaacaaaggtgagggcaactgccacctctgttattttcagcatagccagaggtctttcggtgggcgggctaattgtgggctacgttgcaaccttctcaagcctgctttacggaatgcttctcggagggattgcgttcttgctgatgtgcatatttccgtggcttcttcccgaaacgaagggaagagagctggaggagttttag

SEQ ID NO: 45086 - DNA, 846 bp, Archaeoglobus fulgidus
gtgaaggtctttgttatcggagcgggactgatggggagagggatagccattgccatcgcttcaaagcatgaggtcgttctgcaggatgtaagcgaaaaagctctcgaagctgcaagagagcagattcctgaagagcttttgagcaagatagagttcacaaccacccttgaaaaggttaaagactgcgacatcgtaatggaggcggtttttgaagaccttaacaccaaggttgaagtgctcagagaggtggagaggctcacaaatgcaccgctctgctccaacacgtcagtcataagcgttgatgatattgcggagaggcttgacagcccttcaagatttctcggcgttcactggatgaatcctccccacgtaatgcccctcgttgaaattgtgatttccagatttacggacagcaaaacagtcgccttcgtggagggctttttgagggagttgggaaaggaggttgttgtctgcaaaggccagtccttggtgaacaggttcaatgcagctgtgcttagcgaagcttcgaggatgattgaggagggtgtgagggcggaggacgttgacagagtctggaagcaccacctcggcctgctctacactctgttcggccctctgggaaaccttgactacatcggcctcgacgttgcctactacgcttccctctacctctacaaaagatttggagatgagaagttcaagccgccagaatggctgcaggagaaaataaagaagggcgaggttggtgtgaaggcgggaaaggggatttatgaatatggccctaaagcctatgaggagagagttgagaggctgaaaaagctgctaaggtttctgggactggaatga

SEQ ID NO: 45087 - DNA, 1116 bp, Archaeoglobus fulgidus
gtgagagttgtttttggatggggaaggctggagagaattgaggaggaggttgagaggcttaagggaggaaaggtggtgtttattgcagacagggcggtgagaaaggccgtagaagagctcaacctcagctttgactacgagattttttcggatgttgagcctgaacccgaaatcggcattgtggatgatatcattgagaaattcagcttcgacacggttgttggcgttggtgggggcagcaccctcgatgttgcgaagctcacggcagttgctgcgggggaaaaagctaaggctgtggagctggtggggaaaaagctgcccgaaaggaagtgcaagctccttctctgccccactacagcaggaaccggctctgaggtgacgaagctagcggttttcaaaatccctaaaagagaagtgaagtacgttttcgatgacgagagcctttatgcggatatagccatcatcgacccgaagctcacactctcctgccctcctcatgtgacagcaagctcagggatagatgctttctgccacgctatcgaagcgtacacgtcccttttctcaaacccaatctccgacatgtttgcggagaaggccattgcaattattccaaaagctctcagggaggcttacgccaatggagagaatgtgagggcaagaacagacatgtcttttgcctccctccttgccggaatcgctttcaactcagcgggcacagggctgggacacgctttggggtatgcgcacaatcacattcacaacagcccccatggcaagagtgttggtataacaatgccctacgttctgcagtacaacgccattgcagaccttgagaagcacgccagaatagcgagggctttgggtgagagtggctcctctttaagagaaactgcactaagagcaggaattggctttgccaaacttctgaaggatttaggaatgccccacaaactgagcgacgttggtgctggagaggatgacattgagaagatagtggacaggattttcttgagcgagaagcacgttcggaggaatccaagagttgtaaggagagaggagatgtatgatgtggtgagaaaatcaatccacggaatccttcgggaagaagagtactga

SEQ ID NO: 45088 - DNA, 1029 bp, Archaeoglobus fulgidus
atgagagatgttgtaagattcatcaacccctacgaccccgggcttttccccgaggattttcccgacaaagaggttgtcaacctttcttcaaacgagaatccttatgagccgagcgaggaggttagggaggcttaccttagggctgtgaaatacattccaagatatcctaaagcggactacgcccggctgaaaaaggcccttgcagaatacacgggctttgaagttgaaaacatagctgtgggatgtggagcatctgagctaatttcctgcatctgcaacgttctgctggaagagctggacagggttgtcattccaatgccctcctacaccctctactccatctatgcaatgttgcggagcgcatccatcagcttcccggtttttgagggatacagggttgatcctgacgtcatcgccgaggaaaggccgaagctcgtttttctctgctctcccaacaacccaacgggcaacagcctgagcagagaaatcgttcagaaggtggctgagagtgcggagtacgttgtgctggatgaggcctatgtggagttcagcgatgattcaaagattgagatggttagggattacaacaacctgattgtgctgagaagcttttccaagtttttcgggcttgcaggaatgagggttggttatgctgtctgcagtgcggagattgctgaggcaattgagaaggtaaggctgccctttggtataagctatcctgcagttgaaacggcaattgccgctttgaggtccttggattactacaaaaaagtaagggacagaatcgtcagggagagggagaggcttattgagaaactgaaagaaattgagtggcttgaagtttacccgtcagatgccaacttcgtgcttgtaaaggcgaacaaggagggcgtggtagagaagctggccgagaaggggtttattgtgagggatgcaagtgttatgggccttgagggtctgtatattcgcattacagtgggtaagcgagaggataatgacaggctgattgaggccctaagagaaatttag

SEQ ID NO: 45089 - DNA, 1614 bp, Archaeoglobus fulgidus
atgagtgaggcatataactaccagcttttgttgaagcacattctcgagagcggtgtgacgtacgctccaaagcaggaaatcgtctacagagatttgaagaggttcacctacagagacatctacgagagagttcacaggctggcaagcgctcttgaggagcttggcgtaaagaagggaacgaaggtggcggttctggactgggacacgaaccgctatctggaatgcttcttcgctatccccatgatgggggcggttttgcatacggtcaacgtcaggttaagccccgaggacatactttacacgatgcagcatgccgaggatgaggtggttctggtttacaaggacttcgtaccgcttatagaatcaattgcggacaagctcgacaccgtgaagaaatatgttgttatgacagacgacacaatgcccgaaacgaagcttactgacgtagagtatgaggagatgctgaagaaggccagccccaactacgacttcccggactttgatgagaacacgatggcaacgctgagctacaccaccggcactacgggaaggccgaagggggtctggttcacgcacagaaagctttttctccacactctcgcaggttgtatagcaatgaccggctacaggtcggttttgaggctgaaggaagatgaggtcgtttacatgcccctcacgccgatgttccacgtccacgcgtggggagtgccctacatgatgtggctgctcggccacaagcacgtctatccgggcaggtacgagcctcagatgattgtcaagctggtcatgactgaaggggtaacttactcccactgcgtgccgacaattctacagatgattgttgacaatctgccagagggcttcaagttccccggctggaagatgattattggaggagctaagctgccgaaaggacttgctctgagggcgagggagaagggcataataaccatggcgggctacggaatgtccgagacctgcccaatattgactggagggttcctcaagcctcacttgctcaacgtcgatgaggaaaccaaggttgagctgtcaatcaagaccggcataccattcccgctggtttatgtcagggtggtgcatgacgatttcactgacgtgaagccggacgagcaggacatgggagaggttgtggtcagagcaccgtggctgactgacagctatctcaaagatccggagaagacaaaggagctctgggagggaggatggttgcacactggagatatagcggtcatggatgaggagggttatatcaccattgtcgacaggctcaaggatgttgtgaagagcggaggagagtggatttccacgctgacactcgaaaacctgctgagcctgcatcccaaagtgagggaggttgcagttatcggcatcccggatgagaagtggggtgagagaccgctcgccatcatcgtcccaatgcccggagagaagccgactcctgaagagctgagagctcacctcatgaagtttgtcgaagagggcaagattaccaagtgggctgtgcctgacagattcgaaatagtcgatgagataccgaagacgagcgtcggcaagatagacaagaaggtcctgaagcagatgtactcccgctaa

SEQ ID NO: 45090 - DNA, 1230 bp, Archaeoglobus fulgidus
gtgagactgctgaggcagcatcgcaatataatggtgaaaaggcaaatattaaattttcctgttgggagaggcttcatggacttcgagcttacacaagagcagaaggatattaaaaacgctgccagagaattcgccgtaaatgagtttacaaaggagagggccgaggaatacgacagaaatgaggagtttcccttcgatttgtggaaaaaggcgtgcgaactcggcttcataggcgtgcacttccccgaagagtacggcggagcgggaatgggtgttctcgaaaacatactcatcgtagaggagttctgcagggcggacagcacaatcgggagtgccataatcctctctgacttctcttcagaggttgtaatgaggttcggcagtgaggagcagaaaaaggaggttctgccgaaggtggcgggtggtaaagctatcaccgccggatgctacaccgagcctgaggcgggtagcgatttgacggcaatcaaaaccaaagctgaaaaagatggagatgagtgggttattaacggctccaagaccttcatcacaaatggcaccatcgcggactactacgttgtgctggcagtaactgatccaaacgcgcagccacgctacagaggatttaccaccttccttgttaagaaagacactcctggactgaagacaacaaaaattggaggaaagctgggtataagggcctcgccgactgctgaagtcgtattcaaggacgtgagggttgatgattcagcggttatagggcagctcaacagaggattctaccaggttctcgagttcttcgatgagagcaggattgagattgccgctcaggctctgggaattgcccagggtgctttcgacaggcttgtcaactacgtaaagcagaggaagcagttcgggcagccgattgctgcgttccaggctttgcagcacagaatcgctgacctgaaaacgcagcttgaggctgcgagattgctgatatacaaggcagcgtggaactacgaccagggcagaatcgatcccgggctaacctctatggcgaagtactacgcaggaaagcttgccgtcaagatctgcgatgaggcggtgcagatgcacggaggctacggatacattgcagagtacgaggtggagaggttcttcagggatgccaagattaccgaaatatacgaggggacgaaggaagtgcagctaaacacgattgcgagagacattctcggcaagttcagatag

SEQ ID NO: 45091 - DNA, 960 bp, Archaeoglobus fulgidus
atggagaacttcgaaatctgggttgagaagtaccgcccgcgcactcttgatgaagtcgtggggcaggatgaagttatacagaggcttaaagggtatgttgaaagaaaaaatatacctcacctcctcttttccggacctcctggaactggtaagacggcaacagcaatagctctggcgagggacctgttcggggaaaactggagggacaactttatagagatgaacgcgagtgatgagaggggaattgatgttgtaaggcacaaaatcaaggaattcgcgagaacggcccccataggaggcgctcccttcaagataatcttcctcgacgaggctgatgcactaactgccgacgctcaagcagccttgagaagaacaatggaaatgtactcaaaatcctgccgttttattttgagctgcaactacgttagcaggataattgagcccattcagagcagatgtgcggttttcagattcaagccggtgcccaaggaggcgatgaagaaaaggctgcttgaaatttgcgagaaagagggtgtgaagattacagaggacgggcttgaggctctgatatacatctcaggaggggacttcagaaaggccataaacgcccttcagggtgcagcagcaattggggaggttgttgatgcggatacgatataccagataaccgcaacagcaaggcctgaggagatgacggagttaatccagacggcgttgaagggtaacttcatggaggcgagagagctgttggacaggctgatggtggagtacgggatgagcggtgaggatatagttgcgcagcttttcagagagataatttcgatgcccataaaggacagcctgaaggttcagcttatcgacaagcttggagaggtggatttcaggctgacggagggggcgaacgagaggattcagcttgatgcctatcttgcgtacctctccactttggccaagaagtga

SEQ ID NO: 45092 - DNA, 999 bp, Archaeoglobus fulgidus
atgaaggttggaataattggagcgagcggatacacgggctccgaactcctcaggattctcgctaaccaccccgaggcggaggtgatagcagcatcatccagaaggtatgaggggcagaagatatggaaggttcatcgctttctgaagggattttacgaccttgagttctgcagccctgagctgagcaatttcggtgattgcgatttggtttttacagccgtccctcacggagaggcgatgaagtacgtcccccagcttcttgacagcgggataaaggttgtggacatctccgcagactacaggctggataaggagacctacgaaagagtctatggaaaaaagcatgagggttatgtagaagcggtgtatggtttgacggagctgcatagagaggaaatcaaaaaggcaaatcttgtggcaaatcccggctgctaccccactggcacaatcctcgcagcatcacccctcgcaaagcttgagctgattgagagggttgtttttgactgtaagagcgggataacgggagctggagagtctccctccgccttcacgcactaccccaacctgcacgagtcaatagtgccctacaaaatcacagagcaccgccactactacgagatggttcaggaattgggcaggtttcagagcgacatcaaaatctccttcaccccccaagtctatcccggctcaaggggtattttgaccaacgcccacgtctttctgaggggagagcttacaagggaggagctttacagaatctacgaggaattctacgaagacagcttctttgtcagaattcaggagagtgtctccctcagtcaggtgagggggagcaacttctgcgacatctccatccatcccggagaagacagggttgtagttgtttccgcaatcgacaacctcgtgaagggggcttcggggcaggcggttcagaacatgaacctgatgatggggttcgacgaaacccttggactcagaactccaccactcttcccatga

SEQ ID NO: 45093 - DNA, 2436 bp, Archaeoglobus fulgidus
atgggtgataatatggaaatcacgctaaaggtaaatcaggcgtatccgagtgattcaggaagaggaatagcaagattggacccggacacaatgttaaagcttcaaatctcccccggagacataatagaaatagagggggccagaaagaccgttgcaaaggtctggagagctccgaagagggactgggggaagaacatcataaggattgacagattcataagggagaatgccggagttggtgttggggatgtcgtcaaggttaggaaggttgagtaccagcccgcaaaaaccgtaatcctcgcccccctcaagaagatggatttgaggatttacggagtcgatattggggagtatctcaagcaccagtttctgaaaagaccggttgttgaaggagatttagtccctctcgttggctctccggccctttcgggatttggaaggtacaaccagcagaaccaagctgtggttttcgttgcagtcaagaccgagcccaagggccctgtggtcatcgacgagacaaccaaggtcgtttacagggacagaccggcaaagggcttcgagaggttcggaaaggccggaatcacttacgaagacataggaggtttaaaagaggagcttcagaaggtaagagaggtcatagagctgcctttaaggtatccggagctcttccagaggctcggaatcgagccgccgaagggtgtgctgctctacggtccgccgggaactggaaaaacgttgattgccaaagctgtggcgaacgagatcggggccagcttcttcaccatcaacggtccggaaatcatgagcaagttctatggagaaagcgagcaaaggctgagggagatttttgaagaggcgaaggagaacgctccgtcgataatcttcatagacgaaatcgactcaatcgctcctaagagagaagaggtcaccggagaagttgagagaagagtcgtcgctcagcttctgactctgatggacgggcttgaggagagagggcaggttatagtcatcggcgcaacgaacagaattgacgctgtcgatccagcgttgagaaggccgggaaggttcgacagggagattgagatcggagtgccggacagagagggcagatacgagatattccagatacacacgaggaacatgccactggaggctaagtacagcagagagttcgtcctcgatgcgattgagagattcaagaggcaggttgacgaccctgagctgataaagaatctcgatttcctctacgacgagataaagaactcagagacggaggaggaagtgaaaggagctgtgaaaaatctcctcccgcaggaagtaatcgacgagcttgaagttgagataactaaggcgatgctccgcagccttgctgatcaaacccacggatttgttggggcagacatagaggctctctgcaaggaggctgcaatgaaggctcttaggaggtacctgccgcagattgacctcaacgaggacgagattccgatagagctgctcgaatcgatcagagtgacatgggacgacttcatggatgctctcagagaaattgagccctctgcgatgagggaagttttcgttgagatacccaaggtcacctggaacgacgttggagggcttgaggacgttaagagggagataattgaggctgtggagtggccgctgaagtaccctgagaagttcaagaagttcggaattaagccgccgaaaggtgtgctgctctacggtccgccgggaactggtaaaacgctgattgccaaagctgttgccaacgaaagtgaggcgaacttcataagcatcaagggagggcagattctaagcaagtggctcggagagagtgagaaggctgtgaggaagatattcaggaaggcgaggcaggttgcaccctgtataatcttcttcgacgaaatcgatgcaatagcccaaatgagaggcatagacgaaggaagtagagcagttgagagggtgctcaaccagcttctgactgagatggacggtctcgaggagttgcacggagttgtagttattggcgcaaccaaccgcccggacattctcgaccccgcattgctcaggccgggcagattcgacagaatggtttacgtccgcccaccggacaaaaagagcagactggcaatattcaagattcacacgagggacatgcccctctccgaagacgttgacctcgaggagcttgctgatttgaccgaagggtacgttggagcggacatcgaggcgatttgcagagaggctgtgatgctggcaatcagggaaaacatcaacgcggagaaggtggagatgaggcacttccttgaggctctgaagaagataaagccgagcgtcaacgaggccatgctgaacttctacgagagattcgaggagaaaatgaggaccgagagaatgcaggttgcagcaacaaagcccttcatgggctacggttaa

SEQ ID NO: 45094 - DNA, 1209 bp, Archaeoglobus fulgidus
atgagggctctggttgttgagttaaggctttggaaagcagcactgagcctgctgctggggaaggttacgaaaagcgtttactacagccccctatcgttgctgaaatactacaaaaactaccctgaacctgcgctgcccgacgaggactgggtcaaggtaaagacgaggctctgcgggatttgcgggtcagacctcagaatcataactcttcaggagagcttctatttagccccgctgacatccttccccttcatcccgggccatgaggtggtaggagaggttgttgaggtggggaaggaggcagatgcacaggaaggggagagggttgtcatcaatacagccctttcctgcagagttagaggatttgatgactgcgatgcgtgcagaaaaggccattttgccgcctgccataatgtggataggggcagaatctctcccggcatattcacgggaacgtgcagggatacaggaggagggtgggcagagtactttgtggcccacgaatctcagcttgttagagtgccagaggggattagggatgaaaacgctgtgttcgctgagccgctcaccataggaatccactcagccctgagaagctttcccgatgatggagaggttgtcgcaattgtgggttgtggtgttatcggcatctgcaccatcatcgccctgagacaccttggcttcaggggtgaaatcatcgggattgatataagtgaaagacaggccgagctggcaagaaaatttggagctgatggggtggtaactgaaaatcccgtagagaggattgccgagatgacgggtggaagagtttaccgcccgccgagggacaaaccaatgttcattggtggtggggttgatgtggcctttgagtgcaccggaattccccagaccgtggatacagccctgagaataaccaagcctcttggcagagttgtgattgcgggaaccgtagccaagatgggcgtggactgggctcctgtatttgcgaaagagctgagcgtgttgggaacttttggatgcggaattgaggaggttaatggggagaaaagggatgccttcgacatagcctttgaaatcctcaaaaaagttgacctctcttctctgcttacccacagattcaccatcgaggactacaagaaagctctgagggctgcgattgaaaaagggaaaagtggggcggtgaaggtggcctttgattttactctttga

SEQ ID NO: 45095 - DNA, 1140 bp, Archaeoglobus fulgidus
atgatgcagaggggagctaacaggattgaggtagtccagccttcagccacgctaagagtttcaacgatggcaaaggagctgaagagagagggcaaggacgtagtggacatgagcgttggggagccagacttccccacgcccgattttatcattgaagctgcttacaaagcaatgaaggagggcaaggttttctacactcccacaaagggcgttcctgagctcattgatgccatcgttgagaagctgaggaacgagaacggcattgatgttggagcagagaacataatcgtcacgccgggggcaaagtatgcgattttcgaggcgatgatgtgtttgctgcaggaaggggatgaggtaatactcctcgacccctcgtgggttagctatgaggcgtgcattctgatggcgggagcaaagcccgtctgggttccccacgaggagggctttgaggatgcccccattgaggactacataacgtcaaacacgaaaatgattgttgtgaatactcccagcaacccgctcggcgttgtgtatcccaaggagtttctgaagaaggtaagggacttggcggtggacaaggatatcctcgtgatgagcgatgagatttacgagaagataatcttcgagggcgagcattacagcctcgctgcaatggacgggatgcttgaaaggacaataacaatcaacggcttctccaagacctactccatgacaggctggaggttggggtatgctgcagcgccggagtggataatcaagctcatgaaccgcatgcagagccattctgtcagccatcccacatctttcgttcagtatgctggagttgcagccctcaaaggagaccagagcttcataaaggagattgttgaagagttcagggcgagaagggacatgataatggccaagcttgacgaaatgggtatagagtatgctccacctaagggggccttctacatcttcatgaatgttggcagggacagcaacgagttctgcgaggagtttttgaagagggaatatgtggctctaactcccggctcagcctttggcgttgcctacaaaagctgggtcaggctgagctacgcaacttcgagggagaggattggagagtttctgagcaggctggagaggtttttgggttaa

SEQ ID NO: 45096 - DNA, 1068 bp, Archaeoglobus fulgidus
atggggccaatgagcatagagcagcaaatcagggaacttgaggaagagataaagagaacaccctacaacaaggcaacggagcaccacataggaaggctgaaggccaagcttgcgaggctgagggaagaggcagaaaagcagaaggcaaaagcggcaagacaggctttttcgctcaaaaaagagggtgatgcgaccgcggttttgataggctacccctcggttggaaaatcaacgctgctcaacaagcttaccggggcgaagagcgaggttgcggactacgacttcacaactctaaagcccgttccgggaattttgaactacaaaggagcctcgattcagattattgacgttcccggaataatcgagggtgctgcaagcggcagagggaggggaaaggaggtaatctcagccgtcagggttgctgatttaataatcatcgtagcagacgtattcaacctccacaccatcgacatagtcaagagggagctttacgagggcggtataaggcttgatcaaaagcctccggacgttgtaatcaggaagaaggagagaggaggagtgagaataagctctacagttcccctctcgattgatgaagctacgataaccagtgttctcaaggagtacaaaattcacagtgctgatgttgtgataagggaggatattacgatagaaaggctgattgatgctctcgcgggtaacagggtgtacattccttcccttactgtcgtaaacaaaatcgacctgatggatgtggatgttgcggatgccatcaaagtctcagccgagaaggggataaatcttgacttgctgaaggagcagatttacaggaagcttgaattcatcagggtttacctcaaacctcccggtgggaaggtggatttcagcgagcctatgattttgaggagaggtgcaaccgttgaggatatatgcaggaagctccaccgcgattttgtggagaacttccgctacgcgaaggtttgggggaaatccgtgaagtttgacgggcagagggtaggattggagcacgtcgtcgaggatggggatatcataacaatctacgcatag

SEQ ID NO: 45097 - DNA, 864 bp, Archaeoglobus fulgidus
atggcaattatcgttgatgaaagaacgaaggtggtagttcagggaataactggctatcaaggcaagtttcacacggagagaatgctcaactacggcacaaaaattgttgccggagttactcccggaaagggcgggacggaagtccttggggtgccggtctatgactctgttaaggaggcagtgagggaggctgacgcaaacgcatccgtaatcttcgttcccgctcccttcgctgctgatgccgtgatggaggcggctgatgctggcatcaaagttattgtgtgcataacggaaggcattcccgttcacgatgagctgaaaatgtactggagggtgaaagaggcgggagcgacgctaataggccccaactgccccggaatcataagccccggcaaaacgcacctcggcataatgcccgttcagattttcaagccggggaatgttgggattgtgtcaagaagcggcactctgacgtatcagattgcctacaacctcacaaagctcggattgggtcagtcaacggttgttggaataggaggagacaggataataggcacggactttgtggaggtgctaaggctctttgaggatgacaaggaaaccaaggctgttgttttggtgggtgagattggaggcagggatgaggaggttgcggcagagtttatcagagaaatgtcgaagccggttgtaggctacgttgcaggcttaaccgccccacccggaaagagaatggggcatgcgggggcgataattgaagggggagttggaacggcggagtcgaagattaaagcacttgaagctgcgggagcgagagtggggaagacgccgatggaggtggctgagctggttgcggaaattctatga

SEQ ID NO: 45098 - DNA, 1143 bp, Archaeoglobus fulgidus
atgagacttcacgaatatcaggcgaagcagattttctccaagcacggaataagagttgcaagaggagagctggcaacctctgtcgaggatgttagggggattgctgaggagctagggggcaaggtggtactgaaatctcaggttcttgttggcgggaggggaaaggcaggtggtataaagaaggcctacagcgttgaagaggccgttgaaaaggctaaggaaatgtttggttccgtattaaaaggccacatagttgagaaaatctacgtggaggaaatgattgaagttcagcgagaaatgtatgccgggctaacaattgatagagccaataaaggtatcgcggcaattctgagttctgtgggtggtatggatattgaggaaattgccgtcaagcatcctgagaaaatagccaggatcgctgtgaatccgaagtgggggctctgggattatcagataagggagcttttgctgaattcgcaaatgccgagggagtactggaaggaggtcgcttcaatcctcaaaaccctctaccggattatggttcactacgaggctgagcttgtcgaaatcaacccccttgttgttacacctgatggacttgttgctgcggatgcgaggcttaacattgacgacagtgcacttttcaggcacagggatttggagaaactgagggattataccgaagctgaccagatggagagaatcgcaatggaaaaggggctgaattacgtcaagcttgatgggaacgttggcgtgcttgcaaacggtgccgggatggccatggcaaccatggacctgatatacatttacggtggcaagccggcgaacttcctcgacataggaggtggagcctctgcagaggttgtgagggaggccattaacctaattctcagcgacaagaatgttaaggtggtcttcatcaacatcttcggcgggataacgaggtgcgatgaagttgcgaaggggcttaaagaggctttggcagacgtatcaactccggtggttgtgagactcgcaggcacaaacgaggaggaggggaggaaaatcatggatgagtttgcaaaggataggccaaacttccacattgtcgagacgatggaggaaggggcggagaaggccgtaaagcttgctgaggaggtgtga

SEQ ID NO: 45099 - DNA, 1251 bp, Archaeoglobus fulgidus
atgggcaaaactattgcagaaaaaatactcagcgaaaaatcgaagagtgacgcttacgccggtgacattgttgttgccgagattgaccagatagccctgcaggacggcacggctcctctggcaataaggcagctgatggagctcggaacggaggttagagcagcagacaggacacactttttcgttgaccacgccgctccctcgccaagaagggagctgagcaacgaccagaagttcatctacgagtttgcaaaaaaggttggggcggacttcaacccgcccggagaggggataatccaccagattatggtagagcggtacgtcaagcccggagatttggccgttggggctgacagccacacatgcacctacggaggaattggagctttctccacgggaatgggttctactgatgttgcagttgccatcgcactcggcaagaactggttcagagttcctgagagcttcagagttcagcttgacggctctctccccaaaggagttttcgccaaggatgtgatactgaagctcataggtgatcttggtgttgacggagcaacctacaaggcccttgagttccacggggagtgtgctgagaacatgactgtggaggagaggctcacaatagccaatatggcggtagagtgcggagccaaagcgggaattttcgagagcgatgagaacacgaggaaattcctcgccgagcttgggagggagggggatttcagagaggtaaaggcggatgaggatgcagagtatgaaaaggagatttacatggacgtttcctccctcgttccggttgtctcaaagccccacaacgttgacaatgttgcagagattagcgaggttgagggcacggaggtaaatcaggtttacatcggaacatgcacaaacggcaggctttctgacttagaggttgctgcaagaatcctgaagggcaggaaggttaaggagggtgttaggctgattgttgtccctgcaagcaggagagtctatctgcaggccctcgataaggggctgataagagttttcgttgaggctggaggaatggttctcaaccccggctgcgggccgtgtgtgggaatccatcagggaattctggctgatggcgaggtttgcatctccactcaaaacagaaacttcaagggcagaatgggcaatccgaacgcggaaattttccttgcctcaccagctacagctgcagcaagtgctgttaagggatacatagcagacccgagggagttcctgtga

SEQ ID NO: 45100 - DNA, 2226 bp, Archaeoglobus fulgidus
atgatgagacagggtggtgttatggttggagcaaggaaaaggtggattacggactggtggcccaacaggctgaacctgaaaattctgagacagaacctccagaatccctacggggaggattacgattacgtcgaggaggttgagaatctcgatatcgatgctgtcatcagggatttgaaggagctgatgagaagctctcaggactggtggccggctgacttcggccattacggccctttgttcatccgccttgcgtggcatagcgcgggcagctaccgcatttttgatggcagaggtggggcgagggacgggagcatccgctttccgccccgcataaactggccggacaacataaacctcgacaaggcgataaggctgctctggccgataaagaagaagtacggcagaaagctgtcttgggcggatctgattatccttgcgggcacagttgcaatggaggacatgggagtgaagcttttcggcttcgcactgggcagggaggacatctttgagcctgacgagagccccgactgggggccggaggaggagatgcttacagcaaagagaggggagaaggaggagcttgagagaccttttgcagctaccgagatgggcctgatttacgtaaaccctgaagggcccggcggaaatccagatccgcttggctcggctcaggagattagggttgccttccgcaggatggggatgaacgacgaggagactgtagcacttatcgccggagggcatgccttcggaaagtgtcatggcgctggacccgctgattatcttgggccagacccaagctcctctcccattgaaatgcaggggctcggatggaagtacaactacggcaagggaaagggctctgacaccttcacttctggtcttgaggttacttggtcgcccacgcccacaaagttcggcataaactacctcagaattctcttcacctacgagtgggagctggagaagagcccagcagggaaaaaccagtgggttgccaaggacgctccagaaatcattcccgatgctcatgatccaaacaaaaagcacaggccgagaatgctaaccgctgacttagccctccgcttcgacccagagttctcgaaaattgcgaggagatttctcgaaaatcctgaggaatttgaaaaggcattcgccatcgcgtggtacaagctcacccacagagacatgggtccaaaggactgctacattggcaagtacgtgccggaggagacctttgtgtggcaggacccgttgccaaggagagattacgagctcgttgacgaaaaggacgtggaggagctgaagaggaggattcttgcgtcggggctcagcttaagccagctcgtttactttgcgtgggcctcagcatcaacctaccgcaactcggacaggagaggaggggccaacggggcgagaatcaggcttaagccgatgagtgtgtgggaggtaaaccatccggaagagcttaagaaggttattgctgcatacgagaaaattcagcaggagttcaacgagggggcgaaggggagtgagaagagaatttcaatcgccgacctcattgtccttggaggtattgcagctgttgaggaggcggcaaggagggcgggattcagcgttaaggttccattcattcccggcagagtggatgcgcagcaagagcacgttgacgaggaattctacagagtcattgagcccttcgccgatggcttcaggaactacttcaggtatccagagagaatcaatgaaagggacgtttacacaactcccgagtacttcctcgtcgataaggcgaacctgctaaccctcacagttcccgaaatggtggtgctgattgggggtatgagggctcttggagcaaactacagccactctgactacggtgtccttaccgaaaggcccggagtgctgagcaacgacttcttcgtcaaccttctggacatgtccgtagagtggagggctgctgacgactacaggtacaccttcgaaggctacgataggaagagcggagagctgaggtggagggcaacgagggttgatttaatcttaggccatcacgacgagctgagggctgtggcagaggtttacggttgcgatgatgcaaaggagaagttcgtgaaggacttcgctgcagtgtgtgcaaaggttatgcacctcgaccgctttgatttgtggagaagcaacaggaagctgtataaggagataaccgcaggtttgaggtga

SEQ ID NO: 45101 - DNA, 1638 bp, Archaeoglobus fulgidus
atggccacactgcaggggacaccggttttgatactgaaggagggaactcagagaaccgttggaagagatgcccagaggatgaacataatggccgctcgtgtgattgccgaggcagtgaagagcacccttgggccgaagggaatggacaaaatgctcgttgacagccttggagatgtggtgattacaaacgatggtgtgacaatccttaaggagatggacgttgagcatccagcagcgaagatgatcattgaggttgcaaagacccaggacaatgaggtcggtgacggcaccacaactgctgtagttcttgcgggagagctgctgaagaaggcagaggagcttcttgatcaggacattcatccgacggtgattgccagaggttacagaatggccgcaaacaaggcggttgagattctggagagcatagcaatggacatcgacgttgaggacgaggagaccctcaagaagattgccgcaactgccataactggaaagcactcagaatatgcgctggaccacctgagcagcctcgttgttgaggctgtgaagagggttgcagagaaggtcgatgaccgctacaaggttgacgaggacaacataaagctggagaagaggcagggaggcagtgttgcagacacaaagctcgttaacggcatcgtcatcgacaaggaggtagtgcatccgggaatgcccaagagagtgaagaatgcgaaaattgcagttctgaaggctgcccttgaggtcaaggagaccgagacggatgctgaaatcagaatcaccgacccagaccagctgatgaagttcatcgagcaggaggagaagatgctcaaagagatggtcgacaggcttgcagaggctggagccaacgttgtcttctgccagaagggcattgatgaccttgcccagtactacctcgcaaaggctggaatccttgcagtgaggagagtcaagcagagcgatatcgagaagattgcaaaggcgtgtggagcgaaaatcataaccgacctgagggagataacctcagcagatctcggagaagcggagcttgttgaggagaggaaggttggcgacgagaagatggtcttcatcgagggctgcaagaaccccaaggccgtgacgatactgatcaggggcggcagcgagcacgttgtggatgaggtcgagaggagcttgcaggatgccatcaaggtcgtcaagaccgccctcgagagcggtaaggtcgttgctggtggtggagcacctgaaatagaggttgccctcaagataagagactgggcaccaacgcttggcggaagagagcagctggcagctgaggcctttgcatcagccttagaggttattccaagggccctcgccgagaactcagggcttgacccaatcgacattcttgtcgagctgagaaaggcccatgaagagggcaagaccacctacggtgtggatgtgttcagcggagaagtagcctgcatgaaggagaggggagtccttgagccgctgaaggtcaagactcaggcaatcacaagcgctacagaagtggcaataatgattctgagaatcgacgacgtcattgctgcaaagggactggagaaggagaagggaccagagggagagagcggaggagaggaggattctgaagaataa

SEQ ID NO: 45102 - DNA, 1335 bp, Archaeoglobus fulgidus
atgatagttcaccccatcgattaccgctacggcacccccgaaatgaagaggatttggagcgaggatagcaagatcaagaggatggtaagggttgaaatggctcttctacgcgctcttgcaaaaaaaggatacctcagcgaagaggaggccaaagaggccaaaaagaaggcttacagcgtaacaccagagagagtgaaggaaattgaggcagagataaagcacgacataatggcgctggtaaaggccattaccgaggccaccggatgcaggtgggttcacttcggagccacatcaaacgacataatcgacacagcaacggctttgcagctaagggacagtttgaaaatcctcgaggttaaaataaagcgccttgcgaaggttcttgcggacaaagccttagaatataaggacgtggtctgcctcggcagaactcacggtcaggcggctttgcccacaacctacggcttcagattcgccctgtgggcggctgaggttgcaaggcactacatcaggctgcagcagatgaaggacaggcttctcgtagggcagatgagcggggcagtgggaacacaggccgccttcggcaaagacggcttcgagatagaggaggaggttatgaggctgctgaaccttaaaccggctctgatttcaagccagataatacccagggactcctactgcgagtacctcgagtttctcgcaaatcttgctgcaacactcgaaaagattgctctgaacttcagactccttcaaagagctgaagttggagagttgatggaaaaattcgaggccaagcaggtcggaagctccacgatgccccacaaaaggaacccaatagactgcgagaatgtttgcggcttggcgagggtcgtgagggggttcgtggagcctcagcaccagtcggcaattctgtgggaggagagagaccttacaaactcctcggcggagaggataacccttgttgagtcaacggttctggcggaccacattctaacgaagatgataaaggttgtttccagcgttagtctcaacctcgagaacatcaggaggaatcttgagatgcagagggggctcaacctgagcgaggcggtgatgatagagatgacgaaaagaggggtggggaggcaggaggcgcacgagattctcaggcaggcggcgatgagggcttacgagaacaattcatcgcttcttgacgagcttttgaaagacgagagagttatgaagtacttcaaagaggatgagcttagggagattctgaaacctgaaaattatctggggactgcaagggaaagggtcgagagggttgtgagatgggtgaacgaggtgttgaaatga

SEQ ID NO: 45103 - DNA, 1245 bp, Archaeoglobus fulgidus
atggaggaagtatatatagttgattttctgaggtctgcattctcgaggagcaggccaaagcagccggagaaggacgttttcaacaaaatagacatgcctgcagtggctgcgatgctgataaaggagatggtgaacaggacgggcatcgatccaaaggagattggcgacgtcatcacaggatgcacaatgcagatgaaggagaactggctttacggcggtaaggttgtccctcttctcgctgaactgcccgtagaagttcctgcgcacggcgttgagagggtctgcaactcctcaacgacagcagttcaccacggaacaatggaaatcatgctcggctactctgacatcgtaattgcatgcggtttcgagcacatgacccacttgccaatgcagatggacctcaacccgcacatcggcatctcacccactctgatgtcccgcacggatttgattcagaaatatgatttaatgacggccatgagcatgggtctcacagcggagaagctcttcgaggttgcgaaggacgagatgggatggacgaagagagatctggatgagtggggtgtcaggagccacaagcttgcagctcaggcagtcaaagagggctggttccttgagggagagggctacccgatgaagtggaagggagagattctccccattgaggtggagcaggcagacggaagcaagaaggtcatagacgttgaccagtcaataaggcctgacacaacgcttgagcaggtggagaagctcccaccagccttcaagccgggaggtgttatcactgccggaaactcctctccgctcaatgcaggtgctacagcacttatgctgatgagcaagaagaagatgaaggaatatggccttgagccgatggcaaaaatcgtttcaatgggctgggcttcaatcgacccgagcatcatgggcgcaagccccgttcccgcaagcctgaaggcattgcagaaggctgggcttgaggcgaaggacatagactactgggagataaacgaggccttttctgttgttccgctctacaccataaagaagctcggcctcgaccccgagagggtgaacatcaagggaggagcaattgccataggccacccgctcggagcgagcggtggaagagttctcggcaccctcgcaagaatcctcctcgttcaggaggccaagtacggctgtgccacgctctgtggtgcaggcggacagggtggagccaccatcatcgagaacccgtatatctaa

SEQ ID NO: 45104 - DNA, 1209 bp, Archaeoglobus fulgidus
atgaggtggttaaaaatgctcgcggatttcatcctgacggaagaccagaaggcaattaaggaggcagcaagagagttcgcggagaaggagtttccaaattacgttgaagagtgcgacagggaggagaagttcccctttgagctttggaagaaggctgcccagctcggattcatcggaatggcgattccagagcagtacggagggcagggcttaggagtgctggactcctgcctcgttgtcgaggagttctggagggttgacggcgggcttggaatgattctcgccacaacattcggctcagagcagatcatagccttcggcaacgaggagcagaagaagaagtacctgccaccgctcgcaaagggagagaaaatctgcgccgcctgctacacagaacctcaggcggggagcgatgttgcgggaattaaaacaagggctgacaaggatggagatgagtacgtaatcaacggaacgaagatgttcatcacaaacggcagcattgcagactactacatagttctggcgagaactgatccaaatccgccgaagagacatcatggcatgtcggtgttcttggtcgagagggacatgccaggtgtgcaggcgaacaagctgaagaacaagcttggtattagggcgagcgatacggccgaggtcgtcttcaagaacgtcagagtgccgaaggaaaacctcatcggtcaggaggggcagggattctaccagacgatgatgttcttcaacatcacaagaatccctgttgcgttccaggctcttgggctggctcagggggcatttgagcttgcgtaccactacgccagaaacagggaggttttcgagaggaagcttgcagacttccaggttacgcaggagaagcttgcgaagatgaggacggagcttgaggctgcccgcttactggcatatcaggctgcctacttccaggacaagatggggatgccagatccgggattgacggcgatggcgaagtactacacggccaaggccgcgcagttcattgttaatgaggctttgcagatacacggaggttacggatttatgggagagcagcacataagcaggatgtacagggacgttagaattctggagatctacgagggtacaagggaaatagagatggaagttattgccaggtcgctgctcggaaagataccctcaagactcggagttgtgaggaaacatcctctacagtaa

SEQ ID NO: 45105 - DNA, 1173 bp, Archaeoglobus fulgidus
atgaaggttgtgctgtcatattccggtgggcttgatacgacggtctgcatccctctgcttaaagagaagtacggttttgatgaggttatcacggtcaccgttgacatagggcagcctgaagcggatataaagcaggcagaggagaggggaaagaagtatgcggacaagcactacacaatcgatgcgaaaaaggagtttgttgattccctcttcatgctgatcaaggctaacggcaattacgaaggttacgttttgggaacggctttggctaggccgctgatagccgaaaaggttgttgaagtcgccaagaaggagggggctgaggcggttgctcatggatgcacggggaagggaaacgaccagctcagattcgagaacattttcaggcagcacggatttaaggtcatcgcccccgtgagagagctgaacctcacgagagagtgggaaatcgaatacgcgaggcagcacggcattgaggtgcccgcaacaaaggagaagccgtacagcatcgacgagaatctctggagcaggagcgttgagggagggaagctggaagatccatccttcgagccgcctgaggacatctacgagtggacagcgagcccggaaaaggctccagacaagccagagatcgtaaagatagatttcgagaagggagttcctgtagcgctgaacgatgagagaatgggcggatttgagctgataaaagcccttaacgagattggcggaaagcacggagtgggaagaacggacatgattgaggacagggttctcggactgaaggcgagggagaactacgagcatcctgcagccacaatccttataacagcccacagggaccttgaaaacctcgtcctcagcagaagggagctgaagttcaagaagttcgttgaggaggagtgggcggagcttgtttactatggcctggtcaacgacccgcttttcgacgctctgaacgccttcatagacaagacacaggagagggtgacggggtgggttaaagttaagctttacaagggctccgcagttgttgtggccagaaactcaccctacgccctttactcggaagagctcgtctccttcgacacggagtccattgaccagcgccttgctgagggatttgcggcattccacggtctgcagggcaggctgttcaggaggctgtttcaataa

SEQ ID NO: 45106 - DNA, 1107 bp, Archaeoglobus fulgidus
ttgaaagaggtgaataaagtggaatttgaagatttgggaatctcagaaaacggtttgaatgcagttagaagaaagggttttgagaagcctacggaaattcagagggaaatcataccgaggtttttcgaaggtgaaaaggatatggtcggccaggcacagacgggctcggggaaaacagctgcctttgccctgccaattctcgaccttgtggatgaaagaagcaaggatgtgcaggccatagtaataacgcccacaagggagctggctttgcaggtaaaggacgagattgagtcgctcagagggggcaaaaaggttcacgtcctcgctgtttacggcgggcagcccatattccctcaaattgagaggctgaggaagggcgtgcagatagtcgtgggcacaccgggaagagttatcgaccaccttgagaggagaacgctttcgctcgaaaaagttcggttcttcgtgcttgacgaggcggacaggatgctcgacatgggcttcattgacgacattgagaggatcctcagacacgcaggcgcggaaaggcgtgttctgatgttctccgcaaccatgccccctgaagttttgaggctggcgaggcgttacatgagagattacgaggttgtgagagttcacagcaaaatcactcccgaaaacgtcgagcacagatgtctgaaggttaacccggaaaagaggttcgagcatctctgcagaattctcgacgagaacaacttttacggcatcgttttctgccagacgaaaaaagagacaagagaacttggaagaaggcttagagcgaggggatataaggcagatgcgctgaacggagacattccacagcataaaagagagagcatccttagaaatttcagaaaaggatacaccagagttcttgtcgcaacagatgttgccgcaaggggaattgacgtgaaagacctcacccacgtcgtcaactactctatcccgcaggatccagaagcatatatccacagaaccggaagaaccggcagagagggaaagaggggtaaggccataaccttcgttgctccctgggagtcgaggaagctgaaaataatagagaggactgcgaaggtccggtttaggtaa

SEQ ID NO: 45107 - DNA, 2007 bp, Archaeoglobus fulgidus
gtgccacggagagtgaagcaggtgattaatatggatgtaagggagagaataaaaaccgttgcagttctcggtgccgggctgatgggacacggaattgctgaagtctgcgcgatggcgggctacaacgtgacaatgagggacatcaagcaggagtttgttgacagaggaatgaacatgataaaggagagccttgcgaagctcgagcagaagggcaaaataaagagcgccgaagaagtcctttccagaataaagccaacagtagatctggaggaggctgttaaggatgccgacttggttatagaggcagttccagaagtggttgaaatcaagaagcaggtctgggaggaggttgacaagctggcaaagccggactgcatcttcacctccaacacctcaacaatgagaataaccatgctcgcagacttcacctcaaggccggagaagtttgcaggcctgcacttcttcaacccgccagtcttgatgaggctggttgaggttataaggggagagaagaccagcgacgaggtaatggatttgcttgttgagttcgtgaagagcattggtaagacgcctgtgagagtggagaaggacgtgccagggttcatagtcaacagagtgcaggctcccgcgagcgttctgctgatggccatcctcgagaagggcatagcgacacctgaggaagttgacgccaccgtaagaaggctcggacttccgatggggcccttcgagcttgttgactacacgggagttgacatcctctacaacgccctgaagtactacgcccagacaataagccccgactacgagccgccaaagttcctggaggagatggtgaaagcgaacaagctcggaagaaagaccggacagggattctacgactggagcaagggcagaccgcaaatcgactcgagcaaggcaacagacaaaatcaacccgatggacttcacctttgtcgaaatcaatgaagccgtaaagctcgtcgaaatgggtgttgccacaccccaggacatagacacggcgataaagctcggcctcaacagacccttcggcccctttgagctggcgaagcagtttggagcggagcagattgcgaagaggctcgaggagcttgcaaagcagttcggaaagaagattttcgagccagcaaagactctgaaggaggggaaacttgaggaactgttgaaggcgggaaaggctgaggctgaggagaaaaaagaggacgagttcaagaccatcaagattgaaaagctcgatggagggataacgaagctcgtgctgaacagacctgacaggctaaacacgatctccccagaagttctggatgagatcgatagggcgattacgcagctatggaacgataaagacacgagggtcatcgtcatcacaggtgctggagacagagccttctccgcaggagcagaccttggagggagcatcataacgcaccccttcgacttccttgagcacaacaggaagggagagagagttttcacaaggctaagggagattccgaaaccagtcattgcagcaataaacggctacgcccttggtggtggtttggagattgcgatgaactgcgacattaggctggctaagaagtctgctgttctcggccttccagaggttgggctgggcatactgcccggctggagcggaactcagagattggtgaagctcgttggcataagcagggcaatgcagcttgccttaaccggagagagaatcaccgcagaggaggcagagagatgggggctggttaacaaagtctttgatgacgacaagttcgaggaggaggtaatgaactacgccaagaacatcgcagagcgctgcgccccgatttcgatggccctcatcaagaggctcatcaacaagggcggagaggtgccgatggacatcggccttgagtgggagtgcactgcagcaggtctgcttttcgcaacagaggacatgagagagggaatctcagccttcctgaggaaggacaagccccagttcaaggggcgctaa

SEQ ID NO: 45108 - DNA, 1236 bp, Archaeoglobus fulgidus
gtgtgttccggtgataaaatggagatggagttgagtcaggagcacaggctctttagagacagcttgagggaatttctggcgaaggaagttgagccgatcgcggacgagagggacaggaaaggtcctttgtcgaagggagaggttcttgagttcttcgctaagttcaggaagctcggcatcggctacgatcctgaaagcctctccgtttacttcgaagacccattctactacggaatcgcaagcgaggagataagcagggtctgggcgagcctgaatgttgttctcggcatgtcattccccgttgttttcgtgaacctcgcctcagaccagacaaaggatgccatgatgccaaagctggagaaaaaccagctaataggttgtcttgcagcgacggagcctgaagcgggtagcgacacgaccaagctgaaaactacagcagagcttgacggtgatgagtgggttctgaacggaacaaaaacctggataagcaacgcaacagttgctgatgttgctttagttgttgcaacaaacagggagatgagaatgcaggacatgttcctcgttgaccaggtgaactcccccttcgagactagcgaactccacaagctcggatggagagcagcgccgacaggggagatttatctgagaaactgcagggttccaaaagacaacgctttgagcgtaatgattcagaaagctctcagttcgggaggcatggttgaggcattgcccatagcggcatcaatctcgaagctctacgcctacatgtctccgctgagcgcggtgttctgccttatgcgctccggaatggctttgatggcaaccggtatttctcaagccgcgctcgacgcatcaattgcctatgcaagacagagaaaggcctttggaaagccaataggaaagttccagcttattcaggacatgctctacaagatggctgcaatcaccgaatcatcaaggttgctgggctataaggctctctacatgattcagaaaggagacccaaaggcgagatacatgtcctctctggcaaagggctacgcgtgcgagggttgtgtggaggttacctacaacgccattcagattcacggcgggcttgggttgagcgatgagtatccgctggagcgctacttcagagatgcgagggtgatgacgatcccagacggcacaacggagattcagaagctcatagtgggaagagagttgctcggaaaagggttctcagcctacacttaa

SEQ ID NO: 45109 - DNA, 981 bp, Archaeoglobus fulgidus
gtggatcgatttcagaggttgattgccatgctgaaggaggaaatagcgaaaagggccgaaataatcaacaaagccattgaagagcttctgcccgaaagggagccgattggactctacaaagccgcaaggcatctgatcaaagcaggtggcaagaggctaaggcctgtaataagcctcttagcagtcgaagcccttgggaaagactacagaaagattatcccggctgctgtcagcattgaaacaatccacaacttcaccctcgtgcatgacgacataatggacagggacgagatgaggaggggagttccgacggtacacagggtttatggggaagcgacggccattttagcaggcgacacactctttgctgaagccttcaagctgctgacaaagtgcgatgttgagagcgagggaatcagaaaagctacagaaatgctttcggacgtttgcataaaaatatgcgaggggcagtactacgacatgagctttgagaaaaaggagagcgtttccgaggaggagtatctcaggatggtcgagctgaagaccggagtgctgattgcagcttctgcagcattacctgcggtgctttttggggagagcgaggaaattgtaaaggcgctgtgggactacggagttcttagcggtattggcttccagatccaggacgacctgcttgacctgactgaggagaccggaaaggactggggaagcgacctgcttaaagggaagaaaaccctgattgtcataaaggcgttcgaaaagggagtgaagctaaagacgtttggaaaggaaaaggcggacgtctctgagattagagatgatatcgaaaagttaagagagtgtggtgcgattgattacgctgccagcatggcaagaaagatggctgaagaggcgaaaagaaagctcgaagttctgcctgaaagcaaagccaaggaaacactgctggaacttaccgacttcttggttacaagaaaaaagtga

SEQ ID NO: 45110 - DNA, 723 bp, Archaeoglobus fulgidus
gtgtcagaattgaagagtgacgttaccattctgaagatagggggttcggtgataacagacaagagcaggggggcctttgaaaagctgaaagagagggagcttagggaagtctgcagagcaatttcggagaaatggagaaacctgattgtcgtgcacggtgcaggctcgttcgggcatccccacgtaaaaaaattcggtttaagccctcttggagcctcaaaggttcatctcgggtgcctcagattgagtgagagattctgctccgtcctcaccgagttcgaagttcccgcctaccccatccatccctttctggcgtacagcgttgagattgttgataaagccatgaaaagcggttttcttcccgttctccacggggatgtggtgatggcggagaagatagaagttctctcgggggacgacattgttgcgcacctcgcagaggcttttaaagctgagaagatcgggttcgccaccgacgttgagggtgtttacgattttaacggcaatgttatcgataggcttgacagaagcctccttgaggaaatgattgccaagggtggagtggcaaagggaaaggaggatgtgacaggaggtatgctgagaaagcttcagaagctttatgagatggggcacgggtgtaaggcttacgttttcaaaggcaactacgaaaacttgaagaagttcttacagggagagaaggttggaacggaggtgataatctga

SEQ ID NO: 45111 - DNA, 855 bp, Archaeoglobus fulgidus
atgattgcatcagcacccggaaagataattctgttcggcgagcatgcggtggtttacggtaggcatgcggtggtgtcagcgattaaccttagatgcagagtgtcggtgagaaaatctgacaggtttctgattaggtcttcgttaggagagagcgggctggactatcaaaggcatccctacgtcgtgcaggctgttaagaggtttggggagcttagaaatattccgggtgctgaaattgagattgagagcgaaataccgattggctctgggctgggcagctctgcggcggtgattgttgccacaatagctgctctgaatgcagagttcgatggggatatggataaagaggccatcttccagatggcgaagcaggttgagattgacgttcagggaagggcgagcggaatagacccgttcatatccacctttggaggttcgtggcttttccctgagcgtagaaaggtcgagatgccgttcaagttcttcgttatcaactttggcagcaggtcaacggctgagatggtcgcaaaagttgctgagctgagagagaggcatcctgaggttgtggataaaatatttgacgctatcgacgcaatctcccttgaggcgagcgatgttggcagcgctgaaagacttgaggagctcatagccataaaccagtcgcttctgagggcgataggggtgagcaatcccgaaatcgacagaaccattgcagagctcgaaaggatgggtttgaatgcgaaaataactggagcgggtggtggggggtgtatattcggcctgttcaagggagagaagccgaaagggagcttcatagtcgagcccgaaaaggagggtgtcagaattgaagagtga

SEQ ID NO: 45112 - DNA, 660 bp, Archaeoglobus fulgidus
atggactacgatgagaaaagagagaggctggcagagagattgaggcaggagcttaacctgagcaggaaagtttacgaggcgataagaaaggtgcccagacacctttttgtgcccgagagctacaaaaatgaagcttacgttgacacacccctcccaataggctacggccagacgataagcgcaccccacatggtcgcgatcatgtgcgagcttctcgatttgagggagggggataaggtcctcgaggtgggcacgggttgcggatatcacgccgctgtgactgcagaaattgtcgggaagagcgggaaggtgatatccatcgagtacattcctgaactggcggagagggctagggcgattctgaaggcgcttgggtacgacaatgttgaggtgatagtcggcgacgggagcaagggctacgagaaagaggctccttacgacaaaatctacgtcaccgctgcggcgcctgacatccccaagccgctgatagagcagctaaagcccagaggcaggatggtcattcctgtaggtgactccgtgcagtggctgataatcgtggaaaaggatgagagcggcaatgtaaggaagaagaactggggttctgtgcgatttgtgcccctaaggggcgagtacggcttcaaaagtgtgaggtatgattaa

SEQ ID NO: 45113 - DNA, 810 bp, Archaeoglobus fulgidus
atgctctaccttggcgtcataggttaccccatcaagcactcagtctctcccgcaatgcacaatgcagctttacagcatgaggggatagaggggatttatctggcttttgaggttaagccagacaggctgagggatgcagttttcggtgctaaagccttgggattcagggggcttaacgtcacgatccccttcaaggagagcgtcgtggagttcgttgagcttgaaggtgaggcggctaagataaagacagtgaacaccatcgaccttgttgagatggtgggatacaacacggatgtttatggtgtcaaggcagccctttcgggaaccgagcttggtgggaagactgcgctggttgttggtgcaggcggggcggggaaggctgctgcattggctttgctggatatgggctcaactgttatcgttgcaaacagaaccgaggagaaggggagagaagcggttgaaatgctgagaagatatggggagtgcattttctggcctttgagcagagtagaggagctgaaagggaaggtggatgttgttgttaacgccacacctctcggaatgcggggatttaaggcagaaattccggttccgccttcaatgctcgatggagttgagctggtctttgacaccgtttacaatcctatggaaaccccgctgattcgtgaggcgaagaagaggggctgcaaggtcgtttacggcatagaaatgctcgtccatcagggggcaaaggccttcgaaatctggacgggcattgagcctgacgttggggtgatgagggaggctgctttgagggctttgaggttttga

SEQ ID NO: 45114 - DNA, 1122 bp, Archaeoglobus fulgidus
atgagggaagcagcaagactctctcagatttccacgtcgatgattcgaaggatgttcgaaattgtcgaaagagcaaagaaggagggcagggaaatcatcagcttaacaattggcgagccagactttgataccccgcaggaggtcattgagagggcatgcagagccatgaatgccggcttcactcactacacctccaacttcggccttgaggagcttcgaagcgccattgcagagaggtatggagttgactccagcaatgtgatggttacggctggaggcagcgaggctttgcttaacgcatctctcgctttcatcgaggagggaagcaaggttgttatcccctcacccaactttctgagctacttcacctacgccaagatgtgtgggggccaaatcgttcagctcagaacccacaataacggctttctgccagacgtcgagaagctgaacgaaatcattgacaggaacgtgagcgtcattttcctaaactaccccaacaaccccaccggggcggtaattgacgagaaggatgctagggcagttgttgaaatcgccgctgacaataaagcaattgtagtgagcgacgaaatctacgaccagatatattacgacgtcaaaccaacttcccttgccggctacgaaaacgttgtgtgtgttaatggcttctccaaatccctctccatgaccggttggaggattggtttcaccatagccgatgaaaagctgctcgacccgatgctgaaggtccatcaggttaatggcgtctgcgctcctgctttcgcccagaaggcagtggctgaggttatggcagaaaggttgttcgactccatcgtctcaaggatggtcaaggagttcaggcagaggagggattacctttactcggagctaagcaaaatatacgacgtagttaagcctgaaggggccttctacatgttcgtaaacgttaaccaggactgcatggagtatgccgagaacctcatcaaccttggagttgccgtcacacccggcctgcccttcggagacggaaatgagacttacgtgagaatcagctacgccaactcccttgaaaacctcaagaaggcggctgagataatcagggagtatgagagtcagagagcttag

SEQ ID NO: 45115 - DNA, 1689 bp, Archaeoglobus fulgidus
atgagtgggatacttggtattgaggggcaaaatattcgagagaccgatggtagcggtataaacagaatctgggtgaagcactacgacgagggcgtgagggacaggctcgattatcccgtgatgcccgcttacaggattcttgagatggctgctgaaaagtatgggaacaaggttggaacaatattctttggcaatcagattacttacaggcaggcaaaggaagcttctgacaaagttgcgggatttctcttcgacattggcattgagaaaggggatagagtaatctttgcccttcccaacactccccatgctgccccaataatggctgggattctgaaagttggtggaatcatagtgcagtgcaaccccctctacactcagagagagataaagtttctcgctgaagacagcggtgcaaagacgatgttctgcatggatatgctgtactccaacgtttctccgctgcttgacgatggcactcttgatactgtaataacctgcagccttcaggacttcatggttggcgctacgatgcccgacccgcctgagaagagaaaggggctttactcgtggaagaacgtcatggaggctgagaagactgaaaggagggcggagataaatccgaaagaggatgttgcgatgctgcagtacactggggggacgaccggattccccaagggggttatgctcacccacttcaacattgtagcaaatgcctatcaggctgccaactgggaccccaaagcttcttctgccgatgtggggattggcatgcttcccgttttccacagctacgggatgacgatgatgaacgttggaattcttgtaggtgcgacaattatccccatgcccgacccccgaaactacccgatggttcttcaggccattcagacctttaaagttacaaccctcgcagccgtgccgacgatgtacatcgggatgctgaagcttcttgaggagaacggctacgatttgagctccctgagagtgtgcacgagcggagcggctccgctgccaatagaggtgaagaggaggtgggaggagcttacgggtaagaggattactgagggctacgggctgagcgaggcgtcgccgataactcacggaaaccccatatacgggctgaataaggaggggagtgtagggctgccctatcccgacacgatagcagtggtgattgacgatgagggaaacatcctcccgcccggagaagtgggggagcttgtaataagagggccgcaggtaatgaagggctactggaaccgcaaggaggagacagagaacactctaatcaacggatggcttttaacgggagacatggcgaaaatggacgaggacggctttttctacatcgtggacaggaagaaagacatgataatcgctggagggttcaacatctacccgagggaaatcgaggaagtgttgtacgaacatccagcggttgcggaagctgctgttgttggcattccagacccctacaggggagaaactgtcaaggccttcatagagctcaagccgggatggaagggaaaggtgacggaggaagacataataaagttctgcaaggagaggcttgctccttacaaggttcccaagcttgtagagttcagggatgagctgccgaagtctcttgtggggaaagttctcaggagagttctcagggaagaggagatgaggaagcagggttaa

SEQ ID NO: 45116 - DNA, 549 bp, Archaeoglobus fulgidus
atggcaagatacggcatggtcatagaccttgagaagtgtctcggctgtgaggcgtgcgttacggcatgcatcgaggagaacaacgttccctacgagacggggctgagaacccaggttcacagggttgttaccggcaagttccccaacgtctcgacgatgtacatgcacagaatatgccagcactgcgagcatcccggctgtgttcacgtatgccctactggggcgagctacgtaaacgaggatggcatagttctgatagactacgacctctgcatcgggtgcaagtactgcatggtcgcatgcccttacctggcaagatatatccacccagagaggcacacacctgacaagtgcactttctgcgttcacagggttaaggaggggaagcttccggcttgcgttgagacttgtccagctaacgcgcgaatcttcggagacctcgatgacccgaacagcgaggtggcgaagctggtggcggagaacagagctatccctattggcgcggagtacggtacgaagccgaaggtgttttatataagaccgaggtga

SEQ ID NO: 45117 - DNA, 1155 bp, Archaeoglobus fulgidus
atgaggcgagttgcagttgttggtgtcggccagagcaagttcggagagctctgggagaagggattcagggatatagtccttgaggccggaagagaggctctggaggatgccgaccttgagggaagagagatagaggcaatgttcgtgggcaacatgagcggcgggaggtacctcggccaggagcacgttgcagcactcatcgcagactatgctggcttggccgagttcggcattcccgcaacgagagttgaggccgcagatgcgagcggtggcttggcggtgaggcaggcttacatggccgttgcctcgggcttgcacgatattgtgattgccgccggggcggagaaggtcaccgatgttgacgaccccatgcagattctgtcatcctctgtggatgttgagtgggagaacttcgttggtgggagccttccggctctctacgctataattgcgaggctgcacatggatagcttcggcacgacagaggaggaccttgcactggtcagcgtcaaaaaccacaggaacggtgctaagaacccgaaggcgcagttcaggaaggagataagagttgaggacgtcctcaactccccctacgttgccgagcccctcaagcttcttgactgcgcatcggtgagtgatggtgctgctgctgtaattctcgccagcgaggacgttgcgagagaaatcaccgacactccggttttcatcgaggcatgcacgcaggcgagcgattatctcgctctgcagagcagaaaggacattctgtcaatgagagctgtggttaaagcttcgagagatgcttacgagcttgcgggtgttggaccaaaggacattcaggttgcggaggtgcatgattccttcacaattgcggaaatccttgcttacgaggacttggggtttgcggaaaaggggaagggagcggagctcgtgagggagggcgtgacggagattgggggaaagatacctgtaaacccgtccggagggctcaaggcttgcggtcatgcagtaggggcgacgggagtgaggcagattgttgaactgactctgcagcttcgcggcgaggcgggagagaggcaagttgatgccgaaactggattagcgttgaatattggaggcactggagccacagcagttgtgtcaattctcaggaggtga

SEQ ID NO: 45118 - DNA, 1128 bp, Methanococcus jannaschii
atgataagcagtagatgcaaaaatataaaaccatcagcaattagggagatatttaacttagctacatctgattgcataaatttaggaataggagagccagattttgacactccaaagcatatcattgaggctgcaaaaagggctttagatgaggggaaaactcactactctccaaacaatggaattccagagcttagagaggagataagcaataagttaaaggatgattacaacttagacgttgataaggacaatattattgttacctgtggagcttcagaggcgttaatgttatctattatgactttgattgacagaggggatgaggttttaattccaaatccatcttttgtgtcttatttttcactaacagagtttgctgagggtaagattaagaatatagatttagatgaaaactttaatattgatttagagaaagttaaagaatcaataactaaaaaaacaaagctaataatatttaactctccatcaaatcctactggaaaagtctatgataaggagaccataaaaggcttggcagagattgctgaggattataatctaattattgtttcagatgaagtctatgataagattatctacgataagaagcattactctccaatgcaatttactgatagatgcatattaattaacggtttctctaaaacctatgccatgactggatggaggattggatatttggctgtttctgatgaactaaataaggagttagatttaatcaacaatatgattaagattcatcagtatagctttgcatgtgctacaacctttgctcaatatggggcattagcagctttaagaggtagtcaaaagtgtgttgaggatatggttagagagtttaaaatgaggagagatttaatctataatggattgaaggatatctttaaagtcaataagccagatggggcattctatatattcccagatgtttctgagtatggagatggggtagaggtagctaagaaattgattgagaataaggttttatgtgttcctggagttgcatttggtgagaatggagctaactatattaggttcagctatgctacaaaatatgaagatatagagaaagctttagggattataaaagagatttttgagtga

SEQ ID NO: 45119 - DNA, 1620 bp, Methanococcus jannaschii
atgaaaactgatatcttaattataggcggaggaggagctgctgcaagggcggcaatagaatgcagagataagaatgtcataatagctgttaagggattgtttggaaagagtggatgcacagttatggctgaaggaggttataacgcagtatttaatccaaaagatagctttaagaagcatttttatgacacagtaaaaggagggggatttataaacaatccaaagctggtagagattttagttaaaaatgctcctaaagagcttttgaacttagaaaggtttggagctttgtttgataggactgaagatggctttatagctcaaagaccatttggagggcagagttttaatagaacttgctactgtggagatagaacaggacatgaaataatgagaggtttaatggaatatatctcaaaatttgaaaggattaagattttagaggaggttatggcaataaagttgattgttaaagataacagatgctatggagcgatatttttagatttaaagactgggaatatatttccaatatttgctaaagcaactatattggcaactggaggagctgggcaactatatccaataacatccaatccaatacaaaagactggagatggttttgctatagcttataatgaaggagctgaacttatagacatggagatggttcaattccatccaactggaatggttgggactggaattttagttacagaggccgtgagaggagaaggaggaattttatacaataaatataaagagagattcatggtaagatacgacaaggagagaatggagctatcgacaagggatgttgttgcaagagctatatataaagagattcaagaaggtagaggagttaatggaggagtttatttagacgtttctcatttgcctaatgaggttattgaaaagaagttagaaactatgttaaagcaatttttgagagtaggaattgatattagaaaggagccgatgattgtttctccgactgctcatcattttatgggaggtttaaagattaatgaaagatgtgaaaccaatataattggattatttgcatgtggagaggttacagggggagttcatggagctaatagattaggagggaacgctttagcagatacccaggtctttggagctattgctggaaaatctgccaaagagtttgttgaaaatcatgattttaataatattgatgctgaagaagatgttgccaaaatattggaggagataaatagcttgaaaggagatttaaacgtctataatttaattgaagatttgagaaaggttatgtgggattatgtatccattattagaaatgaggatggattaaaaaaagccttagaaaaaattgatgaaattgagagaaatatagataatgtcaaagttaatggaattattgacttgcagaactactttgaattgaaaaacatggttgttgttgctaagttggttacaaaatctgctttatatagaaaggagagtagaggagcacattatagggaagactttccagaaacaaaggaagagtggagaggaaatattattataaaaggaaaaaagatgtggtttgaaaagttggattatagtgtctttcaaaacttcttggaataa

SEQ ID NO: 45120 - DNA, 903 bp, Methanococcus jannaschii
atggggatggacatgatagagatgattgaaaaggcagagattttaatggaagctcttccattcatacagaaattttatgggaagatttttgtcataaagtatggcgggcatgcgatgattgatgagaaggcaaagaattggactgctcaagatgttgttttgttgaagtatgttggaataaatccagttgtagttcatggtggaggtccagaaatcaacaaagcaatggaaaaaatggggaagaaaccagagtttgtccatgggttgagagttactgatgaagaaactttagatattgttgaaatggttttagccggaaagattaatggagacattgtctcaaagttatcaaagtttggtggaaaggctgttggactatctggaaaatctggaaggataattttagccaagaaaaaattaaagaaaataaaaactgaaaaaggggaggagatagaggttgatttaggtagagttggagagacagttgaggttaatactgaactattagagattttgataaacaacggctacatcccagttgtatcaccaattggtttggatgagaagggagaggcatataatttaaatgccgataccgttgctggagacatagctggagctttgaaggcggagaagcttattttaataacagatgttgatggaataatggatgatataaataatccagagacgttgcatagaaaattaacagcttcagaactaaaagaaatgatagaagatggaagaataaagggagggatgattccaaaggctgaaagtgccttatatgccttagagcatggagttaagagcgttcatataataaatggaaagattcctcatgctttgttgttggagatatttacagaggagggtattgggacgatgataacaagagattaa

SEQ ID NO: 45121 - DNA, 909 bp, Methanococcus jannaschii
atgctaattttaggggttggttattttctattagggcttattctactgtattatgggagcgattggtttgtcttaggaagtgagaggatagcaaggcattttaatgtgtcaaactttgtcattggagctacggttatggctattggaacatctctgccagagatattaacatctgcttatgcttcttatatgcatgctccgggcatatcaataggaaatgccattggttcttgtatctgcaatataggtttagtccttggcttaagtgcaattataagtccaataatagttgataaaaacttacaaaagaatatattagtttatcttctatttgttatatttgctgcagttataggaattgatggattttcatggattgatggagttgttttgctaattttatttattatctacttaagatggactgtaaagaatggaagtgctgagatagaagaaaataatgataaaaacaacccttcagtagtgttctccttagttttgttaataattgggttaattggtgttttagttggagctgaattatttgttgatggagcaaagaagatagcgttagctttagatatatctgataaggttattggatttaccttagtggcatttggaacatctctaccagagttaatggtttccttagcagcagcaaagagaaaccttggaggcatggtcttaggaaatgtcattggaagtaacatagctgatattggtggcgctttggcagttggaagtttatttatgcatctcccagcggaaaatgtacaaatggctgtgttggtaattatgagccttttactctatttatttgcaaaatactcaaagattggtagatggcaaggaattttatttttagctctatatataattgcaatagcttctttgaggatgggataa

SEQ ID NO: 45122 - DNA, 1992 bp, Methanococcus jannaschii
ttgcagaattggtttaaaagtggtgatagcttgaatttagttgatttatacgtaaagaaattcatggatttgattgagattgagagaagatgtgagatggattttcataaaaatgagattattaaattaggcaaaaagagagagaatgttggaagagcaattttaaatttaaaagggaaatttttaggagagagcttaggttgcaccattgtaagatttgggagaaaaaagccatttaaaacagaaatatctccgggagacgttgttttagttagtaaagaaaacccattgcagagtgatttatatgcgaatgtcatatacgtaggaaagaactttatagatgttgcctttgatgttgatgtcccaaaatgggtttataaagaaagagtaagagttgatttatacgtaaatgacataacatttaaaagaatgaaagaagctttaagagaatttgcaagaaagagggataaattagcttatataatattaggcattgaacacccagaaaaacctttaagagaggacatcaaattagagttctatgataaaaatttaaatgaatcacaaaaattagcagttaaaaaggcagttttaagtagggatttgtatttaattcacggccctccaggaactggaaagacaagaactataacagaggttatcgtccaagaggttaaatttaacaaacataaggttttagctacagcagattcaaacatagcagcagataacatcttagagtacctaataaaaaaatatccagatttaaaagttgttagggtagggcatccaacaaggatttcaaaggatttgattcaacactctctcccctatctaattgaaaatcatgagaaatatcaagaaatcctagctttaagagagaagattaaagaaattaaagaacagagggataaatttttaaagccctccccaagatggaggagaggaatgagtgatgagcagattttaaaagtagctaaaagaaagaaatcctacagagggattcctaaggaaaaaatcgttagtatggcagaatggattataagaaataaaaagattaaaagaatcatcaataatttggatgaaattactgaaaaaatcatgaatgagattttagcagaggcagatgttatcgtagcaacaaactctatggctggttcagaaattttgaaaggctgggagtttgatgtgattgttattgatgaaggaagccaagcaatggagccttcttgcttaattccaattgttaaaggaagaaagctaatcatggctggagaccataagcaattaccaccaacagttttaagtgagaatgaagagctaaaaaagactttatttgagagattgattaaaaaatatccagaattttcatcaatattggagattcagtatagaatgaacgaaaaaatcatggaattcccaaataagatgttttataacaacaaattaaaggcagatgagagcgttaaaaacatcactttattagatttagttaaagaggaggagattgatgaggttgatagagatattataaacgaaatcccagttcaatttataaatgttgaagggattgaaaggaaagataaagaatctccatcttattacaacatagaagaggcggagaaggttttagagatagttaaaaaacttgtaaagtataagataccaacaaacgttataactccttacgatgcccaagttaggtatttgaggaggttgtttgaagagcataacatagacatagaggttaatacagtagatggattccaaggaagggagaatgaggctatagttatctcattcgttagaacaaagaactttggatttttgaaggatttgaggaggttgaatgttgccataacaagagctaagagaaagctaattttgataggcaatgaaaatctattgaagcaagataaagtctataatgaaatgataaagtgggcaaaatctgttgaagaagaacacaaaaataaaattatccaaaaataa

SEQ ID NO: 45123 - DNA, 1344 bp, Methanococcus jannaschii
ttggtgggaatgatgagaaaaactaaaattttagtcactttaggaccatccttagaaaataaattagataaagcaataaatttgatagatggagttagatttaacatgtctcatgccacaacagattattgtgaaaagtttttgaatatattggaaaaaaataatatcgccaaagttatggatttgaagggaataaaaattagaattaaagaagttaaattaaaaaataaaatattaaaaatgggggagaaggttgttattggagaggatataaagctcaactacaatatagacacaattgaagaagggcattttattttaataaacgatgggaaaattaagctaagagttgtagaaaaaactgataaaattatcgcagttgtagaagttgggggagagattaaagaaggtatgggagttaatcttccagatacaaggatagaactcccaataattgatgaaactgatttgaagaatataaaattcgctgtagaaaaggactttgaatatattgctttatcatttgttaggaataaggaagatgttaaggaattaaaagatattatatcagaatacaaaggagattgtgaggtaatatcaaaaatagaaactaaggagggattaaagaatataaaagagatagcaagagaaagtgatggagtgatggtagcaaggggagatttgggtgtagaggttccaatagaaaatattccaattgaacaaaagaatatattgagaatagctaatagatatggaattttgtcaataacagccacacaaatattggattctatgataaacaatccatttccaacaagagctgaggttacagacatagctaatgccatatacgatggaactgactgcttaatgctctccaacgaaacaactattggaaaatacccaatagaggcgataaaggtattaaataaggttgccaaagtggcagatgaacattatgaggagtttggtgatagagtttgtttagaggttgagagcattgatgaaggtttagtatatgctgtttatgagctatataagaagctaaatactaagttagttataactccaacatattctggaagaactgctaagttaatatctaaattaaggataaatagtaaaataatagctccaacgccaaatataagaactttaaaaaggttgagattggtttggggagttgaaagctgtttgatggaagaatttgatgatatggagaaaataatcaacacctgtagagaaatggctaaaaaagaaattggaaaggggatttacttaatcacattaggtcatccaataggtcaaaagaaaactaacactataaaagttgaaagtatctaa

SEQ ID NO: 45124 - DNA, 801 bp, Methanococcus jannaschii
gtgtttattatgagaagagaatttccagaagaaggagatatagttataggaactgtaaaggatgttaagccgtatggagcattcgtagagcttttagaatacccaggaaaggaaggaatgattcacatctctgaggttacatcaggatgggttaaaaacattagagaccacgttaaagttgggcagagagttgttgcaaaggttttgagagttgatgagaggaagggacatattgatttatccttaaagagagttactgagcagcaaaaaagggcaaaagttcaagaatggaagagattccaaagagcttcaaagatgcttgaaagagctgctgaaaaattgggtaaaagcttagaggaagcttgggaagaggttggctatttgttggaggatgagtttggggagctatacaatgcctttgaaacaatggttattgaagggaaagaagttttagatgatttagagattagtgaagaatggaaaaatgttttatatgaagtagctaaggagagtattgagctaacaaacgttgaagttgaaggagttattgagatgaaatcttacgccccagatggaattaaacaaataaagaaagcattaacaacagccttaaaagctaacccttatgaggatgttgaggttaagataacctatataggagctccaaagtatagggttgttgttatagctccagattacaagagtggagaggaggtttttaaaaaagtttgtgaaaaggcagtagcaacaattaaaaaacttggtggagaaggaacttactatagggagagtaagaaataa

SEQ ID NO: 45125 - DNA, 693 bp, Methanococcus jannaschii
atgataattattggtattgatgaagctggaagagggcctgttttgggtccaatggttgtttgtgcttttgcaattgaaaaagagagagaagaggaattaaagaaattgggagttaaagatagtaaggagctaactaaaaataaaagggcttatctaaaaaagttacttgaaaatttgggttatgtagaaaaacgtatcttagaagcagaggaaataaaccaattaatgaactcaataaacttaaatgatattgaaattaacgccttttccaaggttgctaaaaatttgatagaaaagttgaatataagggatgatgaaattgaaatttatattgatgcatgcagtacaaacactaaaaaatttgaggatagttttaaagataagatagaggatataattaaagaaagaaatttaaacataaaaattatagctgaacataaggcagatgctaagtatcctgttgtttcagctgcctcaataatagcaaaggcagaacgggatgagataatagactactacaaaaaaatttatggagatattgggagcggttatccatcagacccaaaaactataaagtttcttgaagattactttaaaaagcataaaaaacttcctgatattgcaagaactcactggaaaacatgtaaaaggatattggataaatcaaaacagacaaagctaattatagagtga

SEQ ID NO: 45126 - DNA, 1179 bp, Methanococcus jannaschii
atgataatactaaaagctgattataaaaaatacaacgtctctgaattagaaaagctcagaatggatgaagaaaaattttatgagacatttgataatgccatattattacaaacatgcaacagagttgagataatctttgatgcagatagcttagaagaaattaaaggaatcgaaaatatagatttagaaaaatttgatattctatttggagataaagcaatagaacatctttttagagttgcatgtggtttagagtccatgattgttggagaagaccaaatacttgggcagttaaaaaatgcctatctaaaagcaaaagaaaaaggcagaatatccaaaaaattggagaaaattattttaaaggcaatacatactggacaaagggcaagagtagagacaaagataaatgagggcggggtttcaattggctctgcggcagttgaattggcagaaaaaatttttggattagaagggaaaaatgtcttattaattggagctggagagatggcaaatttagttataaaggcattgaaggaaaaaaacattaaagcaattatcgtagcaaataggacttatgaaaaagctgaaaaattagctaaagaacttggaggaatggctataaagtttgataaattggaagaggctttaagatatgccgatatagttatatcagcaacaggggctccacatccaattttaaataaggagaggttaaaaaatgctggaaagacaattattatagatattgccaatccaagagacacaactgatgacattagagaactgccagatatttttttattcacaattgatgatttaagattagtggctgaagaaaatttaaagaagagaaaagaagaaatcccaaaggttgagatgattatttgtgaagaattagagaggttaaaagaatttcttgataaaatgagatttgaaacagcaataaaagaacttgggcaatatattgaaaatgtgagaaagaaggaggttgaaaaagcaaaaaagatattgaagaataaaaataagccagttgaggaagttttagaagatttttcaaaggcattgtgtaagagaataatttacgatataataaagatatttgagaatgtggaagataaagaagtttttgagtgtttagccaaagaatttaaaaaacttggcaataaaaataaaaattaa

SEQ ID NO: 45127 - DNA, 1722 bp, Methanococcus jannaschii
atgctttggagagatgtttgtgaaatatttaataaaattgaaaaaacaacaaaaaggttggaaaagagagattattttataaaattaattgacatggttaaagagaaagggaagccagaggatttaaaaaagatttgttatatggctatagggagggtttatcccgaatacgatgagagagagttaggaattggagaaaaacttttaataaatgctgttacatctataggaattaagaaagatgaattgttagagaaaattaaagagacgggagatattggattggcaatagagcaattaaaatcaaagattaagcaagcatctttattttttcagccattaactgtagatgaggtttatgaaaccttaaagagggttggggagatagagggagaaggttctcaaaagaaaaagttgaggttaataagtagtctctttttaagagcttcaccaatagagtgcaggtatttggcaaggttaattttggaagatatgaggatagggatgaatgttccaactatattagatgctttgtcagtttatttcaatgttccaaaggaaaaacttgagaagatatatgctataaccaatgatattgggcttttagctgagaaattattaatgggagatttagaaagtgaggagctaaaattaaaattatttagaccaataaaaccaatgttggctcaattaactccttcaattgaagaggcattattggagatgggcagagctcaatttgaaacaaagtatgatggagcaagagttcaaatacataaggatggaaataaagttaagatatatagcaggagattggaggatgttacaaatgcccttccagagattgttgaggcggtaaaaaatattaatgtagataaattaattgttgaaggggagtgtgtagctatagataaacaaacaggaaagccaagacctttccaagatatacttagaagatttaggagaaagtatgatattggaaagatgatgaaggaaataaatttgagagtttatttgtttgatattctttataaagatggagtatcatttatagatgaggaatttgaaaagagaagaaaagttttagaggaaattgttggttatgagaatgattggagaactgaaagaaagaggatagagaaagagcttaaatcagataaaataattgatatatcctataaattagtcacaaacgatgcaaaagaggcaagagaattttataactggtctctatctattgggcatgagggagttatgattaaaaatttaaaggctccttataccccaggaagtagagttagaacaatgtataaatttaaaccaactcttgagagtttagatgtcgtaattacaaaggcaaagagagggatggggaagagaaaggattggtatggttcatttgaaatatgtgttagagatgaggaagggaacctctaccctattggacatgtagggactggactaactgaggcagatttagagtttttgaaagaagagattgataaaattattattagagatttaggtgaagaggttgaagtagaaccaaagatagttattgaagttgcttatgaagaaattcaaaaatctgataaatatccttgtggctatgctttgagattcccaagggttgtaagatttagatttgataagggagttaatgagataaacactatagaggatgttgaaaggatatatgaaatccaaagaggaaggaaataa

SEQ ID NO: 45128 - DNA, 648 bp, Methanococcus jannaschii
atggatttagaagaacaaaagaaagcagtaattgagaaattaattagggaggggtatataaaaagtaaaagagtaattgatgctctattaaaagttccaagggaggaatttcttccagagcatttaaaggaatatgcgtatgtagatactccattagagattggttatgggcagactatttcagccattcatatggttggaatgatgtgtgagcttttagatttaaagccaggaatgaaagttttagagattgggactggttgtggttatcacgcggcagtaactgctgagattgtgggggaggatggtttagttgttagtattgagagaattccagaattggctgaaaaagcagagagaactttaaggaaattgggatacgataacgttattgtaatagtgggagatggaactttagggtatgagccattagccccttatgataggatatatacaactgcagcaggtccaaaaatcccagaaccattaataaggcaattaaaagatgggggaaagttattaatgcctgttggtaggtatctacaaagattagttttagctgaaaagagaggagatgagataataataaaggactgtgggccagtggcatttgttcctttagttggtaaagaaggattccaagggtaa

SEQ ID NO: 45129 - DNA, 1209 bp, Methanococcus jannaschii
atgagagttattgatggtggagttacagcccctaagggatttaaagccaatggatacaaagagggtaagtttggagtagcgataattatctctgaaaaagatgcagtaggagctgggacattcacaacaaataaagttgtagctcatcctgtagttttatcaagggagttgataaaaaatagagataaatttagagcaatagttgcaaatagtggaaacgccaactgttttacaaaagatggaatggaagatgctaaagaaatgcagagattagtagcagagctctttaatattaatgaagatgaggttttagtagcctcaactggagttattggaagaaagatggatatgaacattataaaagatagaataaataaggtttataatttaataaaagaaggaaacagctcaataaacgctgccaaagcaataatgacaactgatacaaaaccaaaggaaatagctgtggagtttgaggttaatggaaaaactgttagagttggggggatagcaaaaggagctgggatgatagctccaaatatgttacatgctactatgctttgctttataacaacagacatagagattgataaagaaagcttaacaaatatcttgcaaaaggttgtagataaaacattcaacaacatatccgttgatggagacacttcaacaaatgataccgtttttgttttagctaatggattaagtggagttaattatgaagaatgtggagaagagtttgaaaatgccttattgtatgtgtgcagagagcttgccaagatgattgttaaggatggtgaaggagctaccaaatttatggaggttgttgttaaaggggctaaaactgaggaggatgcagttaaagcatcaaaggctatagttaattctttgttagttaaaactgctgtgtttggtggagacccaaattggggaaggattgttgctgctgttggatatagtggggctgatttcaacccagaagttgttgatgttatattgagcaactataaagatgaggtttatttagttaaagatgggattccattggctgatgaaggaactgaagagctaaaaaaggccgaggagattatgaaaagtgatgaaataaagatagttgttgatttgaagatgggggagtttgagaacgtttgttatggatgtgatttaagctatgagtatgttagaataaacgctgaatatacaacttaa

SEQ ID NO: 45130 - DNA, 1053 bp, Methanococcus jannaschii
atggttacttacaaagatgcaggagtagatatatctcacgaagataaagtaattaaagccttagtttcacagataacatttaagagaagtgatataaaaccagctgagttaggattgcactatgcaggagctgttgagtttggagattattatttagttttatctacagatggtgttggaagtaagatgatagttgcagagatggctaataaatttgataccgttggaattgacatgattgctatgaatgtaaatgatgccatctgtattggggcagagcctatagcgttggttgattacttagcagttggacatataaccgaagagatagctgagcaaataggaaaaggattaaatgaaggagctaaagaggcaaatataaacattgttggtggtgaaacagctacactaccagatatgattaaaggtattgatttagcaggaactgtgttagcaatagttaagaaggatgaaatcataactggaaaggatgttaaagctggagatgtgattgttggtttaagaagctctggaatacatagcaatgggttatcattggcaaggaaggtattttttgacatagctaagttagacattaatgacaaactctcttatggaaagacagttgctgaagagcttttaacaccaacaaggatttatgtaaagccagttttggagatgattagagataaagatatagaagttaagggtttagcccacataactggaggaagttttagaaagcttaaaagattgaatgataaagtaacttactatattgacaaccttccagagccattaccaatatttaaagagattcaaagattgggtaatgtgcctgatgaagagatgtttagaacgtttaatatgggtattggattctgtgtaattgttgatgaagaagatgccaacaaagttataaaaatagctaataaatataatatcccagcccaagtaataggtagagttgttgatagcttagaggttaatggaaataagattgttggtaaagctgttgttaaatataatgataagcatataatattagaataa

SEQ ID NO: 45131 - DNA, 1065 bp, Methanococcus jannaschii
ttgtctaaaggtgaaaagatgaagataaaagttggtgtcttaggagctactggaagcgtggggcagagatttgtccaattgttggcagaccatccaatgtttgaattaacagctttagcagcatcagagagaagtgctgggaaaaagtataaagatgcatgttattggttccaagatagagatattccagaaaatataaaggatatggttgttattccaacagaccctaagcatgaggagtttgaagatgttgatattgtcttctcagctttaccatcagatttagctaaaaagtttgagccagaatttgctaaggaagggaagttgattttctctaacgcatcagcttatagaatggaagaggatgttccattggtaattcctgaggttaatgcagaccacttggagttgatagaaattcagagagaaaagagaggatgggatggagcaattataacaaaccccaactgttcaacaatctgtgctgtcataaccttaaaaccaataatggataaatttggcttagaggctgtttttatagcaacaatgcaggcagttagtggagcaggttataatggcgttccttcaatggcaatcttagacaatttaattccatttattaaaaatgaagaagaaaaaatgcaaacagagagcttaaagcttttaggaactttaaaagatggaaaagttgagcttgcgaactttaaaataagtgcctcatgcaatagggttgcagttatagatgggcatactgaaagcatattcgtcaaaacaaaagaaggagctgagccagaagagataaaagaggttatggacaaattcgacccgttgaaggatttaaacctcccaacctatgctaaaccaattgttattagagaagagatagataggccacaaccaagattagatagaaatgaaggaaatggaatgagtatcgttgttggtagaataagaaaagacccaatatttgatgttaaatacactgcgttagagcataatacaatcagaggagctgctggggcaagtgtgttaaatgcggaatattttgttaagaaatacatataa

SEQ ID NO: 45132 - DNA, 1095 bp, Methanococcus jannaschii
atgaaactacatgaatatgaagctaaaaatatatttaaaaagtatggtatcccagttcctgagagctttttagtatctaaggaagatgatttaaacagtataaatgttgataaagaagttgttttaaaagcccaagttttagttggtggaagaggaaaagcaggaggaattttatttgcatcaaataaagaagaattcataaagaaagcagaagagttgtttaataaagaagttaaaggagaaaaagttgaaaaaattttagttgaagagaaattgccaatagaaaaagaatactatgtatcaattatcatagacagagatgctaaaaaaccgttaatcatcttctcaactgagggaggagttgatattgaagaagtcgctgaaaagaatccagaaaagattataaagtaccatattgatgttagaaaacctttcctcccttatattgcaagatggatagttaaagaggcaaaattgccaagcaatgagattggaaaggttgctgatgttatttataagttatacaaaatctttaaagagttggatgctacaatggttgaaatcaatccattggttataactaaagatggaaacgtctatgccgctgatgctgttcttcacttagatgatgatgcagcatttagacataactatgaagaatttgaagaatataaaaataaagaaaaattaccatttgcctacgttgagttggatggagatgtggcagttataggtaatggagctggtttaactttggcaagtatggatattataaataacctcggcagaaagccagcttgcttcttagatattggaggaggggctgatgctgaaactgtaaaattggctttgagaaaggttttagaaaacaaaaatgttaagggaatatttattaatattttaggaggaataacaaggtgtgatgaagtagcaaagggaattgttgaagttttaaaagaacatccaaatgtaaagtttgctgttagaatgatgggaactaatgaagagattggaagaaaaatattggaagaacatggaataccttatgagacatcaatggaagaagcaggaagaaaattgattgaacagctataa

SEQ ID NO: 45133 - DNA, 1398 bp, Methanococcus jannaschii
atggctacagcagcatcagcaattgaatactcatcagttaagagtattgcaggacctttgttaatcgttgagggagttgaaggagcagcttatggagagattgttgaggttatctgtccagatggagagaagagaatgggacaggttttggaggcaagagagggtttagcagttgttcaggtatttgagggaacaacaggattaagcacaaaagatacaagagtaagattcacaggaagaactgctaagattggagtttcaatggaaatgttaggaagaatattcaacggagcagggaaaccaattgatggaggaccagaaatagttcctgagaaagagttagatattaatggttatccattaaaccctgtttcaagaaaagttccaagtgatttcatccaaacaggtatttcaacaattgatggaatgaatacattagttagagggcagaaactgccaatcttctcaggttctggtttgccacacaaccagttagctgcacagattgcaagacaggcaaaggttagaggagaaggagagaaattcgcagttgtctttgcagcaatgggtattacatcagaagaggcaaacttcttcatggaagagtttagaaagacaggagctttagagagagcagttgtcttcataaacttagctgacgaccctgcaattgagagaattttaacaccaagaattgctttaactgttgctgaatacttagcttatgagaaggatatgcacgttcttgttatcctaacagatatgacaaactactgtgaggcgttaagagaaatctcagcagcaagaaacgaggttccgggaagaagaggttacccaggttacatgtatactgacttggctacaatctatgaaagagctggtagagttaaaggtagaacaggaacaataactcaaattccaatcttgacaatgccagatgatgatataactcacccaattcctgacttaactggttatattacagaggggcagattgtcttatcaagagagttgcacagaaaaggtatctacccaccagttgatgttcttccatcattatcaagattggctggaaacggacagggtccaggaaaaacaagagaagaccataaaaaagttgttaaccaggcttatgctgcctatgcagagggtagaagtttaagagatttagttgctgttgttggggaagaggcattgacagatagggatagggcatacttgaagtttgcagatgagtttgaagataagtttgttagacaaggaaaggatgaggatagaagtatagaggaaactcttgacttgttatgggagttgttagctatattaccagaagaagagttgaagagagttgatagggagttaattgagaagtatcatccaaaatacagaaagaaataa

SEQ ID NO: 45134 - DNA, 1785 bp, Methanococcus jannaschii
atgaaaagagaggttgagaatatgccagttgttggtaagattattaaaatcgcagggcctgttgtagttgcagagggaatgaaaggagctcagatgtatgaggtcgttaaagtaggagaagagaaattgactggagaaatcattcagttgcacgatgataaagcagttattcaggtttatgaagaaacatctggaattaaaccaggagagccagttgttggtactggagctccattgtctgttgaattagggccagggatgttaagagctatgtatgatggtattcagaggcctttaacagcaattgaagagaaaacaggttcaatctttatcccaagaggagttgatgtccctgcattaccaagagatataaaatgggaatttaaaccagtggtaaatgaaggagattatgttgaagaaggagacataattggaactgttgatgaaactccttcaatagttcataaaatcttagttccaattggtgttaaaggaaaaattgttgaaataaaagagggtaaatttacagttgaagagacagttgcagttgtagaaacagaaaatggagaaaggaaagaaattacaatgatgcaaaaatggccagtaagaaaaccaagaccatataaagagaaactacctccagaaattccattaattacagggcaaagagttgaagacactttctttacattagcaaaaggaggaacagcagcaattccaggtccattcggttcaggaaaaacggttactcagcatcagttggcaaagtggtctgacgctgatgtcgttgtttatatcggatgtggagaaagaggaaacgagatgacagaggttattgaagagttcccacacttagaagatattagaactggaaacaaattaatggatagaactgtattaatagccaacacatcaaacatgcctgtcgctgcaagggaagcatctgtctatacaggaattacaattgcagagtacttcagagatatgggttatggagttttattaacagcagattcaacatcaagatgggcagaggcaatgagagaaatttcaggtagattggaagaaatgccaggggaagaagggtatccagcatacttagcttcaagattggctcagttctatgaaagagctggaagagttataaccttagggaaagataacagacaaggattcgtttgtatcgttggagctgtttcaccaccaggaggggacttctcagaaccagttacatcaaacacactaaggatagttaaggtattctgggcgttagatgcaaacttggcaagaagaagacacttcccagctatcaactggttgcagagttattcattatacattgatgatgttacagagtggtggaacacaaatactggtccagattggagacaattaagagatgaagcaatgagcttattacaaaaagaggcagagttgcaagagattgttcagttagttgggcctgatgcattgccagatagggagagagttattttagaagttgcaagaatgttgagggaggatttcttacagcaagatgcgtttgatgaggtagatacctactgtcctccaatgaaacagtacttaatgttaaagataattatgacattctaccaagaagcattgaaggcagttgaaagaggagttgaaccagctaagattttaggagtttcagttaagcaagatattgcaagaatgaaatacatcccacacgatgagtttataaatgttaaatcaaaagaaataatggagaaaattaagaatgaattaggttcattaaactaa

SEQ ID NO: 45135 - DNA, 2088 bp, Methanococcus jannaschii
gtgattttagtgagacccgtaagaatgaagaagttaaaagcggtgatattggatgaaaaaattgataatgttgtaagaagcttacatgaagaagggatagtggaactctgtgatttatctgaaaagttggaggatttagaatggaagacattgttatcaccttcatcatcagctgattatgttagaaatgttacatcattgatgataaaagcaggtagaatattggacatgttttcaagtgttagtcagaaggagacaagtataaaagatatcttaaacccaaagccagtggaaaagaagaaagtttccttcaactcatatcaggaagttattgattatgctgaaaaggtattaaatgagattagcaaagaggttgatggacctgctgagagattatcagagttagataacaaaaaatcaaagttattacagctgaaagagcagatatcttatttaaaaggtttagagtttgatttaaaataccttggttctggagagtatgtatttattggggcaggaagtgttcctaaggaaaagcttggagaattgaaagcagaacttgataaagtagcagatggatatattggaatattctctggaagtgaatttgaaaaggataagaagattagggttccaattgtatttgttacattgaaagagaagcttgagaatgttttatcagagattagaaagtttgagtttgaaagatatgacataagtgatgttgaaggaacaccaagtgaggctctctcaaaaatagagagtgaattaaaggcaatagaatcagagagaaacagcttaatagaaaagttgaaagcattagcacaaaaatgggaaaaggaattgttagctgtttatgaattgttatcaatagagaaggcaagaggagatgcttattcacaatttggtaagaccgatagaacatactacatagaggcatgggttcctgcaagagatgctgaaaaagctaaaagcttaatagaaaattcagcagatggttttgcatttgttgaaataactgaaccagatgaaccagaagagaaaatacctgttctacttgacaatccaaaggttatcaaaccatttgagatgctcacagagatgtatgctctaccaaaatacaatgaagttgatccaacattattgctggttcctggtttcctattgttctatggaattatgctaacagacgctgtttatggtttgctattgactataataggtttatttatttggaaaaaaattggaaaagttagtgagggagctaataagcttggttatattctaacattggctggaatttcaacagttataatgggtattataactggaggttatttaggggatttcacctatgagttctttggatttgatgtaacaaagacaccattagctttagtcaatccactaggagaaagctactatataaataacaacaacccattattcacccttggtagtataagcgtaacaaatgggccaatggcaatattagtattttccatatttgttggattaatacacctgttaattggattatttgttggattcaaagagaacgtaaaaagaggaaatatgggagatgctttcatcaatcagggagtttggatattgctgatattatcaatattcgttggaattggattaatgtttgctggagcaaatacaatgatagctggaggaataatcggaatctttgttgtattggcaatcttagcttcaatgtataagggttataagagcggaggagtaatggaagcaattcttggagctatggatgttactggattcttaggaaacgttttatcatacgcgagattgttagctctctgtttagcaactggaggtttagcaatggctgttaatattatggctaagcttgtcggtgaatccattccagtaattggaataattgtggctataatcatattgttggtaggacatacatttaacttcgtaatgaatggtttaggggcatttatccactcactaaggttgcactatgtagagttctttagtcagttctatgagggtggaggtaaaaagtttagcccattcaaggcaaatagagaatacacaactgcttaa

SEQ ID NO: 45136 - DNA, 1284 bp, Methanococcus jannaschii
ttgttatataatatggatgagagatttgaaattaaagatattgttgcaagagaagtaattgactcaagaggaaacccaacagttgaagtggaagttataacaaaagggaatggttacggttcagcaattgttccaagtggtgcatcaactggaacacatgaggcattagagttgagggataaagaaaagagatttggtggaaaaggagttttaatggctgttgaaaatgtaaattcaataattagaccagagattttaggttatgatgcaagaatgcagagagaaatagatacaataatgatagaattagatggtactccaaataaatcaagattgggagctaatgccatattggctgtttctttagctgtagcaaaggcagcagcagcaacagcaaaaatccctctctataaatacttggggggatttaactcctatgtcatgccagttccaatgatgaacgttataaatggaggaaaacacgctgggaatgatttagatttgcaagagttcatgataatgccagttggagctacatcaatttctgaagctgtaaggatgggttcagaagtttatcatgtcttaaaaaatgtcatcttagaaaaatatggaaaaaatgctgtaaatgttggagatgagggaggttttgctccaccattaaaaacatcaagggaggctttagatttattaactgagagtgttaaaaaggctgggtatgaggatgaggttgtctttgcattagatgctgctgcctcagagttttataaagatggatattattacgttgaaggtaaaaaattaacaagagaggagcttttagattactataaagcattagttgatgaatatccaatagtctcaattgaagacccattccatgaggaagattttgaaggctttgcaatgataactaaagaattagatatacagatagttggagatgacttgtttgttacaaatgttgaaaggcttagaaaaggtattgagatgaaggctgctaacgctctgcttttgaaagtcaatcagattggaactttaagtgaggcagttgatgctgctcaattggcatttagaaatggttatggtgtagttgtttcacatagaagtggagagactgaggatacaacaatagctgatttgtcagttgctttgaactctggacaaataaagactggagctccagcaagaggggagagaacagctaaatacaatcagttgataagaattgagcaagagttaggattaagcaaatatgctgggagaaactttagatgtccattttaa

SEQ ID NO: 45137 - DNA, 870 bp, Methanococcus jannaschii
atgtttaagggggtctatcccgccatcattactccttttaaaaataaagaagttgattttgatggattagaggagaacataaactttttaattgaaaatggagttagcggaattgtagctgttggaactactggagaaagccctactctatcccacgaagagcataaaaaagttattgaaaaagtggtagatgttgttaatgggcgagttcaggttattgcaggagctgggtcaaactgcacagaggaggcaatagagctttctgtttttgctgaagatgtgggagcagatgctgtattgtcaataactccctattataataaaccaacacaggaaggtttaagaaagcattttggaaaggttgctgaatctataaatcttccaatagttttatataatgttccatcaagaacagctgttaatttagaaccaaagacagtaaagcttttagctgaagaatacagcaatatttcagcagttaaagaggcaaatccaaatctttcccaagtttctgagctaatacatgatgctaagataacagttctttcagggaatgatgaactaaccctcccaataatcgccttaggaggaaaaggggttattagcgtagtggccaacatcgtcccaaaagagtttgttgaaatggttaattacgcattagaaggagatttcgaaaaagcaagggaaattcattataaattgttcccattaatgaaggcgatgttcattgaaaccaacccaattcctgttaaaactgccttaaatatgatgggaagacctgctggcgagttaagattgccattatgtgagatgagtgaagagcataaaaagattttggaaaatgttttaaaagatcttggtttaatttaa

SEQ ID NO: 45138 - DNA, 744 bp, Methanococcus jannaschii
atgttcagaggagttatggagagtgcaaaagagtttaaaaaagttgttgatacaatctcaacacttttagatgagatatgttttgaagttgatgaggaagggataaaagcgagtgcaatggacccaagccatgttgctttagttagtttggaaatcccaagattggcttttgaagaatatgaagcagattctcatgatattggtatagatttagaggcatttaaaaaagtaatgaatagagctaaagctaaagataggctaattttagagttagacgaagaaaagaataaattaaatgttatatttgaaaacactggaaagagaaagttcagcttagctttgttagatatatctgcctcatcagttaaagttcctgaaatagaatatccaaacgtaatcatgattaaaggagatgcgtttaaagaggctttaaaggatgctgatttattcagtgattatgtaattttaaaagctgatgaggataagtttgttattcatgctaagggagatttaaacgagaatgaagcaatatttgaaaaggatagctcagctataattagcttagaggttaaagaagaggcaaaaagtgctttcaatttagattatttaatggacatggttaagggtgttagctcaggagacattattaagatttacttaggtaatgacatgcctctaaaattagaatattcaattgcaggggtaaatttaaccttcctattggctccaagaattgaaggataa

SEQ ID NO: 45139 - DNA, 3468 bp, Methanococcus jannaschii
atggctaaaaaaaacactaagaaggataataaaaatcagaatctcagatgtccaattgtgtgtgttttaggacacgttgaccatggaaagtgcttaatgcctcatgagaaagttttaactgagtatggagagattaagattgaggacttatttaaaataggaaaagagattgttgagaaagatgagttaaaagaaataagaaagttgaatataaaagttcatacactaaatgaaaatggagaaattaagataataaatgctccttatgtgtggaaactaaaacataaaggaaaaatgataaaagttaagttaaagaattggcattcaataactacaacgccagaacatccattcttaaccaataatggttggataaaagcagaaaatatcaaaaaaggaatgtatgttgcaataccaagaaaaatttatggtaatgaggattttgagaagttcattgaatttattaattcaaagatattaactaatgaattaattgtaaaagttaatgagaaagatttaaaaaacgtagagttgccttcaacaaaaatctacaaaaaacagaaaaatgttttcagaagcgaagatattattgaacataatctaaatattgaaaaaatatcattctctccaagaatccacagatgtggaaaacctcagcactatataaaacttccaaagtcgttgaatgaatggaaagctatattctactttgcaggagttatgtttggggatggatgtgtggatagaatagcaaataatgatgaagaagtattcaacaaattaaaatcattgaataatttaggaattgaagttgagagaataaaaagaaaaagttcctatgaaataatatttaaaaatggaaaaaatgcgttaattaatctccttaaaatattatttgattacccaagtgaaaagaaatcccataatataaaaatcccacaaatattatacatagctccaaaagagcttgtagcagagtttattaaaggatactttgatgcagatgggtatgtaaatttaagacagaatagaattgaagtaataagtgcatcaaaggaatttattgaaggactttctattcttttattaagattcgaaataacatcaaaaatctatgaaattaaaaaatcttacaaagaaactaaaaagaaatactaccaattaaacattgtaggaaagagaaacttaaagaacttcaaaaacattgggttttcaataaaatataaagaagaaaacttaaacaaaatcattgaaaagagtagaaaaagtgagaagtatccaataaataaagatatgaaaagattaagaattttgtttggaatgacaaggaatgaagtaaatgtctcatactatgcaaaatatgaaaatggaaaagagattccttcctatgaaattgttaagaaattcctaaattcattaaaaccaaagaacttagataaaaagataaaagtattggaaggaaaagaaagagatgttaattatttaaaagcatttgaaagcgatggtttaatagagaatggaagattaactaaattaggaagagaagcattaaatatttggaagaatcatgaatttggaaaagagaatattgactatatgaaatcattaatagaaaatattgcatttgttgaagttgaagatgttgaaattattgattatgatggctatgtgtatgatttaacaactgaaacacacaactttatagcaaatggtatagttgttcataacacaacacttttagacaagattagaaaaacaagagtcgctaaaagagaagctggaggaattacccaacacataggagcaagtgagattccaatagatgtcataaaacggctgtgtggagatttattaaagatgctaaaagcagatttaaaaatccctggattgttggttatagacacccctgggcatgaggcatttacctcattaagaaaaagaggaggagctttggctgatatagccatattagttgtagatataaacgagggctttaaaccacaaactgttgaggctgttaatatattaagacagtgcaaaaccccatttgttgtagcagcaaataaaattgacttaattcctggatggaactctaaggaagggccgtttatcttaaacttcaatgaaaaaaatcagcatccaaatgctttaactgaatttgaaataaggttgtatgaaaacataataaaaccattaaatgagcttggttttgatgctgatttatactcaagagttcaagacgttacaaaaactgtctgtattattccagtatcagcagttactggagagggaattcctgatttattgatgatggttgctggattagcccaaaagtttttagaggatagattaaagcttaatgttgaaggttatgcaaagggaacaatattagaagttaaggaagaaaaaggattggggacaacgatagatgccataatttatgatgggattgctaagagaggagattatttagttgttggattgcctgatgatgttttagtgacaagagttaaagctttattaaagccgaagccattagatgagatgagagacccaagagataaatttaagccagtaaatgaagttactgccgctgcaggagttaagatagccgctcctgaattggataaagtcatagctggatgtccaataaggattgttccaaaagataagatagaggaagcaaaagaagaggttatgaaagaagttgaagaggcaaagatagaggttgatgatgaaggaattttaataaaagcagatactcttggttctttagaagctttagctaatgagttaaggaaggcaggagttaagattaagaaggcagaggttggagatgtaactaagaaggatgttattgaagttgcatcatacaagcagagtaatccattacatggagcaatagttgcctttaacgtaaaaattttaccagaagctcagaaagaaattgaaaaatatgacataaaggtgtttttagataacattatctataagttggttgaggacttcacagagtggattaaaaaagaggaagagagaattaaatatggagagtttgaaaaacttatcaagccagcaatcatcaggattttaccagattgtatattcagacagaaagaccctgcaatttgtggagttgaagtcctctgtggaactttaagagttggagctcctttaatgagggaggatggaatgcaattaggttatgttagggaaataaaagatagaggagaaaatgttaaagaggcaaaagcaggaaaggcagtttcaatagctatagatggaagagttgtattaaaaaggcatgttgatgaaggggactatatgtatgtagctgttccagaaagtcatgttagagagctctaccataaatacatggataggttgagaaatgatgaaaaagaggcattgttaagatatatggagttgatgcaaaagctaacaaacaacatattctggggaagataa

SEQ ID NO: 45140 - DNA, 567 bp, Methanococcus jannaschii
ttggtggataacatgtttattgtgtttgagggtatagatggtagtggaaaaactacacaatcaaagcttttagctaaaaaaatggatgcattttggacttatgagccatcaaatagcttagtagggaaaataataagagaaattttatctggaaaaacagaagtggataataaaaccttagctttgttatttgcggctgatagaatagagcatacaaaattaataaaagaagaattaaaaaagagagacgttgtttgtgatagatatctatactcatctattgcctatcaaagtgttgcaggagttgatgagaattttataaaatcaataaacagatatgctctaaagccagatattgtttttttattaattgttgatattgagacagcattaaagagggttaaaacaaaagacatatttgaaaaaaaagattttttaaaaaaagttcaggataaatatttagagttagctgaagaatataattttatagttattgacacaacaaaaaagtcagtagaagaggttcataatgagattataggttatttaaaaaacatacctcattaa

SEQ ID NO: 45141 - DNA, 288 bp, Methanococcus jannaschii
atgattttagaggaagtttatgaaattataaaacaaagaataaaagaaaagccagaaggttcttatgtggcaaaactaacaaccgatgataaaaaaacggcaataaacaaaatctgtgagaaaattggggaggaatctactgaattaattttagcagctaaggatgacaagaaagatgagattatttatgaggctgctgatttaatattccatactatggtattattggcttataagaacatagagtttgaagaattattaaaggaatttgaaagaagaaagaaatga

SEQ ID NO: 45142 - DNA, 855 bp, Methanococcus jannaschii
atggaggagcactttattgatttatctaaatttatgatggcaaattgtccttatgaagaagctgagggagttatattttcaattccctatgatgaaacaacctcatttaaaccgggagcgagagagggaggaaacgctataagaacagcatcatggggtttagaaacatacagcccaattttagatagagatttggcagaattaaaatactgtgatttaaaagatttagatttgtatggaagtcaagaagaaatatttggcacaattcactcagtctcaagggaaatattaaaagaaaataaaaaaatcattgtttttggaggagagcattctataacttatccaataatcaaagctgtaaaagacatctatgatgattttattgttattcaatttgatgcccattgtgatttgagagatgaatatttgggtaataagctctctcatgcgtgtgttatgaggagagtttatgagctaaccaaaaatatattccaatttggaattagaagtggagataaagaggaatgggaccttgcaaggaaaaacaacctctatctaaagatggatctaatgaataaggatgatttagaatatataaagagcttagacaagccaatatatgtaactatagatatcgatgtgttagaccctgcctatgctccaggaactggaactccagaaccctgtggattttcaacaagagaactttttaactctttatatttattagaagaggttaaagataaaattattggttttgatatagttgaagtttctccgatttatgatattgccaatattacagcaataaccgctgctaaaatagcaagagaacttatgttgatgattctataa

SEQ ID NO: 45143 - DNA, 1287 bp, Methanococcus jannaschii
atggcaaagcaaaaaccagtattaaacgtagcattcattggacacgtcgatgcaggtaagtcaacaacagtcggtagattattatacgacagtggagctatcgacccacagttattagagaagttaaaaagagaagctcaagagagaggtaaagcaggattcgagtttgcttacgtcatggacaacttgaaagaagagagagaaagaggggttacaattgacgtagctcacaagaagttcgaaacccaaaaatatgaagttacaatcgtcgattgtccaggacacagggacttcattaaaaacatgattacaggagcttcacaggcagacgctgctgtcttagttgttgatgttaatgatgccaagacaggaattcagccacaaacaagagagcacatgttcttagcaagaacattgggtattaagcaaattgcagttgcaattaacaagatggatacagttaactacagccaagaagaatacgaaaaaatgaaaaagatgttatcagagcagttattaaaagtcttaggttacaacccagaccaaattgacttcatcccaacagcttcattgaaaggagacaacgtcgttaaaagatcagaaaacatgccatggtacaaaggtccaacattagttgaagcattagacaaattccaaccaccagaaaaaccaacaaacttaccattaagaatcccaatccaagatgtctattcaattacaggggttggaactgtcccagttggaagagtcgaaacaggtatcttaagaccaggagacaaagttgtcttcgaaccagcaggagttagcggagaagttaagtcaattgagatgcaccacgaacaaattccacaagcagaaccaggagacaacattggattcaacgttagaggagtcagtaagaaagatattaagagaggagacgtttgtgggcacccagacaacccaccaacagttgcagaagaattcacagctcaaatcgttgtcttacagcacccaacagcaattacagttggttacacaccagtcttccacgcacacacagcacaggttgcatgtacattcattgagttgttgaagaaattagacccaagaacagggcaagtcattgaagagaacccacagttcttaaagactggtgacgcagcaatagtcaaaatcaaaccaacaaaaccaatggtcattgaaaacgttagagaaattccacagttaggtagattcgctatcagagatatgggtatgacaatcgctgcaggtatggcaatcgatgtcaaagctaagaacaaataa

SEQ ID NO: 45144 - DNA, 2280 bp, Methanococcus jannaschii
atggtttatgataacataaaaagagaaattataggcatgttaaaaagaatgcctaacaaacaagcagattgggataatgatttattacctactttaaaggcaatgtttaacccaaaatcagtttcaaacgctaaatcccaattaatctctgaaggtgttatatctcaagaaattgttgatggaaagaaaattataactctcattaaggacccttatgagcttcaagctcccaacgtatttgacgaggaaatgttcttggcatactatactgataaattaaaggagtattttaaacacaagttatcaactgaaggaccagagtgggatatttttgacgtgaaagaatttataatgcacttccctgaatctggagatttgaatgataagttaatagaacacccttatgaagttaggaaatcgataacaaatgtatatattgaagcttatgaagaattattcaacgaaacacctaacgtagaatttatccacattagaaatcctattgattgtagaatttccttatctgaattatcatctgcccataaaggaaaattagtagagtttagagcaatgattctccaagcaacgaaacttaaactaaggtatgctaagggattctattactgtccaaagtgcggagctacaaagacattggatttaggattttgggataaacctaaagaagttggaaagtcattaacatgtcctgctgatggctgtgattgtaaaggactaatatttgatgaagatttatctggcaaagttgattttcaggagattaaagttcaaacaccattacaggagtcaatatatgcaaataaacattctacaactgtcttctatgaatttaacaaaccaaagaaagcggtatattctgggtatgtgaagattgttggagttccaattgttaaagaaaataaaaacgggagtgttggagaattatacattcatgctttttacattgaaaaggatgatgaagatattgaagaaatagctaaaaacctcaatgaaaaagatttagagcttattaatagaattgctaaggataagaacgttattcaaaagctttctgactatgcttttagggaagttactggatatgatatgataaaaagagctgttttattacagttggttagtagtgggactaatattgacatgagaacgtccatccatattttgatgatttccgaccctggggttggaaaatcaacattgatggagtcattaattcagaagtttccatttgttaagaaagtttatgctgttacttcatcaggtcctggattggtcgggtctgtagtcagggagaaggcagagtttggagatagttgggtattaaaagctggggttttaactgaggctgatgggggagttgtttgtattgacgaattttcaaggaataaagaggtatatgattatctcttgggagttatggaacagcagaagattgagattaacaaggctggagttattgatgcagtattgccagcaagggttgctattttagcagcatgtaatccaaggtttggaaggtttaatcctgatttaaccgtatgggagcagataaacttgcctaaggagttattggataggtttgatttgatttttgtgattaaagataagattgataaaaagaaagatgaggatatagcagatttctctattgataattataattcaaaagttagagagagaaaaggaaaatcttcgggtaaaaagtttgtaataaatggtgttgagttgaatgatgagttgttgctgaagtatgttctttatgcaagacaaatagagccagaaatatcagatgaagctcgtaagattataaaagagtattatgtttctgtaagaaaaatgagcgaagcaaaaggaacttttggaatatctgcaagacagttagggtctataatcagattagcagttgctcatgcaaagttaagattgtcggaagttgttaaagcggttgatgcagaagaggctataaggttagttgatacctgcttaaaacaaatcgcctacgaccctgagagtggttcaatagacattgacaaaatagctggaactccgaaatctaagagggataaggttgagaaggttctgaatattattaaggaaatttctaactcaagagatgacggcttagctcctgaagaagagatatatgaaagggctgaaagggcgggtttatctgagaaggaagttgaggatgctattaattatctgaaacgggttggagacatttattctccaaagtcgggttattggcaacttatgtcttga

SEQ ID NO: 45145 - DNA, 1350 bp, Methanococcus jannaschii
gtgtttggtgatttgatggtatttaaagcctatgatattagaggaatctatggtagagagttagatgagaactttgcctattccttaggaaagtgcattggtaaaaaatttgaaaataaaaagatattagttggaaatgacgttagaattggttccaaagagcttttaccctattttatagttggtttgaaagaatatgcggatgtattttatgccggaactatttcaacccctttaatgtatttcggaactaaaggaaaatatgatttaggagttatattaacagcatctcataaccctccagaatacactggatttaagatgtgtgataaagaagctattcctctgtcaccaatagaagagataaaaccaatattcaaaaaatatgaattaacagaaagtataaaagaagaagctaaaaacctaaatttagatgatttaaaggttaatattatagaggagtataaaaaattctttttaaagagatgtaaagcctcagataaaaaaatagctgtagattttgcaaatggagctactacaatagctgaaaaagaaattttgaatgaattgtttgataacgcagtttttataaatgattatcccgatggcaatttccctgctcatcaaccagacacactaaaaatggaatgcttaaaagatattataagagcagttaaaaaaaataactgtgaattaggtttaatatttgacggagatggagataggttgggaatagttgatgaaaacggaaatgttttgaggggagatatattaacagccataatagcaaaagaaattttaaaagaaaagtcaaatgccaaaattgtttatgatttaagatgttctaaaatagttccagaaattattgagaagtatggtggcatagcaataaaaagtagagtggggcattactttataaaaaaattaatgcatgaaatagatgctgaatttgctggagagttgagtaatcacttttactttaaagagattggctactttgaaagtccattactggcgttaaattatatcttaaaagctatggatgaagaaaataaatcattatctgaactaaataaggaatttagcaaatatcctcatagtggagagataaactttagagttaaagaccaaaaatatattatggaaaaaataaaggaacattttaaagattgcaagttagaggagttggatggaatatctatttattgtaaaaacttctggtttaatttaagaccttcaaatactgaaccattattaagattaaacttagaagcagatgatgagaaaacaatgaaagagaaggttgaagagattaaaaatctaattgcaaagcttgatgcatccttataa

SEQ ID NO: 45146 - DNA, 909 bp, Methanococcus jannaschii
ttgggtggtaaaatggagaagattacatgtgtagggcatactgcccttgattatatcttcaatgtagaaaaatttccagaaccgaatacttcaattcaaattccttcggcgagaaagtattatggtggagcagcggcaaatacagcagtgggaataaaaaaacttggtgttaattcagagcttttatcatgtgttggctatgattttaaaaatagtggatatgagaggtatttaaagaatttggatataaatatttctaaactttactattctgaagaagaagaaacaccaaaggcatggatatttacagacaaggataacaatcagataactttctttttatggggagctgctaagcattataaggaactaaacccaccaaacttcaatacagaaattgtccatatagccactggagacccagagttcaacttaaaatgtgcaaaaaaagcttatggaaacaatttggtctctttcgaccccggacaggacttacctcaatactcaaaagaaatgttgttggaaattattgagcatacaaactttttatttatgaataaacatgaatttgagagagcatctaatttattaaattttgaaattgatgattatttagagagggttgatgcccttatagtaacaaaaggttctaagggtagtgtaatatacactaaagataaaaaaatagaaattccttgtattaaagcagggaaagttatagacccaacaggtgctggagacagctatagagctggatttttatctgcctatgtcaaagggtatgatttagagaaatgtggtttaattggtgctgcaactgcctcatttgttgttgaggcaaagggatgccaaactaatttaccaacatgggataaggttgttgagagattagaaaaacaccgaatataa

SEQ ID NO: 45147 - DNA, 819 bp, Methanococcus jannaschii
atgctaacaaagagaattattccatgcttagatattaaagacggaagagttgttaaaggaactaagtttttgaatttgagggatgctggagacccagttgagttagcccaatactatgatgatgaaggagctgatgagcttgtatttttagatataaccgcctcagctgaaaagagggacataattattgatgttgtagagagaacagctgaaaaagtatttatcccattaactgttggtggaggaattaagtcaattgaagattttaggagaatactgagagccggggctgataaagtttcgataaacactgccgcagtaaaaaatccaaatttaattaaagaggcaagtgagatatttggctctcaatgtgttgttgttgcaattgatgctaaaagacactatgttaatgaagatgagatagataagataaataaaaatgtcgttaaagtagaggatggttattgctggtttgaagtttatatatacggagggagaaaagaaacaggtatagatgccataaactgggctaaaaaagttgaagaattgggagctggagagattttattgacaagtattgataaagatgggacaaaaagtggctatgatttgatattgacaaaggagatttctaaaagtgttaaactccctgttattgcaagtggaggttgtggaaaaccagaacatgtttatgaggcatttgtttatggaaaggcagatgccgcattaatggcagggatattgcactatagagaatatacaatagaagagataaaaaaatactgtgctgatagaggaatacctatgagattattataa

SEQ ID NO: 45148 - DNA, 873 bp, Methanococcus jannaschii
atgcgagtaataattctaaaaattaagaaaatctttatggtgatgattatgattaaagtggcagttacaggagctttaggaaggatgggaagcaatataattaaaaccataactcagcaagaagatatgaaagttgtttgtgcatttgaagttccaaatcatccaaaaaaaggagaggatgttggagagttaataggcattggtaaaattggagttccattatcaactgcagatgagttagataaggttttaaaagaaacaaagccagatgtattggttgattttaccatagcccatgcatgtgttgaaaatgttaaaatagctgctaaaaatggggttaatttagttattgggactactggatttactgaagagcaaaaggcagagattgaaaaagcaataaaagaaaataatgttgctgctgtaatatctcaaaattttgcaattggagttaatatatttttcaaaactttagagtttttagcaaagaaattaggggattatgatattgaaattatagagatgcatcatagatataaaaaggacgctccttcaggaactgctttgagagcagctgagattataaaagctaatagaggaattgaaagtgtatttgtttatgggagatatggaatgactggagagagaaagaaggaagagattgggattcatgctttaaggggcggggatgttgtaggagaccacacagttatatttgctggagatggagagaggattgagctaactcacagagcaagtagtaggcaagcgtttgttaatggagttatattggctataagatacattgctgataaaaaagaaggcatttataatacatttgacgttttgggattgaatgagattaagttttaa

SEQ ID NO: 45149 - DNA, 1284 bp, Methanococcus jannaschii
atgacaaaagtagagaaaaatggcattggaaaaaggatatgtgtaattggtttgggttacattggtttgccaacggcttcaatgttagcaatacagggatttgatgttattggtgtggatataaatgaaaaaagagtgaaagaaattaaagaactgagctttaaaactacagaaaaagatttaatgactttagttaaaggggctataaactctggaaatctaaaagtgcaaacaaaacctgaaaaagcagatgtttttattatatgtgtgccaacaccttgcatagagtgtgatggagaaaaaaaatgtgatttaacctatttaaataaagctattgaaagcataaaaccatatcttgaaaatgggaatttaataataatagaaagcacgattcctccaggaacaactgatgatatttataaaaaattatcaaaggataagaaaatttatgttgctcactgcccagagagagttttgccaggcagtatattgaaggaacttgttgaaaatgatagagttattggaggagttgatgaaaaatctgctgaaatggcaaaagagatttatgaaacttttgttactggaaagatatatttaactgatgctaaaacagcagagatggttaagttaatggaaaatacttatagagatgttaatattgccttagccaacgaatttgcaaaaattgcagaggaaattggcattaatgtttgggaagcaatagaattagccaataaacatccaagagtaaatattttaaagccagggccaggagtaggtgggcattgtataagcatagacccgtggtttattgttgagaaatcaaagaacgctaaattaataagaactgcaagagagttaaacgactctatgccattatttgttgttgaaaagataaagaagattattaaaaaagatattggaaaagtggcaatatttggagtaacatataaaggaaatgtagatgacacaagggaaagtccagctgaaaaagtggttagtaaattgatagatgagggctttgaagttaaatgctatgataaatatgcgagagattttatttatcctttaaatagtttagatgaagctgttgaaggagctgatattatcgttatattagctgagcatgatgaatataaaaattttgataaagaagatataaaaaatatcgcctcaaaggtaaaaaataaaataatccttgatactaaaaatatattaaatagagagttgtgggaaaaggagggctttaaagtttatgtcttaggtgatggaaagaatgcataa

SEQ ID NO: 45150 - DNA, 1188 bp, Methanococcus jannaschii
atggagagaatagctgtcttagcgtattctggaggattggatacaagctgttgcttaaaattattggaagataagtatggttataaggtagtttctgtctgtgtggatgttggacagccagaagaagagataaaagaagttgaagagaaagctaaaaaattaggagttttaaagcactacacaatagatgcaaaggaagaattcgttaaagattacatatttagagctataaaggcaaatgcaatgtatgaaggctatcccctatcaacagcattagcgagacctttaattgctcataaggttgttgaaatagctgaggaagttggagctgaggcagttgctcatggatgcactggaaagggtaacgaccagttcagatttgaaacaactataagaattaaagctccacatttgaaaattattgcaccaattagggacttaaacctaacaagggctgaagaaattgagtatgctaaagaaaaaggaatcccaatcccaacggaaagtaaaaaatacagtatagatgaaaacttatggggaagaagtattgaaggtagtgagttagaaaaccctgactttgttccaccagaagagatatatgcatggactaaaaacccagttgaagataaagaggaagagattgttgagattgagtttaaggagggcgttccagtagctataaatggagaaaaattagaaccagttgagttaataaagaaagctaatgagattgctggaaagcatggtgttggaagaatagatattattgaggatagaatcataggattaaaatcaagagaaaactatgaatgtcctggagctgttttgttattaactgctcataaagctttagagcagttagttttaacaagggatgagcttagatttaaagagatcgttgatagtttatacggagagttaatttataaaggactttggtttgatccattaagggaggatttagatgcttttatagacaaaactcaagagagagttactggaactgtgaaagttaagttatttggaggaactgcaagagttgttggtagagatagtccttacgctttatacagtaaggaattagtttcatttgatgagaaggagattgaccagaaagaattggctggaatggttaagtatcatggattacaggcaatgttatatgagatgaggaaaaagagaaaataa

SEQ ID NO: 45151 - DNA, 681 bp, Methanococcus jannaschii
ttgggtgatgatttggttaaggtgaagatttgtggaattactaatgaagaggatatagcatatatctcaaaaaaagtccatgcagttggagttatagtagatgttccagtaaagacaccaagaaagatatcattagataaagccattgagttaaaaaaatatgttgctccattcacatccttagttactgtattgatgccaaatagcatagaggaagttttagagatttacaatgccttaaaacctaatgccatacaactacatggatttgagagcttagattttgttaaagagttaaataaacttaaaaatacaggggaattgaacgctcatataattaaagttatccacattcctaaagatgaagaaattgattttaaaactctgctaaacactgctaaagagtatgaaaaatatgtagaggcaattttggtagatacaaagatagagagcataaaacttgaaggaaaaacacacaattgggcagtatctaagaagttgagagagtctttagaaaaaccactaatcttagctggtggtttaaataaagataatgtcttagaggccataaaaacagttaaaccttacgctatagatgtatcttcttcattggaagcttacggtggaaagaaagatttaaaaaaggtagatgagtttttagaggttattaaaaaagtttaa

SEQ ID NO: 45152 - DNA, 1233 bp, Methanococcus jannaschii
atggatttaatagaagaagctataaagttagagagtgatttaataagaataaattcagtaaatccttcatttggtggaaaaggagaaaaagaaaaggcagaatacgtcaagaaaaagttaatggaatacgttgaaagctacaatatagaaaattacactttaaaggaatataacatcatagataaatatggtattgagaggccaaatattgtatttaaaatagattttggaagagataagacattacatattatttctcatttagatactgttccagagggggatattagtttatggggcacaaatccttatgagccagttattaaagatggaaaaatttatggaaggggaagtgaggacaaccataaggggattgtttcctctctattattattaaaaatgatttttgaaaataatattgagccaaaatacaacttatcattaatttttgtctctgatgaagaagatggaagtgaatatggcttaaaatatctattgaataactttgaagatgagatatttaaaaaggatgatttaatcatagttcctgactttggaacaccaactggagaatttgtagagattggagagaagggaattctgtggataaaatttaacattaaaggaaagcaatgtcatggtagcacaccagaaaatgggttgaatgctgatatagtggcttttaactttgcaaatgagttatataatggtttatatgagaaatttgatgaaattaattcaatattcctcccagagtattcaacctttgaaccaacgatattaaaaaataaagttgaaaatccaaacaccattcctggatatgtagaggttgtttttgattgtagaattttgccaacttacaaaatagaggaagttttggagtttataaataagtttatcaaaaactttgagtttaaaaaatatattaagcattatgataactcaataaaggcagagataacttatgaaatattaaaatctgaaaatccaaattacacagatgaaaacgctgaaattatcaaagaattgaaaaaagctataaagaatgttttgaatagagatgctaagctttgcggaatgggtgggggaactgttgcggcatttttgagatataagggctataatgtagcagtttggggcattggagaagagactgcccaccaaccaaatgagcatattaaaatagaggatttggttaagatggctgaagtgttttatgaaattttgaaatag

SEQ ID NO: 45153 - DNA, 942 bp, Methanococcus jannaschii
atgaaagttacaattataggagcttctggtagagttgggagtgcaacagccttattattagctaaagaaccttttatgaaggatttggtgttaattggaagagaacattcaataaataaattggaaggattgagagaagacatctacgatgccttagctgggacaagaagtgatgcaaatatatacgttgagagtgatgaaaatctaaggataattgatgaaagtgatgttgttataataacaagcggtgttccaagaaaagagggaatgagtaggatggatttggcaaaaacaaatgcaaaaattgttgggaagtatgctaaaaaaatagctgaaatctgcgatacaaaaatatttgttataacaaaccctgtggatgtgatgacttataaagctctggtagattcaaaatttgaaagaaatcaagtttttggattagggactcatttagattctttgaggtttaaggttgctattgctaagtttttcggtgttcatattgatgaagttaggacgagaattattggagagcatggggacagcatggttccattgttaagtgctacctctatcggaggaattcctattcaaaaatttgaaagatttaaggaactgccaatagatgagattatagaggatgttaaaacaaaaggagagcagattattagattgaaaggaggttctgagtttggtccagcagcagccattttaaatgttgttaggtgtattgtgaataatgagaaaagattgctaactttatccgcttacgtagatggagagtttgatggaattagagatgtgtgtattggagttccagtaaagattggaagagatgggatagaagaggttgtatcaattgaattggataaagatgagataattgcatttagaaaatctgctgaaatcattaaaaaatactgtgaagaagttaaaaacttataa

SEQ ID NO: 45154 - DNA, 1275 bp, Methanococcus jannaschii
atgggaatgacaattgtagagaagatattagcaaaggcgtctggaaagaaggaagttagtcctggagatatagtgatggcaaacattgatgtagcaatggttcatgatattacagggcctttaacagtcaatacattaaaggagtatggaattgaaaaagtttggaatccagaaaagatagttattttatttgaccaccaagttcctgctgatagtataaaagcggctgaaaaccatatattaatgagaaagttcgtaaaagaacagggtattaaatacttctacgatattagagagggagtttgtcaccaagttttaccagagaaaggacatgtagctccaggagaggtagttgttggagctgattcacacacatgcacacatggagcttttggtgcttttgctaccggtataggttcaactgacatggctcacgtatttgcaacaggtaaattgtggtttaaagttccagaaacaatatacttcaacattactggagatttacaaccttacgttacttcaaaggatgttattctaagcattataggagaagttggtgttgatggggctacatataaagcatgccagtttggtggagaaaccgttaaaaagatgtccatagcatcaagaatgacaatgacaaacatggctattgagatggggggaaaaacaggaattatagagccagatgagaaaaccatccaatatgtaaaagaggctatgaagaaacatggaactgagagaccatttgaggtaataaaaggagatgaagatgctgaatttgcagaggtttatgaaattgaggcagataaaatagagccagtatttgcatgcccacacaatgtagataatgttaaacaggcgagagaagtggctggaaagcctatagaccaggtgtttattggttcatgtacgaacggaagattggaagatttaagaatggctattaagattattgagaagcatggtggaattgctgatgatgttagggttgttgtaactccagcttcaagggaagagtatctaaaagcattaaaagagggaataattgagaaattcttaaagtatggatgtgttgttacaaatccttcatgctctgcttgtatgggttcattgtatggtgttttaggtcctggagaggtctgtgtctcaacctcaaacagaaacttcagaggaaggcagggttcattagaagcagagatttatttagcatcaccaataactgctgctgcatgtgctgttaaaggagaacttgttgacccaagggatttataa

SEQ ID NO: 45155 - DNA, 1290 bp, Methanococcus jannaschii
atgtatttgctgattgttaaaaaaacagatagattggaagggatagttaaagctcctccttcaaaatcttacactcatagagcagttattggagcatctttagctgatggagttagcagaataataaacccactttggggagctgattgtttatcatctgttcatggttgtagaatgttgggggctaatattgagttagataaagaaaaagatgaatggattgttaaaggaggagagttaaaaaccccagataatatcatagatattgggaacagtggaacaaccttaaggattttaacctctatagcctcacagataccaaaaggatatgcaattttaactggagatgattctataagaaagagaccgatgcaacctttattagatgccttaaaacagctaaatatagaggcattttcatcaaaattagatggaactgcaccaataatagttaaaagtgggaaaatttatggaaatgtggtaaagattagaggagacattagctctcagtttataacctctttgatgatgctccttccatttaataaagaagatactgagataattctaacctcaccactaaaatcaaagccatatattgatataacattggatatattaaataaatttggaataaagattgataaaactgataacggctttttagtctatggaaatcagaagtataaaccaatagattatattgttgagggagattattcttcagcttcatacttaatagctgctggagttttaataaactcaaatataactattgaaaacctatttgccaactcaaagcaaggagataaagctataatcaatattgtcaaagagatgggagcagatattaaagttaaaaaagataaagtaattattgaaggagaatacagcttaaaaggaatagatgttgatgttaaagatattccagatttagtcccaacaattgcagttcttggatgctttgcagaaggaaagactgagatttacaatggagaacatgttagattaaaggagtgcgatagattaagagcttgtgctgttgaattaaaaaagatgggtgctgatattgaagagaaaccagatggtttaattataagaggagttaaaaagctaaagggggctaagctaaacacctatcacgaccatagattggttatggcatttactatagctggtttaaaggcagaaggagaaacaattattgaaggagaggaggccgttaaaatctctttcccaaactttgttgatgttatgaagagcttaggggctaatatagaggtaaaataa

SEQ ID NO: 45156 - DNA, 552 bp, Methanococcus jannaschii
gtgaaaatcatggaaccagaaattaagattgttaatgttgtagtctcaacaaaaattggagacaatattgatttagaagaggttgctatgattttagaaaatgctgaatatgagccagaacaattcccagggttagtttgtagattatcagtgccaaaagttgctttattaatatttagaagtggaaaggtaaattgtactggagctaagagcaaagaagaggcagaaatagccattaaaaagattataaaagagttaaaagatgccggaattgatgttattgaaaaccctgaaattaaaatccaaaatatggtcgcaacagctgatttaggaattgagccaaatttagatgacattgccttaatggttgaaggaactgaatatgagccagaacaattcccagggttagtttataggttggatgacccgaaggttgttgttttaatatttggtagtggtaaggtcgttattactggtttaaagagtgaggaagatgccaaaagagctctaaagaagattttagatacaataaaagaagttcaagaactctaa

SEQ ID NO: 45157 - DNA, 1176 bp, Methanococcus jannaschii
atgagagagttaaatgatgtatatgatgtagtggttgttggagcaggtcccggaggaagtatggcaagttatgcatcagcaaagaatggagctaaaacactattaattgagaaatctcaagagattggtgagccagttaggtgtgctgaggcaattccatcaatagaggaatttggattaaaaccagaaccagagtttgttagaaacattattaagggaggaattttattttctccttctggaaaaaaagttacagtaactcaagataaggctcaaggatatgtagttgagagaaaaatttttgataaatatttggctataagggcagctaaagcaggagctaaagtagcagtaaaaacaacagctattggtttagagagggacggagattattggaatgttatagttgaatttttaggagaggagtatgttataaaaactaaagtggttatagctgctgatggtgttgagagcaatatagctgaatatgctggtttaaaggcaaagaaaaagccattggagatttgctcctgtgctgaatatgagatgacaaatgttgaattgttggataaaaatatgatggaattctattttggtaatgaagtggctccaggagggtatgtttggatattccccaaaggagaaacagctaatgttggtttgggagttagagataaaaagaagaaggcaatagaatatttagaagagttcatagaaaatggtttagctaaagataggttaaaggatgcaacaccaatagaattcaaagttggaggagctcctgtttctggccctatagaaaaaacctatactgatggtcttttagttgtgggggatgctgctgggcagataagcccattaactggtggaggaatttatttagctatggattgtggattaatagctggagaagtagcaagtaaagctataaaattaaatgattggagtgaagaaaccctaaaagaatatgaaagaagatggaaagaaaagcattatgaatatttaatgagccatttaaagtatagaaaaatcttagagaaaatgagtgatgatgagttagatgctttagcagaagctttaggagaaagtttagacggcattgacttgaaaaaatttgtcaagagaataataactaaaaaaccatcacttttaaaatactttaaggatttattataa

SEQ ID NO: 45158 - DNA, 3567 bp, Methanococcus jannaschii
ttgttaattatccaaaatacaaaaggggatagcatgaaatttattgcatggttagacgagttatcaaataaagatgtagacattgctggaggtaagggagcttcattaggagagatgtggaacgctggattgccagttccaccagcattcgttgttactgctgatgcttacaggcactttataaaagaaactggattaatggataaaataagagaaattttaagcggtttggacgttaatgacacagatgcattaacaaatgcatcaaaaaaaattagaaaattaattgaagaagcagagatgccggaagatttgagattggctattattgaggcatataacaaattatgtgaaatgtgcggagaggatgaggtaacagtggcagttagaagttctgcaaccgctgaagatttacctgaggcaagttttgcaggacagcaagatacttacttgaatataaaaggagctgaaaatgtagttaaatatgtgcaaaaatgcttctcatctttatttactccaagagccattttctacagagaacaacaggggtttgaccactttaaggttgctttagctgcagttgttcaaaaattggttaatgctgaaaaggcaggagttatgtttacagttaatccaattagcgaaaattatgatgagttagttatcgaagcagcgtggggattaggagagggagttgttagtggttctgtctctccagatacatacattgtcaataaaaagaccttagagattgttgataagcatatagcaagaaaagaaacgatgtttgttaaggatgaaaaaggagaaacaaaggttgttgaagtccctgatgatatgaaggaaaagcaagttttatcagatgatgaaattaaagaattggctaaaatagggttgaatatagaaaaacactatggaaaaccgatggatgttgaatgggcttatgagaaaggcaagttttacatgcttcaagcaagaccgataactaccttaaagaaaggtaaaaaagagaaaaaggcaaaagaagaggatatcgaggcaaaaatattattaaaaggtattggggcatctccaggcattgcaacaggtgttgttaaaataatccacgatgttagtgaaatagacaaggttaaagaaggggatatattagtaacagagatgaccacaccagatatggttccagcgatgaaaaaggcagctgctattgtaacagatgagggaggattaacctgtatagaaggagatgcaaaaattttaacagataggggctttttaaaaatgaaagaggtctataaattagttaaaaatggagaaaaattgaaggttttgggattaaatgctgaaaccttaaaaacagaatggaaagagataattgatgcacaaaaaagagaggcaaggagatatgaaattggcgtttatagaaagaataaaaatacaaaagatacaataaaaatcactccagaccacaaattcccagtgtttgtaaatggagaactcagtaaggttcaattatgtgatattatagataacaacctttctgtattgagtattgactacatcccaatgattgaggagaagtatgaaagcttagcagaagttatgtatttaggaggagcagttctttcagatggacacattgtcagaagaaatggaaaaccaataagggtaagatttacccaaaaagacactgaggaaaagaaggacttcatagaaaaagttaaaggagatgttaagttaattggaggcaactttatagagattagcaatagaaacaacgttattgaatatcaaacaagtagaaaaataccttctgaaatattgggctttattgaggtcaatataaacactatcccattatatgctaccaaagatgaaatagccgatttaattgctggatttgttgatggagatggatgtttaagtggaaagagaagagttgagatatatcaaaactcctcccatatcaaaaagattgagggcttaattgttgggctatatagattgggaataattccaagattgagatataaaaggtcatcaacagcaacaatatactttaataacaacttagaaactatactgcaaagaacaagaagaatcaaattagataagctaaaagagttcaaaaaaccagttgaagataaaaaattaatagatatatctcaaatactgccagaacttaaagaatttgattataagggctatttatacaagacatataaagaaaaactattcattggaataaataaattagaagaataccttagcaaaatagataaagatggcattgaaagaataaaacaaaaaatcaaactcttaaaagagagtgatatttactccatcaggattaaaaaagttggagaagattatggggaagtttataacataacagttaaagcagaaaatgagtttaaccacaactatgttgtttggactaagcattacactccaatagttgtattcaactgccacgcggcaatcgtttcaagggagttaggaacaccttgcgttgttggaacaaagaaagcaacgaaggttttaaaagatggaatgatcgttacagttgatggagagaagggaattgtttatgaaggagagattaaaaaggttgaagaaaaagagaaaaaacaggaggttgttgttcaacaagctccaataataacagctactgaggttaaagttaatgtcagcatgccagaggttgctgaaagagcagcagcaacaggagcagatggggttggcttgttgagagctgagcatatgatattaggattaggtaagcatccaagaaagattttagaggaagagggagaagaagcattgatagaggcgttaatggaaggaattagaaaggtagcagatgcattctacccaagacctgtaacttatagaacattagatgctccaacagatgagtttagaggtttagaaggaggagagaatgagccaatagaacacaatccaatgcttggttggagaggaattaggagagatcttgatgaagtagatatattaaaatgtgaattaaaggcaattaaaagattgagagaagagggctataagaatatagagatcatgatccctctcgtaactcatccagatgaagttagaagagttaaagagataatgagagaagttggtttagaaccatgtaaggatattccatttggaattatggttgaaacaccagcagcagctttaattattgaggactttataaaagaaggaataaactttgttagcttaggaactaacgatttaacacaatacacaatagcaattgatagaaataacgagttagtttcaaagtattataaagaagatcacccagctgtgttaaagttggttgagcacgtaattaaaacttgcaaaaaacatggcataaaaacatcaatttgtgggcaggctggaagcagacctcacatagttgagaagttagttgagtggggaattgatagtgtttcagcaaacattgatgctgtagagacaataagaagagttgtagcaagaactgagcagaaggttatattaaactacataagaaaatcatatgtagagagggagtaa

SEQ ID NO: 45159 - DNA, 1038 bp, Methanococcus jannaschii
gtgaaaaaggtggttttattgacttgcaccattattgttggaggacaatggggagatgaaggaaaaggaaagataataagctatatttgtgataaagacaagccatcaattattgcaagaggaggagtaggaccaaacgctgggcatactgtaaatattggtggaaaaagttatggaattagaatgatacctacaggattcccatacaaagaggcaaagttggctataggggctggtgttttggtagatccagaagttttgttaaaagaggtagagatgcttaaagactttaatgttaaagagagattgattgtagattatagatgtggaattattgaagagaagcataaaattatggacagaaaagatgagcacttggctaaagagattggaactactggaagcggctgtggccctgcaaacgttgatagagtgttgaggattttaaagcaggcaaaggatattgaagagcttaaagaatttttaggagatgtctctgaagaggttaataatgcattggatagaggagaaaatgttttaattgaaggaacacagggaactttactctctttatattatggaacctatccttatgtaacatccaaggatacaacagcttcatcatttgccgctgatgttggaatcggccctacaaaagttgatgaggttatagttgtctttaaaaccttccctacaagagttggtgctgggccatttccaactgaaatgtcattagaagaggcagagagcttgggaattgttgagtatggaacagttactggaagaaggagaagagttggctattttgactttgaattagcaaggaaagcttgtaggttgaatggagcaacacagattgctttaactggattagataaatacgataaagagtgttatggagtaactgaatataataagctaagtgaaaaagctaaagaatttataaacaagattgaagaagttactggagttccagtaactataatctccacaggtccagaaatgcaccaaacaattgatttaagaaatgagctataa

SEQ ID NO: 45160 - DNA, 879 bp, Methanococcus jannaschii
atgattagaatagggacaagaggtagtaaattggcattatatcaagctaacaaagtggctgaactattaaaaaatcttggttataaggtagaaataaagataattaaaactactggagatagggttttagataaaaagctatcggatataggtattggcgtttttacaaaggagttagatttagccatgttaaataacgaaattgatatagcagttcatagcttaaaagacattccaactatttggaatgaaaatttaatggttggggctgttttggagagagatagctatcacgacttgctaatatggaataaggatatagattttaatgaagatagtaaaatagttataggaacttcaagtatgaggaggagggcttttttaaagtttatttatccaaatgcaaaatttgagttattgaggggaaatgtagatacaagattaagaaagctaaaagaagggctttatgatgctattgttttatctgaagctggaataataagattgggagttagtttagaggattttaactataaaagattggatatccttccagctcctgctcaaggaattatagccgttgcttgcaaaagagatgatgaggaaatgaaaagcatcttaaaagagattaaccatgaaagaacttacttagagagtttatgtgaaagaactgcattaaatgaatttggaggaggttgtagtgttccatttggagctttagcagtttatgatgaaaaaaatgagttattaaaattaaaagctgcagttgttaccaacgatgagttaaaaaatgcctctggagaggttaaatgtaaaattgatgagattgataaggcagttgaattagggaaaaaaattggactaaaattaaaaaattaa

SEQ ID NO: 45161 - DNA, 1422 bp, Methanococcus jannaschii
atgacaacagtaatgaagtttggaggaacttctgtaggttctggagaaagaattaggcatgtggcgaaaatagtaacaaagagaaaaaaagaggatgatgatgtggttgttgtagtttcagcaatgagtgaagtaactaacgcattggtggagatatctcagcaagctttagatgttagagatatcgcaaaagtaggagattttataaaatttattagagagaaacactacaaagctatagaagaagctataaaatcagaagaaattaaagaagaagtaaaaaaaataattgacagcaggattgaagaattagagaaggttttaattggtgtagcatacttaggggagcttacaccaaagtcaagagactatatattatcatttggagagaggttgtcctcaccaatattaagtggagctattagagatttaggagaaaagtctattgctttagaaggaggagaagcaggaataataacggataacaactttggaagtgcaagagttaaaagattagaggttaaagagagattgttaccattattaaaagagggcattattccagtggttacaggatttataggaaccactgaagagggttatataacaaccttaggaagaggcggaagtgattactcagccgctttaattggttatggcttagatgcagatattattgaaatttggacagatgtttctggagtttatacaacagacccaagattagttcctactgcaagaagaattccaaaacttagttacatagaggctatggaattagcatactttggagctaaggttttgcatccaagaactatagagccagctatggagaagggcattccaatattggtaaagaatacatttgagccagagagtgaaggaactttaataaccaacgatatggagatgagtgatagcatagttaaagctatatcaacaataaaaaatgtcgctttaataaacatatttggagctgggatggttggagttagtggaacagcggcaaggatattcaaagctttaggagaagaggaagttaatgtaattttaataagccaaggttcctctgaaacaaatatatccctcgttgtaagtgaggaggatgttgataaagcattaaaagcattaaagagagagtttggggattttggaaagaagagctttttaaacaataacttaattagggatgtgagtgttgataaagatgtttgtgttatttcagttgtaggggctggaatgagaggagctaaaggcatagctggaaagatattcactgctgtttctgaaagcggggcaaatataaagatgatagctcaaggttcatcagaagtgaatatatcatttgttattgatgaaaaggatttgttgaattgtgttagaaaattgcacgagaagtttattgaaaaaactaacagctaa

SEQ ID NO: 45162 - DNA, 786 bp, Methanococcus jannaschii
atgcaaatggtacctccaagtgcttatgatagggctattacagtgtttagcccagaaggtagattatatcaagtagagtatgcaagagaggcagtgagaagagggacaacagcgataggtattgcctgtaaagatggtgtagttttagcggtagatagaagaataacaagcaaactcgtaaaaatcaggtcaatagaaaagatattccaaattgacgaccacgttgctgctgctacctctggattggtagctgatgcgagagttttaatagatagagcgagattagaagcccaaatttacagattaacttatggagaggaaatatcaattgaaatgctggctaaaaagatttgtgatattaaacaagcttatactcaacatggtggagttagaccgtttggagtttcattattaattgctggaatagacaaaaatgaagcaagattatttgaaacagacccaagtggggctttaattgaatataaagcaacagcaataggtagtggaagacccgtagttatggaattattggagaaagagtatagagatgatataacattagatgaaggtttggaattagctataactgctttaacaaaagcaaacgaagacataaaacctgaaaatgttgatgtttgtatcataacggttaaagacgcacaatttaaaaaaattcctgtggaagagataaaaaaacttatagaaaaagttaaaaagaaattaaatgaagaaaataagaaagaggaagagaatagagaagaaactaaagaaaaacaagaagaataa

SEQ ID NO: 45163 - DNA, 1338 bp, Methanococcus jannaschii
atggttaattcctctccattatggaagaagttaatgagaaaatgtaaaggtgaaaatatggccttaaaaatggacaagtcaaaggaattatttgaagaggctaaaaaatatttggttggaggagttaatagtccagttagatattttaaaccatatccattttttgttgagaaagctaaagattgctatttatttgatgttgatggaaactgctatattgattactgcttagcttacgggccgatggttttagggcatgcaaatgatgctgtgattaaagcagttaaagagcaacttgaattaggaagtgcttatggatgcccaacagagaaagagattattttagctaaagaggttgttaaaagagttccatgtgctgagatggttagatttgttaattctgggactgaggcgacgatgtcagctataagattggcaagaggagttactggaaggaagaagattattaagtttgatggagcttatcatggagctcatgactatgttttggttaagagtggaagtggtgctctaacccacggacatccaaactctccaggaatcccagaagagacaacaaaaaatactatcttaattccgtttaatgatgaagatgctgtaaaaaaagcaataaatgaaaataaagatgaaattgcctgtattatagttgagccaattatgggaaatgttggttgtatattaccaaaagaaggttatttagagtttttaagagagataactgaggaaaatgatattttgttgatatttgatgaggttataactgggtttagattagctaagggaggagctcaggagtattttggagtagttccagatatagctaccttaggaaagatattgggaggaggatttccaatcggtgctattgtggggagaagagagcttatggagcagttttctccattgggagctatatatcaagcaggaacattcaacggaaatccaatatcaataactgctggaatcgccactcttaagcagttggatgataggttttataaagaaacagcaagaactgctaagatattggcagatactttaagagagttggctgataaacataatattaaagctaaggtttataacattgcttcaatgttccaaatctacttcaatgataaggaagttgtgaattatgagattgccaagcagagtgatactgagaaatttatgaaatacttctggagattgttggagaaaggggtttttgttcctccttcacagtttgaatgttgctttacctcaataaaacatgatgatgaggttgttgataagacaataaaggctatggaggatgtgtttgagggtttagaataa

SEQ ID NO: 45164 - DNA, 924 bp, Methanococcus jannaschii
gtgagatatgtagtagggcacaaaaatccagatactgatagtatagcatcagctattgttttagcttacttcttagattgctatccagcaagattgggagatataaacccagaaacagagtttgttttgaggaagtttggagtcatggaaccagagttgatagaatcagctaaaggtaaagagattatcttagttgaccattcagaaaagagccaaagctttgatgatttagaagaagggaagttaatagctattatagaccaccacaaggttggtttaacaacaactgagccaattttatactatgctaagccagttggttcaacagctacagttatagctgaactctactttaaagatgctatagatttaattggaggtaagaagaaagagctaaaaccagatttagctgggcttttattgagtgcaattatatcagatacagttttgtttaaatcaccaacaacaactgacttagataaagagatggctaaaaaattagctgagattgctggaataagcaatatagaagagtttggaatggagattttaaaagctaagtcagttgttggtaagttaaagccagaagaaatcataaatatggactttaagaactttgatttcaatggaaagaaggttggaattgggcaggttgaggttatagatgttagtgaagttgagagtaaaaaagaagatatttataaattgttagaggagaagttgaaaaatgagggctatgatttaatcgtctttttgataactgatattatgaaagagggtagtgaggcattggttgttggaaataaggagatgtttgagaaagcatttaatgtcaaagttgaaggaaacagtgtattcttagaaggagttatgtcaagaaagaaacaggttgttccaccattggagagagcttataatggataa

SEQ ID NO: 45165 - DNA, 651 bp, Methanococcus jannaschii
atgcagagagtgaatccaacaagaatggagttattaaaattaaaaaataaaattaaattggcagaaaaagggcataaattgcttaagcagaaaagagatgctttaatcatggaattcttccaaattatagagcaagcttcagatttgagggataaggttgaggcaaagttagctgaggcatataaagatttgataatggctcagacagttatgggaactttagcagttaaagaggcagcattagcagctaagaatgataaattagaagttgatatggatacaaagaatattatgggtgttactgttcctacttttgaaatatacaacgttagaagaaaggttggtgaaagaggctactcaccttacggagttagctcaaaattagatgaagcagctaagaaatttgaagaagctttagaattaataactgaattggctgaaatagagacatcaattaaactcttagctgaggagattataacaacaaaaagaagagttaatgctttagagtatgttattatcccaagattaaaatctctcaaaaagtatatatcaatgagattggatgagatggaaagagagaacttcttcaggttgaagttaattaaatcgagaattgagaagagagaagccgaaggggagacagtataa

SEQ ID NO: 45166 - DNA, 1254 bp, Methanococcus jannaschii
atgattatgtttttgacgttggatgactttaattttgaagataagagggtagttttgagagtagatataaactgtccaatagacccaaacactggagagattttagatgataagaggattagagaaataaaaagcacaattacagagcttataaacaaaggtgctaaggttgttatcttagctcaccaaagtaggccagggaagaaagattttactacattaaaaaaccatgcaaaggttttatcagatgttattggtaaagaagtagagtatattgatgaagttataggctctacagcaagagaggcaataatcaatatgaaatgtggagatgtcattttattggagaatgttaggttttattctgaggaggttttaagtgattggaaaaaatgggaaaatataactccaaaaaaacaggcagagacaaatttaattaaaagattagccccattatttgactattttgttaatgatgcctttgcagctgcacacagggctcagccatcattagttggtttctcttactatatgccaatgattgctggaagattgatggagagagaggttggggttttatcaaaggttttagaaaatccagaaaagccctgtgtttatgttttgggaggagctaaggcagatgattcaataagagttatgaaaaacgtcttagaaaatggaactgctgataaggttttaacttcaggaattgttgctaacatcttccttgtagctatgggatatgatttaggcgtaaatatggatattattgaaaatcttggattaaaaagccaaatagagattgctaaagagttgttaaataaatttgaagataaaatcgttgtccctgttgatgtagccctaaatattaatgaagagagggttgaagctgatttaaataaggatgaaaaagtagaacatttaattaatgatattggggagaaaactatcgaactttacagtgaaataattaatgaagcaaaaaccattgttgccaatggtccagcgggagtgtttgaaaaagaggcatttgcaaaaggaactgaagagctgttgaaagcgatagctaactcaaaagggttttcagttattggaggagggcatttatctgcagctgctgaattatttggaattgctgataagattgaccatgttagtacgggaggtggagcaaccttagatttcttagctggagaaaaattgccagtaatagagatgcttaaggaatcatataagaaatataagggacaataa

SEQ ID NO: 45167 - DNA, 1008 bp, Methanococcus jannaschii
ttgtttaaaataaatttgggtgattttatgctgataaggccaagaagattaagaaaaaaccaaaaaattagagatttagttagagaaactatattaacaaaaaatgacttaattatgccaatttttgtagatgaaaatttaaaagggaatgagaagaaggagattagctcaatgcctaatcagtataggtttagtgtggaaggggctatagaagaagcaaaagaaatagctgatttaggcattccagctgtaatattatttggtattccaaagcataaggatgagatagcaagctctgcctacgataaaaatggagttgttcaaagaactataaggggaattaaagaagagttaggggatgagcttttagttattgccgattgttgtttatgcgaatacacaagccatggacactgtggaatagttaaagatggaaagattttgaacgatgccacactcccaatattggcaaagatagctttatcctatgcagatgctggtgttgatattgtcgctccttcagacatgatggatggaagagttagggctataagggagattttagaagaaaatggatatgatgatgttgctataatgagttactcagctaaatatgcctcatcattttacggcccgtttagagaagcggctgaaagtgcccctaaatttggagataggaagagttatcagatggacataggaaacgcaagagaggctttaaaagaaattgcattggatatagaggagggtgctgatttaattttggttaagccagctttgccttatttggatataataaggatggctaaggacaggtttgatgtgcctattggtggatactgcgttagcggagagtatgcaatggttgaagcagcagcaagaaatggatggttagatagagaaaaagtaatttatgaaatactgttaagtataaaaagggctggagctgattttattataacatattgggctaaggaggttgctgaaataggactttcacaggaataa

SEQ ID NO: 45168 - DNA, 921 bp, Methanococcus jannaschii
ttgggtgaatgtatgttgaaaacaaacatctgtggaatagaatttaaaaatcctgtttttttagcaagtggaataatgggagaaactggaagtgcattaaaaagaattgctaaaggaggagctggagctgtaacaacaaaatctattggattaaatccaaatcctggacataaaaatccaactattgtagaggtttatggaggatttttaaatgccatgggtttgcctaatcctggagttgatgagtatttggaggagatagaaaaggttagagatgagttaaataggatggatgttagaattattggctcaatctatgggaaagatgaggaagaatttgctgaagtagctaagaaaatggagaggtatgtagatattattgagctaaacatttcctgccctcatgctaaaggttatggagctaccatagggcaaaatccagatttgtcctatgatgtttgcaaggcagttaaaaaagctgttaaaattccagtttttgctaaattaacaccaaatgttacagatattattgagattgctcaggcagttgtagatgctggtgttgatggattagtagctataaacacagttagaggaatggctatagatattagagcaaaaaaaccaattttagctaataaatttggaggcttaagtgggaaagcaataaagtcaattggaataaaagtagtttgggatttgtatgagaattttgatgtgccaattatcggtgttggaggaattatgagtggagaggatgccattgagtatatgatggctggagcttcagctgttcaaataggaagtggagtttattatagaggttatgatatatttaaaaaagtttgtgatgaaataataagctttttaaaagaggaaaatttaacattggaagagattgttgggatggctcatgaataa

SEQ ID NO: 45169 - DNA, 537 bp, Methanococcus jannaschii
atgataatcaccattggggggctgccagggacaggaactacaacaattgcaaagatgatagcagagaaatataacttaagacacgtatgtgcaggattcatatttagagagatggcaaaagagatgggaatggatttacaggaattcagcaagtatgcagaacagcataaagagattgatgaagaaatagacagaagacaggtagagatagcaaagcagggaaatgttgtattagagggaagattagccgcatggatgcttttaaaaaatggaattaagccagatttaacaatctggtttaaagccccccttgaagtcagagctgaaagaattagcaagagagaaaatatagataaagacgttgctttaaaaaagatgattgaaagagaagcaagtgagaaaaaaagatataaagaaatttataatatagatttagatgacttatctatttacgatttagttattgatacttcaaaatgggacgtggagggagtgtttaatattgtctcctctgctattgataacttaaaaaaataa

SEQ ID NO: 45170 - DNA, 1485 bp, Methanococcus jannaschii
gtgggtggtaatattaaattcttagaagctatggtagatttcttagaaagaaatgtaaaaactatattttcctatccgggagagcagatattgccgttgtataatgaaatagagggtagcagtataaaaaatattatggttagggatgagagaggagcagggttcatggctgatggctatgcaagaataactaactatataggagtttgcttagctactgcaggtcctggagctacgaatttaacaacgccaatagcaacagcctataaggataattcatctgtattggcaattactggaagatgtcagagaaaatatattggcaaaaattattttcaagaggtaaatatggattttttaaatttttataaaggatattttgttgataaagctgaagtaagttatatagcaaaagcatttgctgactgcctatttaataaaaaacctgttcagctaaatattccagttgatttatacaaggaagaagcaaaagatataaatataaccacatatacagatatatataaagatgatgaaactccttccaacaacataaaagaaatagatgtcaaaaaaccactatttttaattgggcagggtatatttgggactttaagttataaagagatagtaaaaatatcaaaaatattagaaaagataaactgtcccatagctacaacatttccagcgagaggagttattaatgaaaaattagagaactgcataggcttagttgggaggagaggggatttaaaatctttgttagaggcagataagataataaatatcggctcatctctatcttacaacacctatgtagagagtgttagggaaaagcttttaagtaaaactgaaaatatacaactaaaaccaaaaagcatcaaagagttaaaagaattttttgaaaatttagatgtaaaaaatagtagctggatatataaaaatagcaacaaatttcagccttctggagattactcaaacaaaatctatgagattattaaaaatattccagaagatgccataatagttacagatgctggtaagcatactgtatttacctgcttattaaaaacctgcgttattccaagaaatatcatttcctcacactcatttggaactatgggttttggtttgcctgcatccattggagtaaaatttggaactatagatttcaacatcgatagagaagttgtattaattagtggggatggcggatttttgatgaatgttgaggagttgcaagttgtagctgaaaataacttaaaaatcttaatggttgtgatgaaaaataacagtttggcagagttctgcaagataaaaaatccaaacttcaacaaaatagctgatgcatttgaaatagataattgctacattgaaaatgttgatgaaattggttcagaaattaaaggctatttaaaaaagaataagccgttattggtggttgttgaaacagaaaacgagccattgcctaaaccaaatatttaa

SEQ ID NO: 45171 - DNA, 1104 bp, Methanococcus jannaschii
ttggaagtggaatatatgaattttaacgaattaaatttgtcagataatatcttaaatgccattagaaataaaggttttgaaaagccaacagatattcagatgaaagtcatcccactatttttaaatgatgaatataacattgtagctcaagcaagaactggaagtgggaaaactgcttcgtttgcaattccattaattgagctcgttaatgaaaacaatggaatagaggcaattattttaactcctacaagagaattagctatacaagtggctgatgagatagagtcattaaaaggtaacaaaaatttaaagattgccaaaatttatggtggaaaagctatatatccacaaattaaggctttaaaaaatgccaatatagttgttggaactccaggaagaattttagaccacataaatagaggaactttaaatttaaaaaatgttaaatattttatattggatgaggcagatgaaatgctcaatatgggttttattaaggacgttgaaaagattttaaatgcctgtaataaagacaagaggattttgttgttctctgctactatgccaagggagatattaaatttggctaaaaagtatatgggagattatagctttataaaagctaagataaacgcaaatattgaacagagttatgttgaagttaatgaaaatgagagatttgaagctttatgcagacttttaaaaaataaagaattttatggattagttttttgtaaaactaagagagatactaaagaattggcaagtatgttgagagatattggatttaaagctggagcaattcatggagatttaagtcaatctcaaagggagaaggttataagattgtttaaacaaaaaaagattaggattttaattgccactgatgttatgagtagagggatagatgtcaatgatttaaactgtgtaattaactaccatcttccacaaaatcctgaatcttatatgcatagaattggaagaactgggagagctggaaagaaagggaaggcaatatcaattataaatagaagggaatataaaaaactgagatatatagagagagcaatgaaattgaaaatcaagaaattaaaatttggataa

SEQ ID NO: 45172 - DNA, 594 bp, Methanococcus jannaschii
atgtttggtgggaatatgaggatttttgaagtaatgagggaaacaaaagagactaatatttacctaaaaataaacattgatggaactggaaaatataaaatagacacgggtattccattttttgaccatttgttggcatcttttgctaaacatggatgttttgatttgattgttaaggcaagaggggatttggagatagatgaccaccacactgttgaagatgttggaatttgcttaggtttagccttaaatcagattgaaaagaggaatatttttagattcggctgggctataattccaatggacgatgcaagggctactgtagcgatagatttaagtggaaggagttattgtgtaggaaattatgagccaaaaagagagtttgttggagacttagcaactgagaatataaatcacttttttgagtcagttgcaagttatggaatgctaaatatccattatgaagttattggaaagaatgagcatcacaaggcagaggctttgtttaaggcttttggagtagctttagatttagctacaaaaattgatgaaaggaagggagttataagcactaagggagaggttaagctataa

SEQ ID NO: 45173 - DNA, 1218 bp, Methanococcus jannaschii
atggaaaattataatgacatccttgaaaaaatgttaaatggagaaataaagccatatcaattagataaaatgtttggttcaaaaatagcaactgaaattagaagaaaatttattgaaaaaaaggttgggattgaatttaagcatatatgcaattactcaatagatgaagaaatggctatgaagaagaatatagaaaatatgattggagctatacagattccattgggttttgctgggcctttaaagataaatggggaatatgcaaagggagagttttacatcccattggcaacaactgaaggagctttggtggcatcggttaataggggttgctcaataataacaaaatgtgggggggcaactgttagggttatagatgataagatgacaagagccccttgcttaaaaacaaagagtgttgtagatgcaataaaagtcagagattggattagagaaaactttgagaggataaaggaagttgctgaatcaacaacaaggcatggaaagctaataaagatagagccaattttaatcgttggaagaaatctatatccaagatttgtatttaaaactggagatgccatgggcatgaatatggttacaattgcaacagagaaggcatgtaattttatagagggggaattaaaaaaagaaggcatatttgttaaaacagttgctgtcagtggaaatgcatgtgtagataaaaagcctagtggaatgaacttaattaatggtagagggaaatctattgtagcagaggtatttttaactgagaaggaagttaataaatacctaaaaaccacttcccaagctatagctgaagtaaataggttaaagaattatataggttcagcaataagcaattcaatgggattcaatgcccattatgcaaatatcattggggcaatattcttagctactgggcaagatgaggcacatatagttgagggtagtttaggaattacaatggctgaagttgaagatgatggattatatttttcagtaactctcccagatgttcctattgggactgttggaggaggaacaagggttgaaacacaaaaagagtgcttagagatgcttggttgctacggagataataaagctttaaaatttgctgaaattgttggagctgcagttttagctggggagttatctttattaggagctttagcagctggacatttaggaaaagctcatcaagaactcggtagataa
